United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 77

SEQ ID NO: 3513001 - RNA, 13 nt, Human
aguccccaggccc

SEQ ID NO: 3513002 - RNA, 17 nt, Human
aguccccaggccccagg

SEQ ID NO: 3513003 - RNA, 23 nt, Human
agucccccaacucugagcccaug

SEQ ID NO: 3513004 - RNA, 20 nt, Human
aguccccccucccaccucca

SEQ ID NO: 3513005 - RNA, 21 nt, Human
aguccccccucccaccuccag

SEQ ID NO: 3513006 - RNA, 18 nt, Human
aguccccgggcaucuuug

SEQ ID NO: 3513007 - RNA, 22 nt, Human
aguccccgggcaucuuugggga

SEQ ID NO: 3513008 - RNA, 17 nt, Human
aguccccgucugccugg

SEQ ID NO: 3513009 - RNA, 20 nt, Human
aguccccgugccccgccucc

SEQ ID NO: 3513010 - RNA, 21 nt, Human
aguccccucuccuccacauuu

SEQ ID NO: 3513011 - RNA, 22 nt, Human
aguccccucuccuccacauuug

SEQ ID NO: 3513012 - RNA, 19 nt, Human
agucccugaggcagguccc

SEQ ID NO: 3513013 - RNA, 21 nt, Human
agucccugcacagugacuucu

SEQ ID NO: 3513014 - RNA, 14 nt, Human
agucccugccugga

SEQ ID NO: 3513015 - RNA, 22 nt, Human
agucccugccuggaccagccuc

SEQ ID NO: 3513016 - RNA, 14 nt, Human
agucccugggggaa

SEQ ID NO: 3513017 - RNA, 17 nt, Human
agucccugggggaagcc

SEQ ID NO: 3513018 - RNA, 18 nt, Human
agucccuguaauuguugu

SEQ ID NO: 3513019 - RNA, 23 nt, Human
agucccuguaauuguuguuugua

SEQ ID NO: 3513020 - RNA, 17 nt, Human
agucccugucaccucuu

SEQ ID NO: 3513021 - RNA, 18 nt, Human
agucccuguuuucugagc

SEQ ID NO: 3513022 - RNA, 15 nt, Human
agucccuuccacacc

SEQ ID NO: 3513023 - RNA, 13 nt, Human
agucccuuccccu

SEQ ID NO: 3513024 - RNA, 14 nt, Human
agucccuuccccuc

SEQ ID NO: 3513025 - RNA, 19 nt, Human
agucccuuccccucccugg

SEQ ID NO: 3513026 - RNA, 20 nt, Human
agucccuuccccucccuggc

SEQ ID NO: 3513027 - RNA, 17 nt, Human
aguccgaggggcgggac

SEQ ID NO: 3513028 - RNA, 18 nt, Human
aguccgcagaagcccuga

SEQ ID NO: 3513029 - RNA, 17 nt, Human
aguccggacccaccuca

SEQ ID NO: 3513030 - RNA, 14 nt, Human
aguccgucaaaaca

SEQ ID NO: 3513031 - RNA, 22 nt, Human
aguccgugcugacagcugcucc

SEQ ID NO: 3513032 - RNA, 18 nt, Human
aguccguguggauccaau

SEQ ID NO: 3513033 - RNA, 13 nt, Human
aguccuagcugca

SEQ ID NO: 3513034 - RNA, 14 nt, Human
aguccuagcugcac

SEQ ID NO: 3513035 - RNA, 23 nt, Human
aguccuaguuuuccuacuuauaa

SEQ ID NO: 3513036 - RNA, 23 nt, Human
aguccuaucugggcuuccuggag

SEQ ID NO: 3513037 - RNA, 14 nt, Human
aguccuauggaaac

SEQ ID NO: 3513038 - RNA, 16 nt, Human
aguccuauucuauugc

SEQ ID NO: 3513039 - RNA, 15 nt, Human
aguccucaaagcuuu

SEQ ID NO: 3513040 - RNA, 22 nt, Human
aguccuccagaacucuuccucc

SEQ ID NO: 3513041 - RNA, 12 nt, Human
aguccuccccuc

SEQ ID NO: 3513042 - RNA, 19 nt, Human
aguccuccccucacagccu

SEQ ID NO: 3513043 - RNA, 23 nt, Human
aguccuccccucacagccucuga

SEQ ID NO: 3513044 - RNA, 22 nt, Human
aguccucccugacuuuucugug

SEQ ID NO: 3513045 - RNA, 19 nt, Human
aguccuccgguugcauacu

SEQ ID NO: 3513046 - RNA, 20 nt, Human
aguccucucccaaguccaca

SEQ ID NO: 3513047 - RNA, 14 nt, Human
aguccucuuuucug

SEQ ID NO: 3513048 - RNA, 13 nt, Human
aguccugaagagg

SEQ ID NO: 3513049 - RNA, 23 nt, Human
aguccugaagaggcgggccagcc

SEQ ID NO: 3513050 - RNA, 17 nt, Human
aguccugcaaccaaacu

SEQ ID NO: 3513051 - RNA, 13 nt, Human
aguccugcccgcc

SEQ ID NO: 3513052 - RNA, 14 nt, Human
aguccugccuggcc

SEQ ID NO: 3513053 - RNA, 17 nt, Human
aguccugccuggccagg

SEQ ID NO: 3513054 - RNA, 15 nt, Human
aguccugcuaccucc

SEQ ID NO: 3513055 - RNA, 22 nt, Human
aguccugcuaccucccuugccu

SEQ ID NO: 3513056 - RNA, 14 nt, Human
aguccugcucucua

SEQ ID NO: 3513057 - RNA, 20 nt, Human
aguccuggcaugggaaugaa

SEQ ID NO: 3513058 - RNA, 18 nt, Human
aguccuggccuggcuucu

SEQ ID NO: 3513059 - RNA, 21 nt, Human
aguccuguaguuuuauuuuau

SEQ ID NO: 3513060 - RNA, 23 nt, Human
aguccuguaguuuuauuuuaugu

SEQ ID NO: 3513061 - RNA, 17 nt, Human
aguccuguaugucuguc

SEQ ID NO: 3513062 - RNA, 20 nt, Human
aguccuguaugucugucauu

SEQ ID NO: 3513063 - RNA, 20 nt, Human
augggaaagcauuguaaaug

SEQ ID NO: 3513064 - RNA, 22 nt, Human
augggaaaguauucucuuuuca

SEQ ID NO: 3513065 - RNA, 21 nt, Human
augggaaaguauucuguacuc

SEQ ID NO: 3513066 - RNA, 20 nt, Human
augggaaaugccuaagaaga

SEQ ID NO: 3513067 - RNA, 21 nt, Human
augggaacacuggcagacugu

SEQ ID NO: 3513068 - RNA, 13 nt, Human
augggaacauuua

SEQ ID NO: 3513069 - RNA, 14 nt, Human
augggaagacauga

SEQ ID NO: 3513070 - RNA, 21 nt, Human
augggaaggugggcgggcagg

SEQ ID NO: 3513071 - RNA, 15 nt, Human
augggaaugaauguc

SEQ ID NO: 3513072 - RNA, 21 nt, Human
augggaaugaaugucagugug

SEQ ID NO: 3513073 - RNA, 17 nt, Human
augggaaugagguggga

SEQ ID NO: 3513074 - RNA, 19 nt, Human
augggacaaauugcacaga

SEQ ID NO: 3513075 - RNA, 22 nt, Human
augggacauuugcucauggaau

SEQ ID NO: 3513076 - RNA, 22 nt, Human
augggaccuauaacugcccagc

SEQ ID NO: 3513077 - RNA, 14 nt, Human
augggacugggagg

SEQ ID NO: 3513078 - RNA, 17 nt, Human
augggacugggagggcc

SEQ ID NO: 3513079 - RNA, 18 nt, Human
augggagacccuugacac

SEQ ID NO: 3513080 - RNA, 22 nt, Human
augggagccccagggucuuccc

SEQ ID NO: 3513081 - RNA, 15 nt, Human
augggagccgggcaa

SEQ ID NO: 3513082 - RNA, 17 nt, Human
augggagccgggucugc

SEQ ID NO: 3513083 - RNA, 21 nt, Human
augggagcuccucuccuggag

SEQ ID NO: 3513084 - RNA, 23 nt, Human
augggagcuccucuccuggagga

SEQ ID NO: 3513085 - RNA, 20 nt, Human
augggagcugguuagaaaug

SEQ ID NO: 3513086 - RNA, 23 nt, Human
augggaggcucacccccuucucc

SEQ ID NO: 3513087 - RNA, 18 nt, Human
augggagggaggcucagg

SEQ ID NO: 3513088 - RNA, 21 nt, Human
augggauacaaccucccucuu

SEQ ID NO: 3513089 - RNA, 15 nt, Human
augggaucaugaaag

SEQ ID NO: 3513090 - RNA, 15 nt, Human
augggauccuggagu

SEQ ID NO: 3513091 - RNA, 13 nt, Human
augggaucuuucu

SEQ ID NO: 3513092 - RNA, 16 nt, Human
augggaugauugaaga

SEQ ID NO: 3513093 - RNA, 23 nt, Human
augggauguaugaauacagcagc

SEQ ID NO: 3513094 - RNA, 17 nt, Human
augggauucuggacagg

SEQ ID NO: 3513095 - RNA, 14 nt, Human
augggcaaaacuga

SEQ ID NO: 3513096 - RNA, 18 nt, Human
augggcacugcugggugg

SEQ ID NO: 3513097 - RNA, 22 nt, Human
augggcacugcuggguggccca

SEQ ID NO: 3513098 - RNA, 14 nt, Human
augggcagagcaga

SEQ ID NO: 3513099 - RNA, 14 nt, Human
augggcaguuacau

SEQ ID NO: 3513100 - RNA, 19 nt, Human
augggcaguuacaugcaua

SEQ ID NO: 3513101 - RNA, 17 nt, Human
augggcaucuaugggag

SEQ ID NO: 3513102 - RNA, 21 nt, Human
augggcaucuuuuguauuaag

SEQ ID NO: 3513103 - RNA, 22 nt, Human
augggcauggggugggccucug

SEQ ID NO: 3513104 - RNA, 17 nt, Human
augggccaccgccuugc

SEQ ID NO: 3513105 - RNA, 14 nt, Human
augggcccaggccu

SEQ ID NO: 3513106 - RNA, 12 nt, Human
augggccccugg

SEQ ID NO: 3513107 - RNA, 14 nt, Human
augggccccuggca

SEQ ID NO: 3513108 - RNA, 17 nt, Human
augggccuccugugugu

SEQ ID NO: 3513109 - RNA, 14 nt, Human
augggcucuucacu

SEQ ID NO: 3513110 - RNA, 15 nt, Human
augggcucuuccaac

SEQ ID NO: 3513111 - RNA, 16 nt, Human
augggcuuagagcagu

SEQ ID NO: 3513112 - RNA, 23 nt, Human
augggcuuguuuucuugccaaug

SEQ ID NO: 3513113 - RNA, 15 nt, Human
auggggaaaaaaauc

SEQ ID NO: 3513114 - RNA, 16 nt, Human
auggggaaggaggcug

SEQ ID NO: 3513115 - RNA, 22 nt, Human
auggggaaucuaagagagcugc

SEQ ID NO: 3513116 - RNA, 14 nt, Human
auggggaccagcag

SEQ ID NO: 3513117 - RNA, 16 nt, Human
auggggagaggaacuc

SEQ ID NO: 3513118 - RNA, 14 nt, Human
auggggaggacaaa

SEQ ID NO: 3513119 - RNA, 12 nt, Human
auggggaggggc

SEQ ID NO: 3513120 - RNA, 20 nt, Human
auggggauagauguguggac

SEQ ID NO: 3513121 - RNA, 15 nt, Human
auggggcaggccacc

SEQ ID NO: 3513122 - RNA, 17 nt, Human
auggggcaggccaccug

SEQ ID NO: 3513123 - RNA, 21 nt, Human
auggggcauccucuuuuucca

SEQ ID NO: 3513124 - RNA, 17 nt, Human
auggggccacagccaga

SEQ ID NO: 3513125 - RNA, 14 nt, Human
auggggccagaucc

SEQ ID NO: 3513126 - RNA, 20 nt, Human
auggggcccuaauucagcca

SEQ ID NO: 3513127 - RNA, 13 nt, Human
auggggcccugcc

SEQ ID NO: 3513128 - RNA, 14 nt, Human
auggggccucuguu

SEQ ID NO: 3513129 - RNA, 18 nt, Human
augugauuuuaacucugu

SEQ ID NO: 3513130 - RNA, 19 nt, Human
augugauuuuaacucuguc

SEQ ID NO: 3513131 - RNA, 23 nt, Human
augugcaaaaauuuuuggauuga

SEQ ID NO: 3513132 - RNA, 23 nt, Human
augugcacaugcacgugugugca

SEQ ID NO: 3513133 - RNA, 22 nt, Human
augugcagcagauuggaaggag

SEQ ID NO: 3513134 - RNA, 13 nt, Human
augugcagcauuu

SEQ ID NO: 3513135 - RNA, 19 nt, Human
augugcagguuuguuacau

SEQ ID NO: 3513136 - RNA, 17 nt, Human
augugcauaguuucuuu

SEQ ID NO: 3513137 - RNA, 15 nt, Human
augugccaagguggg

SEQ ID NO: 3513138 - RNA, 23 nt, Human
augugccaggaaacucuugcuau

SEQ ID NO: 3513139 - RNA, 18 nt, Human
augugccauuuuaaaaaa

SEQ ID NO: 3513140 - RNA, 12 nt, Human
augugcccccag

SEQ ID NO: 3513141 - RNA, 14 nt, Human
augugcccccagac

SEQ ID NO: 3513142 - RNA, 22 nt, Human
augugcccuccugagggaggac

SEQ ID NO: 3513143 - RNA, 14 nt, Human
augugccuaaauaa

SEQ ID NO: 3513144 - RNA, 20 nt, Human
augugccugauccagccucu

SEQ ID NO: 3513145 - RNA, 15 nt, Human
augugccugcaccag

SEQ ID NO: 3513146 - RNA, 14 nt, Human
augugccugggugg

SEQ ID NO: 3513147 - RNA, 21 nt, Human
augugccuuauguugaaaaaa

SEQ ID NO: 3513148 - RNA, 13 nt, Human
augugcuacaggg

SEQ ID NO: 3513149 - RNA, 22 nt, Human
augugcuauaaucuguuuuuac

SEQ ID NO: 3513150 - RNA, 13 nt, Human
augugcuauuaau

SEQ ID NO: 3513151 - RNA, 18 nt, Human
augugcuauuaauauuug

SEQ ID NO: 3513152 - RNA, 16 nt, Human
augugcucaucagaaa

SEQ ID NO: 3513153 - RNA, 13 nt, Human
augugcuguguaa

SEQ ID NO: 3513154 - RNA, 19 nt, Human
augugcuguguaaaguuag

SEQ ID NO: 3513155 - RNA, 20 nt, Human
augugcuguguaaaguuagu

SEQ ID NO: 3513156 - RNA, 23 nt, Human
auguggaaaagccaagaggcugc

SEQ ID NO: 3513157 - RNA, 17 nt, Human
auguggaaagugaauuu

SEQ ID NO: 3513158 - RNA, 15 nt, Human
auguggaagaaaaug

SEQ ID NO: 3513159 - RNA, 22 nt, Human
auguggaagugugggucugugu

SEQ ID NO: 3513160 - RNA, 19 nt, Human
auguggagaaacuguaguc

SEQ ID NO: 3513161 - RNA, 16 nt, Human
auguggaguggggcag

SEQ ID NO: 3513162 - RNA, 14 nt, Human
auguggcccuggcc

SEQ ID NO: 3513163 - RNA, 20 nt, Human
auguggcccuggccugcugg

SEQ ID NO: 3513164 - RNA, 15 nt, Human
auguggcugcagcag

SEQ ID NO: 3513165 - RNA, 10 nt, Human
augugggagg

SEQ ID NO: 3513166 - RNA, 18 nt, Human
augugggcagugauguca

SEQ ID NO: 3513167 - RNA, 18 nt, Human
augugggggucugugugu

SEQ ID NO: 3513168 - RNA, 16 nt, Human
augugggucaaggaau

SEQ ID NO: 3513169 - RNA, 14 nt, Human
auguggucucagga

SEQ ID NO: 3513170 - RNA, 16 nt, Human
auguggugaaaagcag

SEQ ID NO: 3513171 - RNA, 20 nt, Human
auguggugaaaagcagguug

SEQ ID NO: 3513172 - RNA, 13 nt, Human
auguggugccuga

SEQ ID NO: 3513173 - RNA, 21 nt, Human
augugguuaauuuugcauauc

SEQ ID NO: 3513174 - RNA, 16 nt, Human
augugguugaagagca

SEQ ID NO: 3513175 - RNA, 20 nt, Human
augugguugcaaggccgcug

SEQ ID NO: 3513176 - RNA, 19 nt, Human
augugguuuauagagggcc

SEQ ID NO: 3513177 - RNA, 23 nt, Human
augugguuugguuccucucuggu

SEQ ID NO: 3513178 - RNA, 15 nt, Human
auguguaaaauguga

SEQ ID NO: 3513179 - RNA, 19 nt, Human
auguguaaagaucuacaug

SEQ ID NO: 3513180 - RNA, 21 nt, Human
auguguaaagaucuacaugaa

SEQ ID NO: 3513181 - RNA, 22 nt, Human
auguguaaagaucuacaugaau

SEQ ID NO: 3513182 - RNA, 19 nt, Human
auguguaagacaaaaagcu

SEQ ID NO: 3513183 - RNA, 16 nt, Human
auguguaaucaauaaa

SEQ ID NO: 3513184 - RNA, 20 nt, Human
auguguaaucaauaaacgau

SEQ ID NO: 3513185 - RNA, 18 nt, Human
auguguaauuuuucugua

SEQ ID NO: 3513186 - RNA, 20 nt, Human
auguguaauuuuucuguaua

SEQ ID NO: 3513187 - RNA, 22 nt, Human
auguguaauuuuucuguauaga

SEQ ID NO: 3513188 - RNA, 22 nt, Human
auguguacaaaaguuucauccu

SEQ ID NO: 3513189 - RNA, 15 nt, Human
auguguacucuaacu

SEQ ID NO: 3513190 - RNA, 14 nt, Human
auguguagccuaug

SEQ ID NO: 3513191 - RNA, 14 nt, Human
auguguagccugug

SEQ ID NO: 3513192 - RNA, 16 nt, Human
auguguagccugugca

SEQ ID NO: 3513193 - RNA, 23 nt, Human
auguguagccugugcauguaugu

SEQ ID NO: 3513194 - RNA, 18 nt, Human
auguguaguucauguaaa

SEQ ID NO: 3513195 - RNA, 23 nt, Human
auguguaguugucucucuucaga

SEQ ID NO: 3513196 - RNA, 13 nt, Human
auguguauaaaaa

SEQ ID NO: 3513197 - RNA, 12 nt, Human
auguguauaaac

SEQ ID NO: 3513198 - RNA, 14 nt, Human
auguguauaaacaa

SEQ ID NO: 3513199 - RNA, 17 nt, Human
auguguauauauacaua

SEQ ID NO: 3513200 - RNA, 16 nt, Human
auguguaucaguguuu

SEQ ID NO: 3513201 - RNA, 19 nt, Human
auguguaugcacaguaaaa

SEQ ID NO: 3513202 - RNA, 20 nt, Human
auguguaugggcaaaaaacu

SEQ ID NO: 3513203 - RNA, 18 nt, Human
auguguauuacaaauauu

SEQ ID NO: 3513204 - RNA, 17 nt, Human
auguguauuuuauuaca

SEQ ID NO: 3513205 - RNA, 21 nt, Human
augugucaacuucaacauuua

SEQ ID NO: 3513206 - RNA, 14 nt, Human
augugucacuugug

SEQ ID NO: 3513207 - RNA, 21 nt, Human
augugucaguggggcucucug

SEQ ID NO: 3513208 - RNA, 22 nt, Human
augugucaguggggcucucuga

SEQ ID NO: 3513209 - RNA, 16 nt, Human
augugucccagaagau

SEQ ID NO: 3513210 - RNA, 17 nt, Human
auguguccugacacugc

SEQ ID NO: 3513211 - RNA, 12 nt, Human
augugucuuuau

SEQ ID NO: 3513212 - RNA, 22 nt, Human
augugugaggagcugcuggcuu

SEQ ID NO: 3513213 - RNA, 22 nt, Human
augugugcaacaggguauggac

SEQ ID NO: 3513214 - RNA, 12 nt, Human
augugugcaugu

SEQ ID NO: 3513215 - RNA, 15 nt, Human
augugugcaugugug

SEQ ID NO: 3513216 - RNA, 15 nt, Human
augugugccaaggcu

SEQ ID NO: 3513217 - RNA, 18 nt, Human
augugugccauagaguuu

SEQ ID NO: 3513218 - RNA, 22 nt, Human
augugugccauagaguuuaaca

SEQ ID NO: 3513219 - RNA, 14 nt, Human
augugugcccagcu

SEQ ID NO: 3513220 - RNA, 18 nt, Human
augugugcgagugugugc

SEQ ID NO: 3513221 - RNA, 17 nt, Human
augugugguggccucag

SEQ ID NO: 3513222 - RNA, 10 nt, Human
auguguguau

SEQ ID NO: 3513223 - RNA, 12 nt, Human
auguguguauau

SEQ ID NO: 3513224 - RNA, 20 nt, Human
auguguguauauauguguau

SEQ ID NO: 3513225 - RNA, 16 nt, Human
auguguguauauguau

SEQ ID NO: 3513226 - RNA, 18 nt, Human
auguguguauauguaugu

SEQ ID NO: 3513227 - RNA, 21 nt, Human
auguguguccacgacugucuc

SEQ ID NO: 3513228 - RNA, 22 nt, Human
augugugugguuuuuuuucuaa

SEQ ID NO: 3513229 - RNA, 15 nt, Human
auguguguguaugcu

SEQ ID NO: 3513230 - RNA, 16 nt, Human
auguguguguaugcua

SEQ ID NO: 3513231 - RNA, 19 nt, Human
auguguguguaugcuacua

SEQ ID NO: 3513232 - RNA, 23 nt, Human
auguguguguguuguguguggga

SEQ ID NO: 3513233 - RNA, 16 nt, Human
auguguguugauacug

SEQ ID NO: 3513234 - RNA, 19 nt, Human
auguguguugauacuguug

SEQ ID NO: 3513235 - RNA, 21 nt, Human
auguguguugauacuguugca

SEQ ID NO: 3513236 - RNA, 23 nt, Human
auguguguugauacuguugcacg

SEQ ID NO: 3513237 - RNA, 14 nt, Human
auguguguuucugu

SEQ ID NO: 3513238 - RNA, 15 nt, Human
auguguguuuuaaaa

SEQ ID NO: 3513239 - RNA, 14 nt, Human
auguguucuauuca

SEQ ID NO: 3513240 - RNA, 18 nt, Human
auguguugaaaaccaaaa

SEQ ID NO: 3513241 - RNA, 20 nt, Human
auguguuggacaaaugugaa

SEQ ID NO: 3513242 - RNA, 17 nt, Human
auguguuuacuuuaugu

SEQ ID NO: 3513243 - RNA, 14 nt, Human
auguguuuagaauu

SEQ ID NO: 3513244 - RNA, 17 nt, Human
auguguuugcuuucuga

SEQ ID NO: 3513245 - RNA, 20 nt, Human
auguguuuuguuuauuaaau

SEQ ID NO: 3513246 - RNA, 13 nt, Human
auguguuuuucuc

SEQ ID NO: 3513247 - RNA, 15 nt, Human
auguuaaaaaaauaa

SEQ ID NO: 3513248 - RNA, 14 nt, Human
auguuaaaauguau

SEQ ID NO: 3513249 - RNA, 16 nt, Human
auguuaaaauguguug

SEQ ID NO: 3513250 - RNA, 22 nt, Human
auguuaaagagaaugaguccuu

SEQ ID NO: 3513251 - RNA, 17 nt, Human
auguuaaagauguagca

SEQ ID NO: 3513252 - RNA, 17 nt, Human
auguuaaauaaauugua

SEQ ID NO: 3513253 - RNA, 20 nt, Human
auguuaaauaaauuguauau

SEQ ID NO: 3513254 - RNA, 16 nt, Human
auguuaaauuuguaag

SEQ ID NO: 3513255 - RNA, 21 nt, Human
auguuaacaaugccuauugua

SEQ ID NO: 3513256 - RNA, 22 nt, Human
auguuaacaaugccuauuguaa

SEQ ID NO: 3513257 - RNA, 15 nt, Human
auguuaacacauuuu

SEQ ID NO: 3513258 - RNA, 23 nt, Human
auguuaacacauuuuguauaauu

SEQ ID NO: 3513259 - RNA, 23 nt, Human
auguuaagcagcuaaauuuucug

SEQ ID NO: 3513260 - RNA, 15 nt, Human
auguuaagcucuuua

SEQ ID NO: 3513261 - RNA, 18 nt, Human
auguuaauccuagcugug

SEQ ID NO: 3513262 - RNA, 20 nt, Human
auguuaauggauuucagaag

SEQ ID NO: 3513263 - RNA, 13 nt, Human
auguuaauuucau

SEQ ID NO: 3513264 - RNA, 19 nt, Human
auguuaauuuuuugguaca

SEQ ID NO: 3513265 - RNA, 22 nt, Human
auguuaauuuuuugguacaaaa

SEQ ID NO: 3513266 - RNA, 23 nt, Human
auguuaauuuuuugguacaaaaa

SEQ ID NO: 3513267 - RNA, 17 nt, Human
auguuacaucacagugu

SEQ ID NO: 3513268 - RNA, 20 nt, Human
auuaauauggggaugcagca

SEQ ID NO: 3513269 - RNA, 17 nt, Human
auuaauauucauuguau

SEQ ID NO: 3513270 - RNA, 12 nt, Human
auuaauauuuaa

SEQ ID NO: 3513271 - RNA, 12 nt, Human
auuaaucacugu

SEQ ID NO: 3513272 - RNA, 13 nt, Human
auuaaucacugug

SEQ ID NO: 3513273 - RNA, 18 nt, Human
aguggcuaaagagaugag

SEQ ID NO: 3513274 - RNA, 22 nt, Human
aguggcuauuucuuuauauuua

SEQ ID NO: 3513275 - RNA, 14 nt, Human
aguggcucacgccu

SEQ ID NO: 3513276 - RNA, 14 nt, Human
aguggcugcugccc

SEQ ID NO: 3513277 - RNA, 17 nt, Human
aguggcugcugcccagg

SEQ ID NO: 3513278 - RNA, 16 nt, Human
aguggcugucaucagc

SEQ ID NO: 3513279 - RNA, 13 nt, Human
aguggcuguccag

SEQ ID NO: 3513280 - RNA, 19 nt, Human
aguggcuguccagugccca

SEQ ID NO: 3513281 - RNA, 23 nt, Human
aguggcuguccagugcccauucc

SEQ ID NO: 3513282 - RNA, 19 nt, Human
aguggcuuacuacaugugg

SEQ ID NO: 3513283 - RNA, 16 nt, Human
aaaaaugggacuucuu

SEQ ID NO: 3513284 - RNA, 11 nt, Human
aaaaaugguaa

SEQ ID NO: 3513285 - RNA, 15 nt, Human
aaaaaugguaaaauu

SEQ ID NO: 3513286 - RNA, 19 nt, Human
aaaaaugguagcauuuuaa

SEQ ID NO: 3513287 - RNA, 19 nt, Human
aaaaaugguaucaaaauua

SEQ ID NO: 3513288 - RNA, 15 nt, Human
aaaaauggugccuga

SEQ ID NO: 3513289 - RNA, 19 nt, Human
aaaaaugguggcuucagcu

SEQ ID NO: 3513290 - RNA, 17 nt, Human
aaaaaugguuuaaaugg

SEQ ID NO: 3513291 - RNA, 13 nt, Human
aaaaauguaaaua

SEQ ID NO: 3513292 - RNA, 16 nt, Human
aaaaauguauuuuaug

SEQ ID NO: 3513293 - RNA, 17 nt, Human
aaaaauguauuuuaugu

SEQ ID NO: 3513294 - RNA, 23 nt, Human
aaaaaugucaaaaguagaacuuu

SEQ ID NO: 3513295 - RNA, 22 nt, Human
aaaaauguguguauucuuaaaa

SEQ ID NO: 3513296 - RNA, 20 nt, Human
aaaaauguuaaaauguauuc

SEQ ID NO: 3513297 - RNA, 12 nt, Human
aaaaauguugaa

SEQ ID NO: 3513298 - RNA, 12 nt, Human
aaaaauguuugu

SEQ ID NO: 3513299 - RNA, 23 nt, Human
aaaaauguuuuuggucuuuuaua

SEQ ID NO: 3513300 - RNA, 14 nt, Human
aaaaauuacuaauu

SEQ ID NO: 3513301 - RNA, 22 nt, Human
aaaaauucagcaaaccauuuuu

SEQ ID NO: 3513302 - RNA, 13 nt, Human
aaaaauugaaaug

SEQ ID NO: 3513303 - RNA, 19 nt, Human
aaaaauugaagagagauau

SEQ ID NO: 3513304 - RNA, 12 nt, Human
aaaaauugugau

SEQ ID NO: 3513305 - RNA, 11 nt, Human
aaaaauuuaaa

SEQ ID NO: 3513306 - RNA, 21 nt, Human
aaaaauuuaagcauuguuugc

SEQ ID NO: 3513307 - RNA, 11 nt, Human
aaaaauuucac

SEQ ID NO: 3513308 - RNA, 13 nt, Human
aaaaauuucacga

SEQ ID NO: 3513309 - RNA, 22 nt, Human
aaaaauuuuauaaaauuaagca

SEQ ID NO: 3513310 - RNA, 14 nt, Human
aaaaauuuuguaau

SEQ ID NO: 3513311 - RNA, 21 nt, Human
aaaaauuuuuggauugacagu

SEQ ID NO: 3513312 - RNA, 15 nt, Human
aaaacaaaaagaaca

SEQ ID NO: 3513313 - RNA, 15 nt, Human
aaaacaaaaagaugu

SEQ ID NO: 3513314 - RNA, 14 nt, Human
aaaacaaaacaaaa

SEQ ID NO: 3513315 - RNA, 22 nt, Human
aaaacaaaauuugacuaauuuu

SEQ ID NO: 3513316 - RNA, 13 nt, Human
aaaacaacaaaaa

SEQ ID NO: 3513317 - RNA, 18 nt, Human
aaaacaacuucuuuguaa

SEQ ID NO: 3513318 - RNA, 17 nt, Human
aaaacaaggaugaauua

SEQ ID NO: 3513319 - RNA, 17 nt, Human
aaaacaauaggaugggc

SEQ ID NO: 3513320 - RNA, 17 nt, Human
aaaacaauauuuauugu

SEQ ID NO: 3513321 - RNA, 19 nt, Human
aaaacaaucuggaagaaaa

SEQ ID NO: 3513322 - RNA, 12 nt, Human
aaaacacagagg

SEQ ID NO: 3513323 - RNA, 18 nt, Human
aaaacacagcaaggguga

SEQ ID NO: 3513324 - RNA, 21 nt, Human
aaaacacaguguuuuuguaaa

SEQ ID NO: 3513325 - RNA, 15 nt, Human
aaaacacauuuuucu

SEQ ID NO: 3513326 - RNA, 22 nt, Human
aaaacaccgcuucugccuuuuc

SEQ ID NO: 3513327 - RNA, 22 nt, Human
aaaacaccuagcuuuauucuuc

SEQ ID NO: 3513328 - RNA, 13 nt, Human
aaaacacugugga

SEQ ID NO: 3513329 - RNA, 17 nt, Human
aaaacacuucuguccug

SEQ ID NO: 3513330 - RNA, 21 nt, Human
aaaacagaaaaaaaacacaca

SEQ ID NO: 3513331 - RNA, 22 nt, Human
aaaacagaguaaucuuguuggu

SEQ ID NO: 3513332 - RNA, 20 nt, Human
aaaacagcauugcuuucuga

SEQ ID NO: 3513333 - RNA, 18 nt, Human
aaaacagccucacagaag

SEQ ID NO: 3513334 - RNA, 18 nt, Human
aaaacagcucugcaggcu

SEQ ID NO: 3513335 - RNA, 19 nt, Human
aaaacagcugcauuagaaa

SEQ ID NO: 3513336 - RNA, 18 nt, Human
aaaacagguggagaaauu

SEQ ID NO: 3513337 - RNA, 16 nt, Human
aaaacaguauuuauuu

SEQ ID NO: 3513338 - RNA, 18 nt, Human
aaaacaguauuuauuuug

SEQ ID NO: 3513339 - RNA, 19 nt, Human
aaaacaguauuuauuuugu

SEQ ID NO: 3513340 - RNA, 20 nt, Human
aaaacaguguguaaacaaaa

SEQ ID NO: 3513341 - RNA, 21 nt, Human
aaaacaguuggcaugcauccc

SEQ ID NO: 3513342 - RNA, 23 nt, Human
aaaacauagaaauggaaauuuug

SEQ ID NO: 3513343 - RNA, 14 nt, Human
aaaacaucauuccu

SEQ ID NO: 3513344 - RNA, 21 nt, Human
aaaacaucauuccuuuuuauu

SEQ ID NO: 3513345 - RNA, 16 nt, Human
aaaacauccagauaca

SEQ ID NO: 3513346 - RNA, 16 nt, Human
aaaacaucuauucucu

SEQ ID NO: 3513347 - RNA, 11 nt, Human
aaaacaucugg

SEQ ID NO: 3513348 - RNA, 13 nt, Human
aaaacaugcuaca

SEQ ID NO: 3513349 - RNA, 14 nt, Human
aaaacaugcuacac

SEQ ID NO: 3513350 - RNA, 18 nt, Human
aaaacauuaagaaaauca

SEQ ID NO: 3513351 - RNA, 16 nt, Human
aaaacauuccauccuu

SEQ ID NO: 3513352 - RNA, 22 nt, Human
aaaacauuccguuuacauuuua

SEQ ID NO: 3513353 - RNA, 20 nt, Human
aaaacauugaagagagagcu

SEQ ID NO: 3513354 - RNA, 14 nt, Human
aaaacauuggauua

SEQ ID NO: 3513355 - RNA, 12 nt, Human
aaaacauuuauu

SEQ ID NO: 3513356 - RNA, 12 nt, Human
aaaacauuugcu

SEQ ID NO: 3513357 - RNA, 20 nt, Human
aaaaccaaaaguuauuaaaa

SEQ ID NO: 3513358 - RNA, 13 nt, Human
aaaaccaaaauga

SEQ ID NO: 3513359 - RNA, 22 nt, Human
aaaaccaaagagggcuuccucu

SEQ ID NO: 3513360 - RNA, 18 nt, Human
aaaaccaaauguuuauuu

SEQ ID NO: 3513361 - RNA, 21 nt, Human
aaaaccaauguucucucuucu

SEQ ID NO: 3513362 - RNA, 19 nt, Human
aaaaccaauguuuugcagu

SEQ ID NO: 3513363 - RNA, 14 nt, Human
aaaaccacaaaggc

SEQ ID NO: 3513364 - RNA, 15 nt, Human
aaaaccacacaaaga

SEQ ID NO: 3513365 - RNA, 20 nt, Human
aaaaccacagcccugucagu

SEQ ID NO: 3513366 - RNA, 20 nt, Human
aaaaccacauggcacagaga

SEQ ID NO: 3513367 - RNA, 11 nt, Human
aaaaccaggcc

SEQ ID NO: 3513368 - RNA, 16 nt, Human
aaaaccaggcuuucua

SEQ ID NO: 3513369 - RNA, 20 nt, Human
aaaaccaucaaaaauauucc

SEQ ID NO: 3513370 - RNA, 17 nt, Human
aaaaccaucaaguugug

SEQ ID NO: 3513371 - RNA, 12 nt, Human
aaaacccaagug

SEQ ID NO: 3513372 - RNA, 21 nt, Human
aaaacccacaaaaauguugaa

SEQ ID NO: 3513373 - RNA, 12 nt, Human
aaaacccagaga

SEQ ID NO: 3513374 - RNA, 21 nt, Human
aaaacccagcaacagaaaaau

SEQ ID NO: 3513375 - RNA, 12 nt, Human
aaaacccagcug

SEQ ID NO: 3513376 - RNA, 14 nt, Human
aaaacccagcugca

SEQ ID NO: 3513377 - RNA, 22 nt, Human
aaaaccccacuacacagucugc

SEQ ID NO: 3513378 - RNA, 18 nt, Human
aaaaccccccagauauca

SEQ ID NO: 3513379 - RNA, 19 nt, Human
aaaaccguguuugucucuu

SEQ ID NO: 3513380 - RNA, 21 nt, Human
aaaaccguguuugucucuucu

SEQ ID NO: 3513381 - RNA, 21 nt, Human
aaaaccuaaguccuuuaugug

SEQ ID NO: 3513382 - RNA, 15 nt, Human
aaaaccugagauuua

SEQ ID NO: 3513383 - RNA, 13 nt, Human
aaaaccuuucaaa

SEQ ID NO: 3513384 - RNA, 20 nt, Human
aaaaccuuucaaauuucaca

SEQ ID NO: 3513385 - RNA, 14 nt, Human
aaaaccuuuugaaa

SEQ ID NO: 3513386 - RNA, 21 nt, Human
aaaacgcgcagaugugcagca

SEQ ID NO: 3513387 - RNA, 19 nt, Human
aaaacgcugucaaaaguug

SEQ ID NO: 3513388 - RNA, 16 nt, Human
aaaacguggcugcuuc

SEQ ID NO: 3513389 - RNA, 16 nt, Human
aaaacguuuuauugug

SEQ ID NO: 3513390 - RNA, 23 nt, Human
aaaacguuuuguuugaaaaagca

SEQ ID NO: 3513391 - RNA, 22 nt, Human
aaaacuaaauagcauguauugu

SEQ ID NO: 3513392 - RNA, 15 nt, Human
aaaacuacauuuuaa

SEQ ID NO: 3513393 - RNA, 14 nt, Human
aaaacuacuuagca

SEQ ID NO: 3513394 - RNA, 21 nt, Human
aaaacuaggcauuuguaaaua

SEQ ID NO: 3513395 - RNA, 20 nt, Human
aaaacuauacuugaacaaaa

SEQ ID NO: 3513396 - RNA, 19 nt, Human
aaaacuauauguaugguuu

SEQ ID NO: 3513397 - RNA, 14 nt, Human
aaaacucacuguga

SEQ ID NO: 3513398 - RNA, 15 nt, Human
aaaacucacugugau

SEQ ID NO: 3513399 - RNA, 19 nt, Human
aaaacucagccugggacag

SEQ ID NO: 3513400 - RNA, 20 nt, Human
aaaacuccgcccccagccua

SEQ ID NO: 3513401 - RNA, 13 nt, Human
aaaacucugguaa

SEQ ID NO: 3513402 - RNA, 18 nt, Human
aaaacugaaaaucuaaua

SEQ ID NO: 3513403 - RNA, 17 nt, Human
aaaacugaagucugaaa

SEQ ID NO: 3513404 - RNA, 15 nt, Human
aaaacugacagagga

SEQ ID NO: 3513405 - RNA, 16 nt, Human
aaaacugacuccuuag

SEQ ID NO: 3513406 - RNA, 18 nt, Human
aaaacugauuuuuuuuuc

SEQ ID NO: 3513407 - RNA, 19 nt, Human
aaaacugcucauaugaugu

SEQ ID NO: 3513408 - RNA, 22 nt, Human
aaaacugcugacuguuuucucu

SEQ ID NO: 3513409 - RNA, 16 nt, Human
aaaacuggaccuguau

SEQ ID NO: 3513410 - RNA, 19 nt, Human
aaaacuggaccuguauauu

SEQ ID NO: 3513411 - RNA, 20 nt, Human
aaaacuguacauuuaaaauu

SEQ ID NO: 3513412 - RNA, 20 nt, Human
aaaacuguacuuugauucac

SEQ ID NO: 3513413 - RNA, 21 nt, Human
aaaacuguacuuugauucaca

SEQ ID NO: 3513414 - RNA, 21 nt, Human
aaaacugugaccaaguauaaa

SEQ ID NO: 3513415 - RNA, 17 nt, Human
aaaacuguguugccaca

SEQ ID NO: 3513416 - RNA, 20 nt, Human
aaaacuucguuuaaugaaug

SEQ ID NO: 3513417 - RNA, 22 nt, Human
aaaacuucuugucagacauaaa

SEQ ID NO: 3513418 - RNA, 20 nt, Human
auucacuuugacacuuuuca

SEQ ID NO: 3513419 - RNA, 18 nt, Human
auucagaaaauguucugu

SEQ ID NO: 3513420 - RNA, 19 nt, Human
auucagaaaauguucuguu

SEQ ID NO: 3513421 - RNA, 23 nt, Human
auucagaaccccaacuacugugu

SEQ ID NO: 3513422 - RNA, 16 nt, Human
auucagaagaaaaaga

SEQ ID NO: 3513423 - RNA, 18 nt, Human
auucagaagaaaaagaag

SEQ ID NO: 3513424 - RNA, 17 nt, Human
auucagacaaaauggau

SEQ ID NO: 3513425 - RNA, 14 nt, Human
auucagacagauga

SEQ ID NO: 3513426 - RNA, 20 nt, Human
auucagacagaugaggcuuu

SEQ ID NO: 3513427 - RNA, 16 nt, Human
auucagagaauaucaa

SEQ ID NO: 3513428 - RNA, 16 nt, Human
auucagaucacugaau

SEQ ID NO: 3513429 - RNA, 19 nt, Human
auucagaucacugaauuua

SEQ ID NO: 3513430 - RNA, 21 nt, Human
auucagcaaggcgcuaacuug

SEQ ID NO: 3513431 - RNA, 12 nt, Human
auucagcaucug

SEQ ID NO: 3513432 - RNA, 19 nt, Human
auucagcauuagugggaaa

SEQ ID NO: 3513433 - RNA, 15 nt, Human
auucagccuggcuuc

SEQ ID NO: 3513434 - RNA, 14 nt, Human
auucagccuucuuu

SEQ ID NO: 3513435 - RNA, 17 nt, Human
auucagccuucuuuuuc

SEQ ID NO: 3513436 - RNA, 20 nt, Human
auucagccuucuuuuucugg

SEQ ID NO: 3513437 - RNA, 18 nt, Human
auucagcucugcaagaau

SEQ ID NO: 3513438 - RNA, 21 nt, Human
auucagcugagguucauuaca

SEQ ID NO: 3513439 - RNA, 11 nt, Human
auucagcugcc

SEQ ID NO: 3513440 - RNA, 20 nt, Human
auucagcuucauuuguguca

SEQ ID NO: 3513441 - RNA, 19 nt, Human
auucaggaaaagccucugu

SEQ ID NO: 3513442 - RNA, 18 nt, Human
auucaggaaaaggccugg

SEQ ID NO: 3513443 - RNA, 19 nt, Human
auucaggaaaaggccuggg

SEQ ID NO: 3513444 - RNA, 12 nt, Human
auucaggaagcu

SEQ ID NO: 3513445 - RNA, 17 nt, Human
auucaggaagcucaggg

SEQ ID NO: 3513446 - RNA, 19 nt, Human
auucaggacuugaaagaaa

SEQ ID NO: 3513447 - RNA, 20 nt, Human
auucagggaaagugggacag

SEQ ID NO: 3513448 - RNA, 18 nt, Human
auucaggggaaacuugau

SEQ ID NO: 3513449 - RNA, 14 nt, Human
auucagguaacacu

SEQ ID NO: 3513450 - RNA, 15 nt, Human
auucagguaauacaa

SEQ ID NO: 3513451 - RNA, 17 nt, Human
auucagguauguugccu

SEQ ID NO: 3513452 - RNA, 15 nt, Human
auucaguaauaacuc

SEQ ID NO: 3513453 - RNA, 16 nt, Human
auucaguauguuuuac

SEQ ID NO: 3513454 - RNA, 22 nt, Human
auucaguauguuuuacacugua

SEQ ID NO: 3513455 - RNA, 19 nt, Human
auucaguauuaaagggggg

SEQ ID NO: 3513456 - RNA, 12 nt, Human
auucagucacau

SEQ ID NO: 3513457 - RNA, 15 nt, Human
auucagugagggucu

SEQ ID NO: 3513458 - RNA, 16 nt, Human
auucagugagggucuu

SEQ ID NO: 3513459 - RNA, 15 nt, Human
auucagugauuacug

SEQ ID NO: 3513460 - RNA, 19 nt, Human
auucagugauuacugucaa

SEQ ID NO: 3513461 - RNA, 20 nt, Human
auucagugcuguggccuggg

SEQ ID NO: 3513462 - RNA, 14 nt, Human
auucagugcuucuu

SEQ ID NO: 3513463 - RNA, 18 nt, Human
auucaguguauuucaguu

SEQ ID NO: 3513464 - RNA, 14 nt, Human
auucaguuaagaaa

SEQ ID NO: 3513465 - RNA, 16 nt, Human
auucaguuaagaaaaa

SEQ ID NO: 3513466 - RNA, 14 nt, Human
auucaguuuucauu

SEQ ID NO: 3513467 - RNA, 14 nt, Human
auucauaaugacuu

SEQ ID NO: 3513468 - RNA, 19 nt, Human
auucauaaugacuuaagca

SEQ ID NO: 3513469 - RNA, 21 nt, Human
auucauaauuauuauuuggcc

SEQ ID NO: 3513470 - RNA, 18 nt, Human
auucauaguaacuucuua

SEQ ID NO: 3513471 - RNA, 17 nt, Human
auucauaguaagauuga

SEQ ID NO: 3513472 - RNA, 16 nt, Human
auucauaguagaacuu

SEQ ID NO: 3513473 - RNA, 23 nt, Human
auucauauauuuuaugaaucaga

SEQ ID NO: 3513474 - RNA, 15 nt, Human
auucauaugcauauu

SEQ ID NO: 3513475 - RNA, 16 nt, Human
auucauaugcauauuu

SEQ ID NO: 3513476 - RNA, 13 nt, Human
auucauauuacaa

SEQ ID NO: 3513477 - RNA, 14 nt, Human
auucauauuacaau

SEQ ID NO: 3513478 - RNA, 19 nt, Human
auucauauucuguuggaag

SEQ ID NO: 3513479 - RNA, 16 nt, Human
auucauauucuucaua

SEQ ID NO: 3513480 - RNA, 19 nt, Human
auucauauuuacuucuuau

SEQ ID NO: 3513481 - RNA, 17 nt, Human
auucauauuuguacuuu

SEQ ID NO: 3513482 - RNA, 21 nt, Human
auucauauuuguacuuucugu

SEQ ID NO: 3513483 - RNA, 23 nt, Human
auucauauuuguacuuucuguua

SEQ ID NO: 3513484 - RNA, 17 nt, Human
auucauccaaguuaaau

SEQ ID NO: 3513485 - RNA, 20 nt, Human
auucaucuguuuuucuuuuu

SEQ ID NO: 3513486 - RNA, 15 nt, Human
auucaucuuuuguau

SEQ ID NO: 3513487 - RNA, 13 nt, Human
auucaugaacuuc

SEQ ID NO: 3513488 - RNA, 16 nt, Human
auucaugaggagggug

SEQ ID NO: 3513489 - RNA, 20 nt, Human
aguuggacagcaaaaccauu

SEQ ID NO: 3513490 - RNA, 14 nt, Human
aguuggacuaaaug

SEQ ID NO: 3513491 - RNA, 19 nt, Human
aguuggagcuccagccuga

SEQ ID NO: 3513492 - RNA, 20 nt, Human
aguuggaguucauucauauu

SEQ ID NO: 3513493 - RNA, 19 nt, Human
aguuggaguuuuuuguacc

SEQ ID NO: 3513494 - RNA, 23 nt, Human
aguuggccauauuuaccucagcc

SEQ ID NO: 3513495 - RNA, 19 nt, Human
aguugggcuuccucauagu

SEQ ID NO: 3513496 - RNA, 19 nt, Human
aguugggcuugcuauucug

SEQ ID NO: 3513497 - RNA, 15 nt, Human
aguugggugagaaca

SEQ ID NO: 3513498 - RNA, 20 nt, Human
aguuggguguauugugcgcu

SEQ ID NO: 3513499 - RNA, 13 nt, Human
aguugguaacuuu

SEQ ID NO: 3513500 - RNA, 14 nt, Human
aguuggugagaaac

SEQ ID NO: 3513501 - RNA, 13 nt, Human
aguuggugucuuu

SEQ ID NO: 3513502 - RNA, 15 nt, Human
aguugguuggauaag

SEQ ID NO: 3513503 - RNA, 16 nt, Human
aguuguaaauauauaa

SEQ ID NO: 3513504 - RNA, 20 nt, Human
aguuguaaauauauaaauau

SEQ ID NO: 3513505 - RNA, 17 nt, Human
aguuguaacuuauauug

SEQ ID NO: 3513506 - RNA, 18 nt, Human
aguuguaacuuauauuga

SEQ ID NO: 3513507 - RNA, 22 nt, Human
aguuguacaugaaauuuuugua

SEQ ID NO: 3513508 - RNA, 16 nt, Human
aguuguaccaagugaa

SEQ ID NO: 3513509 - RNA, 23 nt, Human
aguuguacuuuaaaaauuuacua

SEQ ID NO: 3513510 - RNA, 16 nt, Human
aguuguagaauguauu

SEQ ID NO: 3513511 - RNA, 18 nt, Human
aguuguagacaaaguaca

SEQ ID NO: 3513512 - RNA, 23 nt, Human
aguuguagacaaaguacauucug

SEQ ID NO: 3513513 - RNA, 22 nt, Human
aguuguaggcgaaucauuuguu

SEQ ID NO: 3513514 - RNA, 23 nt, Human
aguuguaucagcacguguggccu

SEQ ID NO: 3513515 - RNA, 15 nt, Human
aguuguaucucuuuu

SEQ ID NO: 3513516 - RNA, 17 nt, Human
aguuguaugaucugugc

SEQ ID NO: 3513517 - RNA, 23 nt, Human
aguuguauuuaacagaaauugua

SEQ ID NO: 3513518 - RNA, 20 nt, Human
aguugucccgauuguaacuc

SEQ ID NO: 3513519 - RNA, 13 nt, Human
aguugucuaaaca

SEQ ID NO: 3513520 - RNA, 15 nt, Human
aguugucucucuuca

SEQ ID NO: 3513521 - RNA, 21 nt, Human
aguugucucucuucagacucu

SEQ ID NO: 3513522 - RNA, 13 nt, Human
aguugucucugau

SEQ ID NO: 3513523 - RNA, 16 nt, Human
aguugucucugaugca

SEQ ID NO: 3513524 - RNA, 14 nt, Human
aguugugaaaguuu

SEQ ID NO: 3513525 - RNA, 20 nt, Human
aguugugacaacuuccugag

SEQ ID NO: 3513526 - RNA, 18 nt, Human
aguugugaccuuaguguu

SEQ ID NO: 3513527 - RNA, 13 nt, Human
aguugugaucauc

SEQ ID NO: 3513528 - RNA, 22 nt, Human
aguugugccuuuuauagcuauu

SEQ ID NO: 3513529 - RNA, 18 nt, Human
aguuguggaaagccucug

SEQ ID NO: 3513530 - RNA, 19 nt, Human
aguuguggaaagccucugc

SEQ ID NO: 3513531 - RNA, 21 nt, Human
aguuguggaaagccucugcug

SEQ ID NO: 3513532 - RNA, 16 nt, Human
aguuguggauuucagu

SEQ ID NO: 3513533 - RNA, 20 nt, Human
aguuguggugcugacaaagc

SEQ ID NO: 3513534 - RNA, 20 nt, Human
aguuguguacucuggccucu

SEQ ID NO: 3513535 - RNA, 21 nt, Human
aguugugucuggcaguuuaua

SEQ ID NO: 3513536 - RNA, 16 nt, Human
aguuguguguaugugu

SEQ ID NO: 3513537 - RNA, 18 nt, Human
aguuguguguaugugugu

SEQ ID NO: 3513538 - RNA, 15 nt, Human
aguuguguuguucuu

SEQ ID NO: 3513539 - RNA, 22 nt, Human
aguuguguuuguugcuggcuug

SEQ ID NO: 3513540 - RNA, 19 nt, Human
aguuguguuuuuuaagaug

SEQ ID NO: 3513541 - RNA, 16 nt, Human
aguuguuacauuuuua

SEQ ID NO: 3513542 - RNA, 19 nt, Human
aguuguuacauuuuuaagu

SEQ ID NO: 3513543 - RNA, 20 nt, Human
aguuguuacauuuuuaagug

SEQ ID NO: 3513544 - RNA, 24 nt, Human
aguuguuaccccaagcgcccuggc

SEQ ID NO: 3513545 - RNA, 20 nt, Human
aguuguuacuaacuaaacuc

SEQ ID NO: 3513546 - RNA, 23 nt, Human
aguuguuacuaacuaaacucucu

SEQ ID NO: 3513547 - RNA, 20 nt, Human
aguuguuagauuaagaaaua

SEQ ID NO: 3513548 - RNA, 15 nt, Human
aguuguucaacuauu

SEQ ID NO: 3513549 - RNA, 17 nt, Human
aguuguucaacuauuuu

SEQ ID NO: 3513550 - RNA, 20 nt, Human
aguuguucaauaauaaauau

SEQ ID NO: 3513551 - RNA, 19 nt, Human
aguuguuccuuaagucaga

SEQ ID NO: 3513552 - RNA, 13 nt, Human
aguuguuggccuc

SEQ ID NO: 3513553 - RNA, 14 nt, Human
aguuguuggccucc

SEQ ID NO: 3513554 - RNA, 16 nt, Human
aguuguuguaaccugc

SEQ ID NO: 3513555 - RNA, 18 nt, Human
aguuguuguggguucuau

SEQ ID NO: 3513556 - RNA, 19 nt, Human
aguuguuguggguucuaug

SEQ ID NO: 3513557 - RNA, 13 nt, Human
aguuguuucauug

SEQ ID NO: 3513558 - RNA, 15 nt, Human
aguuguuugugccuu

SEQ ID NO: 3513559 - RNA, 17 nt, Human
aguuguuuguuuuugcu

SEQ ID NO: 3513560 - RNA, 19 nt, Human
aguuguuuucagacucaga

SEQ ID NO: 3513561 - RNA, 17 nt, Human
aguuguuuuuguauauu

SEQ ID NO: 3513562 - RNA, 16 nt, Human
auuauucuuucuccuu

SEQ ID NO: 3513563 - RNA, 20 nt, Human
auuauucuuucuccuuuuuu

SEQ ID NO: 3513564 - RNA, 21 nt, Human
auuauugaaggaagccaaauu

SEQ ID NO: 3513565 - RNA, 14 nt, Human
auuauugaugaaaa

SEQ ID NO: 3513566 - RNA, 19 nt, Human
auuauugcuuauugcuuag

SEQ ID NO: 3513567 - RNA, 23 nt, Human
auuauuguguguuauuuaaauga

SEQ ID NO: 3513568 - RNA, 18 nt, Human
auuauuguugcauuaaaa

SEQ ID NO: 3513569 - RNA, 11 nt, Human
auuauuuaaac

SEQ ID NO: 3513570 - RNA, 22 nt, Human
auuauuuaaaccgcuaaaagaa

SEQ ID NO: 3513571 - RNA, 19 nt, Human
auuauuuaagacuaaaagu

SEQ ID NO: 3513572 - RNA, 15 nt, Human
auuauuuaauaacau

SEQ ID NO: 3513573 - RNA, 15 nt, Human
auuauuuaauugucc

SEQ ID NO: 3513574 - RNA, 14 nt, Human
auuauuuacaagaa

SEQ ID NO: 3513575 - RNA, 14 nt, Human
auuauuuauguauu

SEQ ID NO: 3513576 - RNA, 13 nt, Human
auuauuuauuaca

SEQ ID NO: 3513577 - RNA, 17 nt, Human
auuauuuauuuaauaac

SEQ ID NO: 3513578 - RNA, 15 nt, Human
auuauuuauuuauuu

SEQ ID NO: 3513579 - RNA, 21 nt, Human
auuauuucacuuuagaugcug

SEQ ID NO: 3513580 - RNA, 22 nt, Human
auuauuucuaggaagaauuuua

SEQ ID NO: 3513581 - RNA, 23 nt, Human
auuauuugaaaacauauaaagca

SEQ ID NO: 3513582 - RNA, 21 nt, Human
auuauuugauuauuuaagacu

SEQ ID NO: 3513583 - RNA, 20 nt, Human
auuauuugcauguuauguuu

SEQ ID NO: 3513584 - RNA, 21 nt, Human
auuauuugcauguuauguuua

SEQ ID NO: 3513585 - RNA, 15 nt, Human
auuauuuguaagaua

SEQ ID NO: 3513586 - RNA, 12 nt, Human
auuauuuguguu

SEQ ID NO: 3513587 - RNA, 15 nt, Human
auuauuuguguuuua

SEQ ID NO: 3513588 - RNA, 15 nt, Human
auuauuuuaaacaaa

SEQ ID NO: 3513589 - RNA, 16 nt, Human
auuauuuuaaauuaua

SEQ ID NO: 3513590 - RNA, 16 nt, Human
auuauuuucaccuguu

SEQ ID NO: 3513591 - RNA, 23 nt, Human
auuauuuucauccuugucuuauu

SEQ ID NO: 3513592 - RNA, 16 nt, Human
auuauuuucugucaga

SEQ ID NO: 3513593 - RNA, 14 nt, Human
auuauuuucuucau

SEQ ID NO: 3513594 - RNA, 19 nt, Human
auuauuuuggggucucuuu

SEQ ID NO: 3513595 - RNA, 15 nt, Human
auuauuuuguucaua

SEQ ID NO: 3513596 - RNA, 17 nt, Human
auuauuuuguucauaca

SEQ ID NO: 3513597 - RNA, 18 nt, Human
auuauuuuguucauacau

SEQ ID NO: 3513598 - RNA, 18 nt, Human
auuauuuuuauaauugua

SEQ ID NO: 3513599 - RNA, 17 nt, Human
auuauuuuucacucuaa

SEQ ID NO: 3513600 - RNA, 13 nt, Human
auuauuuuuucag

SEQ ID NO: 3513601 - RNA, 14 nt, Human
auuauuuuuucaga

SEQ ID NO: 3513602 - RNA, 21 nt, Human
auuauuuuuucagaccgaaaa

SEQ ID NO: 3513603 - RNA, 17 nt, Human
auuauuuuuuuaaaauu

SEQ ID NO: 3513604 - RNA, 21 nt, Human
auuauuuuuuuuuuuugaaaa

SEQ ID NO: 3513605 - RNA, 19 nt, Human
auucaaaaagucacaguua

SEQ ID NO: 3513606 - RNA, 17 nt, Human
auucaaaaaguguuuau

SEQ ID NO: 3513607 - RNA, 16 nt, Human
auucaaaaauuaucua

SEQ ID NO: 3513608 - RNA, 20 nt, Human
auucaaaauaggguauauuu

SEQ ID NO: 3513609 - RNA, 15 nt, Human
auucaaaauauuuaa

SEQ ID NO: 3513610 - RNA, 19 nt, Human
auucaaaauugacauugcu

SEQ ID NO: 3513611 - RNA, 17 nt, Human
auucaaacuggggccuc

SEQ ID NO: 3513612 - RNA, 14 nt, Human
auucaaagaaauau

SEQ ID NO: 3513613 - RNA, 21 nt, Human
auucaaagaaucaccuaauua

SEQ ID NO: 3513614 - RNA, 15 nt, Human
auucaaagguucuag

SEQ ID NO: 3513615 - RNA, 18 nt, Human
auucaaagguucuagguu

SEQ ID NO: 3513616 - RNA, 14 nt, Human
auucaaaguguuau

SEQ ID NO: 3513617 - RNA, 18 nt, Human
auucaaaguugccuaaau

SEQ ID NO: 3513618 - RNA, 14 nt, Human
auucaaauaccaau

SEQ ID NO: 3513619 - RNA, 18 nt, Human
auucaaauguauuacagu

SEQ ID NO: 3513620 - RNA, 12 nt, Human
auucaaauuuau

SEQ ID NO: 3513621 - RNA, 13 nt, Human
auucaaauuuauu

SEQ ID NO: 3513622 - RNA, 21 nt, Human
auucaaauuuauuuccaaugu

SEQ ID NO: 3513623 - RNA, 16 nt, Human
auucaaccacuguaaa

SEQ ID NO: 3513624 - RNA, 21 nt, Human
auucaaccauggacuuuauaa

SEQ ID NO: 3513625 - RNA, 16 nt, Human
auucaacccuggagag

SEQ ID NO: 3513626 - RNA, 23 nt, Human
auucaacuaaaaaaaaaaaagua

SEQ ID NO: 3513627 - RNA, 14 nt, Human
auucaacucagacu

SEQ ID NO: 3513628 - RNA, 14 nt, Human
auucaacuuuguaa

SEQ ID NO: 3513629 - RNA, 18 nt, Human
auucaacuuuguaaaaau

SEQ ID NO: 3513630 - RNA, 23 nt, Human
auucaagaaagccagucuuaaca

SEQ ID NO: 3513631 - RNA, 16 nt, Human
auucaaggaauuucuu

SEQ ID NO: 3513632 - RNA, 16 nt, Human
auucaagguaaaauuc

SEQ ID NO: 3513633 - RNA, 18 nt, Human
auucaagguaaaauucua

SEQ ID NO: 3513634 - RNA, 21 nt, Human
auucaagguaaaauucuaaau

SEQ ID NO: 3513635 - RNA, 16 nt, Human
auucaaguuauuguac

SEQ ID NO: 3513636 - RNA, 12 nt, Human
auucaauaaagc

SEQ ID NO: 3513637 - RNA, 13 nt, Human
auucaauaaagcu

SEQ ID NO: 3513638 - RNA, 13 nt, Human
auucaauaaagua

SEQ ID NO: 3513639 - RNA, 21 nt, Human
auucaauaaaguauuuaauua

SEQ ID NO: 3513640 - RNA, 15 nt, Human
auucaauacaaacaa

SEQ ID NO: 3513641 - RNA, 21 nt, Human
auucaauacaaacaaucucuu

SEQ ID NO: 3513642 - RNA, 16 nt, Human
auucaauauccuuugc

SEQ ID NO: 3513643 - RNA, 19 nt, Human
auucaauauccuuugccuc

SEQ ID NO: 3513644 - RNA, 13 nt, Human
auucaauauugac

SEQ ID NO: 3513645 - RNA, 16 nt, Human
auucaaucuguaaacu

SEQ ID NO: 3513646 - RNA, 19 nt, Human
auucaauuaaagaaauaau

SEQ ID NO: 3513647 - RNA, 16 nt, Human
auucaauuccucuggg

SEQ ID NO: 3513648 - RNA, 17 nt, Human
auucaauuccucuggga

SEQ ID NO: 3513649 - RNA, 18 nt, Human
auucaauuccucugggaa

SEQ ID NO: 3513650 - RNA, 14 nt, Human
auucaauuguaaau

SEQ ID NO: 3513651 - RNA, 13 nt, Human
auucacaaacuuu

SEQ ID NO: 3513652 - RNA, 16 nt, Human
auucacaaaguaauuu

SEQ ID NO: 3513653 - RNA, 17 nt, Human
auucacaaaguaauuug

SEQ ID NO: 3513654 - RNA, 16 nt, Human
auuccuuaaauaaacu

SEQ ID NO: 3513655 - RNA, 19 nt, Human
auuccuuagacucuuuucc

SEQ ID NO: 3513656 - RNA, 22 nt, Human
auuccuucagggugaugccagg

SEQ ID NO: 3513657 - RNA, 12 nt, Human
auuccuucccau

SEQ ID NO: 3513658 - RNA, 16 nt, Human
auuccuuccuguucug

SEQ ID NO: 3513659 - RNA, 17 nt, Human
auuccuuccuguucuga

SEQ ID NO: 3513660 - RNA, 15 nt, Human
auuccuucucugaac

SEQ ID NO: 3513661 - RNA, 22 nt, Human
auuccuucuggccuuuccucuc

SEQ ID NO: 3513662 - RNA, 14 nt, Human
auuccuucuuugau

SEQ ID NO: 3513663 - RNA, 20 nt, Human
auuccuucuuugauaauguu

SEQ ID NO: 3513664 - RNA, 19 nt, Human
auuccuugaucauuuuggg

SEQ ID NO: 3513665 - RNA, 12 nt, Human
auuccuugugaa

SEQ ID NO: 3513666 - RNA, 20 nt, Human
auuccuuuaacaacauguuu

SEQ ID NO: 3513667 - RNA, 18 nt, Human
auuccuuucccuuccucu

SEQ ID NO: 3513668 - RNA, 17 nt, Human
auuccuuucccuuuagc

SEQ ID NO: 3513669 - RNA, 20 nt, Human
auuccuuugaagaggaaaau

SEQ ID NO: 3513670 - RNA, 14 nt, Human
auuccuuugcauau

SEQ ID NO: 3513671 - RNA, 16 nt, Human
auuccuuugucuucaa

SEQ ID NO: 3513672 - RNA, 15 nt, Human
auuccuuuucuuguu

SEQ ID NO: 3513673 - RNA, 16 nt, Human
auuccuuuuuauuuau

SEQ ID NO: 3513674 - RNA, 16 nt, Human
auucgaaugaaaagac

SEQ ID NO: 3513675 - RNA, 16 nt, Human
auucgaccugauuuac

SEQ ID NO: 3513676 - RNA, 21 nt, Human
auucgaccugauuuacaguuu

SEQ ID NO: 3513677 - RNA, 18 nt, Human
auucgccacacaguauuu

SEQ ID NO: 3513678 - RNA, 19 nt, Human
auucgcccaaagccagaca

SEQ ID NO: 3513679 - RNA, 21 nt, Human
auucgcuacuaugauuuaauu

SEQ ID NO: 3513680 - RNA, 16 nt, Human
auucguacauaauacu

SEQ ID NO: 3513681 - RNA, 23 nt, Human
auucguacauaauacugaaccac

SEQ ID NO: 3513682 - RNA, 16 nt, Human
auucguguguuuuuuu

SEQ ID NO: 3513683 - RNA, 17 nt, Human
auucguuaucuaauagg

SEQ ID NO: 3513684 - RNA, 19 nt, Human
auucguuguguuuuuuaag

SEQ ID NO: 3513685 - RNA, 14 nt, Human
auucuaaaaugauu

SEQ ID NO: 3513686 - RNA, 16 nt, Human
auucuaaaaugauugu

SEQ ID NO: 3513687 - RNA, 19 nt, Human
auucuaaagagcacuuacu

SEQ ID NO: 3513688 - RNA, 23 nt, Human
auucuaaagagcacuuacuguaa

SEQ ID NO: 3513689 - RNA, 14 nt, Human
auucuaaaggucca

SEQ ID NO: 3513690 - RNA, 18 nt, Human
auucuaaaugaauguuua

SEQ ID NO: 3513691 - RNA, 14 nt, Human
auucuaaauuuuau

SEQ ID NO: 3513692 - RNA, 19 nt, Human
auucuaacuuuuuugcuau

SEQ ID NO: 3513693 - RNA, 18 nt, Human
auucuaagaaauaucugu

SEQ ID NO: 3513694 - RNA, 18 nt, Human
auucuaagacuaaugcuc

SEQ ID NO: 3513695 - RNA, 20 nt, Human
auucuaagacuuacucuaag

SEQ ID NO: 3513696 - RNA, 23 nt, Human
auucuaagacuuacucuaagauc

SEQ ID NO: 3513697 - RNA, 19 nt, Human
auucuaauaagcuaguuga

SEQ ID NO: 3513698 - RNA, 17 nt, Human
auucuaaugauggccca

SEQ ID NO: 3513699 - RNA, 18 nt, Human
auucuaaugauggcccau

SEQ ID NO: 3513700 - RNA, 14 nt, Human
auucuaaugucuuc

SEQ ID NO: 3513701 - RNA, 13 nt, Human
auucuacacagag

SEQ ID NO: 3513702 - RNA, 16 nt, Human
auucuacuugcucugg

SEQ ID NO: 3513703 - RNA, 23 nt, Human
auucuacuugcucuggaccugcc

SEQ ID NO: 3513704 - RNA, 17 nt, Human
auucuacuuuaagcacu

SEQ ID NO: 3513705 - RNA, 16 nt, Human
auucuagauuaccaug

SEQ ID NO: 3513706 - RNA, 16 nt, Human
auucuaggaccugugu

SEQ ID NO: 3513707 - RNA, 17 nt, Human
auucagauuguuaucua

SEQ ID NO: 3513708 - RNA, 19 nt, Human
auucagauuucucuuugaa

SEQ ID NO: 3513709 - RNA, 14 nt, Human
auucagauuuuaaa

SEQ ID NO: 3513710 - RNA, 19 nt, Human
auucagauuuuaaaaaguc

SEQ ID NO: 3513711 - RNA, 15 nt, Human
auucagcaaaccauu

SEQ ID NO: 3513712 - RNA, 23 nt, Human
auucagcaaggcgcuaacuugcu

SEQ ID NO: 3513713 - RNA, 18 nt, Human
auucagcagcaaauuuuc

SEQ ID NO: 3513714 - RNA, 14 nt, Human
auucagccuguuug

SEQ ID NO: 3513715 - RNA, 12 nt, Human
auucagccuucu

SEQ ID NO: 3513716 - RNA, 16 nt, Human
auucagccuucuuuuu

SEQ ID NO: 3513717 - RNA, 22 nt, Human
auucagccuucuuuuucuggac

SEQ ID NO: 3513718 - RNA, 13 nt, Human
auucagcugcccc

SEQ ID NO: 3513719 - RNA, 12 nt, Human
auucagcuucau

SEQ ID NO: 3513720 - RNA, 22 nt, Human
auucaggaaaacugacagagga

SEQ ID NO: 3513721 - RNA, 20 nt, Human
auucaggaaaaggccugggg

SEQ ID NO: 3513722 - RNA, 13 nt, Human
auucaggaagcuc

SEQ ID NO: 3513723 - RNA, 14 nt, Human
auucaggaagcuca

SEQ ID NO: 3513724 - RNA, 20 nt, Human
auucaggaagcucagggccu

SEQ ID NO: 3513725 - RNA, 22 nt, Human
auucaggagaguagaacagaua

SEQ ID NO: 3513726 - RNA, 13 nt, Human
auucaggcugcuu

SEQ ID NO: 3513727 - RNA, 14 nt, Human
auucagggaaggag

SEQ ID NO: 3513728 - RNA, 20 nt, Human
auucaggggcugacacuuca

SEQ ID NO: 3513729 - RNA, 18 nt, Human
auucaggguaaauaggaa

SEQ ID NO: 3513730 - RNA, 16 nt, Human
auucagguaauacaaa

SEQ ID NO: 3513731 - RNA, 19 nt, Human
auucaggugaaaauguuca

SEQ ID NO: 3513732 - RNA, 17 nt, Human
auucaggugcagaggaa

SEQ ID NO: 3513733 - RNA, 12 nt, Human
auucagguuuuu

SEQ ID NO: 3513734 - RNA, 16 nt, Human
auucagguuuuuccuu

SEQ ID NO: 3513735 - RNA, 18 nt, Human
auucaguaacugucaggc

SEQ ID NO: 3513736 - RNA, 14 nt, Human
auucaguauguuuu

SEQ ID NO: 3513737 - RNA, 18 nt, Human
auucaguccuaagaaaga

SEQ ID NO: 3513738 - RNA, 12 nt, Human
auucagucuugc

SEQ ID NO: 3513739 - RNA, 15 nt, Human
auucagucuugccuu

SEQ ID NO: 3513740 - RNA, 17 nt, Human
auucagucuugccuuac

SEQ ID NO: 3513741 - RNA, 21 nt, Human
auucagugagggucuucuuac

SEQ ID NO: 3513742 - RNA, 16 nt, Human
auucagugaugugccu

SEQ ID NO: 3513743 - RNA, 17 nt, Human
auucagugauuacuguc

SEQ ID NO: 3513744 - RNA, 19 nt, Human
auucagugcuucuuaaaga

SEQ ID NO: 3513745 - RNA, 14 nt, Human
auucagugucacug

SEQ ID NO: 3513746 - RNA, 17 nt, Human
auucaguuaagaaaaaa

SEQ ID NO: 3513747 - RNA, 18 nt, Human
auucaguuaagaaaaaaa

SEQ ID NO: 3513748 - RNA, 20 nt, Human
auucaguuaagaaaaaaaua

SEQ ID NO: 3513749 - RNA, 17 nt, Human
auucaguucccagaauc

SEQ ID NO: 3513750 - RNA, 16 nt, Human
auucaguuguuagugu

SEQ ID NO: 3513751 - RNA, 13 nt, Human
auucaguuucaua

SEQ ID NO: 3513752 - RNA, 17 nt, Human
auucaguuucauaaaag

SEQ ID NO: 3513753 - RNA, 18 nt, Human
auucaguuucuaaaauug

SEQ ID NO: 3513754 - RNA, 13 nt, Human
auucaguuuucau

SEQ ID NO: 3513755 - RNA, 21 nt, Human
auucauacuuaaaaauuuauu

SEQ ID NO: 3513756 - RNA, 19 nt, Human
auucauagcagcuuauuca

SEQ ID NO: 3513757 - RNA, 22 nt, Human
auucauagcagcuuauucacaa

SEQ ID NO: 3513758 - RNA, 20 nt, Human
auucauagucuuuggagaaa

SEQ ID NO: 3513759 - RNA, 18 nt, Human
auucauaugcauauuuuu

SEQ ID NO: 3513760 - RNA, 15 nt, Human
auucauauuacaaua

SEQ ID NO: 3513761 - RNA, 17 nt, Human
auucauauuacaauauu

SEQ ID NO: 3513762 - RNA, 19 nt, Human
auucauauuacaauauuug

SEQ ID NO: 3513763 - RNA, 13 nt, Human
auucauauugaau

SEQ ID NO: 3513764 - RNA, 14 nt, Human
auucauauugaaua

SEQ ID NO: 3513765 - RNA, 15 nt, Human
auucauauuggaaaa

SEQ ID NO: 3513766 - RNA, 20 nt, Human
auucauauuuacuucuuaua

SEQ ID NO: 3513767 - RNA, 12 nt, Human
auucauauuugu

SEQ ID NO: 3513768 - RNA, 13 nt, Human
auucauauuugua

SEQ ID NO: 3513769 - RNA, 19 nt, Human
auucauauuuguacuuucu

SEQ ID NO: 3513770 - RNA, 20 nt, Human
auucauauuuucuuucaaaa

SEQ ID NO: 3513771 - RNA, 19 nt, Human
auucaucaaauggaagaca

SEQ ID NO: 3513772 - RNA, 14 nt, Human
auucaucagcauuu

SEQ ID NO: 3513773 - RNA, 18 nt, Human
auucauccaaguuaaaug

SEQ ID NO: 3513774 - RNA, 17 nt, Human
auucaucugucuauauu

SEQ ID NO: 3513775 - RNA, 13 nt, Human
auucaugccuggc

SEQ ID NO: 3513776 - RNA, 21 nt, Human
auucaugcuacugccaaccug

SEQ ID NO: 3513777 - RNA, 22 nt, Human
auucauguuauauuuaaugcau

SEQ ID NO: 3513778 - RNA, 15 nt, Human
auucauuaaauguuu

SEQ ID NO: 3513779 - RNA, 16 nt, Human
auucauuaaauguuug

SEQ ID NO: 3513780 - RNA, 12 nt, Human
auucauuauuug

SEQ ID NO: 3513781 - RNA, 15 nt, Human
auucauuauuuguca

SEQ ID NO: 3513782 - RNA, 16 nt, Human
auucauucauacuuaa

SEQ ID NO: 3513783 - RNA, 17 nt, Human
auucauuccauucugga

SEQ ID NO: 3513784 - RNA, 18 nt, Human
auucauuccauucuggaa

SEQ ID NO: 3513785 - RNA, 12 nt, Human
auucauucucau

SEQ ID NO: 3513786 - RNA, 18 nt, Human
auucauucugcauugcua

SEQ ID NO: 3513787 - RNA, 16 nt, Human
auucauuguauaaaaa

SEQ ID NO: 3513788 - RNA, 21 nt, Human
auucauugugguuauuuuuau

SEQ ID NO: 3513789 - RNA, 14 nt, Human
auucauuguguuac

SEQ ID NO: 3513790 - RNA, 14 nt, Human
auucauuuaaaaug

SEQ ID NO: 3513791 - RNA, 15 nt, Human
auucauuuaaaauga

SEQ ID NO: 3513792 - RNA, 13 nt, Human
auucauuucacau

SEQ ID NO: 3513793 - RNA, 11 nt, Human
auucauuucua

SEQ ID NO: 3513794 - RNA, 18 nt, Human
auucauuuuauauugaaa

SEQ ID NO: 3513795 - RNA, 20 nt, Human
auucauuuuauauugaaaaa

SEQ ID NO: 3513796 - RNA, 22 nt, Human
auucauuuuauauugaaaaaaa

SEQ ID NO: 3513797 - RNA, 21 nt, Human
auucauuuucuagauacaaua

SEQ ID NO: 3513798 - RNA, 14 nt, Human
auucauuuucucua

SEQ ID NO: 3513799 - RNA, 16 nt, Human
auucauuuucucuaau

SEQ ID NO: 3513800 - RNA, 15 nt, Human
auucauuuucucuuu

SEQ ID NO: 3513801 - RNA, 22 nt, Human
auucauuuuugaaacugcauuu

SEQ ID NO: 3513802 - RNA, 17 nt, Human
auucauuuuuuaaauuc

SEQ ID NO: 3513803 - RNA, 15 nt, Human
auuccaaaauauuau

SEQ ID NO: 3513804 - RNA, 17 nt, Human
auuccaaagaacagccu

SEQ ID NO: 3513805 - RNA, 20 nt, Human
auuccaaagaguagaauugc

SEQ ID NO: 3513806 - RNA, 13 nt, Human
auuccaaagcaaa

SEQ ID NO: 3513807 - RNA, 14 nt, Human
auuccaaaggggac

SEQ ID NO: 3513808 - RNA, 16 nt, Human
auuccaaagucucuaa

SEQ ID NO: 3513809 - RNA, 18 nt, Human
auuccaaagucucuaauu

SEQ ID NO: 3513810 - RNA, 14 nt, Human
auaaaaaagaaauc

SEQ ID NO: 3513811 - RNA, 14 nt, Human
auaaaaaagucucu

SEQ ID NO: 3513812 - RNA, 15 nt, Human
auaaaaaagucucua

SEQ ID NO: 3513813 - RNA, 21 nt, Human
auaaaaaauaaucuauuucua

SEQ ID NO: 3513814 - RNA, 15 nt, Human
auaaaaaauuaugac

SEQ ID NO: 3513815 - RNA, 15 nt, Human
auaaaaaauuuugua

SEQ ID NO: 3513816 - RNA, 21 nt, Human
auaaaaaauuuuguaauuuuc

SEQ ID NO: 3513817 - RNA, 12 nt, Human
auaaaaacaaau

SEQ ID NO: 3513818 - RNA, 23 nt, Human
auaaaaacauugccuuugaaugu

SEQ ID NO: 3513819 - RNA, 16 nt, Human
auaaaaacccacaaaa

SEQ ID NO: 3513820 - RNA, 13 nt, Human
auaaaaacuugaa

SEQ ID NO: 3513821 - RNA, 19 nt, Human
auaaaaagauaaucucagu

SEQ ID NO: 3513822 - RNA, 20 nt, Human
auaaaaagccugcaauuuca

SEQ ID NO: 3513823 - RNA, 22 nt, Human
auaaaaagccugcaauuucaua

SEQ ID NO: 3513824 - RNA, 21 nt, Human
auaaaaaggcaccuauaaaac

SEQ ID NO: 3513825 - RNA, 19 nt, Human
auaaaaagugacacagcag

SEQ ID NO: 3513826 - RNA, 20 nt, Human
auaaaaagugacacagcagc

SEQ ID NO: 3513827 - RNA, 11 nt, Human
auaaaaaguua

SEQ ID NO: 3513828 - RNA, 12 nt, Human
auaaaaaguuaa

SEQ ID NO: 3513829 - RNA, 13 nt, Human
auaaaaauaaauu

SEQ ID NO: 3513830 - RNA, 12 nt, Human
auaaaaauauau

SEQ ID NO: 3513831 - RNA, 16 nt, Human
auaaaaauucuagauu

SEQ ID NO: 3513832 - RNA, 16 nt, Human
auaaaacagaguaauc

SEQ ID NO: 3513833 - RNA, 14 nt, Human
auaaaacagcuuug

SEQ ID NO: 3513834 - RNA, 17 nt, Human
auaaaacauuaagaaaa

SEQ ID NO: 3513835 - RNA, 13 nt, Human
auaaaacauuaau

SEQ ID NO: 3513836 - RNA, 13 nt, Human
auaaaacauuaug

SEQ ID NO: 3513837 - RNA, 13 nt, Human
auaaaacugaugu

SEQ ID NO: 3513838 - RNA, 15 nt, Human
auaaaacugauguga

SEQ ID NO: 3513839 - RNA, 18 nt, Human
auaaaacugaugugaaac

SEQ ID NO: 3513840 - RNA, 15 nt, Human
auaaaacuggcuuug

SEQ ID NO: 3513841 - RNA, 11 nt, Human
auaaaacuuuu

SEQ ID NO: 3513842 - RNA, 15 nt, Human
auaaaacuuuuuaaa

SEQ ID NO: 3513843 - RNA, 13 nt, Human
auaaaagaaaauu

SEQ ID NO: 3513844 - RNA, 16 nt, Human
auaaaagaaaauuaca

SEQ ID NO: 3513845 - RNA, 13 nt, Human
auaaaagaaacac

SEQ ID NO: 3513846 - RNA, 17 nt, Human
auaaaagaaaugcacaa

SEQ ID NO: 3513847 - RNA, 21 nt, Human
auaaaagaaaugcacaauguc

SEQ ID NO: 3513848 - RNA, 12 nt, Human
auaaaagacaca

SEQ ID NO: 3513849 - RNA, 14 nt, Human
auaaaagauacauu

SEQ ID NO: 3513850 - RNA, 10 nt, Human
auaaaagaug

SEQ ID NO: 3513851 - RNA, 22 nt, Human
auaaaagauggggucuguaaaa

SEQ ID NO: 3513852 - RNA, 15 nt, Human
auaaaagcauaaaug

SEQ ID NO: 3513853 - RNA, 18 nt, Human
auaaaagcauaaaugcaa

SEQ ID NO: 3513854 - RNA, 16 nt, Human
auugacaaaucugugu

SEQ ID NO: 3513855 - RNA, 17 nt, Human
auugacaaaucugugua

SEQ ID NO: 3513856 - RNA, 20 nt, Human
auugacaaaucuguguauau

SEQ ID NO: 3513857 - RNA, 22 nt, Human
auugacaaaucuguguauauua

SEQ ID NO: 3513858 - RNA, 17 nt, Human
auugacaacacccauuu

SEQ ID NO: 3513859 - RNA, 12 nt, Human
auugacaaguuu

SEQ ID NO: 3513860 - RNA, 15 nt, Human
auugacaauaaaaua

SEQ ID NO: 3513861 - RNA, 20 nt, Human
auugacaauaaaauauuauu

SEQ ID NO: 3513862 - RNA, 14 nt, Human
auugacacagaaaa

SEQ ID NO: 3513863 - RNA, 18 nt, Human
auugacacaguaccauuu

SEQ ID NO: 3513864 - RNA, 13 nt, Human
auugacagcuuug

SEQ ID NO: 3513865 - RNA, 16 nt, Human
auugacagcuuugcug

SEQ ID NO: 3513866 - RNA, 18 nt, Human
auugacagcuuugcugcu

SEQ ID NO: 3513867 - RNA, 19 nt, Human
auugacagcuuugcugcug

SEQ ID NO: 3513868 - RNA, 15 nt, Human
auugacaguaacuug

SEQ ID NO: 3513869 - RNA, 22 nt, Human
auugacaucagcaucaccuaga

SEQ ID NO: 3513870 - RNA, 17 nt, Human
auuguggcugucagcag

SEQ ID NO: 3513871 - RNA, 19 nt, Human
auuguggcugucagcagga

SEQ ID NO: 3513872 - RNA, 21 nt, Human
auugugggacuuauuacaauu

SEQ ID NO: 3513873 - RNA, 18 nt, Human
auugugggggaaaaauaa

SEQ ID NO: 3513874 - RNA, 18 nt, Human
auugugguacaaucucaa

SEQ ID NO: 3513875 - RNA, 19 nt, Human
auugugguacaaucucaaa

SEQ ID NO: 3513876 - RNA, 18 nt, Human
auugugguaggccuuuua

SEQ ID NO: 3513877 - RNA, 23 nt, Human
auugugguaggccuuuuaacauu

SEQ ID NO: 3513878 - RNA, 20 nt, Human
auuguggucacaacuugaug

SEQ ID NO: 3513879 - RNA, 21 nt, Human
auugugguuuauauauuuaaa

SEQ ID NO: 3513880 - RNA, 15 nt, Human
auuguguauauucau

SEQ ID NO: 3513881 - RNA, 16 nt, Human
auugugucuuuugcau

SEQ ID NO: 3513882 - RNA, 12 nt, Human
auugugugaugu

SEQ ID NO: 3513883 - RNA, 20 nt, Human
auuguguggucaguggcucu

SEQ ID NO: 3513884 - RNA, 23 nt, Human
auuguguuuacauuuuauggugc

SEQ ID NO: 3513885 - RNA, 12 nt, Human
auuguguuucua

SEQ ID NO: 3513886 - RNA, 13 nt, Human
auuguuaaaauaa

SEQ ID NO: 3513887 - RNA, 15 nt, Human
auuguuaaaauaacu

SEQ ID NO: 3513888 - RNA, 14 nt, Human
auuguuaaaggcua

SEQ ID NO: 3513889 - RNA, 17 nt, Human
auuguuaacucuugucu

SEQ ID NO: 3513890 - RNA, 19 nt, Human
auuguuaauacaagguaua

SEQ ID NO: 3513891 - RNA, 23 nt, Human
auuguuaauacaagguauaauaa

SEQ ID NO: 3513892 - RNA, 18 nt, Human
auuguuaaucucuguuau

SEQ ID NO: 3513893 - RNA, 15 nt, Human
auuguuaauuucagu

SEQ ID NO: 3513894 - RNA, 15 nt, Human
auuguuacagaagcu

SEQ ID NO: 3513895 - RNA, 21 nt, Human
auuguuacauuauguggaaaa

SEQ ID NO: 3513896 - RNA, 19 nt, Human
auuguuacguagccuaagg

SEQ ID NO: 3513897 - RNA, 18 nt, Human
auuguuagcuuccuuaag

SEQ ID NO: 3513898 - RNA, 22 nt, Human
auuguuauauacauacuaugaa

SEQ ID NO: 3513899 - RNA, 13 nt, Human
auuguuauuaaau

SEQ ID NO: 3513900 - RNA, 18 nt, Human
auuguuccaaaugaaugu

SEQ ID NO: 3513901 - RNA, 14 nt, Human
auuguuccaagaca

SEQ ID NO: 3513902 - RNA, 18 nt, Human
auuguuccaagacauugu

SEQ ID NO: 3513903 - RNA, 21 nt, Human
auuguucccagugacacuuca

SEQ ID NO: 3513904 - RNA, 19 nt, Human
auuguuccuaaguucuuag

SEQ ID NO: 3513905 - RNA, 13 nt, Human
auuguuccuguca

SEQ ID NO: 3513906 - RNA, 19 nt, Human
auuguucuuaguuugcagu

SEQ ID NO: 3513907 - RNA, 18 nt, Human
auuguucuuauucuggca

SEQ ID NO: 3513908 - RNA, 17 nt, Human
auuguugaaaaaguuug

SEQ ID NO: 3513909 - RNA, 18 nt, Human
auuguugaaaaaguuugu

SEQ ID NO: 3513910 - RNA, 20 nt, Human
auuguugaaaaaguuuguuu

SEQ ID NO: 3513911 - RNA, 19 nt, Human
auuguugacaacugugacu

SEQ ID NO: 3513912 - RNA, 18 nt, Human
auuguugacaguucugaa

SEQ ID NO: 3513913 - RNA, 21 nt, Human
auuguugagguggucugaaug

SEQ ID NO: 3513914 - RNA, 22 nt, Human
auuguugagguggucugaaugu

SEQ ID NO: 3513915 - RNA, 12 nt, Human
auuguugcauua

SEQ ID NO: 3513916 - RNA, 16 nt, Human
auuguugcugaaacuu

SEQ ID NO: 3513917 - RNA, 16 nt, Human
auuguugucugcaacu

SEQ ID NO: 3513918 - RNA, 13 nt, Human
auuguuguucugu

SEQ ID NO: 3513919 - RNA, 18 nt, Human
auuguuguucuguuaacu

SEQ ID NO: 3513920 - RNA, 21 nt, Human
auuguuguucuguuaacugaa

SEQ ID NO: 3513921 - RNA, 12 nt, Human
auuguuguuucu

SEQ ID NO: 3513922 - RNA, 14 nt, Human
auuguuguuucuuu

SEQ ID NO: 3513923 - RNA, 16 nt, Human
auuguuguuucuuucu

SEQ ID NO: 3513924 - RNA, 14 nt, Human
auuguuuaaaaacc

SEQ ID NO: 3513925 - RNA, 15 nt, Human
auuguuuaaaaugua

SEQ ID NO: 3513926 - RNA, 16 nt, Human
auuguuuaaagcaacu

SEQ ID NO: 3513927 - RNA, 22 nt, Human
auuguuuaaagcaacugucuau

SEQ ID NO: 3513928 - RNA, 16 nt, Human
auuguuuaucuagaug

SEQ ID NO: 3513929 - RNA, 12 nt, Human
auuguuuaugua

SEQ ID NO: 3513930 - RNA, 21 nt, Human
auuguuuauuuaucagugaca

SEQ ID NO: 3513931 - RNA, 19 nt, Human
auuguuucaaaauaaaaac

SEQ ID NO: 3513932 - RNA, 13 nt, Human
auuguuucaauug

SEQ ID NO: 3513933 - RNA, 22 nt, Human
auuguuucaauugcaucuccca

SEQ ID NO: 3513934 - RNA, 13 nt, Human
auuguuucagaau

SEQ ID NO: 3513935 - RNA, 17 nt, Human
auuguuuccucuuccaa

SEQ ID NO: 3513936 - RNA, 12 nt, Human
auuguuucugca

SEQ ID NO: 3513937 - RNA, 13 nt, Human
auuguuugaaaca

SEQ ID NO: 3513938 - RNA, 16 nt, Human
auuguuugcuuauugu

SEQ ID NO: 3513939 - RNA, 18 nt, Human
auuguuugcuuauuguuc

SEQ ID NO: 3513940 - RNA, 23 nt, Human
auuguuugcuuauuguuccaaga

SEQ ID NO: 3513941 - RNA, 20 nt, Human
auuguuuggcuuccuccuga

SEQ ID NO: 3513942 - RNA, 21 nt, Human
auuguuugggauccuauugaa

SEQ ID NO: 3513943 - RNA, 20 nt, Human
auuguuuuaaucugaaauuc

SEQ ID NO: 3513944 - RNA, 15 nt, Human
auuguuuuacaauag

SEQ ID NO: 3513945 - RNA, 10 nt, Human
auuguuuuca

SEQ ID NO: 3513946 - RNA, 17 nt, Human
auuguuuucaguguaca

SEQ ID NO: 3513947 - RNA, 15 nt, Human
auuguuuucuauuua

SEQ ID NO: 3513948 - RNA, 21 nt, Human
auuguuuucuauuuaugccuu

SEQ ID NO: 3513949 - RNA, 22 nt, Human
auuguuuucuauuuaugccuug

SEQ ID NO: 3513950 - RNA, 19 nt, Human
auuguuuucuuuaaagaug

SEQ ID NO: 3513951 - RNA, 19 nt, Human
auuguuuucuuuuucuacc

SEQ ID NO: 3513952 - RNA, 22 nt, Human
auuguuuugaauauuacuccua

SEQ ID NO: 3513953 - RNA, 18 nt, Human
auuguuuugccaacauug

SEQ ID NO: 3513954 - RNA, 11 nt, Human
auuguuuuucu

SEQ ID NO: 3513955 - RNA, 16 nt, Human
auuguuuuuuaucuuu

SEQ ID NO: 3513956 - RNA, 14 nt, Human
auuuaaaaaaauca

SEQ ID NO: 3513957 - RNA, 16 nt, Human
auuuaaaaaaaucaca

SEQ ID NO: 3513958 - RNA, 17 nt, Human
auuuaaaaaacuaaaaa

SEQ ID NO: 3513959 - RNA, 22 nt, Human
auuuaaaaaacuaaaaacuaga

SEQ ID NO: 3513960 - RNA, 12 nt, Human
auuuaaaaauaa

SEQ ID NO: 3513961 - RNA, 12 nt, Human
auuuaaaaaugu

SEQ ID NO: 3513962 - RNA, 14 nt, Human
auuuaaaaaugucu

SEQ ID NO: 3513963 - RNA, 12 nt, Human
auuuaaaacaaa

SEQ ID NO: 3513964 - RNA, 18 nt, Human
auuuaaaacagacacugg

SEQ ID NO: 3513965 - RNA, 13 nt, Human
auuuaaaacauua

SEQ ID NO: 3513966 - RNA, 19 nt, Human
auuuaaaacauuaaaauau

SEQ ID NO: 3513967 - RNA, 14 nt, Human
auuuaaaagacagc

SEQ ID NO: 3513968 - RNA, 17 nt, Human
auuuaaaagacagcuuu

SEQ ID NO: 3513969 - RNA, 19 nt, Human
auuuaaaagauucauuuuu

SEQ ID NO: 3513970 - RNA, 14 nt, Human
auuuaaaagccugc

SEQ ID NO: 3513971 - RNA, 15 nt, Human
auuuaaaagggaagu

SEQ ID NO: 3513972 - RNA, 22 nt, Human
auuuaaaauagcaaaagaagaa

SEQ ID NO: 3513973 - RNA, 14 nt, Human
auuuaaaaugauua

SEQ ID NO: 3513974 - RNA, 21 nt, Human
auuuaaaauguguuucuuaca

SEQ ID NO: 3513975 - RNA, 17 nt, Human
auuuaaaauugcuaugu

SEQ ID NO: 3513976 - RNA, 21 nt, Human
auuuaaaauugcuauguuacu

SEQ ID NO: 3513977 - RNA, 14 nt, Human
auuuaaacacacag

SEQ ID NO: 3513978 - RNA, 11 nt, Human
auuuaaacaga

SEQ ID NO: 3513979 - RNA, 12 nt, Human
auuuaaacagau

SEQ ID NO: 3513980 - RNA, 15 nt, Human
auuuaaacagcagug

SEQ ID NO: 3513981 - RNA, 15 nt, Human
auuuaaacaggccca

SEQ ID NO: 3513982 - RNA, 18 nt, Human
auuuaaacaggcccagca

SEQ ID NO: 3513983 - RNA, 20 nt, Human
auuuaaaccgcuaaaagaaa

SEQ ID NO: 3513984 - RNA, 14 nt, Human
auuuaaaccuuuua

SEQ ID NO: 3513985 - RNA, 15 nt, Human
auuuaaacucugaau

SEQ ID NO: 3513986 - RNA, 18 nt, Human
auuuaaacucugaauuua

SEQ ID NO: 3513987 - RNA, 21 nt, Human
auuuaaacucugaauuuaucu

SEQ ID NO: 3513988 - RNA, 19 nt, Human
auuuaaagaacacccuaua

SEQ ID NO: 3513989 - RNA, 21 nt, Human
auuuaaagacagggaagagca

SEQ ID NO: 3513990 - RNA, 19 nt, Human
auuuaaagauauuguucaa

SEQ ID NO: 3513991 - RNA, 15 nt, Human
auuuaaagccuccuc

SEQ ID NO: 3513992 - RNA, 18 nt, Human
auuuaaaggcccuaucug

SEQ ID NO: 3513993 - RNA, 21 nt, Human
auuuaaaggcuaccuuauugu

SEQ ID NO: 3513994 - RNA, 14 nt, Human
auuuaaaguuguuu

SEQ ID NO: 3513995 - RNA, 20 nt, Human
auuuaaauaucugaacauuu

SEQ ID NO: 3513996 - RNA, 23 nt, Human
auuuaaauaucugaacauuuacu

SEQ ID NO: 3513997 - RNA, 16 nt, Human
auuuaaauauuaaaua

SEQ ID NO: 3513998 - RNA, 13 nt, Human
auuuaaaugaaag

SEQ ID NO: 3513999 - RNA, 24 nt, Human
auuuagggaguauucuaauaagcu

SEQ ID NO: 3514000 - RNA, 22 nt, Human
auuuaggguacuaaauuuaaau

SEQ ID NO: 3514001 - RNA, 14 nt, Human
auuuagguuucuga

SEQ ID NO: 3514002 - RNA, 17 nt, Human
auuuagguuuuuauuag

SEQ ID NO: 3514003 - RNA, 15 nt, Human
auuuaguaaauguua

SEQ ID NO: 3514004 - RNA, 14 nt, Human
auuuaguaagaaua

SEQ ID NO: 3514005 - RNA, 21 nt, Human
auuuaguaggugaguuuucac

SEQ ID NO: 3514006 - RNA, 20 nt, Human
auuuaguaucuuuuuauuca

SEQ ID NO: 3514007 - RNA, 13 nt, Human
auuuagucucuuu

SEQ ID NO: 3514008 - RNA, 16 nt, Human
auuuagucucuuuauu

SEQ ID NO: 3514009 - RNA, 20 nt, Human
auuuagugaaagcuagagau

SEQ ID NO: 3514010 - RNA, 21 nt, Human
auuuagugaguuauuccuuga

SEQ ID NO: 3514011 - RNA, 16 nt, Human
auuuaguguucauaaa

SEQ ID NO: 3514012 - RNA, 17 nt, Human
auuuaguguucauaaau

SEQ ID NO: 3514013 - RNA, 21 nt, Human
auuuaguguuuuuaccucugu

SEQ ID NO: 3514014 - RNA, 13 nt, Human
auuuaguuauagu

SEQ ID NO: 3514015 - RNA, 14 nt, Human
auuuaguuauaguu

SEQ ID NO: 3514016 - RNA, 16 nt, Human
auuuaguucuuuguua

SEQ ID NO: 3514017 - RNA, 15 nt, Human
auuuaguuguuguag

SEQ ID NO: 3514018 - RNA, 19 nt, Human
auuuaguuguuguagagaa

SEQ ID NO: 3514019 - RNA, 20 nt, Human
auuuaguuguuguagagaaa

SEQ ID NO: 3514020 - RNA, 12 nt, Human
auuuaguuucag

SEQ ID NO: 3514021 - RNA, 14 nt, Human
auuuaguuucagua

SEQ ID NO: 3514022 - RNA, 20 nt, Human
auuuaguuucaguagauugc

SEQ ID NO: 3514023 - RNA, 22 nt, Human
auuuauaaaaauaaaaaacacu

SEQ ID NO: 3514024 - RNA, 19 nt, Human
auuuauaaaauuagaaagc

SEQ ID NO: 3514025 - RNA, 22 nt, Human
auaauuaucggaagcagugccu

SEQ ID NO: 3514026 - RNA, 21 nt, Human
auaauuaugaguuugcuuaug

SEQ ID NO: 3514027 - RNA, 22 nt, Human
auaauuauguuauugaaaaaaa

SEQ ID NO: 3514028 - RNA, 23 nt, Human
auaauuauguuauugaaaaaaau

SEQ ID NO: 3514029 - RNA, 22 nt, Human
auaauuauuuauuacauaauuu

SEQ ID NO: 3514030 - RNA, 18 nt, Human
auaauuauuuauuuaaua

SEQ ID NO: 3514031 - RNA, 19 nt, Human
auaauuauuugucucagau

SEQ ID NO: 3514032 - RNA, 18 nt, Human
auaauucacucaagcacu

SEQ ID NO: 3514033 - RNA, 22 nt, Human
auaauucacuguacuaucaggu

SEQ ID NO: 3514034 - RNA, 20 nt, Human
auaauucaguauguuuuaca

SEQ ID NO: 3514035 - RNA, 16 nt, Human
auaauucuaaaucccu

SEQ ID NO: 3514036 - RNA, 22 nt, Human
auaauucugaaguuauauuucc

SEQ ID NO: 3514037 - RNA, 15 nt, Human
auaauucuggagaua

SEQ ID NO: 3514038 - RNA, 19 nt, Human
auaauucugggaagcaaaa

SEQ ID NO: 3514039 - RNA, 11 nt, Human
auaauucugua

SEQ ID NO: 3514040 - RNA, 12 nt, Human
auaauucuguaa

SEQ ID NO: 3514041 - RNA, 13 nt, Human
auaauucuguaaa

SEQ ID NO: 3514042 - RNA, 14 nt, Human
auaauucuguaaau

SEQ ID NO: 3514043 - RNA, 13 nt, Human
auaauucuguaca

SEQ ID NO: 3514044 - RNA, 16 nt, Human
auaauucuuauuuugu

SEQ ID NO: 3514045 - RNA, 15 nt, Human
auaauucuuucaaua

SEQ ID NO: 3514046 - RNA, 14 nt, Human
auaauucuuuuuua

SEQ ID NO: 3514047 - RNA, 17 nt, Human
auaauucuuuuuuauua

SEQ ID NO: 3514048 - RNA, 14 nt, Human
auaauugaucaaau

SEQ ID NO: 3514049 - RNA, 14 nt, Human
auaauugcauugac

SEQ ID NO: 3514050 - RNA, 19 nt, Human
auaauugcucauaagcaau

SEQ ID NO: 3514051 - RNA, 17 nt, Human
auaauuggauuuccuaa

SEQ ID NO: 3514052 - RNA, 15 nt, Human
auaauuguacaaaau

SEQ ID NO: 3514053 - RNA, 21 nt, Human
auaauuguacaaaauuaagca

SEQ ID NO: 3514054 - RNA, 13 nt, Human
auaauuguaucgu

SEQ ID NO: 3514055 - RNA, 18 nt, Human
auaauuguugaaauuuug

SEQ ID NO: 3514056 - RNA, 22 nt, Human
auaauuguugaaauuuugcaaa

SEQ ID NO: 3514057 - RNA, 17 nt, Human
auaauuguuguucuguu

SEQ ID NO: 3514058 - RNA, 21 nt, Human
auaauuuaaaaauauauuuau

SEQ ID NO: 3514059 - RNA, 23 nt, Human
auaauuuaacuacccuuaauuac

SEQ ID NO: 3514060 - RNA, 12 nt, Human
auaauuuaagag

SEQ ID NO: 3514061 - RNA, 15 nt, Human
auaauuuaaugcaug

SEQ ID NO: 3514062 - RNA, 22 nt, Human
auaauuucccaauuaggaagug

SEQ ID NO: 3514063 - RNA, 14 nt, Human
auaauuucuaaugu

SEQ ID NO: 3514064 - RNA, 14 nt, Human
auaauuuguuucca

SEQ ID NO: 3514065 - RNA, 15 nt, Human
auaauuuuaaaaaug

SEQ ID NO: 3514066 - RNA, 16 nt, Human
auaauuuuaaaaaugg

SEQ ID NO: 3514067 - RNA, 14 nt, Human
auaauuuuaaaugu

SEQ ID NO: 3514068 - RNA, 13 nt, Human
auaauuuuaagau

SEQ ID NO: 3514069 - RNA, 15 nt, Human
auaauuuuaugaaug

SEQ ID NO: 3514070 - RNA, 22 nt, Human
auaauuuuccuuuaauaugaaa

SEQ ID NO: 3514071 - RNA, 13 nt, Human
auaauuuugauag

SEQ ID NO: 3514072 - RNA, 16 nt, Human
auaauuuugcauaaaa

SEQ ID NO: 3514073 - RNA, 13 nt, Human
auaauuuugcugg

SEQ ID NO: 3514074 - RNA, 14 nt, Human
auaauuuuuauauu

SEQ ID NO: 3514075 - RNA, 21 nt, Human
auaauuuuuauauuugaaaua

SEQ ID NO: 3514076 - RNA, 13 nt, Human
auaauuuuuugua

SEQ ID NO: 3514077 - RNA, 20 nt, Human
auaauuuuuuucaauauuua

SEQ ID NO: 3514078 - RNA, 14 nt, Human
auacaaaaagaaaa

SEQ ID NO: 3514079 - RNA, 12 nt, Human
auacaaaagcau

SEQ ID NO: 3514080 - RNA, 16 nt, Human
auacaaacaauggaaa

SEQ ID NO: 3514081 - RNA, 18 nt, Human
auacaaacaauggaaacu

SEQ ID NO: 3514082 - RNA, 16 nt, Human
auacaaauauauuguu

SEQ ID NO: 3514083 - RNA, 20 nt, Human
auacaaaugcaucuuugaug

SEQ ID NO: 3514084 - RNA, 21 nt, Human
auacaaaugcaucuuugaugu

SEQ ID NO: 3514085 - RNA, 17 nt, Human
auacaaauggauuuugg

SEQ ID NO: 3514086 - RNA, 18 nt, Human
auacaaauuagaaaaugu

SEQ ID NO: 3514087 - RNA, 12 nt, Human
auacaacaaagg

SEQ ID NO: 3514088 - RNA, 15 nt, Human
auacaacacaaagag

SEQ ID NO: 3514089 - RNA, 20 nt, Human
auacaacagugcuaaaaaug

SEQ ID NO: 3514090 - RNA, 18 nt, Human
auacaaccuucauuuaaa

SEQ ID NO: 3514091 - RNA, 19 nt, Human
auacaaguucuuggucccu

SEQ ID NO: 3514092 - RNA, 10 nt, Human
auacaauaaa

SEQ ID NO: 3514093 - RNA, 21 nt, Human
auacaauaaacuauuggaaag

SEQ ID NO: 3514094 - RNA, 15 nt, Human
auacaauacauagga

SEQ ID NO: 3514095 - RNA, 15 nt, Human
auacaauauauaaaa

SEQ ID NO: 3514096 - RNA, 13 nt, Human
auacaaucagcug

SEQ ID NO: 3514097 - RNA, 18 nt, Human
auacaaugaacacuuaua

SEQ ID NO: 3514098 - RNA, 22 nt, Human
auacaaugaugcuauuugcaau

SEQ ID NO: 3514099 - RNA, 18 nt, Human
auacaauguauuuauuua

SEQ ID NO: 3514100 - RNA, 21 nt, Human
auacaauguauuuauuuaaaa

SEQ ID NO: 3514101 - RNA, 15 nt, Human
auacaauucuacauu

SEQ ID NO: 3514102 - RNA, 14 nt, Human
auacaauuuuguuu

SEQ ID NO: 3514103 - RNA, 18 nt, Human
auacaauuuuguuucugu

SEQ ID NO: 3514104 - RNA, 20 nt, Human
auacaauuuuguuucuguac

SEQ ID NO: 3514105 - RNA, 18 nt, Human
auacaauuuuuauuucuu

SEQ ID NO: 3514106 - RNA, 14 nt, Human
auacacaaaaucaa

SEQ ID NO: 3514107 - RNA, 16 nt, Human
auacacaaaaucaaau

SEQ ID NO: 3514108 - RNA, 11 nt, Human
auacacacaca

SEQ ID NO: 3514109 - RNA, 14 nt, Human
auacacacacacac

SEQ ID NO: 3514110 - RNA, 18 nt, Human
auacacacacacacacag

SEQ ID NO: 3514111 - RNA, 20 nt, Human
auacacacacacacacagcc

SEQ ID NO: 3514112 - RNA, 14 nt, Human
auacacacgcugcc

SEQ ID NO: 3514113 - RNA, 18 nt, Human
auacacacucaaaucaag

SEQ ID NO: 3514114 - RNA, 20 nt, Human
auacacacucaaaucaagaa

SEQ ID NO: 3514115 - RNA, 14 nt, Human
auacacaggauccu

SEQ ID NO: 3514116 - RNA, 21 nt, Human
auacacauauaccuauaaugu

SEQ ID NO: 3514117 - RNA, 15 nt, Human
auacacauauagugu

SEQ ID NO: 3514118 - RNA, 14 nt, Human
auacacauuugcua

SEQ ID NO: 3514119 - RNA, 20 nt, Human
auacaccaccucacuccugu

SEQ ID NO: 3514120 - RNA, 19 nt, Human
auacaccacuacauucugu

SEQ ID NO: 3514121 - RNA, 21 nt, Human
auacaccacuacauucuguua

SEQ ID NO: 3514122 - RNA, 22 nt, Human
auacacccccucuucugagcac

SEQ ID NO: 3514123 - RNA, 21 nt, Human
auacacuaugaagauguuuca

SEQ ID NO: 3514124 - RNA, 20 nt, Human
auacacuguauguuauagaa

SEQ ID NO: 3514125 - RNA, 11 nt, Human
auacacugugu

SEQ ID NO: 3514126 - RNA, 19 nt, Human
auacacuuggaguuugcau

SEQ ID NO: 3514127 - RNA, 17 nt, Human
auacacuuguauaaaug

SEQ ID NO: 3514128 - RNA, 18 nt, Human
auacacuuguauaaaugu

SEQ ID NO: 3514129 - RNA, 20 nt, Human
auacacuugugauuauaaaa

SEQ ID NO: 3514130 - RNA, 17 nt, Human
auacacuuuguugcaag

SEQ ID NO: 3514131 - RNA, 13 nt, Human
auacagaaaaguu

SEQ ID NO: 3514132 - RNA, 15 nt, Human
auacagaacucuuuc

SEQ ID NO: 3514133 - RNA, 20 nt, Human
auacagaacucuuucaaaac

SEQ ID NO: 3514134 - RNA, 23 nt, Human
auacagaacucuuucaaaaccuu

SEQ ID NO: 3514135 - RNA, 22 nt, Human
auacagaauugugucugcagga

SEQ ID NO: 3514136 - RNA, 14 nt, Human
auacagacacuaag

SEQ ID NO: 3514137 - RNA, 19 nt, Human
auacagacacuaaguuaua

SEQ ID NO: 3514138 - RNA, 23 nt, Human
auacagacacuaaguuauaguau

SEQ ID NO: 3514139 - RNA, 12 nt, Human
auacagaggaaa

SEQ ID NO: 3514140 - RNA, 21 nt, Human
auacagaggaaaucuguaaca

SEQ ID NO: 3514141 - RNA, 17 nt, Human
auacagaggcaacugca

SEQ ID NO: 3514142 - RNA, 16 nt, Human
auacagaugaaaauuu

SEQ ID NO: 3514143 - RNA, 17 nt, Human
auacagauuuugauagc

SEQ ID NO: 3514144 - RNA, 16 nt, Human
auuuaaacagcagugu

SEQ ID NO: 3514145 - RNA, 19 nt, Human
auuuaaacaggcccagcau

SEQ ID NO: 3514146 - RNA, 13 nt, Human
auuuaaacccauu

SEQ ID NO: 3514147 - RNA, 20 nt, Human
auuuaaacccauuuuaguca

SEQ ID NO: 3514148 - RNA, 22 nt, Human
auuuaaaccgcuaaaagaaacu

SEQ ID NO: 3514149 - RNA, 19 nt, Human
auuuaaacuauaagcaaga

SEQ ID NO: 3514150 - RNA, 20 nt, Human
auuuaaacuauaagcaagaa

SEQ ID NO: 3514151 - RNA, 16 nt, Human
auuuaaacuaucuugu

SEQ ID NO: 3514152 - RNA, 18 nt, Human
auuuaaacucaagacaau

SEQ ID NO: 3514153 - RNA, 19 nt, Human
auuuaaagaaaaaaauguc

SEQ ID NO: 3514154 - RNA, 19 nt, Human
auuuaaagcagguucuugu

SEQ ID NO: 3514155 - RNA, 21 nt, Human
auuuaaagcauugcuguuaug

SEQ ID NO: 3514156 - RNA, 16 nt, Human
auuuaaagcauugcuu

SEQ ID NO: 3514157 - RNA, 20 nt, Human
auuuaaaggcccuaucuguu

SEQ ID NO: 3514158 - RNA, 17 nt, Human
auuuaaagggaaauuga

SEQ ID NO: 3514159 - RNA, 18 nt, Human
auuuaaauauaauucugu

SEQ ID NO: 3514160 - RNA, 20 nt, Human
auuuaaauauaauucuguaa

SEQ ID NO: 3514161 - RNA, 23 nt, Human
auuuaaauauaauucuguaaaug

SEQ ID NO: 3514162 - RNA, 13 nt, Human
auuuaaaucuguu

SEQ ID NO: 3514163 - RNA, 16 nt, Human
auuuaaauucuuuuuu

SEQ ID NO: 3514164 - RNA, 16 nt, Human
auuuaaauuuaaguaa

SEQ ID NO: 3514165 - RNA, 20 nt, Human
auuuaacaaugcgaauggua

SEQ ID NO: 3514166 - RNA, 13 nt, Human
auuuaacagaaau

SEQ ID NO: 3514167 - RNA, 14 nt, Human
auuuaacagaaaug

SEQ ID NO: 3514168 - RNA, 20 nt, Human
auuuaacagaaauguacagc

SEQ ID NO: 3514169 - RNA, 16 nt, Human
auuuaacagaaauugu

SEQ ID NO: 3514170 - RNA, 15 nt, Human
auuuaacagcugaau

SEQ ID NO: 3514171 - RNA, 21 nt, Human
auuuaacagcugaauuaucua

SEQ ID NO: 3514172 - RNA, 15 nt, Human
auuuaacauuauuua

SEQ ID NO: 3514173 - RNA, 14 nt, Human
auuuaacccagcuc

SEQ ID NO: 3514174 - RNA, 16 nt, Human
auuuaaccccccugua

SEQ ID NO: 3514175 - RNA, 23 nt, Human
auuuaaccccccuguacacaacu

SEQ ID NO: 3514176 - RNA, 18 nt, Human
auuuaacuacccuuaauu

SEQ ID NO: 3514177 - RNA, 19 nt, Human
auuuaacuacccuuaauua

SEQ ID NO: 3514178 - RNA, 13 nt, Human
auuuaacugaaga

SEQ ID NO: 3514179 - RNA, 22 nt, Human
auuuaacuggugcacuuuguaa

SEQ ID NO: 3514180 - RNA, 23 nt, Human
auuuaacuggugcacuuuguaaa

SEQ ID NO: 3514181 - RNA, 17 nt, Human
auuuaacuugagcuuua

SEQ ID NO: 3514182 - RNA, 21 nt, Human
auuuaacuugaggguaauaaa

SEQ ID NO: 3514183 - RNA, 22 nt, Human
auuuaacuugaggguaauaaac

SEQ ID NO: 3514184 - RNA, 21 nt, Human
auuuaagaaaauacaauaaac

SEQ ID NO: 3514185 - RNA, 15 nt, Human
auuuaagauaauuau

SEQ ID NO: 3514186 - RNA, 13 nt, Human
auuuaagauguga

SEQ ID NO: 3514187 - RNA, 15 nt, Human
auuuaagaugugaaa

SEQ ID NO: 3514188 - RNA, 16 nt, Human
auuuaagcaacaucuu

SEQ ID NO: 3514189 - RNA, 15 nt, Human
auuuaagcauuguuu

SEQ ID NO: 3514190 - RNA, 22 nt, Human
auuuaagccuaaagauuuugau

SEQ ID NO: 3514191 - RNA, 16 nt, Human
auuuaagcuuuccugu

SEQ ID NO: 3514192 - RNA, 14 nt, Human
auuuaagggaaaaa

SEQ ID NO: 3514193 - RNA, 18 nt, Human
auuuaagggaaaaauaua

SEQ ID NO: 3514194 - RNA, 17 nt, Human
auuuaagggaaagaaaa

SEQ ID NO: 3514195 - RNA, 19 nt, Human
auuuaagggaaagaaaaug

SEQ ID NO: 3514196 - RNA, 23 nt, Human
auuuaagggggaaaaagugucaa

SEQ ID NO: 3514197 - RNA, 20 nt, Human
auuuaaguuuugacaagcug

SEQ ID NO: 3514198 - RNA, 16 nt, Human
auuuaauaaaaaaaca

SEQ ID NO: 3514199 - RNA, 19 nt, Human
auuuaauaaaauaauucua

SEQ ID NO: 3514200 - RNA, 16 nt, Human
auuuaauaaaugugcc

SEQ ID NO: 3514201 - RNA, 13 nt, Human
auuuaauacagca

SEQ ID NO: 3514202 - RNA, 17 nt, Human
auuuaauagcaaagaau

SEQ ID NO: 3514203 - RNA, 14 nt, Human
auuuaauaguguua

SEQ ID NO: 3514204 - RNA, 23 nt, Human
auuuaauauaaaguuuuauauau

SEQ ID NO: 3514205 - RNA, 14 nt, Human
auuuaauauagcua

SEQ ID NO: 3514206 - RNA, 19 nt, Human
auuuaauauagcuauuuuu

SEQ ID NO: 3514207 - RNA, 14 nt, Human
auuuaauaugcaaa

SEQ ID NO: 3514208 - RNA, 15 nt, Human
auuuaauaugcaaag

SEQ ID NO: 3514209 - RNA, 14 nt, Human
auuuaauauuacag

SEQ ID NO: 3514210 - RNA, 16 nt, Human
auuuaauauuuacucu

SEQ ID NO: 3514211 - RNA, 15 nt, Human
auuuaauauuuugca

SEQ ID NO: 3514212 - RNA, 21 nt, Human
auuuaaugaaagacuguacaa

SEQ ID NO: 3514213 - RNA, 17 nt, Human
auuuaauggggaggaca

SEQ ID NO: 3514214 - RNA, 15 nt, Human
auuuaaugugaguuu

SEQ ID NO: 3514215 - RNA, 19 nt, Human
auuuaauguugaacaaaau

SEQ ID NO: 3514216 - RNA, 18 nt, Human
auuuaauguuuuaaaugu

SEQ ID NO: 3514217 - RNA, 20 nt, Human
auuuaauguuuuaaauguac

SEQ ID NO: 3514218 - RNA, 23 nt, Human
auuuaauguuuuaaauguacaga

SEQ ID NO: 3514219 - RNA, 19 nt, Human
auuuaauuaaucaugaaug

SEQ ID NO: 3514220 - RNA, 15 nt, Human
auuuaauuagugcua

SEQ ID NO: 3514221 - RNA, 20 nt, Human
auuuaauuagugcuaagugu

SEQ ID NO: 3514222 - RNA, 23 nt, Human
auuuaauuagugcuaagugugaa

SEQ ID NO: 3514223 - RNA, 15 nt, Human
auuuaauucauguuu

SEQ ID NO: 3514224 - RNA, 17 nt, Human
auuuaauucauguuucu

SEQ ID NO: 3514225 - RNA, 16 nt, Human
auuuaauucucuugaa

SEQ ID NO: 3514226 - RNA, 16 nt, Human
auuuaauuguaaacug

SEQ ID NO: 3514227 - RNA, 17 nt, Human
auuuaauuguaaacugu

SEQ ID NO: 3514228 - RNA, 12 nt, Human
auuuaauuucca

SEQ ID NO: 3514229 - RNA, 15 nt, Human
auuuaauuugaaggu

SEQ ID NO: 3514230 - RNA, 17 nt, Human
auuuaauuugccaaaau

SEQ ID NO: 3514231 - RNA, 17 nt, Human
auagguccuuuagaaac

SEQ ID NO: 3514232 - RNA, 15 nt, Human
auaggucucuucucc

SEQ ID NO: 3514233 - RNA, 17 nt, Human
auaggucucuucuccca

SEQ ID NO: 3514234 - RNA, 15 nt, Human
auaggucugaaauuu

SEQ ID NO: 3514235 - RNA, 15 nt, Human
auaggugcuacaaaa

SEQ ID NO: 3514236 - RNA, 13 nt, Human
auagguggccucu

SEQ ID NO: 3514237 - RNA, 21 nt, Human
auagguuaaaaaaaaaaguca

SEQ ID NO: 3514238 - RNA, 12 nt, Human
auagguuauuuu

SEQ ID NO: 3514239 - RNA, 18 nt, Human
auagguuguaaauguguu

SEQ ID NO: 3514240 - RNA, 12 nt, Human
auagguuuagag

SEQ ID NO: 3514241 - RNA, 12 nt, Human
auagguuucuaa

SEQ ID NO: 3514242 - RNA, 14 nt, Human
auagguuuggacaa

SEQ ID NO: 3514243 - RNA, 17 nt, Human
auagguuuuguuugcua

SEQ ID NO: 3514244 - RNA, 13 nt, Human
auaguaaaaauaa

SEQ ID NO: 3514245 - RNA, 14 nt, Human
auaguaaaaauaaa

SEQ ID NO: 3514246 - RNA, 18 nt, Human
auaguaaaagauaacaag

SEQ ID NO: 3514247 - RNA, 19 nt, Human
auaguaaaucacgcuuuuu

SEQ ID NO: 3514248 - RNA, 14 nt, Human
auaguaaauguagu

SEQ ID NO: 3514249 - RNA, 16 nt, Human
auaguaaauguaguuc

SEQ ID NO: 3514250 - RNA, 19 nt, Human
auaguaacugacaugauua

SEQ ID NO: 3514251 - RNA, 13 nt, Human
auaguaagauuga

SEQ ID NO: 3514252 - RNA, 13 nt, Human
auaguaagcauag

SEQ ID NO: 3514253 - RNA, 23 nt, Human
auaguaaugaguuuaaaaaucaa

SEQ ID NO: 3514254 - RNA, 14 nt, Human
auaguaauuuguaa

SEQ ID NO: 3514255 - RNA, 16 nt, Human
auaguaauuuguaaag

SEQ ID NO: 3514256 - RNA, 19 nt, Human
auaguaccauuuauacaaa

SEQ ID NO: 3514257 - RNA, 14 nt, Human
auaguaccuuugcu

SEQ ID NO: 3514258 - RNA, 22 nt, Human
auaguacuagagauauuuugua

SEQ ID NO: 3514259 - RNA, 22 nt, Human
auaguagagugauauggagcaa

SEQ ID NO: 3514260 - RNA, 22 nt, Human
auaguagauguggccuuugaau

SEQ ID NO: 3514261 - RNA, 15 nt, Human
auaguagcauacauu

SEQ ID NO: 3514262 - RNA, 17 nt, Human
auaguauaucuggacaa

SEQ ID NO: 3514263 - RNA, 17 nt, Human
auaguauauuaaaaaug

SEQ ID NO: 3514264 - RNA, 16 nt, Human
auaguaugguggcugg

SEQ ID NO: 3514265 - RNA, 22 nt, Human
auaguauuccauugugugagug

SEQ ID NO: 3514266 - RNA, 14 nt, Human
auaguauuugaaaa

SEQ ID NO: 3514267 - RNA, 18 nt, Human
auaguauuugaaaacaga

SEQ ID NO: 3514268 - RNA, 19 nt, Human
auaguauuugaaaacagaa

SEQ ID NO: 3514269 - RNA, 20 nt, Human
auaguauuugagaguucuaa

SEQ ID NO: 3514270 - RNA, 23 nt, Human
auaguauuugagaguucuaaauu

SEQ ID NO: 3514271 - RNA, 21 nt, Human
auaguauuugauucaaaauau

SEQ ID NO: 3514272 - RNA, 21 nt, Human
auagucaagaaaaauuauugu

SEQ ID NO: 3514273 - RNA, 16 nt, Human
auagucaccuuuuaaa

SEQ ID NO: 3514274 - RNA, 23 nt, Human
auagucaccuuuuaaauccuguu

SEQ ID NO: 3514275 - RNA, 16 nt, Human
auagucauuccaaaua

SEQ ID NO: 3514276 - RNA, 17 nt, Human
auaguccagcuuuguuc

SEQ ID NO: 3514277 - RNA, 17 nt, Human
auagucuaguguaguau

SEQ ID NO: 3514278 - RNA, 14 nt, Human
auagucucuuuaaa

SEQ ID NO: 3514279 - RNA, 16 nt, Human
auagucuuuugcuuuu

SEQ ID NO: 3514280 - RNA, 14 nt, Human
auagugacgauacu

SEQ ID NO: 3514281 - RNA, 15 nt, Human
auagugaucaagaag

SEQ ID NO: 3514282 - RNA, 20 nt, Human
auagugcaacuaugaaugua

SEQ ID NO: 3514283 - RNA, 18 nt, Human
auagugcaauauauuuug

SEQ ID NO: 3514284 - RNA, 15 nt, Human
auagugcacaaaaug

SEQ ID NO: 3514285 - RNA, 14 nt, Human
auagugcuaacaug

SEQ ID NO: 3514286 - RNA, 19 nt, Human
auagugcuaacaugaagac

SEQ ID NO: 3514287 - RNA, 15 nt, Human
auagugcuauauaua

SEQ ID NO: 3514288 - RNA, 20 nt, Human
auagugcucgcuuucuaugu

SEQ ID NO: 3514289 - RNA, 22 nt, Human
auuuuaugguuauguuuuucug

SEQ ID NO: 3514290 - RNA, 18 nt, Human
auuuuauguaaaauuuug

SEQ ID NO: 3514291 - RNA, 14 nt, Human
auuuuauguauguu

SEQ ID NO: 3514292 - RNA, 22 nt, Human
auuuuauguauguuuacacugu

SEQ ID NO: 3514293 - RNA, 23 nt, Human
auuuuauguauguuuacacuguc

SEQ ID NO: 3514294 - RNA, 13 nt, Human
auuuuaugucuuu

SEQ ID NO: 3514295 - RNA, 18 nt, Human
auuuuauguuauauauaa

SEQ ID NO: 3514296 - RNA, 18 nt, Human
auuuuauguugacauuug

SEQ ID NO: 3514297 - RNA, 14 nt, Human
auuuuauguugcau

SEQ ID NO: 3514298 - RNA, 15 nt, Human
auuuuauuacuguuu

SEQ ID NO: 3514299 - RNA, 18 nt, Human
auuuuauuacuguuuauu

SEQ ID NO: 3514300 - RNA, 11 nt, Human
auuuuauuaug

SEQ ID NO: 3514301 - RNA, 14 nt, Human
auuuuauuaugaaa

SEQ ID NO: 3514302 - RNA, 18 nt, Human
auuuuauuaugaaacuug

SEQ ID NO: 3514303 - RNA, 12 nt, Human
auuuuauuaugc

SEQ ID NO: 3514304 - RNA, 16 nt, Human
auuuuauuauguaaau

SEQ ID NO: 3514305 - RNA, 17 nt, Human
auuuuauuauguaaauc

SEQ ID NO: 3514306 - RNA, 20 nt, Human
auuuuauuauguaaauccca

SEQ ID NO: 3514307 - RNA, 16 nt, Human
auuuuauucaagguaa

SEQ ID NO: 3514308 - RNA, 23 nt, Human
auuuuauucaagguaaaauucua

SEQ ID NO: 3514309 - RNA, 11 nt, Human
auuuuauucuu

SEQ ID NO: 3514310 - RNA, 15 nt, Human
auuuuauucuugauc

SEQ ID NO: 3514311 - RNA, 14 nt, Human
auuuuauugcuuga

SEQ ID NO: 3514312 - RNA, 22 nt, Human
auuuuauuuaccccuccccuau

SEQ ID NO: 3514313 - RNA, 19 nt, Human
auuuuauuuagacaagaga

SEQ ID NO: 3514314 - RNA, 21 nt, Human
auuuuauuuugugcucauuua

SEQ ID NO: 3514315 - RNA, 17 nt, Human
auuuucaaaaccagguc

SEQ ID NO: 3514316 - RNA, 19 nt, Human
auuuucaaaagauaauauu

SEQ ID NO: 3514317 - RNA, 15 nt, Human
auuuucaaagacuua

SEQ ID NO: 3514318 - RNA, 16 nt, Human
auuuucaagaaacuga

SEQ ID NO: 3514319 - RNA, 21 nt, Human
auuuucaagcagcaucuucug

SEQ ID NO: 3514320 - RNA, 17 nt, Human
auuuucaaggcccucag

SEQ ID NO: 3514321 - RNA, 12 nt, Human
auuuucaaguaa

SEQ ID NO: 3514322 - RNA, 19 nt, Human
auuuucaaguaauugugaa

SEQ ID NO: 3514323 - RNA, 22 nt, Human
auuuucaauucaaaaauguaca

SEQ ID NO: 3514324 - RNA, 20 nt, Human
auuuucacacaauacaauaa

SEQ ID NO: 3514325 - RNA, 15 nt, Human
auuuucacauucuug

SEQ ID NO: 3514326 - RNA, 21 nt, Human
auuuucaccuguuuuuaagcu

SEQ ID NO: 3514327 - RNA, 13 nt, Human
auuuucacuguag

SEQ ID NO: 3514328 - RNA, 14 nt, Human
auuuucagaaaaua

SEQ ID NO: 3514329 - RNA, 21 nt, Human
auuuucagaaucugaauguaa

SEQ ID NO: 3514330 - RNA, 12 nt, Human
auuuucagaccc

SEQ ID NO: 3514331 - RNA, 13 nt, Human
auuuucagagccg

SEQ ID NO: 3514332 - RNA, 12 nt, Human
auuuucagauuu

SEQ ID NO: 3514333 - RNA, 16 nt, Human
auuuucagauuugcac

SEQ ID NO: 3514334 - RNA, 23 nt, Human
auuuucagcaugaaaaugugugu

SEQ ID NO: 3514335 - RNA, 20 nt, Human
auuuucagcauuaagcuguu

SEQ ID NO: 3514336 - RNA, 18 nt, Human
auuuucaguaauguuauu

SEQ ID NO: 3514337 - RNA, 14 nt, Human
auuuucaguauuuu

SEQ ID NO: 3514338 - RNA, 21 nt, Human
auuuucauaacuuauugcuga

SEQ ID NO: 3514339 - RNA, 23 nt, Human
auuuucauaacuuauugcugauu

SEQ ID NO: 3514340 - RNA, 17 nt, Human
auuuucauccuugucuu

SEQ ID NO: 3514341 - RNA, 20 nt, Human
auuuucaugaaaauaccauu

SEQ ID NO: 3514342 - RNA, 19 nt, Human
auuuucaugacuuuuccau

SEQ ID NO: 3514343 - RNA, 13 nt, Human
auuuucauuagca

SEQ ID NO: 3514344 - RNA, 14 nt, Human
auuuucauuuuaca

SEQ ID NO: 3514345 - RNA, 22 nt, Human
auuuuccaaaaguggccucuuu

SEQ ID NO: 3514346 - RNA, 15 nt, Human
auuuuccaagugugc

SEQ ID NO: 3514347 - RNA, 17 nt, Human
auuuuccaagugugcau

SEQ ID NO: 3514348 - RNA, 20 nt, Human
auuuuccacaagauucccag

SEQ ID NO: 3514349 - RNA, 23 nt, Human
auuuuccacaagauucccagaga

SEQ ID NO: 3514350 - RNA, 17 nt, Human
auuuuccagggcaauca

SEQ ID NO: 3514351 - RNA, 22 nt, Human
auuuuccagggcaaucaauguu

SEQ ID NO: 3514352 - RNA, 18 nt, Human
auuuuccaucuaaaaaua

SEQ ID NO: 3514353 - RNA, 20 nt, Human
auuuucccacucauucugaa

SEQ ID NO: 3514354 - RNA, 14 nt, Human
auuuucccacugca

SEQ ID NO: 3514355 - RNA, 15 nt, Human
auuuuccccccacuc

SEQ ID NO: 3514356 - RNA, 20 nt, Human
auuuucccccuuuucugcau

SEQ ID NO: 3514357 - RNA, 17 nt, Human
auuuuccccuaucauuu

SEQ ID NO: 3514358 - RNA, 16 nt, Human
auuuuccuccccagca

SEQ ID NO: 3514359 - RNA, 17 nt, Human
auuuuccuccuuucucu

SEQ ID NO: 3514360 - RNA, 12 nt, Human
auuuuccugaua

SEQ ID NO: 3514361 - RNA, 13 nt, Human
auuuuccugcuuc

SEQ ID NO: 3514362 - RNA, 23 nt, Human
auuuuccuggugccaauuucaag

SEQ ID NO: 3514363 - RNA, 16 nt, Human
auuuuccuguccucuu

SEQ ID NO: 3514364 - RNA, 21 nt, Human
auuuuccuguccucuuucagc

SEQ ID NO: 3514365 - RNA, 15 nt, Human
auuuuccuugaagcc

SEQ ID NO: 3514366 - RNA, 16 nt, Human
auuuucguaugaaaau

SEQ ID NO: 3514367 - RNA, 21 nt, Human
auuuucuaaaagcuuucaugu

SEQ ID NO: 3514368 - RNA, 14 nt, Human
auuuucuaaagacu

SEQ ID NO: 3514369 - RNA, 20 nt, Human
auuuucuaaaguacugagca

SEQ ID NO: 3514370 - RNA, 22 nt, Human
auuuucuaagaaacauuuauau

SEQ ID NO: 3514371 - RNA, 22 nt, Human
auuuucuaagcaauuucuugcu

SEQ ID NO: 3514372 - RNA, 15 nt, Human
auuuucuacaauuaa

SEQ ID NO: 3514373 - RNA, 14 nt, Human
auuuucuacagugg

SEQ ID NO: 3514374 - RNA, 17 nt, Human
auuuucuacguuucuuu

SEQ ID NO: 3514375 - RNA, 19 nt, Human
auuuucuauaauuuaaaua

SEQ ID NO: 3514376 - RNA, 14 nt, Human
auuuucuauguacu

SEQ ID NO: 3514377 - RNA, 19 nt, Human
auuuucuauguacuaguac

SEQ ID NO: 3514378 - RNA, 17 nt, Human
auuuucuccaaauguuc

SEQ ID NO: 3514379 - RNA, 14 nt, Human
auuuucuccagcuc

SEQ ID NO: 3514380 - RNA, 14 nt, Human
auuuucucccugga

SEQ ID NO: 3514381 - RNA, 18 nt, Human
auuuucucccuggauuuu

SEQ ID NO: 3514382 - RNA, 22 nt, Human
auuuucucccuggauuuuuacc

SEQ ID NO: 3514383 - RNA, 22 nt, Human
auuuucucuguguuuguuccua

SEQ ID NO: 3514384 - RNA, 16 nt, Human
auuuucucuuagaaaa

SEQ ID NO: 3514385 - RNA, 16 nt, Human
auuuucugaaacuaau

SEQ ID NO: 3514386 - RNA, 19 nt, Human
auuuucugaaacuaaugaa

SEQ ID NO: 3514387 - RNA, 22 nt, Human
auuuucugaaaguuacccacug

SEQ ID NO: 3514388 - RNA, 16 nt, Human
auuuucugcaagccug

SEQ ID NO: 3514389 - RNA, 19 nt, Human
auuuucugcaucuccacuu

SEQ ID NO: 3514390 - RNA, 19 nt, Human
auuuucuggaauacaugaa

SEQ ID NO: 3514391 - RNA, 18 nt, Human
auuuucuggccaguguuu

SEQ ID NO: 3514392 - RNA, 22 nt, Human
auuuucuggggcuccucacaua

SEQ ID NO: 3514393 - RNA, 17 nt, Human
auuuucugguaaaaaga

SEQ ID NO: 3514394 - RNA, 17 nt, Human
auuuucugguagauaga

SEQ ID NO: 3514395 - RNA, 14 nt, Human
auauaaauucugug

SEQ ID NO: 3514396 - RNA, 16 nt, Human
auauaaauugucuuaa

SEQ ID NO: 3514397 - RNA, 20 nt, Human
auauaaauuuuuaagagaaa

SEQ ID NO: 3514398 - RNA, 12 nt, Human
auauaacaaugc

SEQ ID NO: 3514399 - RNA, 15 nt, Human
auauaacagauacau

SEQ ID NO: 3514400 - RNA, 16 nt, Human
auauaacauauaugga

SEQ ID NO: 3514401 - RNA, 13 nt, Human
auauaacaugaaa

SEQ ID NO: 3514402 - RNA, 16 nt, Human
auauaacaugaaauga

SEQ ID NO: 3514403 - RNA, 23 nt, Human
auauaacccuaacacacacagaa

SEQ ID NO: 3514404 - RNA, 20 nt, Human
auauaacugccuuaaaacuu

SEQ ID NO: 3514405 - RNA, 17 nt, Human
auauaacuguauuugaa

SEQ ID NO: 3514406 - RNA, 20 nt, Human
auauaacuguauuugaaaua

SEQ ID NO: 3514407 - RNA, 21 nt, Human
auauaacuuaaaaauguaaau

SEQ ID NO: 3514408 - RNA, 15 nt, Human
auauaagaaagacau

SEQ ID NO: 3514409 - RNA, 13 nt, Human
auauaagacaaau

SEQ ID NO: 3514410 - RNA, 12 nt, Human
auauaagauuuu

SEQ ID NO: 3514411 - RNA, 22 nt, Human
auauaagcccuugauuggaagg

SEQ ID NO: 3514412 - RNA, 19 nt, Human
auauaagcuuguauuccuu

SEQ ID NO: 3514413 - RNA, 23 nt, Human
auauaaggaaagcaauaaaugaa

SEQ ID NO: 3514414 - RNA, 17 nt, Human
auauaagugcuguauaa

SEQ ID NO: 3514415 - RNA, 15 nt, Human
auauaaguguguguu

SEQ ID NO: 3514416 - RNA, 14 nt, Human
auauaaguuugaag

SEQ ID NO: 3514417 - RNA, 22 nt, Human
auauaauaaaauguguugaaac

SEQ ID NO: 3514418 - RNA, 18 nt, Human
auauaauaaagcuacuga

SEQ ID NO: 3514419 - RNA, 18 nt, Human
auauaauacacaaaauca

SEQ ID NO: 3514420 - RNA, 15 nt, Human
auauaauauauguuu

SEQ ID NO: 3514421 - RNA, 18 nt, Human
auauaauauugucucuuu

SEQ ID NO: 3514422 - RNA, 17 nt, Human
auauaaucaucaaguaa

SEQ ID NO: 3514423 - RNA, 16 nt, Human
auauaauggaagagaa

SEQ ID NO: 3514424 - RNA, 22 nt, Human
auauaauggaagagaaaucuca

SEQ ID NO: 3514425 - RNA, 15 nt, Human
auauaaugguuucaa

SEQ ID NO: 3514426 - RNA, 21 nt, Human
auauaauuaucggaagcagug

SEQ ID NO: 3514427 - RNA, 22 nt, Human
auauaauuccuguuuuuauuau

SEQ ID NO: 3514428 - RNA, 16 nt, Human
auauaauucuguaaau

SEQ ID NO: 3514429 - RNA, 22 nt, Human
auauaauucuguacauagccua

SEQ ID NO: 3514430 - RNA, 12 nt, Human
auauaauucuua

SEQ ID NO: 3514431 - RNA, 15 nt, Human
auauaauugccaaaa

SEQ ID NO: 3514432 - RNA, 18 nt, Human
auauaauuguuuuaucug

SEQ ID NO: 3514433 - RNA, 15 nt, Human
caaaccaccagaagc

SEQ ID NO: 3514434 - RNA, 17 nt, Human
caaaccacgccucuuga

SEQ ID NO: 3514435 - RNA, 19 nt, Human
caaaccacgccucuugacc

SEQ ID NO: 3514436 - RNA, 22 nt, Human
caaaccacgccucuugaccagg

SEQ ID NO: 3514437 - RNA, 17 nt, Human
caaaccacuuuuugcag

SEQ ID NO: 3514438 - RNA, 14 nt, Human
caaaccagcuucau

SEQ ID NO: 3514439 - RNA, 21 nt, Human
caaaccaucauugaaaucuuu

SEQ ID NO: 3514440 - RNA, 17 nt, Human
caaacccacccuuucua

SEQ ID NO: 3514441 - RNA, 21 nt, Human
caaacccaccugcuaguguga

SEQ ID NO: 3514442 - RNA, 21 nt, Human
caaacccacgauuuucuccag

SEQ ID NO: 3514443 - RNA, 23 nt, Human
caaacccacgauuuucuccagcu

SEQ ID NO: 3514444 - RNA, 13 nt, Human
caaacccaguguu

SEQ ID NO: 3514445 - RNA, 19 nt, Human
auauuaaaaagucuuuuaa

SEQ ID NO: 3514446 - RNA, 20 nt, Human
auauuaaaaagucuuuuaaa

SEQ ID NO: 3514447 - RNA, 14 nt, Human
auauuaaaaauaua

SEQ ID NO: 3514448 - RNA, 15 nt, Human
auauuaaaaauauaa

SEQ ID NO: 3514449 - RNA, 23 nt, Human
auauuaaaaauauggaacuucua

SEQ ID NO: 3514450 - RNA, 14 nt, Human
auauuaaaaauggu

SEQ ID NO: 3514451 - RNA, 23 nt, Human
auauuaaaaaugguaaaauugca

SEQ ID NO: 3514452 - RNA, 14 nt, Human
auauuaaaagaaag

SEQ ID NO: 3514453 - RNA, 23 nt, Human
auauuaaaagucacaauguucuu

SEQ ID NO: 3514454 - RNA, 14 nt, Human
auauuaaaauaagc

SEQ ID NO: 3514455 - RNA, 20 nt, Human
auauuaaacaaaguuucaga

SEQ ID NO: 3514456 - RNA, 19 nt, Human
auauuaaaccauaagaugg

SEQ ID NO: 3514457 - RNA, 12 nt, Human
auauuaaauaca

SEQ ID NO: 3514458 - RNA, 13 nt, Human
auauuaaauacag

SEQ ID NO: 3514459 - RNA, 17 nt, Human
auauuaaauacagacac

SEQ ID NO: 3514460 - RNA, 12 nt, Human
auauuaaaucug

SEQ ID NO: 3514461 - RNA, 14 nt, Human
auauuaacaugcuu

SEQ ID NO: 3514462 - RNA, 19 nt, Human
auauuaaccagauauauau

SEQ ID NO: 3514463 - RNA, 17 nt, Human
auauuaagaaagacuau

SEQ ID NO: 3514464 - RNA, 17 nt, Human
auauuaagguaguuauu

SEQ ID NO: 3514465 - RNA, 19 nt, Human
auauuaauaguaauuugua

SEQ ID NO: 3514466 - RNA, 19 nt, Human
auauuaauauauaucugcu

SEQ ID NO: 3514467 - RNA, 14 nt, Human
auauuaauauuccu

SEQ ID NO: 3514468 - RNA, 16 nt, Human
auauuaaugcccagac

SEQ ID NO: 3514469 - RNA, 18 nt, Human
auauuaauguacuuguuu

SEQ ID NO: 3514470 - RNA, 20 nt, Human
auauuaauuuaucagauugc

SEQ ID NO: 3514471 - RNA, 15 nt, Human
auauuaauuuucuac

SEQ ID NO: 3514472 - RNA, 16 nt, Human
auauuacaaaaacaaa

SEQ ID NO: 3514473 - RNA, 17 nt, Human
auauuacaauauuugug

SEQ ID NO: 3514474 - RNA, 12 nt, Human
auauuacaauga

SEQ ID NO: 3514475 - RNA, 23 nt, Human
auauuacacaaauacuuauucau

SEQ ID NO: 3514476 - RNA, 16 nt, Human
auauuacacauuugua

SEQ ID NO: 3514477 - RNA, 15 nt, Human
auauuacacuacaca

SEQ ID NO: 3514478 - RNA, 23 nt, Human
auauuacagauaaaauguaaacu

SEQ ID NO: 3514479 - RNA, 17 nt, Human
auauuaccacagacaua

SEQ ID NO: 3514480 - RNA, 21 nt, Human
auauuacuacuuaccauuugc

SEQ ID NO: 3514481 - RNA, 22 nt, Human
auauuacuccuauuuuuguaaa

SEQ ID NO: 3514482 - RNA, 14 nt, Human
auauuacugacauu

SEQ ID NO: 3514483 - RNA, 16 nt, Human
auauuacugacauuuc

SEQ ID NO: 3514484 - RNA, 17 nt, Human
auauuacugacauuucu

SEQ ID NO: 3514485 - RNA, 17 nt, Human
auauuacuguacauggg

SEQ ID NO: 3514486 - RNA, 11 nt, Human
auauuacuuua

SEQ ID NO: 3514487 - RNA, 19 nt, Human
auauuacuuuaucacuuuu

SEQ ID NO: 3514488 - RNA, 15 nt, Human
auauuagaaaacuuu

SEQ ID NO: 3514489 - RNA, 20 nt, Human
auauuagaaaacuuuguuag

SEQ ID NO: 3514490 - RNA, 18 nt, Human
auauuagaaguguuaacu

SEQ ID NO: 3514491 - RNA, 16 nt, Human
auauuagaugugauuu

SEQ ID NO: 3514492 - RNA, 15 nt, Human
auauuagcauuuagu

SEQ ID NO: 3514493 - RNA, 15 nt, Human
auauuaggaaaauau

SEQ ID NO: 3514494 - RNA, 18 nt, Human
auauuaguugcuuuguua

SEQ ID NO: 3514495 - RNA, 20 nt, Human
auauuauaaaggauaaagaa

SEQ ID NO: 3514496 - RNA, 15 nt, Human
auauuauaaauauau

SEQ ID NO: 3514497 - RNA, 18 nt, Human
auauuauauggaaauaua

SEQ ID NO: 3514498 - RNA, 22 nt, Human
auauuauauuuggaugcagagu

SEQ ID NO: 3514499 - RNA, 21 nt, Human
auauuaucaugcaaaugcugu

SEQ ID NO: 3514500 - RNA, 14 nt, Human
auauuaugagaugc

SEQ ID NO: 3514501 - RNA, 15 nt, Human
auauuaugagaugcu

SEQ ID NO: 3514502 - RNA, 17 nt, Human
auauuaugcaaauuccc

SEQ ID NO: 3514503 - RNA, 16 nt, Human
auauuauggaagauuu

SEQ ID NO: 3514504 - RNA, 13 nt, Human
auauuauguguuu

SEQ ID NO: 3514505 - RNA, 13 nt, Human
auauuauguuaaa

SEQ ID NO: 3514506 - RNA, 12 nt, Human
auauuauuacuu

SEQ ID NO: 3514507 - RNA, 15 nt, Human
auauuauuacuugua

SEQ ID NO: 3514508 - RNA, 21 nt, Human
auauuauuauaaucuuauaau

SEQ ID NO: 3514509 - RNA, 23 nt, Human
auauuauucaccauguaaaacaa

SEQ ID NO: 3514510 - RNA, 22 nt, Human
auauuauuugcagugcaguaua

SEQ ID NO: 3514511 - RNA, 23 nt, Human
auauuauuugcuaauuaaaaagu

SEQ ID NO: 3514512 - RNA, 15 nt, Human
auauuauuuuauguu

SEQ ID NO: 3514513 - RNA, 22 nt, Human
auauuauuuuauguugcauaga

SEQ ID NO: 3514514 - RNA, 13 nt, Human
auauucaauaaag

SEQ ID NO: 3514515 - RNA, 16 nt, Human
auauucacugggccaa

SEQ ID NO: 3514516 - RNA, 20 nt, Human
auauucagaaucuuuguuaa

SEQ ID NO: 3514517 - RNA, 19 nt, Human
auauucagacaaaauggau

SEQ ID NO: 3514518 - RNA, 16 nt, Human
auauucaggaagcuca

SEQ ID NO: 3514519 - RNA, 20 nt, Human
auauucaggguaaauaggaa

SEQ ID NO: 3514520 - RNA, 14 nt, Human
auauucauguaaac

SEQ ID NO: 3514521 - RNA, 15 nt, Human
auauucauuuggaaa

SEQ ID NO: 3514522 - RNA, 17 nt, Human
auauuccagaucuuuca

SEQ ID NO: 3514523 - RNA, 20 nt, Human
auauuccauaguauauuaaa

SEQ ID NO: 3514524 - RNA, 15 nt, Human
auauuccaugaaugu

SEQ ID NO: 3514525 - RNA, 16 nt, Human
auauuccuuucuauca

SEQ ID NO: 3514526 - RNA, 19 nt, Human
auauuccuuucuaucauuu

SEQ ID NO: 3514527 - RNA, 16 nt, Human
auauuccuuugaagau

SEQ ID NO: 3514528 - RNA, 12 nt, Human
auauuccuuugc

SEQ ID NO: 3514529 - RNA, 18 nt, Human
auauucuaagaaauaucu

SEQ ID NO: 3514530 - RNA, 22 nt, Human
auauucuaagaaauaucuguga

SEQ ID NO: 3514531 - RNA, 18 nt, Human
auauucuauaugaauuua

SEQ ID NO: 3514532 - RNA, 13 nt, Human
auauucuauuuua

SEQ ID NO: 3514533 - RNA, 16 nt, Human
auauucuauuuuacaa

SEQ ID NO: 3514534 - RNA, 18 nt, Human
auauucucacagcuccaa

SEQ ID NO: 3514535 - RNA, 22 nt, Human
auauucucacagcuccaagaau

SEQ ID NO: 3514536 - RNA, 22 nt, Human
auauucucacgggcaguagcug

SEQ ID NO: 3514537 - RNA, 15 nt, Human
auauucucuguacau

SEQ ID NO: 3514538 - RNA, 19 nt, Human
auauucucuguacauauua

SEQ ID NO: 3514539 - RNA, 22 nt, Human
auauucucuuugguguacaaaa

SEQ ID NO: 3514540 - RNA, 16 nt, Human
auauucugcucuauua

SEQ ID NO: 3514541 - RNA, 16 nt, Human
auauucuguuggccag

SEQ ID NO: 3514542 - RNA, 12 nt, Human
auauucuuguca

SEQ ID NO: 3514543 - RNA, 15 nt, Human
auauucuuucaauaa

SEQ ID NO: 3514544 - RNA, 21 nt, Human
auauucuuuucugcaaaauag

SEQ ID NO: 3514545 - RNA, 21 nt, Human
auauugaagacaauuugauac

SEQ ID NO: 3514546 - RNA, 13 nt, Human
auauugaauguua

SEQ ID NO: 3514547 - RNA, 13 nt, Human
auauugaauuuuu

SEQ ID NO: 3514548 - RNA, 13 nt, Human
auauugacauuug

SEQ ID NO: 3514549 - RNA, 14 nt, Human
auauugacauuugu

SEQ ID NO: 3514550 - RNA, 16 nt, Human
auauugacuuguauau

SEQ ID NO: 3514551 - RNA, 18 nt, Human
auauugagcaauauguca

SEQ ID NO: 3514552 - RNA, 18 nt, Human
auauugaggccaagaaua

SEQ ID NO: 3514553 - RNA, 16 nt, Human
auauugaggcuuugug

SEQ ID NO: 3514554 - RNA, 18 nt, Human
auauugaggcuuuguguu

SEQ ID NO: 3514555 - RNA, 16 nt, Human
auauugauuguccuuu

SEQ ID NO: 3514556 - RNA, 22 nt, Human
auauugauuucugccuuccuug

SEQ ID NO: 3514557 - RNA, 15 nt, Human
auauugcaaaauaca

SEQ ID NO: 3514558 - RNA, 12 nt, Human
auauugcaauga

SEQ ID NO: 3514559 - RNA, 13 nt, Human
auauugcacaugu

SEQ ID NO: 3514560 - RNA, 16 nt, Human
auauugcccaggcugg

SEQ ID NO: 3514561 - RNA, 22 nt, Human
auauugcugagagaaauaugga

SEQ ID NO: 3514562 - RNA, 21 nt, Human
auauugcugcugguaauuugu

SEQ ID NO: 3514563 - RNA, 15 nt, Human
auauugcuuuuucua

SEQ ID NO: 3514564 - RNA, 21 nt, Human
auauuggccaaggaaaggcac

SEQ ID NO: 3514565 - RNA, 17 nt, Human
auauuguaaaacaggua

SEQ ID NO: 3514566 - RNA, 12 nt, Human
auauuguaaaua

SEQ ID NO: 3514567 - RNA, 14 nt, Human
auauuguaagaaau

SEQ ID NO: 3514568 - RNA, 13 nt, Human
auauuguacacuu

SEQ ID NO: 3514569 - RNA, 14 nt, Human
auauuguacacuuu

SEQ ID NO: 3514570 - RNA, 22 nt, Human
auauuguauuguuagauguuug

SEQ ID NO: 3514571 - RNA, 22 nt, Human
auauugucagaguucugcucua

SEQ ID NO: 3514572 - RNA, 16 nt, Human
auauugucauaucagc

SEQ ID NO: 3514573 - RNA, 15 nt, Human
auauugucauuccug

SEQ ID NO: 3514574 - RNA, 13 nt, Human
auauugugaagua

SEQ ID NO: 3514575 - RNA, 17 nt, Human
auauugugauucugccu

SEQ ID NO: 3514576 - RNA, 20 nt, Human
auauugugccaauauguauu

SEQ ID NO: 3514577 - RNA, 20 nt, Human
auauuguguugacuuuauaa

SEQ ID NO: 3514578 - RNA, 13 nt, Human
caaagauuuaauc

SEQ ID NO: 3514579 - RNA, 16 nt, Human
caaagauuuaaucugc

SEQ ID NO: 3514580 - RNA, 23 nt, Human
caaagcaagcauucagaagaaaa

SEQ ID NO: 3514581 - RNA, 16 nt, Human
caaagcaauaauagua

SEQ ID NO: 3514582 - RNA, 18 nt, Human
caaagcaaugcauuuugg

SEQ ID NO: 3514583 - RNA, 18 nt, Human
caaagcaauucuuucaag

SEQ ID NO: 3514584 - RNA, 11 nt, Human
caaagcacaga

SEQ ID NO: 3514585 - RNA, 14 nt, Human
caaagcacagagag

SEQ ID NO: 3514586 - RNA, 19 nt, Human
caaagcacagagagucugg

SEQ ID NO: 3514587 - RNA, 14 nt, Human
caaagcacaguguu

SEQ ID NO: 3514588 - RNA, 17 nt, Human
caaagcacaguuugaac

SEQ ID NO: 3514589 - RNA, 18 nt, Human
caaagcacauugaaagag

SEQ ID NO: 3514590 - RNA, 21 nt, Human
caaagcaccaaaauaagaaaa

SEQ ID NO: 3514591 - RNA, 24 nt, Human
caaagcaccaaaauaagaaaagau

SEQ ID NO: 3514592 - RNA, 21 nt, Human
caaagcacccauuucaaugug

SEQ ID NO: 3514593 - RNA, 21 nt, Human
caaagcacuguugagaaggag

SEQ ID NO: 3514594 - RNA, 13 nt, Human
caaagcagacagc

SEQ ID NO: 3514595 - RNA, 16 nt, Human
caaagcagacagcucc

SEQ ID NO: 3514596 - RNA, 18 nt, Human
caaagcagcaacacacau

SEQ ID NO: 3514597 - RNA, 18 nt, Human
caaagcaggggaguaugc

SEQ ID NO: 3514598 - RNA, 15 nt, Human
caaagcagggucugg

SEQ ID NO: 3514599 - RNA, 23 nt, Human
caaagcaucuugcauuaugcaau

SEQ ID NO: 3514600 - RNA, 14 nt, Human
caaagcauggacua

SEQ ID NO: 3514601 - RNA, 19 nt, Human
caaagcaugggauuauuag

SEQ ID NO: 3514602 - RNA, 22 nt, Human
caaagccaaacucugccagcca

SEQ ID NO: 3514603 - RNA, 23 nt, Human
caaagccaccucugucauuuguu

SEQ ID NO: 3514604 - RNA, 12 nt, Human
auuuuaaaugug

SEQ ID NO: 3514605 - RNA, 19 nt, Human
auuuuaaauuauaaggacu

SEQ ID NO: 3514606 - RNA, 20 nt, Human
auuuuaaauuauaaggacug

SEQ ID NO: 3514607 - RNA, 23 nt, Human
auuuuaaauuauaaggacugcau

SEQ ID NO: 3514608 - RNA, 16 nt, Human
auuuuaaauucacaau

SEQ ID NO: 3514609 - RNA, 19 nt, Human
auuuuaacaagaagaugaa

SEQ ID NO: 3514610 - RNA, 20 nt, Human
auuuuaacaagaagaugaau

SEQ ID NO: 3514611 - RNA, 21 nt, Human
auuuuaacauggaacucuagg

SEQ ID NO: 3514612 - RNA, 16 nt, Human
auuuuaaccaaaacau

SEQ ID NO: 3514613 - RNA, 21 nt, Human
auuuuaacuaaauuuuaaagc

SEQ ID NO: 3514614 - RNA, 14 nt, Human
auuuuaacucuguc

SEQ ID NO: 3514615 - RNA, 18 nt, Human
auuuuaacuuaacugaaa

SEQ ID NO: 3514616 - RNA, 20 nt, Human
auuuuaacuuaacugaaaug

SEQ ID NO: 3514617 - RNA, 21 nt, Human
auuuuaagacguguuuguguu

SEQ ID NO: 3514618 - RNA, 14 nt, Human
auuuuaagauuccu

SEQ ID NO: 3514619 - RNA, 15 nt, Human
auuuuaagauuccuu

SEQ ID NO: 3514620 - RNA, 21 nt, Human
auuuuaagcacucuuaaagca

SEQ ID NO: 3514621 - RNA, 23 nt, Human
auuuuaagcauuacucuuguaag

SEQ ID NO: 3514622 - RNA, 17 nt, Human
auuuuaagcauugugag

SEQ ID NO: 3514623 - RNA, 18 nt, Human
auuuuaagccuuuguuga

SEQ ID NO: 3514624 - RNA, 17 nt, Human
auuuuaagcuaggaaaa

SEQ ID NO: 3514625 - RNA, 22 nt, Human
auuuuaagcuaggaaaagaaau

SEQ ID NO: 3514626 - RNA, 19 nt, Human
auuuuaagucccugucacc

SEQ ID NO: 3514627 - RNA, 18 nt, Human
auuuuaagugcuuuguaa

SEQ ID NO: 3514628 - RNA, 15 nt, Human
auuuuaauaaaaaua

SEQ ID NO: 3514629 - RNA, 18 nt, Human
auuuuaauaaaaauaauu

SEQ ID NO: 3514630 - RNA, 12 nt, Human
auuuuaauaaug

SEQ ID NO: 3514631 - RNA, 16 nt, Human
auuuuaauaauguuuc

SEQ ID NO: 3514632 - RNA, 19 nt, Human
auuuuaauaauguuucaaa

SEQ ID NO: 3514633 - RNA, 14 nt, Human
auuuuaaucaaguu

SEQ ID NO: 3514634 - RNA, 23 nt, Human
auuuuaauggauuguuaauuuca

SEQ ID NO: 3514635 - RNA, 14 nt, Human
auuuuaaugugaug

SEQ ID NO: 3514636 - RNA, 18 nt, Human
auuuuaaugugaugaugu

SEQ ID NO: 3514637 - RNA, 18 nt, Human
auuuuaauuaucuuuucu

SEQ ID NO: 3514638 - RNA, 23 nt, Human
auuuuaauuauuauucuucauaa

SEQ ID NO: 3514639 - RNA, 24 nt, Human
auuuuaauucaucccaacugucuu

SEQ ID NO: 3514640 - RNA, 21 nt, Human
auuuuaauuuaguaaauguua

SEQ ID NO: 3514641 - RNA, 12 nt, Human
auuuuaauuuau

SEQ ID NO: 3514642 - RNA, 11 nt, Human
auuuuacaaaa

SEQ ID NO: 3514643 - RNA, 16 nt, Human
auuuuacaaaagaugu

SEQ ID NO: 3514644 - RNA, 22 nt, Human
auuuuacaagggcauaaaguaa

SEQ ID NO: 3514645 - RNA, 17 nt, Human
auuuuacacagaaacac

SEQ ID NO: 3514646 - RNA, 13 nt, Human
auuuuacauaaau

SEQ ID NO: 3514647 - RNA, 14 nt, Human
auuuuacaugaagu

SEQ ID NO: 3514648 - RNA, 21 nt, Human
auuuuaccaucacacauguuc

SEQ ID NO: 3514649 - RNA, 17 nt, Human
auuuuaccuagcuaauu

SEQ ID NO: 3514650 - RNA, 17 nt, Human
auuuuaccuuugacaaa

SEQ ID NO: 3514651 - RNA, 22 nt, Human
auuuuacuguacagacagaaaa

SEQ ID NO: 3514652 - RNA, 20 nt, Human
auuuuacugucuuaauuaag

SEQ ID NO: 3514653 - RNA, 23 nt, Human
auuuuacuuggaaauauuaaaag

SEQ ID NO: 3514654 - RNA, 16 nt, Human
auuuuacuuuuauaau

SEQ ID NO: 3514655 - RNA, 16 nt, Human
auuuuacuuuuuccug

SEQ ID NO: 3514656 - RNA, 14 nt, Human
auuuuacuuuuugg

SEQ ID NO: 3514657 - RNA, 17 nt, Human
auuuuagaaauauucac

SEQ ID NO: 3514658 - RNA, 19 nt, Human
auuuuagaacaauuuucuu

SEQ ID NO: 3514659 - RNA, 16 nt, Human
auuuuagacaaaucua

SEQ ID NO: 3514660 - RNA, 20 nt, Human
auuuuagacaaaucuaaggg

SEQ ID NO: 3514661 - RNA, 23 nt, Human
auuuuagcaaagcggguuauaau

SEQ ID NO: 3514662 - RNA, 14 nt, Human
auuuuagcaguucu

SEQ ID NO: 3514663 - RNA, 19 nt, Human
auuuuagcaguucugcaaa

SEQ ID NO: 3514664 - RNA, 17 nt, Human
auuuuagccuucucugu

SEQ ID NO: 3514665 - RNA, 15 nt, Human
auuuuagcuaauuua

SEQ ID NO: 3514666 - RNA, 16 nt, Human
auuuuagcuaauuuag

SEQ ID NO: 3514667 - RNA, 18 nt, Human
auuuuagcuacuauauau

SEQ ID NO: 3514668 - RNA, 15 nt, Human
auuuuagcugcagaa

SEQ ID NO: 3514669 - RNA, 19 nt, Human
auuuuaggagcuaaggcuc

SEQ ID NO: 3514670 - RNA, 22 nt, Human
auuuuaggagcuaaggcucuau

SEQ ID NO: 3514671 - RNA, 19 nt, Human
auuuuagggguagcauuug

SEQ ID NO: 3514672 - RNA, 16 nt, Human
auuuuagguguugauu

SEQ ID NO: 3514673 - RNA, 23 nt, Human
auuuuagucacacguggucuuuc

SEQ ID NO: 3514674 - RNA, 16 nt, Human
auuuuaguccaaauaa

SEQ ID NO: 3514675 - RNA, 23 nt, Human
auuuuagugacagcucugccugu

SEQ ID NO: 3514676 - RNA, 18 nt, Human
auuuuaguuacagcugug

SEQ ID NO: 3514677 - RNA, 18 nt, Human
auuuuaguuucuguucug

SEQ ID NO: 3514678 - RNA, 19 nt, Human
auuuuaguuucuguucugu

SEQ ID NO: 3514679 - RNA, 18 nt, Human
auuuuauaaaauuaaaga

SEQ ID NO: 3514680 - RNA, 13 nt, Human
auuuuauaaacaa

SEQ ID NO: 3514681 - RNA, 15 nt, Human
auuuuauaaagugcu

SEQ ID NO: 3514682 - RNA, 21 nt, Human
auuuuauaaagugcuugugua

SEQ ID NO: 3514683 - RNA, 15 nt, Human
auuuuauaaaucgcu

SEQ ID NO: 3514684 - RNA, 20 nt, Human
auuuuauaaaucgcuuuuga

SEQ ID NO: 3514685 - RNA, 19 nt, Human
auuuuauaagcaaauuuca

SEQ ID NO: 3514686 - RNA, 18 nt, Human
auuuuauaaggacuuccu

SEQ ID NO: 3514687 - RNA, 15 nt, Human
auuuuauacauuaac

SEQ ID NO: 3514688 - RNA, 19 nt, Human
auuuuauagacacccuggc

SEQ ID NO: 3514689 - RNA, 17 nt, Human
auuuuauaggaaaaaau

SEQ ID NO: 3514690 - RNA, 22 nt, Human
auuuuauaggcauaccuccuau

SEQ ID NO: 3514691 - RNA, 18 nt, Human
auuuuauaguguguugug

SEQ ID NO: 3514692 - RNA, 15 nt, Human
auuuuauaugcuuac

SEQ ID NO: 3514693 - RNA, 18 nt, Human
auuuuauauuaaaauaag

SEQ ID NO: 3514694 - RNA, 22 nt, Human
auuuuauauuacugacauuucu

SEQ ID NO: 3514695 - RNA, 13 nt, Human
auuuuauauugaa

SEQ ID NO: 3514696 - RNA, 14 nt, Human
auuuuaucugugaa

SEQ ID NO: 3514697 - RNA, 13 nt, Human
auuuuaucuuuga

SEQ ID NO: 3514698 - RNA, 20 nt, Human
auuuuaucuuugauucuccu

SEQ ID NO: 3514699 - RNA, 17 nt, Human
auuuuaugaucaguguu

SEQ ID NO: 3514700 - RNA, 15 nt, Human
auuuuaugauccagc

SEQ ID NO: 3514701 - RNA, 21 nt, Human
auuuuaugccuuuuauuucuu

SEQ ID NO: 3514702 - RNA, 17 nt, Human
auuuuaugcuuuaaaca

SEQ ID NO: 3514703 - RNA, 16 nt, Human
auuuuauggugcauua

SEQ ID NO: 3514704 - RNA, 16 nt, Human
auuuuaugguuauguu

SEQ ID NO: 3514705 - RNA, 18 nt, Human
auuuuaugguuauguuuu

SEQ ID NO: 3514706 - RNA, 22 nt, Human
auuuuauguuaagggaagaauu

SEQ ID NO: 3514707 - RNA, 13 nt, Human
auuuuauguuaua

SEQ ID NO: 3514708 - RNA, 15 nt, Human
auuuuauguugacau

SEQ ID NO: 3514709 - RNA, 17 nt, Human
auuuuauguugacauuu

SEQ ID NO: 3514710 - RNA, 22 nt, Human
auuuuauguugacauuuguuug

SEQ ID NO: 3514711 - RNA, 21 nt, Human
auuuuauguugcauagaauaa

SEQ ID NO: 3514712 - RNA, 15 nt, Human
auuuuauguuuagau

SEQ ID NO: 3514713 - RNA, 22 nt, Human
auuuuauuaagcuuuuuggaau

SEQ ID NO: 3514714 - RNA, 14 nt, Human
auuuuauuacuggc

SEQ ID NO: 3514715 - RNA, 12 nt, Human
auuuuauuauga

SEQ ID NO: 3514716 - RNA, 21 nt, Human
auuuuauuaugaaacuugugu

SEQ ID NO: 3514717 - RNA, 16 nt, Human
auuuuauuaugaagaa

SEQ ID NO: 3514718 - RNA, 18 nt, Human
auuuuauuauguaaaucc

SEQ ID NO: 3514719 - RNA, 21 nt, Human
auuuuauuauguaaaucccau

SEQ ID NO: 3514720 - RNA, 18 nt, Human
auuuuauucaagaaugcc

SEQ ID NO: 3514721 - RNA, 13 nt, Human
auuuugaagcuaa

SEQ ID NO: 3514722 - RNA, 14 nt, Human
auuuugaagcuaau

SEQ ID NO: 3514723 - RNA, 12 nt, Human
auuuugaaguuu

SEQ ID NO: 3514724 - RNA, 16 nt, Human
auuuugaaguuuacau

SEQ ID NO: 3514725 - RNA, 11 nt, Human
auuuugaauac

SEQ ID NO: 3514726 - RNA, 12 nt, Human
auuuugaauacc

SEQ ID NO: 3514727 - RNA, 14 nt, Human
auuuugaauaccau

SEQ ID NO: 3514728 - RNA, 15 nt, Human
auuuugaauaccauu

SEQ ID NO: 3514729 - RNA, 22 nt, Human
auuuugaauaccauuaaaacug

SEQ ID NO: 3514730 - RNA, 11 nt, Human
auuuugaauca

SEQ ID NO: 3514731 - RNA, 14 nt, Human
auuuugaaucaaua

SEQ ID NO: 3514732 - RNA, 18 nt, Human
auuuugacacuauaucug

SEQ ID NO: 3514733 - RNA, 17 nt, Human
auuuugacauaaaguug

SEQ ID NO: 3514734 - RNA, 24 nt, Human
auuuugacauaaaguugauaaaga

SEQ ID NO: 3514735 - RNA, 19 nt, Human
auuuugacuuaaugugauu

SEQ ID NO: 3514736 - RNA, 22 nt, Human
auuuugagaaagucuuauuuau

SEQ ID NO: 3514737 - RNA, 18 nt, Human
auuuugagguaaagauau

SEQ ID NO: 3514738 - RNA, 13 nt, Human
auuuugauaauaa

SEQ ID NO: 3514739 - RNA, 18 nt, Human
auuuugauaauaaauuga

SEQ ID NO: 3514740 - RNA, 16 nt, Human
auuuugauaauaauau

SEQ ID NO: 3514741 - RNA, 21 nt, Human
auuuugauaauaauauuguuu

SEQ ID NO: 3514742 - RNA, 17 nt, Human
auuuugauaccagaagg

SEQ ID NO: 3514743 - RNA, 19 nt, Human
auuuugauaccagaaggga

SEQ ID NO: 3514744 - RNA, 19 nt, Human
auuuugauccaagcugguc

SEQ ID NO: 3514745 - RNA, 19 nt, Human
auuuugaucuucaacaaau

SEQ ID NO: 3514746 - RNA, 20 nt, Human
auuuugaucuucaacaaauu

SEQ ID NO: 3514747 - RNA, 22 nt, Human
auuuugaugcagcauuugauaa

SEQ ID NO: 3514748 - RNA, 14 nt, Human
auuuugauuauugu

SEQ ID NO: 3514749 - RNA, 20 nt, Human
auuuugauuuuuuuuuuaaa

SEQ ID NO: 3514750 - RNA, 15 nt, Human
auuuugcaaaauuuc

SEQ ID NO: 3514751 - RNA, 16 nt, Human
auuuugcaaagauuua

SEQ ID NO: 3514752 - RNA, 14 nt, Human
auuuugcagcagug

SEQ ID NO: 3514753 - RNA, 15 nt, Human
auuuugcagcaguga

SEQ ID NO: 3514754 - RNA, 16 nt, Human
auuuugcagcagugag

SEQ ID NO: 3514755 - RNA, 16 nt, Human
auuuugcauuugaaua

SEQ ID NO: 3514756 - RNA, 18 nt, Human
auuuugccagugggaacu

SEQ ID NO: 3514757 - RNA, 22 nt, Human
auuuugcccuuccauagccuaa

SEQ ID NO: 3514758 - RNA, 23 nt, Human
auuuugccuaauacauuaaagca

SEQ ID NO: 3514759 - RNA, 20 nt, Human
auuuugcuaaaugugaauga

SEQ ID NO: 3514760 - RNA, 21 nt, Human
auuuugcuauuguaaauaugu

SEQ ID NO: 3514761 - RNA, 22 nt, Human
auuuugcuauuguaaauauguu

SEQ ID NO: 3514762 - RNA, 19 nt, Human
auuuugcuggaauuccuaa

SEQ ID NO: 3514763 - RNA, 14 nt, Human
auuuugcuguauau

SEQ ID NO: 3514764 - RNA, 11 nt, Human
auuuugcuuua

SEQ ID NO: 3514765 - RNA, 12 nt, Human
auuuugcuuuaa

SEQ ID NO: 3514766 - RNA, 18 nt, Human
auauuuuucuuaaaaagu

SEQ ID NO: 3514767 - RNA, 21 nt, Human
auauuuuugguugucaauauu

SEQ ID NO: 3514768 - RNA, 15 nt, Human
auauuuuuguagcac

SEQ ID NO: 3514769 - RNA, 19 nt, Human
auauuuuuguuuguuuugu

SEQ ID NO: 3514770 - RNA, 20 nt, Human
auauuuuuguuuguuuugug

SEQ ID NO: 3514771 - RNA, 17 nt, Human
auauuuuuuaauuuaaa

SEQ ID NO: 3514772 - RNA, 20 nt, Human
auauuuuuuaauuugaugaa

SEQ ID NO: 3514773 - RNA, 20 nt, Human
auauuuuuuauauauacagu

SEQ ID NO: 3514774 - RNA, 22 nt, Human
auauuuuuuauaucuggaauga

SEQ ID NO: 3514775 - RNA, 16 nt, Human
auauuuuuuaucauaa

SEQ ID NO: 3514776 - RNA, 18 nt, Human
auauuuuuuguuaaauga

SEQ ID NO: 3514777 - RNA, 15 nt, Human
auauuuuuuuccuua

SEQ ID NO: 3514778 - RNA, 17 nt, Human
auauuuuuuuccuuaca

SEQ ID NO: 3514779 - RNA, 22 nt, Human
auauuuuuuuccuuacauaaac

SEQ ID NO: 3514780 - RNA, 18 nt, Human
auauuuuuuucuuuucuu

SEQ ID NO: 3514781 - RNA, 23 nt, Human
auauuuuuuuuuaagcucugagc

SEQ ID NO: 3514782 - RNA, 19 nt, Human
aucaaaaauugaagagaga

SEQ ID NO: 3514783 - RNA, 17 nt, Human
aucaaaagacaauucuu

SEQ ID NO: 3514784 - RNA, 19 nt, Human
aucaaaagacaauucuuua

SEQ ID NO: 3514785 - RNA, 20 nt, Human
aucaaaagguuaauaaagua

SEQ ID NO: 3514786 - RNA, 14 nt, Human
aucaaaauaaaaag

SEQ ID NO: 3514787 - RNA, 15 nt, Human
aucaaaauaaaaagu

SEQ ID NO: 3514788 - RNA, 19 nt, Human
aucaaaauaaauugaaaua

SEQ ID NO: 3514789 - RNA, 16 nt, Human
aucaaaaucucuccac

SEQ ID NO: 3514790 - RNA, 20 nt, Human
aucaaaaugcucuuauuuca

SEQ ID NO: 3514791 - RNA, 12 nt, Human
aucaaaaugcuu

SEQ ID NO: 3514792 - RNA, 13 nt, Human
aucaaaaugcuuu

SEQ ID NO: 3514793 - RNA, 14 nt, Human
aucaaacagcucag

SEQ ID NO: 3514794 - RNA, 16 nt, Human
aucaaacauuuugaaa

SEQ ID NO: 3514795 - RNA, 15 nt, Human
aucaaaccuuugagu

SEQ ID NO: 3514796 - RNA, 16 nt, Human
aucaaacucaaugcuu

SEQ ID NO: 3514797 - RNA, 16 nt, Human
aucaaacugaagccag

SEQ ID NO: 3514798 - RNA, 21 nt, Human
aucaaaggaaaauaguaaugu

SEQ ID NO: 3514799 - RNA, 13 nt, Human
aucaaaguauuug

SEQ ID NO: 3514800 - RNA, 20 nt, Human
aucaaagucaaaaauagcaa

SEQ ID NO: 3514801 - RNA, 17 nt, Human
aucaaauaaagagagaa

SEQ ID NO: 3514802 - RNA, 11 nt, Human
aucaaauacuu

SEQ ID NO: 3514803 - RNA, 13 nt, Human
aucaaauacuuua

SEQ ID NO: 3514804 - RNA, 14 nt, Human
aucaaauacuuuaa

SEQ ID NO: 3514805 - RNA, 22 nt, Human
aucaaauggaaaggagaggaaa

SEQ ID NO: 3514806 - RNA, 21 nt, Human
aucaaauggaagacacauuga

SEQ ID NO: 3514807 - RNA, 17 nt, Human
aucaaaugguaucuuuu

SEQ ID NO: 3514808 - RNA, 14 nt, Human
aucaaauguuuaau

SEQ ID NO: 3514809 - RNA, 15 nt, Human
aucaaauguuuaauc

SEQ ID NO: 3514810 - RNA, 16 nt, Human
aucaaauguuuaauca

SEQ ID NO: 3514811 - RNA, 18 nt, Human
aucaaauguuuaaucaua

SEQ ID NO: 3514812 - RNA, 22 nt, Human
aucaaauguuuaaucauauaaa

SEQ ID NO: 3514813 - RNA, 16 nt, Human
aucaacaaaaauuguc

SEQ ID NO: 3514814 - RNA, 18 nt, Human
aucaacaagaguugucuu

SEQ ID NO: 3514815 - RNA, 15 nt, Human
aucaacaagauuucc

SEQ ID NO: 3514816 - RNA, 20 nt, Human
aucaaccccuucgcuccugu

SEQ ID NO: 3514817 - RNA, 11 nt, Human
aucaacccuuc

SEQ ID NO: 3514818 - RNA, 18 nt, Human
aucaacuaaaguuguacu

SEQ ID NO: 3514819 - RNA, 20 nt, Human
aucaacuaaaguuguacuuu

SEQ ID NO: 3514820 - RNA, 22 nt, Human
aucaacuaaaguuguacuuuaa

SEQ ID NO: 3514821 - RNA, 17 nt, Human
aucaacuacuauucaaa

SEQ ID NO: 3514822 - RNA, 13 nt, Human
aucaacucauguu

SEQ ID NO: 3514823 - RNA, 23 nt, Human
aucaacugaaaguguuuccuuca

SEQ ID NO: 3514824 - RNA, 11 nt, Human
aucaacugaau

SEQ ID NO: 3514825 - RNA, 14 nt, Human
aucaacugaaugag

SEQ ID NO: 3514826 - RNA, 21 nt, Human
aucaacugcaucaagauguga

SEQ ID NO: 3514827 - RNA, 21 nt, Human
aucaacuuaccaggcaccaaa

SEQ ID NO: 3514828 - RNA, 21 nt, Human
aucaacuuuaaucaaguugua

SEQ ID NO: 3514829 - RNA, 13 nt, Human
aucaacuuuuuau

SEQ ID NO: 3514830 - RNA, 22 nt, Human
aucaacuuuuuauugccuucuc

SEQ ID NO: 3514831 - RNA, 19 nt, Human
aucaagaagggcugcauga

SEQ ID NO: 3514832 - RNA, 13 nt, Human
aucaagacauagc

SEQ ID NO: 3514833 - RNA, 15 nt, Human
aucaagacuggaagg

SEQ ID NO: 3514834 - RNA, 14 nt, Human
aucaagagccuuaa

SEQ ID NO: 3514835 - RNA, 15 nt, Human
aucaagagccuuaaa

SEQ ID NO: 3514836 - RNA, 21 nt, Human
aucaagagccuuaaaacauca

SEQ ID NO: 3514837 - RNA, 17 nt, Human
aucaagagcugcccucc

SEQ ID NO: 3514838 - RNA, 16 nt, Human
aucaagauaaaggaca

SEQ ID NO: 3514839 - RNA, 13 nt, Human
aucaagcuaauaa

SEQ ID NO: 3514840 - RNA, 15 nt, Human
aucaagcuaauaaaa

SEQ ID NO: 3514841 - RNA, 11 nt, Human
aucaagcugug

SEQ ID NO: 3514842 - RNA, 21 nt, Human
aucaagcuucaguuuccuggu

SEQ ID NO: 3514843 - RNA, 13 nt, Human
aucaaggcacugc

SEQ ID NO: 3514844 - RNA, 19 nt, Human
aucaaggggucacuuacag

SEQ ID NO: 3514845 - RNA, 15 nt, Human
aucaaggucguuuuu

SEQ ID NO: 3514846 - RNA, 15 nt, Human
aucaaguaauacaaa

SEQ ID NO: 3514847 - RNA, 19 nt, Human
aucaaguagacuacuguuc

SEQ ID NO: 3514848 - RNA, 19 nt, Human
aucaaguauagaaaaucuu

SEQ ID NO: 3514849 - RNA, 16 nt, Human
aucaaguauuugggaa

SEQ ID NO: 3514850 - RNA, 15 nt, Human
aucaagucaaucauu

SEQ ID NO: 3514851 - RNA, 15 nt, Human
aucaagucuguuuac

SEQ ID NO: 3514852 - RNA, 23 nt, Human
aucaagucuguuuacugcaaggu

SEQ ID NO: 3514853 - RNA, 16 nt, Human
aucaagugucuuccau

SEQ ID NO: 3514854 - RNA, 15 nt, Human
aucaagugugcuuua

SEQ ID NO: 3514855 - RNA, 16 nt, Human
aucaagugugcuuuag

SEQ ID NO: 3514856 - RNA, 22 nt, Human
aucaaguuauugacaaacucuc

SEQ ID NO: 3514857 - RNA, 15 nt, Human
aucaaguugaauuga

SEQ ID NO: 3514858 - RNA, 11 nt, Human
aucaaguuuua

SEQ ID NO: 3514859 - RNA, 13 nt, Human
aucaaguuuuaag

SEQ ID NO: 3514860 - RNA, 15 nt, Human
aucaauaaaaaauua

SEQ ID NO: 3514861 - RNA, 14 nt, Human
aucaauaaacgauu

SEQ ID NO: 3514862 - RNA, 15 nt, Human
aucaauaaacgauuu

SEQ ID NO: 3514863 - RNA, 19 nt, Human
aucaauaaacgauuuaauu

SEQ ID NO: 3514864 - RNA, 23 nt, Human
aucaauaguguccuaugcaauaa

SEQ ID NO: 3514865 - RNA, 14 nt, Human
aucaauaguugaau

SEQ ID NO: 3514866 - RNA, 18 nt, Human
aucaauaucuaauauaua

SEQ ID NO: 3514867 - RNA, 20 nt, Human
auccagauggugggaugugg

SEQ ID NO: 3514868 - RNA, 14 nt, Human
auccagauguggcu

SEQ ID NO: 3514869 - RNA, 23 nt, Human
auccagauguggcuacugacaua

SEQ ID NO: 3514870 - RNA, 23 nt, Human
auccagccuaacuuacauucuua

SEQ ID NO: 3514871 - RNA, 21 nt, Human
auccagccucuccccugauua

SEQ ID NO: 3514872 - RNA, 21 nt, Human
auccagccuggggcugaggcu

SEQ ID NO: 3514873 - RNA, 17 nt, Human
auccagcugccuauuga

SEQ ID NO: 3514874 - RNA, 13 nt, Human
auccaggacccug

SEQ ID NO: 3514875 - RNA, 19 nt, Human
auccaggacccugccaggc

SEQ ID NO: 3514876 - RNA, 20 nt, Human
auccaggacccugccaggca

SEQ ID NO: 3514877 - RNA, 23 nt, Human
auccaggacuauauuugggccug

SEQ ID NO: 3514878 - RNA, 15 nt, Human
auccaggacucuguc

SEQ ID NO: 3514879 - RNA, 16 nt, Human
auccaggcaccaggac

SEQ ID NO: 3514880 - RNA, 21 nt, Human
auccaggcacccaaaccccgg

SEQ ID NO: 3514881 - RNA, 16 nt, Human
auccaggcagauccag

SEQ ID NO: 3514882 - RNA, 19 nt, Human
auccaggccacucuuagcc

SEQ ID NO: 3514883 - RNA, 14 nt, Human
auccaggccccucc

SEQ ID NO: 3514884 - RNA, 14 nt, Human
auccagggacagag

SEQ ID NO: 3514885 - RNA, 16 nt, Human
auccagggacagaggc

SEQ ID NO: 3514886 - RNA, 18 nt, Human
auccagggaugccaucug

SEQ ID NO: 3514887 - RNA, 19 nt, Human
auccagguacgcacagaca

SEQ ID NO: 3514888 - RNA, 20 nt, Human
auccagguacgcacagacag

SEQ ID NO: 3514889 - RNA, 15 nt, Human
auccaggucaacaga

SEQ ID NO: 3514890 - RNA, 23 nt, Human
auccaggucaacagaaugaaaaa

SEQ ID NO: 3514891 - RNA, 15 nt, Human
auccagguucagcuu

SEQ ID NO: 3514892 - RNA, 16 nt, Human
auccagguucagcuug

SEQ ID NO: 3514893 - RNA, 15 nt, Human
auccagguucccucc

SEQ ID NO: 3514894 - RNA, 19 nt, Human
auccagguucccucccaga

SEQ ID NO: 3514895 - RNA, 15 nt, Human
auccaguaaaauaau

SEQ ID NO: 3514896 - RNA, 16 nt, Human
auccaguacauuuaau

SEQ ID NO: 3514897 - RNA, 19 nt, Human
auccaguacauuuaauuga

SEQ ID NO: 3514898 - RNA, 17 nt, Human
auccagugaccucucuc

SEQ ID NO: 3514899 - RNA, 21 nt, Human
auccagugauccuuacaaguu

SEQ ID NO: 3514900 - RNA, 18 nt, Human
auccaguuuugucaaugc

SEQ ID NO: 3514901 - RNA, 18 nt, Human
auccaguuuuguuuggac

SEQ ID NO: 3514902 - RNA, 21 nt, Human
auccaguuuuguuuggaccaa

SEQ ID NO: 3514903 - RNA, 16 nt, Human
auccauaaagaagcaa

SEQ ID NO: 3514904 - RNA, 15 nt, Human
auccauaacugaaca

SEQ ID NO: 3514905 - RNA, 16 nt, Human
auccauaguaguauga

SEQ ID NO: 3514906 - RNA, 21 nt, Human
auccauauuaaguaagucuca

SEQ ID NO: 3514907 - RNA, 19 nt, Human
auccauauuuuauuacugu

SEQ ID NO: 3514908 - RNA, 18 nt, Human
auccaucaucaugugugu

SEQ ID NO: 3514909 - RNA, 21 nt, Human
auccaucuaaauaccugcccu

SEQ ID NO: 3514910 - RNA, 18 nt, Human
auccaugaccuaguuuuc

SEQ ID NO: 3514911 - RNA, 21 nt, Human
auccaugaccuaguuuuccau

SEQ ID NO: 3514912 - RNA, 15 nt, Human
auccaugcaccaaac

SEQ ID NO: 3514913 - RNA, 20 nt, Human
auccauggggcugauuguau

SEQ ID NO: 3514914 - RNA, 19 nt, Human
auccauggggucucucaca

SEQ ID NO: 3514915 - RNA, 23 nt, Human
auccauggggucucucacagaca

SEQ ID NO: 3514916 - RNA, 16 nt, Human
auccauguaacugccu

SEQ ID NO: 3514917 - RNA, 19 nt, Human
auccauguaagguaucagu

SEQ ID NO: 3514918 - RNA, 12 nt, Human
auccauguacug

SEQ ID NO: 3514919 - RNA, 20 nt, Human
auccauguacuguaguuuuu

SEQ ID NO: 3514920 - RNA, 20 nt, Human
auccauguuaguuuuuacuu

SEQ ID NO: 3514921 - RNA, 19 nt, Human
auccauuaggccagcaacg

SEQ ID NO: 3514922 - RNA, 14 nt, Human
auccauuaucaugu

SEQ ID NO: 3514923 - RNA, 15 nt, Human
auccauuaucaugug

SEQ ID NO: 3514924 - RNA, 17 nt, Human
auccauuaucaugugua

SEQ ID NO: 3514925 - RNA, 15 nt, Human
auccauucuuucuga

SEQ ID NO: 3514926 - RNA, 16 nt, Human
auccauuuccauugcu

SEQ ID NO: 3514927 - RNA, 23 nt, Human
auccauuucuaauuauguagcuc

SEQ ID NO: 3514928 - RNA, 13 nt, Human
auccauuuggaaa

SEQ ID NO: 3514929 - RNA, 17 nt, Human
auccauuuggaaaucuu

SEQ ID NO: 3514930 - RNA, 13 nt, Human
aucccaaaaguca

SEQ ID NO: 3514931 - RNA, 24 nt, Human
aucccaaacugugaugaagccgac

SEQ ID NO: 3514932 - RNA, 16 nt, Human
aucccaaaggacagcc

SEQ ID NO: 3514933 - RNA, 20 nt, Human
aucccaaaguuguuguaacc

SEQ ID NO: 3514934 - RNA, 15 nt, Human
aucccaacacugcca

SEQ ID NO: 3514935 - RNA, 15 nt, Human
aucccaacagccaug

SEQ ID NO: 3514936 - RNA, 22 nt, Human
aucccaaccaggcaccucuucc

SEQ ID NO: 3514937 - RNA, 15 nt, Human
aucccaaccagugcc

SEQ ID NO: 3514938 - RNA, 17 nt, Human
aucccaacugucuuuuu

SEQ ID NO: 3514939 - RNA, 19 nt, Human
aucccaagaucugugcagc

SEQ ID NO: 3514940 - RNA, 20 nt, Human
aucccaaguagaaucucagu

SEQ ID NO: 3514941 - RNA, 15 nt, Human
aucccaagugccagu

SEQ ID NO: 3514942 - RNA, 14 nt, Human
aucccacacccugg

SEQ ID NO: 3514943 - RNA, 22 nt, Human
aucccacauccaacuccagcaa

SEQ ID NO: 3514944 - RNA, 15 nt, Human
aucccaccaacccuc

SEQ ID NO: 3514945 - RNA, 18 nt, Human
aucccaccccauccucca

SEQ ID NO: 3514946 - RNA, 20 nt, Human
aucccaccccauccuccagg

SEQ ID NO: 3514947 - RNA, 20 nt, Human
aucccacggaaaaugccaau

SEQ ID NO: 3514948 - RNA, 20 nt, Human
aucccacuaaugcaaacugg

SEQ ID NO: 3514949 - RNA, 18 nt, Human
aucccagaaaaaguaacu

SEQ ID NO: 3514950 - RNA, 17 nt, Human
aucccagaaauuagaaa

SEQ ID NO: 3514951 - RNA, 18 nt, Human
aucccagagagcccgagg

SEQ ID NO: 3514952 - RNA, 12 nt, Human
aucccagcccaa

SEQ ID NO: 3514953 - RNA, 11 nt, Human
aucccagcccc

SEQ ID NO: 3514954 - RNA, 23 nt, Human
aucccagcccuuugggaggcuga

SEQ ID NO: 3514955 - RNA, 14 nt, Human
aucccagccggcca

SEQ ID NO: 3514956 - RNA, 24 nt, Human
aucccagccggccaauggaaaccu

SEQ ID NO: 3514957 - RNA, 13 nt, Human
aucccagccuugg

SEQ ID NO: 3514958 - RNA, 23 nt, Human
aucccagcuacucaagaggcuga

SEQ ID NO: 3514959 - RNA, 18 nt, Human
aucccagcuacucaggag

SEQ ID NO: 3514960 - RNA, 20 nt, Human
aucccagcuacucaggaggc

SEQ ID NO: 3514961 - RNA, 22 nt, Human
aucccagcuacuugggaggcug

SEQ ID NO: 3514962 - RNA, 20 nt, Human
aucccagcuucggcauuuga

SEQ ID NO: 3514963 - RNA, 24 nt, Human
aucccauaugccugggcagaagga

SEQ ID NO: 3514964 - RNA, 17 nt, Human
aucccaucauuuuccau

SEQ ID NO: 3514965 - RNA, 16 nt, Human
aucccaucccauccca

SEQ ID NO: 3514966 - RNA, 20 nt, Human
aucccaucuaagcugcagcu

SEQ ID NO: 3514967 - RNA, 18 nt, Human
aucccaugaacacacugu

SEQ ID NO: 3514968 - RNA, 15 nt, Human
caagaaaacaacuuc

SEQ ID NO: 3514969 - RNA, 15 nt, Human
caagaaaacaggcac

SEQ ID NO: 3514970 - RNA, 16 nt, Human
caagaaaacaggcacu

SEQ ID NO: 3514971 - RNA, 17 nt, Human
caagaaaacaggcacug

SEQ ID NO: 3514972 - RNA, 23 nt, Human
caagaaaacaggcacugcccugg

SEQ ID NO: 3514973 - RNA, 15 nt, Human
caagaaacagccagc

SEQ ID NO: 3514974 - RNA, 20 nt, Human
caagaaaggcugcuguacug

SEQ ID NO: 3514975 - RNA, 21 nt, Human
caagaaauaaaaggaagccaa

SEQ ID NO: 3514976 - RNA, 18 nt, Human
caagaaauaaguuuuugu

SEQ ID NO: 3514977 - RNA, 13 nt, Human
caagaaaugaaag

SEQ ID NO: 3514978 - RNA, 16 nt, Human
caagaaaugaaagcag

SEQ ID NO: 3514979 - RNA, 21 nt, Human
caagaacagcaggcccaccua

SEQ ID NO: 3514980 - RNA, 15 nt, Human
caagaaccuggaaaa

SEQ ID NO: 3514981 - RNA, 20 nt, Human
caagaacucaucacuguggc

SEQ ID NO: 3514982 - RNA, 14 nt, Human
caagaacucugggc

SEQ ID NO: 3514983 - RNA, 15 nt, Human
caagaacugaaaaca

SEQ ID NO: 3514984 - RNA, 19 nt, Human
caagaacugcauggaccua

SEQ ID NO: 3514985 - RNA, 13 nt, Human
caagaacuuguuu

SEQ ID NO: 3514986 - RNA, 17 nt, Human
caagaacuuguuuaaua

SEQ ID NO: 3514987 - RNA, 13 nt, Human
caagaagaaaaag

SEQ ID NO: 3514988 - RNA, 22 nt, Human
caagaagaaaugcuuuccaaaa

SEQ ID NO: 3514989 - RNA, 18 nt, Human
caagaagaucacgcuccc

SEQ ID NO: 3514990 - RNA, 23 nt, Human
caagaagaucacgcuccccgccu

SEQ ID NO: 3514991 - RNA, 13 nt, Human
caagaagcagugg

SEQ ID NO: 3514992 - RNA, 23 nt, Human
caagaagcauuuuguaaguugaa

SEQ ID NO: 3514993 - RNA, 13 nt, Human
caagaagcccagg

SEQ ID NO: 3514994 - RNA, 14 nt, Human
caagaagcccagga

SEQ ID NO: 3514995 - RNA, 18 nt, Human
caagaagcccaggaaagg

SEQ ID NO: 3514996 - RNA, 17 nt, Human
caagaaggaugauucaa

SEQ ID NO: 3514997 - RNA, 16 nt, Human
caagaaggcaaaaaua

SEQ ID NO: 3514998 - RNA, 13 nt, Human
caagaagggcugc

SEQ ID NO: 3514999 - RNA, 14 nt, Human
caagaagggcugca

SEQ ID NO: 3515000 - RNA, 15 nt, Human
caagaagggcugcau

SEQ ID NO: 3515001 - RNA, 19 nt, Human
caagaagggcugcaugaug

SEQ ID NO: 3515002 - RNA, 16 nt, Human
caagaaguagcagugu

SEQ ID NO: 3515003 - RNA, 20 nt, Human
caagaaguccccucuccucc

SEQ ID NO: 3515004 - RNA, 14 nt, Human
caagaagugaagaa

SEQ ID NO: 3515005 - RNA, 14 nt, Human
caagaagugauuag

SEQ ID NO: 3515006 - RNA, 12 nt, Human
caagaauaaaaa

SEQ ID NO: 3515007 - RNA, 22 nt, Human
caagaauaaaggcagcuguugu

SEQ ID NO: 3515008 - RNA, 18 nt, Human
caagaauaaucacgcuuu

SEQ ID NO: 3515009 - RNA, 21 nt, Human
caagaauaaucacgcuuuccu

SEQ ID NO: 3515010 - RNA, 22 nt, Human
caagaauaaucacgcuuuccug

SEQ ID NO: 3515011 - RNA, 13 nt, Human
caagcacaguggu

SEQ ID NO: 3515012 - RNA, 16 nt, Human
caagcaccagggaaga

SEQ ID NO: 3515013 - RNA, 16 nt, Human
caagcaccuccugccu

SEQ ID NO: 3515014 - RNA, 17 nt, Human
caagcaccuccugccuc

SEQ ID NO: 3515015 - RNA, 15 nt, Human
caagcacugauaucu

SEQ ID NO: 3515016 - RNA, 13 nt, Human
caagcacugugcu

SEQ ID NO: 3515017 - RNA, 14 nt, Human
caagcacuucuuuu

SEQ ID NO: 3515018 - RNA, 17 nt, Human
caagcagagguggccag

SEQ ID NO: 3515019 - RNA, 18 nt, Human
caagcagagugcacagcu

SEQ ID NO: 3515020 - RNA, 19 nt, Human
caagcagagugcacagcug

SEQ ID NO: 3515021 - RNA, 16 nt, Human
caagcagauacugcug

SEQ ID NO: 3515022 - RNA, 23 nt, Human
caagcagauacugcuguguaaug

SEQ ID NO: 3515023 - RNA, 21 nt, Human
caagcagauuggagaaacccu

SEQ ID NO: 3515024 - RNA, 17 nt, Human
caagcagcaucuucugg

SEQ ID NO: 3515025 - RNA, 14 nt, Human
caagcaggaagcuc

SEQ ID NO: 3515026 - RNA, 16 nt, Human
caagcaggaaguucaa

SEQ ID NO: 3515027 - RNA, 14 nt, Human
caagcaggacaugg

SEQ ID NO: 3515028 - RNA, 14 nt, Human
caagcaggagacga

SEQ ID NO: 3515029 - RNA, 13 nt, Human
caagcagggagga

SEQ ID NO: 3515030 - RNA, 16 nt, Human
caagcagguuagagaa

SEQ ID NO: 3515031 - RNA, 19 nt, Human
caagcagucgugccugugu

SEQ ID NO: 3515032 - RNA, 18 nt, Human
caagcagucuacccaccu

SEQ ID NO: 3515033 - RNA, 15 nt, Human
caagcaucacuuuuu

SEQ ID NO: 3515034 - RNA, 15 nt, Human
caagcaucuccugag

SEQ ID NO: 3515035 - RNA, 17 nt, Human
caagcaugcagcuuugc

SEQ ID NO: 3515036 - RNA, 23 nt, Human
caagcauggucccacaucccugg

SEQ ID NO: 3515037 - RNA, 16 nt, Human
caagcauucagaagaa

SEQ ID NO: 3515038 - RNA, 21 nt, Human
caagcauuuaauguagccaug

SEQ ID NO: 3515039 - RNA, 22 nt, Human
caagcauuuaauguagccaugg

SEQ ID NO: 3515040 - RNA, 16 nt, Human
caagcauuuagaugua

SEQ ID NO: 3515041 - RNA, 18 nt, Human
caagccaacgacaaagcc

SEQ ID NO: 3515042 - RNA, 15 nt, Human
caagccaacuuguaa

SEQ ID NO: 3515043 - RNA, 20 nt, Human
caagccaacuuguaaauaca

SEQ ID NO: 3515044 - RNA, 21 nt, Human
caagccaacuuguaaauacac

SEQ ID NO: 3515045 - RNA, 22 nt, Human
caagccaagggaaccugugucc

SEQ ID NO: 3515046 - RNA, 14 nt, Human
caagccaauccccu

SEQ ID NO: 3515047 - RNA, 17 nt, Human
caagccaauccccuccu

SEQ ID NO: 3515048 - RNA, 13 nt, Human
caagccacagaag

SEQ ID NO: 3515049 - RNA, 22 nt, Human
caagccacagaagccaggagca

SEQ ID NO: 3515050 - RNA, 22 nt, Human
caagccaccaacauacucccau

SEQ ID NO: 3515051 - RNA, 21 nt, Human
caagccaccagaugugacagu

SEQ ID NO: 3515052 - RNA, 13 nt, Human
caagccagaacuu

SEQ ID NO: 3515053 - RNA, 20 nt, Human
caagccaggcucacucacag

SEQ ID NO: 3515054 - RNA, 18 nt, Human
caagccagggugugucuc

SEQ ID NO: 3515055 - RNA, 22 nt, Human
caagcccacagcacagcucccu

SEQ ID NO: 3515056 - RNA, 23 nt, Human
caagcccacagguguccccagcc

SEQ ID NO: 3515057 - RNA, 18 nt, Human
caagcccccccuuccacu

SEQ ID NO: 3515058 - RNA, 21 nt, Human
caagcccuccccaucccaugu

SEQ ID NO: 3515059 - RNA, 14 nt, Human
caagccguggcuuc

SEQ ID NO: 3515060 - RNA, 15 nt, Human
caagccguggcuucc

SEQ ID NO: 3515061 - RNA, 16 nt, Human
caagccguggcuuccc

SEQ ID NO: 3515062 - RNA, 18 nt, Human
caagccuaagggauccug

SEQ ID NO: 3515063 - RNA, 15 nt, Human
caagccuccacagcg

SEQ ID NO: 3515064 - RNA, 17 nt, Human
caagccuccacagcgag

SEQ ID NO: 3515065 - RNA, 18 nt, Human
caagccucugcccaggca

SEQ ID NO: 3515066 - RNA, 11 nt, Human
caagccugagg

SEQ ID NO: 3515067 - RNA, 15 nt, Human
caagccuggaaaaaa

SEQ ID NO: 3515068 - RNA, 14 nt, Human
caagccuggcaagg

SEQ ID NO: 3515069 - RNA, 15 nt, Human
caagccugugcaaaa

SEQ ID NO: 3515070 - RNA, 19 nt, Human
caagccugugcaaaaaaau

SEQ ID NO: 3515071 - RNA, 17 nt, Human
caagccuuggcucuacc

SEQ ID NO: 3515072 - RNA, 20 nt, Human
caagcgaggucaacagagaa

SEQ ID NO: 3515073 - RNA, 17 nt, Human
caagcgauucuccugcc

SEQ ID NO: 3515074 - RNA, 19 nt, Human
caagcgauucuucugcuuc

SEQ ID NO: 3515075 - RNA, 23 nt, Human
caagcgcauccaaucucaaggaa

SEQ ID NO: 3515076 - RNA, 13 nt, Human
caagcggugucuc

SEQ ID NO: 3515077 - RNA, 17 nt, Human
caagcuaauaaaauauc

SEQ ID NO: 3515078 - RNA, 19 nt, Human
caagcuaauaaaauaucau

SEQ ID NO: 3515079 - RNA, 17 nt, Human
caagcuagaaggccaca

SEQ ID NO: 3515080 - RNA, 17 nt, Human
caagcuaucuaaaguuu

SEQ ID NO: 3515081 - RNA, 16 nt, Human
caagcuauuccuuucc

SEQ ID NO: 3515082 - RNA, 23 nt, Human
caagcuauuccuuucccuuccuc

SEQ ID NO: 3515083 - RNA, 21 nt, Human
caagcucacaguuccucgccc

SEQ ID NO: 3515084 - RNA, 21 nt, Human
caagcucacuccccaaccccc

SEQ ID NO: 3515085 - RNA, 17 nt, Human
caagcucagaaggcucu

SEQ ID NO: 3515086 - RNA, 16 nt, Human
caagcucaggaccagg

SEQ ID NO: 3515087 - RNA, 17 nt, Human
caagcuccaagcuccca

SEQ ID NO: 3515088 - RNA, 21 nt, Human
caagcuccaagcucccaggca

SEQ ID NO: 3515089 - RNA, 21 nt, Human
caagcuccaucuccacuccag

SEQ ID NO: 3515090 - RNA, 18 nt, Human
caagcucccaagggaugg

SEQ ID NO: 3515091 - RNA, 22 nt, Human
caagcucccaagggauggugcc

SEQ ID NO: 3515092 - RNA, 13 nt, Human
caagcucccugcc

SEQ ID NO: 3515093 - RNA, 15 nt, Human
caagcuccgcaggac

SEQ ID NO: 3515094 - RNA, 15 nt, Human
caagcuccuccuccc

SEQ ID NO: 3515095 - RNA, 22 nt, Human
caagcuccuccucccugcaucu

SEQ ID NO: 3515096 - RNA, 14 nt, Human
caagcuccuccucg

SEQ ID NO: 3515097 - RNA, 17 nt, Human
caagcuccuugggaggc

SEQ ID NO: 3515098 - RNA, 13 nt, Human
caagcucucugca

SEQ ID NO: 3515099 - RNA, 12 nt, Human
caagcucucuug

SEQ ID NO: 3515100 - RNA, 13 nt, Human
caagcugaaauuu

SEQ ID NO: 3515101 - RNA, 18 nt, Human
caagcugaggugcccagg

SEQ ID NO: 3515102 - RNA, 20 nt, Human
caagcugaggugcccaggag

SEQ ID NO: 3515103 - RNA, 20 nt, Human
caagcugaguauuaaaaugu

SEQ ID NO: 3515104 - RNA, 15 nt, Human
caagcugaguuuccu

SEQ ID NO: 3515105 - RNA, 22 nt, Human
caagcugaguuuccuaugggaa

SEQ ID NO: 3515106 - RNA, 20 nt, Human
caagcugcacccucaggcag

SEQ ID NO: 3515107 - RNA, 21 nt, Human
caagcugcacccucaggcagg

SEQ ID NO: 3515108 - RNA, 12 nt, Human
caagcugccucc

SEQ ID NO: 3515109 - RNA, 14 nt, Human
caagcugccucccu

SEQ ID NO: 3515110 - RNA, 14 nt, Human
caagcugcuguggc

SEQ ID NO: 3515111 - RNA, 14 nt, Human
caagcuggaagcac

SEQ ID NO: 3515112 - RNA, 12 nt, Human
caagcuggccuc

SEQ ID NO: 3515113 - RNA, 13 nt, Human
caagcuggccucu

SEQ ID NO: 3515114 - RNA, 12 nt, Human
caagcuggcugg

SEQ ID NO: 3515115 - RNA, 23 nt, Human
caagcuggcugggguggccugug

SEQ ID NO: 3515116 - RNA, 12 nt, Human
caagcugggccc

SEQ ID NO: 3515117 - RNA, 17 nt, Human
caagcugggccccagcc

SEQ ID NO: 3515118 - RNA, 18 nt, Human
caagcugggccccagccc

SEQ ID NO: 3515119 - RNA, 22 nt, Human
caagcugggccccagcccaccc

SEQ ID NO: 3515120 - RNA, 23 nt, Human
caagcuggucccacucaguccau

SEQ ID NO: 3515121 - RNA, 23 nt, Human
caagcugugagacagugggaaau

SEQ ID NO: 3515122 - RNA, 16 nt, Human
caagcugugccacccu

SEQ ID NO: 3515123 - RNA, 17 nt, Human
caagcugugccacccug

SEQ ID NO: 3515124 - RNA, 19 nt, Human
caagcugugccacccuggg

SEQ ID NO: 3515125 - RNA, 14 nt, Human
caagcuuauuuugg

SEQ ID NO: 3515126 - RNA, 12 nt, Human
caagcuucaguu

SEQ ID NO: 3515127 - RNA, 19 nt, Human
caagcuucaguuuccuggu

SEQ ID NO: 3515128 - RNA, 22 nt, Human
caagcuucaguuuccuggucug

SEQ ID NO: 3515129 - RNA, 15 nt, Human
caagcuucugagacg

SEQ ID NO: 3515130 - RNA, 14 nt, Human
caagcuuuuuuauu

SEQ ID NO: 3515131 - RNA, 15 nt, Human
caagcuuuuuuauuu

SEQ ID NO: 3515132 - RNA, 19 nt, Human
caaaggggacaggccucac

SEQ ID NO: 3515133 - RNA, 20 nt, Human
caaaggggaucauaaaguua

SEQ ID NO: 3515134 - RNA, 16 nt, Human
caaaggguaucaggug

SEQ ID NO: 3515135 - RNA, 18 nt, Human
caaaggguaucaggugcu

SEQ ID NO: 3515136 - RNA, 19 nt, Human
caaaggguaucaggugcug

SEQ ID NO: 3515137 - RNA, 20 nt, Human
caaaggguaucaggugcugc

SEQ ID NO: 3515138 - RNA, 21 nt, Human
caaaggguaucaggugcugcc

SEQ ID NO: 3515139 - RNA, 23 nt, Human
caaagggugaagcuauuuaucug

SEQ ID NO: 3515140 - RNA, 13 nt, Human
caaaggguggaau

SEQ ID NO: 3515141 - RNA, 11 nt, Human
caaagggugug

SEQ ID NO: 3515142 - RNA, 23 nt, Human
caaaggguugggagcugaugaaa

SEQ ID NO: 3515143 - RNA, 16 nt, Human
caaaggguuuuaaugu

SEQ ID NO: 3515144 - RNA, 19 nt, Human
caaaggguuuuaauguaga

SEQ ID NO: 3515145 - RNA, 14 nt, Human
caaagguaaaucag

SEQ ID NO: 3515146 - RNA, 22 nt, Human
caaagguaaaucagacuaugaa

SEQ ID NO: 3515147 - RNA, 13 nt, Human
caaagguggcucu

SEQ ID NO: 3515148 - RNA, 14 nt, Human
caaagguucuaggu

SEQ ID NO: 3515149 - RNA, 15 nt, Human
caaagguugagaugu

SEQ ID NO: 3515150 - RNA, 20 nt, Human
caaagguuuaaaugaacaag

SEQ ID NO: 3515151 - RNA, 18 nt, Human
caaagguuuggaaggagc

SEQ ID NO: 3515152 - RNA, 11 nt, Human
caaagguuuuc

SEQ ID NO: 3515153 - RNA, 18 nt, Human
caaaguaaaacuugcugc

SEQ ID NO: 3515154 - RNA, 15 nt, Human
caaaguaaaagaaac

SEQ ID NO: 3515155 - RNA, 23 nt, Human
caaaguaaaagaaaccacuucug

SEQ ID NO: 3515156 - RNA, 22 nt, Human
caauauuauacuaagaaaagau

SEQ ID NO: 3515157 - RNA, 16 nt, Human
caauauucucuguaca

SEQ ID NO: 3515158 - RNA, 22 nt, Human
caauauucucuguacauauuag

SEQ ID NO: 3515159 - RNA, 15 nt, Human
caauauugaacuuuu

SEQ ID NO: 3515160 - RNA, 17 nt, Human
caauauugauugggaaa

SEQ ID NO: 3515161 - RNA, 20 nt, Human
caauauugauugggaaaaca

SEQ ID NO: 3515162 - RNA, 22 nt, Human
caauauuuaaggagauguaaga

SEQ ID NO: 3515163 - RNA, 18 nt, Human
caauauuuaaucuuuuau

SEQ ID NO: 3515164 - RNA, 14 nt, Human
caauauuuauuauu

SEQ ID NO: 3515165 - RNA, 13 nt, Human
caauauuuauugu

SEQ ID NO: 3515166 - RNA, 21 nt, Human
caauauuucagauaaucacaa

SEQ ID NO: 3515167 - RNA, 13 nt, Human
caauauuuguaga

SEQ ID NO: 3515168 - RNA, 16 nt, Human
caauauuuuaagcauu

SEQ ID NO: 3515169 - RNA, 23 nt, Human
caauauuuuaagcauuacucuug

SEQ ID NO: 3515170 - RNA, 15 nt, Human
caauauuuuccauga

SEQ ID NO: 3515171 - RNA, 20 nt, Human
caauauuuuccaugaaaaug

SEQ ID NO: 3515172 - RNA, 17 nt, Human
caauauuuucuuuuccc

SEQ ID NO: 3515173 - RNA, 14 nt, Human
caauauuuuuagau

SEQ ID NO: 3515174 - RNA, 16 nt, Human
caauauuuuuauauca

SEQ ID NO: 3515175 - RNA, 20 nt, Human
caauauuuuuauaucaugca

SEQ ID NO: 3515176 - RNA, 22 nt, Human
caauauuuuuauaucaugcaaa

SEQ ID NO: 3515177 - RNA, 17 nt, Human
caaucaaagcacuugga

SEQ ID NO: 3515178 - RNA, 14 nt, Human
caaucaaaucugcu

SEQ ID NO: 3515179 - RNA, 12 nt, Human
caaucaagauaa

SEQ ID NO: 3515180 - RNA, 19 nt, Human
caaucaagguuauaauuuu

SEQ ID NO: 3515181 - RNA, 20 nt, Human
caaucaagguuauaauuuuu

SEQ ID NO: 3515182 - RNA, 17 nt, Human
caacuucaguccuggga

SEQ ID NO: 3515183 - RNA, 16 nt, Human
caacuucaucuggaag

SEQ ID NO: 3515184 - RNA, 17 nt, Human
caacuucaucuggaagu

SEQ ID NO: 3515185 - RNA, 19 nt, Human
caacuucaugucaacuucu

SEQ ID NO: 3515186 - RNA, 23 nt, Human
caacuucccaguucaggaguccc

SEQ ID NO: 3515187 - RNA, 14 nt, Human
caacuucguuuccu

SEQ ID NO: 3515188 - RNA, 14 nt, Human
caacuucuaauugc

SEQ ID NO: 3515189 - RNA, 16 nt, Human
caacuucuaauugcca

SEQ ID NO: 3515190 - RNA, 19 nt, Human
caacuucuacuucugcccu

SEQ ID NO: 3515191 - RNA, 20 nt, Human
caacuugaacuucaccugca

SEQ ID NO: 3515192 - RNA, 9 nt, Human
caacuugag

SEQ ID NO: 3515193 - RNA, 22 nt, Human
caacuugagauguaugaaggcu

SEQ ID NO: 3515194 - RNA, 20 nt, Human
caacuugagcauguuacuga

SEQ ID NO: 3515195 - RNA, 13 nt, Human
caacuugagggcc

SEQ ID NO: 3515196 - RNA, 19 nt, Human
caacuugagggcccagagc

SEQ ID NO: 3515197 - RNA, 20 nt, Human
caacuugagggcccagagca

SEQ ID NO: 3515198 - RNA, 21 nt, Human
caacuugagggcccagagcag

SEQ ID NO: 3515199 - RNA, 22 nt, Human
caacuugagggcccagagcagg

SEQ ID NO: 3515200 - RNA, 22 nt, Human
caacuugcauccaacuccagga

SEQ ID NO: 3515201 - RNA, 17 nt, Human
caacuugccuuugaaga

SEQ ID NO: 3515202 - RNA, 19 nt, Human
caacuuggcuuccuuucuu

SEQ ID NO: 3515203 - RNA, 12 nt, Human
caacuuggcuuu

SEQ ID NO: 3515204 - RNA, 12 nt, Human
caacuugggaac

SEQ ID NO: 3515205 - RNA, 18 nt, Human
caacuugguucugcuuca

SEQ ID NO: 3515206 - RNA, 13 nt, Human
caacuuguaaaua

SEQ ID NO: 3515207 - RNA, 16 nt, Human
caacuuguaaauacac

SEQ ID NO: 3515208 - RNA, 19 nt, Human
caacuuguccuagcacaga

SEQ ID NO: 3515209 - RNA, 20 nt, Human
caacuuguccuagcacagau

SEQ ID NO: 3515210 - RNA, 16 nt, Human
caacuuuaagaggaca

SEQ ID NO: 3515211 - RNA, 22 nt, Human
caacuuuaagcagcucuugcua

SEQ ID NO: 3515212 - RNA, 17 nt, Human
caacuuucaagaacuug

SEQ ID NO: 3515213 - RNA, 11 nt, Human
caacuuucugu

SEQ ID NO: 3515214 - RNA, 14 nt, Human
caacuuugaauaaa

SEQ ID NO: 3515215 - RNA, 22 nt, Human
caacuuuguaaaaaucuuuuga

SEQ ID NO: 3515216 - RNA, 12 nt, Human
caacuuuguaua

SEQ ID NO: 3515217 - RNA, 22 nt, Human
caacuuuguggaugucuuccuu

SEQ ID NO: 3515218 - RNA, 21 nt, Human
caacuuuuaaccaaacaauua

SEQ ID NO: 3515219 - RNA, 13 nt, Human
caacuuuucuauu

SEQ ID NO: 3515220 - RNA, 20 nt, Human
caacuuuuguguaaugaaaa

SEQ ID NO: 3515221 - RNA, 14 nt, Human
caacuuuuuauugc

SEQ ID NO: 3515222 - RNA, 18 nt, Human
caacuuuuuauugccuuc

SEQ ID NO: 3515223 - RNA, 20 nt, Human
caacuuuuuauugccuucuc

SEQ ID NO: 3515224 - RNA, 15 nt, Human
caacuuuuuuuucuu

SEQ ID NO: 3515225 - RNA, 14 nt, Human
caagaaaaauaaag

SEQ ID NO: 3515226 - RNA, 17 nt, Human
caagaaaaauaaagaaa

SEQ ID NO: 3515227 - RNA, 23 nt, Human
caagaaaaauaaagaaaagaugc

SEQ ID NO: 3515228 - RNA, 19 nt, Human
caagaaaacaggcacugcc

SEQ ID NO: 3515229 - RNA, 12 nt, Human
caagaaaagagu

SEQ ID NO: 3515230 - RNA, 18 nt, Human
caagaaaaucagguauua

SEQ ID NO: 3515231 - RNA, 16 nt, Human
caagaaacagccagca

SEQ ID NO: 3515232 - RNA, 19 nt, Human
caagaaacagccagcaaga

SEQ ID NO: 3515233 - RNA, 19 nt, Human
caagaaacugaggaauuuu

SEQ ID NO: 3515234 - RNA, 14 nt, Human
caagaaagauguau

SEQ ID NO: 3515235 - RNA, 17 nt, Human
caagaaaggaaaccuuu

SEQ ID NO: 3515236 - RNA, 13 nt, Human
caagaaaggagag

SEQ ID NO: 3515237 - RNA, 13 nt, Human
caagaaauaaaag

SEQ ID NO: 3515238 - RNA, 14 nt, Human
caagaaaucccugu

SEQ ID NO: 3515239 - RNA, 12 nt, Human
caagaaaugaag

SEQ ID NO: 3515240 - RNA, 17 nt, Human
caagaaaugaagagcug

SEQ ID NO: 3515241 - RNA, 20 nt, Human
caagaacacagcccugcuuc

SEQ ID NO: 3515242 - RNA, 17 nt, Human
caagaacagcaggccca

SEQ ID NO: 3515243 - RNA, 19 nt, Human
caagaacucaucacugugg

SEQ ID NO: 3515244 - RNA, 16 nt, Human
caagaacugaaaacau

SEQ ID NO: 3515245 - RNA, 17 nt, Human
caagaacugaaaacaua

SEQ ID NO: 3515246 - RNA, 13 nt, Human
caagaacugcaug

SEQ ID NO: 3515247 - RNA, 18 nt, Human
caagaacugcauggaccu

SEQ ID NO: 3515248 - RNA, 15 nt, Human
caagaacuuguuuaa

SEQ ID NO: 3515249 - RNA, 20 nt, Human
caagaacuuuccaggaaggc

SEQ ID NO: 3515250 - RNA, 13 nt, Human
caagaagaccaga

SEQ ID NO: 3515251 - RNA, 21 nt, Human
caagaagaccagacuguggag

SEQ ID NO: 3515252 - RNA, 19 nt, Human
caagaagaucacgcucccc

SEQ ID NO: 3515253 - RNA, 11 nt, Human
caagaagauga

SEQ ID NO: 3515254 - RNA, 14 nt, Human
caagaagcaggcua

SEQ ID NO: 3515255 - RNA, 15 nt, Human
caagaagccuuuccu

SEQ ID NO: 3515256 - RNA, 18 nt, Human
caagaaggaaagauuuug

SEQ ID NO: 3515257 - RNA, 13 nt, Human
caagaaggcuggg

SEQ ID NO: 3515258 - RNA, 13 nt, Human
caagaagggacug

SEQ ID NO: 3515259 - RNA, 20 nt, Human
caagaagggcugcaugaugu

SEQ ID NO: 3515260 - RNA, 21 nt, Human
caagaaguucuuugauucugu

SEQ ID NO: 3515261 - RNA, 15 nt, Human
caagaaguuuaagga

SEQ ID NO: 3515262 - RNA, 15 nt, Human
caagaauaaaggcag

SEQ ID NO: 3515263 - RNA, 17 nt, Human
caagaauaaaggcagcu

SEQ ID NO: 3515264 - RNA, 18 nt, Human
caagaauaaaggcagcug

SEQ ID NO: 3515265 - RNA, 21 nt, Human
caagaauaaaggcagcuguug

SEQ ID NO: 3515266 - RNA, 22 nt, Human
caagaauagcaucuguacaaag

SEQ ID NO: 3515267 - RNA, 23 nt, Human
caagaauagcaucuguacaaagg

SEQ ID NO: 3515268 - RNA, 18 nt, Human
caagaaucagugcaaaga

SEQ ID NO: 3515269 - RNA, 18 nt, Human
caagaauccacauuucua

SEQ ID NO: 3515270 - RNA, 19 nt, Human
caagaauccacauuucuaa

SEQ ID NO: 3515271 - RNA, 23 nt, Human
caagaaugacggaauaagagacc

SEQ ID NO: 3515272 - RNA, 17 nt, Human
caagaaugcauugauau

SEQ ID NO: 3515273 - RNA, 13 nt, Human
caagaauggauca

SEQ ID NO: 3515274 - RNA, 15 nt, Human
caagaaugguggcuu

SEQ ID NO: 3515275 - RNA, 20 nt, Human
caagaauguacguccagccu

SEQ ID NO: 3515276 - RNA, 16 nt, Human
caagacagaugcccca

SEQ ID NO: 3515277 - RNA, 22 nt, Human
caagacagaugccccagagcug

SEQ ID NO: 3515278 - RNA, 11 nt, Human
caagacauugu

SEQ ID NO: 3515279 - RNA, 14 nt, Human
caagacauugucaa

SEQ ID NO: 3515280 - RNA, 17 nt, Human
caagacauugucaauaa

SEQ ID NO: 3515281 - RNA, 18 nt, Human
caagacauugucaauaaa

SEQ ID NO: 3515282 - RNA, 17 nt, Human
caagaccacguuucuaa

SEQ ID NO: 3515283 - RNA, 13 nt, Human
caagacccccagc

SEQ ID NO: 3515284 - RNA, 15 nt, Human
caagaccuaggcuca

SEQ ID NO: 3515285 - RNA, 24 nt, Human
caagaccucagggcacaaagaugg

SEQ ID NO: 3515286 - RNA, 20 nt, Human
caagaccuucaccaaacaua

SEQ ID NO: 3515287 - RNA, 23 nt, Human
caagaccuucuccuucaccuuug

SEQ ID NO: 3515288 - RNA, 13 nt, Human
caagacgcugugc

SEQ ID NO: 3515289 - RNA, 15 nt, Human
caagacgcugugcug

SEQ ID NO: 3515290 - RNA, 22 nt, Human
caagacucccucgucgagcugg

SEQ ID NO: 3515291 - RNA, 14 nt, Human
caagacucuagagu

SEQ ID NO: 3515292 - RNA, 17 nt, Human
caagacucuagagucca

SEQ ID NO: 3515293 - RNA, 21 nt, Human
caagacucuagaguccaaggu

SEQ ID NO: 3515294 - RNA, 23 nt, Human
caagacugcuguggccaggaggu

SEQ ID NO: 3515295 - RNA, 17 nt, Human
caagacuguugcucaaa

SEQ ID NO: 3515296 - RNA, 18 nt, Human
caagacuguugcucaaau

SEQ ID NO: 3515297 - RNA, 19 nt, Human
caagacuucgggaaggugu

SEQ ID NO: 3515298 - RNA, 21 nt, Human
caagacuucgggaaggugucu

SEQ ID NO: 3515299 - RNA, 18 nt, Human
caagagaaaggccugcac

SEQ ID NO: 3515300 - RNA, 23 nt, Human
caagagaacucgcgcucaguaaa

SEQ ID NO: 3515301 - RNA, 14 nt, Human
caauugagaaaaau

SEQ ID NO: 3515302 - RNA, 14 nt, Human
caauugcaucuccc

SEQ ID NO: 3515303 - RNA, 17 nt, Human
caauugcugcuacuuau

SEQ ID NO: 3515304 - RNA, 15 nt, Human
caauuggcaccgaag

SEQ ID NO: 3515305 - RNA, 21 nt, Human
caauuggcaccgaagcccaga

SEQ ID NO: 3515306 - RNA, 20 nt, Human
caauugggagcugccaagag

SEQ ID NO: 3515307 - RNA, 21 nt, Human
caauugguaaaacucacugug

SEQ ID NO: 3515308 - RNA, 15 nt, Human
caauugucacuuuuu

SEQ ID NO: 3515309 - RNA, 17 nt, Human
caauugucacuuuuuau

SEQ ID NO: 3515310 - RNA, 14 nt, Human
caauugucauuuau

SEQ ID NO: 3515311 - RNA, 16 nt, Human
caauugucauuuauaa

SEQ ID NO: 3515312 - RNA, 23 nt, Human
caauugugaaaaaauuuacuuua

SEQ ID NO: 3515313 - RNA, 18 nt, Human
caauugugagccaccacg

SEQ ID NO: 3515314 - RNA, 13 nt, Human
caauugugcugcc

SEQ ID NO: 3515315 - RNA, 18 nt, Human
caauuguguagccuuuuu

SEQ ID NO: 3515316 - RNA, 21 nt, Human
caauuguugacaguucugaag

SEQ ID NO: 3515317 - RNA, 22 nt, Human
caauuguuugggguugaaaauu

SEQ ID NO: 3515318 - RNA, 22 nt, Human
caauuguuugggugauuccuaa

SEQ ID NO: 3515319 - RNA, 12 nt, Human
caauuuaaaaaa

SEQ ID NO: 3515320 - RNA, 15 nt, Human
caauuuaaacccauu

SEQ ID NO: 3515321 - RNA, 22 nt, Human
caauuuaaacccauuuuaguca

SEQ ID NO: 3515322 - RNA, 17 nt, Human
caauuuacaaagugugu

SEQ ID NO: 3515323 - RNA, 21 nt, Human
caauuuacaaaguguguauua

SEQ ID NO: 3515324 - RNA, 17 nt, Human
caauuuaguuguuguag

SEQ ID NO: 3515325 - RNA, 20 nt, Human
caauuuaguuguuguagaga

SEQ ID NO: 3515326 - RNA, 14 nt, Human
caauuuauaccuca

SEQ ID NO: 3515327 - RNA, 22 nt, Human
caauuuauaccucaauuuucac

SEQ ID NO: 3515328 - RNA, 22 nt, Human
caauuuauuaaaaugauuguaa

SEQ ID NO: 3515329 - RNA, 14 nt, Human
caauuuauucaaga

SEQ ID NO: 3515330 - RNA, 20 nt, Human
caauuucaaaaaaauaaaau

SEQ ID NO: 3515331 - RNA, 21 nt, Human
caauuucaaaaaaauaaaaua

SEQ ID NO: 3515332 - RNA, 17 nt, Human
caauuucaaauuacucu

SEQ ID NO: 3515333 - RNA, 16 nt, Human
caauuucaagguucua

SEQ ID NO: 3515334 - RNA, 17 nt, Human
caauuuccaagagcuga

SEQ ID NO: 3515335 - RNA, 16 nt, Human
caauuuccuuuauauu

SEQ ID NO: 3515336 - RNA, 21 nt, Human
caauuuccuuuauauuuagug

SEQ ID NO: 3515337 - RNA, 17 nt, Human
caauuucggauuuuuuc

SEQ ID NO: 3515338 - RNA, 21 nt, Human
caauuucggauuuuuuccaaa

SEQ ID NO: 3515339 - RNA, 22 nt, Human
caauuucggauuuuuuccaaaa

SEQ ID NO: 3515340 - RNA, 20 nt, Human
caauuucuacaaaauccuga

SEQ ID NO: 3515341 - RNA, 20 nt, Human
caauuucuacuuugaaguca

SEQ ID NO: 3515342 - RNA, 21 nt, Human
caauuucuacuuugaagucau

SEQ ID NO: 3515343 - RNA, 14 nt, Human
caauuugauacaua

SEQ ID NO: 3515344 - RNA, 15 nt, Human
caauuugauacauaa

SEQ ID NO: 3515345 - RNA, 23 nt, Human
caauuugcacaucuuggcuaugu

SEQ ID NO: 3515346 - RNA, 20 nt, Human
caauuugcacuaaaucagag

SEQ ID NO: 3515347 - RNA, 21 nt, Human
caauuugcacuaaaucagaga

SEQ ID NO: 3515348 - RNA, 21 nt, Human
caauuuggauuuaaaagccug

SEQ ID NO: 3515349 - RNA, 23 nt, Human
caauuuggauuuaaaagccugcu

SEQ ID NO: 3515350 - RNA, 19 nt, Human
aucugugcuuuccagcuca

SEQ ID NO: 3515351 - RNA, 23 nt, Human
aucugugggucugggagucacac

SEQ ID NO: 3515352 - RNA, 20 nt, Human
aucuguguauauuauuuggc

SEQ ID NO: 3515353 - RNA, 14 nt, Human
aucugugucuuguu

SEQ ID NO: 3515354 - RNA, 17 nt, Human
aucugugugaaaauggg

SEQ ID NO: 3515355 - RNA, 15 nt, Human
aucugugugaaacuu

SEQ ID NO: 3515356 - RNA, 18 nt, Human
aucuguguuuuugaaaua

SEQ ID NO: 3515357 - RNA, 12 nt, Human
aucuguuacaca

SEQ ID NO: 3515358 - RNA, 18 nt, Human
aucuguuagaugcuacua

SEQ ID NO: 3515359 - RNA, 16 nt, Human
aucuguuccuuggcag

SEQ ID NO: 3515360 - RNA, 19 nt, Human
aucuguucuuuaauuuauu

SEQ ID NO: 3515361 - RNA, 17 nt, Human
aucuguugauaaaucca

SEQ ID NO: 3515362 - RNA, 13 nt, Human
aucuguugcaaac

SEQ ID NO: 3515363 - RNA, 21 nt, Human
aucuguuguguacguggagag

SEQ ID NO: 3515364 - RNA, 23 nt, Human
aucuguuguguacguggagaggg

SEQ ID NO: 3515365 - RNA, 17 nt, Human
aucuguuuaaagcauau

SEQ ID NO: 3515366 - RNA, 21 nt, Human
aucuguuuaaaguagauuaga

SEQ ID NO: 3515367 - RNA, 13 nt, Human
aucuguuugagaa

SEQ ID NO: 3515368 - RNA, 19 nt, Human
aucuguuugagaaagucag

SEQ ID NO: 3515369 - RNA, 21 nt, Human
aucuguuuugugguuuggaau

SEQ ID NO: 3515370 - RNA, 19 nt, Human
aucuguuuuuaaaaaucau

SEQ ID NO: 3515371 - RNA, 15 nt, Human
aucuguuuuuacgua

SEQ ID NO: 3515372 - RNA, 18 nt, Human
aucuuaaagaaacagcuu

SEQ ID NO: 3515373 - RNA, 22 nt, Human
aucuuaaagaaacagcuuucaa

SEQ ID NO: 3515374 - RNA, 23 nt, Human
aucuuaaagaaacagcuuucaag

SEQ ID NO: 3515375 - RNA, 19 nt, Human
aucuuaaaguguguuucua

SEQ ID NO: 3515376 - RNA, 23 nt, Human
aucuuaacucuuugccuuugcca

SEQ ID NO: 3515377 - RNA, 17 nt, Human
aucuuaauacuguuauu

SEQ ID NO: 3515378 - RNA, 20 nt, Human
aucuuaauacuguuauucuu

SEQ ID NO: 3515379 - RNA, 21 nt, Human
aucuuaauacuguuauucuuu

SEQ ID NO: 3515380 - RNA, 14 nt, Human
aucuuaauauaaau

SEQ ID NO: 3515381 - RNA, 23 nt, Human
aucuuaauauauuucuaaauguu

SEQ ID NO: 3515382 - RNA, 19 nt, Human
aucuuaaucuguuuauuua

SEQ ID NO: 3515383 - RNA, 21 nt, Human
aucuuaaugaaugagucuguu

SEQ ID NO: 3515384 - RNA, 15 nt, Human
aucuuaauguaucaa

SEQ ID NO: 3515385 - RNA, 12 nt, Human
aucuuaauguuc

SEQ ID NO: 3515386 - RNA, 18 nt, Human
aucuuaauuuugguugua

SEQ ID NO: 3515387 - RNA, 19 nt, Human
aucuuaauuuugguuguau

SEQ ID NO: 3515388 - RNA, 23 nt, Human
aucuuaauuuugguuguauucuu

SEQ ID NO: 3515389 - RNA, 22 nt, Human
aucuuacaacaggcuuaugaau

SEQ ID NO: 3515390 - RNA, 15 nt, Human
aucuuacaauauuga

SEQ ID NO: 3515391 - RNA, 19 nt, Human
aucuuacuuuguaaauucu

SEQ ID NO: 3515392 - RNA, 20 nt, Human
aucuuacuuuguaaauucug

SEQ ID NO: 3515393 - RNA, 21 nt, Human
aucuuacuuuguaaauucuga

SEQ ID NO: 3515394 - RNA, 15 nt, Human
aucuuagauucucug

SEQ ID NO: 3515395 - RNA, 22 nt, Human
aucuuagauucucugugucuaa

SEQ ID NO: 3515396 - RNA, 13 nt, Human
aucuuaguguaug

SEQ ID NO: 3515397 - RNA, 16 nt, Human
aucuuaguguaugauu

SEQ ID NO: 3515398 - RNA, 19 nt, Human
aucuuaguguaugauuacu

SEQ ID NO: 3515399 - RNA, 24 nt, Human
aucuuauaaaguggaaguauguau

SEQ ID NO: 3515400 - RNA, 14 nt, Human
aucuuauaauuguu

SEQ ID NO: 3515401 - RNA, 14 nt, Human
aucuuauaauuuaa

SEQ ID NO: 3515402 - RNA, 17 nt, Human
aucuuauagcacuuuga

SEQ ID NO: 3515403 - RNA, 14 nt, Human
aucuuaucucagau

SEQ ID NO: 3515404 - RNA, 20 nt, Human
aucuuaucucagauauuugc

SEQ ID NO: 3515405 - RNA, 13 nt, Human
aucuuauuaaagu

SEQ ID NO: 3515406 - RNA, 19 nt, Human
aucuuauuaaaguuucaaa

SEQ ID NO: 3515407 - RNA, 20 nt, Human
aucuuauuaaaguuucaaaa

SEQ ID NO: 3515408 - RNA, 18 nt, Human
aucuuauucauuuucucu

SEQ ID NO: 3515409 - RNA, 23 nt, Human
aucuuauuuucauguauaugugu

SEQ ID NO: 3515410 - RNA, 19 nt, Human
aucuuauuuuucuaaacgu

SEQ ID NO: 3515411 - RNA, 17 nt, Human
aucuucaaaaguaaugc

SEQ ID NO: 3515412 - RNA, 13 nt, Human
aucuucaacaaau

SEQ ID NO: 3515413 - RNA, 22 nt, Human
aucuucaccagaggaaucacuc

SEQ ID NO: 3515414 - RNA, 23 nt, Human
aucuucacuucuaaaugcauauc

SEQ ID NO: 3515415 - RNA, 17 nt, Human
aucuucaguugucucug

SEQ ID NO: 3515416 - RNA, 18 nt, Human
aucuucaguugucucuga

SEQ ID NO: 3515417 - RNA, 22 nt, Human
aucuucaguuuuaucuuuaauc

SEQ ID NO: 3515418 - RNA, 17 nt, Human
aucuuccagaaguguga

SEQ ID NO: 3515419 - RNA, 18 nt, Human
aucuuccauauuuggaag

SEQ ID NO: 3515420 - RNA, 23 nt, Human
aucuucccagcagggccacuccc

SEQ ID NO: 3515421 - RNA, 15 nt, Human
aucuuccucugcuaa

SEQ ID NO: 3515422 - RNA, 18 nt, Human
aucuuccuggucgaaagu

SEQ ID NO: 3515423 - RNA, 12 nt, Human
aucuuccugugu

SEQ ID NO: 3515424 - RNA, 15 nt, Human
aucuuccuguguccu

SEQ ID NO: 3515425 - RNA, 15 nt, Human
aucuucguuaguaau

SEQ ID NO: 3515426 - RNA, 19 nt, Human
aucuucguuaguaaucugu

SEQ ID NO: 3515427 - RNA, 21 nt, Human
aucuucguuaguaaucuguau

SEQ ID NO: 3515428 - RNA, 22 nt, Human
aucuucguuaguaaucuguaua

SEQ ID NO: 3515429 - RNA, 15 nt, Human
aucuucguucuuguu

SEQ ID NO: 3515430 - RNA, 19 nt, Human
aucuucucaaguucuaaga

SEQ ID NO: 3515431 - RNA, 23 nt, Human
aucuucucaaguucuaagauucu

SEQ ID NO: 3515432 - RNA, 12 nt, Human
aucuucucagcu

SEQ ID NO: 3515433 - RNA, 16 nt, Human
aucuucucagcuccca

SEQ ID NO: 3515434 - RNA, 17 nt, Human
aucuucucuuugacaau

SEQ ID NO: 3515435 - RNA, 19 nt, Human
aucuucugaaaugaaacaa

SEQ ID NO: 3515436 - RNA, 18 nt, Human
aucuucugccuucucaug

SEQ ID NO: 3515437 - RNA, 19 nt, Human
aucuucuggacuauagcug

SEQ ID NO: 3515438 - RNA, 18 nt, Human
aucuucuggagucuccag

SEQ ID NO: 3515439 - RNA, 17 nt, Human
aucuugaaggaaaaauu

SEQ ID NO: 3515440 - RNA, 20 nt, Human
aucuugaauccuuccauucc

SEQ ID NO: 3515441 - RNA, 14 nt, Human
aucuugaauguggu

SEQ ID NO: 3515442 - RNA, 16 nt, Human
aucuugaauuguaacu

SEQ ID NO: 3515443 - RNA, 22 nt, Human
caauggaccggagagugggggu

SEQ ID NO: 3515444 - RNA, 23 nt, Human
caauggaguagaccccuggcugg

SEQ ID NO: 3515445 - RNA, 13 nt, Human
caauggauuugau

SEQ ID NO: 3515446 - RNA, 11 nt, Human
caauggcagcc

SEQ ID NO: 3515447 - RNA, 14 nt, Human
caauggcagccuug

SEQ ID NO: 3515448 - RNA, 21 nt, Human
caauggccuaaaacuggccug

SEQ ID NO: 3515449 - RNA, 16 nt, Human
caauggcgcagugccu

SEQ ID NO: 3515450 - RNA, 18 nt, Human
caauggcgcagugccucu

SEQ ID NO: 3515451 - RNA, 16 nt, Human
caauggcuaauuccca

SEQ ID NO: 3515452 - RNA, 18 nt, Human
caauggcuaauucccaga

SEQ ID NO: 3515453 - RNA, 19 nt, Human
caauggcuaauucccagag

SEQ ID NO: 3515454 - RNA, 22 nt, Human
caauggcuauauggcaagaaag

SEQ ID NO: 3515455 - RNA, 17 nt, Human
caauggcuauuaacaau

SEQ ID NO: 3515456 - RNA, 20 nt, Human
caauggcuauuaacaauuaa

SEQ ID NO: 3515457 - RNA, 17 nt, Human
caaugggaccuguggcu

SEQ ID NO: 3515458 - RNA, 19 nt, Human
caaugggagcugaggccac

SEQ ID NO: 3515459 - RNA, 15 nt, Human
caaugggcacuggga

SEQ ID NO: 3515460 - RNA, 19 nt, Human
caaugggcacugggaugag

SEQ ID NO: 3515461 - RNA, 23 nt, Human
caauggugaacugucauuacaga

SEQ ID NO: 3515462 - RNA, 17 nt, Human
caaugguguugcccuga

SEQ ID NO: 3515463 - RNA, 22 nt, Human
caaugguguugcccugagugga

SEQ ID NO: 3515464 - RNA, 17 nt, Human
caaugguuugcaaggaa

SEQ ID NO: 3515465 - RNA, 20 nt, Human
caaugguuugcaaggaagcc

SEQ ID NO: 3515466 - RNA, 21 nt, Human
caaugguuuuuaaauuuugua

SEQ ID NO: 3515467 - RNA, 20 nt, Human
caauguaaacacuuaacaga

SEQ ID NO: 3515468 - RNA, 13 nt, Human
caauguaauuauu

SEQ ID NO: 3515469 - RNA, 22 nt, Human
caauguaauuauuuauguaugg

SEQ ID NO: 3515470 - RNA, 22 nt, Human
caauguacuaggauacugcugc

SEQ ID NO: 3515471 - RNA, 17 nt, Human
caauguagaaagcuuug

SEQ ID NO: 3515472 - RNA, 23 nt, Human
caauguagucagaauuagcugcu

SEQ ID NO: 3515473 - RNA, 20 nt, Human
caauguauuuauuuaaaaga

SEQ ID NO: 3515474 - RNA, 23 nt, Human
caauguauuuauuuaaaagauuc

SEQ ID NO: 3515475 - RNA, 14 nt, Human
caaugucaguauuu

SEQ ID NO: 3515476 - RNA, 15 nt, Human
caaugucugagugaa

SEQ ID NO: 3515477 - RNA, 15 nt, Human
caaugucugcagccc

SEQ ID NO: 3515478 - RNA, 20 nt, Human
caaugucuggagaccaccag

SEQ ID NO: 3515479 - RNA, 21 nt, Human
caaugucuggagaccaccagg

SEQ ID NO: 3515480 - RNA, 20 nt, Human
caaugucugugcuagggaaa

SEQ ID NO: 3515481 - RNA, 11 nt, Human
caaugucuuga

SEQ ID NO: 3515482 - RNA, 21 nt, Human
caaugucuugaugcaugcacu

SEQ ID NO: 3515483 - RNA, 19 nt, Human
caaugucuugguacuugcu

SEQ ID NO: 3515484 - RNA, 18 nt, Human
caaugugaaaaauguguc

SEQ ID NO: 3515485 - RNA, 22 nt, Human
caaugugaaaagaaaaaugagc

SEQ ID NO: 3515486 - RNA, 14 nt, Human
caaugugaacuuua

SEQ ID NO: 3515487 - RNA, 22 nt, Human
caaugugacuuaaugccacuaa

SEQ ID NO: 3515488 - RNA, 20 nt, Human
caaugugaggggucccuagc

SEQ ID NO: 3515489 - RNA, 18 nt, Human
caaugugauauaaacagc

SEQ ID NO: 3515490 - RNA, 15 nt, Human
caaugugaucuaugu

SEQ ID NO: 3515491 - RNA, 22 nt, Human
caaugugaucuauguuucaucu

SEQ ID NO: 3515492 - RNA, 16 nt, Human
caaugugcuacugauu

SEQ ID NO: 3515493 - RNA, 23 nt, Human
caauguggcaaggaaaaacaggu

SEQ ID NO: 3515494 - RNA, 15 nt, Human
caauguguauaaaca

SEQ ID NO: 3515495 - RNA, 23 nt, Human
caauguguauaaacaagaaaaau

SEQ ID NO: 3515496 - RNA, 12 nt, Human
caauguguguau

SEQ ID NO: 3515497 - RNA, 14 nt, Human
caauguguguauau

SEQ ID NO: 3515498 - RNA, 15 nt, Human
caauguuaaauuaau

SEQ ID NO: 3515499 - RNA, 16 nt, Human
caauguuaaggaaacu

SEQ ID NO: 3515500 - RNA, 20 nt, Human
caauguuaaggaaacucuua

SEQ ID NO: 3515501 - RNA, 19 nt, Human
caauguuacuaucugcuuu

SEQ ID NO: 3515502 - RNA, 13 nt, Human
caauguucaucau

SEQ ID NO: 3515503 - RNA, 14 nt, Human
caauguucauccca

SEQ ID NO: 3515504 - RNA, 15 nt, Human
caauguucaucccau

SEQ ID NO: 3515505 - RNA, 20 nt, Human
caauguuuaugcaaggaagg

SEQ ID NO: 3515506 - RNA, 22 nt, Human
caauguuucaagaggagccccc

SEQ ID NO: 3515507 - RNA, 20 nt, Human
caauguuuuccuuugucauc

SEQ ID NO: 3515508 - RNA, 15 nt, Human
caauuaaacggauua

SEQ ID NO: 3515509 - RNA, 16 nt, Human
caauuaaacggauuau

SEQ ID NO: 3515510 - RNA, 13 nt, Human
caauuaaagaaau

SEQ ID NO: 3515511 - RNA, 15 nt, Human
caauuaaagaaauaa

SEQ ID NO: 3515512 - RNA, 22 nt, Human
caauuaaauguagguaugaaua

SEQ ID NO: 3515513 - RNA, 21 nt, Human
caauuaaggauuuuaugcuuu

SEQ ID NO: 3515514 - RNA, 18 nt, Human
caauuaauaguuugucua

SEQ ID NO: 3515515 - RNA, 13 nt, Human
caauuaaugcuuu

SEQ ID NO: 3515516 - RNA, 19 nt, Human
caauuaauugcuauugugu

SEQ ID NO: 3515517 - RNA, 18 nt, Human
caauuaauugucuugcac

SEQ ID NO: 3515518 - RNA, 13 nt, Human
caauuaauuuuuu

SEQ ID NO: 3515519 - RNA, 23 nt, Human
caauuaauuuuuuuauuguuuaa

SEQ ID NO: 3515520 - RNA, 19 nt, Human
caauuacaacggagucaaa

SEQ ID NO: 3515521 - RNA, 16 nt, Human
caauuacaggaaguac

SEQ ID NO: 3515522 - RNA, 17 nt, Human
caauuacaggaaguacu

SEQ ID NO: 3515523 - RNA, 18 nt, Human
caauuacaggaaguacug

SEQ ID NO: 3515524 - RNA, 17 nt, Human
caauuacugguccaaaa

SEQ ID NO: 3515525 - RNA, 17 nt, Human
caauuacuuuagaaaau

SEQ ID NO: 3515526 - RNA, 15 nt, Human
caauuacuuugguag

SEQ ID NO: 3515527 - RNA, 21 nt, Human
caauuagcaauugacugucac

SEQ ID NO: 3515528 - RNA, 17 nt, Human
caauuagguuuuuccuu

SEQ ID NO: 3515529 - RNA, 14 nt, Human
caauuaguuuccuu

SEQ ID NO: 3515530 - RNA, 21 nt, Human
caauuaguuuccuuuuuaaua

SEQ ID NO: 3515531 - RNA, 22 nt, Human
caauuauaaacucauuuugcuu

SEQ ID NO: 3515532 - RNA, 16 nt, Human
caauuauggaaaaaaa

SEQ ID NO: 3515533 - RNA, 18 nt, Human
caauuauggaaaaaaaau

SEQ ID NO: 3515534 - RNA, 18 nt, Human
caauuauugauauauauu

SEQ ID NO: 3515535 - RNA, 22 nt, Human
caauuauuguuacacauuaagu

SEQ ID NO: 3515536 - RNA, 23 nt, Human
caauuauuguuacacauuaagua

SEQ ID NO: 3515537 - RNA, 15 nt, Human
caauuauuuccccca

SEQ ID NO: 3515538 - RNA, 16 nt, Human
caauucaaaaauguac

SEQ ID NO: 3515539 - RNA, 17 nt, Human
caauucaaaaguuccaa

SEQ ID NO: 3515540 - RNA, 14 nt, Human
caauucaacccuuu

SEQ ID NO: 3515541 - RNA, 17 nt, Human
caauucaauacaaacaa

SEQ ID NO: 3515542 - RNA, 20 nt, Human
caauucauauuuaugaaucu

SEQ ID NO: 3515543 - RNA, 18 nt, Human
caauucauccucacucag

SEQ ID NO: 3515544 - RNA, 13 nt, Human
caauucaugaacu

SEQ ID NO: 3515545 - RNA, 15 nt, Human
caauucaugaacuuc

SEQ ID NO: 3515546 - RNA, 15 nt, Human
caauuccaaaggaau

SEQ ID NO: 3515547 - RNA, 22 nt, Human
caauuccaacaguuuaaugaag

SEQ ID NO: 3515548 - RNA, 21 nt, Human
caauuccacucugauagaauu

SEQ ID NO: 3515549 - RNA, 22 nt, Human
caauuccaugacaauaugcccu

SEQ ID NO: 3515550 - RNA, 13 nt, Human
caauuccccucug

SEQ ID NO: 3515551 - RNA, 16 nt, Human
caauuccuagauaaaa

SEQ ID NO: 3515552 - RNA, 21 nt, Human
augaccuccagcuuuccugua

SEQ ID NO: 3515553 - RNA, 19 nt, Human
augaccugugaccagcacu

SEQ ID NO: 3515554 - RNA, 13 nt, Human
augaccuuacauu

SEQ ID NO: 3515555 - RNA, 14 nt, Human
augaccuuacauuu

SEQ ID NO: 3515556 - RNA, 16 nt, Human
augaccuuacauuucc

SEQ ID NO: 3515557 - RNA, 17 nt, Human
augaccuuauccuuccu

SEQ ID NO: 3515558 - RNA, 19 nt, Human
augaccuuguaauguaacu

SEQ ID NO: 3515559 - RNA, 20 nt, Human
augaccuuguaauguaacug

SEQ ID NO: 3515560 - RNA, 18 nt, Human
augaccuuucaauaggaa

SEQ ID NO: 3515561 - RNA, 23 nt, Human
augaccuuucaauaggaaaaacu

SEQ ID NO: 3515562 - RNA, 19 nt, Human
augacgacgacaacgauga

SEQ ID NO: 3515563 - RNA, 13 nt, Human
augacgcaaagag

SEQ ID NO: 3515564 - RNA, 17 nt, Human
augacgcugauacauaa

SEQ ID NO: 3515565 - RNA, 14 nt, Human
augacuaaaaauau

SEQ ID NO: 3515566 - RNA, 12 nt, Human
augacuaaagag

SEQ ID NO: 3515567 - RNA, 21 nt, Human
augacuaauuaggguacauuu

SEQ ID NO: 3515568 - RNA, 16 nt, Human
augacuauguaaacua

SEQ ID NO: 3515569 - RNA, 14 nt, Human
augacucaaagucu

SEQ ID NO: 3515570 - RNA, 21 nt, Human
augacucaagauucccaggag

SEQ ID NO: 3515571 - RNA, 23 nt, Human
augacucaagauucccaggaguu

SEQ ID NO: 3515572 - RNA, 15 nt, Human
augacugccaagacu

SEQ ID NO: 3515573 - RNA, 16 nt, Human
augacugccaagacug

SEQ ID NO: 3515574 - RNA, 13 nt, Human
augacuggaauuu

SEQ ID NO: 3515575 - RNA, 13 nt, Human
augacuggcauuu

SEQ ID NO: 3515576 - RNA, 19 nt, Human
augacuguuuuucggacag

SEQ ID NO: 3515577 - RNA, 17 nt, Human
augacuguuuuuguagu

SEQ ID NO: 3515578 - RNA, 18 nt, Human
augacuguuuuuguagug

SEQ ID NO: 3515579 - RNA, 16 nt, Human
augacuuacuguacau

SEQ ID NO: 3515580 - RNA, 17 nt, Human
augacuuacuguacaug

SEQ ID NO: 3515581 - RNA, 19 nt, Human
augacuuccccaauaucuu

SEQ ID NO: 3515582 - RNA, 23 nt, Human
augacuuuauauggaugauucag

SEQ ID NO: 3515583 - RNA, 18 nt, Human
augacuuuauuauuuauu

SEQ ID NO: 3515584 - RNA, 17 nt, Human
augacuuuuccauguau

SEQ ID NO: 3515585 - RNA, 20 nt, Human
augacuuuuccauguaucua

SEQ ID NO: 3515586 - RNA, 21 nt, Human
augaguuuuugauagcuuuau

SEQ ID NO: 3515587 - RNA, 17 nt, Human
augauaaaaaauuuugu

SEQ ID NO: 3515588 - RNA, 15 nt, Human
augauaauagauucu

SEQ ID NO: 3515589 - RNA, 15 nt, Human
augauaaugaacaga

SEQ ID NO: 3515590 - RNA, 17 nt, Human
augauacaagauuagaa

SEQ ID NO: 3515591 - RNA, 13 nt, Human
augauacaaugaa

SEQ ID NO: 3515592 - RNA, 17 nt, Human
augauacaaugaacacu

SEQ ID NO: 3515593 - RNA, 22 nt, Human
augauacccugaauuuggccug

SEQ ID NO: 3515594 - RNA, 23 nt, Human
augauacuucgacacuguucuua

SEQ ID NO: 3515595 - RNA, 21 nt, Human
augauacuugaaaauuaacau

SEQ ID NO: 3515596 - RNA, 17 nt, Human
augauagauuugaccuc

SEQ ID NO: 3515597 - RNA, 20 nt, Human
augauagcgggaaaaggaga

SEQ ID NO: 3515598 - RNA, 17 nt, Human
augauauaacuuuagaa

SEQ ID NO: 3515599 - RNA, 22 nt, Human
augauauguaaacauaauucuu

SEQ ID NO: 3515600 - RNA, 17 nt, Human
augauauugcugaagaa

SEQ ID NO: 3515601 - RNA, 21 nt, Human
augauauuuuuuuaagucuuu

SEQ ID NO: 3515602 - RNA, 14 nt, Human
augaucaaauguuu

SEQ ID NO: 3515603 - RNA, 19 nt, Human
augaucaaauguuuaauca

SEQ ID NO: 3515604 - RNA, 20 nt, Human
augaucaguggacagucugc

SEQ ID NO: 3515605 - RNA, 20 nt, Human
augaucaguguuguugcucu

SEQ ID NO: 3515606 - RNA, 19 nt, Human
augaucccugcuuaaaaga

SEQ ID NO: 3515607 - RNA, 21 nt, Human
augauccggauuuaauuugau

SEQ ID NO: 3515608 - RNA, 15 nt, Human
augauccuaaugaau

SEQ ID NO: 3515609 - RNA, 17 nt, Human
augaucggcaggacacc

SEQ ID NO: 3515610 - RNA, 14 nt, Human
augaucuacucaga

SEQ ID NO: 3515611 - RNA, 18 nt, Human
augaucuacucagaaauu

SEQ ID NO: 3515612 - RNA, 21 nt, Human
augaucuagguuuaacucaga

SEQ ID NO: 3515613 - RNA, 12 nt, Human
augaucucccug

SEQ ID NO: 3515614 - RNA, 14 nt, Human
augaucucccugcc

SEQ ID NO: 3515615 - RNA, 15 nt, Human
augaucucccugccg

SEQ ID NO: 3515616 - RNA, 17 nt, Human
augaucugccucuaaaa

SEQ ID NO: 3515617 - RNA, 20 nt, Human
augaucuggauccaccaaga

SEQ ID NO: 3515618 - RNA, 14 nt, Human
augaucuugugaca

SEQ ID NO: 3515619 - RNA, 16 nt, Human
augaucuuuaaaauac

SEQ ID NO: 3515620 - RNA, 12 nt, Human
augaugaaugag

SEQ ID NO: 3515621 - RNA, 17 nt, Human
augaugacgacgacaac

SEQ ID NO: 3515622 - RNA, 20 nt, Human
augaugaucaauuauaguuu

SEQ ID NO: 3515623 - RNA, 15 nt, Human
augaugauccuaggc

SEQ ID NO: 3515624 - RNA, 22 nt, Human
augaugccacaccaagcugugc

SEQ ID NO: 3515625 - RNA, 17 nt, Human
augaugccaugaggaac

SEQ ID NO: 3515626 - RNA, 22 nt, Human
augaugccucugucuucuggac

SEQ ID NO: 3515627 - RNA, 21 nt, Human
augaugcuuguaacaagaaaa

SEQ ID NO: 3515628 - RNA, 15 nt, Human
augauggaugccaau

SEQ ID NO: 3515629 - RNA, 19 nt, Human
augauggaugccaauauua

SEQ ID NO: 3515630 - RNA, 23 nt, Human
augauggggcccuaauucagcca

SEQ ID NO: 3515631 - RNA, 18 nt, Human
augaugguugcaaaagac

SEQ ID NO: 3515632 - RNA, 20 nt, Human
augauguaaguuuaccuaug

SEQ ID NO: 3515633 - RNA, 18 nt, Human
augauguacagauucuuu

SEQ ID NO: 3515634 - RNA, 23 nt, Human
augauguauguugaagccuuugu

SEQ ID NO: 3515635 - RNA, 23 nt, Human
augauguccagaagaauauucag

SEQ ID NO: 3515636 - RNA, 19 nt, Human
augaugucuuuuuauuaaa

SEQ ID NO: 3515637 - RNA, 17 nt, Human
augaugugaaacacuuu

SEQ ID NO: 3515638 - RNA, 20 nt, Human
augauguggugccugagguc

SEQ ID NO: 3515639 - RNA, 23 nt, Human
augauguggugccugaggucugu

SEQ ID NO: 3515640 - RNA, 19 nt, Human
augauguuaguuuuccuua

SEQ ID NO: 3515641 - RNA, 17 nt, Human
augauguugaauauuug

SEQ ID NO: 3515642 - RNA, 21 nt, Human
augauguuucgugaaguauac

SEQ ID NO: 3515643 - RNA, 17 nt, Human
augauguuuuuaaaauc

SEQ ID NO: 3515644 - RNA, 18 nt, Human
augauguuuuuaaaaucu

SEQ ID NO: 3515645 - RNA, 21 nt, Human
augauguuuuuaaaaucuuau

SEQ ID NO: 3515646 - RNA, 14 nt, Human
augauuaaaaauau

SEQ ID NO: 3515647 - RNA, 19 nt, Human
augauuaaauaagauucua

SEQ ID NO: 3515648 - RNA, 24 nt, Human
augauuaaauaagauucuaacggu

SEQ ID NO: 3515649 - RNA, 14 nt, Human
augauuaaguaaug

SEQ ID NO: 3515650 - RNA, 22 nt, Human
augauuagaaauuaccugugga

SEQ ID NO: 3515651 - RNA, 23 nt, Human
augauuagcaaguuacagugaug

SEQ ID NO: 3515652 - RNA, 15 nt, Human
augauuauuuucauu

SEQ ID NO: 3515653 - RNA, 13 nt, Human
augauucaaaaag

SEQ ID NO: 3515654 - RNA, 21 nt, Human
augauucaaaugucuauaaac

SEQ ID NO: 3515655 - RNA, 14 nt, Human
augauucagaaauu

SEQ ID NO: 3515656 - RNA, 17 nt, Human
augauucagaaauugga

SEQ ID NO: 3515657 - RNA, 22 nt, Human
augauucaggugcagaggaagu

SEQ ID NO: 3515658 - RNA, 13 nt, Human
augauuccagcca

SEQ ID NO: 3515659 - RNA, 12 nt, Human
augauucccagc

SEQ ID NO: 3515660 - RNA, 23 nt, Human
augauucuaauuuuuaagcaaaa

SEQ ID NO: 3515661 - RNA, 15 nt, Human
augauucugcuuuua

SEQ ID NO: 3515662 - RNA, 21 nt, Human
augauugcagaauuguuuaga

SEQ ID NO: 3515663 - RNA, 15 nt, Human
augauugcuuuuaaa

SEQ ID NO: 3515664 - RNA, 16 nt, Human
augauuggauuauuca

SEQ ID NO: 3515665 - RNA, 15 nt, Human
augauuguaaaauag

SEQ ID NO: 3515666 - RNA, 18 nt, Human
augauuuaaaacauguaa

SEQ ID NO: 3515667 - RNA, 18 nt, Human
augauuuaauaaaauaau

SEQ ID NO: 3515668 - RNA, 17 nt, Human
augauuuaauuugaaau

SEQ ID NO: 3515669 - RNA, 15 nt, Human
augauuuacucauua

SEQ ID NO: 3515670 - RNA, 20 nt, Human
augauuuauaaacagacaau

SEQ ID NO: 3515671 - RNA, 14 nt, Human
augauuuauaccua

SEQ ID NO: 3515672 - RNA, 12 nt, Human
augauuucacaa

SEQ ID NO: 3515673 - RNA, 17 nt, Human
augauuucacaaauauu

SEQ ID NO: 3515674 - RNA, 23 nt, Human
augauuucacaaauauuaaaaag

SEQ ID NO: 3515675 - RNA, 16 nt, Human
augauuucagaaacaa

SEQ ID NO: 3515676 - RNA, 17 nt, Human
augauuucagcucacug

SEQ ID NO: 3515677 - RNA, 19 nt, Human
augauuucagcucacugca

SEQ ID NO: 3515678 - RNA, 14 nt, Human
augauuucaguagc

SEQ ID NO: 3515679 - RNA, 21 nt, Human
augauuucaugcuaucucugu

SEQ ID NO: 3515680 - RNA, 16 nt, Human
augauuuccuugaaug

SEQ ID NO: 3515681 - RNA, 18 nt, Human
augauuuccuugaaugug

SEQ ID NO: 3515682 - RNA, 19 nt, Human
augauuuccuugaaugugg

SEQ ID NO: 3515683 - RNA, 17 nt, Human
augauuuguaguggaaa

SEQ ID NO: 3515684 - RNA, 21 nt, Human
augauuuuaaguuucucugca

SEQ ID NO: 3515685 - RNA, 18 nt, Human
augauuuuauuugacaaa

SEQ ID NO: 3515686 - RNA, 23 nt, Human
augauuuuauuugacaaaauuug

SEQ ID NO: 3515687 - RNA, 14 nt, Human
augauuuuuaaaga

SEQ ID NO: 3515688 - RNA, 17 nt, Human
augauuuuucuuuacaa

SEQ ID NO: 3515689 - RNA, 15 nt, Human
augauuuuugucauc

SEQ ID NO: 3515690 - RNA, 17 nt, Human
augauuuuuuaaaagaa

SEQ ID NO: 3515691 - RNA, 19 nt, Human
augauuuuuuaaaagaaau

SEQ ID NO: 3515692 - RNA, 17 nt, Human
augauuuuuugaaaguu

SEQ ID NO: 3515693 - RNA, 23 nt, Human
augauuuuuugaaaguuaacauu

SEQ ID NO: 3515694 - RNA, 17 nt, Human
augauuuuuuuuucaua

SEQ ID NO: 3515695 - RNA, 13 nt, Human
augcaaaaaaucu

SEQ ID NO: 3515696 - RNA, 17 nt, Human
augcaaaaacucuuuga

SEQ ID NO: 3515697 - RNA, 23 nt, Human
augcaaaaacucuuugagagggu

SEQ ID NO: 3515698 - RNA, 12 nt, Human
augcaaaaagaa

SEQ ID NO: 3515699 - RNA, 11 nt, Human
augcaaaaauc

SEQ ID NO: 3515700 - RNA, 13 nt, Human
augcaaaagcaag

SEQ ID NO: 3515701 - RNA, 23 nt, Human
augcaaaagguucacuaaagcag

SEQ ID NO: 3515702 - RNA, 11 nt, Human
augcaaaaugg

SEQ ID NO: 3515703 - RNA, 18 nt, Human
augcaaaauuuuuuuaau

SEQ ID NO: 3515704 - RNA, 20 nt, Human
augcaaacauaacaaaauca

SEQ ID NO: 3515705 - RNA, 17 nt, Human
augcaaacauuggaaga

SEQ ID NO: 3515706 - RNA, 13 nt, Human
augcaaagcacug

SEQ ID NO: 3515707 - RNA, 15 nt, Human
augcaaaguacaaug

SEQ ID NO: 3515708 - RNA, 20 nt, Human
augcaaaguauaaauuugug

SEQ ID NO: 3515709 - RNA, 14 nt, Human
augcaaaguucugu

SEQ ID NO: 3515710 - RNA, 17 nt, Human
augcaaaguucuguguu

SEQ ID NO: 3515711 - RNA, 21 nt, Human
augcaaaguucuguguuuaau

SEQ ID NO: 3515712 - RNA, 16 nt, Human
augcaaauaacacaaa

SEQ ID NO: 3515713 - RNA, 19 nt, Human
augcaaaugagcucugaaa

SEQ ID NO: 3515714 - RNA, 20 nt, Human
augcaaaugagcucugaaau

SEQ ID NO: 3515715 - RNA, 16 nt, Human
augcaacaacauguau

SEQ ID NO: 3515716 - RNA, 18 nt, Human
cacaaggauugaaaauuc

SEQ ID NO: 3515717 - RNA, 17 nt, Human
cacaaggcagcaaggcc

SEQ ID NO: 3515718 - RNA, 22 nt, Human
cacaaggcagcaaggcccgagc

SEQ ID NO: 3515719 - RNA, 19 nt, Human
cacaaggcugaccaagaga

SEQ ID NO: 3515720 - RNA, 17 nt, Human
cacaagggaaggacaga

SEQ ID NO: 3515721 - RNA, 22 nt, Human
cacaagggaaggacagaaagga

SEQ ID NO: 3515722 - RNA, 18 nt, Human
cacaaggucauggccaca

SEQ ID NO: 3515723 - RNA, 22 nt, Human
cacaaggucauggccacacugu

SEQ ID NO: 3515724 - RNA, 23 nt, Human
cacaaggucauggccacacugug

SEQ ID NO: 3515725 - RNA, 20 nt, Human
cacaaguagaugccugaacu

SEQ ID NO: 3515726 - RNA, 22 nt, Human
cacaaguagaugccugaacuug

SEQ ID NO: 3515727 - RNA, 18 nt, Human
cacaaguggguaccccca

SEQ ID NO: 3515728 - RNA, 19 nt, Human
cacaaguggguacccccag

SEQ ID NO: 3515729 - RNA, 15 nt, Human
auggaauugauuugc

SEQ ID NO: 3515730 - RNA, 18 nt, Human
auggaauugauuugcauu

SEQ ID NO: 3515731 - RNA, 17 nt, Human
auggaauuucucccagu

SEQ ID NO: 3515732 - RNA, 15 nt, Human
auggaauuuguaagu

SEQ ID NO: 3515733 - RNA, 17 nt, Human
auggaauuuuuuuguac

SEQ ID NO: 3515734 - RNA, 21 nt, Human
auggacaccccuuauccagga

SEQ ID NO: 3515735 - RNA, 19 nt, Human
auggacacuacacccagca

SEQ ID NO: 3515736 - RNA, 22 nt, Human
auggacacuacacccagcaaua

SEQ ID NO: 3515737 - RNA, 15 nt, Human
auggacacuccagug

SEQ ID NO: 3515738 - RNA, 16 nt, Human
auggacacuuuucacc

SEQ ID NO: 3515739 - RNA, 19 nt, Human
auggacagaagaaggcagc

SEQ ID NO: 3515740 - RNA, 13 nt, Human
auggacagaauuu

SEQ ID NO: 3515741 - RNA, 14 nt, Human
auggacaggcuggc

SEQ ID NO: 3515742 - RNA, 23 nt, Human
auggacaguucacacccugcaag

SEQ ID NO: 3515743 - RNA, 20 nt, Human
auggacauccuguauaagca

SEQ ID NO: 3515744 - RNA, 17 nt, Human
auggacaucuugucauu

SEQ ID NO: 3515745 - RNA, 20 nt, Human
auggacauuuagaagaaaga

SEQ ID NO: 3515746 - RNA, 18 nt, Human
auggacccaaugcacaca

SEQ ID NO: 3515747 - RNA, 20 nt, Human
auggaccggagagugggggu

SEQ ID NO: 3515748 - RNA, 14 nt, Human
auggaccuaacauu

SEQ ID NO: 3515749 - RNA, 18 nt, Human
auggaccugccugcauag

SEQ ID NO: 3515750 - RNA, 13 nt, Human
auggacggugcuc

SEQ ID NO: 3515751 - RNA, 21 nt, Human
auggacuaaccccaacgcaca

SEQ ID NO: 3515752 - RNA, 20 nt, Human
auggacuaucugucuggugg

SEQ ID NO: 3515753 - RNA, 18 nt, Human
auggacucagaaacucca

SEQ ID NO: 3515754 - RNA, 18 nt, Human
auggacucuacacuguga

SEQ ID NO: 3515755 - RNA, 17 nt, Human
auggacucuucccccac

SEQ ID NO: 3515756 - RNA, 16 nt, Human
auggacugaugcuuuu

SEQ ID NO: 3515757 - RNA, 17 nt, Human
auggacugguuugagau

SEQ ID NO: 3515758 - RNA, 16 nt, Human
auggacuguggugacu

SEQ ID NO: 3515759 - RNA, 22 nt, Human
auggacuguggugacuuuggau

SEQ ID NO: 3515760 - RNA, 14 nt, Human
auggacuucuggau

SEQ ID NO: 3515761 - RNA, 17 nt, Human
auggacuuguauauuug

SEQ ID NO: 3515762 - RNA, 17 nt, Human
auggacuuuauaagcca

SEQ ID NO: 3515763 - RNA, 22 nt, Human
auggacuuugcacacuuuggcc

SEQ ID NO: 3515764 - RNA, 15 nt, Human
auggacuuuggaagc

SEQ ID NO: 3515765 - RNA, 17 nt, Human
auggacuuuggaagcag

SEQ ID NO: 3515766 - RNA, 12 nt, Human
auggagaaagcu

SEQ ID NO: 3515767 - RNA, 16 nt, Human
auggagaaagcugacu

SEQ ID NO: 3515768 - RNA, 22 nt, Human
auggagaagcagaaauacauau

SEQ ID NO: 3515769 - RNA, 14 nt, Human
auggagaaggaagg

SEQ ID NO: 3515770 - RNA, 20 nt, Human
auggagacuccugcccuguu

SEQ ID NO: 3515771 - RNA, 21 nt, Human
auggagacugguccugugugc

SEQ ID NO: 3515772 - RNA, 18 nt, Human
auggagacugucucaaga

SEQ ID NO: 3515773 - RNA, 14 nt, Human
auggagagagggga

SEQ ID NO: 3515774 - RNA, 15 nt, Human
auggagagaggggaa

SEQ ID NO: 3515775 - RNA, 13 nt, Human
auggagagcccug

SEQ ID NO: 3515776 - RNA, 11 nt, Human
cacaugugugc

SEQ ID NO: 3515777 - RNA, 12 nt, Human
cacauguguggu

SEQ ID NO: 3515778 - RNA, 18 nt, Human
cacauguuuagaguugca

SEQ ID NO: 3515779 - RNA, 12 nt, Human
cacauguuuccu

SEQ ID NO: 3515780 - RNA, 15 nt, Human
cacauguuuccucua

SEQ ID NO: 3515781 - RNA, 15 nt, Human
cacauguuuucucug

SEQ ID NO: 3515782 - RNA, 13 nt, Human
cacauguuuuuau

SEQ ID NO: 3515783 - RNA, 13 nt, Human
cacauuaaaaaau

SEQ ID NO: 3515784 - RNA, 12 nt, Human
cacauuaaagaa

SEQ ID NO: 3515785 - RNA, 20 nt, Human
cacauuaaagaagaccugag

SEQ ID NO: 3515786 - RNA, 13 nt, Human
cacauuaaaugac

SEQ ID NO: 3515787 - RNA, 19 nt, Human
cacauuaauauuugcugac

SEQ ID NO: 3515788 - RNA, 21 nt, Human
cacauuagaagacaauugaca

SEQ ID NO: 3515789 - RNA, 17 nt, Human
cacauuagacuauccau

SEQ ID NO: 3515790 - RNA, 23 nt, Human
cacauuagauuuuauuuuacuau

SEQ ID NO: 3515791 - RNA, 21 nt, Human
cacauuaggaaaaguugcuau

SEQ ID NO: 3515792 - RNA, 14 nt, Human
cacauuauuugcau

SEQ ID NO: 3515793 - RNA, 22 nt, Human
cacauucaaaauaggguauauu

SEQ ID NO: 3515794 - RNA, 23 nt, Human
cacauucagggcuauuuuuuccc

SEQ ID NO: 3515795 - RNA, 16 nt, Human
cacauuccugaugcuu

SEQ ID NO: 3515796 - RNA, 18 nt, Human
cacauuccuugccugcac

SEQ ID NO: 3515797 - RNA, 19 nt, Human
cacauuccuugccugcaca

SEQ ID NO: 3515798 - RNA, 17 nt, Human
cacauucuuauaaauau

SEQ ID NO: 3515799 - RNA, 18 nt, Human
cacauucuuauaaauaug

SEQ ID NO: 3515800 - RNA, 13 nt, Human
cacauucuuggcu

SEQ ID NO: 3515801 - RNA, 22 nt, Human
cacauucuuggcuuaaucauuu

SEQ ID NO: 3515802 - RNA, 16 nt, Human
cacauugcauucuauu

SEQ ID NO: 3515803 - RNA, 18 nt, Human
cacauugcauucuauugc

SEQ ID NO: 3515804 - RNA, 19 nt, Human
cacauugcauucuauugcc

SEQ ID NO: 3515805 - RNA, 23 nt, Human
cacauuguuuuaaaaagaaacaa

SEQ ID NO: 3515806 - RNA, 18 nt, Human
cacauuuagucucuuuau

SEQ ID NO: 3515807 - RNA, 16 nt, Human
cacauuucacugucug

SEQ ID NO: 3515808 - RNA, 18 nt, Human
cacauuucucaacaaggc

SEQ ID NO: 3515809 - RNA, 21 nt, Human
cacauuucuuuuuaaaaaaag

SEQ ID NO: 3515810 - RNA, 21 nt, Human
cacauuugcuuuuugugauau

SEQ ID NO: 3515811 - RNA, 16 nt, Human
cacauuuggaauacuu

SEQ ID NO: 3515812 - RNA, 18 nt, Human
cacauuugguaauguuuu

SEQ ID NO: 3515813 - RNA, 22 nt, Human
cacauuugguucuaagaaaccc

SEQ ID NO: 3515814 - RNA, 12 nt, Human
cacauuuguaca

SEQ ID NO: 3515815 - RNA, 23 nt, Human
cacauuugucuucuuucugucuu

SEQ ID NO: 3515816 - RNA, 19 nt, Human
cacauuuuauuuuauuaug

SEQ ID NO: 3515817 - RNA, 12 nt, Human
cacauuuugauu

SEQ ID NO: 3515818 - RNA, 12 nt, Human
cacauuuuguau

SEQ ID NO: 3515819 - RNA, 21 nt, Human
cacauuuuguauaauuguauc

SEQ ID NO: 3515820 - RNA, 21 nt, Human
cacauuuuuuaaaugcaccug

SEQ ID NO: 3515821 - RNA, 22 nt, Human
cacauuuuuuaaaugcaccugg

SEQ ID NO: 3515822 - RNA, 17 nt, Human
cacauuuuuuaggaaau

SEQ ID NO: 3515823 - RNA, 12 nt, Human
cacauuuuuuau

SEQ ID NO: 3515824 - RNA, 19 nt, Human
cacauuuuuuuuuuuaauu

SEQ ID NO: 3515825 - RNA, 21 nt, Human
cacauuuuuuuuuuuaauuuu

SEQ ID NO: 3515826 - RNA, 19 nt, Human
caccaaaaaaauccagaaa

SEQ ID NO: 3515827 - RNA, 14 nt, Human
caccaaaaaauauc

SEQ ID NO: 3515828 - RNA, 17 nt, Human
caccaaaaaauaucuag

SEQ ID NO: 3515829 - RNA, 12 nt, Human
caccaaaaacaa

SEQ ID NO: 3515830 - RNA, 13 nt, Human
caccaaaaacaaa

SEQ ID NO: 3515831 - RNA, 13 nt, Human
caccaaagcugcc

SEQ ID NO: 3515832 - RNA, 14 nt, Human
caccaaaguucuaa

SEQ ID NO: 3515833 - RNA, 13 nt, Human
caccaacccagcc

SEQ ID NO: 3515834 - RNA, 21 nt, Human
caccaacccagccgcugcccg

SEQ ID NO: 3515835 - RNA, 18 nt, Human
caccaacuacuaccugua

SEQ ID NO: 3515836 - RNA, 19 nt, Human
caccaacuccuaguucuag

SEQ ID NO: 3515837 - RNA, 19 nt, Human
caccaacuggcccucuucu

SEQ ID NO: 3515838 - RNA, 15 nt, Human
caccaagaugucugu

SEQ ID NO: 3515839 - RNA, 17 nt, Human
caccaagaugucugucu

SEQ ID NO: 3515840 - RNA, 13 nt, Human
caccaagccaagg

SEQ ID NO: 3515841 - RNA, 15 nt, Human
caccaagcccacagg

SEQ ID NO: 3515842 - RNA, 16 nt, Human
caccaagcuaggugcu

SEQ ID NO: 3515843 - RNA, 15 nt, Human
caccaagcugugcca

SEQ ID NO: 3515844 - RNA, 16 nt, Human
caccaagcugugccac

SEQ ID NO: 3515845 - RNA, 21 nt, Human
caccaagcugugccacccugg

SEQ ID NO: 3515846 - RNA, 23 nt, Human
caccaagcugugccacccugggc

SEQ ID NO: 3515847 - RNA, 18 nt, Human
caccaagggcgcaagagu

SEQ ID NO: 3515848 - RNA, 20 nt, Human
caccaaggucuucagccauc

SEQ ID NO: 3515849 - RNA, 23 nt, Human
caccaaguuggaacauccuugga

SEQ ID NO: 3515850 - RNA, 23 nt, Human
caccaauguacccaccgggccac

SEQ ID NO: 3515851 - RNA, 21 nt, Human
caccaauuggauaaagcagcu

SEQ ID NO: 3515852 - RNA, 18 nt, Human
caccacacacaacagcca

SEQ ID NO: 3515853 - RNA, 15 nt, Human
caccacacaucccag

SEQ ID NO: 3515854 - RNA, 15 nt, Human
caccacacccagccc

SEQ ID NO: 3515855 - RNA, 18 nt, Human
caccacacccagccucag

SEQ ID NO: 3515856 - RNA, 15 nt, Human
caccacacucagccc

SEQ ID NO: 3515857 - RNA, 13 nt, Human
caccacagacaca

SEQ ID NO: 3515858 - RNA, 15 nt, Human
caccacagacacaca

SEQ ID NO: 3515859 - RNA, 13 nt, Human
caccacagcaggu

SEQ ID NO: 3515860 - RNA, 19 nt, Human
caccacagccagcaccugg

SEQ ID NO: 3515861 - RNA, 18 nt, Human
caccacauccuccgucca

SEQ ID NO: 3515862 - RNA, 14 nt, Human
caccacaucuaagc

SEQ ID NO: 3515863 - RNA, 18 nt, Human
caccaccacuggccacca

SEQ ID NO: 3515864 - RNA, 14 nt, Human
caccaccaggucuc

SEQ ID NO: 3515865 - RNA, 16 nt, Human
caccaccccccacucu

SEQ ID NO: 3515866 - RNA, 18 nt, Human
caccaccccccacucugu

SEQ ID NO: 3515867 - RNA, 20 nt, Human
caccaccccccacucugugc

SEQ ID NO: 3515868 - RNA, 22 nt, Human
caccaccccccacucugugccu

SEQ ID NO: 3515869 - RNA, 18 nt, Human
caccaccucacuccuguu

SEQ ID NO: 3515870 - RNA, 14 nt, Human
caccaccucuuugg

SEQ ID NO: 3515871 - RNA, 15 nt, Human
caccacgauguggcc

SEQ ID NO: 3515872 - RNA, 18 nt, Human
caccacgauguggcccug

SEQ ID NO: 3515873 - RNA, 19 nt, Human
caccacgauguggcccugg

SEQ ID NO: 3515874 - RNA, 12 nt, Human
auguauaguaaa

SEQ ID NO: 3515875 - RNA, 20 nt, Human
auguauaguauuugaaaaca

SEQ ID NO: 3515876 - RNA, 16 nt, Human
auguauaguuuugaau

SEQ ID NO: 3515877 - RNA, 13 nt, Human
auguauauaaaaa

SEQ ID NO: 3515878 - RNA, 12 nt, Human
auguauauacac

SEQ ID NO: 3515879 - RNA, 17 nt, Human
auguauauacacauaua

SEQ ID NO: 3515880 - RNA, 22 nt, Human
auguauauauuuuuuaaaaauc

SEQ ID NO: 3515881 - RNA, 14 nt, Human
auguauauuaaaaa

SEQ ID NO: 3515882 - RNA, 21 nt, Human
auguauauuaaaaaagagaca

SEQ ID NO: 3515883 - RNA, 18 nt, Human
auguauauuuuuuuaauu

SEQ ID NO: 3515884 - RNA, 14 nt, Human
auguaucaaacugu

SEQ ID NO: 3515885 - RNA, 15 nt, Human
auguaucaaugagua

SEQ ID NO: 3515886 - RNA, 11 nt, Human
auguaucacua

SEQ ID NO: 3515887 - RNA, 17 nt, Human
auguaucauagaaaugu

SEQ ID NO: 3515888 - RNA, 12 nt, Human
auguaucaucug

SEQ ID NO: 3515889 - RNA, 16 nt, Human
auguaucugaaaguca

SEQ ID NO: 3515890 - RNA, 13 nt, Human
auguaugaaggcu

SEQ ID NO: 3515891 - RNA, 14 nt, Human
auguaugaaggcuu

SEQ ID NO: 3515892 - RNA, 15 nt, Human
auguaugcacacaca

SEQ ID NO: 3515893 - RNA, 17 nt, Human
auguaugcagcuaucug

SEQ ID NO: 3515894 - RNA, 13 nt, Human
auguaugcauaau

SEQ ID NO: 3515895 - RNA, 14 nt, Human
auguaugcuucaua

SEQ ID NO: 3515896 - RNA, 16 nt, Human
auguaugcuucauaca

SEQ ID NO: 3515897 - RNA, 20 nt, Human
auguaugcuucauacaggga

SEQ ID NO: 3515898 - RNA, 21 nt, Human
auguauggguaggguaaauca

SEQ ID NO: 3515899 - RNA, 22 nt, Human
auguauggugcaauguguguau

SEQ ID NO: 3515900 - RNA, 15 nt, Human
auguauguaaaaaug

SEQ ID NO: 3515901 - RNA, 22 nt, Human
auguauguaaauagguuucuaa

SEQ ID NO: 3515902 - RNA, 17 nt, Human
auguaugugcacuguca

SEQ ID NO: 3515903 - RNA, 14 nt, Human
auguaugugcauuu

SEQ ID NO: 3515904 - RNA, 16 nt, Human
auguauguguaaguau

SEQ ID NO: 3515905 - RNA, 14 nt, Human
auguauguguguau

SEQ ID NO: 3515906 - RNA, 12 nt, Human
auguauguguuu

SEQ ID NO: 3515907 - RNA, 12 nt, Human
auguauguuacc

SEQ ID NO: 3515908 - RNA, 19 nt, Human
auguauguuuacacuguca

SEQ ID NO: 3515909 - RNA, 19 nt, Human
auguauguuuggcucugcu

SEQ ID NO: 3515910 - RNA, 22 nt, Human
auguauuacaguggggaaugaa

SEQ ID NO: 3515911 - RNA, 20 nt, Human
auguauuauguccugugaga

SEQ ID NO: 3515912 - RNA, 20 nt, Human
auguauuauucugcagcaug

SEQ ID NO: 3515913 - RNA, 16 nt, Human
auguauuauuuauaau

SEQ ID NO: 3515914 - RNA, 14 nt, Human
auguauucaaauac

SEQ ID NO: 3515915 - RNA, 21 nt, Human
auguauucauauuuguacuuu

SEQ ID NO: 3515916 - RNA, 20 nt, Human
auguauuguaaacauguguu

SEQ ID NO: 3515917 - RNA, 12 nt, Human
auguauuguacc

SEQ ID NO: 3515918 - RNA, 15 nt, Human
auguauugugcaaug

SEQ ID NO: 3515919 - RNA, 18 nt, Human
auguauugugcaaugugu

SEQ ID NO: 3515920 - RNA, 19 nt, Human
auguauugugcaaugugua

SEQ ID NO: 3515921 - RNA, 20 nt, Human
auguauugugcaauguguau

SEQ ID NO: 3515922 - RNA, 19 nt, Human
auguauugugucuuuugca

SEQ ID NO: 3515923 - RNA, 20 nt, Human
auguauugugucuuuugcau

SEQ ID NO: 3515924 - RNA, 22 nt, Human
auguauugugucuuuugcauga

SEQ ID NO: 3515925 - RNA, 22 nt, Human
auguauuuaccaaaaauuuugu

SEQ ID NO: 3515926 - RNA, 19 nt, Human
auguauuuccuggauguuu

SEQ ID NO: 3515927 - RNA, 15 nt, Human
auguauuugcugaca

SEQ ID NO: 3515928 - RNA, 15 nt, Human
auguauuuguagugu

SEQ ID NO: 3515929 - RNA, 13 nt, Human
auguauuuuaugu

SEQ ID NO: 3515930 - RNA, 15 nt, Human
auguauuuuauguau

SEQ ID NO: 3515931 - RNA, 17 nt, Human
auguauuuuauguaugu

SEQ ID NO: 3515932 - RNA, 14 nt, Human
auguauuuuauguu

SEQ ID NO: 3515933 - RNA, 15 nt, Human
auguauuuuauugua

SEQ ID NO: 3515934 - RNA, 23 nt, Human
auguauuuuauuguaacagacau

SEQ ID NO: 3515935 - RNA, 20 nt, Human
auguauuuugugaguuuguu

SEQ ID NO: 3515936 - RNA, 16 nt, Human
auguauuuuucuacau

SEQ ID NO: 3515937 - RNA, 23 nt, Human
auguauuuuucuacauuauugcu

SEQ ID NO: 3515938 - RNA, 17 nt, Human
augucaaaaauauuuag

SEQ ID NO: 3515939 - RNA, 13 nt, Human
augucaaacaaau

SEQ ID NO: 3515940 - RNA, 19 nt, Human
augucaaauauuuagaugu

SEQ ID NO: 3515941 - RNA, 17 nt, Human
augucaacuucuggcuc

SEQ ID NO: 3515942 - RNA, 16 nt, Human
augucaacuuuaugca

SEQ ID NO: 3515943 - RNA, 14 nt, Human
augucaagggcagc

SEQ ID NO: 3515944 - RNA, 17 nt, Human
augucaaggugcuguug

SEQ ID NO: 3515945 - RNA, 19 nt, Human
augucaauaaacaacagcu

SEQ ID NO: 3515946 - RNA, 16 nt, Human
augucaauaacaguau

SEQ ID NO: 3515947 - RNA, 15 nt, Human
augucacaggcaggu

SEQ ID NO: 3515948 - RNA, 13 nt, Human
augucaccaccuu

SEQ ID NO: 3515949 - RNA, 19 nt, Human
augucaccaccuucccagc

SEQ ID NO: 3515950 - RNA, 23 nt, Human
augucaccaccuucccagcucuc

SEQ ID NO: 3515951 - RNA, 22 nt, Human
augucaccguggaccuuccugc

SEQ ID NO: 3515952 - RNA, 23 nt, Human
augucaccguggaccuuccugcc

SEQ ID NO: 3515953 - RNA, 16 nt, Human
augucacgaauaugga

SEQ ID NO: 3515954 - RNA, 19 nt, Human
augucacguacugucugau

SEQ ID NO: 3515955 - RNA, 14 nt, Human
augucacuagaaug

SEQ ID NO: 3515956 - RNA, 16 nt, Human
augucacugugguccu

SEQ ID NO: 3515957 - RNA, 15 nt, Human
augucacuucuggau

SEQ ID NO: 3515958 - RNA, 10 nt, Human
augucacuuu

SEQ ID NO: 3515959 - RNA, 20 nt, Human
augucacuuuuugaggcaaa

SEQ ID NO: 3515960 - RNA, 23 nt, Human
augucagaaaaacaauaagagcg

SEQ ID NO: 3515961 - RNA, 13 nt, Human
augucagacacag

SEQ ID NO: 3515962 - RNA, 20 nt, Human
augucagacacagauuggcc

SEQ ID NO: 3515963 - RNA, 21 nt, Human
augucagacacagauuggcca

SEQ ID NO: 3515964 - RNA, 19 nt, Human
augucagacagaacuugaa

SEQ ID NO: 3515965 - RNA, 14 nt, Human
augucagauacaau

SEQ ID NO: 3515966 - RNA, 18 nt, Human
augucagauuccuuuccc

SEQ ID NO: 3515967 - RNA, 13 nt, Human
augucagcaaaaa

SEQ ID NO: 3515968 - RNA, 13 nt, Human
augucagcaguug

SEQ ID NO: 3515969 - RNA, 21 nt, Human
augucagcaguugcugguaaa

SEQ ID NO: 3515970 - RNA, 19 nt, Human
augucagccgagccgggcc

SEQ ID NO: 3515971 - RNA, 12 nt, Human
augucaggccug

SEQ ID NO: 3515972 - RNA, 20 nt, Human
augucaggguaccuggggcc

SEQ ID NO: 3515973 - RNA, 19 nt, Human
augucagucugcuuagaaa

SEQ ID NO: 3515974 - RNA, 21 nt, Human
augucagucugcuuagaaaua

SEQ ID NO: 3515975 - RNA, 22 nt, Human
augucagucugcuuagaaauaa

SEQ ID NO: 3515976 - RNA, 13 nt, Human
augucagugugac

SEQ ID NO: 3515977 - RNA, 16 nt, Human
augucaguucugauau

SEQ ID NO: 3515978 - RNA, 21 nt, Human
augucaguucugauauggaag

SEQ ID NO: 3515979 - RNA, 17 nt, Human
augucauauauuacuag

SEQ ID NO: 3515980 - RNA, 15 nt, Human
augucaucauacaug

SEQ ID NO: 3515981 - RNA, 14 nt, Human
augucaucccauug

SEQ ID NO: 3515982 - RNA, 13 nt, Human
augucaugcugcc

SEQ ID NO: 3515983 - RNA, 14 nt, Human
augucaugcugccu

SEQ ID NO: 3515984 - RNA, 21 nt, Human
augucauguguacaaaaguuu

SEQ ID NO: 3515985 - RNA, 16 nt, Human
augucauuaaacauga

SEQ ID NO: 3515986 - RNA, 15 nt, Human
augucauuaaugugu

SEQ ID NO: 3515987 - RNA, 16 nt, Human
augucauuucagaagu

SEQ ID NO: 3515988 - RNA, 18 nt, Human
augucauuucauuuccua

SEQ ID NO: 3515989 - RNA, 22 nt, Human
aaaagaaaaucuuuauaaaugu

SEQ ID NO: 3515990 - RNA, 11 nt, Human
aaaagaaaauu

SEQ ID NO: 3515991 - RNA, 10 nt, Human
aaaagaaaca

SEQ ID NO: 3515992 - RNA, 20 nt, Human
aaaagaaacucuauggucuu

SEQ ID NO: 3515993 - RNA, 12 nt, Human
aaaagaaacuuu

SEQ ID NO: 3515994 - RNA, 18 nt, Human
aaaagaaaggcuguuaaa

SEQ ID NO: 3515995 - RNA, 14 nt, Human
aaaagaaauaauaa

SEQ ID NO: 3515996 - RNA, 14 nt, Human
aaaagaaaucaaua

SEQ ID NO: 3515997 - RNA, 14 nt, Human
aaaagaaaugacua

SEQ ID NO: 3515998 - RNA, 15 nt, Human
aaaagaaaugacuaa

SEQ ID NO: 3515999 - RNA, 15 nt, Human
aaaagaaaugcacaa

SEQ ID NO: 3516000 - RNA, 17 nt, Human
aaaagaacaugcaguuu

SEQ ID NO: 3516001 - RNA, 18 nt, Human
aaaagaacaugcaguuug

SEQ ID NO: 3516002 - RNA, 11 nt, Human
aaaagaaggaa

SEQ ID NO: 3516003 - RNA, 14 nt, Human
aaaagaaguagugu

SEQ ID NO: 3516004 - RNA, 19 nt, Human
aaaagaaucccuguucauu

SEQ ID NO: 3516005 - RNA, 23 nt, Human
aaaagaaugacguuuacauauaa

SEQ ID NO: 3516006 - RNA, 11 nt, Human
aaaagaaugau

SEQ ID NO: 3516007 - RNA, 20 nt, Human
aaaagaaugggcaguuacau

SEQ ID NO: 3516008 - RNA, 15 nt, Human
aaaagaaugucagaa

SEQ ID NO: 3516009 - RNA, 19 nt, Human
aaaagacaauucuuuauac

SEQ ID NO: 3516010 - RNA, 15 nt, Human
aaaagacauucagga

SEQ ID NO: 3516011 - RNA, 17 nt, Human
aaaagacuaagaucggu

SEQ ID NO: 3516012 - RNA, 10 nt, Human
aaaagacuca

SEQ ID NO: 3516013 - RNA, 12 nt, Human
aaaagacucauc

SEQ ID NO: 3516014 - RNA, 13 nt, Human
aaaagacuccaaa

SEQ ID NO: 3516015 - RNA, 14 nt, Human
aaaagacugucuua

SEQ ID NO: 3516016 - RNA, 20 nt, Human
aaaagacuucccuaacacuu

SEQ ID NO: 3516017 - RNA, 15 nt, Human
aaaagacuuguuucu

SEQ ID NO: 3516018 - RNA, 13 nt, Human
aaaagagaagaag

SEQ ID NO: 3516019 - RNA, 21 nt, Human
aaaagagaccacccauaucau

SEQ ID NO: 3516020 - RNA, 21 nt, Human
aaaagagagaaaacuuauuug

SEQ ID NO: 3516021 - RNA, 14 nt, Human
auguccauuuacac

SEQ ID NO: 3516022 - RNA, 22 nt, Human
augucccaucacguguacuggc

SEQ ID NO: 3516023 - RNA, 19 nt, Human
auguccccaaaccugcaag

SEQ ID NO: 3516024 - RNA, 21 nt, Human
augucccuacaccccuccccu

SEQ ID NO: 3516025 - RNA, 24 nt, Human
augucccuaccgagucucuucucc

SEQ ID NO: 3516026 - RNA, 14 nt, Human
augucccugggcca

SEQ ID NO: 3516027 - RNA, 15 nt, Human
augucccugggccag

SEQ ID NO: 3516028 - RNA, 18 nt, Human
augucccugggccagggu

SEQ ID NO: 3516029 - RNA, 16 nt, Human
augucccuuucuucuc

SEQ ID NO: 3516030 - RNA, 18 nt, Human
augucccuuucuucuccc

SEQ ID NO: 3516031 - RNA, 20 nt, Human
augucccuuuuccuaaguca

SEQ ID NO: 3516032 - RNA, 19 nt, Human
auguccuaaggacacacua

SEQ ID NO: 3516033 - RNA, 15 nt, Human
auguccuaaugguga

SEQ ID NO: 3516034 - RNA, 16 nt, Human
auguccuaauggugau

SEQ ID NO: 3516035 - RNA, 20 nt, Human
auguccuacuaucacugaac

SEQ ID NO: 3516036 - RNA, 15 nt, Human
auguccuagacaggu

SEQ ID NO: 3516037 - RNA, 17 nt, Human
auguccucaccacaugc

SEQ ID NO: 3516038 - RNA, 20 nt, Human
auguccuccagaagccucug

SEQ ID NO: 3516039 - RNA, 22 nt, Human
auguccuccagaagccucuggc

SEQ ID NO: 3516040 - RNA, 23 nt, Human
auguccuccagaagccucuggcu

SEQ ID NO: 3516041 - RNA, 13 nt, Human
auguccugccuuu

SEQ ID NO: 3516042 - RNA, 22 nt, Human
auguccuguaaacacucagcug

SEQ ID NO: 3516043 - RNA, 13 nt, Human
auguccuguaaag

SEQ ID NO: 3516044 - RNA, 19 nt, Human
auguccugugagaugugua

SEQ ID NO: 3516045 - RNA, 11 nt, Human
auguccugugu

SEQ ID NO: 3516046 - RNA, 21 nt, Human
auguccugugucaguuuaugu

SEQ ID NO: 3516047 - RNA, 16 nt, Human
auguccuucugagccc

SEQ ID NO: 3516048 - RNA, 13 nt, Human
augucgccucugc

SEQ ID NO: 3516049 - RNA, 15 nt, Human
augucgccucugcau

SEQ ID NO: 3516050 - RNA, 23 nt, Human
augucgucaaagcugaaauggac

SEQ ID NO: 3516051 - RNA, 20 nt, Human
augucguggacacacacaga

SEQ ID NO: 3516052 - RNA, 13 nt, Human
augucuaaaauug

SEQ ID NO: 3516053 - RNA, 17 nt, Human
augucuaaaugcugaaa

SEQ ID NO: 3516054 - RNA, 17 nt, Human
augucuaauguauuuua

SEQ ID NO: 3516055 - RNA, 19 nt, Human
augucuaauguauuuuauu

SEQ ID NO: 3516056 - RNA, 14 nt, Human
augucuauucagcu

SEQ ID NO: 3516057 - RNA, 14 nt, Human
augucuauugucca

SEQ ID NO: 3516058 - RNA, 13 nt, Human
augucuauuuaag

SEQ ID NO: 3516059 - RNA, 14 nt, Human
augucuauuuaagc

SEQ ID NO: 3516060 - RNA, 20 nt, Human
augucucaaggcaguuaauu

SEQ ID NO: 3516061 - RNA, 15 nt, Human
augucucacugagca

SEQ ID NO: 3516062 - RNA, 19 nt, Human
augucucacugagcacugu

SEQ ID NO: 3516063 - RNA, 20 nt, Human
augucucacugagcacuguu

SEQ ID NO: 3516064 - RNA, 15 nt, Human
augucuccuaagcac

SEQ ID NO: 3516065 - RNA, 15 nt, Human
augucucgugguagg

SEQ ID NO: 3516066 - RNA, 19 nt, Human
augucucgugguaggacug

SEQ ID NO: 3516067 - RNA, 17 nt, Human
augucucugagcauuag

SEQ ID NO: 3516068 - RNA, 15 nt, Human
augucucuuccuggu

SEQ ID NO: 3516069 - RNA, 16 nt, Human
augucucuuccuggua

SEQ ID NO: 3516070 - RNA, 13 nt, Human
augucucuucuga

SEQ ID NO: 3516071 - RNA, 17 nt, Human
augucucuucugagcua

SEQ ID NO: 3516072 - RNA, 17 nt, Human
augucugaacucuccag

SEQ ID NO: 3516073 - RNA, 14 nt, Human
augucugaacuuug

SEQ ID NO: 3516074 - RNA, 17 nt, Human
augucugaacuuuggga

SEQ ID NO: 3516075 - RNA, 11 nt, Human
augucugcagc

SEQ ID NO: 3516076 - RNA, 13 nt, Human
augucugcagccc

SEQ ID NO: 3516077 - RNA, 20 nt, Human
augucugcagugugcccccc

SEQ ID NO: 3516078 - RNA, 19 nt, Human
augucugcuccuuuccccu

SEQ ID NO: 3516079 - RNA, 14 nt, Human
augucuggagacca

SEQ ID NO: 3516080 - RNA, 12 nt, Human
augucuggggca

SEQ ID NO: 3516081 - RNA, 12 nt, Human
augucuguaaau

SEQ ID NO: 3516082 - RNA, 16 nt, Human
augucuguagcuccuc

SEQ ID NO: 3516083 - RNA, 13 nt, Human
augucugucauug

SEQ ID NO: 3516084 - RNA, 16 nt, Human
augucuguucuacaua

SEQ ID NO: 3516085 - RNA, 23 nt, Human
augucuuaaaaccugcuuuucaa

SEQ ID NO: 3516086 - RNA, 12 nt, Human
augucuuaauga

SEQ ID NO: 3516087 - RNA, 11 nt, Human
augucuuauuu

SEQ ID NO: 3516088 - RNA, 16 nt, Human
augucuuauuuuuaga

SEQ ID NO: 3516089 - RNA, 19 nt, Human
augucuucaaggcuucagu

SEQ ID NO: 3516090 - RNA, 21 nt, Human
augucuucauaccuacaugua

SEQ ID NO: 3516091 - RNA, 22 nt, Human
augucuuccauguaucuuuuga

SEQ ID NO: 3516092 - RNA, 22 nt, Human
augucuucguacaguucuucgg

SEQ ID NO: 3516093 - RNA, 20 nt, Human
augucuucucacaagccagc

SEQ ID NO: 3516094 - RNA, 15 nt, Human
augucuucugccugu

SEQ ID NO: 3516095 - RNA, 20 nt, Human
augucuucuguauucacuua

SEQ ID NO: 3516096 - RNA, 16 nt, Human
augucuugagcucuau

SEQ ID NO: 3516097 - RNA, 19 nt, Human
augucuugcuguugacaua

SEQ ID NO: 3516098 - RNA, 20 nt, Human
augucuuggaacauuggaau

SEQ ID NO: 3516099 - RNA, 13 nt, Human
augucuuggacac

SEQ ID NO: 3516100 - RNA, 19 nt, Human
augucuuggacacuguaca

SEQ ID NO: 3516101 - RNA, 13 nt, Human
augucuugguacu

SEQ ID NO: 3516102 - RNA, 13 nt, Human
augucuuguuaau

SEQ ID NO: 3516103 - RNA, 22 nt, Human
augucuuuaggcagcagcuuuu

SEQ ID NO: 3516104 - RNA, 19 nt, Human
augucuuuccaaauuauuu

SEQ ID NO: 3516105 - RNA, 18 nt, Human
augucuuucuccaaaguu

SEQ ID NO: 3516106 - RNA, 22 nt, Human
augucuuucuccaaaguuaucc

SEQ ID NO: 3516107 - RNA, 17 nt, Human
augucuuugguccucuu

SEQ ID NO: 3516108 - RNA, 15 nt, Human
augucuuuguaaguc

SEQ ID NO: 3516109 - RNA, 22 nt, Human
augucuuuguaagucaguguug

SEQ ID NO: 3516110 - RNA, 18 nt, Human
augucuuuuagaagauag

SEQ ID NO: 3516111 - RNA, 18 nt, Human
augucuuuuauaguggaa

SEQ ID NO: 3516112 - RNA, 19 nt, Human
augucuuuuauaguggaaa

SEQ ID NO: 3516113 - RNA, 21 nt, Human
augucuuuuauauuuguaucg

SEQ ID NO: 3516114 - RNA, 16 nt, Human
augucuuuucccauuu

SEQ ID NO: 3516115 - RNA, 15 nt, Human
augucuuuucuuggc

SEQ ID NO: 3516116 - RNA, 18 nt, Human
augucuuuuuaagcuuau

SEQ ID NO: 3516117 - RNA, 20 nt, Human
augucuuuuuaagcuuauuu

SEQ ID NO: 3516118 - RNA, 23 nt, Human
augucuuuuuaagcuuauuuaau

SEQ ID NO: 3516119 - RNA, 21 nt, Human
augucuuuuuucaaacuuuau

SEQ ID NO: 3516120 - RNA, 19 nt, Human
augucuuuuuuuuaaugug

SEQ ID NO: 3516121 - RNA, 16 nt, Human
augugaaaaucaaaua

SEQ ID NO: 3516122 - RNA, 18 nt, Human
augugaaaaucaaauaca

SEQ ID NO: 3516123 - RNA, 21 nt, Human
augugaaaaugguccaggaga

SEQ ID NO: 3516124 - RNA, 22 nt, Human
augugaaaaugguccaggagaa

SEQ ID NO: 3516125 - RNA, 15 nt, Human
augugaaaccuuuuu

SEQ ID NO: 3516126 - RNA, 22 nt, Human
augugaaaccuuuuuuaagauu

SEQ ID NO: 3516127 - RNA, 23 nt, Human
augugaaaccuuuuuuaagauuu

SEQ ID NO: 3516128 - RNA, 12 nt, Human
augugaaagcac

SEQ ID NO: 3516129 - RNA, 18 nt, Human
augugaaaggauaugaau

SEQ ID NO: 3516130 - RNA, 14 nt, Human
augugaaaucauuc

SEQ ID NO: 3516131 - RNA, 17 nt, Human
augugaaauguaacugu

SEQ ID NO: 3516132 - RNA, 23 nt, Human
augugaacaguuguguuugaagc

SEQ ID NO: 3516133 - RNA, 12 nt, Human
augugaaccauu

SEQ ID NO: 3516134 - RNA, 14 nt, Human
augugaacuagcug

SEQ ID NO: 3516135 - RNA, 19 nt, Human
augugaacuagcuggaauu

SEQ ID NO: 3516136 - RNA, 17 nt, Human
augugaacuuguagcug

SEQ ID NO: 3516137 - RNA, 22 nt, Human
augugaacuuguagcuguaaaa

SEQ ID NO: 3516138 - RNA, 12 nt, Human
augugaagccuu

SEQ ID NO: 3516139 - RNA, 15 nt, Human
augugaagccuuccc

SEQ ID NO: 3516140 - RNA, 13 nt, Human
augugaaguguua

SEQ ID NO: 3516141 - RNA, 20 nt, Human
augugaaguguuaauacuag

SEQ ID NO: 3516142 - RNA, 21 nt, Human
augugaauaaaauuauuuugg

SEQ ID NO: 3516143 - RNA, 21 nt, Human
augugaauuacuaacuucuaa

SEQ ID NO: 3516144 - RNA, 22 nt, Human
augugaauuacuaacuucuaaa

SEQ ID NO: 3516145 - RNA, 20 nt, Human
augugaauuauugacacuga

SEQ ID NO: 3516146 - RNA, 18 nt, Human
augugaauugccugcaga

SEQ ID NO: 3516147 - RNA, 15 nt, Human
augugaauuuuuaag

SEQ ID NO: 3516148 - RNA, 16 nt, Human
augugaauuuuuaagc

SEQ ID NO: 3516149 - RNA, 18 nt, Human
augugaauuuuuauuguu

SEQ ID NO: 3516150 - RNA, 15 nt, Human
augugacaauaauau

SEQ ID NO: 3516151 - RNA, 15 nt, Human
augugacaccaaagc

SEQ ID NO: 3516152 - RNA, 19 nt, Human
augugacaugcgggcuggg

SEQ ID NO: 3516153 - RNA, 18 nt, Human
augugacauuaacaaaua

SEQ ID NO: 3516154 - RNA, 21 nt, Human
augugacauuaacaaauaaaa

SEQ ID NO: 3516155 - RNA, 23 nt, Human
cacuguaguaaauaaugcuuuga

SEQ ID NO: 3516156 - RNA, 17 nt, Human
cacuguaguucuaagac

SEQ ID NO: 3516157 - RNA, 21 nt, Human
cacuguauaaauaggagagga

SEQ ID NO: 3516158 - RNA, 15 nt, Human
cacuguauaccccgu

SEQ ID NO: 3516159 - RNA, 14 nt, Human
cacuguauccaggu

SEQ ID NO: 3516160 - RNA, 22 nt, Human
cacuguaugauuuauaaacaga

SEQ ID NO: 3516161 - RNA, 16 nt, Human
cacuguaugcuggacg

SEQ ID NO: 3516162 - RNA, 16 nt, Human
cacugucacuguuucu

SEQ ID NO: 3516163 - RNA, 18 nt, Human
cacugucacuguuucucu

SEQ ID NO: 3516164 - RNA, 16 nt, Human
cacugucccucaaaug

SEQ ID NO: 3516165 - RNA, 22 nt, Human
cagacuguguaaaaagagagcu

SEQ ID NO: 3516166 - RNA, 23 nt, Human
cagacuguuagaaaauggacacu

SEQ ID NO: 3516167 - RNA, 24 nt, Human
cagacuguuagaaaauggacacug

SEQ ID NO: 3516168 - RNA, 16 nt, Human
cagacuguugucccug

SEQ ID NO: 3516169 - RNA, 18 nt, Human
cagacuuaccaggaagca

SEQ ID NO: 3516170 - RNA, 14 nt, Human
cagacuucacacug

SEQ ID NO: 3516171 - RNA, 15 nt, Human
cagacuucacacugc

SEQ ID NO: 3516172 - RNA, 12 nt, Human
cagacuucccac

SEQ ID NO: 3516173 - RNA, 24 nt, Human
cagacuuccuugagacacggagcc

SEQ ID NO: 3516174 - RNA, 20 nt, Human
cagacuucuccagacccacc

SEQ ID NO: 3516175 - RNA, 21 nt, Human
cagacuugccaugugacucug

SEQ ID NO: 3516176 - RNA, 14 nt, Human
cagacuuggcucag

SEQ ID NO: 3516177 - RNA, 17 nt, Human
cagacuuguauauucua

SEQ ID NO: 3516178 - RNA, 20 nt, Human
cagacuuuacaugacacagc

SEQ ID NO: 3516179 - RNA, 16 nt, Human
cagacuuuuguacauc

SEQ ID NO: 3516180 - RNA, 21 nt, Human
cagacuuuuuuaaacaucaaa

SEQ ID NO: 3516181 - RNA, 20 nt, Human
cagacuuuuuuuaaauagua

SEQ ID NO: 3516182 - RNA, 14 nt, Human
cagagaaaccagcu

SEQ ID NO: 3516183 - RNA, 16 nt, Human
cagagaaaccagcuuc

SEQ ID NO: 3516184 - RNA, 18 nt, Human
cagagaaaccagcuuccu

SEQ ID NO: 3516185 - RNA, 22 nt, Human
cagagaaaccagcuuccuucag

SEQ ID NO: 3516186 - RNA, 23 nt, Human
cagagaaaccagcuuccuucaga

SEQ ID NO: 3516187 - RNA, 20 nt, Human
cagagaaagaagagacagga

SEQ ID NO: 3516188 - RNA, 17 nt, Human
cagagaaagcgcagaug

SEQ ID NO: 3516189 - RNA, 18 nt, Human
cagagaaaggggagccca

SEQ ID NO: 3516190 - RNA, 19 nt, Human
cagagaaaggggagcccac

SEQ ID NO: 3516191 - RNA, 20 nt, Human
cagagaaaucuaagcugugu

SEQ ID NO: 3516192 - RNA, 11 nt, Human
cagagaacagc

SEQ ID NO: 3516193 - RNA, 24 nt, Human
cagagaacagcgaaguagcuugcu

SEQ ID NO: 3516194 - RNA, 22 nt, Human
cagagaacccagcccacccccg

SEQ ID NO: 3516195 - RNA, 19 nt, Human
cagagaagaaagaacggaa

SEQ ID NO: 3516196 - RNA, 21 nt, Human
cagagaagauucuuguauuua

SEQ ID NO: 3516197 - RNA, 18 nt, Human
cagagaagccagcuuguu

SEQ ID NO: 3516198 - RNA, 14 nt, Human
cagagaagccauca

SEQ ID NO: 3516199 - RNA, 19 nt, Human
cagagaagccaucaccuca

SEQ ID NO: 3516200 - RNA, 21 nt, Human
cagagaagccaucaccucaga

SEQ ID NO: 3516201 - RNA, 22 nt, Human
cagagaagccaucaccucagau

SEQ ID NO: 3516202 - RNA, 13 nt, Human
cagagaagccuuc

SEQ ID NO: 3516203 - RNA, 21 nt, Human
cagagaagcuggggaggagcu

SEQ ID NO: 3516204 - RNA, 15 nt, Human
cagagaaggcagcag

SEQ ID NO: 3516205 - RNA, 13 nt, Human
cagagaaggcagg

SEQ ID NO: 3516206 - RNA, 18 nt, Human
cagagaaggccaggggcu

SEQ ID NO: 3516207 - RNA, 18 nt, Human
cagagaagggcauaaaac

SEQ ID NO: 3516208 - RNA, 19 nt, Human
cagagaagucacagggcag

SEQ ID NO: 3516209 - RNA, 16 nt, Human
cagagaagugacaggg

SEQ ID NO: 3516210 - RNA, 21 nt, Human
cagagaagugacagggaagcu

SEQ ID NO: 3516211 - RNA, 20 nt, Human
cagagaagugacgguuccua

SEQ ID NO: 3516212 - RNA, 19 nt, Human
cagagaauauaacaugaaa

SEQ ID NO: 3516213 - RNA, 20 nt, Human
cagagaaugaaagggcccag

SEQ ID NO: 3516214 - RNA, 21 nt, Human
cagagaauugcugauucuuga

SEQ ID NO: 3516215 - RNA, 23 nt, Human
cagagaauuucuaccauuucaga

SEQ ID NO: 3516216 - RNA, 12 nt, Human
cagagacaaaau

SEQ ID NO: 3516217 - RNA, 13 nt, Human
cagagacaaggag

SEQ ID NO: 3516218 - RNA, 14 nt, Human
cagagacacaagcc

SEQ ID NO: 3516219 - RNA, 14 nt, Human
cagagacaccugca

SEQ ID NO: 3516220 - RNA, 16 nt, Human
auuaaggcaacugaac

SEQ ID NO: 3516221 - RNA, 17 nt, Human
auuaaggucucucuuug

SEQ ID NO: 3516222 - RNA, 18 nt, Human
auuaaguaaacuaaugag

SEQ ID NO: 3516223 - RNA, 15 nt, Human
auuaaguaacuuauu

SEQ ID NO: 3516224 - RNA, 15 nt, Human
auuaaguaaucaaua

SEQ ID NO: 3516225 - RNA, 20 nt, Human
auuaaguucucaaugugaaa

SEQ ID NO: 3516226 - RNA, 13 nt, Human
auuaaguucuuua

SEQ ID NO: 3516227 - RNA, 20 nt, Human
auuaaguuguuaauaaaagu

SEQ ID NO: 3516228 - RNA, 16 nt, Human
auuaauaaaaaaugga

SEQ ID NO: 3516229 - RNA, 22 nt, Human
auuaauaaaaaauggaaagaau

SEQ ID NO: 3516230 - RNA, 13 nt, Human
auuaauaaaaaga

SEQ ID NO: 3516231 - RNA, 13 nt, Human
auuaauaaauaga

SEQ ID NO: 3516232 - RNA, 20 nt, Human
auuaauacaaugaugcuauu

SEQ ID NO: 3516233 - RNA, 16 nt, Human
auuaauacuaaaauau

SEQ ID NO: 3516234 - RNA, 20 nt, Human
auuaauacuaaaauaugucu

SEQ ID NO: 3516235 - RNA, 19 nt, Human
auuaauagcuuuuauugua

SEQ ID NO: 3516236 - RNA, 18 nt, Human
auuaauaguaauuuguaa

SEQ ID NO: 3516237 - RNA, 17 nt, Human
auuaauauauauuaucu

SEQ ID NO: 3516238 - RNA, 21 nt, Human
auuaauauauguauuauuuau

SEQ ID NO: 3516239 - RNA, 22 nt, Human
auuaauauauguauuauuuaua

SEQ ID NO: 3516240 - RNA, 15 nt, Human
auuaauaugaaaacu

SEQ ID NO: 3516241 - RNA, 16 nt, Human
auuaauauucauugua

SEQ ID NO: 3516242 - RNA, 13 nt, Human
auuaaucacuauu

SEQ ID NO: 3516243 - RNA, 14 nt, Human
auuaaucacugugu

SEQ ID NO: 3516244 - RNA, 19 nt, Human
auuaaucaucuauaaagaa

SEQ ID NO: 3516245 - RNA, 17 nt, Human
auuaaucuuaguguaug

SEQ ID NO: 3516246 - RNA, 19 nt, Human
auuaaucuuaguguaugau

SEQ ID NO: 3516247 - RNA, 21 nt, Human
auuaaucuuggauagcuaaua

SEQ ID NO: 3516248 - RNA, 17 nt, Human
auuaaugaaaauaagaa

SEQ ID NO: 3516249 - RNA, 15 nt, Human
auuaaugaaauaucu

SEQ ID NO: 3516250 - RNA, 19 nt, Human
auuaaugaaauaucuguau

SEQ ID NO: 3516251 - RNA, 16 nt, Human
auuaaugacagagcca

SEQ ID NO: 3516252 - RNA, 16 nt, Human
auuaaugcacuuucua

SEQ ID NO: 3516253 - RNA, 14 nt, Human
auuaaugcccagac

SEQ ID NO: 3516254 - RNA, 17 nt, Human
auuaaugccugcuuuuu

SEQ ID NO: 3516255 - RNA, 22 nt, Human
auuaaugccugcuuuuuggaaa

SEQ ID NO: 3516256 - RNA, 23 nt, Human
auuaaugcuaagggcaggcccaa

SEQ ID NO: 3516257 - RNA, 13 nt, Human
auuaaugcuuugg

SEQ ID NO: 3516258 - RNA, 23 nt, Human
auuaauguacuuguuucucuguu

SEQ ID NO: 3516259 - RNA, 21 nt, Human
auuaauguauccaaugaaaua

SEQ ID NO: 3516260 - RNA, 12 nt, Human
auuaauguuaau

SEQ ID NO: 3516261 - RNA, 14 nt, Human
auuaauguugauuu

SEQ ID NO: 3516262 - RNA, 17 nt, Human
auuaauguugauuucua

SEQ ID NO: 3516263 - RNA, 17 nt, Human
auuaauguuuucaaaag

SEQ ID NO: 3516264 - RNA, 18 nt, Human
auuaauuccuguuugucu

SEQ ID NO: 3516265 - RNA, 19 nt, Human
auuaauuggcagcagauuu

SEQ ID NO: 3516266 - RNA, 19 nt, Human
auuaauugggccagcuuuu

SEQ ID NO: 3516267 - RNA, 22 nt, Human
auuaauugggccagcuuuucaa

SEQ ID NO: 3516268 - RNA, 13 nt, Human
auuaauuguaauc

SEQ ID NO: 3516269 - RNA, 20 nt, Human
auuaauuguaaucugaauaa

SEQ ID NO: 3516270 - RNA, 14 nt, Human
auuaauugugugaa

SEQ ID NO: 3516271 - RNA, 16 nt, Human
auuaauugugugaacu

SEQ ID NO: 3516272 - RNA, 21 nt, Human
auuaauugugugaacuuggaa

SEQ ID NO: 3516273 - RNA, 19 nt, Human
auuaauuguuuugcacuuu

SEQ ID NO: 3516274 - RNA, 20 nt, Human
auuaauuguuuugcacuuuu

SEQ ID NO: 3516275 - RNA, 14 nt, Human
auuaauuuaaauga

SEQ ID NO: 3516276 - RNA, 19 nt, Human
auuaauuuaucagauugcu

SEQ ID NO: 3516277 - RNA, 13 nt, Human
auuaauuucugcc

SEQ ID NO: 3516278 - RNA, 20 nt, Human
auuaauuucugccauuucau

SEQ ID NO: 3516279 - RNA, 16 nt, Human
auuaauuugauuaaca

SEQ ID NO: 3516280 - RNA, 21 nt, Human
auuaauuugauuaacaaauau

SEQ ID NO: 3516281 - RNA, 17 nt, Human
auuaauuuuuuuucauu

SEQ ID NO: 3516282 - RNA, 10 nt, Human
auuacaaaua

SEQ ID NO: 3516283 - RNA, 14 nt, Human
auuacaaaucagaa

SEQ ID NO: 3516284 - RNA, 23 nt, Human
auuacaaaucagaagucaucuug

SEQ ID NO: 3516285 - RNA, 13 nt, Human
auuacaaaugguu

SEQ ID NO: 3516286 - RNA, 22 nt, Human
auuacaagcgugagccacugca

SEQ ID NO: 3516287 - RNA, 14 nt, Human
auuacaauauuucu

SEQ ID NO: 3516288 - RNA, 13 nt, Human
auuacaauauuug

SEQ ID NO: 3516289 - RNA, 13 nt, Human
auuacaauuuuau

SEQ ID NO: 3516290 - RNA, 17 nt, Human
auuacacaaaacaaaug

SEQ ID NO: 3516291 - RNA, 18 nt, Human
auuacacaaaacaaaugc

SEQ ID NO: 3516292 - RNA, 18 nt, Human
auuacacaaauacuuauu

SEQ ID NO: 3516293 - RNA, 14 nt, Human
auuacacccaaaga

SEQ ID NO: 3516294 - RNA, 19 nt, Human
auuacacuugguaauugua

SEQ ID NO: 3516295 - RNA, 17 nt, Human
auuacagagaggagaaa

SEQ ID NO: 3516296 - RNA, 21 nt, Human
auuacagagaggagaaacaca

SEQ ID NO: 3516297 - RNA, 15 nt, Human
auuacagaggaaguu

SEQ ID NO: 3516298 - RNA, 22 nt, Human
auuacagauaaaauguaaacug

SEQ ID NO: 3516299 - RNA, 21 nt, Human
auuacagaugggcaaauuaag

SEQ ID NO: 3516300 - RNA, 17 nt, Human
auuacaggcuccugcca

SEQ ID NO: 3516301 - RNA, 15 nt, Human
auuacaggcuugagc

SEQ ID NO: 3516302 - RNA, 19 nt, Human
auuacaguggggaaugaag

SEQ ID NO: 3516303 - RNA, 21 nt, Human
auuacaguggggaaugaagau

SEQ ID NO: 3516304 - RNA, 18 nt, Human
auuacauaaucuguacaa

SEQ ID NO: 3516305 - RNA, 18 nt, Human
auuacauccuuguggcac

SEQ ID NO: 3516306 - RNA, 16 nt, Human
auuacaucuuucacau

SEQ ID NO: 3516307 - RNA, 17 nt, Human
auuacaucuuucacauu

SEQ ID NO: 3516308 - RNA, 17 nt, Human
auuacauuccuugauaa

SEQ ID NO: 3516309 - RNA, 20 nt, Human
cacugugggugugugacucu

SEQ ID NO: 3516310 - RNA, 18 nt, Human
cacugugguaaaugccac

SEQ ID NO: 3516311 - RNA, 20 nt, Human
cacugugguaaaugccacac

SEQ ID NO: 3516312 - RNA, 12 nt, Human
cacuguguaagc

SEQ ID NO: 3516313 - RNA, 14 nt, Human
cacuguguauauuu

SEQ ID NO: 3516314 - RNA, 15 nt, Human
cacuguguauauuug

SEQ ID NO: 3516315 - RNA, 14 nt, Human
cacuguguauuguu

SEQ ID NO: 3516316 - RNA, 15 nt, Human
cacuguguauuuaac

SEQ ID NO: 3516317 - RNA, 13 nt, Human
cacuguuagaaca

SEQ ID NO: 3516318 - RNA, 14 nt, Human
cacuguuagaacac

SEQ ID NO: 3516319 - RNA, 15 nt, Human
cacuguuagaacacu

SEQ ID NO: 3516320 - RNA, 17 nt, Human
cacuguuagaacacuau

SEQ ID NO: 3516321 - RNA, 18 nt, Human
cacuguuagaacacuauu

SEQ ID NO: 3516322 - RNA, 19 nt, Human
cacuguuagaacacuauuu

SEQ ID NO: 3516323 - RNA, 20 nt, Human
cacuguuagaacacuauuuu

SEQ ID NO: 3516324 - RNA, 21 nt, Human
cacuguuagaacacuauuuuc

SEQ ID NO: 3516325 - RNA, 23 nt, Human
cacuguuagcuuuuuaaaacauu

SEQ ID NO: 3516326 - RNA, 19 nt, Human
cacuguucaugcuggcgag

SEQ ID NO: 3516327 - RNA, 20 nt, Human
cacuguuccagccugcccuc

SEQ ID NO: 3516328 - RNA, 21 nt, Human
cacuguuccagugucuauaaa

SEQ ID NO: 3516329 - RNA, 17 nt, Human
cacuguucccccugugc

SEQ ID NO: 3516330 - RNA, 19 nt, Human
cacuguucccccugugcag

SEQ ID NO: 3516331 - RNA, 16 nt, Human
cacuguucccucugcu

SEQ ID NO: 3516332 - RNA, 17 nt, Human
cacuguucccucugcuc

SEQ ID NO: 3516333 - RNA, 15 nt, Human
cacuguucucugccc

SEQ ID NO: 3516334 - RNA, 16 nt, Human
cacuguucucugcccu

SEQ ID NO: 3516335 - RNA, 17 nt, Human
cacuguucucugcccuc

SEQ ID NO: 3516336 - RNA, 21 nt, Human
cacuguucucugcccuccaag

SEQ ID NO: 3516337 - RNA, 21 nt, Human
cacuguucuuagcucaaugag

SEQ ID NO: 3516338 - RNA, 23 nt, Human
cacuguucuuagcucaaugagca

SEQ ID NO: 3516339 - RNA, 17 nt, Human
cacuguugaaaauuauu

SEQ ID NO: 3516340 - RNA, 17 nt, Human
cacuguugaauuuucuc

SEQ ID NO: 3516341 - RNA, 17 nt, Human
cacuguugauaaaaacu

SEQ ID NO: 3516342 - RNA, 17 nt, Human
cacuguugauguaucug

SEQ ID NO: 3516343 - RNA, 14 nt, Human
cacuguugcccagg

SEQ ID NO: 3516344 - RNA, 16 nt, Human
cacuguugcccaggcu

SEQ ID NO: 3516345 - RNA, 17 nt, Human
cacuguuuacaagaaaa

SEQ ID NO: 3516346 - RNA, 18 nt, Human
cacuguuuacaagaaaaa

SEQ ID NO: 3516347 - RNA, 15 nt, Human
cacuguuuagauuug

SEQ ID NO: 3516348 - RNA, 21 nt, Human
cacuguuucacuacucagcau

SEQ ID NO: 3516349 - RNA, 14 nt, Human
cacuguuuccuggg

SEQ ID NO: 3516350 - RNA, 15 nt, Human
cacuguuuccugggc

SEQ ID NO: 3516351 - RNA, 14 nt, Human
cacuguuucucugc

SEQ ID NO: 3516352 - RNA, 22 nt, Human
cacuguuucucuugagcuggcc

SEQ ID NO: 3516353 - RNA, 18 nt, Human
cacuguuucuugcuugua

SEQ ID NO: 3516354 - RNA, 15 nt, Human
cacuguuuguuuuua

SEQ ID NO: 3516355 - RNA, 18 nt, Human
cacuguuuguuuuuauuu

SEQ ID NO: 3516356 - RNA, 17 nt, Human
cacuguuuucuagugua

SEQ ID NO: 3516357 - RNA, 22 nt, Human
cacuguuuugaaucucauaauu

SEQ ID NO: 3516358 - RNA, 14 nt, Human
cacuguuuuuagac

SEQ ID NO: 3516359 - RNA, 20 nt, Human
cacuguuuuuagacaccuuc

SEQ ID NO: 3516360 - RNA, 14 nt, Human
cacuguuuuuccau

SEQ ID NO: 3516361 - RNA, 15 nt, Human
cacuguuuuuccaua

SEQ ID NO: 3516362 - RNA, 14 nt, Human
cacuuaaaaaaugu

SEQ ID NO: 3516363 - RNA, 16 nt, Human
cacuuaaaacacguuu

SEQ ID NO: 3516364 - RNA, 22 nt, Human
cacuuaaaacacguuuuaagga

SEQ ID NO: 3516365 - RNA, 15 nt, Human
cacuuaaacuugcau

SEQ ID NO: 3516366 - RNA, 23 nt, Human
cacuuaaauaucaaucauuuucc

SEQ ID NO: 3516367 - RNA, 18 nt, Human
cacuuaacaaacaaauuu

SEQ ID NO: 3516368 - RNA, 22 nt, Human
cacuuaacaagcucccaggccg

SEQ ID NO: 3516369 - RNA, 13 nt, Human
cacuuaacagaug

SEQ ID NO: 3516370 - RNA, 21 nt, Human
cacuuaacauuccuaaaaugc

SEQ ID NO: 3516371 - RNA, 21 nt, Human
cacuuaagacuguguauucua

SEQ ID NO: 3516372 - RNA, 20 nt, Human
cacuuaagagaauauuuuaa

SEQ ID NO: 3516373 - RNA, 21 nt, Human
cacuuaaguuagccuccacca

SEQ ID NO: 3516374 - RNA, 18 nt, Human
auuacuuguaaauauaaa

SEQ ID NO: 3516375 - RNA, 21 nt, Human
auuacuuguaaauauaaagac

SEQ ID NO: 3516376 - RNA, 17 nt, Human
auuacuuguugccuaua

SEQ ID NO: 3516377 - RNA, 11 nt, Human
auuacuuuauc

SEQ ID NO: 3516378 - RNA, 15 nt, Human
auuacuuuaucacuu

SEQ ID NO: 3516379 - RNA, 16 nt, Human
auuacuuuaucacuuu

SEQ ID NO: 3516380 - RNA, 21 nt, Human
auuacuuuuccacaaaucagu

SEQ ID NO: 3516381 - RNA, 22 nt, Human
auuagaaaaaaauuacuaauuu

SEQ ID NO: 3516382 - RNA, 17 nt, Human
auuagaaaaauuccuaa

SEQ ID NO: 3516383 - RNA, 13 nt, Human
auuagaaaauauu

SEQ ID NO: 3516384 - RNA, 17 nt, Human
auuagaaacauaaauaa

SEQ ID NO: 3516385 - RNA, 22 nt, Human
auuagaaauagacaguauauuu

SEQ ID NO: 3516386 - RNA, 12 nt, Human
auuagaaauauu

SEQ ID NO: 3516387 - RNA, 14 nt, Human
auuagaaauauuuu

SEQ ID NO: 3516388 - RNA, 21 nt, Human
auuagaagauauuagucuugg

SEQ ID NO: 3516389 - RNA, 18 nt, Human
auuagaaguguuaacuua

SEQ ID NO: 3516390 - RNA, 20 nt, Human
auuagaaguguuaacuuagc

SEQ ID NO: 3516391 - RNA, 21 nt, Human
auuagaaucaaacauuuugaa

SEQ ID NO: 3516392 - RNA, 19 nt, Human
auuagaauuaccauuuguu

SEQ ID NO: 3516393 - RNA, 14 nt, Human
auuagaauuauuua

SEQ ID NO: 3516394 - RNA, 15 nt, Human
auuagacuccuccuc

SEQ ID NO: 3516395 - RNA, 16 nt, Human
auuagacuccuccucc

SEQ ID NO: 3516396 - RNA, 15 nt, Human
auuagacuggacagc

SEQ ID NO: 3516397 - RNA, 20 nt, Human
auuagacuggacagcuugug

SEQ ID NO: 3516398 - RNA, 15 nt, Human
auuagacuucuguuu

SEQ ID NO: 3516399 - RNA, 20 nt, Human
auuagacuucuguuuucaau

SEQ ID NO: 3516400 - RNA, 20 nt, Human
auuagacuuuagaaauaaau

SEQ ID NO: 3516401 - RNA, 15 nt, Human
auuagagaacauccu

SEQ ID NO: 3516402 - RNA, 19 nt, Human
auuagagaguguugaaacg

SEQ ID NO: 3516403 - RNA, 20 nt, Human
auuagagauuaccuccugag

SEQ ID NO: 3516404 - RNA, 16 nt, Human
auuagaggggaaaagc

SEQ ID NO: 3516405 - RNA, 11 nt, Human
auuagaugaau

SEQ ID NO: 3516406 - RNA, 14 nt, Human
auuagaugcauguu

SEQ ID NO: 3516407 - RNA, 20 nt, Human
auuagaugcauguugaccau

SEQ ID NO: 3516408 - RNA, 14 nt, Human
auuagaugugauuu

SEQ ID NO: 3516409 - RNA, 13 nt, Human
auuagauguucuc

SEQ ID NO: 3516410 - RNA, 21 nt, Human
auuagauguucucuaucauuu

SEQ ID NO: 3516411 - RNA, 14 nt, Human
auuagauuauauug

SEQ ID NO: 3516412 - RNA, 16 nt, Human
auuagcaaaaaaaguu

SEQ ID NO: 3516413 - RNA, 18 nt, Human
auuagcaaaaaaaguugu

SEQ ID NO: 3516414 - RNA, 19 nt, Human
auuagcaaaaaaaguugua

SEQ ID NO: 3516415 - RNA, 21 nt, Human
auuagcaaaaaaaguuguaug

SEQ ID NO: 3516416 - RNA, 14 nt, Human
auuagcauuuaguc

SEQ ID NO: 3516417 - RNA, 22 nt, Human
auuagccaggaucaugguguaa

SEQ ID NO: 3516418 - RNA, 14 nt, Human
auuagccaguaauc

SEQ ID NO: 3516419 - RNA, 16 nt, Human
auuagccaguaauccu

SEQ ID NO: 3516420 - RNA, 18 nt, Human
auuagccgggcauggugg

SEQ ID NO: 3516421 - RNA, 14 nt, Human
auuagccugaguag

SEQ ID NO: 3516422 - RNA, 17 nt, Human
auuagccugaguagaaa

SEQ ID NO: 3516423 - RNA, 12 nt, Human
auuagcugcuuc

SEQ ID NO: 3516424 - RNA, 21 nt, Human
auuagcugcuucuauguuuca

SEQ ID NO: 3516425 - RNA, 15 nt, Human
auuagcugugauuuu

SEQ ID NO: 3516426 - RNA, 17 nt, Human
auuagcuuggggccagg

SEQ ID NO: 3516427 - RNA, 18 nt, Human
auuagcuuggggccaggg

SEQ ID NO: 3516428 - RNA, 20 nt, Human
auuagcuuuacuguuuguua

SEQ ID NO: 3516429 - RNA, 13 nt, Human
auuagcuuugugu

SEQ ID NO: 3516430 - RNA, 22 nt, Human
auuaggaaguguaacagcugag

SEQ ID NO: 3516431 - RNA, 16 nt, Human
auuaggaauaaauaaa

SEQ ID NO: 3516432 - RNA, 14 nt, Human
auuaggauuucaug

SEQ ID NO: 3516433 - RNA, 21 nt, Human
auuaggcagacucuuuaugcu

SEQ ID NO: 3516434 - RNA, 16 nt, Human
auuaggcaugguuuug

SEQ ID NO: 3516435 - RNA, 14 nt, Human
auuaggcuguaacu

SEQ ID NO: 3516436 - RNA, 15 nt, Human
auuaggcuguaacua

SEQ ID NO: 3516437 - RNA, 17 nt, Human
auuaggcuguaacuacu

SEQ ID NO: 3516438 - RNA, 21 nt, Human
auuaggcuguaacuacuuuau

SEQ ID NO: 3516439 - RNA, 16 nt, Human
auuagggagagaagau

SEQ ID NO: 3516440 - RNA, 19 nt, Human
auuagggcauuugagaaau

SEQ ID NO: 3516441 - RNA, 15 nt, Human
auuagggcccugugu

SEQ ID NO: 3516442 - RNA, 18 nt, Human
auuaggugugacugaauu

SEQ ID NO: 3516443 - RNA, 15 nt, Human
auuagguuaacuaug

SEQ ID NO: 3516444 - RNA, 13 nt, Human
auuagguugugaa

SEQ ID NO: 3516445 - RNA, 15 nt, Human
auuagguugugaaug

SEQ ID NO: 3516446 - RNA, 13 nt, Human
auuaguaaauguc

SEQ ID NO: 3516447 - RNA, 17 nt, Human
auuaguaaaugucuuug

SEQ ID NO: 3516448 - RNA, 13 nt, Human
auuaguaacaugu

SEQ ID NO: 3516449 - RNA, 12 nt, Human
auuaguaagauc

SEQ ID NO: 3516450 - RNA, 21 nt, Human
auuaguaagaucucuuucuaa

SEQ ID NO: 3516451 - RNA, 20 nt, Human
auuaguacuccccuccuuga

SEQ ID NO: 3516452 - RNA, 13 nt, Human
auuaguauuguug

SEQ ID NO: 3516453 - RNA, 13 nt, Human
auuagucccuggc

SEQ ID NO: 3516454 - RNA, 23 nt, Human
cagacaagcaacagguuuuauaa

SEQ ID NO: 3516455 - RNA, 17 nt, Human
cagacaauaugugagug

SEQ ID NO: 3516456 - RNA, 14 nt, Human
cagacaaucuucug

SEQ ID NO: 3516457 - RNA, 13 nt, Human
cagacacaaacaa

SEQ ID NO: 3516458 - RNA, 17 nt, Human
cagacacacacacgcac

SEQ ID NO: 3516459 - RNA, 20 nt, Human
cagacacagggacuugaagu

SEQ ID NO: 3516460 - RNA, 21 nt, Human
cagacacagggacuugaaguu

SEQ ID NO: 3516461 - RNA, 22 nt, Human
cagacacagggacuugaaguug

SEQ ID NO: 3516462 - RNA, 12 nt, Human
cagacacccagg

SEQ ID NO: 3516463 - RNA, 13 nt, Human
cagacacccagga

SEQ ID NO: 3516464 - RNA, 15 nt, Human
cagacacccaggacu

SEQ ID NO: 3516465 - RNA, 17 nt, Human
cagacaccuugacaggg

SEQ ID NO: 3516466 - RNA, 18 nt, Human
cagacaccuuggacaucc

SEQ ID NO: 3516467 - RNA, 18 nt, Human
cagacacgccuuccccuc

SEQ ID NO: 3516468 - RNA, 11 nt, Human
cagacacuaag

SEQ ID NO: 3516469 - RNA, 13 nt, Human
cagacacucuggc

SEQ ID NO: 3516470 - RNA, 22 nt, Human
cagacacugguuugaagaaugu

SEQ ID NO: 3516471 - RNA, 15 nt, Human
cagacacuuuggaag

SEQ ID NO: 3516472 - RNA, 15 nt, Human
cagacagaacuugaa

SEQ ID NO: 3516473 - RNA, 18 nt, Human
cagacagaagucuccuca

SEQ ID NO: 3516474 - RNA, 16 nt, Human
cagacagacacacaca

SEQ ID NO: 3516475 - RNA, 14 nt, Human
cagacagagccagg

SEQ ID NO: 3516476 - RNA, 17 nt, Human
cagacagagccaggaga

SEQ ID NO: 3516477 - RNA, 14 nt, Human
cagacagagcccug

SEQ ID NO: 3516478 - RNA, 16 nt, Human
cagacagcagcucagg

SEQ ID NO: 3516479 - RNA, 18 nt, Human
cagacagcagcucaggca

SEQ ID NO: 3516480 - RNA, 19 nt, Human
cagacagcagcucaggcac

SEQ ID NO: 3516481 - RNA, 19 nt, Human
cagacagcaggcagcgcca

SEQ ID NO: 3516482 - RNA, 14 nt, Human
cagacagcccucca

SEQ ID NO: 3516483 - RNA, 13 nt, Human
cagacagccugua

SEQ ID NO: 3516484 - RNA, 21 nt, Human
cagacagcuccacccuggccg

SEQ ID NO: 3516485 - RNA, 12 nt, Human
cagacagcuccc

SEQ ID NO: 3516486 - RNA, 18 nt, Human
cagacagcugccugggau

SEQ ID NO: 3516487 - RNA, 15 nt, Human
cagacaggaaaggga

SEQ ID NO: 3516488 - RNA, 20 nt, Human
cagacaggaaagggaaggcc

SEQ ID NO: 3516489 - RNA, 23 nt, Human
cagacaggaaagggaaggcccca

SEQ ID NO: 3516490 - RNA, 13 nt, Human
cagacaggaccag

SEQ ID NO: 3516491 - RNA, 17 nt, Human
cagacaggaccagggau

SEQ ID NO: 3516492 - RNA, 18 nt, Human
cagacaggcaaauaaaag

SEQ ID NO: 3516493 - RNA, 22 nt, Human
cagacaggcucuuagcagcuuc

SEQ ID NO: 3516494 - RNA, 16 nt, Human
cagacaggucccuccc

SEQ ID NO: 3516495 - RNA, 18 nt, Human
cagacagguuuucacaua

SEQ ID NO: 3516496 - RNA, 20 nt, Human
cagacaguuaagagaaauga

SEQ ID NO: 3516497 - RNA, 12 nt, Human
cagacauaaagc

SEQ ID NO: 3516498 - RNA, 22 nt, Human
cagacauaaagccauguuuccu

SEQ ID NO: 3516499 - RNA, 15 nt, Human
cagacauaaaggaaa

SEQ ID NO: 3516500 - RNA, 19 nt, Human
cagacauacgaaacacaaa

SEQ ID NO: 3516501 - RNA, 15 nt, Human
cagacauauuuaacu

SEQ ID NO: 3516502 - RNA, 17 nt, Human
cagacauauuuaacugg

SEQ ID NO: 3516503 - RNA, 15 nt, Human
cagacaucaugaauu

SEQ ID NO: 3516504 - RNA, 17 nt, Human
cagacauccaaacuaaa

SEQ ID NO: 3516505 - RNA, 19 nt, Human
cagacauccauguuuguaa

SEQ ID NO: 3516506 - RNA, 22 nt, Human
cagacauccauguuuguaaaac

SEQ ID NO: 3516507 - RNA, 23 nt, Human
cagacaugguggcaugcaccugc

SEQ ID NO: 3516508 - RNA, 12 nt, Human
cagacauguuuu

SEQ ID NO: 3516509 - RNA, 16 nt, Human
cagacauuaaauaauc

SEQ ID NO: 3516510 - RNA, 13 nt, Human
cagacauucugcc

SEQ ID NO: 3516511 - RNA, 11 nt, Human
cagacauuguc

SEQ ID NO: 3516512 - RNA, 15 nt, Human
cagacauugucagca

SEQ ID NO: 3516513 - RNA, 14 nt, Human
cagacauugugcua

SEQ ID NO: 3516514 - RNA, 15 nt, Human
cagacauuguuuugc

SEQ ID NO: 3516515 - RNA, 20 nt, Human
cagacauuguuuugccaaca

SEQ ID NO: 3516516 - RNA, 23 nt, Human
cagaccaacguuacucagggcuc

SEQ ID NO: 3516517 - RNA, 20 nt, Human
cagaccacaucuuuaucugu

SEQ ID NO: 3516518 - RNA, 15 nt, Human
cagaccacaugcccc

SEQ ID NO: 3516519 - RNA, 19 nt, Human
cagaccaccccgccugccc

SEQ ID NO: 3516520 - RNA, 24 nt, Human
cagaccacgcccguccugccugug

SEQ ID NO: 3516521 - RNA, 15 nt, Human
cagaccagagcucug

SEQ ID NO: 3516522 - RNA, 13 nt, Human
cagaccagcucuu

SEQ ID NO: 3516523 - RNA, 14 nt, Human
cagaccauggacac

SEQ ID NO: 3516524 - RNA, 21 nt, Human
cagaccauuggggcucccagc

SEQ ID NO: 3516525 - RNA, 22 nt, Human
cagaccauuggggcucccagcc

SEQ ID NO: 3516526 - RNA, 17 nt, Human
cagaccauugucucaga

SEQ ID NO: 3516527 - RNA, 14 nt, Human
cagaccccagcggc

SEQ ID NO: 3516528 - RNA, 15 nt, Human
cagaccccagcggcu

SEQ ID NO: 3516529 - RNA, 14 nt, Human
cagacccccacccc

SEQ ID NO: 3516530 - RNA, 20 nt, Human
cagacccccaccccuucccc

SEQ ID NO: 3516531 - RNA, 13 nt, Human
cagacccccagca

SEQ ID NO: 3516532 - RNA, 18 nt, Human
cagacccccagcaacccu

SEQ ID NO: 3516533 - RNA, 15 nt, Human
cagaccccuggcuuu

SEQ ID NO: 3516534 - RNA, 16 nt, Human
cagaccccuuggccag

SEQ ID NO: 3516535 - RNA, 16 nt, Human
cagacccggcugcgug

SEQ ID NO: 3516536 - RNA, 13 nt, Human
cagacccugcccu

SEQ ID NO: 3516537 - RNA, 21 nt, Human
cagacccugcccugugggccc

SEQ ID NO: 3516538 - RNA, 15 nt, Human
cagacccugcccuug

SEQ ID NO: 3516539 - RNA, 14 nt, Human
cagacccuggaggc

SEQ ID NO: 3516540 - RNA, 20 nt, Human
cagaccgcgggcacugccgc

SEQ ID NO: 3516541 - RNA, 19 nt, Human
cagaccgucuuccuccaac

SEQ ID NO: 3516542 - RNA, 15 nt, Human
cagaccuaaugcucc

SEQ ID NO: 3516543 - RNA, 18 nt, Human
cagaccuauuccuccugg

SEQ ID NO: 3516544 - RNA, 19 nt, Human
cagaccuauuccuccuggg

SEQ ID NO: 3516545 - RNA, 16 nt, Human
cagaccuccccagccc

SEQ ID NO: 3516546 - RNA, 12 nt, Human
cagaccucugga

SEQ ID NO: 3516547 - RNA, 17 nt, Human
cagaccugagcucccca

SEQ ID NO: 3516548 - RNA, 13 nt, Human
cagaccugauccu

SEQ ID NO: 3516549 - RNA, 14 nt, Human
cagaccugauccug

SEQ ID NO: 3516550 - RNA, 20 nt, Human
cagaccugcagacgcccaga

SEQ ID NO: 3516551 - RNA, 23 nt, Human
cagaccugcuuuuugaaaugaaa

SEQ ID NO: 3516552 - RNA, 21 nt, Human
cagaccuggaagaacaggccu

SEQ ID NO: 3516553 - RNA, 13 nt, Human
cagaccuggagcc

SEQ ID NO: 3516554 - RNA, 14 nt, Human
cagaccuggagccc

SEQ ID NO: 3516555 - RNA, 19 nt, Human
cagaccuggagccccuggg

SEQ ID NO: 3516556 - RNA, 21 nt, Human
cagaccuggagccccugggug

SEQ ID NO: 3516557 - RNA, 17 nt, Human
cagaccuguccuccugg

SEQ ID NO: 3516558 - RNA, 14 nt, Human
cagacgcccagauu

SEQ ID NO: 3516559 - RNA, 23 nt, Human
cagacgccggggacagaggccug

SEQ ID NO: 3516560 - RNA, 19 nt, Human
cagacgcucauucagcauc

SEQ ID NO: 3516561 - RNA, 18 nt, Human
cagacgcugcugucacaa

SEQ ID NO: 3516562 - RNA, 17 nt, Human
cagacggcacccaccca

SEQ ID NO: 3516563 - RNA, 13 nt, Human
cagacggggcugg

SEQ ID NO: 3516564 - RNA, 19 nt, Human
cagacggggcuggagugug

SEQ ID NO: 3516565 - RNA, 19 nt, Human
cagacgguucaccagccuc

SEQ ID NO: 3516566 - RNA, 20 nt, Human
cagacguaugcuuauuuuaa

SEQ ID NO: 3516567 - RNA, 14 nt, Human
cagacuaagccagc

SEQ ID NO: 3516568 - RNA, 18 nt, Human
cagacuaagccagcaccg

SEQ ID NO: 3516569 - RNA, 16 nt, Human
cagacuacacaggaug

SEQ ID NO: 3516570 - RNA, 12 nt, Human
cagacuacagcu

SEQ ID NO: 3516571 - RNA, 15 nt, Human
cagacuacuauuuuc

SEQ ID NO: 3516572 - RNA, 19 nt, Human
cagacuacuauuuucuuuu

SEQ ID NO: 3516573 - RNA, 23 nt, Human
cagacuagaauucuagugcugcu

SEQ ID NO: 3516574 - RNA, 22 nt, Human
cagacuagauggaccugccugc

SEQ ID NO: 3516575 - RNA, 21 nt, Human
cagacuaggauaauguccaac

SEQ ID NO: 3516576 - RNA, 18 nt, Human
cagacuauuuaacuugag

SEQ ID NO: 3516577 - RNA, 22 nt, Human
cagacucaaaugcucagaccag

SEQ ID NO: 3516578 - RNA, 15 nt, Human
cagacucagcucuga

SEQ ID NO: 3516579 - RNA, 16 nt, Human
cagacucaguuuguca

SEQ ID NO: 3516580 - RNA, 16 nt, Human
cagacucauacagaag

SEQ ID NO: 3516581 - RNA, 17 nt, Human
cagacucccauuccuga

SEQ ID NO: 3516582 - RNA, 18 nt, Human
cagacucccauuccugaa

SEQ ID NO: 3516583 - RNA, 19 nt, Human
cagacucccauuccugaag

SEQ ID NO: 3516584 - RNA, 13 nt, Human
cagauuccuuccc

SEQ ID NO: 3516585 - RNA, 19 nt, Human
cagauucguggucuuuucc

SEQ ID NO: 3516586 - RNA, 15 nt, Human
cagauucuugcaucc

SEQ ID NO: 3516587 - RNA, 14 nt, Human
cagauucuuuccug

SEQ ID NO: 3516588 - RNA, 18 nt, Human
cagauucuuuccugaggc

SEQ ID NO: 3516589 - RNA, 20 nt, Human
cagauucuuuccugaggcug

SEQ ID NO: 3516590 - RNA, 12 nt, Human
cagauugaaaag

SEQ ID NO: 3516591 - RNA, 13 nt, Human
cagauugaacuua

SEQ ID NO: 3516592 - RNA, 17 nt, Human
cagauugcaacaggcug

SEQ ID NO: 3516593 - RNA, 18 nt, Human
cagauugcaacaggcugg

SEQ ID NO: 3516594 - RNA, 12 nt, Human
cagauugcaugu

SEQ ID NO: 3516595 - RNA, 15 nt, Human
cagauugcaugugac

SEQ ID NO: 3516596 - RNA, 20 nt, Human
cagauugcaugugacucuga

SEQ ID NO: 3516597 - RNA, 12 nt, Human
cagauugcuuuu

SEQ ID NO: 3516598 - RNA, 12 nt, Human
cagauuggauuu

SEQ ID NO: 3516599 - RNA, 21 nt, Human
cagauuggauuuuauguugac

SEQ ID NO: 3516600 - RNA, 20 nt, Human
cagcaccuacaguguacagu

SEQ ID NO: 3516601 - RNA, 14 nt, Human
cagcaccuccaggc

SEQ ID NO: 3516602 - RNA, 16 nt, Human
cagcaccuccucagcc

SEQ ID NO: 3516603 - RNA, 19 nt, Human
cagcaccugccuccucguu

SEQ ID NO: 3516604 - RNA, 15 nt, Human
cagcaccuugugccu

SEQ ID NO: 3516605 - RNA, 20 nt, Human
cagcaccuugugccuggggu

SEQ ID NO: 3516606 - RNA, 14 nt, Human
cagcacgauuucug

SEQ ID NO: 3516607 - RNA, 20 nt, Human
cagcacgauuucuguuuaga

SEQ ID NO: 3516608 - RNA, 15 nt, Human
cagcacggacaauaa

SEQ ID NO: 3516609 - RNA, 17 nt, Human
cagcacguguggccugu

SEQ ID NO: 3516610 - RNA, 20 nt, Human
cagcacuaaagcaguggaca

SEQ ID NO: 3516611 - RNA, 10 nt, Human
cagcacuaac

SEQ ID NO: 3516612 - RNA, 17 nt, Human
cagcacugccugcuccc

SEQ ID NO: 3516613 - RNA, 23 nt, Human
cagcacugccugcucccauccug

SEQ ID NO: 3516614 - RNA, 18 nt, Human
cagcacugcuugaggaaa

SEQ ID NO: 3516615 - RNA, 17 nt, Human
cagcacuggcucucucc

SEQ ID NO: 3516616 - RNA, 19 nt, Human
cagcacuggcucucuccag

SEQ ID NO: 3516617 - RNA, 16 nt, Human
cagcacugucccuugc

SEQ ID NO: 3516618 - RNA, 14 nt, Human
cagcacugucucag

SEQ ID NO: 3516619 - RNA, 13 nt, Human
cagcacuuauuua

SEQ ID NO: 3516620 - RNA, 19 nt, Human
cagcacuuggagaggcuga

SEQ ID NO: 3516621 - RNA, 15 nt, Human
cagcacuuggcccuu

SEQ ID NO: 3516622 - RNA, 19 nt, Human
cagcacuuggcccuucuac

SEQ ID NO: 3516623 - RNA, 15 nt, Human
cagcacuuguccagc

SEQ ID NO: 3516624 - RNA, 14 nt, Human
cagcacuugucuca

SEQ ID NO: 3516625 - RNA, 22 nt, Human
cagcacuuuagaauaugccuug

SEQ ID NO: 3516626 - RNA, 20 nt, Human
cagcacuuugggagaccaag

SEQ ID NO: 3516627 - RNA, 18 nt, Human
cagcacuuugggaggccg

SEQ ID NO: 3516628 - RNA, 19 nt, Human
cagcacuuugggaggcuga

SEQ ID NO: 3516629 - RNA, 13 nt, Human
cagcagaaggauu

SEQ ID NO: 3516630 - RNA, 13 nt, Human
cagcagaaggggg

SEQ ID NO: 3516631 - RNA, 16 nt, Human
cagcagacagagccag

SEQ ID NO: 3516632 - RNA, 17 nt, Human
cagcagacagagccagg

SEQ ID NO: 3516633 - RNA, 19 nt, Human
cagcagacaucagaacaca

SEQ ID NO: 3516634 - RNA, 14 nt, Human
cagcagacauuguc

SEQ ID NO: 3516635 - RNA, 21 nt, Human
cagcagagacuugggacauug

SEQ ID NO: 3516636 - RNA, 11 nt, Human
cagcagagcac

SEQ ID NO: 3516637 - RNA, 16 nt, Human
cagcagaggcacuggg

SEQ ID NO: 3516638 - RNA, 22 nt, Human
cagcagaggcggucuucaacau

SEQ ID NO: 3516639 - RNA, 15 nt, Human
cagcagagugcuuua

SEQ ID NO: 3516640 - RNA, 20 nt, Human
cagcagauaacaaugcagca

SEQ ID NO: 3516641 - RNA, 12 nt, Human
cagcagaucugu

SEQ ID NO: 3516642 - RNA, 15 nt, Human
cagcagauuauucac

SEQ ID NO: 3516643 - RNA, 15 nt, Human
cagcagcaaauuuuc

SEQ ID NO: 3516644 - RNA, 14 nt, Human
cagcagcaagaaaa

SEQ ID NO: 3516645 - RNA, 17 nt, Human
cagcagcaagaaaaaaa

SEQ ID NO: 3516646 - RNA, 14 nt, Human
cagcagcagcaggu

SEQ ID NO: 3516647 - RNA, 15 nt, Human
cagcagcagcaggug

SEQ ID NO: 3516648 - RNA, 16 nt, Human
cagcagcagcccaagc

SEQ ID NO: 3516649 - RNA, 13 nt, Human
cagcagcauuuuu

SEQ ID NO: 3516650 - RNA, 21 nt, Human
cagcagcauuuuuauuucaga

SEQ ID NO: 3516651 - RNA, 14 nt, Human
cagcagccagccaa

SEQ ID NO: 3516652 - RNA, 14 nt, Human
cagcagccagcccu

SEQ ID NO: 3516653 - RNA, 16 nt, Human
cagcagccagcccugc

SEQ ID NO: 3516654 - RNA, 18 nt, Human
cagcagccagcccugccu

SEQ ID NO: 3516655 - RNA, 21 nt, Human
cagcagccagcccugccugga

SEQ ID NO: 3516656 - RNA, 22 nt, Human
cagcagccagcccugccuggag

SEQ ID NO: 3516657 - RNA, 13 nt, Human
cagcagccagcuc

SEQ ID NO: 3516658 - RNA, 17 nt, Human
cagcagccagcucucag

SEQ ID NO: 3516659 - RNA, 20 nt, Human
cagcagcccaagcuucccuc

SEQ ID NO: 3516660 - RNA, 16 nt, Human
cagcagccccacacca

SEQ ID NO: 3516661 - RNA, 18 nt, Human
cagcagccccacaccagg

SEQ ID NO: 3516662 - RNA, 11 nt, Human
cagcagcccua

SEQ ID NO: 3516663 - RNA, 16 nt, Human
cagcagcccuaaggau

SEQ ID NO: 3516664 - RNA, 23 nt, Human
cagcagcccuaaggaucucucag

SEQ ID NO: 3516665 - RNA, 11 nt, Human
cagcagcccuc

SEQ ID NO: 3516666 - RNA, 23 nt, Human
cagcagccucgccccuggcagag

SEQ ID NO: 3516667 - RNA, 20 nt, Human
cagcagccugcuucccaccu

SEQ ID NO: 3516668 - RNA, 14 nt, Human
cagcagccuggacc

SEQ ID NO: 3516669 - RNA, 15 nt, Human
cagcagccuggaccc

SEQ ID NO: 3516670 - RNA, 17 nt, Human
cagcagccuuuaaugca

SEQ ID NO: 3516671 - RNA, 21 nt, Human
cagcagcgaccaccccugccu

SEQ ID NO: 3516672 - RNA, 17 nt, Human
cagcagcgccuuuccca

SEQ ID NO: 3516673 - RNA, 17 nt, Human
cagcagcggaaccgccc

SEQ ID NO: 3516674 - RNA, 13 nt, Human
cagcagcucaggc

SEQ ID NO: 3516675 - RNA, 20 nt, Human
cagcagcugaacagccaaau

SEQ ID NO: 3516676 - RNA, 17 nt, Human
cagcagcuucaccagag

SEQ ID NO: 3516677 - RNA, 15 nt, Human
cagcagcuugcugca

SEQ ID NO: 3516678 - RNA, 11 nt, Human
cagcaggaggg

SEQ ID NO: 3516679 - RNA, 18 nt, Human
cagcaggaggggggaggg

SEQ ID NO: 3516680 - RNA, 21 nt, Human
cagcaggaguggugcagacag

SEQ ID NO: 3516681 - RNA, 22 nt, Human
cagcaggaguggugcagacaga

SEQ ID NO: 3516682 - RNA, 12 nt, Human
cagcaggcagcc

SEQ ID NO: 3516683 - RNA, 15 nt, Human
cagcaggcagcgcca

SEQ ID NO: 3516684 - RNA, 13 nt, Human
cagcaggcccacc

SEQ ID NO: 3516685 - RNA, 18 nt, Human
cagcaggcccaccuaccu

SEQ ID NO: 3516686 - RNA, 12 nt, Human
cagcaggcucuc

SEQ ID NO: 3516687 - RNA, 18 nt, Human
cagcaggcucucaggcca

SEQ ID NO: 3516688 - RNA, 19 nt, Human
cagcaggcucucaggccag

SEQ ID NO: 3516689 - RNA, 13 nt, Human
cagcaggcugcca

SEQ ID NO: 3516690 - RNA, 14 nt, Human
cagcaggcuggccu

SEQ ID NO: 3516691 - RNA, 21 nt, Human
cagcagggacuguaaacacag

SEQ ID NO: 3516692 - RNA, 22 nt, Human
cagcagggacuguaaacacaga

SEQ ID NO: 3516693 - RNA, 15 nt, Human
cagcagggaugcccu

SEQ ID NO: 3516694 - RNA, 16 nt, Human
cagcagggaugcccug

SEQ ID NO: 3516695 - RNA, 22 nt, Human
cagcagggaugcccuggaggug

SEQ ID NO: 3516696 - RNA, 20 nt, Human
cagcagggguuggggaaaca

SEQ ID NO: 3516697 - RNA, 18 nt, Human
cagcagggucuuuucauc

SEQ ID NO: 3516698 - RNA, 21 nt, Human
cagcagggucuuuucaucugg

SEQ ID NO: 3516699 - RNA, 16 nt, Human
cagcagguagccugcu

SEQ ID NO: 3516700 - RNA, 21 nt, Human
cagcagguccccagcuuuggc

SEQ ID NO: 3516701 - RNA, 23 nt, Human
cagcaggugauuggaccaggcca

SEQ ID NO: 3516702 - RNA, 14 nt, Human
cagcaggugcugcu

SEQ ID NO: 3516703 - RNA, 17 nt, Human
cagcaggugcugcuacc

SEQ ID NO: 3516704 - RNA, 14 nt, Human
cagcaguagacauu

SEQ ID NO: 3516705 - RNA, 19 nt, Human
cagcaguccuuuguaaaca

SEQ ID NO: 3516706 - RNA, 21 nt, Human
cagcagucucugccuugccuu

SEQ ID NO: 3516707 - RNA, 15 nt, Human
cagcagugaaaacaa

SEQ ID NO: 3516708 - RNA, 17 nt, Human
cagcaguguuccccauc

SEQ ID NO: 3516709 - RNA, 13 nt, Human
cagcaguucagag

SEQ ID NO: 3516710 - RNA, 22 nt, Human
cagcaguucagagcugcccucu

SEQ ID NO: 3516711 - RNA, 17 nt, Human
cagcaguugaaaagacu

SEQ ID NO: 3516712 - RNA, 20 nt, Human
cagcaguugcugguaaaaug

SEQ ID NO: 3516713 - RNA, 23 nt, Human
cagcaguugcugguaaaaugaag

SEQ ID NO: 3516714 - RNA, 17 nt, Human
cagcauauucaggaagc

SEQ ID NO: 3516715 - RNA, 23 nt, Human
cagcauauucaggaagcucaggg

SEQ ID NO: 3516716 - RNA, 20 nt, Human
cagcaucacuccccaaggaa

SEQ ID NO: 3516717 - RNA, 22 nt, Human
cagcaucacuccccaaggaaga

SEQ ID NO: 3516718 - RNA, 20 nt, Human
cagcaucauuuugcauucaa

SEQ ID NO: 3516719 - RNA, 22 nt, Human
cagcaucauuuugcauucaaau

SEQ ID NO: 3516720 - RNA, 23 nt, Human
cagcaucauuuugcauucaaauu

SEQ ID NO: 3516721 - RNA, 20 nt, Human
cagcauccccuugaacucuu

SEQ ID NO: 3516722 - RNA, 18 nt, Human
cagcaucccuugaccagg

SEQ ID NO: 3516723 - RNA, 19 nt, Human
cagcaucccuugaccaggc

SEQ ID NO: 3516724 - RNA, 19 nt, Human
cagcauccuggcacccggc

SEQ ID NO: 3516725 - RNA, 21 nt, Human
cagcauccuggcacccggccc

SEQ ID NO: 3516726 - RNA, 21 nt, Human
cagcaucgcacucuggcagca

SEQ ID NO: 3516727 - RNA, 22 nt, Human
cagcaucggacaagacccccag

SEQ ID NO: 3516728 - RNA, 13 nt, Human
cagcaucucagcu

SEQ ID NO: 3516729 - RNA, 17 nt, Human
cagcaucuccaagcagc

SEQ ID NO: 3516730 - RNA, 17 nt, Human
cagcaucucuaccuucu

SEQ ID NO: 3516731 - RNA, 20 nt, Human
cagcaucucuaccuucuccc

SEQ ID NO: 3516732 - RNA, 20 nt, Human
cagcaucugggccuuggccu

SEQ ID NO: 3516733 - RNA, 12 nt, Human
cagcaugaauuu

SEQ ID NO: 3516734 - RNA, 14 nt, Human
cagcaugaauuugu

SEQ ID NO: 3516735 - RNA, 21 nt, Human
cagcaugacauaacagugcag

SEQ ID NO: 3516736 - RNA, 23 nt, Human
cagcaugaccugugaccagcacu

SEQ ID NO: 3516737 - RNA, 15 nt, Human
cagcauggcacuccc

SEQ ID NO: 3516738 - RNA, 22 nt, Human
cagcauggcauccaagacucuu

SEQ ID NO: 3516739 - RNA, 17 nt, Human
cagcauggucccugccu

SEQ ID NO: 3516740 - RNA, 16 nt, Human
cagcauggugcaugcc

SEQ ID NO: 3516741 - RNA, 22 nt, Human
cagcauguacggauuuucaguu

SEQ ID NO: 3516742 - RNA, 13 nt, Human
cagcaugugccuu

SEQ ID NO: 3516743 - RNA, 18 nt, Human
cagcauuaccucuuugga

SEQ ID NO: 3516744 - RNA, 21 nt, Human
cagcauuccagccccucuggu

SEQ ID NO: 3516745 - RNA, 15 nt, Human
auugcuuuuaaaacu

SEQ ID NO: 3516746 - RNA, 20 nt, Human
auugcuuuugugcauuggau

SEQ ID NO: 3516747 - RNA, 15 nt, Human
auugcuuuuucuaau

SEQ ID NO: 3516748 - RNA, 18 nt, Human
auugcuuuuuuguauugg

SEQ ID NO: 3516749 - RNA, 12 nt, Human
auuggaaaaauc

SEQ ID NO: 3516750 - RNA, 12 nt, Human
auuggaaaugga

SEQ ID NO: 3516751 - RNA, 23 nt, Human
auuggaaauggaugcaaaguaca

SEQ ID NO: 3516752 - RNA, 16 nt, Human
auuggaaauuuagcau

SEQ ID NO: 3516753 - RNA, 15 nt, Human
auuggaacuggaggc

SEQ ID NO: 3516754 - RNA, 22 nt, Human
auuggaagagcagcaccuccuc

SEQ ID NO: 3516755 - RNA, 22 nt, Human
auuggaaggagacacagauguu

SEQ ID NO: 3516756 - RNA, 18 nt, Human
auuggaaugggcagcuca

SEQ ID NO: 3516757 - RNA, 19 nt, Human
auuggaauuaaccuggugc

SEQ ID NO: 3516758 - RNA, 16 nt, Human
auuggacauagauauu

SEQ ID NO: 3516759 - RNA, 22 nt, Human
auuggacauuaagcaucacaaa

SEQ ID NO: 3516760 - RNA, 17 nt, Human
auuggacauuuucuuca

SEQ ID NO: 3516761 - RNA, 13 nt, Human
auuggaccaggcc

SEQ ID NO: 3516762 - RNA, 22 nt, Human
auuggagaaguaauccuaggga

SEQ ID NO: 3516763 - RNA, 16 nt, Human
auuggagcucguggaa

SEQ ID NO: 3516764 - RNA, 17 nt, Human
auuggagcucgugggac

SEQ ID NO: 3516765 - RNA, 22 nt, Human
auuggaggaccaaaaaaauaag

SEQ ID NO: 3516766 - RNA, 15 nt, Human
auuggauacagcagu

SEQ ID NO: 3516767 - RNA, 16 nt, Human
auuggauuauccugag

SEQ ID NO: 3516768 - RNA, 19 nt, Human
auuggauuauucauuuaaa

SEQ ID NO: 3516769 - RNA, 21 nt, Human
auuggauuauucauuuaaaau

SEQ ID NO: 3516770 - RNA, 22 nt, Human
auuggauuauucauuuaaaaug

SEQ ID NO: 3516771 - RNA, 17 nt, Human
auuggauuauuuaauaa

SEQ ID NO: 3516772 - RNA, 18 nt, Human
auuggauuauuuaauaac

SEQ ID NO: 3516773 - RNA, 19 nt, Human
auuggauuauuuaauaaca

SEQ ID NO: 3516774 - RNA, 17 nt, Human
auuggauuuuauguuga

SEQ ID NO: 3516775 - RNA, 21 nt, Human
auuggauuuuauguugacauu

SEQ ID NO: 3516776 - RNA, 18 nt, Human
auuggcagcaggugcugc

SEQ ID NO: 3516777 - RNA, 14 nt, Human
auuggcauggcuuu

SEQ ID NO: 3516778 - RNA, 23 nt, Human
auuggcauggcuuuauuuguuuu

SEQ ID NO: 3516779 - RNA, 14 nt, Human
auuggcauguguau

SEQ ID NO: 3516780 - RNA, 22 nt, Human
auuggccauucuauuguggcaa

SEQ ID NO: 3516781 - RNA, 12 nt, Human
auuggccuggag

SEQ ID NO: 3516782 - RNA, 20 nt, Human
auuggccuguagaguugcug

SEQ ID NO: 3516783 - RNA, 22 nt, Human
auuggccuguagaguugcugag

SEQ ID NO: 3516784 - RNA, 20 nt, Human
auuggcuagagguucaaaga

SEQ ID NO: 3516785 - RNA, 22 nt, Human
auuggcuagagguucaaagaua

SEQ ID NO: 3516786 - RNA, 17 nt, Human
auuggcuaguugaaucu

SEQ ID NO: 3516787 - RNA, 17 nt, Human
auuggcuauuuaaaacu

SEQ ID NO: 3516788 - RNA, 17 nt, Human
auuggcucacacugaga

SEQ ID NO: 3516789 - RNA, 21 nt, Human
auuggcucacacugagaaugu

SEQ ID NO: 3516790 - RNA, 21 nt, Human
auuggcucacccaagcaaggc

SEQ ID NO: 3516791 - RNA, 22 nt, Human
auuggcugaacucaugagaagu

SEQ ID NO: 3516792 - RNA, 14 nt, Human
auuggcugagagac

SEQ ID NO: 3516793 - RNA, 14 nt, Human
auuggcuuguagaa

SEQ ID NO: 3516794 - RNA, 15 nt, Human
auuggcuuguagaau

SEQ ID NO: 3516795 - RNA, 16 nt, Human
auuggcuuguagaauu

SEQ ID NO: 3516796 - RNA, 23 nt, Human
auuggcuuuaaacacccuucaca

SEQ ID NO: 3516797 - RNA, 16 nt, Human
auuggcuuuucaugcg

SEQ ID NO: 3516798 - RNA, 20 nt, Human
auugggaaggggacccccgc

SEQ ID NO: 3516799 - RNA, 16 nt, Human
auugggaauaaauaug

SEQ ID NO: 3516800 - RNA, 17 nt, Human
auugggaauaaauaugc

SEQ ID NO: 3516801 - RNA, 20 nt, Human
auugggaauaaauaugccuc

SEQ ID NO: 3516802 - RNA, 20 nt, Human
auugggaguccaggcacagg

SEQ ID NO: 3516803 - RNA, 17 nt, Human
auugggcacaucauuuc

SEQ ID NO: 3516804 - RNA, 21 nt, Human
auugggcacaucauuucaaga

SEQ ID NO: 3516805 - RNA, 19 nt, Human
cagauccuuguuucaaaca

SEQ ID NO: 3516806 - RNA, 13 nt, Human
cagaucucccaca

SEQ ID NO: 3516807 - RNA, 20 nt, Human
cagaucucuaacuucaccau

SEQ ID NO: 3516808 - RNA, 14 nt, Human
cagaucugccuaag

SEQ ID NO: 3516809 - RNA, 19 nt, Human
cagaucugccuaaggacuu

SEQ ID NO: 3516810 - RNA, 23 nt, Human
cagaucugccuaaggacuucuuu

SEQ ID NO: 3516811 - RNA, 15 nt, Human
cagaucuggaaccuc

SEQ ID NO: 3516812 - RNA, 20 nt, Human
cagaucuggaaccucagccu

SEQ ID NO: 3516813 - RNA, 17 nt, Human
cagaucuggucccuugc

SEQ ID NO: 3516814 - RNA, 13 nt, Human
cagaucugucuga

SEQ ID NO: 3516815 - RNA, 19 nt, Human
cagaucuuggacucaugag

SEQ ID NO: 3516816 - RNA, 22 nt, Human
cagaucuuggacucaugaggag

SEQ ID NO: 3516817 - RNA, 15 nt, Human
cagaugaaaauuuga

SEQ ID NO: 3516818 - RNA, 17 nt, Human
cagaugaaaauuugaga

SEQ ID NO: 3516819 - RNA, 13 nt, Human
cagaugaauaaac

SEQ ID NO: 3516820 - RNA, 14 nt, Human
cagaugaaugauaa

SEQ ID NO: 3516821 - RNA, 17 nt, Human
cagaugaaugccgugga

SEQ ID NO: 3516822 - RNA, 15 nt, Human
cagaugaauguauuu

SEQ ID NO: 3516823 - RNA, 19 nt, Human
cagaugaauguauuuauuu

SEQ ID NO: 3516824 - RNA, 23 nt, Human
cagaugaauguauuuauuuggga

SEQ ID NO: 3516825 - RNA, 23 nt, Human
cagaugacaagaaaggcugcugu

SEQ ID NO: 3516826 - RNA, 13 nt, Human
cagaugaccccuc

SEQ ID NO: 3516827 - RNA, 17 nt, Human
cagaugaccccugccca

SEQ ID NO: 3516828 - RNA, 18 nt, Human
cagaugaccccugcccag

SEQ ID NO: 3516829 - RNA, 19 nt, Human
cagaugaccccugcccaga

SEQ ID NO: 3516830 - RNA, 23 nt, Human
cagaugaccccugcccagaucag

SEQ ID NO: 3516831 - RNA, 19 nt, Human
cagaugagaaacucuugag

SEQ ID NO: 3516832 - RNA, 19 nt, Human
cagaugagaacaaagcugu

SEQ ID NO: 3516833 - RNA, 19 nt, Human
cagaugaggugaaaaggcc

SEQ ID NO: 3516834 - RNA, 16 nt, Human
cagaugaguaaaggag

SEQ ID NO: 3516835 - RNA, 16 nt, Human
cagaugauuucccccc

SEQ ID NO: 3516836 - RNA, 16 nt, Human
cagaugcaaagaggca

SEQ ID NO: 3516837 - RNA, 21 nt, Human
cagaugcaaugugcuacugau

SEQ ID NO: 3516838 - RNA, 17 nt, Human
cagaugcacaugagcug

SEQ ID NO: 3516839 - RNA, 22 nt, Human
cagaugcaccagcccuuagcag

SEQ ID NO: 3516840 - RNA, 16 nt, Human
cagaugcagagagcca

SEQ ID NO: 3516841 - RNA, 20 nt, Human
cagaugcagagagccauuuu

SEQ ID NO: 3516842 - RNA, 12 nt, Human
cagaugcagcuc

SEQ ID NO: 3516843 - RNA, 18 nt, Human
cagaugcagcucuuccug

SEQ ID NO: 3516844 - RNA, 19 nt, Human
cagaugcagcucuuccugg

SEQ ID NO: 3516845 - RNA, 16 nt, Human
cagaugccacccuagc

SEQ ID NO: 3516846 - RNA, 13 nt, Human
cagaugccagagc

SEQ ID NO: 3516847 - RNA, 15 nt, Human
cagaugcccagaggg

SEQ ID NO: 3516848 - RNA, 19 nt, Human
cagaugcccagagggccca

SEQ ID NO: 3516849 - RNA, 20 nt, Human
cagaugcccagagggcccag

SEQ ID NO: 3516850 - RNA, 18 nt, Human
cagaugccccagagcugu

SEQ ID NO: 3516851 - RNA, 14 nt, Human
cagaugccuccuuc

SEQ ID NO: 3516852 - RNA, 14 nt, Human
cagaugcuccaaga

SEQ ID NO: 3516853 - RNA, 16 nt, Human
cagaugcuccaagauu

SEQ ID NO: 3516854 - RNA, 21 nt, Human
cagaugcuccaagauucuaga

SEQ ID NO: 3516855 - RNA, 13 nt, Human
cagaugcucugag

SEQ ID NO: 3516856 - RNA, 15 nt, Human
cagaugcugugcaaa

SEQ ID NO: 3516857 - RNA, 22 nt, Human
cagaugcuugcggcaaaaggaa

SEQ ID NO: 3516858 - RNA, 14 nt, Human
cagaugcuuuucug

SEQ ID NO: 3516859 - RNA, 18 nt, Human
cagauggaaaaacugagg

SEQ ID NO: 3516860 - RNA, 16 nt, Human
cagauggaaaggagcc

SEQ ID NO: 3516861 - RNA, 17 nt, Human
cagauggaaauauuuug

SEQ ID NO: 3516862 - RNA, 14 nt, Human
cagauggaaccgca

SEQ ID NO: 3516863 - RNA, 19 nt, Human
cagauggaaccgcaggaag

SEQ ID NO: 3516864 - RNA, 12 nt, Human
cagauggcacuu

SEQ ID NO: 3516865 - RNA, 16 nt, Human
cagauggcagcuuuua

SEQ ID NO: 3516866 - RNA, 19 nt, Human
cagaugggggaaagcacag

SEQ ID NO: 3516867 - RNA, 18 nt, Human
cagaugggugcuuggagg

SEQ ID NO: 3516868 - RNA, 16 nt, Human
cagauggucauccaga

SEQ ID NO: 3516869 - RNA, 19 nt, Human
cagaugguuuccacauuua

SEQ ID NO: 3516870 - RNA, 22 nt, Human
cagauguaauguuuucuuugca

SEQ ID NO: 3516871 - RNA, 15 nt, Human
cagaugucuauauug

SEQ ID NO: 3516872 - RNA, 15 nt, Human
cagaugucuucugcc

SEQ ID NO: 3516873 - RNA, 18 nt, Human
cagaugucuucugccugu

SEQ ID NO: 3516874 - RNA, 14 nt, Human
cagaugugaaccau

SEQ ID NO: 3516875 - RNA, 14 nt, Human
cagaugugcagcag

SEQ ID NO: 3516876 - RNA, 16 nt, Human
cagaugugcagcagau

SEQ ID NO: 3516877 - RNA, 23 nt, Human
cagaugugggccaccauugcaac

SEQ ID NO: 3516878 - RNA, 20 nt, Human
cagaugugggcuuugauuuc

SEQ ID NO: 3516879 - RNA, 16 nt, Human
cagauguuaaaauaaa

SEQ ID NO: 3516880 - RNA, 18 nt, Human
cagauguuaaaauaaaug

SEQ ID NO: 3516881 - RNA, 20 nt, Human
cagauguuaaaauaaauggu

SEQ ID NO: 3516882 - RNA, 17 nt, Human
cagauguuagauauuuu

SEQ ID NO: 3516883 - RNA, 17 nt, Human
cagauguucccccaucu

SEQ ID NO: 3516884 - RNA, 17 nt, Human
cagauguugaauucuuu

SEQ ID NO: 3516885 - RNA, 19 nt, Human
cagauguugaauucuuuug

SEQ ID NO: 3516886 - RNA, 17 nt, Human
cagauguuuaaaacacc

SEQ ID NO: 3516887 - RNA, 19 nt, Human
cagauguuucuuuuguaug

SEQ ID NO: 3516888 - RNA, 22 nt, Human
cagauguuucuuuuguauguaa

SEQ ID NO: 3516889 - RNA, 20 nt, Human
cagcugaggucucuugaggg

SEQ ID NO: 3516890 - RNA, 18 nt, Human
cagcugaguuaugaugua

SEQ ID NO: 3516891 - RNA, 16 nt, Human
cagcugauacuucauu

SEQ ID NO: 3516892 - RNA, 21 nt, Human
cagcugauacuucauuuaaaa

SEQ ID NO: 3516893 - RNA, 15 nt, Human
cagcugaugacucaa

SEQ ID NO: 3516894 - RNA, 16 nt, Human
cagcugaugacucaag

SEQ ID NO: 3516895 - RNA, 21 nt, Human
cagcugaugacucaagauucc

SEQ ID NO: 3516896 - RNA, 23 nt, Human
cagcugaugacucaagauuccca

SEQ ID NO: 3516897 - RNA, 18 nt, Human
cagcugauguuggaagag

SEQ ID NO: 3516898 - RNA, 17 nt, Human
cagcugauuuuaacaau

SEQ ID NO: 3516899 - RNA, 12 nt, Human
cagcugcaaagu

SEQ ID NO: 3516900 - RNA, 13 nt, Human
cagcugcaaagug

SEQ ID NO: 3516901 - RNA, 16 nt, Human
cagcugcaagggaguu

SEQ ID NO: 3516902 - RNA, 18 nt, Human
cagcugcaauucccugga

SEQ ID NO: 3516903 - RNA, 12 nt, Human
cagcugcacccc

SEQ ID NO: 3516904 - RNA, 14 nt, Human
cagcugcaccccuu

SEQ ID NO: 3516905 - RNA, 23 nt, Human
cagcugcaccccuuccugggcac

SEQ ID NO: 3516906 - RNA, 16 nt, Human
cagcugcaccugccag

SEQ ID NO: 3516907 - RNA, 18 nt, Human
cagcugcaccugccagcc

SEQ ID NO: 3516908 - RNA, 22 nt, Human
cagcugcaccugccagccuggc

SEQ ID NO: 3516909 - RNA, 12 nt, Human
cagcugcacuga

SEQ ID NO: 3516910 - RNA, 17 nt, Human
cagcugcaucuacucag

SEQ ID NO: 3516911 - RNA, 13 nt, Human
cagcugccagaga

SEQ ID NO: 3516912 - RNA, 14 nt, Human
cagcugccagagaa

SEQ ID NO: 3516913 - RNA, 15 nt, Human
cagcugccaggagca

SEQ ID NO: 3516914 - RNA, 17 nt, Human
cagcugcccccagagcc

SEQ ID NO: 3516915 - RNA, 22 nt, Human
cagcugccccggccccuccccc

SEQ ID NO: 3516916 - RNA, 13 nt, Human
cagcugccccucc

SEQ ID NO: 3516917 - RNA, 19 nt, Human
cagcugcccuaugggccug

SEQ ID NO: 3516918 - RNA, 18 nt, Human
cagcugccgaccagagcc

SEQ ID NO: 3516919 - RNA, 14 nt, Human
cagcugccucacuu

SEQ ID NO: 3516920 - RNA, 15 nt, Human
cagcugccuccccuc

SEQ ID NO: 3516921 - RNA, 23 nt, Human
cagcugccuccccuccucugcuu

SEQ ID NO: 3516922 - RNA, 24 nt, Human
cagcugccuccccuccucugcuug

SEQ ID NO: 3516923 - RNA, 12 nt, Human
cagcugccuggg

SEQ ID NO: 3516924 - RNA, 14 nt, Human
cagcugccugggau

SEQ ID NO: 3516925 - RNA, 18 nt, Human
cagcugccugggaucccu

SEQ ID NO: 3516926 - RNA, 15 nt, Human
cagcugccuuagcuu

SEQ ID NO: 3516927 - RNA, 16 nt, Human
cagcugccuuagcuuc

SEQ ID NO: 3516928 - RNA, 22 nt, Human
cagcugccuuagcuucaggaac

SEQ ID NO: 3516929 - RNA, 17 nt, Human
cagcugcgcuugcuuuu

SEQ ID NO: 3516930 - RNA, 17 nt, Human
cagcugcuacuacuccu

SEQ ID NO: 3516931 - RNA, 21 nt, Human
cagcugcucaauaaaguacaa

SEQ ID NO: 3516932 - RNA, 15 nt, Human
cagcugcucagaucc

SEQ ID NO: 3516933 - RNA, 18 nt, Human
cagcugcucccuggcauu

SEQ ID NO: 3516934 - RNA, 23 nt, Human
cagcugcuccgaggacccaggaa

SEQ ID NO: 3516935 - RNA, 12 nt, Human
cagcugcuccua

SEQ ID NO: 3516936 - RNA, 18 nt, Human
cagcugcuccuagaggga

SEQ ID NO: 3516937 - RNA, 23 nt, Human
cagcugcuccuagagggaggggc

SEQ ID NO: 3516938 - RNA, 15 nt, Human
cagcugcucugccca

SEQ ID NO: 3516939 - RNA, 16 nt, Human
cagcugcucugcccag

SEQ ID NO: 3516940 - RNA, 19 nt, Human
cagcugcucugcccagagc

SEQ ID NO: 3516941 - RNA, 23 nt, Human
cagcugcucugcccagagcuggg

SEQ ID NO: 3516942 - RNA, 13 nt, Human
cagcugcugagcc

SEQ ID NO: 3516943 - RNA, 17 nt, Human
cagcugcugagccgcag

SEQ ID NO: 3516944 - RNA, 18 nt, Human
cagcugcuggagacuccu

SEQ ID NO: 3516945 - RNA, 19 nt, Human
cagcugcuggagacuccua

SEQ ID NO: 3516946 - RNA, 23 nt, Human
cagcugcuggagacuccuaggca

SEQ ID NO: 3516947 - RNA, 12 nt, Human
cagcugcugucu

SEQ ID NO: 3516948 - RNA, 14 nt, Human
cagcugcugucuuc

SEQ ID NO: 3516949 - RNA, 11 nt, Human
cagcugcuucu

SEQ ID NO: 3516950 - RNA, 12 nt, Human
cagcugcuucuc

SEQ ID NO: 3516951 - RNA, 15 nt, Human
cagcugcuucuccca

SEQ ID NO: 3516952 - RNA, 18 nt, Human
cagcugcuugggcuucau

SEQ ID NO: 3516953 - RNA, 21 nt, Human
cagcugcuugggcuucauccu

SEQ ID NO: 3516954 - RNA, 14 nt, Human
cagcugcuuguguc

SEQ ID NO: 3516955 - RNA, 15 nt, Human
cagcugcuugugucc

SEQ ID NO: 3516956 - RNA, 15 nt, Human
cagcugcuuuguuac

SEQ ID NO: 3516957 - RNA, 16 nt, Human
cagcugcuuuguuacc

SEQ ID NO: 3516958 - RNA, 14 nt, Human
cagcuggacagagg

SEQ ID NO: 3516959 - RNA, 15 nt, Human
cagcuggacagaggg

SEQ ID NO: 3516960 - RNA, 19 nt, Human
auugggcagcgcccuuccu

SEQ ID NO: 3516961 - RNA, 14 nt, Human
auuggggaggaggg

SEQ ID NO: 3516962 - RNA, 15 nt, Human
auuggggcucccagc

SEQ ID NO: 3516963 - RNA, 19 nt, Human
auugggggcuggugccagc

SEQ ID NO: 3516964 - RNA, 22 nt, Human
auugggggcuggugccagccuu

SEQ ID NO: 3516965 - RNA, 22 nt, Human
auugggggggccaaaaggaaaa

SEQ ID NO: 3516966 - RNA, 13 nt, Human
auugggguaguug

SEQ ID NO: 3516967 - RNA, 15 nt, Human
auuggggucccucua

SEQ ID NO: 3516968 - RNA, 12 nt, Human
auugggguuauu

SEQ ID NO: 3516969 - RNA, 14 nt, Human
auugggguuauuuu

SEQ ID NO: 3516970 - RNA, 22 nt, Human
auuggguaucaagacauagcau

SEQ ID NO: 3516971 - RNA, 15 nt, Human
auugggucuauucca

SEQ ID NO: 3516972 - RNA, 18 nt, Human
auugggucuauuccagcu

SEQ ID NO: 3516973 - RNA, 19 nt, Human
auugggucuauuccagcuc

SEQ ID NO: 3516974 - RNA, 20 nt, Human
auugggucuauuccagcuca

SEQ ID NO: 3516975 - RNA, 18 nt, Human
auugggugggcaggaaaa

SEQ ID NO: 3516976 - RNA, 21 nt, Human
auuggguggggggcuucauac

SEQ ID NO: 3516977 - RNA, 23 nt, Human
auuggguggggggcuucauacac

SEQ ID NO: 3516978 - RNA, 13 nt, Human
auuggguuaugaa

SEQ ID NO: 3516979 - RNA, 23 nt, Human
auuggguucaugaugcagucucc

SEQ ID NO: 3516980 - RNA, 13 nt, Human
auuggguucauua

SEQ ID NO: 3516981 - RNA, 18 nt, Human
auugguaaagaauggaag

SEQ ID NO: 3516982 - RNA, 15 nt, Human
auugguaacauccuu

SEQ ID NO: 3516983 - RNA, 23 nt, Human
auugguacugccuuaaagauaca

SEQ ID NO: 3516984 - RNA, 18 nt, Human
auuggucuaauuuauuca

SEQ ID NO: 3516985 - RNA, 17 nt, Human
auuggucuccucucagc

SEQ ID NO: 3516986 - RNA, 19 nt, Human
auugguguaagguacuuuc

SEQ ID NO: 3516987 - RNA, 13 nt, Human
auugguguugcca

SEQ ID NO: 3516988 - RNA, 19 nt, Human
auugguguuuuuuucuaug

SEQ ID NO: 3516989 - RNA, 15 nt, Human
auugguuaauuuuua

SEQ ID NO: 3516990 - RNA, 17 nt, Human
auugguuuaaagaaagu

SEQ ID NO: 3516991 - RNA, 15 nt, Human
auugguuucucuucu

SEQ ID NO: 3516992 - RNA, 20 nt, Human
auuguaaaaaaaaaugccuu

SEQ ID NO: 3516993 - RNA, 15 nt, Human
auuguaaaaauggca

SEQ ID NO: 3516994 - RNA, 20 nt, Human
auuguaaaaccugucaauga

SEQ ID NO: 3516995 - RNA, 17 nt, Human
auuguaaaacugaggca

SEQ ID NO: 3516996 - RNA, 19 nt, Human
auuguaaaagcauuuugua

SEQ ID NO: 3516997 - RNA, 21 nt, Human
auuguaaaagcauuuuguaau

SEQ ID NO: 3516998 - RNA, 17 nt, Human
auuguaaaauaauucug

SEQ ID NO: 3516999 - RNA, 19 nt, Human
auuguaaaauagcuuguau

SEQ ID NO: 3517000 - RNA, 20 nt, Human
auuguaaaauuauuucauga

SEQ ID NO: 3517001 - RNA, 14 nt, Human
auuguaaaugugcu

SEQ ID NO: 3517002 - RNA, 15 nt, Human
auuguaaaugugcuu

SEQ ID NO: 3517003 - RNA, 15 nt, Human
auuguaaauuauauu

SEQ ID NO: 3517004 - RNA, 16 nt, Human
auuguaaauugaauca

SEQ ID NO: 3517005 - RNA, 14 nt, Human
auuguaacagacau

SEQ ID NO: 3517006 - RNA, 17 nt, Human
auuguaacagacauugu

SEQ ID NO: 3517007 - RNA, 15 nt, Human
auuguaacguugcug

SEQ ID NO: 3517008 - RNA, 22 nt, Human
auuguaauauagaaaaaaacau

SEQ ID NO: 3517009 - RNA, 23 nt, Human
auuguaauguugugaauaauuac

SEQ ID NO: 3517010 - RNA, 15 nt, Human
auuguaauuauaucu

SEQ ID NO: 3517011 - RNA, 15 nt, Human
auuguacaaaauuaa

SEQ ID NO: 3517012 - RNA, 16 nt, Human
auuguacaaaguauua

SEQ ID NO: 3517013 - RNA, 19 nt, Human
auuguacacaccuuauauu

SEQ ID NO: 3517014 - RNA, 17 nt, Human
auuguacagcuguuuaa

SEQ ID NO: 3517015 - RNA, 14 nt, Human
auuguacaguuugu

SEQ ID NO: 3517016 - RNA, 17 nt, Human
auuguacaguuuguuua

SEQ ID NO: 3517017 - RNA, 19 nt, Human
auuguacaguuuguuuaca

SEQ ID NO: 3517018 - RNA, 15 nt, Human
auuguacauaaaaga

SEQ ID NO: 3517019 - RNA, 12 nt, Human
auuguaccucuc

SEQ ID NO: 3517020 - RNA, 18 nt, Human
auuguaccucucuuauag

SEQ ID NO: 3517021 - RNA, 15 nt, Human
auuguaccuuuuaac

SEQ ID NO: 3517022 - RNA, 17 nt, Human
auuguaccuuuuaacac

SEQ ID NO: 3517023 - RNA, 15 nt, Human
auuguacuaaagcca

SEQ ID NO: 3517024 - RNA, 22 nt, Human
auuguacuaaagccaaacauau

SEQ ID NO: 3517025 - RNA, 20 nt, Human
auuguagcauccuggaauau

SEQ ID NO: 3517026 - RNA, 16 nt, Human
auuguagcauuucuug

SEQ ID NO: 3517027 - RNA, 18 nt, Human
auuguagcauuucuugau

SEQ ID NO: 3517028 - RNA, 13 nt, Human
auuguaguaaucu

SEQ ID NO: 3517029 - RNA, 22 nt, Human
auuguauaaacuaucaguuugu

SEQ ID NO: 3517030 - RNA, 14 nt, Human
auuguauaacaggu

SEQ ID NO: 3517031 - RNA, 22 nt, Human
auuguauaagauuagaaugaaa

SEQ ID NO: 3517032 - RNA, 15 nt, Human
auuguauagagauau

SEQ ID NO: 3517033 - RNA, 22 nt, Human
auuguauagagauaugcagaag

SEQ ID NO: 3517034 - RNA, 17 nt, Human
cagcuuauucacaagac

SEQ ID NO: 3517035 - RNA, 16 nt, Human
cagcuucaccagagca

SEQ ID NO: 3517036 - RNA, 14 nt, Human
cagcuucacuucug

SEQ ID NO: 3517037 - RNA, 12 nt, Human
cagcuucaguug

SEQ ID NO: 3517038 - RNA, 21 nt, Human
cagcuucaugccuuuguaagu

SEQ ID NO: 3517039 - RNA, 20 nt, Human
cagcuucauuuccugugucu

SEQ ID NO: 3517040 - RNA, 13 nt, Human
cagcuuccagcag

SEQ ID NO: 3517041 - RNA, 19 nt, Human
cagcuuccuacccacaccu

SEQ ID NO: 3517042 - RNA, 13 nt, Human
cagcuuccuguca

SEQ ID NO: 3517043 - RNA, 21 nt, Human
cagcuuccuguccccaucugu

SEQ ID NO: 3517044 - RNA, 14 nt, Human
cagcuuccuucaga

SEQ ID NO: 3517045 - RNA, 19 nt, Human
cagcuuccuucagagagca

SEQ ID NO: 3517046 - RNA, 21 nt, Human
cagcuuccuucagagagcagu

SEQ ID NO: 3517047 - RNA, 22 nt, Human
cagcuucguuuauuuucaagaa

SEQ ID NO: 3517048 - RNA, 11 nt, Human
cagcuucugcc

SEQ ID NO: 3517049 - RNA, 19 nt, Human
cagcuucugccacauaaaa

SEQ ID NO: 3517050 - RNA, 15 nt, Human
cagcuucugccacuu

SEQ ID NO: 3517051 - RNA, 17 nt, Human
cagcuucugccacuucc

SEQ ID NO: 3517052 - RNA, 18 nt, Human
cagcuucugccacuuccc

SEQ ID NO: 3517053 - RNA, 16 nt, Human
cagcuucugcugggcu

SEQ ID NO: 3517054 - RNA, 20 nt, Human
cagcuucugguacucuccua

SEQ ID NO: 3517055 - RNA, 15 nt, Human
cagcuucuucaucuu

SEQ ID NO: 3517056 - RNA, 23 nt, Human
cagcuugaccugaggcugugguc

SEQ ID NO: 3517057 - RNA, 21 nt, Human
cagcuugagccgggccccugg

SEQ ID NO: 3517058 - RNA, 22 nt, Human
cagcuugagccgggccccuggg

SEQ ID NO: 3517059 - RNA, 14 nt, Human
cagcuugaggguug

SEQ ID NO: 3517060 - RNA, 20 nt, Human
cagcuugaggguugggcugg

SEQ ID NO: 3517061 - RNA, 23 nt, Human
cagcuugaucaaaggcacacagc

SEQ ID NO: 3517062 - RNA, 20 nt, Human
cagcuugccagaugcugcag

SEQ ID NO: 3517063 - RNA, 12 nt, Human
cagcuugccccg

SEQ ID NO: 3517064 - RNA, 14 nt, Human
cagcuugcgaauaa

SEQ ID NO: 3517065 - RNA, 22 nt, Human
cagcuugcguuagaaugaggag

SEQ ID NO: 3517066 - RNA, 15 nt, Human
cagcuugcucuucag

SEQ ID NO: 3517067 - RNA, 13 nt, Human
cagcuugcugcac

SEQ ID NO: 3517068 - RNA, 14 nt, Human
cagcuugcugcacc

SEQ ID NO: 3517069 - RNA, 17 nt, Human
cagcuuggcccuuuccu

SEQ ID NO: 3517070 - RNA, 18 nt, Human
cagcuugggcccagcugg

SEQ ID NO: 3517071 - RNA, 19 nt, Human
cagcuugggcccagcuggg

SEQ ID NO: 3517072 - RNA, 21 nt, Human
cagcuugggcccagcugggcu

SEQ ID NO: 3517073 - RNA, 23 nt, Human
cagcuugggcccagcugggcucu

SEQ ID NO: 3517074 - RNA, 18 nt, Human
cagcuuguaaauagcuca

SEQ ID NO: 3517075 - RNA, 16 nt, Human
cagcuuguagccagcc

SEQ ID NO: 3517076 - RNA, 23 nt, Human
cagcuuguaugcaauggauuuuc

SEQ ID NO: 3517077 - RNA, 15 nt, Human
cagcuugugcacaau

SEQ ID NO: 3517078 - RNA, 18 nt, Human
cagcuuguggagccccac

SEQ ID NO: 3517079 - RNA, 21 nt, Human
cagcuuguggagccccacacu

SEQ ID NO: 3517080 - RNA, 18 nt, Human
cagcuuguggcaagugaa

SEQ ID NO: 3517081 - RNA, 21 nt, Human
cagcuuguggcaagugaauuu

SEQ ID NO: 3517082 - RNA, 13 nt, Human
cagcuuguuuaca

SEQ ID NO: 3517083 - RNA, 14 nt, Human
cagcuuguuuacau

SEQ ID NO: 3517084 - RNA, 21 nt, Human
cagcuuguuuacaugcuuauu

SEQ ID NO: 3517085 - RNA, 16 nt, Human
cagcuuguuuuggacu

SEQ ID NO: 3517086 - RNA, 21 nt, Human
cagcuuguuuuggacuuuguu

SEQ ID NO: 3517087 - RNA, 17 nt, Human
cagcuuuaaaaaauuaa

SEQ ID NO: 3517088 - RNA, 13 nt, Human
cagcuuuaaacaa

SEQ ID NO: 3517089 - RNA, 15 nt, Human
cagcuuuaaacaaau

SEQ ID NO: 3517090 - RNA, 20 nt, Human
cagcuuuaaacucagggaca

SEQ ID NO: 3517091 - RNA, 20 nt, Human
cagcuuuaaccauuaaaacu

SEQ ID NO: 3517092 - RNA, 19 nt, Human
cagcuuuacaugcaauuua

SEQ ID NO: 3517093 - RNA, 16 nt, Human
cagcuuucaaagcauu

SEQ ID NO: 3517094 - RNA, 17 nt, Human
cagcuuucaagugccuu

SEQ ID NO: 3517095 - RNA, 19 nt, Human
cagcuuucagggccauggu

SEQ ID NO: 3517096 - RNA, 20 nt, Human
cagcuuucaugauuagcaag

SEQ ID NO: 3517097 - RNA, 17 nt, Human
cagcuuucccugccucu

SEQ ID NO: 3517098 - RNA, 22 nt, Human
cagcuuucugaccuucagcuca

SEQ ID NO: 3517099 - RNA, 13 nt, Human
cagcuuugacccg

SEQ ID NO: 3517100 - RNA, 18 nt, Human
cagcuuugagaagccuuc

SEQ ID NO: 3517101 - RNA, 19 nt, Human
cagcuuugagaagccuuca

SEQ ID NO: 3517102 - RNA, 20 nt, Human
cagcuuugagaagccuucag

SEQ ID NO: 3517103 - RNA, 14 nt, Human
cagcuuugccuucc

SEQ ID NO: 3517104 - RNA, 16 nt, Human
cagcuuugccuuccac

SEQ ID NO: 3517105 - RNA, 22 nt, Human
cagcuuugcuaccaaagcaccu

SEQ ID NO: 3517106 - RNA, 22 nt, Human
cagcuuuguuuguugucagcug

SEQ ID NO: 3517107 - RNA, 15 nt, Human
cagcuuuuaaccauc

SEQ ID NO: 3517108 - RNA, 21 nt, Human
cagcuuuuaguacccaccuga

SEQ ID NO: 3517109 - RNA, 13 nt, Human
cagcuuuucaaac

SEQ ID NO: 3517110 - RNA, 17 nt, Human
cagcuuuuccugggaca

SEQ ID NO: 3517111 - RNA, 21 nt, Human
cagcuuuucucaacugggucc

SEQ ID NO: 3517112 - RNA, 12 nt, Human
cagcuuuugcaa

SEQ ID NO: 3517113 - RNA, 17 nt, Human
cagcuuuuuaccaaguu

SEQ ID NO: 3517114 - RNA, 14 nt, Human
caggaaaaaaacuu

SEQ ID NO: 3517115 - RNA, 15 nt, Human
caggaaaaaaacuuu

SEQ ID NO: 3517116 - RNA, 19 nt, Human
caggaaaacugacagagga

SEQ ID NO: 3517117 - RNA, 17 nt, Human
caggaaaagccucugug

SEQ ID NO: 3517118 - RNA, 19 nt, Human
caggaaaagcugcugacag

SEQ ID NO: 3517119 - RNA, 14 nt, Human
caggaaaaggccug

SEQ ID NO: 3517120 - RNA, 18 nt, Human
cagcagcccuccucaccc

SEQ ID NO: 3517121 - RNA, 18 nt, Human
cagcagccucgccccugg

SEQ ID NO: 3517122 - RNA, 19 nt, Human
cagcagccucgccccuggc

SEQ ID NO: 3517123 - RNA, 19 nt, Human
cagcagccuggacccugug

SEQ ID NO: 3517124 - RNA, 21 nt, Human
cagcagccuggggcuggccuc

SEQ ID NO: 3517125 - RNA, 15 nt, Human
cagcagcucaggcac

SEQ ID NO: 3517126 - RNA, 16 nt, Human
cagcagcucaggcaca

SEQ ID NO: 3517127 - RNA, 18 nt, Human
cagcagcugaacagccaa

SEQ ID NO: 3517128 - RNA, 15 nt, Human
cagcagcuuauaaug

SEQ ID NO: 3517129 - RNA, 23 nt, Human
cagcagcuuauaaugggcucucc

SEQ ID NO: 3517130 - RNA, 12 nt, Human
cagcagcuucac

SEQ ID NO: 3517131 - RNA, 16 nt, Human
cagcagcuucaccaga

SEQ ID NO: 3517132 - RNA, 18 nt, Human
cagcagcuucaccagagc

SEQ ID NO: 3517133 - RNA, 17 nt, Human
cagcagcuuuuaauaca

SEQ ID NO: 3517134 - RNA, 14 nt, Human
cagcaggaggccag

SEQ ID NO: 3517135 - RNA, 18 nt, Human
cagcaggaggccaggccg

SEQ ID NO: 3517136 - RNA, 15 nt, Human
cagcaggagggacag

SEQ ID NO: 3517137 - RNA, 22 nt, Human
cagcaggagggacagucucacc

SEQ ID NO: 3517138 - RNA, 16 nt, Human
cagcaggaguggugca

SEQ ID NO: 3517139 - RNA, 15 nt, Human
cagcaggcagccuug

SEQ ID NO: 3517140 - RNA, 13 nt, Human
cagcaggcagcgc

SEQ ID NO: 3517141 - RNA, 16 nt, Human
cagcaggcagcgccaa

SEQ ID NO: 3517142 - RNA, 21 nt, Human
cagcaggccagguccagagag

SEQ ID NO: 3517143 - RNA, 23 nt, Human
cagcaggccagguccagagagac

SEQ ID NO: 3517144 - RNA, 14 nt, Human
cagcaggcccaccu

SEQ ID NO: 3517145 - RNA, 23 nt, Human
cagcaggcggccuuuguugcuca

SEQ ID NO: 3517146 - RNA, 15 nt, Human
cagcaggcucucagg

SEQ ID NO: 3517147 - RNA, 16 nt, Human
cagcaggcucucaggc

SEQ ID NO: 3517148 - RNA, 17 nt, Human
cagcaggcucucaggcc

SEQ ID NO: 3517149 - RNA, 14 nt, Human
cagcaggcugccag

SEQ ID NO: 3517150 - RNA, 18 nt, Human
cagcaggcugccagugcc

SEQ ID NO: 3517151 - RNA, 22 nt, Human
cagcagggaaaaugcagcaggg

SEQ ID NO: 3517152 - RNA, 23 nt, Human
cagcagggaaaaugcagcaggga

SEQ ID NO: 3517153 - RNA, 18 nt, Human
cagcagggaugcccugga

SEQ ID NO: 3517154 - RNA, 16 nt, Human
cagcagggccacuccc

SEQ ID NO: 3517155 - RNA, 17 nt, Human
cagcagggccacucccg

SEQ ID NO: 3517156 - RNA, 11 nt, Human
cagcagggcua

SEQ ID NO: 3517157 - RNA, 20 nt, Human
cagcaggguagucugguuuc

SEQ ID NO: 3517158 - RNA, 21 nt, Human
cagcaggugauuggaccaggc

SEQ ID NO: 3517159 - RNA, 11 nt, Human
cagcaggugcu

SEQ ID NO: 3517160 - RNA, 19 nt, Human
cagcaggugcugcuacccu

SEQ ID NO: 3517161 - RNA, 13 nt, Human
cagcaguagacau

SEQ ID NO: 3517162 - RNA, 15 nt, Human
cagcaguagacauuu

SEQ ID NO: 3517163 - RNA, 19 nt, Human
cagcagucgguuggagcga

SEQ ID NO: 3517164 - RNA, 13 nt, Human
cagcagucucugc

SEQ ID NO: 3517165 - RNA, 21 nt, Human
cagcagucuuaugcuuccaga

SEQ ID NO: 3517166 - RNA, 14 nt, Human
cagcagugaaaaca

SEQ ID NO: 3517167 - RNA, 17 nt, Human
cagcagugaaaacaagu

SEQ ID NO: 3517168 - RNA, 16 nt, Human
cagcagugagagcaga

SEQ ID NO: 3517169 - RNA, 21 nt, Human
cagcagugagucucuucagaa

SEQ ID NO: 3517170 - RNA, 16 nt, Human
cagcagugucaucaga

SEQ ID NO: 3517171 - RNA, 17 nt, Human
cagcagugugaggccag

SEQ ID NO: 3517172 - RNA, 19 nt, Human
cagcagugugaggccaggg

SEQ ID NO: 3517173 - RNA, 21 nt, Human
cagcaguguuccccaucuggg

SEQ ID NO: 3517174 - RNA, 22 nt, Human
cagcaguguuccccaucugggu

SEQ ID NO: 3517175 - RNA, 23 nt, Human
cagcaguuccggauuggcuugug

SEQ ID NO: 3517176 - RNA, 22 nt, Human
cagcaguugaaaagacuccaaa

SEQ ID NO: 3517177 - RNA, 21 nt, Human
cagcaguugcugguaaaauga

SEQ ID NO: 3517178 - RNA, 18 nt, Human
auuucaguaagucucaua

SEQ ID NO: 3517179 - RNA, 17 nt, Human
auuucaguacuucagca

SEQ ID NO: 3517180 - RNA, 14 nt, Human
auuucagugccaau

SEQ ID NO: 3517181 - RNA, 16 nt, Human
auuucaguguaguuaa

SEQ ID NO: 3517182 - RNA, 19 nt, Human
auuucaguguuaccugugu

SEQ ID NO: 3517183 - RNA, 22 nt, Human
auuucaguuauugucccuggcu

SEQ ID NO: 3517184 - RNA, 10 nt, Human
auuucaguuu

SEQ ID NO: 3517185 - RNA, 12 nt, Human
auuucauaaaga

SEQ ID NO: 3517186 - RNA, 23 nt, Human
auuucauaauuuguuuccagcau

SEQ ID NO: 3517187 - RNA, 20 nt, Human
auuucauaccuaucaucuua

SEQ ID NO: 3517188 - RNA, 16 nt, Human
auuucauaguucagaa

SEQ ID NO: 3517189 - RNA, 15 nt, Human
auuucaucacaagaa

SEQ ID NO: 3517190 - RNA, 19 nt, Human
auuucaucacaagaacaca

SEQ ID NO: 3517191 - RNA, 17 nt, Human
auuucaucagaacagcu

SEQ ID NO: 3517192 - RNA, 18 nt, Human
auuucaucauauuauaca

SEQ ID NO: 3517193 - RNA, 19 nt, Human
auuucauccuuucacuucu

SEQ ID NO: 3517194 - RNA, 13 nt, Human
auuucaucuauuu

SEQ ID NO: 3517195 - RNA, 18 nt, Human
auuucaucuauuucugag

SEQ ID NO: 3517196 - RNA, 15 nt, Human
auuucaucucauuua

SEQ ID NO: 3517197 - RNA, 16 nt, Human
auuucaucugcucucc

SEQ ID NO: 3517198 - RNA, 19 nt, Human
auuucaucugcucuccuuc

SEQ ID NO: 3517199 - RNA, 20 nt, Human
auuucaucugcucuccuucc

SEQ ID NO: 3517200 - RNA, 20 nt, Human
auuucaugcucugcaaaagg

SEQ ID NO: 3517201 - RNA, 16 nt, Human
auuucauguacugcau

SEQ ID NO: 3517202 - RNA, 21 nt, Human
auuucauguccauaaaagaga

SEQ ID NO: 3517203 - RNA, 22 nt, Human
auuucauguccugugucaguuu

SEQ ID NO: 3517204 - RNA, 23 nt, Human
auuucauguccugugucaguuua

SEQ ID NO: 3517205 - RNA, 14 nt, Human
auuucauguggcug

SEQ ID NO: 3517206 - RNA, 16 nt, Human
auuucauguggcugua

SEQ ID NO: 3517207 - RNA, 14 nt, Human
auuucauguugggu

SEQ ID NO: 3517208 - RNA, 14 nt, Human
auuucauuccuaac

SEQ ID NO: 3517209 - RNA, 14 nt, Human
auuucauucuucuc

SEQ ID NO: 3517210 - RNA, 18 nt, Human
auuucauugccuguguau

SEQ ID NO: 3517211 - RNA, 12 nt, Human
auuucauuucuu

SEQ ID NO: 3517212 - RNA, 22 nt, Human
auuucauuugugccagaaugcu

SEQ ID NO: 3517213 - RNA, 23 nt, Human
auuucauuuuucaauagcacaua

SEQ ID NO: 3517214 - RNA, 16 nt, Human
auuucauuuuuugcau

SEQ ID NO: 3517215 - RNA, 16 nt, Human
auuuccaaagagaaaa

SEQ ID NO: 3517216 - RNA, 13 nt, Human
auuuccaaauaaa

SEQ ID NO: 3517217 - RNA, 18 nt, Human
auuuccaaauaaaaugag

SEQ ID NO: 3517218 - RNA, 17 nt, Human
auuuccaaaugaaugac

SEQ ID NO: 3517219 - RNA, 21 nt, Human
auuuccaacaccacagacaca

SEQ ID NO: 3517220 - RNA, 23 nt, Human
auuuccaacaccacagacacaca

SEQ ID NO: 3517221 - RNA, 21 nt, Human
auuuccaagcaaguauuagaa

SEQ ID NO: 3517222 - RNA, 19 nt, Human
auuuccaaguaauauaaug

SEQ ID NO: 3517223 - RNA, 22 nt, Human
auuuccacucaggucuguuuuc

SEQ ID NO: 3517224 - RNA, 13 nt, Human
auuuccacugugc

SEQ ID NO: 3517225 - RNA, 22 nt, Human
auuuccagaaccacacuugaaa

SEQ ID NO: 3517226 - RNA, 10 nt, Human
auuuccagag

SEQ ID NO: 3517227 - RNA, 17 nt, Human
auuuccagccaaagccu

SEQ ID NO: 3517228 - RNA, 21 nt, Human
auuuccagcuuucuccccgcu

SEQ ID NO: 3517229 - RNA, 22 nt, Human
auuuccagcuuucuccccgcua

SEQ ID NO: 3517230 - RNA, 13 nt, Human
auuuccaguaccu

SEQ ID NO: 3517231 - RNA, 13 nt, Human
auuuccagucucc

SEQ ID NO: 3517232 - RNA, 22 nt, Human
auuuccaguguucuaugaacaa

SEQ ID NO: 3517233 - RNA, 18 nt, Human
auuuccauguaugcauaa

SEQ ID NO: 3517234 - RNA, 20 nt, Human
auuuccauguccccucccag

SEQ ID NO: 3517235 - RNA, 17 nt, Human
auuuccauuauuuauau

SEQ ID NO: 3517236 - RNA, 16 nt, Human
auuuccauuccagaau

SEQ ID NO: 3517237 - RNA, 16 nt, Human
auuucccaaagcagug

SEQ ID NO: 3517238 - RNA, 18 nt, Human
auuucccaauuaggaagu

SEQ ID NO: 3517239 - RNA, 21 nt, Human
auuucccaggcugaauuggga

SEQ ID NO: 3517240 - RNA, 15 nt, Human
auuucccaucugcac

SEQ ID NO: 3517241 - RNA, 21 nt, Human
auuucccauuugugccagagg

SEQ ID NO: 3517242 - RNA, 15 nt, Human
auuuccccaacagug

SEQ ID NO: 3517243 - RNA, 17 nt, Human
auuuccccaacagugug

SEQ ID NO: 3517244 - RNA, 14 nt, Human
auuuccccagggca

SEQ ID NO: 3517245 - RNA, 14 nt, Human
auuucccccuuucu

SEQ ID NO: 3517246 - RNA, 18 nt, Human
auuucccccuuucuuccu

SEQ ID NO: 3517247 - RNA, 20 nt, Human
auuucccccuuucuuccuca

SEQ ID NO: 3517248 - RNA, 16 nt, Human
auuuccccuaaucuuu

SEQ ID NO: 3517249 - RNA, 22 nt, Human
auuuccccuuuugcauucuccc

SEQ ID NO: 3517250 - RNA, 21 nt, Human
auuucccguggccccagccug

SEQ ID NO: 3517251 - RNA, 22 nt, Human
auuucccguggccccagccugg

SEQ ID NO: 3517252 - RNA, 20 nt, Human
auuucccuacauuaaacaug

SEQ ID NO: 3517253 - RNA, 23 nt, Human
auuucccuucuugcauccuuccu

SEQ ID NO: 3517254 - RNA, 23 nt, Human
auuuccgcacuucagaauuccau

SEQ ID NO: 3517255 - RNA, 14 nt, Human
auuuccuaaauaua

SEQ ID NO: 3517256 - RNA, 18 nt, Human
auuuccuaguucuguaga

SEQ ID NO: 3517257 - RNA, 15 nt, Human
auuuccuauaccauu

SEQ ID NO: 3517258 - RNA, 21 nt, Human
auuuccuaugauguauacugc

SEQ ID NO: 3517259 - RNA, 13 nt, Human
auuuccuccuggc

SEQ ID NO: 3517260 - RNA, 18 nt, Human
auuuccucuauugaugua

SEQ ID NO: 3517261 - RNA, 19 nt, Human
auuuccucuauugauguac

SEQ ID NO: 3517262 - RNA, 19 nt, Human
auuuccucuguaaucuauu

SEQ ID NO: 3517263 - RNA, 14 nt, Human
auuuccuggauguu

SEQ ID NO: 3517264 - RNA, 15 nt, Human
auuuccuggauguuu

SEQ ID NO: 3517265 - RNA, 16 nt, Human
auuuccugugucaauc

SEQ ID NO: 3517266 - RNA, 18 nt, Human
auuuccuuaaacugugug

SEQ ID NO: 3517267 - RNA, 14 nt, Human
auuuccuuaaagca

SEQ ID NO: 3517268 - RNA, 10 nt, Human
auuuccuuua

SEQ ID NO: 3517269 - RNA, 16 nt, Human
auuuccuuuaugugaa

SEQ ID NO: 3517270 - RNA, 21 nt, Human
auuuccuuuaugugaauuuuu

SEQ ID NO: 3517271 - RNA, 19 nt, Human
auuuccuuuuugacacuga

SEQ ID NO: 3517272 - RNA, 19 nt, Human
auuuccuuuuuuguuauua

SEQ ID NO: 3517273 - RNA, 20 nt, Human
auuucggauuuuuuccaaaa

SEQ ID NO: 3517274 - RNA, 20 nt, Human
auuucuaaaaagauuagcaa

SEQ ID NO: 3517275 - RNA, 21 nt, Human
auuucuaaaucuccaaaauaa

SEQ ID NO: 3517276 - RNA, 22 nt, Human
auuucuaacucugauguaaaug

SEQ ID NO: 3517277 - RNA, 18 nt, Human
auuucuaauguuggacac

SEQ ID NO: 3517278 - RNA, 21 nt, Human
auuucuaauuauguagcucuu

SEQ ID NO: 3517279 - RNA, 17 nt, Human
auuucuaccauuucaga

SEQ ID NO: 3517280 - RNA, 15 nt, Human
auuucuacucuccca

SEQ ID NO: 3517281 - RNA, 16 nt, Human
auuucuacugugacug

SEQ ID NO: 3517282 - RNA, 21 nt, Human
auuucuagaacaucccugcca

SEQ ID NO: 3517283 - RNA, 23 nt, Human
auuucuaggacugaauuaugaaa

SEQ ID NO: 3517284 - RNA, 11 nt, Human
auuucuaggua

SEQ ID NO: 3517285 - RNA, 19 nt, Human
auuucuagguaggaaaugu

SEQ ID NO: 3517286 - RNA, 20 nt, Human
auuucuaguccaaaauuaca

SEQ ID NO: 3517287 - RNA, 18 nt, Human
auuucuaguuauuuauuc

SEQ ID NO: 3517288 - RNA, 16 nt, Human
auuucuauauuuucau

SEQ ID NO: 3517289 - RNA, 17 nt, Human
auuucuauauuuucauu

SEQ ID NO: 3517290 - RNA, 18 nt, Human
auuucuaugaaauauuau

SEQ ID NO: 3517291 - RNA, 17 nt, Human
auuucuaugagaaaaga

SEQ ID NO: 3517292 - RNA, 14 nt, Human
auuucuauuauuaa

SEQ ID NO: 3517293 - RNA, 16 nt, Human
auuucuauuuauuuac

SEQ ID NO: 3517294 - RNA, 17 nt, Human
auuucuauuuauuuacu

SEQ ID NO: 3517295 - RNA, 20 nt, Human
auuucuauuucuccuccaug

SEQ ID NO: 3517296 - RNA, 12 nt, Human
auuucuauuuuu

SEQ ID NO: 3517297 - RNA, 22 nt, Human
auuucucaacaaagcacagugu

SEQ ID NO: 3517298 - RNA, 24 nt, Human
auuucucagaagucuuucagcaag

SEQ ID NO: 3517299 - RNA, 22 nt, Human
auuucucauugacuuuuauaaa

SEQ ID NO: 3517300 - RNA, 12 nt, Human
auuucuccagaa

SEQ ID NO: 3517301 - RNA, 16 nt, Human
auuucuccagaaccca

SEQ ID NO: 3517302 - RNA, 11 nt, Human
auuucucccag

SEQ ID NO: 3517303 - RNA, 12 nt, Human
auuucuccuccc

SEQ ID NO: 3517304 - RNA, 21 nt, Human
auuucuccuuugauaaaauaa

SEQ ID NO: 3517305 - RNA, 17 nt, Human
auuucuccuuuuguguu

SEQ ID NO: 3517306 - RNA, 17 nt, Human
auuucucuaauuaugca

SEQ ID NO: 3517307 - RNA, 17 nt, Human
auuucucuacagauguc

SEQ ID NO: 3517308 - RNA, 22 nt, Human
auuucucuaguaguuaaaaaaa

SEQ ID NO: 3517309 - RNA, 21 nt, Human
auuucugaggugcacugggag

SEQ ID NO: 3517310 - RNA, 17 nt, Human
auuucugauauagaauu

SEQ ID NO: 3517311 - RNA, 13 nt, Human
auuucugauuuua

SEQ ID NO: 3517312 - RNA, 16 nt, Human
auuucugauuuuaugu

SEQ ID NO: 3517313 - RNA, 17 nt, Human
auuucugauuuuaugua

SEQ ID NO: 3517314 - RNA, 16 nt, Human
auuucugcagguucuu

SEQ ID NO: 3517315 - RNA, 15 nt, Human
auuucugccauuuca

SEQ ID NO: 3517316 - RNA, 18 nt, Human
auuucugccauuucaugu

SEQ ID NO: 3517317 - RNA, 16 nt, Human
auuucugccuuccuug

SEQ ID NO: 3517318 - RNA, 22 nt, Human
auuucugcugaauuuucacaug

SEQ ID NO: 3517319 - RNA, 17 nt, Human
auuucugcuuucuuuga

SEQ ID NO: 3517320 - RNA, 20 nt, Human
caggcccccgccuuggccug

SEQ ID NO: 3517321 - RNA, 22 nt, Human
caggccccgcuuguccagcgcc

SEQ ID NO: 3517322 - RNA, 12 nt, Human
auuuggaaaaua

SEQ ID NO: 3517323 - RNA, 13 nt, Human
auuuggaaaauaa

SEQ ID NO: 3517324 - RNA, 18 nt, Human
auuuggaaacuaauaaaa

SEQ ID NO: 3517325 - RNA, 15 nt, Human
auuuggaaauaaagu

SEQ ID NO: 3517326 - RNA, 20 nt, Human
auuuggaaaucuuuaaaaaa

SEQ ID NO: 3517327 - RNA, 16 nt, Human
auuuggaaccuuguuu

SEQ ID NO: 3517328 - RNA, 17 nt, Human
auuuggaaccuuguuuu

SEQ ID NO: 3517329 - RNA, 14 nt, Human
auuuggaauuagaa

SEQ ID NO: 3517330 - RNA, 15 nt, Human
auuuggaauucuguu

SEQ ID NO: 3517331 - RNA, 17 nt, Human
auuuggaccauuuuccu

SEQ ID NO: 3517332 - RNA, 15 nt, Human
auuuggagagaaaua

SEQ ID NO: 3517333 - RNA, 23 nt, Human
auuuggaggcuggaguaaucaga

SEQ ID NO: 3517334 - RNA, 16 nt, Human
auuuggagggccuggg

SEQ ID NO: 3517335 - RNA, 22 nt, Human
auuuggagggccugggccuggc

SEQ ID NO: 3517336 - RNA, 12 nt, Human
caggcugggaga

SEQ ID NO: 3517337 - RNA, 20 nt, Human
caggcugggagagccuucca

SEQ ID NO: 3517338 - RNA, 22 nt, Human
caggcugggagagccuuccagg

SEQ ID NO: 3517339 - RNA, 10 nt, Human
caggcugggc

SEQ ID NO: 3517340 - RNA, 17 nt, Human
caggcugggccaugucc

SEQ ID NO: 3517341 - RNA, 22 nt, Human
caggcugggccauguccaaaga

SEQ ID NO: 3517342 - RNA, 14 nt, Human
caggcugggcuggg

SEQ ID NO: 3517343 - RNA, 17 nt, Human
caggcugggcugggcac

SEQ ID NO: 3517344 - RNA, 16 nt, Human
caggcugggcuucagu

SEQ ID NO: 3517345 - RNA, 19 nt, Human
caggcugggcuucaguggc

SEQ ID NO: 3517346 - RNA, 23 nt, Human
caggcugggucgcccuggacugu

SEQ ID NO: 3517347 - RNA, 18 nt, Human
caggcugggugacagagc

SEQ ID NO: 3517348 - RNA, 14 nt, Human
caggcuggucucaa

SEQ ID NO: 3517349 - RNA, 20 nt, Human
caggcuggucuugaaguccu

SEQ ID NO: 3517350 - RNA, 15 nt, Human
caggcuggugggagg

SEQ ID NO: 3517351 - RNA, 21 nt, Human
caggcuguaucccaugagccu

SEQ ID NO: 3517352 - RNA, 16 nt, Human
caggcugugggccuca

SEQ ID NO: 3517353 - RNA, 22 nt, Human
caggcuguguuuggcuuucagg

SEQ ID NO: 3517354 - RNA, 18 nt, Human
caggcuguucugcacuga

SEQ ID NO: 3517355 - RNA, 20 nt, Human
caggcuguucugcacugaaa

SEQ ID NO: 3517356 - RNA, 21 nt, Human
caggcuguucugcacugaaaa

SEQ ID NO: 3517357 - RNA, 22 nt, Human
caggcuguucugcacugaaaag

SEQ ID NO: 3517358 - RNA, 21 nt, Human
caggcuuagucacugagacag

SEQ ID NO: 3517359 - RNA, 21 nt, Human
caggcuuaugaauauauuuaa

SEQ ID NO: 3517360 - RNA, 15 nt, Human
caggcuucacccuga

SEQ ID NO: 3517361 - RNA, 22 nt, Human
caggcuuccugcaauuuucuaa

SEQ ID NO: 3517362 - RNA, 17 nt, Human
caggcuucugcuggggc

SEQ ID NO: 3517363 - RNA, 19 nt, Human
caggcuucugcuggggccu

SEQ ID NO: 3517364 - RNA, 18 nt, Human
caggcuugccugcaggca

SEQ ID NO: 3517365 - RNA, 23 nt, Human
caggcuuuguuuauagcuugcgc

SEQ ID NO: 3517366 - RNA, 13 nt, Human
cagggaaagacug

SEQ ID NO: 3517367 - RNA, 15 nt, Human
cagggaaaggccagu

SEQ ID NO: 3517368 - RNA, 23 nt, Human
cagggaaccguuauuauaauugu

SEQ ID NO: 3517369 - RNA, 19 nt, Human
cagggaacuaggaaggcac

SEQ ID NO: 3517370 - RNA, 15 nt, Human
cagggaagagcagaa

SEQ ID NO: 3517371 - RNA, 19 nt, Human
cagggaagaggggugcaga

SEQ ID NO: 3517372 - RNA, 17 nt, Human
cagggaagcagcagccu

SEQ ID NO: 3517373 - RNA, 13 nt, Human
cagggaagcccag

SEQ ID NO: 3517374 - RNA, 18 nt, Human
cagggaagcccagcucca

SEQ ID NO: 3517375 - RNA, 23 nt, Human
cagggaagcccagcuccagggcc

SEQ ID NO: 3517376 - RNA, 23 nt, Human
cagggaagccccacauguccagc

SEQ ID NO: 3517377 - RNA, 16 nt, Human
cagggaagccuugugg

SEQ ID NO: 3517378 - RNA, 20 nt, Human
cagggaagcuacagguuaca

SEQ ID NO: 3517379 - RNA, 14 nt, Human
cagggaaggaggag

SEQ ID NO: 3517380 - RNA, 15 nt, Human
cagggaaggaggagc

SEQ ID NO: 3517381 - RNA, 13 nt, Human
cagggaaggcagg

SEQ ID NO: 3517382 - RNA, 18 nt, Human
cagggaaggcaggcaggg

SEQ ID NO: 3517383 - RNA, 16 nt, Human
cagggaaggccugacu

SEQ ID NO: 3517384 - RNA, 15 nt, Human
cagggaaggggacaa

SEQ ID NO: 3517385 - RNA, 16 nt, Human
cagggaaguccccagg

SEQ ID NO: 3517386 - RNA, 21 nt, Human
cagggaaguguaagaaacaca

SEQ ID NO: 3517387 - RNA, 18 nt, Human
cagggaauccaagccucc

SEQ ID NO: 3517388 - RNA, 16 nt, Human
cagggaauuucuaucu

SEQ ID NO: 3517389 - RNA, 17 nt, Human
cagggacaaagaggccu

SEQ ID NO: 3517390 - RNA, 18 nt, Human
cagggacaaagaggccuu

SEQ ID NO: 3517391 - RNA, 19 nt, Human
cagggacaccagccaggcu

SEQ ID NO: 3517392 - RNA, 22 nt, Human
cagggacaccagccaggcucug

SEQ ID NO: 3517393 - RNA, 17 nt, Human
cagggacacgggcagcc

SEQ ID NO: 3517394 - RNA, 14 nt, Human
cagggacagaggcc

SEQ ID NO: 3517395 - RNA, 16 nt, Human
cagggacagaggcccc

SEQ ID NO: 3517396 - RNA, 20 nt, Human
cagggacagaggggguggcc

SEQ ID NO: 3517397 - RNA, 14 nt, Human
cagggaccaaggac

SEQ ID NO: 3517398 - RNA, 22 nt, Human
cagggaccacacccuguacugu

SEQ ID NO: 3517399 - RNA, 13 nt, Human
cagggaccacagc

SEQ ID NO: 3517400 - RNA, 15 nt, Human
cagggaccacagcaa

SEQ ID NO: 3517401 - RNA, 15 nt, Human
cagggaccccagaau

SEQ ID NO: 3517402 - RNA, 22 nt, Human
cagggacgaagaagagccacag

SEQ ID NO: 3517403 - RNA, 23 nt, Human
cagggacgaagaagagccacagu

SEQ ID NO: 3517404 - RNA, 20 nt, Human
cagggacugaaaaccucucc

SEQ ID NO: 3517405 - RNA, 19 nt, Human
cagggacuugaaguuguua

SEQ ID NO: 3517406 - RNA, 21 nt, Human
cagggagacgguuuccaggga

SEQ ID NO: 3517407 - RNA, 14 nt, Human
cagggagagcccag

SEQ ID NO: 3517408 - RNA, 16 nt, Human
cagggagaggccauga

SEQ ID NO: 3517409 - RNA, 17 nt, Human
cagggagagggggcugg

SEQ ID NO: 3517410 - RNA, 20 nt, Human
cagggagcagggaaggccug

SEQ ID NO: 3517411 - RNA, 21 nt, Human
cagggagcaugagaggaggca

SEQ ID NO: 3517412 - RNA, 19 nt, Human
cagggagcauggcugugag

SEQ ID NO: 3517413 - RNA, 20 nt, Human
cagggagcauuuuccuccau

SEQ ID NO: 3517414 - RNA, 13 nt, Human
cagggagccuccu

SEQ ID NO: 3517415 - RNA, 15 nt, Human
cagggagccuccugc

SEQ ID NO: 3517416 - RNA, 16 nt, Human
cagggagccuccugcc

SEQ ID NO: 3517417 - RNA, 13 nt, Human
cagggagcggaaa

SEQ ID NO: 3517418 - RNA, 18 nt, Human
cagggagcggaaagcagc

SEQ ID NO: 3517419 - RNA, 19 nt, Human
cagggagcggaaagcagcu

SEQ ID NO: 3517420 - RNA, 19 nt, Human
cagggagcggccggccagc

SEQ ID NO: 3517421 - RNA, 21 nt, Human
cagggagcggccggccagccc

SEQ ID NO: 3517422 - RNA, 14 nt, Human
cagggagcugcagg

SEQ ID NO: 3517423 - RNA, 15 nt, Human
cagggagcugcaggg

SEQ ID NO: 3517424 - RNA, 17 nt, Human
cagggagcugcaggggc

SEQ ID NO: 3517425 - RNA, 15 nt, Human
cagggagcugggaca

SEQ ID NO: 3517426 - RNA, 22 nt, Human
cagggaggacgcucucuggccu

SEQ ID NO: 3517427 - RNA, 13 nt, Human
cagggaggcacca

SEQ ID NO: 3517428 - RNA, 12 nt, Human
cagggaggccga

SEQ ID NO: 3517429 - RNA, 13 nt, Human
cagggagggccug

SEQ ID NO: 3517430 - RNA, 17 nt, Human
cagggagggccugggcc

SEQ ID NO: 3517431 - RNA, 16 nt, Human
cagggaggggaagagg

SEQ ID NO: 3517432 - RNA, 12 nt, Human
cagggaggggac

SEQ ID NO: 3517433 - RNA, 19 nt, Human
cagggaggggacuauuuau

SEQ ID NO: 3517434 - RNA, 12 nt, Human
cagggaggggcc

SEQ ID NO: 3517435 - RNA, 16 nt, Human
cagggaggggccggcc

SEQ ID NO: 3517436 - RNA, 21 nt, Human
cagggaggggccggcccugug

SEQ ID NO: 3517437 - RNA, 19 nt, Human
cagggaggucaggcccugg

SEQ ID NO: 3517438 - RNA, 16 nt, Human
cagggagguccgggag

SEQ ID NO: 3517439 - RNA, 23 nt, Human
cagggaggugugaggcaggagag

SEQ ID NO: 3517440 - RNA, 23 nt, Human
cagggagguuaagugacuugccc

SEQ ID NO: 3517441 - RNA, 23 nt, Human
cagggaguccccuccccggcccu

SEQ ID NO: 3517442 - RNA, 14 nt, Human
cagggagugcuggc

SEQ ID NO: 3517443 - RNA, 22 nt, Human
cagggagugcuggcucacagua

SEQ ID NO: 3517444 - RNA, 17 nt, Human
cagggaucuugcauucc

SEQ ID NO: 3517445 - RNA, 21 nt, Human
cagggaugcccuggagguggc

SEQ ID NO: 3517446 - RNA, 20 nt, Human
cagggauggccguuggccac

SEQ ID NO: 3517447 - RNA, 18 nt, Human
cagggauggggccacagc

SEQ ID NO: 3517448 - RNA, 12 nt, Human
cagggauguggg

SEQ ID NO: 3517449 - RNA, 13 nt, Human
cagggaugugggu

SEQ ID NO: 3517450 - RNA, 18 nt, Human
cagggauuaaccucugca

SEQ ID NO: 3517451 - RNA, 16 nt, Human
cagggauugauuuuaa

SEQ ID NO: 3517452 - RNA, 21 nt, Human
cagggauugauuuuaaaaugu

SEQ ID NO: 3517453 - RNA, 18 nt, Human
cagggauuguuucuguuu

SEQ ID NO: 3517454 - RNA, 13 nt, Human
cagggauuugagg

SEQ ID NO: 3517455 - RNA, 21 nt, Human
cagggcaaaauauucacuggg

SEQ ID NO: 3517456 - RNA, 13 nt, Human
cagggcaaagcca

SEQ ID NO: 3517457 - RNA, 14 nt, Human
cagggcaaagccag

SEQ ID NO: 3517458 - RNA, 17 nt, Human
cagggcaaagccagguc

SEQ ID NO: 3517459 - RNA, 22 nt, Human
cagggcaaaugacaugcacuga

SEQ ID NO: 3517460 - RNA, 18 nt, Human
cagggcaagcuccgcagg

SEQ ID NO: 3517461 - RNA, 22 nt, Human
cagggcaaggguuaaggccuga

SEQ ID NO: 3517462 - RNA, 12 nt, Human
cagggcacagga

SEQ ID NO: 3517463 - RNA, 15 nt, Human
cagggcacaggagcu

SEQ ID NO: 3517464 - RNA, 21 nt, Human
cagggcacaggagcuaccugu

SEQ ID NO: 3517465 - RNA, 15 nt, Human
cagggcacaggccau

SEQ ID NO: 3517466 - RNA, 23 nt, Human
cagucagauuuccagucuccacc

SEQ ID NO: 3517467 - RNA, 14 nt, Human
cagucagccucucu

SEQ ID NO: 3517468 - RNA, 22 nt, Human
cagucagcucuucaucugccca

SEQ ID NO: 3517469 - RNA, 18 nt, Human
cagucaggaaagagaacu

SEQ ID NO: 3517470 - RNA, 19 nt, Human
cagucaggcucucugggcu

SEQ ID NO: 3517471 - RNA, 16 nt, Human
cagucaucaucagggc

SEQ ID NO: 3517472 - RNA, 19 nt, Human
cagucaucaucagggccug

SEQ ID NO: 3517473 - RNA, 20 nt, Human
cagucaucaucagggccugg

SEQ ID NO: 3517474 - RNA, 22 nt, Human
cagucaucaucagggccugggg

SEQ ID NO: 3517475 - RNA, 23 nt, Human
cagucaucaucagggccuggggc

SEQ ID NO: 3517476 - RNA, 22 nt, Human
cagucaucguaggugauuugaa

SEQ ID NO: 3517477 - RNA, 19 nt, Human
cagucaugcauaaauaugc

SEQ ID NO: 3517478 - RNA, 20 nt, Human
cagucaugcauaaauaugca

SEQ ID NO: 3517479 - RNA, 23 nt, Human
cagucaugcauaaauaugcagug

SEQ ID NO: 3517480 - RNA, 19 nt, Human
cagucauuaaauuacuaua

SEQ ID NO: 3517481 - RNA, 22 nt, Human
cagucauuagacuccuccucca

SEQ ID NO: 3517482 - RNA, 13 nt, Human
cagucauuaugag

SEQ ID NO: 3517483 - RNA, 21 nt, Human
cagucauuggcugucuccuag

SEQ ID NO: 3517484 - RNA, 11 nt, Human
cagucauuuaa

SEQ ID NO: 3517485 - RNA, 18 nt, Human
caguccaaauguccucca

SEQ ID NO: 3517486 - RNA, 22 nt, Human
caguccaaggaaaccacagcug

SEQ ID NO: 3517487 - RNA, 18 nt, Human
caguccacccugccugcc

SEQ ID NO: 3517488 - RNA, 15 nt, Human
caguccaccugagcu

SEQ ID NO: 3517489 - RNA, 20 nt, Human
caguccaccugagcugccau

SEQ ID NO: 3517490 - RNA, 20 nt, Human
caguccaccugaggaacugu

SEQ ID NO: 3517491 - RNA, 20 nt, Human
caguccacuucugacagccu

SEQ ID NO: 3517492 - RNA, 17 nt, Human
caguccagccuggagau

SEQ ID NO: 3517493 - RNA, 19 nt, Human
cagucccaaauccuuccca

SEQ ID NO: 3517494 - RNA, 19 nt, Human
cagucccaagcggugucuc

SEQ ID NO: 3517495 - RNA, 21 nt, Human
cagucccaagcggugucucuc

SEQ ID NO: 3517496 - RNA, 16 nt, Human
cagucccaaugcacau

SEQ ID NO: 3517497 - RNA, 15 nt, Human
cagucccagagcagg

SEQ ID NO: 3517498 - RNA, 13 nt, Human
cagucccagcagc

SEQ ID NO: 3517499 - RNA, 17 nt, Human
caguccccaccccugcc

SEQ ID NO: 3517500 - RNA, 18 nt, Human
caguccccaccccugccc

SEQ ID NO: 3517501 - RNA, 19 nt, Human
caguccccaccccugcccc

SEQ ID NO: 3517502 - RNA, 20 nt, Human
caguccccagaacucugccu

SEQ ID NO: 3517503 - RNA, 16 nt, Human
cagucccccaacccca

SEQ ID NO: 3517504 - RNA, 14 nt, Human
caguccccccaccc

SEQ ID NO: 3517505 - RNA, 21 nt, Human
cagucccccuauccuuggcac

SEQ ID NO: 3517506 - RNA, 17 nt, Human
cagucccccugccccag

SEQ ID NO: 3517507 - RNA, 18 nt, Human
caguccccgugccccgcc

SEQ ID NO: 3517508 - RNA, 12 nt, Human
caguccccuccc

SEQ ID NO: 3517509 - RNA, 23 nt, Human
cagucccugagaccauuuaacau

SEQ ID NO: 3517510 - RNA, 14 nt, Human
cagucccugaggca

SEQ ID NO: 3517511 - RNA, 20 nt, Human
cagucccugaggcagguccc

SEQ ID NO: 3517512 - RNA, 23 nt, Human
cagucccugaggcagguccccag

SEQ ID NO: 3517513 - RNA, 12 nt, Human
cagucccugcca

SEQ ID NO: 3517514 - RNA, 20 nt, Human
cagucccugggggaagcccu

SEQ ID NO: 3517515 - RNA, 15 nt, Human
caguccuaagaaaga

SEQ ID NO: 3517516 - RNA, 15 nt, Human
caguccuacucaagc

SEQ ID NO: 3517517 - RNA, 13 nt, Human
caguccuagcugc

SEQ ID NO: 3517518 - RNA, 23 nt, Human
caguccuagcugcacagggcagc

SEQ ID NO: 3517519 - RNA, 21 nt, Human
caguccuaucugggcuuccug

SEQ ID NO: 3517520 - RNA, 15 nt, Human
caguccucccaucuc

SEQ ID NO: 3517521 - RNA, 14 nt, Human
caguccuccccuca

SEQ ID NO: 3517522 - RNA, 18 nt, Human
caguccuccccucacagc

SEQ ID NO: 3517523 - RNA, 20 nt, Human
caguccuccccucacagccu

SEQ ID NO: 3517524 - RNA, 21 nt, Human
caguccuccccucacagccuc

SEQ ID NO: 3517525 - RNA, 22 nt, Human
caguccuccccucacagccucu

SEQ ID NO: 3517526 - RNA, 20 nt, Human
caguccuccgguugcauacu

SEQ ID NO: 3517527 - RNA, 21 nt, Human
caguccucucccaaguccaca

SEQ ID NO: 3517528 - RNA, 13 nt, Human
caguccugcucuc

SEQ ID NO: 3517529 - RNA, 13 nt, Human
caguccuggccug

SEQ ID NO: 3517530 - RNA, 12 nt, Human
caguccugggag

SEQ ID NO: 3517531 - RNA, 21 nt, Human
caguccugggagaaccucagg

SEQ ID NO: 3517532 - RNA, 19 nt, Human
caggaaggagcugccugga

SEQ ID NO: 3517533 - RNA, 21 nt, Human
caggaaggagcugccuggacc

SEQ ID NO: 3517534 - RNA, 18 nt, Human
caggaaggaugagcauuu

SEQ ID NO: 3517535 - RNA, 13 nt, Human
caggaaggccugg

SEQ ID NO: 3517536 - RNA, 20 nt, Human
caggaagggaugcaggcucc

SEQ ID NO: 3517537 - RNA, 22 nt, Human
caggaagggccuacagcccauu

SEQ ID NO: 3517538 - RNA, 21 nt, Human
caggaaggggguccacccagc

SEQ ID NO: 3517539 - RNA, 16 nt, Human
caggaaguagaggagg

SEQ ID NO: 3517540 - RNA, 17 nt, Human
caggaaguagcacaggc

SEQ ID NO: 3517541 - RNA, 21 nt, Human
caggaaguccuuaucuagcug

SEQ ID NO: 3517542 - RNA, 16 nt, Human
caggaagucuucaggg

SEQ ID NO: 3517543 - RNA, 23 nt, Human
caggaauaaggccuuaauauguu

SEQ ID NO: 3517544 - RNA, 17 nt, Human
caggaauauaugugugc

SEQ ID NO: 3517545 - RNA, 16 nt, Human
caggaaucaagagcug

SEQ ID NO: 3517546 - RNA, 16 nt, Human
caggaaucaguuuaaa

SEQ ID NO: 3517547 - RNA, 19 nt, Human
caggaaucuguauauauuu

SEQ ID NO: 3517548 - RNA, 18 nt, Human
caggaauuugggacccug

SEQ ID NO: 3517549 - RNA, 21 nt, Human
caggaauuugggacccugcuu

SEQ ID NO: 3517550 - RNA, 23 nt, Human
caggaauuugggacccugcuuua

SEQ ID NO: 3517551 - RNA, 16 nt, Human
caggacaacgaggaag

SEQ ID NO: 3517552 - RNA, 14 nt, Human
caggacaagcaugg

SEQ ID NO: 3517553 - RNA, 18 nt, Human
caggacacaggccugugu

SEQ ID NO: 3517554 - RNA, 19 nt, Human
caggacacaggccugugua

SEQ ID NO: 3517555 - RNA, 13 nt, Human
caggacacaguca

SEQ ID NO: 3517556 - RNA, 15 nt, Human
caggacacagucaga

SEQ ID NO: 3517557 - RNA, 19 nt, Human
caggacaccacacccagcc

SEQ ID NO: 3517558 - RNA, 21 nt, Human
caggacaccacacccagccuc

SEQ ID NO: 3517559 - RNA, 15 nt, Human
caggacagcauggug

SEQ ID NO: 3517560 - RNA, 17 nt, Human
caggacaggagaugcug

SEQ ID NO: 3517561 - RNA, 21 nt, Human
caggacaggagaugcugugcc

SEQ ID NO: 3517562 - RNA, 12 nt, Human
caggacaggccc

SEQ ID NO: 3517563 - RNA, 16 nt, Human
caggacagggguuccu

SEQ ID NO: 3517564 - RNA, 16 nt, Human
caggacagugcuucag

SEQ ID NO: 3517565 - RNA, 20 nt, Human
caggacagugcuucagccug

SEQ ID NO: 3517566 - RNA, 21 nt, Human
caggacaugcgguagccagca

SEQ ID NO: 3517567 - RNA, 22 nt, Human
caggacaugcgguagccagcac

SEQ ID NO: 3517568 - RNA, 13 nt, Human
caggacaugcuga

SEQ ID NO: 3517569 - RNA, 12 nt, Human
caggacauuucu

SEQ ID NO: 3517570 - RNA, 15 nt, Human
caggaccaagccaca

SEQ ID NO: 3517571 - RNA, 12 nt, Human
caggaccacaaa

SEQ ID NO: 3517572 - RNA, 16 nt, Human
caggaccacaggcuca

SEQ ID NO: 3517573 - RNA, 17 nt, Human
caggaccacaggcucag

SEQ ID NO: 3517574 - RNA, 23 nt, Human
caggaccacaggcucaggcaggg

SEQ ID NO: 3517575 - RNA, 20 nt, Human
caggaccagccagcagcagc

SEQ ID NO: 3517576 - RNA, 13 nt, Human
caggaccagcuca

SEQ ID NO: 3517577 - RNA, 14 nt, Human
caggaccagcucag

SEQ ID NO: 3517578 - RNA, 14 nt, Human
caggaccagcuggg

SEQ ID NO: 3517579 - RNA, 13 nt, Human
caggaccaggacu

SEQ ID NO: 3517580 - RNA, 13 nt, Human
caggaccagggau

SEQ ID NO: 3517581 - RNA, 21 nt, Human
caggaccagggauuuccauga

SEQ ID NO: 3517582 - RNA, 19 nt, Human
caggaccaggguuggcacc

SEQ ID NO: 3517583 - RNA, 16 nt, Human
caggaccaucuucccg

SEQ ID NO: 3517584 - RNA, 14 nt, Human
caggacccagagga

SEQ ID NO: 3517585 - RNA, 21 nt, Human
caggacccaucacgccugugc

SEQ ID NO: 3517586 - RNA, 12 nt, Human
caggaccccagc

SEQ ID NO: 3517587 - RNA, 14 nt, Human
caggaccccagcuc

SEQ ID NO: 3517588 - RNA, 16 nt, Human
caggacccccuucccc

SEQ ID NO: 3517589 - RNA, 17 nt, Human
caggacccucgcuggcc

SEQ ID NO: 3517590 - RNA, 19 nt, Human
caggacccucgcuggcccc

SEQ ID NO: 3517591 - RNA, 22 nt, Human
caggacccucgcuggcccccac

SEQ ID NO: 3517592 - RNA, 18 nt, Human
caggacccugaaggggcc

SEQ ID NO: 3517593 - RNA, 12 nt, Human
caggacccugcc

SEQ ID NO: 3517594 - RNA, 13 nt, Human
caggacccugcca

SEQ ID NO: 3517595 - RNA, 15 nt, Human
caggacccugccagg

SEQ ID NO: 3517596 - RNA, 19 nt, Human
caggacccugccaggcaca

SEQ ID NO: 3517597 - RNA, 17 nt, Human
caggacccuggacccag

SEQ ID NO: 3517598 - RNA, 17 nt, Human
caggacccuggaccuga

SEQ ID NO: 3517599 - RNA, 15 nt, Human
caggaccgccaaaga

SEQ ID NO: 3517600 - RNA, 23 nt, Human
caggaccucaggugagaagcaga

SEQ ID NO: 3517601 - RNA, 20 nt, Human
caggaccucccuuccgaccc

SEQ ID NO: 3517602 - RNA, 23 nt, Human
caggaccucccuuccgacccucu

SEQ ID NO: 3517603 - RNA, 13 nt, Human
caggaccugacua

SEQ ID NO: 3517604 - RNA, 17 nt, Human
caggaccuggcugccau

SEQ ID NO: 3517605 - RNA, 20 nt, Human
caggaccuucgggcugugcc

SEQ ID NO: 3517606 - RNA, 13 nt, Human
caggaccuuuuga

SEQ ID NO: 3517607 - RNA, 19 nt, Human
caggacgcugaccguggag

SEQ ID NO: 3517608 - RNA, 21 nt, Human
caggacgcuucugaaugcugc

SEQ ID NO: 3517609 - RNA, 17 nt, Human
caggacgugggcugggc

SEQ ID NO: 3517610 - RNA, 16 nt, Human
caaaagggugucugag

SEQ ID NO: 3517611 - RNA, 20 nt, Human
caaaagggugucugagcccu

SEQ ID NO: 3517612 - RNA, 22 nt, Human
caaaaggugccugugaggcagg

SEQ ID NO: 3517613 - RNA, 19 nt, Human
caaaagguucacuaaagca

SEQ ID NO: 3517614 - RNA, 11 nt, Human
caaaagguuua

SEQ ID NO: 3517615 - RNA, 16 nt, Human
caaaaguaucgggggc

SEQ ID NO: 3517616 - RNA, 15 nt, Human
caaaaguauuuuccu

SEQ ID NO: 3517617 - RNA, 19 nt, Human
caaaaguauuuuccuguaa

SEQ ID NO: 3517618 - RNA, 13 nt, Human
caaaagugcuuug

SEQ ID NO: 3517619 - RNA, 14 nt, Human
caaaagugcuuugg

SEQ ID NO: 3517620 - RNA, 16 nt, Human
caaaaguggccucuuu

SEQ ID NO: 3517621 - RNA, 17 nt, Human
caaaaguggccucuuug

SEQ ID NO: 3517622 - RNA, 16 nt, Human
caaaaguuacauguuu

SEQ ID NO: 3517623 - RNA, 18 nt, Human
caaaaguuacauguuugc

SEQ ID NO: 3517624 - RNA, 19 nt, Human
caaaaguuacauguuugca

SEQ ID NO: 3517625 - RNA, 17 nt, Human
caaaaguuagcugagcg

SEQ ID NO: 3517626 - RNA, 18 nt, Human
caaaaguuauuaaaauug

SEQ ID NO: 3517627 - RNA, 22 nt, Human
caaaaguuauuaaaauuguugu

SEQ ID NO: 3517628 - RNA, 21 nt, Human
caaaaguucccugaaacacga

SEQ ID NO: 3517629 - RNA, 15 nt, Human
caaaaguucugacuu

SEQ ID NO: 3517630 - RNA, 15 nt, Human
caaaaguuuuccuga

SEQ ID NO: 3517631 - RNA, 22 nt, Human
caaaauaaaaagugacacagca

SEQ ID NO: 3517632 - RNA, 15 nt, Human
caaaauaaaacaaag

SEQ ID NO: 3517633 - RNA, 18 nt, Human
caaaauaaaacauagcaa

SEQ ID NO: 3517634 - RNA, 19 nt, Human
caaaauaaaacauagcaaa

SEQ ID NO: 3517635 - RNA, 14 nt, Human
caaaauaaaacuuu

SEQ ID NO: 3517636 - RNA, 18 nt, Human
caaaauaaaguuacauug

SEQ ID NO: 3517637 - RNA, 22 nt, Human
caaaauaaaucagugggauuug

SEQ ID NO: 3517638 - RNA, 15 nt, Human
caaaauaagaaaaga

SEQ ID NO: 3517639 - RNA, 17 nt, Human
caaaauaauaaaaauca

SEQ ID NO: 3517640 - RNA, 15 nt, Human
caaaauaaugucuug

SEQ ID NO: 3517641 - RNA, 17 nt, Human
caaaauaaugucuuguu

SEQ ID NO: 3517642 - RNA, 14 nt, Human
caaaauacaugaag

SEQ ID NO: 3517643 - RNA, 17 nt, Human
caaaauacaugaagcuu

SEQ ID NO: 3517644 - RNA, 22 nt, Human
caaaauacaugaagcuucaugc

SEQ ID NO: 3517645 - RNA, 23 nt, Human
caaaauauuaugcaaacuacugu

SEQ ID NO: 3517646 - RNA, 18 nt, Human
caaaauauuuaaaaaugu

SEQ ID NO: 3517647 - RNA, 16 nt, Human
caaaauauuuuuaaaa

SEQ ID NO: 3517648 - RNA, 19 nt, Human
caaaaucaagcaagccucu

SEQ ID NO: 3517649 - RNA, 15 nt, Human
caaaaucagguaacu

SEQ ID NO: 3517650 - RNA, 16 nt, Human
caaaaucauuuuaaug

SEQ ID NO: 3517651 - RNA, 22 nt, Human
caaaauccaaaaagaaaugaug

SEQ ID NO: 3517652 - RNA, 12 nt, Human
caaaauccccuu

SEQ ID NO: 3517653 - RNA, 21 nt, Human
caaaaucucuccacuuucagc

SEQ ID NO: 3517654 - RNA, 17 nt, Human
caaaaucuguucuaaca

SEQ ID NO: 3517655 - RNA, 11 nt, Human
caaaaugaaac

SEQ ID NO: 3517656 - RNA, 15 nt, Human
caaaaugacaaugau

SEQ ID NO: 3517657 - RNA, 19 nt, Human
caaaaugacaucuuuuuaa

SEQ ID NO: 3517658 - RNA, 20 nt, Human
caaaaugagaucucauuaaa

SEQ ID NO: 3517659 - RNA, 18 nt, Human
caaaaugaggaauguaua

SEQ ID NO: 3517660 - RNA, 19 nt, Human
caaaaugaggaauguauau

SEQ ID NO: 3517661 - RNA, 23 nt, Human
caaaaugcuuuuuauuucugcau

SEQ ID NO: 3517662 - RNA, 17 nt, Human
caaaauggaauaaaagg

SEQ ID NO: 3517663 - RNA, 18 nt, Human
caaaauggauaaaaucug

SEQ ID NO: 3517664 - RNA, 16 nt, Human
caaaauggauacauaa

SEQ ID NO: 3517665 - RNA, 15 nt, Human
caaaauggcuucagu

SEQ ID NO: 3517666 - RNA, 11 nt, Human
caaaauguaac

SEQ ID NO: 3517667 - RNA, 12 nt, Human
caaaauguaacu

SEQ ID NO: 3517668 - RNA, 13 nt, Human
caaaauguaacug

SEQ ID NO: 3517669 - RNA, 22 nt, Human
caaaaugucuguagcuccucaa

SEQ ID NO: 3517670 - RNA, 19 nt, Human
caaaaugugagugguugaa

SEQ ID NO: 3517671 - RNA, 14 nt, Human
caaaauguguauuu

SEQ ID NO: 3517672 - RNA, 20 nt, Human
caaaauguguauuucuuaua

SEQ ID NO: 3517673 - RNA, 21 nt, Human
caaaauguuaucuucucaagu

SEQ ID NO: 3517674 - RNA, 16 nt, Human
caaaauguuauuuccc

SEQ ID NO: 3517675 - RNA, 21 nt, Human
caaaauguuggucauuuuaug

SEQ ID NO: 3517676 - RNA, 22 nt, Human
caaaauuaagcaaauguuaaaa

SEQ ID NO: 3517677 - RNA, 13 nt, Human
caaaauuagccag

SEQ ID NO: 3517678 - RNA, 22 nt, Human
caaaauuauaggagacuuguag

SEQ ID NO: 3517679 - RNA, 15 nt, Human
caaaauucaaagcau

SEQ ID NO: 3517680 - RNA, 19 nt, Human
caaaauugacauugcuuua

SEQ ID NO: 3517681 - RNA, 23 nt, Human
caaaauugggaaaggaguagaaa

SEQ ID NO: 3517682 - RNA, 21 nt, Human
caaaauuuaguuuuuguucuu

SEQ ID NO: 3517683 - RNA, 20 nt, Human
caaaauuuauuuuauaagaa

SEQ ID NO: 3517684 - RNA, 21 nt, Human
caaaauuuauuuuauaagaaa

SEQ ID NO: 3517685 - RNA, 12 nt, Human
caaaauuugaaa

SEQ ID NO: 3517686 - RNA, 22 nt, Human
caaaauuugcugccaaaugcgu

SEQ ID NO: 3517687 - RNA, 23 nt, Human
caaaauuuuauagcucaguuuau

SEQ ID NO: 3517688 - RNA, 16 nt, Human
caaaauuuuauuuugu

SEQ ID NO: 3517689 - RNA, 22 nt, Human
caaaauuuucucauuuucuuuu

SEQ ID NO: 3517690 - RNA, 15 nt, Human
caaaauuuuucaacc

SEQ ID NO: 3517691 - RNA, 22 nt, Human
caaaauuuuucaaccccacccu

SEQ ID NO: 3517692 - RNA, 14 nt, Human
caaacaaaauuucu

SEQ ID NO: 3517693 - RNA, 15 nt, Human
caaacaaacaagcua

SEQ ID NO: 3517694 - RNA, 14 nt, Human
caaacaaagccaga

SEQ ID NO: 3517695 - RNA, 16 nt, Human
caaacaaagccagaag

SEQ ID NO: 3517696 - RNA, 20 nt, Human
caaacaaagccagaagcuga

SEQ ID NO: 3517697 - RNA, 22 nt, Human
caguccugggagaaccucaggc

SEQ ID NO: 3517698 - RNA, 14 nt, Human
caguccuguaguuu

SEQ ID NO: 3517699 - RNA, 16 nt, Human
caguccuguaguuuua

SEQ ID NO: 3517700 - RNA, 19 nt, Human
caguccuuaccagcagagc

SEQ ID NO: 3517701 - RNA, 20 nt, Human
caguccuuaccagcagagca

SEQ ID NO: 3517702 - RNA, 21 nt, Human
caguccuuaccagcagagcac

SEQ ID NO: 3517703 - RNA, 12 nt, Human
caguccuuccac

SEQ ID NO: 3517704 - RNA, 14 nt, Human
caguccuuuguaaa

SEQ ID NO: 3517705 - RNA, 21 nt, Human
cagucgccuuucagcaggcag

SEQ ID NO: 3517706 - RNA, 23 nt, Human
cagucgccuuucagcaggcagcc

SEQ ID NO: 3517707 - RNA, 18 nt, Human
cagucgcgcugccugugu

SEQ ID NO: 3517708 - RNA, 16 nt, Human
cagucgggggcuggcc

SEQ ID NO: 3517709 - RNA, 18 nt, Human
cagucgggggcuggccua

SEQ ID NO: 3517710 - RNA, 17 nt, Human
cagucgucgcacagucu

SEQ ID NO: 3517711 - RNA, 15 nt, Human
cagucgugccugugu

SEQ ID NO: 3517712 - RNA, 17 nt, Human
cagucgugccugugucc

SEQ ID NO: 3517713 - RNA, 23 nt, Human
cagucuacccaccucagccuccu

SEQ ID NO: 3517714 - RNA, 14 nt, Human
cagucuaguuccug

SEQ ID NO: 3517715 - RNA, 13 nt, Human
cagucuauccaca

SEQ ID NO: 3517716 - RNA, 16 nt, Human
cagucuauccacagag

SEQ ID NO: 3517717 - RNA, 17 nt, Human
cagucucaccauuuccc

SEQ ID NO: 3517718 - RNA, 21 nt, Human
cagucucaccauuuccccagg

SEQ ID NO: 3517719 - RNA, 21 nt, Human
cagucucagaaugucauuuug

SEQ ID NO: 3517720 - RNA, 18 nt, Human
cagucucaggagcauggg

SEQ ID NO: 3517721 - RNA, 23 nt, Human
cagucuccucuuuaaaacaaaac

SEQ ID NO: 3517722 - RNA, 13 nt, Human
cagucucgucucu

SEQ ID NO: 3517723 - RNA, 21 nt, Human
cagucucuauaccaauaaagu

SEQ ID NO: 3517724 - RNA, 22 nt, Human
cagucucucuucucuccagcug

SEQ ID NO: 3517725 - RNA, 15 nt, Human
cagucucugagggcu

SEQ ID NO: 3517726 - RNA, 18 nt, Human
cagucucugcuccaccuu

SEQ ID NO: 3517727 - RNA, 20 nt, Human
cagucugacuguuuccauca

SEQ ID NO: 3517728 - RNA, 14 nt, Human
cagucugcugcccu

SEQ ID NO: 3517729 - RNA, 15 nt, Human
cagucugcugcccuc

SEQ ID NO: 3517730 - RNA, 21 nt, Human
cagucugcugcccuccauccc

SEQ ID NO: 3517731 - RNA, 22 nt, Human
cagucugcugcccuccaucccg

SEQ ID NO: 3517732 - RNA, 14 nt, Human
cagucugcuuagaa

SEQ ID NO: 3517733 - RNA, 15 nt, Human
cagucugcuuagaaa

SEQ ID NO: 3517734 - RNA, 23 nt, Human
cagucugcuuauccuuccacgga

SEQ ID NO: 3517735 - RNA, 12 nt, Human
cagucugucaug

SEQ ID NO: 3517736 - RNA, 22 nt, Human
cagucugucuucuguauauaaa

SEQ ID NO: 3517737 - RNA, 23 nt, Human
cagucuuauagcaagacuguuag

SEQ ID NO: 3517738 - RNA, 16 nt, Human
cagucuuaugcuucca

SEQ ID NO: 3517739 - RNA, 18 nt, Human
cagucuuaugcuuccaga

SEQ ID NO: 3517740 - RNA, 20 nt, Human
cagucuuaugcuuccagaaa

SEQ ID NO: 3517741 - RNA, 17 nt, Human
cagucuuccauuugcaa

SEQ ID NO: 3517742 - RNA, 20 nt, Human
cagucuucccuagggcuggg

SEQ ID NO: 3517743 - RNA, 16 nt, Human
cagucuuccugacacu

SEQ ID NO: 3517744 - RNA, 17 nt, Human
cagucuuguauuaaguu

SEQ ID NO: 3517745 - RNA, 12 nt, Human
cagucuuuuucu

SEQ ID NO: 3517746 - RNA, 21 nt, Human
cagucuuuuucuguuguaacu

SEQ ID NO: 3517747 - RNA, 14 nt, Human
cagugaaaaacuau

SEQ ID NO: 3517748 - RNA, 13 nt, Human
cagugaaaacuag

SEQ ID NO: 3517749 - RNA, 20 nt, Human
cagugaaagaaaauaacaau

SEQ ID NO: 3517750 - RNA, 13 nt, Human
cagugaaagcauc

SEQ ID NO: 3517751 - RNA, 14 nt, Human
cagugaaagcauca

SEQ ID NO: 3517752 - RNA, 21 nt, Human
cagugaagagccacugccauu

SEQ ID NO: 3517753 - RNA, 20 nt, Human
cagugaagauauuuuauuuc

SEQ ID NO: 3517754 - RNA, 13 nt, Human
cauaaucuucugc

SEQ ID NO: 3517755 - RNA, 22 nt, Human
cauaaugcauucuucucuguug

SEQ ID NO: 3517756 - RNA, 18 nt, Human
cauaaugcuaauuuaaag

SEQ ID NO: 3517757 - RNA, 23 nt, Human
cauaaugggccacugaaaucugu

SEQ ID NO: 3517758 - RNA, 12 nt, Human
cauaaugugaag

SEQ ID NO: 3517759 - RNA, 19 nt, Human
cauaaugugaaguguuaau

SEQ ID NO: 3517760 - RNA, 22 nt, Human
cauaauguuucuggauuucaua

SEQ ID NO: 3517761 - RNA, 17 nt, Human
cauaauuaaagugucca

SEQ ID NO: 3517762 - RNA, 18 nt, Human
cauaauuaaaguguccau

SEQ ID NO: 3517763 - RNA, 18 nt, Human
cauaauuagauccauuaa

SEQ ID NO: 3517764 - RNA, 14 nt, Human
cauaauuaugacag

SEQ ID NO: 3517765 - RNA, 19 nt, Human
cauaauuaugacaguuaua

SEQ ID NO: 3517766 - RNA, 18 nt, Human
cauaauuauuauuuggcc

SEQ ID NO: 3517767 - RNA, 17 nt, Human
cauaauucacucugagu

SEQ ID NO: 3517768 - RNA, 18 nt, Human
cauaauucuaagacuaau

SEQ ID NO: 3517769 - RNA, 17 nt, Human
cauaauucugaaguuau

SEQ ID NO: 3517770 - RNA, 22 nt, Human
cauaauucugaaguuauauuuc

SEQ ID NO: 3517771 - RNA, 17 nt, Human
cauaauucuuguauauu

SEQ ID NO: 3517772 - RNA, 13 nt, Human
cauaauuuaaaaa

SEQ ID NO: 3517773 - RNA, 20 nt, Human
cauaauuuaguuguuucuag

SEQ ID NO: 3517774 - RNA, 14 nt, Human
cauaauuuguuucc

SEQ ID NO: 3517775 - RNA, 16 nt, Human
cauaauuuguuuccag

SEQ ID NO: 3517776 - RNA, 19 nt, Human
cauacaaaugcaucuuuga

SEQ ID NO: 3517777 - RNA, 15 nt, Human
cauacacacacacac

SEQ ID NO: 3517778 - RNA, 21 nt, Human
cauacacacacacacacagcc

SEQ ID NO: 3517779 - RNA, 14 nt, Human
cauacaccagcauu

SEQ ID NO: 3517780 - RNA, 21 nt, Human
cauacacccccaccuccugca

SEQ ID NO: 3517781 - RNA, 22 nt, Human
cauacacccccucuucugagca

SEQ ID NO: 3517782 - RNA, 23 nt, Human
cauacacccccucuucugagcac

SEQ ID NO: 3517783 - RNA, 23 nt, Human
cauacacuuauuggaacucugcu

SEQ ID NO: 3517784 - RNA, 14 nt, Human
cauacacuuuuucu

SEQ ID NO: 3517785 - RNA, 15 nt, Human
cauacagagaaguca

SEQ ID NO: 3517786 - RNA, 16 nt, Human
cauacaguuugcacuu

SEQ ID NO: 3517787 - RNA, 15 nt, Human
cauacauaaaagaaa

SEQ ID NO: 3517788 - RNA, 20 nt, Human
cauacauaaaagaaauaaac

SEQ ID NO: 3517789 - RNA, 17 nt, Human
cauacaugcaaaaagaa

SEQ ID NO: 3517790 - RNA, 16 nt, Human
cauacauuaauuaaua

SEQ ID NO: 3517791 - RNA, 17 nt, Human
cauaccaacacgagcag

SEQ ID NO: 3517792 - RNA, 14 nt, Human
cauaccaaugaaaa

SEQ ID NO: 3517793 - RNA, 22 nt, Human
cauaccagcucgcaccccccug

SEQ ID NO: 3517794 - RNA, 12 nt, Human
cauacccacccc

SEQ ID NO: 3517795 - RNA, 15 nt, Human
cauaccuacauguau

SEQ ID NO: 3517796 - RNA, 13 nt, Human
cauaccucugacc

SEQ ID NO: 3517797 - RNA, 17 nt, Human
cauaccucugaccaaca

SEQ ID NO: 3517798 - RNA, 15 nt, Human
cauaccuggcccugu

SEQ ID NO: 3517799 - RNA, 14 nt, Human
cauaccuuccuucc

SEQ ID NO: 3517800 - RNA, 19 nt, Human
cauaccuuuauugugaucu

SEQ ID NO: 3517801 - RNA, 17 nt, Human
cauaccuuuuauuuuuu

SEQ ID NO: 3517802 - RNA, 16 nt, Human
cauacgaaacacaaac

SEQ ID NO: 3517803 - RNA, 14 nt, Human
cauacguaaaaauc

SEQ ID NO: 3517804 - RNA, 15 nt, Human
cauacguaaaaaucu

SEQ ID NO: 3517805 - RNA, 13 nt, Human
cauacguacacau

SEQ ID NO: 3517806 - RNA, 13 nt, Human
cauacguccacca

SEQ ID NO: 3517807 - RNA, 21 nt, Human
cauacuaaccagcagaaaugc

SEQ ID NO: 3517808 - RNA, 18 nt, Human
cauacuacugaaacagau

SEQ ID NO: 3517809 - RNA, 14 nt, Human
cauacuauuaaaca

SEQ ID NO: 3517810 - RNA, 12 nt, Human
cauacucagccu

SEQ ID NO: 3517811 - RNA, 17 nt, Human
cauacucagccugcugc

SEQ ID NO: 3517812 - RNA, 14 nt, Human
cauacucaugcaug

SEQ ID NO: 3517813 - RNA, 15 nt, Human
cauacucccaucugu

SEQ ID NO: 3517814 - RNA, 18 nt, Human
cauacucccaucugugaa

SEQ ID NO: 3517815 - RNA, 15 nt, Human
cauacucgagucuga

SEQ ID NO: 3517816 - RNA, 17 nt, Human
cauacucgagucugagg

SEQ ID NO: 3517817 - RNA, 22 nt, Human
cauacucuagauuuuguuuugc

SEQ ID NO: 3517818 - RNA, 15 nt, Human
cauacucugucuccc

SEQ ID NO: 3517819 - RNA, 11 nt, Human
cauacugcugu

SEQ ID NO: 3517820 - RNA, 15 nt, Human
cauacuggacucuuc

SEQ ID NO: 3517821 - RNA, 12 nt, Human
cauacuggccuc

SEQ ID NO: 3517822 - RNA, 16 nt, Human
cauacuggccucgccu

SEQ ID NO: 3517823 - RNA, 17 nt, Human
cauacuggccucgccug

SEQ ID NO: 3517824 - RNA, 18 nt, Human
cauacuggccucgccugg

SEQ ID NO: 3517825 - RNA, 21 nt, Human
cauacuggccucgccuggccu

SEQ ID NO: 3517826 - RNA, 18 nt, Human
cauacuggccuggacugu

SEQ ID NO: 3517827 - RNA, 19 nt, Human
cauacugugcuggagccac

SEQ ID NO: 3517828 - RNA, 15 nt, Human
cauacuuaagcaaaa

SEQ ID NO: 3517829 - RNA, 14 nt, Human
cauacuuaccuagu

SEQ ID NO: 3517830 - RNA, 18 nt, Human
cauacuuaucucucugug

SEQ ID NO: 3517831 - RNA, 18 nt, Human
cauacuucaaaaguauuu

SEQ ID NO: 3517832 - RNA, 18 nt, Human
cauacuucaugaaauccu

SEQ ID NO: 3517833 - RNA, 21 nt, Human
cauacuugaacguuuucuaau

SEQ ID NO: 3517834 - RNA, 14 nt, Human
cauacuugaagggc

SEQ ID NO: 3517835 - RNA, 17 nt, Human
cauacuugaagggccag

SEQ ID NO: 3517836 - RNA, 18 nt, Human
cauacuugaagggccaga

SEQ ID NO: 3517837 - RNA, 15 nt, Human
cauacuuuguaaaua

SEQ ID NO: 3517838 - RNA, 17 nt, Human
cauacuuuguauuuuga

SEQ ID NO: 3517839 - RNA, 15 nt, Human
cauagaaacaugaca

SEQ ID NO: 3517840 - RNA, 19 nt, Human
cauagaacuggguaaaugc

SEQ ID NO: 3517841 - RNA, 23 nt, Human
cauagaacuggguaaaugcaaag

SEQ ID NO: 3517842 - RNA, 21 nt, Human
cauagaauagcauguuguaga

SEQ ID NO: 3517843 - RNA, 20 nt, Human
cauagaauugcaaucuauaa

SEQ ID NO: 3517844 - RNA, 15 nt, Human
cauagacagaagaaa

SEQ ID NO: 3517845 - RNA, 16 nt, Human
cauagacccucucaag

SEQ ID NO: 3517846 - RNA, 21 nt, Human
cauagagagcaagacgcugug

SEQ ID NO: 3517847 - RNA, 21 nt, Human
cauagagccggguguccccaa

SEQ ID NO: 3517848 - RNA, 22 nt, Human
cauagagccggguguccccaac

SEQ ID NO: 3517849 - RNA, 15 nt, Human
cauagaggcuucucc

SEQ ID NO: 3517850 - RNA, 23 nt, Human
cauagaggcuucuccgccagccu

SEQ ID NO: 3517851 - RNA, 21 nt, Human
cauagauaaaacaucuuugaa

SEQ ID NO: 3517852 - RNA, 23 nt, Human
cauagauaauauuguuugguaaa

SEQ ID NO: 3517853 - RNA, 24 nt, Human
cauagauaauauuguuugguaaau

SEQ ID NO: 3517854 - RNA, 14 nt, Human
cauagauauuuuca

SEQ ID NO: 3517855 - RNA, 13 nt, Human
cauagaucuucug

SEQ ID NO: 3517856 - RNA, 14 nt, Human
cauagaucuucuga

SEQ ID NO: 3517857 - RNA, 19 nt, Human
cauagauuaauggcacuga

SEQ ID NO: 3517858 - RNA, 18 nt, Human
cauagauucaccuguaaa

SEQ ID NO: 3517859 - RNA, 17 nt, Human
cauagauucccugagca

SEQ ID NO: 3517860 - RNA, 18 nt, Human
cauagauucccugagcag

SEQ ID NO: 3517861 - RNA, 21 nt, Human
cauagauuuauuuuucaguuc

SEQ ID NO: 3517862 - RNA, 16 nt, Human
cauagauuucugauuu

SEQ ID NO: 3517863 - RNA, 17 nt, Human
cauagauuucugauuuu

SEQ ID NO: 3517864 - RNA, 15 nt, Human
cauagcaacaggaaa

SEQ ID NO: 3517865 - RNA, 16 nt, Human
cauagcaacaggaaaa

SEQ ID NO: 3517866 - RNA, 20 nt, Human
cauagcaagacacaucccua

SEQ ID NO: 3517867 - RNA, 18 nt, Human
cauagcagauuuuaauuu

SEQ ID NO: 3517868 - RNA, 19 nt, Human
cauagcagcuuauucacaa

SEQ ID NO: 3517869 - RNA, 19 nt, Human
cauagcauccaaguggcau

SEQ ID NO: 3517870 - RNA, 15 nt, Human
cauagcaugacauuu

SEQ ID NO: 3517871 - RNA, 16 nt, Human
cauagcauuaacuaau

SEQ ID NO: 3517872 - RNA, 16 nt, Human
cauagccaaaauguga

SEQ ID NO: 3517873 - RNA, 15 nt, Human
cauagccaccccaga

SEQ ID NO: 3517874 - RNA, 11 nt, Human
cauagcccagu

SEQ ID NO: 3517875 - RNA, 13 nt, Human
cauagcccauccc

SEQ ID NO: 3517876 - RNA, 16 nt, Human
cauagcccaucccugc

SEQ ID NO: 3517877 - RNA, 18 nt, Human
cauagcccaucccugccu

SEQ ID NO: 3517878 - RNA, 23 nt, Human
cauagcccaucccugccugguca

SEQ ID NO: 3517879 - RNA, 12 nt, Human
cauagcccucac

SEQ ID NO: 3517880 - RNA, 15 nt, Human
cauagccuauauuua

SEQ ID NO: 3517881 - RNA, 16 nt, Human
cauagcgcugcucuua

SEQ ID NO: 3517882 - RNA, 16 nt, Human
cauagcuaucaagugu

SEQ ID NO: 3517883 - RNA, 15 nt, Human
cauagcuccugcucc

SEQ ID NO: 3517884 - RNA, 18 nt, Human
cauagcuccuucucucuu

SEQ ID NO: 3517885 - RNA, 16 nt, Human
cauagcucuguacauc

SEQ ID NO: 3517886 - RNA, 19 nt, Human
cauagcugguuccugcuag

SEQ ID NO: 3517887 - RNA, 14 nt, Human
cauagcugucuaga

SEQ ID NO: 3517888 - RNA, 18 nt, Human
cauagcugugauuuuugg

SEQ ID NO: 3517889 - RNA, 21 nt, Human
cauagcuugauaaagggccaa

SEQ ID NO: 3517890 - RNA, 23 nt, Human
cauaggaaaaguacauuuaauac

SEQ ID NO: 3517891 - RNA, 24 nt, Human
cauaggaagggaccaaggcaaggc

SEQ ID NO: 3517892 - RNA, 19 nt, Human
cauaggaaguuaaaagcac

SEQ ID NO: 3517893 - RNA, 17 nt, Human
cauaggaaguuagccuu

SEQ ID NO: 3517894 - RNA, 20 nt, Human
cauaggaaguuagccuuuau

SEQ ID NO: 3517895 - RNA, 17 nt, Human
cauaggaguuuggagga

SEQ ID NO: 3517896 - RNA, 14 nt, Human
cauaggccugggug

SEQ ID NO: 3517897 - RNA, 16 nt, Human
cauagguauuucaaaa

SEQ ID NO: 3517898 - RNA, 14 nt, Human
cauaggucacuggc

SEQ ID NO: 3517899 - RNA, 21 nt, Human
caacagguagcauagcucugu

SEQ ID NO: 3517900 - RNA, 19 nt, Human
caacagguuuuccugaaga

SEQ ID NO: 3517901 - RNA, 17 nt, Human
caacaguaaaccacuga

SEQ ID NO: 3517902 - RNA, 14 nt, Human
caacagucaaaaca

SEQ ID NO: 3517903 - RNA, 16 nt, Human
caacagugagagacuc

SEQ ID NO: 3517904 - RNA, 19 nt, Human
caacagugugaaguuagaa

SEQ ID NO: 3517905 - RNA, 14 nt, Human
caacaguuccuuca

SEQ ID NO: 3517906 - RNA, 15 nt, Human
caacaguuuaaugaa

SEQ ID NO: 3517907 - RNA, 19 nt, Human
caacauacucccaucugug

SEQ ID NO: 3517908 - RNA, 23 nt, Human
caacauagugagaccccugucuc

SEQ ID NO: 3517909 - RNA, 15 nt, Human
caacaucaacaucuu

SEQ ID NO: 3517910 - RNA, 18 nt, Human
caacaucaauguucauug

SEQ ID NO: 3517911 - RNA, 16 nt, Human
caacaucacagcccag

SEQ ID NO: 3517912 - RNA, 20 nt, Human
caacaucacagcccagcccg

SEQ ID NO: 3517913 - RNA, 14 nt, Human
caacaucagcuuga

SEQ ID NO: 3517914 - RNA, 17 nt, Human
caacauccugccagccc

SEQ ID NO: 3517915 - RNA, 14 nt, Human
caacaucugagugc

SEQ ID NO: 3517916 - RNA, 22 nt, Human
caacaucuuggucagauuugaa

SEQ ID NO: 3517917 - RNA, 23 nt, Human
cauauugcugagagaaauaugga

SEQ ID NO: 3517918 - RNA, 11 nt, Human
cauauuguaca

SEQ ID NO: 3517919 - RNA, 20 nt, Human
cauauuguacacuuuuuugg

SEQ ID NO: 3517920 - RNA, 20 nt, Human
cauauugugccaauauguau

SEQ ID NO: 3517921 - RNA, 23 nt, Human
cauauugugcuucacaguagagc

SEQ ID NO: 3517922 - RNA, 18 nt, Human
cauauuguggcacaagca

SEQ ID NO: 3517923 - RNA, 13 nt, Human
cauauuguuacug

SEQ ID NO: 3517924 - RNA, 16 nt, Human
cauauuguugaaaggu

SEQ ID NO: 3517925 - RNA, 19 nt, Human
cauauuguugcauugcuuu

SEQ ID NO: 3517926 - RNA, 14 nt, Human
cauauuuaaagaca

SEQ ID NO: 3517927 - RNA, 13 nt, Human
cauauuuaacugg

SEQ ID NO: 3517928 - RNA, 14 nt, Human
cauauuuaacuggu

SEQ ID NO: 3517929 - RNA, 13 nt, Human
cauauuuaauguu

SEQ ID NO: 3517930 - RNA, 14 nt, Human
cauauuuaauguuu

SEQ ID NO: 3517931 - RNA, 23 nt, Human
cauauuuaauguuuuaaauguac

SEQ ID NO: 3517932 - RNA, 13 nt, Human
cauauuuacuacc

SEQ ID NO: 3517933 - RNA, 14 nt, Human
cauauuuacuucuu

SEQ ID NO: 3517934 - RNA, 16 nt, Human
cauauuuacuucuuau

SEQ ID NO: 3517935 - RNA, 12 nt, Human
cauauuuauaaa

SEQ ID NO: 3517936 - RNA, 12 nt, Human
cauauuuaucca

SEQ ID NO: 3517937 - RNA, 12 nt, Human
cauauuucaauu

SEQ ID NO: 3517938 - RNA, 24 nt, Human
cauauuucuaauuggcuuuacuau

SEQ ID NO: 3517939 - RNA, 16 nt, Human
cauauuugaagggucu

SEQ ID NO: 3517940 - RNA, 15 nt, Human
cauauuugagacuag

SEQ ID NO: 3517941 - RNA, 12 nt, Human
cauauuugcacu

SEQ ID NO: 3517942 - RNA, 14 nt, Human
cauauuugcacuaa

SEQ ID NO: 3517943 - RNA, 17 nt, Human
cauauuugcauauguau

SEQ ID NO: 3517944 - RNA, 23 nt, Human
cauauuuggaauaaaaauuccag

SEQ ID NO: 3517945 - RNA, 21 nt, Human
cauauuuguacuuucuguuaa

SEQ ID NO: 3517946 - RNA, 23 nt, Human
cauauuuguacuuucuguuaaaa

SEQ ID NO: 3517947 - RNA, 20 nt, Human
cauauuuguuaaauauuuac

SEQ ID NO: 3517948 - RNA, 13 nt, Human
cauauuuuaaaau

SEQ ID NO: 3517949 - RNA, 14 nt, Human
cauauuuuaauuuc

SEQ ID NO: 3517950 - RNA, 13 nt, Human
cauauuuuagcua

SEQ ID NO: 3517951 - RNA, 16 nt, Human
cauauuuuauagaacu

SEQ ID NO: 3517952 - RNA, 23 nt, Human
cauauuuuauuacuguuuauuac

SEQ ID NO: 3517953 - RNA, 14 nt, Human
cauauuuuguaacu

SEQ ID NO: 3517954 - RNA, 13 nt, Human
cauauuuuguaua

SEQ ID NO: 3517955 - RNA, 13 nt, Human
cauauuuuuacaa

SEQ ID NO: 3517956 - RNA, 14 nt, Human
cauauuuuucacau

SEQ ID NO: 3517957 - RNA, 18 nt, Human
cauauuuuucacauaucu

SEQ ID NO: 3517958 - RNA, 22 nt, Human
cauauuuuuuuccuuacauaaa

SEQ ID NO: 3517959 - RNA, 15 nt, Human
caucaaaagacaauu

SEQ ID NO: 3517960 - RNA, 20 nt, Human
caucaaaagacaauucuuua

SEQ ID NO: 3517961 - RNA, 21 nt, Human
caucaaaauauuucagugaau

SEQ ID NO: 3517962 - RNA, 17 nt, Human
caucaaaccuuugagua

SEQ ID NO: 3517963 - RNA, 14 nt, Human
caucaaacuguaaa

SEQ ID NO: 3517964 - RNA, 15 nt, Human
caucaaauggaagac

SEQ ID NO: 3517965 - RNA, 17 nt, Human
caucaaauggaagacac

SEQ ID NO: 3517966 - RNA, 16 nt, Human
caucaacaagauuucc

SEQ ID NO: 3517967 - RNA, 17 nt, Human
caucaagaagggcugca

SEQ ID NO: 3517968 - RNA, 21 nt, Human
caucaagaagggcugcaugau

SEQ ID NO: 3517969 - RNA, 21 nt, Human
caucaagaggugggagggccc

SEQ ID NO: 3517970 - RNA, 18 nt, Human
caucaagcacagaaggag

SEQ ID NO: 3517971 - RNA, 12 nt, Human
caucaagccacu

SEQ ID NO: 3517972 - RNA, 17 nt, Human
caucaaggcacugccug

SEQ ID NO: 3517973 - RNA, 16 nt, Human
caucaaggggucacuu

SEQ ID NO: 3517974 - RNA, 19 nt, Human
caucaaucaaauaaguauu

SEQ ID NO: 3517975 - RNA, 14 nt, Human
caucaaucauugua

SEQ ID NO: 3517976 - RNA, 15 nt, Human
caucaaucauuguac

SEQ ID NO: 3517977 - RNA, 16 nt, Human
caucaaucauuguaca

SEQ ID NO: 3517978 - RNA, 20 nt, Human
caucaaucauuguacaguuu

SEQ ID NO: 3517979 - RNA, 14 nt, Human
caucaauccugauu

SEQ ID NO: 3517980 - RNA, 18 nt, Human
caucaaugaaugaaugaa

SEQ ID NO: 3517981 - RNA, 19 nt, Human
caucaauggggccagucag

SEQ ID NO: 3517982 - RNA, 15 nt, Human
caucaauguucauug

SEQ ID NO: 3517983 - RNA, 22 nt, Human
caucaauugaauggucagcguu

SEQ ID NO: 3517984 - RNA, 15 nt, Human
caucacaauacagau

SEQ ID NO: 3517985 - RNA, 20 nt, Human
caucacacacauggaaaccc

SEQ ID NO: 3517986 - RNA, 15 nt, Human
caucacaccugcccu

SEQ ID NO: 3517987 - RNA, 13 nt, Human
caucacagcagcc

SEQ ID NO: 3517988 - RNA, 14 nt, Human
caucacagcccagc

SEQ ID NO: 3517989 - RNA, 17 nt, Human
caucacagcuaacaauu

SEQ ID NO: 3517990 - RNA, 13 nt, Human
caucacagggugg

SEQ ID NO: 3517991 - RNA, 14 nt, Human
caucacaggguggg

SEQ ID NO: 3517992 - RNA, 15 nt, Human
caucaccaacgucug

SEQ ID NO: 3517993 - RNA, 20 nt, Human
caucaccaacgucugugcca

SEQ ID NO: 3517994 - RNA, 20 nt, Human
caucaccuacucacacaggc

SEQ ID NO: 3517995 - RNA, 20 nt, Human
caucaccucagauggcagcu

SEQ ID NO: 3517996 - RNA, 22 nt, Human
caucaccucagauggcagcuuu

SEQ ID NO: 3517997 - RNA, 15 nt, Human
caucaccuuagacca

SEQ ID NO: 3517998 - RNA, 20 nt, Human
caucaccuuaggcagggaag

SEQ ID NO: 3517999 - RNA, 14 nt, Human
caucacgccugugc

SEQ ID NO: 3518000 - RNA, 15 nt, Human
caucacgccugugca

SEQ ID NO: 3518001 - RNA, 17 nt, Human
caucacguguacuggcu

SEQ ID NO: 3518002 - RNA, 22 nt, Human
caucacuauccaugcaccaaac

SEQ ID NO: 3518003 - RNA, 14 nt, Human
caucacuccccucc

SEQ ID NO: 3518004 - RNA, 17 nt, Human
caucacugaguuuucca

SEQ ID NO: 3518005 - RNA, 16 nt, Human
caucacugcgccacug

SEQ ID NO: 3518006 - RNA, 20 nt, Human
caucacugcuugaugaagca

SEQ ID NO: 3518007 - RNA, 14 nt, Human
caucacuggcaugg

SEQ ID NO: 3518008 - RNA, 12 nt, Human
caucacuguggc

SEQ ID NO: 3518009 - RNA, 17 nt, Human
caucacuguggcugucu

SEQ ID NO: 3518010 - RNA, 14 nt, Human
caucacuguucaug

SEQ ID NO: 3518011 - RNA, 14 nt, Human
caucacuucccuac

SEQ ID NO: 3518012 - RNA, 15 nt, Human
caucacuuguacaaa

SEQ ID NO: 3518013 - RNA, 18 nt, Human
caucagaaaggaaaaaca

SEQ ID NO: 3518014 - RNA, 20 nt, Human
caucagaaaggaaaaacaaa

SEQ ID NO: 3518015 - RNA, 23 nt, Human
caucagaaagggagggcucugag

SEQ ID NO: 3518016 - RNA, 11 nt, Human
caucagaaaug

SEQ ID NO: 3518017 - RNA, 12 nt, Human
caucagaaaugu

SEQ ID NO: 3518018 - RNA, 18 nt, Human
caucagaagccuauugua

SEQ ID NO: 3518019 - RNA, 11 nt, Human
caucagaagga

SEQ ID NO: 3518020 - RNA, 14 nt, Human
caucagacagaugg

SEQ ID NO: 3518021 - RNA, 16 nt, Human
caucagagcaaauuug

SEQ ID NO: 3518022 - RNA, 17 nt, Human
caucagcuagcaaaaga

SEQ ID NO: 3518023 - RNA, 15 nt, Human
caucagcugcucaga

SEQ ID NO: 3518024 - RNA, 16 nt, Human
caucagcugcucagau

SEQ ID NO: 3518025 - RNA, 18 nt, Human
caucagcugcucagaucc

SEQ ID NO: 3518026 - RNA, 13 nt, Human
caucagcugcuga

SEQ ID NO: 3518027 - RNA, 18 nt, Human
caucagcugcugaaacaa

SEQ ID NO: 3518028 - RNA, 17 nt, Human
caucagcuguaagaaga

SEQ ID NO: 3518029 - RNA, 23 nt, Human
caucagcuuaggggcugcugacc

SEQ ID NO: 3518030 - RNA, 19 nt, Human
caucaggaaggaaaugaca

SEQ ID NO: 3518031 - RNA, 15 nt, Human
caucaggacucuugu

SEQ ID NO: 3518032 - RNA, 22 nt, Human
caucaggagaaaaagccuccag

SEQ ID NO: 3518033 - RNA, 17 nt, Human
caucaggaugaacccag

SEQ ID NO: 3518034 - RNA, 16 nt, Human
caucaggccaggcccu

SEQ ID NO: 3518035 - RNA, 21 nt, Human
caucaggccaggcccucugcc

SEQ ID NO: 3518036 - RNA, 15 nt, Human
caucaggcuuucuua

SEQ ID NO: 3518037 - RNA, 14 nt, Human
caucagggacagga

SEQ ID NO: 3518038 - RNA, 16 nt, Human
caucagggccuggggc

SEQ ID NO: 3518039 - RNA, 18 nt, Human
caucagggggaagaagca

SEQ ID NO: 3518040 - RNA, 21 nt, Human
caucagggggaagaagcagag

SEQ ID NO: 3518041 - RNA, 23 nt, Human
caucagguuaggcaguauaaaga

SEQ ID NO: 3518042 - RNA, 17 nt, Human
caucagguuccaucccg

SEQ ID NO: 3518043 - RNA, 20 nt, Human
caucaguauuaauacuaaaa

SEQ ID NO: 3518044 - RNA, 16 nt, Human
caucagugcucccuca

SEQ ID NO: 3518045 - RNA, 13 nt, Human
cagguccugcuca

SEQ ID NO: 3518046 - RNA, 14 nt, Human
cagguccugguggg

SEQ ID NO: 3518047 - RNA, 21 nt, Human
cagguccugguggggcagcuc

SEQ ID NO: 3518048 - RNA, 16 nt, Human
caggucgggcucagcu

SEQ ID NO: 3518049 - RNA, 20 nt, Human
caggucucagaaucuuuccu

SEQ ID NO: 3518050 - RNA, 19 nt, Human
caggucucccacgugggag

SEQ ID NO: 3518051 - RNA, 19 nt, Human
caggucuccuccaccgcca

SEQ ID NO: 3518052 - RNA, 21 nt, Human
caggucugaagcucaacucuc

SEQ ID NO: 3518053 - RNA, 17 nt, Human
caggucugggagaggca

SEQ ID NO: 3518054 - RNA, 18 nt, Human
caggucugggagaggcag

SEQ ID NO: 3518055 - RNA, 20 nt, Human
caggucugggagaggcagag

SEQ ID NO: 3518056 - RNA, 20 nt, Human
caggucuucaucgaaucuac

SEQ ID NO: 3518057 - RNA, 20 nt, Human
caggucuugaacuccuggcc

SEQ ID NO: 3518058 - RNA, 21 nt, Human
caggucuugaacuccuggccu

SEQ ID NO: 3518059 - RNA, 19 nt, Human
caggucuuuccuaaggcug

SEQ ID NO: 3518060 - RNA, 14 nt, Human
caggugaauuguuu

SEQ ID NO: 3518061 - RNA, 16 nt, Human
caggugacagugaggu

SEQ ID NO: 3518062 - RNA, 19 nt, Human
caggugacagugagguccu

SEQ ID NO: 3518063 - RNA, 21 nt, Human
caggugacagugagguccugg

SEQ ID NO: 3518064 - RNA, 12 nt, Human
caggugacaugu

SEQ ID NO: 3518065 - RNA, 17 nt, Human
caggugacaugugaaac

SEQ ID NO: 3518066 - RNA, 21 nt, Human
caggugacaugugaaaccuuu

SEQ ID NO: 3518067 - RNA, 13 nt, Human
caggugagaaacu

SEQ ID NO: 3518068 - RNA, 22 nt, Human
caggugagaaacuguuugaaaa

SEQ ID NO: 3518069 - RNA, 20 nt, Human
caggugagaagcagaggaag

SEQ ID NO: 3518070 - RNA, 23 nt, Human
caggugaguccuagagcuacagg

SEQ ID NO: 3518071 - RNA, 23 nt, Human
caggugauccacccaccucagcc

SEQ ID NO: 3518072 - RNA, 22 nt, Human
caucauuacccuucccugcacu

SEQ ID NO: 3518073 - RNA, 13 nt, Human
caucauuagaaca

SEQ ID NO: 3518074 - RNA, 12 nt, Human
caucauuauuau

SEQ ID NO: 3518075 - RNA, 20 nt, Human
caucauucacuucacugugc

SEQ ID NO: 3518076 - RNA, 14 nt, Human
caucauucccucuc

SEQ ID NO: 3518077 - RNA, 16 nt, Human
caucauucccucucau

SEQ ID NO: 3518078 - RNA, 15 nt, Human
caucauuccuuuuua

SEQ ID NO: 3518079 - RNA, 19 nt, Human
caucauuccuuuuuauuua

SEQ ID NO: 3518080 - RNA, 24 nt, Human
caucauucucugucucauccauca

SEQ ID NO: 3518081 - RNA, 21 nt, Human
caucauugaaaucuuuuugcu

SEQ ID NO: 3518082 - RNA, 13 nt, Human
caucauuguuucu

SEQ ID NO: 3518083 - RNA, 12 nt, Human
caucauuucacu

SEQ ID NO: 3518084 - RNA, 15 nt, Human
caucauuucacuugu

SEQ ID NO: 3518085 - RNA, 22 nt, Human
caucauuuuccauauccuggug

SEQ ID NO: 3518086 - RNA, 18 nt, Human
caucauuuugcauucaaa

SEQ ID NO: 3518087 - RNA, 20 nt, Human
caucauuuugcauucaaauu

SEQ ID NO: 3518088 - RNA, 18 nt, Human
caucauuuuuccuucccu

SEQ ID NO: 3518089 - RNA, 14 nt, Human
caucauuuuuuacu

SEQ ID NO: 3518090 - RNA, 15 nt, Human
cauccaaccccccac

SEQ ID NO: 3518091 - RNA, 19 nt, Human
cauccaaccccccaccugc

SEQ ID NO: 3518092 - RNA, 14 nt, Human
cauccaaccuuccc

SEQ ID NO: 3518093 - RNA, 15 nt, Human
cauccaacugagaaa

SEQ ID NO: 3518094 - RNA, 14 nt, Human
cauccaaggagaaa

SEQ ID NO: 3518095 - RNA, 14 nt, Human
cauccaauccucac

SEQ ID NO: 3518096 - RNA, 20 nt, Human
cauccaaucuauuauuucuc

SEQ ID NO: 3518097 - RNA, 14 nt, Human
cauccaaugcucaa

SEQ ID NO: 3518098 - RNA, 23 nt, Human
cauccaaugcucaagaaacaacu

SEQ ID NO: 3518099 - RNA, 18 nt, Human
cauccacaauaaccaaga

SEQ ID NO: 3518100 - RNA, 21 nt, Human
cauccacauuguuuuaaaaag

SEQ ID NO: 3518101 - RNA, 12 nt, Human
cauccaccccau

SEQ ID NO: 3518102 - RNA, 14 nt, Human
cauccaccccaucc

SEQ ID NO: 3518103 - RNA, 20 nt, Human
cauccaccguccccucccag

SEQ ID NO: 3518104 - RNA, 14 nt, Human
cauccaccuccuuc

SEQ ID NO: 3518105 - RNA, 16 nt, Human
cauccaccuccuucuc

SEQ ID NO: 3518106 - RNA, 14 nt, Human
cauccacuagugca

SEQ ID NO: 3518107 - RNA, 15 nt, Human
cauccacucuacccu

SEQ ID NO: 3518108 - RNA, 20 nt, Human
cauccagagauucauuuucu

SEQ ID NO: 3518109 - RNA, 20 nt, Human
cauccagagucccugccugg

SEQ ID NO: 3518110 - RNA, 23 nt, Human
cauccagcagauuuccagccuuc

SEQ ID NO: 3518111 - RNA, 16 nt, Human
cauccagcagucucug

SEQ ID NO: 3518112 - RNA, 15 nt, Human
cauccagcuugccag

SEQ ID NO: 3518113 - RNA, 19 nt, Human
cauccagugacaaaccauc

SEQ ID NO: 3518114 - RNA, 13 nt, Human
cauccaguucaug

SEQ ID NO: 3518115 - RNA, 12 nt, Human
cauccauaaauc

SEQ ID NO: 3518116 - RNA, 17 nt, Human
cauccauaaauccaguu

SEQ ID NO: 3518117 - RNA, 14 nt, Human
cauccaugccucag

SEQ ID NO: 3518118 - RNA, 15 nt, Human
cauccaugccucaga

SEQ ID NO: 3518119 - RNA, 11 nt, Human
cauccaugggg

SEQ ID NO: 3518120 - RNA, 12 nt, Human
cauccauuccca

SEQ ID NO: 3518121 - RNA, 14 nt, Human
cauccauucccaag

SEQ ID NO: 3518122 - RNA, 18 nt, Human
cauccauucccaagaaau

SEQ ID NO: 3518123 - RNA, 16 nt, Human
cauccauuccucaggg

SEQ ID NO: 3518124 - RNA, 16 nt, Human
cauccauucuccugag

SEQ ID NO: 3518125 - RNA, 19 nt, Human
cauccauuucaucuauuuc

SEQ ID NO: 3518126 - RNA, 20 nt, Human
caucccaaacccuucagugc

SEQ ID NO: 3518127 - RNA, 23 nt, Human
caucccaaccaggcaccucuucc

SEQ ID NO: 3518128 - RNA, 15 nt, Human
caucccacaaguggu

SEQ ID NO: 3518129 - RNA, 23 nt, Human
caucccacucacaacagcugccu

SEQ ID NO: 3518130 - RNA, 13 nt, Human
caucccacugcca

SEQ ID NO: 3518131 - RNA, 23 nt, Human
caucccagacaggucccuccccu

SEQ ID NO: 3518132 - RNA, 11 nt, Human
caucccagagg

SEQ ID NO: 3518133 - RNA, 15 nt, Human
caucccagcaccugc

SEQ ID NO: 3518134 - RNA, 12 nt, Human
caucccagcccc

SEQ ID NO: 3518135 - RNA, 16 nt, Human
caucccagccccaaug

SEQ ID NO: 3518136 - RNA, 16 nt, Human
caucccagccccaauu

SEQ ID NO: 3518137 - RNA, 22 nt, Human
caucccaggacaccacacccag

SEQ ID NO: 3518138 - RNA, 19 nt, Human
caucccaggggaccacacc

SEQ ID NO: 3518139 - RNA, 13 nt, Human
caucccaguggcc

SEQ ID NO: 3518140 - RNA, 20 nt, Human
caucccaguggccucaaccc

SEQ ID NO: 3518141 - RNA, 20 nt, Human
caucccaucuaagcugcagc

SEQ ID NO: 3518142 - RNA, 12 nt, Human
cauccccagggg

SEQ ID NO: 3518143 - RNA, 18 nt, Human
cauccccaggggucccag

SEQ ID NO: 3518144 - RNA, 18 nt, Human
cauccccauccuccagcu

SEQ ID NO: 3518145 - RNA, 21 nt, Human
cauccccauccuccagcuucu

SEQ ID NO: 3518146 - RNA, 14 nt, Human
caucccccaaaguu

SEQ ID NO: 3518147 - RNA, 12 nt, Human
cauccccccuca

SEQ ID NO: 3518148 - RNA, 14 nt, Human
cauccccccucacc

SEQ ID NO: 3518149 - RNA, 17 nt, Human
cauccccccucaccagg

SEQ ID NO: 3518150 - RNA, 16 nt, Human
cauccccgcuggcugg

SEQ ID NO: 3518151 - RNA, 14 nt, Human
cauccccugccucc

SEQ ID NO: 3518152 - RNA, 14 nt, Human
cauccccuggacug

SEQ ID NO: 3518153 - RNA, 17 nt, Human
caucccgcucuuuuccu

SEQ ID NO: 3518154 - RNA, 16 nt, Human
caucccggaggaaauc

SEQ ID NO: 3518155 - RNA, 21 nt, Human
caucccgggacgcagcaggag

SEQ ID NO: 3518156 - RNA, 18 nt, Human
caucccuaaugcugcaga

SEQ ID NO: 3518157 - RNA, 23 nt, Human
caucccuaccgacccaggguucc

SEQ ID NO: 3518158 - RNA, 13 nt, Human
caucccucaccca

SEQ ID NO: 3518159 - RNA, 15 nt, Human
caucccucuggggcu

SEQ ID NO: 3518160 - RNA, 19 nt, Human
caucccucuggggcuguuc

SEQ ID NO: 3518161 - RNA, 11 nt, Human
caucccugaag

SEQ ID NO: 3518162 - RNA, 13 nt, Human
caucccugaaggc

SEQ ID NO: 3518163 - RNA, 21 nt, Human
caucccugaaggccccgccca

SEQ ID NO: 3518164 - RNA, 23 nt, Human
caucccugagacagggagggaag

SEQ ID NO: 3518165 - RNA, 16 nt, Human
caucccugccugguca

SEQ ID NO: 3518166 - RNA, 12 nt, Human
caucccuggccc

SEQ ID NO: 3518167 - RNA, 13 nt, Human
caucccuggcccc

SEQ ID NO: 3518168 - RNA, 22 nt, Human
caucccuggcccccucccugga

SEQ ID NO: 3518169 - RNA, 17 nt, Human
caucccugggccugcug

SEQ ID NO: 3518170 - RNA, 20 nt, Human
caucccugggccugcugcug

SEQ ID NO: 3518171 - RNA, 22 nt, Human
caucccugggccuugggcuccg

SEQ ID NO: 3518172 - RNA, 23 nt, Human
caucccuugaccaggccugggcc

SEQ ID NO: 3518173 - RNA, 14 nt, Human
caucccuuucccuu

SEQ ID NO: 3518174 - RNA, 17 nt, Human
caucccuuucccuuggu

SEQ ID NO: 3518175 - RNA, 16 nt, Human
cauccgaccagguugu

SEQ ID NO: 3518176 - RNA, 13 nt, Human
cauccgaggcagg

SEQ ID NO: 3518177 - RNA, 22 nt, Human
cauccgaggcagggucaggaga

SEQ ID NO: 3518178 - RNA, 13 nt, Human
cauccgcaggugc

SEQ ID NO: 3518179 - RNA, 14 nt, Human
cauccgcaggugcu

SEQ ID NO: 3518180 - RNA, 16 nt, Human
cauccgcgugugccug

SEQ ID NO: 3518181 - RNA, 17 nt, Human
cauccggggccagcucc

SEQ ID NO: 3518182 - RNA, 17 nt, Human
cauccgugccucuuuuu

SEQ ID NO: 3518183 - RNA, 14 nt, Human
cauccuaacuccau

SEQ ID NO: 3518184 - RNA, 15 nt, Human
cauccuaagaaauau

SEQ ID NO: 3518185 - RNA, 19 nt, Human
cauccuacccccugugccu

SEQ ID NO: 3518186 - RNA, 19 nt, Human
cauccuacccucgggccca

SEQ ID NO: 3518187 - RNA, 20 nt, Human
cauccuagucucuaucauua

SEQ ID NO: 3518188 - RNA, 16 nt, Human
cauccuaucagccugu

SEQ ID NO: 3518189 - RNA, 17 nt, Human
cauccuauccacugggc

SEQ ID NO: 3518190 - RNA, 17 nt, Human
cagugccuuccauaauu

SEQ ID NO: 3518191 - RNA, 23 nt, Human
cagugccuuccauaauuaugaca

SEQ ID NO: 3518192 - RNA, 14 nt, Human
cagugccuugggga

SEQ ID NO: 3518193 - RNA, 18 nt, Human
cagugcgauucuggauaa

SEQ ID NO: 3518194 - RNA, 12 nt, Human
cagugcggccag

SEQ ID NO: 3518195 - RNA, 15 nt, Human
cagugcuaaaaaugg

SEQ ID NO: 3518196 - RNA, 19 nt, Human
cagugcuaaaaaugggacu

SEQ ID NO: 3518197 - RNA, 22 nt, Human
cagugcuaaaaaugggacuucu

SEQ ID NO: 3518198 - RNA, 13 nt, Human
cagugcuacugaa

SEQ ID NO: 3518199 - RNA, 19 nt, Human
cagugcuagugagcugggc

SEQ ID NO: 3518200 - RNA, 19 nt, Human
cagugcucacccacaccau

SEQ ID NO: 3518201 - RNA, 14 nt, Human
cagugcucccucac

SEQ ID NO: 3518202 - RNA, 14 nt, Human
cagugcucgcuguu

SEQ ID NO: 3518203 - RNA, 18 nt, Human
cagugcucgcuguugcug

SEQ ID NO: 3518204 - RNA, 23 nt, Human
cagugcucuuuucuccucacugu

SEQ ID NO: 3518205 - RNA, 12 nt, Human
cagugcugccug

SEQ ID NO: 3518206 - RNA, 22 nt, Human
cagugcugucugaucugugcuu

SEQ ID NO: 3518207 - RNA, 12 nt, Human
cagugcugugcu

SEQ ID NO: 3518208 - RNA, 15 nt, Human
cagugcuucagccug

SEQ ID NO: 3518209 - RNA, 16 nt, Human
cagugcuucagccuga

SEQ ID NO: 3518210 - RNA, 13 nt, Human
cagugcuuccaag

SEQ ID NO: 3518211 - RNA, 12 nt, Human
cagugcuucuca

SEQ ID NO: 3518212 - RNA, 15 nt, Human
cagugcuugccacag

SEQ ID NO: 3518213 - RNA, 18 nt, Human
cagugcuugccacagagc

SEQ ID NO: 3518214 - RNA, 13 nt, Human
cagugcuuggccc

SEQ ID NO: 3518215 - RNA, 14 nt, Human
cagugcuuggccca

SEQ ID NO: 3518216 - RNA, 16 nt, Human
cagugcuuggcccagg

SEQ ID NO: 3518217 - RNA, 20 nt, Human
cagugcuuggcccaggaguu

SEQ ID NO: 3518218 - RNA, 12 nt, Human
cagugcuuuugg

SEQ ID NO: 3518219 - RNA, 18 nt, Human
caguggaaauucagguga

SEQ ID NO: 3518220 - RNA, 13 nt, Human
caguggaagaagc

SEQ ID NO: 3518221 - RNA, 23 nt, Human
caguggaauauaaggaaagcaau

SEQ ID NO: 3518222 - RNA, 22 nt, Human
caguggacucagaaagccaaca

SEQ ID NO: 3518223 - RNA, 17 nt, Human
caguggacuuuccaccc

SEQ ID NO: 3518224 - RNA, 20 nt, Human
caguggacuuuccacccccu

SEQ ID NO: 3518225 - RNA, 21 nt, Human
caguggacuuuccacccccuc

SEQ ID NO: 3518226 - RNA, 22 nt, Human
caguggacuuuccacccccucc

SEQ ID NO: 3518227 - RNA, 23 nt, Human
caguggacuuuccacccccuccc

SEQ ID NO: 3518228 - RNA, 14 nt, Human
caguggaggugcug

SEQ ID NO: 3518229 - RNA, 21 nt, Human
caguggagugcaaaaggcuug

SEQ ID NO: 3518230 - RNA, 14 nt, Human
caguggauacgugu

SEQ ID NO: 3518231 - RNA, 12 nt, Human
caguggcagggc

SEQ ID NO: 3518232 - RNA, 13 nt, Human
caguggcagggca

SEQ ID NO: 3518233 - RNA, 19 nt, Human
caguggcagggcacagggc

SEQ ID NO: 3518234 - RNA, 14 nt, Human
caguggcagggcuc

SEQ ID NO: 3518235 - RNA, 17 nt, Human
caguggcagggcucagg

SEQ ID NO: 3518236 - RNA, 18 nt, Human
caguggcagggcucagga

SEQ ID NO: 3518237 - RNA, 17 nt, Human
caguggcauggcuccag

SEQ ID NO: 3518238 - RNA, 13 nt, Human
caguggccacuca

SEQ ID NO: 3518239 - RNA, 16 nt, Human
caguggcccauggcau

SEQ ID NO: 3518240 - RNA, 21 nt, Human
caguggccucaacccucccuc

SEQ ID NO: 3518241 - RNA, 18 nt, Human
caguggccuggcuccgcu

SEQ ID NO: 3518242 - RNA, 19 nt, Human
caguggccuuccccagcau

SEQ ID NO: 3518243 - RNA, 19 nt, Human
caguggcgaaaucccugcu

SEQ ID NO: 3518244 - RNA, 20 nt, Human
caguggcgaaaucccugcuc

SEQ ID NO: 3518245 - RNA, 21 nt, Human
caguggcgaaaucccugcuca

SEQ ID NO: 3518246 - RNA, 21 nt, Human
caguggcgcgaucucagcuca

SEQ ID NO: 3518247 - RNA, 13 nt, Human
caguggcucuuuu

SEQ ID NO: 3518248 - RNA, 19 nt, Human
caguggcugguccagggcu

SEQ ID NO: 3518249 - RNA, 19 nt, Human
caguggcuucaucugucaa

SEQ ID NO: 3518250 - RNA, 21 nt, Human
caguggcuucaucugucaagu

SEQ ID NO: 3518251 - RNA, 12 nt, Human
cagugggaaaua

SEQ ID NO: 3518252 - RNA, 14 nt, Human
cagugggaaauauu

SEQ ID NO: 3518253 - RNA, 22 nt, Human
cagugggaacgugacugcccca

SEQ ID NO: 3518254 - RNA, 16 nt, Human
cagugggacagggcau

SEQ ID NO: 3518255 - RNA, 22 nt, Human
cagugggagcaaacugcaugcc

SEQ ID NO: 3518256 - RNA, 18 nt, Human
cagugggagccagggcug

SEQ ID NO: 3518257 - RNA, 15 nt, Human
cagugggagcugccu

SEQ ID NO: 3518258 - RNA, 16 nt, Human
cagugggagcugccug

SEQ ID NO: 3518259 - RNA, 17 nt, Human
cagugggagcugccugu

SEQ ID NO: 3518260 - RNA, 20 nt, Human
cagugggagcugccuguuca

SEQ ID NO: 3518261 - RNA, 12 nt, Human
cagugggaggcg

SEQ ID NO: 3518262 - RNA, 17 nt, Human
cagugggaggggcaggc

SEQ ID NO: 3518263 - RNA, 21 nt, Human
cagugggaggggcaggcugac

SEQ ID NO: 3518264 - RNA, 21 nt, Human
cagugggaggugagaccaccu

SEQ ID NO: 3518265 - RNA, 14 nt, Human
cagugggccuggcc

SEQ ID NO: 3518266 - RNA, 20 nt, Human
caguggggaggggcuguggg

SEQ ID NO: 3518267 - RNA, 20 nt, Human
caguggggccugaggcuccu

SEQ ID NO: 3518268 - RNA, 13 nt, Human
caguggggccugu

SEQ ID NO: 3518269 - RNA, 17 nt, Human
caguggggccuguggaa

SEQ ID NO: 3518270 - RNA, 23 nt, Human
cagugggguuucgcagccugagu

SEQ ID NO: 3518271 - RNA, 14 nt, Human
cagugggucccacu

SEQ ID NO: 3518272 - RNA, 17 nt, Human
cagugggucccacuucc

SEQ ID NO: 3518273 - RNA, 18 nt, Human
cagugggucccacuuccc

SEQ ID NO: 3518274 - RNA, 23 nt, Human
cagugggucccacuuccccuccu

SEQ ID NO: 3518275 - RNA, 16 nt, Human
cagugguaagaauagu

SEQ ID NO: 3518276 - RNA, 20 nt, Human
cagugguaugaucacggcuc

SEQ ID NO: 3518277 - RNA, 18 nt, Human
caguggucaaaccgcacu

SEQ ID NO: 3518278 - RNA, 15 nt, Human
caguggugccaucau

SEQ ID NO: 3518279 - RNA, 20 nt, Human
caagcagcuuagaguuggcc

SEQ ID NO: 3518280 - RNA, 17 nt, Human
caagcaggacagugcuu

SEQ ID NO: 3518281 - RNA, 19 nt, Human
caagcaggagacgacaggc

SEQ ID NO: 3518282 - RNA, 12 nt, Human
caagcaggaggc

SEQ ID NO: 3518283 - RNA, 13 nt, Human
caagcaggaggcu

SEQ ID NO: 3518284 - RNA, 15 nt, Human
caagcagggcucugc

SEQ ID NO: 3518285 - RNA, 15 nt, Human
caagcagucgugccu

SEQ ID NO: 3518286 - RNA, 18 nt, Human
caagcagucgugccugug

SEQ ID NO: 3518287 - RNA, 20 nt, Human
caagcagucgugccuguguc

SEQ ID NO: 3518288 - RNA, 22 nt, Human
caagcaguugggacuacaggcg

SEQ ID NO: 3518289 - RNA, 13 nt, Human
caagcaguuucaa

SEQ ID NO: 3518290 - RNA, 20 nt, Human
caagcaguuucaauaaaguu

SEQ ID NO: 3518291 - RNA, 15 nt, Human
caagcaucaggggga

SEQ ID NO: 3518292 - RNA, 22 nt, Human
caagcaucagggggaagaagca

SEQ ID NO: 3518293 - RNA, 18 nt, Human
caagcaucuccugaggau

SEQ ID NO: 3518294 - RNA, 20 nt, Human
caagcaugcuugugaaaaug

SEQ ID NO: 3518295 - RNA, 18 nt, Human
caagcauggcuauuuuau

SEQ ID NO: 3518296 - RNA, 21 nt, Human
caagcauggcuauuuuauauu

SEQ ID NO: 3518297 - RNA, 15 nt, Human
caagcauguauuuuu

SEQ ID NO: 3518298 - RNA, 13 nt, Human
caagcauucuccu

SEQ ID NO: 3518299 - RNA, 15 nt, Human
caagcauucuccugu

SEQ ID NO: 3518300 - RNA, 17 nt, Human
caagcauucucuccauu

SEQ ID NO: 3518301 - RNA, 19 nt, Human
caagccaacgacaaagcca

SEQ ID NO: 3518302 - RNA, 18 nt, Human
caagccaacuuguaaaua

SEQ ID NO: 3518303 - RNA, 13 nt, Human
caagccaagcagc

SEQ ID NO: 3518304 - RNA, 15 nt, Human
caagccaagcagcca

SEQ ID NO: 3518305 - RNA, 19 nt, Human
caagccaagcagccaagcu

SEQ ID NO: 3518306 - RNA, 18 nt, Human
caagccaagggaaccugu

SEQ ID NO: 3518307 - RNA, 22 nt, Human
caagccaauccccuccuugggc

SEQ ID NO: 3518308 - RNA, 11 nt, Human
caagccacaga

SEQ ID NO: 3518309 - RNA, 22 nt, Human
caagccacucggcggcagcaug

SEQ ID NO: 3518310 - RNA, 13 nt, Human
caagccagaggcu

SEQ ID NO: 3518311 - RNA, 16 nt, Human
caagccagaggcuggg

SEQ ID NO: 3518312 - RNA, 22 nt, Human
caagccagcaacacagagcacu

SEQ ID NO: 3518313 - RNA, 14 nt, Human
caagccagcuggag

SEQ ID NO: 3518314 - RNA, 19 nt, Human
caagccaggcucacucaca

SEQ ID NO: 3518315 - RNA, 22 nt, Human
caagccagggauggggccacag

SEQ ID NO: 3518316 - RNA, 23 nt, Human
caagccagggauggggccacagc

SEQ ID NO: 3518317 - RNA, 20 nt, Human
caagccaucuugagugguca

SEQ ID NO: 3518318 - RNA, 12 nt, Human
caagcccaggag

SEQ ID NO: 3518319 - RNA, 14 nt, Human
caagcccaggugcc

SEQ ID NO: 3518320 - RNA, 22 nt, Human
caagcccaggugccagccugag

SEQ ID NO: 3518321 - RNA, 15 nt, Human
caagccccaggcagg

SEQ ID NO: 3518322 - RNA, 17 nt, Human
caagccccaggcaggcu

SEQ ID NO: 3518323 - RNA, 16 nt, Human
caagccccauccugcc

SEQ ID NO: 3518324 - RNA, 14 nt, Human
caagcccccccuuc

SEQ ID NO: 3518325 - RNA, 16 nt, Human
caagcccccccuucca

SEQ ID NO: 3518326 - RNA, 17 nt, Human
caagcccccccuuccac

SEQ ID NO: 3518327 - RNA, 13 nt, Human
caagccccugccc

SEQ ID NO: 3518328 - RNA, 17 nt, Human
caagcccuacagagcug

SEQ ID NO: 3518329 - RNA, 14 nt, Human
caagccuccacagc

SEQ ID NO: 3518330 - RNA, 16 nt, Human
caagccuccacagcga

SEQ ID NO: 3518331 - RNA, 19 nt, Human
caagccucgaggugccuuc

SEQ ID NO: 3518332 - RNA, 21 nt, Human
caagccugaccacgcuuucua

SEQ ID NO: 3518333 - RNA, 21 nt, Human
caagccugagggaaaggccag

SEQ ID NO: 3518334 - RNA, 13 nt, Human
caagccugcaacu

SEQ ID NO: 3518335 - RNA, 22 nt, Human
cauggcagaauaaucuuugggu

SEQ ID NO: 3518336 - RNA, 19 nt, Human
cauggcagauguaggaggg

SEQ ID NO: 3518337 - RNA, 12 nt, Human
cauggcaguggg

SEQ ID NO: 3518338 - RNA, 23 nt, Human
cauggcauauuuuucacauaucu

SEQ ID NO: 3518339 - RNA, 17 nt, Human
cauggcaucccuuuuuc

SEQ ID NO: 3518340 - RNA, 23 nt, Human
cauggcaucccuuuuucauaaau

SEQ ID NO: 3518341 - RNA, 21 nt, Human
cauggcaucuucgucuucacu

SEQ ID NO: 3518342 - RNA, 14 nt, Human
cauggccacacugu

SEQ ID NO: 3518343 - RNA, 15 nt, Human
cauggccacacugug

SEQ ID NO: 3518344 - RNA, 16 nt, Human
cauggccacacuguga

SEQ ID NO: 3518345 - RNA, 18 nt, Human
cauggccacacugugaca

SEQ ID NO: 3518346 - RNA, 20 nt, Human
cauggccacacugugacaca

SEQ ID NO: 3518347 - RNA, 22 nt, Human
cauggccacacugugacacacu

SEQ ID NO: 3518348 - RNA, 22 nt, Human
cauggccagcagcaccugcccu

SEQ ID NO: 3518349 - RNA, 15 nt, Human
cauggccagguggcc

SEQ ID NO: 3518350 - RNA, 12 nt, Human
cauggccccucu

SEQ ID NO: 3518351 - RNA, 17 nt, Human
cauggccccucugaccu

SEQ ID NO: 3518352 - RNA, 16 nt, Human
cauggccccugugagu

SEQ ID NO: 3518353 - RNA, 22 nt, Human
cauggcccucccaguaccuccu

SEQ ID NO: 3518354 - RNA, 18 nt, Human
cauggccggcuuucagga

SEQ ID NO: 3518355 - RNA, 14 nt, Human
cauggccgugaacu

SEQ ID NO: 3518356 - RNA, 17 nt, Human
cauggccuaugcacaua

SEQ ID NO: 3518357 - RNA, 19 nt, Human
cauggccuaugcacauaug

SEQ ID NO: 3518358 - RNA, 19 nt, Human
cauggccugcaaacuggga

SEQ ID NO: 3518359 - RNA, 22 nt, Human
cauggccuuugcuugaaagaaa

SEQ ID NO: 3518360 - RNA, 14 nt, Human
cauggcuaacuggc

SEQ ID NO: 3518361 - RNA, 20 nt, Human
cauggcuaagcuuaaaaaaa

SEQ ID NO: 3518362 - RNA, 15 nt, Human
cauggcuaagcuuua

SEQ ID NO: 3518363 - RNA, 18 nt, Human
cauggcuaaggcaccagc

SEQ ID NO: 3518364 - RNA, 14 nt, Human
cauggcucacugca

SEQ ID NO: 3518365 - RNA, 16 nt, Human
cauggcucaggguggu

SEQ ID NO: 3518366 - RNA, 20 nt, Human
cauggcuccagucugcugcc

SEQ ID NO: 3518367 - RNA, 22 nt, Human
cauggcuccagucugcugcccu

SEQ ID NO: 3518368 - RNA, 17 nt, Human
cauggcucccccuccac

SEQ ID NO: 3518369 - RNA, 11 nt, Human
cauggcugaac

SEQ ID NO: 3518370 - RNA, 13 nt, Human
cauggcugagcug

SEQ ID NO: 3518371 - RNA, 17 nt, Human
cauggcugccaauggga

SEQ ID NO: 3518372 - RNA, 15 nt, Human
cauggcugcuguugc

SEQ ID NO: 3518373 - RNA, 18 nt, Human
cauggcugcuguugcuua

SEQ ID NO: 3518374 - RNA, 24 nt, Human
cauggcugggaacugcagaccugu

SEQ ID NO: 3518375 - RNA, 12 nt, Human
cauggcuguguu

SEQ ID NO: 3518376 - RNA, 23 nt, Human
cauggcuguguuugcagccugcu

SEQ ID NO: 3518377 - RNA, 14 nt, Human
cauggcuuccuccu

SEQ ID NO: 3518378 - RNA, 17 nt, Human
cauggcuuccuccugcg

SEQ ID NO: 3518379 - RNA, 18 nt, Human
cauggcuugccacagcuc

SEQ ID NO: 3518380 - RNA, 20 nt, Human
caugggaaaugucaacaagu

SEQ ID NO: 3518381 - RNA, 19 nt, Human
caugggaagacgaggcccu

SEQ ID NO: 3518382 - RNA, 18 nt, Human
caugggaccuauaacugc

SEQ ID NO: 3518383 - RNA, 22 nt, Human
caugggaccuauaacugcccag

SEQ ID NO: 3518384 - RNA, 13 nt, Human
caugggagccggg

SEQ ID NO: 3518385 - RNA, 21 nt, Human
caugggagcugguuagaaaug

SEQ ID NO: 3518386 - RNA, 21 nt, Human
caugggaggccuuucccuaag

SEQ ID NO: 3518387 - RNA, 12 nt, Human
caugggagggag

SEQ ID NO: 3518388 - RNA, 16 nt, Human
caugggauaaaugcca

SEQ ID NO: 3518389 - RNA, 17 nt, Human
caugggauaaaugccau

SEQ ID NO: 3518390 - RNA, 16 nt, Human
caugggauuauuagaa

SEQ ID NO: 3518391 - RNA, 17 nt, Human
caugggcacugcugggu

SEQ ID NO: 3518392 - RNA, 20 nt, Human
caugggcaucuaugggagag

SEQ ID NO: 3518393 - RNA, 16 nt, Human
caugggccagccccuc

SEQ ID NO: 3518394 - RNA, 14 nt, Human
caugggccccucug

SEQ ID NO: 3518395 - RNA, 17 nt, Human
caugggccuccugugug

SEQ ID NO: 3518396 - RNA, 18 nt, Human
caugggccuccugugugu

SEQ ID NO: 3518397 - RNA, 23 nt, Human
caugggccuggccaccucucucc

SEQ ID NO: 3518398 - RNA, 15 nt, Human
caugggcuucacugu

SEQ ID NO: 3518399 - RNA, 16 nt, Human
caugggcuucacugua

SEQ ID NO: 3518400 - RNA, 17 nt, Human
caugggcuucacuguau

SEQ ID NO: 3518401 - RNA, 16 nt, Human
cauggggaagggauau

SEQ ID NO: 3518402 - RNA, 15 nt, Human
cauggggaggaggag

SEQ ID NO: 3518403 - RNA, 11 nt, Human
cauggggaggg

SEQ ID NO: 3518404 - RNA, 14 nt, Human
caugggggcagggc

SEQ ID NO: 3518405 - RNA, 17 nt, Human
caugggggccucagggc

SEQ ID NO: 3518406 - RNA, 15 nt, Human
cauggggucucucac

SEQ ID NO: 3518407 - RNA, 19 nt, Human
cauggggucucucacagac

SEQ ID NO: 3518408 - RNA, 23 nt, Human
cauggggucucucacagacagga

SEQ ID NO: 3518409 - RNA, 16 nt, Human
cauggggugggccucu

SEQ ID NO: 3518410 - RNA, 19 nt, Human
cauggggugggccucuggu

SEQ ID NO: 3518411 - RNA, 21 nt, Human
cauggggugggguagggcuga

SEQ ID NO: 3518412 - RNA, 19 nt, Human
caugggguuggcugggccc

SEQ ID NO: 3518413 - RNA, 15 nt, Human
cauggguagccuggg

SEQ ID NO: 3518414 - RNA, 15 nt, Human
cauggguagcuucug

SEQ ID NO: 3518415 - RNA, 16 nt, Human
cauggguagcuucuga

SEQ ID NO: 3518416 - RNA, 17 nt, Human
caugggucgcccaugag

SEQ ID NO: 3518417 - RNA, 23 nt, Human
cauggguuuuguagguacuuuug

SEQ ID NO: 3518418 - RNA, 23 nt, Human
caugguaauuuauaguuuauaca

SEQ ID NO: 3518419 - RNA, 18 nt, Human
caugguacccccuucugg

SEQ ID NO: 3518420 - RNA, 16 nt, Human
caugguauuugagaca

SEQ ID NO: 3518421 - RNA, 16 nt, Human
cauggucaacccucag

SEQ ID NO: 3518422 - RNA, 15 nt, Human
cauggucacacacug

SEQ ID NO: 3518423 - RNA, 17 nt, Human
cauggucccacaucccu

SEQ ID NO: 3518424 - RNA, 20 nt, Human
cauggucccacaucccuggg

SEQ ID NO: 3518425 - RNA, 13 nt, Human
cauggucccugcc

SEQ ID NO: 3518426 - RNA, 15 nt, Human
cauggucccugccuu

SEQ ID NO: 3518427 - RNA, 17 nt, Human
cauggucccugccuuag

SEQ ID NO: 3518428 - RNA, 17 nt, Human
caugguccgguguccuu

SEQ ID NO: 3518429 - RNA, 20 nt, Human
caugguccgguguccuuuuc

SEQ ID NO: 3518430 - RNA, 17 nt, Human
cauggucggaaaacaug

SEQ ID NO: 3518431 - RNA, 23 nt, Human
cauggucggaaaacaugcuacac

SEQ ID NO: 3518432 - RNA, 15 nt, Human
cauggucugcccucu

SEQ ID NO: 3518433 - RNA, 17 nt, Human
cauggugaaaagcucca

SEQ ID NO: 3518434 - RNA, 18 nt, Human
cauggugaaaagcuccau

SEQ ID NO: 3518435 - RNA, 19 nt, Human
cauggugaaaauguacuga

SEQ ID NO: 3518436 - RNA, 21 nt, Human
cauggugaaaauguacugaga

SEQ ID NO: 3518437 - RNA, 19 nt, Human
cauggugaaaccccgucuc

SEQ ID NO: 3518438 - RNA, 14 nt, Human
cauggugaagugcu

SEQ ID NO: 3518439 - RNA, 20 nt, Human
cauggugacuuuugaaaaga

SEQ ID NO: 3518440 - RNA, 21 nt, Human
cauggugaggcuuaacaaugu

SEQ ID NO: 3518441 - RNA, 21 nt, Human
cauggugcaguugacagcagg

SEQ ID NO: 3518442 - RNA, 15 nt, Human
cauggugccccagga

SEQ ID NO: 3518443 - RNA, 18 nt, Human
cauggugccccuagcuuu

SEQ ID NO: 3518444 - RNA, 22 nt, Human
caaguaauccaccugccucggc

SEQ ID NO: 3518445 - RNA, 11 nt, Human
caaguaauugu

SEQ ID NO: 3518446 - RNA, 23 nt, Human
caaguaauuucaguguaaagugu

SEQ ID NO: 3518447 - RNA, 15 nt, Human
caaguacacugagag

SEQ ID NO: 3518448 - RNA, 16 nt, Human
caaguacaguacuuug

SEQ ID NO: 3518449 - RNA, 16 nt, Human
caaguaccaaaguuuu

SEQ ID NO: 3518450 - RNA, 14 nt, Human
caaguacugcugua

SEQ ID NO: 3518451 - RNA, 16 nt, Human
caaguacugcuguaaa

SEQ ID NO: 3518452 - RNA, 16 nt, Human
caaguagaccaugguc

SEQ ID NO: 3518453 - RNA, 20 nt, Human
caaguagaugccugaacuug

SEQ ID NO: 3518454 - RNA, 19 nt, Human
caaguagcugggauuuuaa

SEQ ID NO: 3518455 - RNA, 13 nt, Human
caaguagucugcu

SEQ ID NO: 3518456 - RNA, 15 nt, Human
caaguagucugcuca

SEQ ID NO: 3518457 - RNA, 19 nt, Human
caaguaguucuguauuuga

SEQ ID NO: 3518458 - RNA, 20 nt, Human
caaguauaauuuuuuguaau

SEQ ID NO: 3518459 - RNA, 18 nt, Human
caaguauacuagggagcc

SEQ ID NO: 3518460 - RNA, 19 nt, Human
caaguauagaaaaucuuca

SEQ ID NO: 3518461 - RNA, 18 nt, Human
caaguauagccuauggca

SEQ ID NO: 3518462 - RNA, 22 nt, Human
caaguauccaaccaacuugguu

SEQ ID NO: 3518463 - RNA, 16 nt, Human
caaguaugaauaaaga

SEQ ID NO: 3518464 - RNA, 19 nt, Human
caaguaugaauaaagacac

SEQ ID NO: 3518465 - RNA, 17 nt, Human
caaguauuacuaaauug

SEQ ID NO: 3518466 - RNA, 23 nt, Human
caaguauuagggguaauauauug

SEQ ID NO: 3518467 - RNA, 18 nt, Human
caaguauucugccuuugc

SEQ ID NO: 3518468 - RNA, 15 nt, Human
caaguauuuaagccu

SEQ ID NO: 3518469 - RNA, 22 nt, Human
caaguauuuaagccuaaagauu

SEQ ID NO: 3518470 - RNA, 16 nt, Human
caaguauuuuuaauua

SEQ ID NO: 3518471 - RNA, 17 nt, Human
caagucaagugaaaaag

SEQ ID NO: 3518472 - RNA, 15 nt, Human
caagucaaucauuuc

SEQ ID NO: 3518473 - RNA, 16 nt, Human
caagucaaucauuucu

SEQ ID NO: 3518474 - RNA, 12 nt, Human
caagucacaaag

SEQ ID NO: 3518475 - RNA, 18 nt, Human
caagucacaugcguaaac

SEQ ID NO: 3518476 - RNA, 14 nt, Human
caagucacucccaa

SEQ ID NO: 3518477 - RNA, 20 nt, Human
caagucagcuuugccuucca

SEQ ID NO: 3518478 - RNA, 20 nt, Human
caagucauagguuaauauuu

SEQ ID NO: 3518479 - RNA, 16 nt, Human
caauuuuugucucaga

SEQ ID NO: 3518480 - RNA, 17 nt, Human
caauuuuuuuaauuuug

SEQ ID NO: 3518481 - RNA, 21 nt, Human
cacaaaacuccgcccccagcc

SEQ ID NO: 3518482 - RNA, 18 nt, Human
cacaaaaguuagcugagc

SEQ ID NO: 3518483 - RNA, 22 nt, Human
cacaaaauaaccaauccuggac

SEQ ID NO: 3518484 - RNA, 22 nt, Human
cacaaaauauauuuuguuuaca

SEQ ID NO: 3518485 - RNA, 15 nt, Human
cacaaaaucugucca

SEQ ID NO: 3518486 - RNA, 16 nt, Human
cacaaaauugggaaag

SEQ ID NO: 3518487 - RNA, 19 nt, Human
cacaaacaaacaagcuagg

SEQ ID NO: 3518488 - RNA, 13 nt, Human
cacaaacacaagg

SEQ ID NO: 3518489 - RNA, 13 nt, Human
cacaaaccugccu

SEQ ID NO: 3518490 - RNA, 23 nt, Human
cacaaacguuuacuuaucuuaug

SEQ ID NO: 3518491 - RNA, 23 nt, Human
cacaaacucuaucggagaacaug

SEQ ID NO: 3518492 - RNA, 20 nt, Human
cacaaagagaaaaagaaaug

SEQ ID NO: 3518493 - RNA, 21 nt, Human
cacaaagaguucuggaaaaga

SEQ ID NO: 3518494 - RNA, 14 nt, Human
cacaaagcccaagg

SEQ ID NO: 3518495 - RNA, 18 nt, Human
cacaaagcccuuccaugu

SEQ ID NO: 3518496 - RNA, 13 nt, Human
cacaaagccuuau

SEQ ID NO: 3518497 - RNA, 16 nt, Human
cacaaagcuuuugcau

SEQ ID NO: 3518498 - RNA, 21 nt, Human
cacaaaggaccucagcugcuu

SEQ ID NO: 3518499 - RNA, 19 nt, Human
cacaaaggccaaacugcug

SEQ ID NO: 3518500 - RNA, 18 nt, Human
cacaaaguaauuuggaaa

SEQ ID NO: 3518501 - RNA, 13 nt, Human
cacaaaguggcau

SEQ ID NO: 3518502 - RNA, 21 nt, Human
cacaaauauuuauuuucuuuc

SEQ ID NO: 3518503 - RNA, 22 nt, Human
cacaaaugacuuuauuauuuau

SEQ ID NO: 3518504 - RNA, 16 nt, Human
cacaaauuaguuauau

SEQ ID NO: 3518505 - RNA, 17 nt, Human
cacaaauuauuaaugaa

SEQ ID NO: 3518506 - RNA, 20 nt, Human
cacaaauuauuaaugaaaau

SEQ ID NO: 3518507 - RNA, 21 nt, Human
cacaaauucugucucuggauu

SEQ ID NO: 3518508 - RNA, 15 nt, Human
cacaaauuucucugu

SEQ ID NO: 3518509 - RNA, 12 nt, Human
cacaacaaaaau

SEQ ID NO: 3518510 - RNA, 16 nt, Human
cacaacacacacacuc

SEQ ID NO: 3518511 - RNA, 22 nt, Human
cacaacacacagauuugagcuc

SEQ ID NO: 3518512 - RNA, 21 nt, Human
cacaacagccaacagcuacaa

SEQ ID NO: 3518513 - RNA, 23 nt, Human
cacaacagccugacaacauuucu

SEQ ID NO: 3518514 - RNA, 20 nt, Human
cacaaccaacgcgaaaccaa

SEQ ID NO: 3518515 - RNA, 21 nt, Human
cacaacccaucuaccccugga

SEQ ID NO: 3518516 - RNA, 15 nt, Human
cacaacccccagcuc

SEQ ID NO: 3518517 - RNA, 17 nt, Human
cacaacgugcauugugc

SEQ ID NO: 3518518 - RNA, 14 nt, Human
cacaacuauuuuuc

SEQ ID NO: 3518519 - RNA, 19 nt, Human
cacaacucacuccuuuuaa

SEQ ID NO: 3518520 - RNA, 15 nt, Human
cacaacugacacagg

SEQ ID NO: 3518521 - RNA, 18 nt, Human
cacaacuugauggcugcg

SEQ ID NO: 3518522 - RNA, 18 nt, Human
cacaagaaaugaaagcag

SEQ ID NO: 3518523 - RNA, 20 nt, Human
cacaagaaaugaaagcaggg

SEQ ID NO: 3518524 - RNA, 12 nt, Human
cacaagaaauuu

SEQ ID NO: 3518525 - RNA, 20 nt, Human
cacaagaacacacacauaua

SEQ ID NO: 3518526 - RNA, 19 nt, Human
cacaagaagaccagacugu

SEQ ID NO: 3518527 - RNA, 17 nt, Human
cacaagaaucacuugaa

SEQ ID NO: 3518528 - RNA, 14 nt, Human
cacaagacccuugu

SEQ ID NO: 3518529 - RNA, 16 nt, Human
cacaagacccuugugg

SEQ ID NO: 3518530 - RNA, 18 nt, Human
cacaagacugcacaucaa

SEQ ID NO: 3518531 - RNA, 14 nt, Human
cacaagagcccagg

SEQ ID NO: 3518532 - RNA, 19 nt, Human
cacaagagcccaggccucc

SEQ ID NO: 3518533 - RNA, 18 nt, Human
cacaagauggaauuuauc

SEQ ID NO: 3518534 - RNA, 15 nt, Human
cacaagauucccaga

SEQ ID NO: 3518535 - RNA, 16 nt, Human
cacaagauucccagag

SEQ ID NO: 3518536 - RNA, 18 nt, Human
cacaagauucccagagac

SEQ ID NO: 3518537 - RNA, 22 nt, Human
cacaagcaaaaaaaaaaaaaag

SEQ ID NO: 3518538 - RNA, 17 nt, Human
cacaagccacagaagcc

SEQ ID NO: 3518539 - RNA, 15 nt, Human
cacaagccagggugu

SEQ ID NO: 3518540 - RNA, 21 nt, Human
cacaagccucgaggugccuuc

SEQ ID NO: 3518541 - RNA, 22 nt, Human
cacaagccucugcccaggcacu

SEQ ID NO: 3518542 - RNA, 15 nt, Human
cacaagcuccaagcu

SEQ ID NO: 3518543 - RNA, 19 nt, Human
cacaagcuccaagcuccca

SEQ ID NO: 3518544 - RNA, 12 nt, Human
cacaagcugccu

SEQ ID NO: 3518545 - RNA, 14 nt, Human
cacaagcugccucc

SEQ ID NO: 3518546 - RNA, 16 nt, Human
cacaagcugccucccu

SEQ ID NO: 3518547 - RNA, 14 nt, Human
cacaaggaagaaau

SEQ ID NO: 3518548 - RNA, 22 nt, Human
cacaaggacuuccuguccagcu

SEQ ID NO: 3518549 - RNA, 17 nt, Human
cacaaggauagaugcug

SEQ ID NO: 3518550 - RNA, 11 nt, Human
cacaaggcagc

SEQ ID NO: 3518551 - RNA, 14 nt, Human
cacaaggcagcaag

SEQ ID NO: 3518552 - RNA, 15 nt, Human
cacaaggcagcaagg

SEQ ID NO: 3518553 - RNA, 16 nt, Human
cacaaggcagcaaggc

SEQ ID NO: 3518554 - RNA, 15 nt, Human
cacaaggccaucugg

SEQ ID NO: 3518555 - RNA, 18 nt, Human
cacaaggcuccaagaccu

SEQ ID NO: 3518556 - RNA, 16 nt, Human
cacaaggcuguugcau

SEQ ID NO: 3518557 - RNA, 16 nt, Human
cacaaggucauggcca

SEQ ID NO: 3518558 - RNA, 17 nt, Human
cacaaggucauggccac

SEQ ID NO: 3518559 - RNA, 19 nt, Human
cacaaggucauggccacac

SEQ ID NO: 3518560 - RNA, 21 nt, Human
cacaaggucauggccacacug

SEQ ID NO: 3518561 - RNA, 14 nt, Human
cacaaguaagagac

SEQ ID NO: 3518562 - RNA, 21 nt, Human
cacaaguagaugccugaacuu

SEQ ID NO: 3518563 - RNA, 21 nt, Human
cacaaguccuggauguugugu

SEQ ID NO: 3518564 - RNA, 16 nt, Human
cacaaguccugugaau

SEQ ID NO: 3518565 - RNA, 20 nt, Human
cacaaguccugugaauuucu

SEQ ID NO: 3518566 - RNA, 12 nt, Human
cacaagugaaaa

SEQ ID NO: 3518567 - RNA, 16 nt, Human
cacaagugaaaaacau

SEQ ID NO: 3518568 - RNA, 20 nt, Human
cacaaguuaagauucuuggu

SEQ ID NO: 3518569 - RNA, 16 nt, Human
cacaaguuauuuaaau

SEQ ID NO: 3518570 - RNA, 14 nt, Human
cacaaguuguguuu

SEQ ID NO: 3518571 - RNA, 21 nt, Human
cacaauaacacuaaaauuuua

SEQ ID NO: 3518572 - RNA, 20 nt, Human
cacaauaacuccucccaggg

SEQ ID NO: 3518573 - RNA, 21 nt, Human
cacaauaaggucaaugccaga

SEQ ID NO: 3518574 - RNA, 11 nt, Human
cacaauauuuu

SEQ ID NO: 3518575 - RNA, 22 nt, Human
cacaauccuaacacauuaucgg

SEQ ID NO: 3518576 - RNA, 22 nt, Human
cacaaucucggcucacugcauc

SEQ ID NO: 3518577 - RNA, 23 nt, Human
cacaaugagauugaauuucacug

SEQ ID NO: 3518578 - RNA, 21 nt, Human
cacaauggcuaauucccagag

SEQ ID NO: 3518579 - RNA, 16 nt, Human
cacaaugucaguauuu

SEQ ID NO: 3518580 - RNA, 15 nt, Human
cacaauguucuuuau

SEQ ID NO: 3518581 - RNA, 22 nt, Human
cacaauguucuuuauauacaau

SEQ ID NO: 3518582 - RNA, 16 nt, Human
cacaauuagauuucuc

SEQ ID NO: 3518583 - RNA, 17 nt, Human
cacaauuagauuucuca

SEQ ID NO: 3518584 - RNA, 13 nt, Human
cacaauuugcacu

SEQ ID NO: 3518585 - RNA, 18 nt, Human
cacaauuuugauaaaaau

SEQ ID NO: 3518586 - RNA, 16 nt, Human
cacaauuuuuaauggc

SEQ ID NO: 3518587 - RNA, 21 nt, Human
cacacaaaaagugucucugcc

SEQ ID NO: 3518588 - RNA, 13 nt, Human
cacacaaagagag

SEQ ID NO: 3518589 - RNA, 14 nt, Human
cacacaacaaaaau

SEQ ID NO: 3518590 - RNA, 19 nt, Human
cacacaagggaaggacaga

SEQ ID NO: 3518591 - RNA, 16 nt, Human
cacacaaggggcccuu

SEQ ID NO: 3518592 - RNA, 16 nt, Human
cacacaaguaagagac

SEQ ID NO: 3518593 - RNA, 18 nt, Human
cacacaaugugucugaga

SEQ ID NO: 3518594 - RNA, 16 nt, Human
cacacaauuagauuuc

SEQ ID NO: 3518595 - RNA, 13 nt, Human
cacacacaaaccu

SEQ ID NO: 3518596 - RNA, 14 nt, Human
cacacacaaaccuu

SEQ ID NO: 3518597 - RNA, 15 nt, Human
cacacacaacaaaaa

SEQ ID NO: 3518598 - RNA, 13 nt, Human
cacacacaacagc

SEQ ID NO: 3518599 - RNA, 15 nt, Human
cacacacaacagcca

SEQ ID NO: 3518600 - RNA, 13 nt, Human
cacacacacaaaa

SEQ ID NO: 3518601 - RNA, 15 nt, Human
cacacacacaacaaa

SEQ ID NO: 3518602 - RNA, 13 nt, Human
cacacacacacaa

SEQ ID NO: 3518603 - RNA, 15 nt, Human
cacacacacacacag

SEQ ID NO: 3518604 - RNA, 16 nt, Human
cacacacacacacagc

SEQ ID NO: 3518605 - RNA, 14 nt, Human
cacacacacacacu

SEQ ID NO: 3518606 - RNA, 14 nt, Human
cacacacacacagc

SEQ ID NO: 3518607 - RNA, 16 nt, Human
cacacacacacaggag

SEQ ID NO: 3518608 - RNA, 14 nt, Human
cacacacacacaua

SEQ ID NO: 3518609 - RNA, 16 nt, Human
cacacacacacaugca

SEQ ID NO: 3518610 - RNA, 14 nt, Human
cacacacacacgca

SEQ ID NO: 3518611 - RNA, 11 nt, Human
cacacacacag

SEQ ID NO: 3518612 - RNA, 15 nt, Human
cacacacacagaaaa

SEQ ID NO: 3518613 - RNA, 12 nt, Human
cacacacacagg

SEQ ID NO: 3518614 - RNA, 14 nt, Human
cacacacacaggag

SEQ ID NO: 3518615 - RNA, 14 nt, Human
cacacacacauaca

SEQ ID NO: 3518616 - RNA, 14 nt, Human
cacacacacaugca

SEQ ID NO: 3518617 - RNA, 13 nt, Human
cacacacacgcac

SEQ ID NO: 3518618 - RNA, 20 nt, Human
cacacacagaaaauauacug

SEQ ID NO: 3518619 - RNA, 23 nt, Human
cacacacagaggaagagcaggca

SEQ ID NO: 3518620 - RNA, 12 nt, Human
cacacacagcca

SEQ ID NO: 3518621 - RNA, 13 nt, Human
cacacacagccac

SEQ ID NO: 3518622 - RNA, 15 nt, Human
cacacacagccacac

SEQ ID NO: 3518623 - RNA, 15 nt, Human
cacacacagcugggc

SEQ ID NO: 3518624 - RNA, 12 nt, Human
cacacacaggug

SEQ ID NO: 3518625 - RNA, 14 nt, Human
cauugagcugugca

SEQ ID NO: 3518626 - RNA, 10 nt, Human
cauugaguau

SEQ ID NO: 3518627 - RNA, 18 nt, Human
cauugauaugaaaaauau

SEQ ID NO: 3518628 - RNA, 14 nt, Human
cauugauauuguga

SEQ ID NO: 3518629 - RNA, 16 nt, Human
cauugauauugugaac

SEQ ID NO: 3518630 - RNA, 20 nt, Human
cauugauauugugaacauuu

SEQ ID NO: 3518631 - RNA, 23 nt, Human
cauugauauuugugcauuuucua

SEQ ID NO: 3518632 - RNA, 15 nt, Human
cauugauugcugugu

SEQ ID NO: 3518633 - RNA, 16 nt, Human
cauugauugcuguguc

SEQ ID NO: 3518634 - RNA, 18 nt, Human
cauugauugucagcuacu

SEQ ID NO: 3518635 - RNA, 13 nt, Human
cauugauuugauu

SEQ ID NO: 3518636 - RNA, 22 nt, Human
cauugauuugauuuuuauuauu

SEQ ID NO: 3518637 - RNA, 15 nt, Human
cauugcaacaaaaua

SEQ ID NO: 3518638 - RNA, 19 nt, Human
cauugcacauaagcuucca

SEQ ID NO: 3518639 - RNA, 18 nt, Human
cauugcacccagcccaga

SEQ ID NO: 3518640 - RNA, 16 nt, Human
cauugcacuccagccu

SEQ ID NO: 3518641 - RNA, 22 nt, Human
cauugcagaauaauguucuauu

SEQ ID NO: 3518642 - RNA, 16 nt, Human
cauugcauauaacuua

SEQ ID NO: 3518643 - RNA, 20 nt, Human
cauugcauucuauugccuuc

SEQ ID NO: 3518644 - RNA, 17 nt, Human
cauugccagugucuuuc

SEQ ID NO: 3518645 - RNA, 21 nt, Human
cauugccagugucuuucuuug

SEQ ID NO: 3518646 - RNA, 19 nt, Human
cauugccauucccugccug

SEQ ID NO: 3518647 - RNA, 20 nt, Human
cauugccauucccugccugg

SEQ ID NO: 3518648 - RNA, 23 nt, Human
cauugccccaaauggauuccugu

SEQ ID NO: 3518649 - RNA, 17 nt, Human
cauugcccccagggcac

SEQ ID NO: 3518650 - RNA, 21 nt, Human
cauugccguggcaucuuaaaa

SEQ ID NO: 3518651 - RNA, 22 nt, Human
cauugccuaacuacuaguuuuu

SEQ ID NO: 3518652 - RNA, 20 nt, Human
cauugccuauuucaguggca

SEQ ID NO: 3518653 - RNA, 18 nt, Human
cauugccuccuccuuccc

SEQ ID NO: 3518654 - RNA, 17 nt, Human
cauugccuggccuuccu

SEQ ID NO: 3518655 - RNA, 21 nt, Human
cauugccuuaacuggagcccc

SEQ ID NO: 3518656 - RNA, 21 nt, Human
cauugcgcucuagccugggca

SEQ ID NO: 3518657 - RNA, 19 nt, Human
caucagcacgauuucuguu

SEQ ID NO: 3518658 - RNA, 17 nt, Human
caucagcauaccuuuau

SEQ ID NO: 3518659 - RNA, 18 nt, Human
caucagcccaaucccuga

SEQ ID NO: 3518660 - RNA, 18 nt, Human
caucagcuaaacaccacg

SEQ ID NO: 3518661 - RNA, 13 nt, Human
caucagcuagcaa

SEQ ID NO: 3518662 - RNA, 15 nt, Human
caucagcugcugaaa

SEQ ID NO: 3518663 - RNA, 19 nt, Human
caucaggaugaacccagga

SEQ ID NO: 3518664 - RNA, 19 nt, Human
caucaggccaggcccucug

SEQ ID NO: 3518665 - RNA, 20 nt, Human
caucaggccaggcccucugc

SEQ ID NO: 3518666 - RNA, 22 nt, Human
caucaggccaggcccucugccc

SEQ ID NO: 3518667 - RNA, 23 nt, Human
caucaggccaggcccucugccca

SEQ ID NO: 3518668 - RNA, 15 nt, Human
caucaggcuuucuuu

SEQ ID NO: 3518669 - RNA, 18 nt, Human
caucagggacaggaugac

SEQ ID NO: 3518670 - RNA, 18 nt, Human
caucagggccuggggccu

SEQ ID NO: 3518671 - RNA, 22 nt, Human
caucagggccuggggccugaga

SEQ ID NO: 3518672 - RNA, 20 nt, Human
caucaguauugaagcauuuu

SEQ ID NO: 3518673 - RNA, 15 nt, Human
caucagucccuaugu

SEQ ID NO: 3518674 - RNA, 17 nt, Human
caucagucccuauguau

SEQ ID NO: 3518675 - RNA, 15 nt, Human
caucagugcucccuc

SEQ ID NO: 3518676 - RNA, 24 nt, Human
caucagugcucccucacaugucag

SEQ ID NO: 3518677 - RNA, 14 nt, Human
caucaguggagcca

SEQ ID NO: 3518678 - RNA, 16 nt, Human
caucaguggcauggcu

SEQ ID NO: 3518679 - RNA, 22 nt, Human
caucaguggcauggcuccaguc

SEQ ID NO: 3518680 - RNA, 21 nt, Human
caucaguguacccccgcccag

SEQ ID NO: 3518681 - RNA, 18 nt, Human
caucaguguuaaaaaauu

SEQ ID NO: 3518682 - RNA, 12 nt, Human
caucauaaaaua

SEQ ID NO: 3518683 - RNA, 14 nt, Human
caucauaaaauaaa

SEQ ID NO: 3518684 - RNA, 20 nt, Human
caucauaaaauaaaguauau

SEQ ID NO: 3518685 - RNA, 23 nt, Human
caucauaaaauaaaguauauaua

SEQ ID NO: 3518686 - RNA, 23 nt, Human
caucauaggaagggaccaaggca

SEQ ID NO: 3518687 - RNA, 20 nt, Human
caucauaguaaaagaaauga

SEQ ID NO: 3518688 - RNA, 13 nt, Human
caucaucagagcc

SEQ ID NO: 3518689 - RNA, 13 nt, Human
caucaucagggcc

SEQ ID NO: 3518690 - RNA, 15 nt, Human
caucaucauggccag

SEQ ID NO: 3518691 - RNA, 16 nt, Human
caucauccuaagcuau

SEQ ID NO: 3518692 - RNA, 14 nt, Human
caucauccucuggc

SEQ ID NO: 3518693 - RNA, 13 nt, Human
caucaucuguaag

SEQ ID NO: 3518694 - RNA, 13 nt, Human
caucaucuguaga

SEQ ID NO: 3518695 - RNA, 16 nt, Human
caucaugaauuuuaca

SEQ ID NO: 3518696 - RNA, 23 nt, Human
caucaugacacucguauaagcau

SEQ ID NO: 3518697 - RNA, 17 nt, Human
caucaugaguucugcug

SEQ ID NO: 3518698 - RNA, 16 nt, Human
caucaugcaucuuacu

SEQ ID NO: 3518699 - RNA, 13 nt, Human
caucaugccucug

SEQ ID NO: 3518700 - RNA, 14 nt, Human
caucaugccucuga

SEQ ID NO: 3518701 - RNA, 15 nt, Human
caucaugccucugag

SEQ ID NO: 3518702 - RNA, 16 nt, Human
caucaugccucugagg

SEQ ID NO: 3518703 - RNA, 19 nt, Human
caucaugccucugaggcca

SEQ ID NO: 3518704 - RNA, 20 nt, Human
caucaugccucugaggccag

SEQ ID NO: 3518705 - RNA, 14 nt, Human
caucauggccagcu

SEQ ID NO: 3518706 - RNA, 15 nt, Human
caucauggccagcug

SEQ ID NO: 3518707 - RNA, 21 nt, Human
caucauggccagcuggaggca

SEQ ID NO: 3518708 - RNA, 15 nt, Human
caucauggcuaucug

SEQ ID NO: 3518709 - RNA, 14 nt, Human
caucaugucuauug

SEQ ID NO: 3518710 - RNA, 22 nt, Human
caucauguggccccacccaauc

SEQ ID NO: 3518711 - RNA, 19 nt, Human
caucauguuuacagaggac

SEQ ID NO: 3518712 - RNA, 21 nt, Human
caucauguuuacagaggacag

SEQ ID NO: 3518713 - RNA, 15 nt, Human
caucauuauuuaugu

SEQ ID NO: 3518714 - RNA, 19 nt, Human
caucauucacuucacugug

SEQ ID NO: 3518715 - RNA, 18 nt, Human
caucauucaugcuacugc

SEQ ID NO: 3518716 - RNA, 12 nt, Human
caucauucccuu

SEQ ID NO: 3518717 - RNA, 17 nt, Human
caucauuccuugagaaa

SEQ ID NO: 3518718 - RNA, 22 nt, Human
caucauucucugucucauccau

SEQ ID NO: 3518719 - RNA, 14 nt, Human
caucauugcacucu

SEQ ID NO: 3518720 - RNA, 21 nt, Human
caucauugcugucugcagccu

SEQ ID NO: 3518721 - RNA, 14 nt, Human
caucauuguauaua

SEQ ID NO: 3518722 - RNA, 14 nt, Human
caucauuucaagaa

SEQ ID NO: 3518723 - RNA, 14 nt, Human
caucauuucaggag

SEQ ID NO: 3518724 - RNA, 12 nt, Human
caucauuucugg

SEQ ID NO: 3518725 - RNA, 23 nt, Human
cauccaaaauaguuaagacauga

SEQ ID NO: 3518726 - RNA, 15 nt, Human
cauccaaagcagaca

SEQ ID NO: 3518727 - RNA, 21 nt, Human
cauccaaccccccaccugcca

SEQ ID NO: 3518728 - RNA, 15 nt, Human
cauccaacuccagca

SEQ ID NO: 3518729 - RNA, 21 nt, Human
cauccaaggagaaacagagac

SEQ ID NO: 3518730 - RNA, 15 nt, Human
cauccaauccucacu

SEQ ID NO: 3518731 - RNA, 19 nt, Human
cauccaaucuaaccacauc

SEQ ID NO: 3518732 - RNA, 20 nt, Human
cauccaaucuaaccacauca

SEQ ID NO: 3518733 - RNA, 16 nt, Human
cauccaauuagcuuau

SEQ ID NO: 3518734 - RNA, 23 nt, Human
cauccacaaaugcaguuuuagaa

SEQ ID NO: 3518735 - RNA, 14 nt, Human
cauccacagucucc

SEQ ID NO: 3518736 - RNA, 14 nt, Human
cauccacucuaccc

SEQ ID NO: 3518737 - RNA, 14 nt, Human
cauccacugugcca

SEQ ID NO: 3518738 - RNA, 17 nt, Human
cauccacugugccaugu

SEQ ID NO: 3518739 - RNA, 23 nt, Human
cauccacugugccaugugccagg

SEQ ID NO: 3518740 - RNA, 18 nt, Human
cauccacuuacauauauu

SEQ ID NO: 3518741 - RNA, 17 nt, Human
cauccagacucagagcu

SEQ ID NO: 3518742 - RNA, 21 nt, Human
cauccagacucagagcucucu

SEQ ID NO: 3518743 - RNA, 13 nt, Human
cauccagaugugg

SEQ ID NO: 3518744 - RNA, 14 nt, Human
cauccagauguggc

SEQ ID NO: 3518745 - RNA, 15 nt, Human
cauccagauguggcu

SEQ ID NO: 3518746 - RNA, 18 nt, Human
cauccagcagucucugcc

SEQ ID NO: 3518747 - RNA, 20 nt, Human
cauccagcagucucugccuu

SEQ ID NO: 3518748 - RNA, 22 nt, Human
cauccaggaggaauaagcuccc

SEQ ID NO: 3518749 - RNA, 12 nt, Human
cauccaggcagu

SEQ ID NO: 3518750 - RNA, 11 nt, Human
cauccagggcc

SEQ ID NO: 3518751 - RNA, 21 nt, Human
cauccagggcccccaucucau

SEQ ID NO: 3518752 - RNA, 15 nt, Human
cauccagguucagcu

SEQ ID NO: 3518753 - RNA, 17 nt, Human
cauccaguuaaccaagu

SEQ ID NO: 3518754 - RNA, 16 nt, Human
cauccauaaagaagca

SEQ ID NO: 3518755 - RNA, 17 nt, Human
cauccauaaagaagcaa

SEQ ID NO: 3518756 - RNA, 14 nt, Human
cauccaucaucaug

SEQ ID NO: 3518757 - RNA, 12 nt, Human
cauccauccagg

SEQ ID NO: 3518758 - RNA, 17 nt, Human
cauccaugccucagaag

SEQ ID NO: 3518759 - RNA, 14 nt, Human
cauccauggccagc

SEQ ID NO: 3518760 - RNA, 19 nt, Human
cauccauggggcugauugu

SEQ ID NO: 3518761 - RNA, 20 nt, Human
cauccauggggucucucaca

SEQ ID NO: 3518762 - RNA, 21 nt, Human
cauccauggggucucucacag

SEQ ID NO: 3518763 - RNA, 16 nt, Human
cauccauguguggacu

SEQ ID NO: 3518764 - RNA, 18 nt, Human
cauccauguuccgagaag

SEQ ID NO: 3518765 - RNA, 15 nt, Human
cauccauguuuguaa

SEQ ID NO: 3518766 - RNA, 19 nt, Human
cauccauguuuguaaaacu

SEQ ID NO: 3518767 - RNA, 18 nt, Human
cauccauuccucagggac

SEQ ID NO: 3518768 - RNA, 22 nt, Human
cauccauuuauuuggcaucugu

SEQ ID NO: 3518769 - RNA, 14 nt, Human
ccaaagcauggacu

SEQ ID NO: 3518770 - RNA, 13 nt, Human
ccaaagccaccag

SEQ ID NO: 3518771 - RNA, 22 nt, Human
ccaaagccaccagacugacaaa

SEQ ID NO: 3518772 - RNA, 23 nt, Human
ccaaagcuaggguggcccuugca

SEQ ID NO: 3518773 - RNA, 21 nt, Human
ccaaagcugagccugcaggga

SEQ ID NO: 3518774 - RNA, 13 nt, Human
ccaaagcugccca

SEQ ID NO: 3518775 - RNA, 13 nt, Human
ccaaagcuuuccu

SEQ ID NO: 3518776 - RNA, 14 nt, Human
ccaaagcuuuccug

SEQ ID NO: 3518777 - RNA, 23 nt, Human
ccaaaggaagcacaugccucucu

SEQ ID NO: 3518778 - RNA, 19 nt, Human
ccaaaggacgcacugagca

SEQ ID NO: 3518779 - RNA, 12 nt, Human
ccaaaggaggcu

SEQ ID NO: 3518780 - RNA, 15 nt, Human
ccaaaggaggcuggc

SEQ ID NO: 3518781 - RNA, 17 nt, Human
ccaaaggaggcuggcag

SEQ ID NO: 3518782 - RNA, 19 nt, Human
ccaaaggaugugauauaua

SEQ ID NO: 3518783 - RNA, 14 nt, Human
ccaaaggcucccug

SEQ ID NO: 3518784 - RNA, 16 nt, Human
ccaaaggcucucuccu

SEQ ID NO: 3518785 - RNA, 20 nt, Human
ccaaagggagaguuccagag

SEQ ID NO: 3518786 - RNA, 18 nt, Human
ccaaagggagucugccag

SEQ ID NO: 3518787 - RNA, 21 nt, Human
ccaaagggagucugccagggc

SEQ ID NO: 3518788 - RNA, 19 nt, Human
ccaaaggggaccuggaagg

SEQ ID NO: 3518789 - RNA, 22 nt, Human
ccaaaggugaaggaauauaugg

SEQ ID NO: 3518790 - RNA, 15 nt, Human
ccaaaguacacuguu

SEQ ID NO: 3518791 - RNA, 20 nt, Human
ccaaaguacacuguuucaaa

SEQ ID NO: 3518792 - RNA, 19 nt, Human
ccaaaguccugggauuaca

SEQ ID NO: 3518793 - RNA, 14 nt, Human
ccaaagucucccuu

SEQ ID NO: 3518794 - RNA, 16 nt, Human
ccaaagucucccuucu

SEQ ID NO: 3518795 - RNA, 14 nt, Human
ccaaagucucuaau

SEQ ID NO: 3518796 - RNA, 18 nt, Human
ccaaagucucuaauucua

SEQ ID NO: 3518797 - RNA, 16 nt, Human
ccaaagucuuaaaaua

SEQ ID NO: 3518798 - RNA, 23 nt, Human
ccaaagugccacucauuccugua

SEQ ID NO: 3518799 - RNA, 19 nt, Human
ccaaaguucuaauaauuuc

SEQ ID NO: 3518800 - RNA, 23 nt, Human
ccaaaguucuaauaauuucuaau

SEQ ID NO: 3518801 - RNA, 19 nt, Human
ccaaaguuguuguaaccug

SEQ ID NO: 3518802 - RNA, 16 nt, Human
ccaaauaaaaacuaaa

SEQ ID NO: 3518803 - RNA, 20 nt, Human
ccaaauaaaaacuaaauugu

SEQ ID NO: 3518804 - RNA, 12 nt, Human
ccaaauaaauaa

SEQ ID NO: 3518805 - RNA, 15 nt, Human
ccaaauaacuucagu

SEQ ID NO: 3518806 - RNA, 17 nt, Human
ccaaauaagaaaccuaa

SEQ ID NO: 3518807 - RNA, 23 nt, Human
ccaaauaauauguuuccuucccu

SEQ ID NO: 3518808 - RNA, 16 nt, Human
ccaaauaaugucucug

SEQ ID NO: 3518809 - RNA, 19 nt, Human
ccaaauauauucucuuugg

SEQ ID NO: 3518810 - RNA, 16 nt, Human
ccaaaucaaaaucucu

SEQ ID NO: 3518811 - RNA, 19 nt, Human
ccaaaucaaaaucucucca

SEQ ID NO: 3518812 - RNA, 20 nt, Human
ccaaaucaaaaucucuccac

SEQ ID NO: 3518813 - RNA, 20 nt, Human
ccaaaucacugaacuuugcu

SEQ ID NO: 3518814 - RNA, 24 nt, Human
ccaaauccgaaccuccucugugaa

SEQ ID NO: 3518815 - RNA, 19 nt, Human
ccaaauccgcucucuuccu

SEQ ID NO: 3518816 - RNA, 20 nt, Human
ccaaauccgcucucuuccug

SEQ ID NO: 3518817 - RNA, 18 nt, Human
ccaaaucucuuccacaag

SEQ ID NO: 3518818 - RNA, 20 nt, Human
ccaaaucugccuauugcagc

SEQ ID NO: 3518819 - RNA, 23 nt, Human
ccaaaucugccuauugcagcugg

SEQ ID NO: 3518820 - RNA, 15 nt, Human
ccaaaugcaauguga

SEQ ID NO: 3518821 - RNA, 16 nt, Human
ccaaaugcaauuugau

SEQ ID NO: 3518822 - RNA, 12 nt, Human
ccaaaugcagcu

SEQ ID NO: 3518823 - RNA, 15 nt, Human
ccaaaugcuuuaaaa

SEQ ID NO: 3518824 - RNA, 17 nt, Human
ccaaauggaaacagagg

SEQ ID NO: 3518825 - RNA, 22 nt, Human
ccaaauggaaaugggcagagca

SEQ ID NO: 3518826 - RNA, 14 nt, Human
ccaaaugguacaaa

SEQ ID NO: 3518827 - RNA, 22 nt, Human
ccaaauguaauugaauaaaguu

SEQ ID NO: 3518828 - RNA, 19 nt, Human
ccaaaugugugcccagcuu

SEQ ID NO: 3518829 - RNA, 20 nt, Human
ccaaaugugugcccagcuua

SEQ ID NO: 3518830 - RNA, 18 nt, Human
ccaaauguucaucaauga

SEQ ID NO: 3518831 - RNA, 17 nt, Human
ccaaauuaaaaaagaua

SEQ ID NO: 3518832 - RNA, 18 nt, Human
ccaaauuaaaaaagauaa

SEQ ID NO: 3518833 - RNA, 17 nt, Human
ccaaauuaguacagaaa

SEQ ID NO: 3518834 - RNA, 19 nt, Human
ccaaauuaucaagcuaaua

SEQ ID NO: 3518835 - RNA, 19 nt, Human
ccaaauuauuucuuaauua

SEQ ID NO: 3518836 - RNA, 18 nt, Human
ccaaauuauuuguguaau

SEQ ID NO: 3518837 - RNA, 15 nt, Human
ccaaauucaguuuca

SEQ ID NO: 3518838 - RNA, 20 nt, Human
ccaaauuccuuggcaugccu

SEQ ID NO: 3518839 - RNA, 20 nt, Human
ccaaauugcugggauuacag

SEQ ID NO: 3518840 - RNA, 14 nt, Human
ccaaauugugcuuc

SEQ ID NO: 3518841 - RNA, 12 nt, Human
ccaaauuuauca

SEQ ID NO: 3518842 - RNA, 20 nt, Human
ccaaauuugauugauuugaa

SEQ ID NO: 3518843 - RNA, 14 nt, Human
ccaacaaagcuguu

SEQ ID NO: 3518844 - RNA, 19 nt, Human
ccaacaagaauaaaggcag

SEQ ID NO: 3518845 - RNA, 16 nt, Human
ccaacaagggcagugg

SEQ ID NO: 3518846 - RNA, 17 nt, Human
ccaacaagggcagugga

SEQ ID NO: 3518847 - RNA, 22 nt, Human
ccaacaauccuagugcuuuccu

SEQ ID NO: 3518848 - RNA, 19 nt, Human
ccaacaccaagcacagcag

SEQ ID NO: 3518849 - RNA, 14 nt, Human
ccaacaccacagac

SEQ ID NO: 3518850 - RNA, 21 nt, Human
ccaacaccacagacacacaca

SEQ ID NO: 3518851 - RNA, 23 nt, Human
ccaacaccacagacacacacacg

SEQ ID NO: 3518852 - RNA, 12 nt, Human
ccaacaccaggg

SEQ ID NO: 3518853 - RNA, 14 nt, Human
ccaacacucaagaa

SEQ ID NO: 3518854 - RNA, 15 nt, Human
ccaacacugccagca

SEQ ID NO: 3518855 - RNA, 14 nt, Human
ccaacacugugccc

SEQ ID NO: 3518856 - RNA, 12 nt, Human
ccaacacuucca

SEQ ID NO: 3518857 - RNA, 13 nt, Human
ccaacacuuccag

SEQ ID NO: 3518858 - RNA, 19 nt, Human
ccaacagaagaacuguguu

SEQ ID NO: 3518859 - RNA, 22 nt, Human
ccaacagaugcuuuucugucuc

SEQ ID NO: 3518860 - RNA, 15 nt, Human
ccaacagccaugccc

SEQ ID NO: 3518861 - RNA, 22 nt, Human
ccaacagcgacauagcccaucc

SEQ ID NO: 3518862 - RNA, 23 nt, Human
ccaacagcgcccaaaggacgcac

SEQ ID NO: 3518863 - RNA, 13 nt, Human
ccaacagcuacaa

SEQ ID NO: 3518864 - RNA, 17 nt, Human
ccaacagcuacaacagc

SEQ ID NO: 3518865 - RNA, 23 nt, Human
ccaacagcuacaacagccucacu

SEQ ID NO: 3518866 - RNA, 12 nt, Human
ccaacagcugga

SEQ ID NO: 3518867 - RNA, 22 nt, Human
ccaacagcuggacccugaccag

SEQ ID NO: 3518868 - RNA, 17 nt, Human
ccaacaggaggacaauu

SEQ ID NO: 3518869 - RNA, 18 nt, Human
ccaacaggaggacaauuc

SEQ ID NO: 3518870 - RNA, 23 nt, Human
ccaacagguggcaggaccaggac

SEQ ID NO: 3518871 - RNA, 19 nt, Human
ccaacagucaaaacagaga

SEQ ID NO: 3518872 - RNA, 15 nt, Human
ccaacagucauguuu

SEQ ID NO: 3518873 - RNA, 12 nt, Human
ccaacagugagu

SEQ ID NO: 3518874 - RNA, 14 nt, Human
ccaacagugugaag

SEQ ID NO: 3518875 - RNA, 19 nt, Human
ccaacagugugaaguuaga

SEQ ID NO: 3518876 - RNA, 23 nt, Human
ccaacaguguuaggccuggcaca

SEQ ID NO: 3518877 - RNA, 14 nt, Human
ccaacauacuccca

SEQ ID NO: 3518878 - RNA, 16 nt, Human
ccaacauacucccauc

SEQ ID NO: 3518879 - RNA, 18 nt, Human
ccaacauacucccaucug

SEQ ID NO: 3518880 - RNA, 16 nt, Human
ccaacaucaacaucuu

SEQ ID NO: 3518881 - RNA, 17 nt, Human
ccaacaucacagcccag

SEQ ID NO: 3518882 - RNA, 18 nt, Human
ccaacaucacagcccagc

SEQ ID NO: 3518883 - RNA, 15 nt, Human
ccaacauccacucuc

SEQ ID NO: 3518884 - RNA, 17 nt, Human
ccaacaucccauugccc

SEQ ID NO: 3518885 - RNA, 20 nt, Human
ccaacaucccauugcccugg

SEQ ID NO: 3518886 - RNA, 17 nt, Human
ccaacaucgugaaaccc

SEQ ID NO: 3518887 - RNA, 17 nt, Human
ccaacaugcacugaugu

SEQ ID NO: 3518888 - RNA, 23 nt, Human
ccaacauggagaaacccugucuc

SEQ ID NO: 3518889 - RNA, 17 nt, Human
ccaacauguggcuccuc

SEQ ID NO: 3518890 - RNA, 13 nt, Human
ccaacccagccgc

SEQ ID NO: 3518891 - RNA, 14 nt, Human
ccaacccaucagaa

SEQ ID NO: 3518892 - RNA, 17 nt, Human
ccaacccccaccccaca

SEQ ID NO: 3518893 - RNA, 19 nt, Human
ccaacccccaccccacacu

SEQ ID NO: 3518894 - RNA, 20 nt, Human
ccaacccccaccccacacuu

SEQ ID NO: 3518895 - RNA, 21 nt, Human
ccaacccccagcacccgggcu

SEQ ID NO: 3518896 - RNA, 18 nt, Human
ccaaccccccaccugcca

SEQ ID NO: 3518897 - RNA, 13 nt, Human
ccaaccccccagc

SEQ ID NO: 3518898 - RNA, 15 nt, Human
ccaaccccccagcac

SEQ ID NO: 3518899 - RNA, 19 nt, Human
ccaaccccccagcacugag

SEQ ID NO: 3518900 - RNA, 19 nt, Human
ccaaccccuuaagcccugg

SEQ ID NO: 3518901 - RNA, 22 nt, Human
ccaacccgucuggcccaccagg

SEQ ID NO: 3518902 - RNA, 15 nt, Human
ccaacccguggaggc

SEQ ID NO: 3518903 - RNA, 18 nt, Human
ccaacccguggaggcugc

SEQ ID NO: 3518904 - RNA, 12 nt, Human
ccaacccuagca

SEQ ID NO: 3518905 - RNA, 19 nt, Human
ccaacccuaucuccugaca

SEQ ID NO: 3518906 - RNA, 20 nt, Human
ccaacccuaucuccugacag

SEQ ID NO: 3518907 - RNA, 15 nt, Human
ccaacccucagagcc

SEQ ID NO: 3518908 - RNA, 12 nt, Human
ccaacccucauc

SEQ ID NO: 3518909 - RNA, 13 nt, Human
ccaacccucauca

SEQ ID NO: 3518910 - RNA, 21 nt, Human
ccaacccugccgucaccacca

SEQ ID NO: 3518911 - RNA, 18 nt, Human
ccaacccuggcacccagg

SEQ ID NO: 3518912 - RNA, 12 nt, Human
ccaacccuuccc

SEQ ID NO: 3518913 - RNA, 19 nt, Human
ccaagcaggacagugcuug

SEQ ID NO: 3518914 - RNA, 20 nt, Human
ccaagcaggagacgacaggc

SEQ ID NO: 3518915 - RNA, 13 nt, Human
ccaagcagggagg

SEQ ID NO: 3518916 - RNA, 20 nt, Human
ccaagcaguugggacuacag

SEQ ID NO: 3518917 - RNA, 13 nt, Human
ccaagcauagaga

SEQ ID NO: 3518918 - RNA, 16 nt, Human
ccaagcaucaggggga

SEQ ID NO: 3518919 - RNA, 19 nt, Human
ccaagcaucagggggaaga

SEQ ID NO: 3518920 - RNA, 13 nt, Human
ccaagcaucuugg

SEQ ID NO: 3518921 - RNA, 18 nt, Human
ccaagccaagggaaccug

SEQ ID NO: 3518922 - RNA, 12 nt, Human
ccaagccacuga

SEQ ID NO: 3518923 - RNA, 17 nt, Human
ccaagccagaggcuggg

SEQ ID NO: 3518924 - RNA, 22 nt, Human
ccaagccagggauggggccaca

SEQ ID NO: 3518925 - RNA, 23 nt, Human
ccaagccagggauggggccacag

SEQ ID NO: 3518926 - RNA, 20 nt, Human
ccaagccauggguagccugg

SEQ ID NO: 3518927 - RNA, 21 nt, Human
ccaagccauggguagccuggg

SEQ ID NO: 3518928 - RNA, 13 nt, Human
ccaagccguggcu

SEQ ID NO: 3518929 - RNA, 21 nt, Human
ccaagccguggcuucccgcuc

SEQ ID NO: 3518930 - RNA, 15 nt, Human
ccaagccuccacagc

SEQ ID NO: 3518931 - RNA, 18 nt, Human
ccaagccuccacagcgag

SEQ ID NO: 3518932 - RNA, 19 nt, Human
ccaagccuggucagcccaa

SEQ ID NO: 3518933 - RNA, 20 nt, Human
ccaagccuggucagcccaaa

SEQ ID NO: 3518934 - RNA, 22 nt, Human
ccaagccuuggggauucuucca

SEQ ID NO: 3518935 - RNA, 13 nt, Human
ccaagcgcccugg

SEQ ID NO: 3518936 - RNA, 14 nt, Human
ccaagcgcccuggc

SEQ ID NO: 3518937 - RNA, 22 nt, Human
ccaagcgcccuggcccccacau

SEQ ID NO: 3518938 - RNA, 15 nt, Human
ccaagcggugucucu

SEQ ID NO: 3518939 - RNA, 17 nt, Human
ccaagcuaagcacugcc

SEQ ID NO: 3518940 - RNA, 15 nt, Human
ccaagcuagaauucc

SEQ ID NO: 3518941 - RNA, 17 nt, Human
ccaagcuagaauucccu

SEQ ID NO: 3518942 - RNA, 22 nt, Human
ccaagcuagaauucccucucuc

SEQ ID NO: 3518943 - RNA, 13 nt, Human
ccaagcuauuccu

SEQ ID NO: 3518944 - RNA, 16 nt, Human
ccaagcuauuccuuuc

SEQ ID NO: 3518945 - RNA, 18 nt, Human
ccaagcuauuccuuuccc

SEQ ID NO: 3518946 - RNA, 20 nt, Human
ccaagcuauuccuuucccuu

SEQ ID NO: 3518947 - RNA, 19 nt, Human
ccaagcucacaguuccucg

SEQ ID NO: 3518948 - RNA, 14 nt, Human
ccaagcucagaagg

SEQ ID NO: 3518949 - RNA, 16 nt, Human
ccaagcucagaaggcu

SEQ ID NO: 3518950 - RNA, 17 nt, Human
ccaagcuccaagcccca

SEQ ID NO: 3518951 - RNA, 13 nt, Human
ccaagcuccuccu

SEQ ID NO: 3518952 - RNA, 14 nt, Human
ccaagcuccuuggg

SEQ ID NO: 3518953 - RNA, 17 nt, Human
ccaagcuccuugggagg

SEQ ID NO: 3518954 - RNA, 17 nt, Human
ccaagcucugcuccucu

SEQ ID NO: 3518955 - RNA, 18 nt, Human
ccaagcucugcuccucuc

SEQ ID NO: 3518956 - RNA, 23 nt, Human
ccaagcugaggugcccaggagaa

SEQ ID NO: 3518957 - RNA, 19 nt, Human
ccaagcugaguuuccuaug

SEQ ID NO: 3518958 - RNA, 22 nt, Human
ccaagcuggagugcaguggugc

SEQ ID NO: 3518959 - RNA, 14 nt, Human
ccaagcuggcuggg

SEQ ID NO: 3518960 - RNA, 17 nt, Human
ccaagcuggcuggggug

SEQ ID NO: 3518961 - RNA, 23 nt, Human
ccaagcuggcugggguggccugu

SEQ ID NO: 3518962 - RNA, 11 nt, Human
ccaagcugggc

SEQ ID NO: 3518963 - RNA, 18 nt, Human
ccaagcugggccccagcc

SEQ ID NO: 3518964 - RNA, 21 nt, Human
ccaagcugggccccagcccac

SEQ ID NO: 3518965 - RNA, 14 nt, Human
ccaagcugugccac

SEQ ID NO: 3518966 - RNA, 22 nt, Human
ccaagcugugccacccugggcu

SEQ ID NO: 3518967 - RNA, 14 nt, Human
ccaagcuguuuucu

SEQ ID NO: 3518968 - RNA, 11 nt, Human
ccaagcuuccc

SEQ ID NO: 3518969 - RNA, 16 nt, Human
ccaagcuuggcagccg

SEQ ID NO: 3518970 - RNA, 23 nt, Human
ccaagcuuguccaacccgaggcc

SEQ ID NO: 3518971 - RNA, 18 nt, Human
ccaagcuuuaaauuaugu

SEQ ID NO: 3518972 - RNA, 18 nt, Human
ccaaggaaaccacagcug

SEQ ID NO: 3518973 - RNA, 20 nt, Human
ccaaggaaaccacagcugcu

SEQ ID NO: 3518974 - RNA, 22 nt, Human
ccaaggacagaaggcuccugcc

SEQ ID NO: 3518975 - RNA, 13 nt, Human
ccaaggaccaggu

SEQ ID NO: 3518976 - RNA, 14 nt, Human
ccaaggaccccuca

SEQ ID NO: 3518977 - RNA, 16 nt, Human
ccaaggaccccucacc

SEQ ID NO: 3518978 - RNA, 18 nt, Human
ccaaggaccccucaccuu

SEQ ID NO: 3518979 - RNA, 15 nt, Human
ccaaggacugaggga

SEQ ID NO: 3518980 - RNA, 23 nt, Human
ccaaggacugagggacucugaag

SEQ ID NO: 3518981 - RNA, 17 nt, Human
ccaaggagcacaggucc

SEQ ID NO: 3518982 - RNA, 22 nt, Human
ccaaggagcugagaauagaagg

SEQ ID NO: 3518983 - RNA, 15 nt, Human
ccaaggagcugcuau

SEQ ID NO: 3518984 - RNA, 22 nt, Human
ccaaggagcugcuauagccugg

SEQ ID NO: 3518985 - RNA, 22 nt, Human
ccaaggagucacugagaccaag

SEQ ID NO: 3518986 - RNA, 11 nt, Human
ccaaggauccc

SEQ ID NO: 3518987 - RNA, 15 nt, Human
ccaaggcaaggcagg

SEQ ID NO: 3518988 - RNA, 17 nt, Human
ccaaggcaaggcaggug

SEQ ID NO: 3518989 - RNA, 22 nt, Human
ccaaggcaaggcaggugccucc

SEQ ID NO: 3518990 - RNA, 23 nt, Human
ccaaggcaaggcaggugccucca

SEQ ID NO: 3518991 - RNA, 21 nt, Human
ccaaggcaaggggugccuggg

SEQ ID NO: 3518992 - RNA, 21 nt, Human
ccaaggcagaagcagcagggg

SEQ ID NO: 3518993 - RNA, 16 nt, Human
ccaaggcagaggccug

SEQ ID NO: 3518994 - RNA, 16 nt, Human
ccaaggccaaaggaag

SEQ ID NO: 3518995 - RNA, 17 nt, Human
ccaaggccgaagcucug

SEQ ID NO: 3518996 - RNA, 20 nt, Human
ccaaggccgaagcucuggcu

SEQ ID NO: 3518997 - RNA, 19 nt, Human
ccaaggccuuccccuggca

SEQ ID NO: 3518998 - RNA, 14 nt, Human
ccaaggccuucucc

SEQ ID NO: 3518999 - RNA, 16 nt, Human
ccaaggccuucuccuc

SEQ ID NO: 3519000 - RNA, 20 nt, Human
ccaaggcgggcggaucacuu

SEQ ID NO: 3519001 - RNA, 18 nt, Human
ccaaggcuagaaccaccu

SEQ ID NO: 3519002 - RNA, 19 nt, Human
ccaaggcugauuaaaccaa

SEQ ID NO: 3519003 - RNA, 16 nt, Human
ccaaggcuuucucuac

SEQ ID NO: 3519004 - RNA, 21 nt, Human
ccaagggaaaggggugcuuuu

SEQ ID NO: 3519005 - RNA, 22 nt, Human
ccaagggaaaggggugcuuuua

SEQ ID NO: 3519006 - RNA, 17 nt, Human
ccaagggaaccuguguc

SEQ ID NO: 3519007 - RNA, 18 nt, Human
ccaagggaaccugugucc

SEQ ID NO: 3519008 - RNA, 16 nt, Human
ccaagggaauauugcc

SEQ ID NO: 3519009 - RNA, 21 nt, Human
ccaagggaucugguccuaccc

SEQ ID NO: 3519010 - RNA, 15 nt, Human
ccaagggcagaaagu

SEQ ID NO: 3519011 - RNA, 18 nt, Human
ccaagggccgacuaagag

SEQ ID NO: 3519012 - RNA, 16 nt, Human
ccaagggccuggccug

SEQ ID NO: 3519013 - RNA, 14 nt, Human
ccaagggcuucugc

SEQ ID NO: 3519014 - RNA, 19 nt, Human
ccaagggcuucugcacccu

SEQ ID NO: 3519015 - RNA, 21 nt, Human
ccaagggcuuuguuuugcaca

SEQ ID NO: 3519016 - RNA, 19 nt, Human
ccaagggguccccuccagg

SEQ ID NO: 3519017 - RNA, 23 nt, Human
ccaaggguauccaaguuggacug

SEQ ID NO: 3519018 - RNA, 17 nt, Human
ccaaggucuucagccau

SEQ ID NO: 3519019 - RNA, 19 nt, Human
ccaaggucuucagccauca

SEQ ID NO: 3519020 - RNA, 13 nt, Human
ccaaggugggagg

SEQ ID NO: 3519021 - RNA, 18 nt, Human
ccaaggugggaggauugc

SEQ ID NO: 3519022 - RNA, 23 nt, Human
ccaaggugggcugagcccuggca

SEQ ID NO: 3519023 - RNA, 21 nt, Human
ccaaggugucauuuauguguc

SEQ ID NO: 3519024 - RNA, 13 nt, Human
ccaagguguccua

SEQ ID NO: 3519025 - RNA, 17 nt, Human
ccaagguguccuacaga

SEQ ID NO: 3519026 - RNA, 19 nt, Human
ccaagguguccuacagaaa

SEQ ID NO: 3519027 - RNA, 21 nt, Human
ccaagguguccuacagaaaaa

SEQ ID NO: 3519028 - RNA, 20 nt, Human
ccaagguuggagcccagggc

SEQ ID NO: 3519029 - RNA, 23 nt, Human
ccaagguuuggggaagaacgaag

SEQ ID NO: 3519030 - RNA, 19 nt, Human
ccaaguaaagguuaaaaau

SEQ ID NO: 3519031 - RNA, 13 nt, Human
cauguauaaauga

SEQ ID NO: 3519032 - RNA, 15 nt, Human
cauguauaaauguga

SEQ ID NO: 3519033 - RNA, 20 nt, Human
cauguauaauauuuuuaauu

SEQ ID NO: 3519034 - RNA, 18 nt, Human
cauguaugucuuggacac

SEQ ID NO: 3519035 - RNA, 21 nt, Human
cauguaugucuuggacacugu

SEQ ID NO: 3519036 - RNA, 17 nt, Human
cauguauuggccuggag

SEQ ID NO: 3519037 - RNA, 19 nt, Human
cauguauuggccuggaggu

SEQ ID NO: 3519038 - RNA, 15 nt, Human
cauguauuuauguaa

SEQ ID NO: 3519039 - RNA, 18 nt, Human
cauguauuuguuugcaua

SEQ ID NO: 3519040 - RNA, 21 nt, Human
caugucaaacaugagaugugu

SEQ ID NO: 3519041 - RNA, 19 nt, Human
caugucaagagucgcugug

SEQ ID NO: 3519042 - RNA, 23 nt, Human
caugucaccguggaccuuccugc

SEQ ID NO: 3519043 - RNA, 13 nt, Human
caugucacugugg

SEQ ID NO: 3519044 - RNA, 14 nt, Human
caugucacuguggu

SEQ ID NO: 3519045 - RNA, 13 nt, Human
caugucagacaca

SEQ ID NO: 3519046 - RNA, 23 nt, Human
caugucagcaaaaagcaaaauca

SEQ ID NO: 3519047 - RNA, 18 nt, Human
cauguccaagaagcccag

SEQ ID NO: 3519048 - RNA, 19 nt, Human
cauguccaagaagcccagg

SEQ ID NO: 3519049 - RNA, 20 nt, Human
cauguccaagaagcccagga

SEQ ID NO: 3519050 - RNA, 19 nt, Human
cauguccagcaccuugugc

SEQ ID NO: 3519051 - RNA, 16 nt, Human
caugucccuaccgagu

SEQ ID NO: 3519052 - RNA, 23 nt, Human
caugucccuaccgagucucuucu

SEQ ID NO: 3519053 - RNA, 18 nt, Human
cauguccuaugugugacu

SEQ ID NO: 3519054 - RNA, 22 nt, Human
cauguccugccuauuaucuguc

SEQ ID NO: 3519055 - RNA, 18 nt, Human
cauguccugugucaguuu

SEQ ID NO: 3519056 - RNA, 16 nt, Human
caccugcuucucugcc

SEQ ID NO: 3519057 - RNA, 12 nt, Human
caccuggacccc

SEQ ID NO: 3519058 - RNA, 15 nt, Human
caccuggaccccugc

SEQ ID NO: 3519059 - RNA, 23 nt, Human
caccuggcaucgcaccauucuga

SEQ ID NO: 3519060 - RNA, 12 nt, Human
caccuggccacc

SEQ ID NO: 3519061 - RNA, 14 nt, Human
caccuggccaccug

SEQ ID NO: 3519062 - RNA, 15 nt, Human
caccuggccaccuga

SEQ ID NO: 3519063 - RNA, 17 nt, Human
caccuggccaccugagg

SEQ ID NO: 3519064 - RNA, 15 nt, Human
caccuggccccaugu

SEQ ID NO: 3519065 - RNA, 16 nt, Human
caccuggcccucucug

SEQ ID NO: 3519066 - RNA, 20 nt, Human
caccuggcccugcuuccugc

SEQ ID NO: 3519067 - RNA, 13 nt, Human
caccuggcccugg

SEQ ID NO: 3519068 - RNA, 14 nt, Human
caccuggcccuggg

SEQ ID NO: 3519069 - RNA, 19 nt, Human
caccuggcccuggggccug

SEQ ID NO: 3519070 - RNA, 14 nt, Human
caccuggccucugc

SEQ ID NO: 3519071 - RNA, 17 nt, Human
caccuggccucugcacu

SEQ ID NO: 3519072 - RNA, 18 nt, Human
caccuggccucugcacuc

SEQ ID NO: 3519073 - RNA, 19 nt, Human
caccuggccucugcacucc

SEQ ID NO: 3519074 - RNA, 16 nt, Human
caccuggcucucaccu

SEQ ID NO: 3519075 - RNA, 13 nt, Human
caccuggcucugu

SEQ ID NO: 3519076 - RNA, 14 nt, Human
caccuggcucugug

SEQ ID NO: 3519077 - RNA, 19 nt, Human
caccuggcugagccuggcu

SEQ ID NO: 3519078 - RNA, 14 nt, Human
caccuggcuuguuu

SEQ ID NO: 3519079 - RNA, 16 nt, Human
caccuggcuuguuuau

SEQ ID NO: 3519080 - RNA, 16 nt, Human
caccugggagaaaucu

SEQ ID NO: 3519081 - RNA, 14 nt, Human
caccugggcccugg

SEQ ID NO: 3519082 - RNA, 19 nt, Human
caccugggcccuggggccu

SEQ ID NO: 3519083 - RNA, 22 nt, Human
caccuggggagugggacagagu

SEQ ID NO: 3519084 - RNA, 23 nt, Human
caccuggggcagucaccugccca

SEQ ID NO: 3519085 - RNA, 20 nt, Human
caccuggggugugggaggcc

SEQ ID NO: 3519086 - RNA, 18 nt, Human
caccugggucuuuaugca

SEQ ID NO: 3519087 - RNA, 20 nt, Human
caccugguacucccucucag

SEQ ID NO: 3519088 - RNA, 20 nt, Human
caccugguuccggaauccug

SEQ ID NO: 3519089 - RNA, 14 nt, Human
caccuguaaaccug

SEQ ID NO: 3519090 - RNA, 16 nt, Human
caccuguaaaccugag

SEQ ID NO: 3519091 - RNA, 22 nt, Human
ccaccuccccuauccacccagc

SEQ ID NO: 3519092 - RNA, 15 nt, Human
ccaccuccccuuggg

SEQ ID NO: 3519093 - RNA, 16 nt, Human
ccaccuccccuugggc

SEQ ID NO: 3519094 - RNA, 15 nt, Human
ccaccucccucacca

SEQ ID NO: 3519095 - RNA, 16 nt, Human
ccaccucccugcccag

SEQ ID NO: 3519096 - RNA, 18 nt, Human
ccaccuccuaaaaggccc

SEQ ID NO: 3519097 - RNA, 17 nt, Human
ccaccuccuucucuguc

SEQ ID NO: 3519098 - RNA, 14 nt, Human
ccaccucuccaagg

SEQ ID NO: 3519099 - RNA, 16 nt, Human
ccaccucuccaagggc

SEQ ID NO: 3519100 - RNA, 17 nt, Human
ccaccucuccaagggcu

SEQ ID NO: 3519101 - RNA, 17 nt, Human
ccaccucuccccaccuu

SEQ ID NO: 3519102 - RNA, 14 nt, Human
ccaccucucucacu

SEQ ID NO: 3519103 - RNA, 10 nt, Human
ccaccucugc

SEQ ID NO: 3519104 - RNA, 20 nt, Human
ccaccucugcggaccccagc

SEQ ID NO: 3519105 - RNA, 15 nt, Human
ccaccucugugaccu

SEQ ID NO: 3519106 - RNA, 18 nt, Human
ccaccucugugaccucag

SEQ ID NO: 3519107 - RNA, 19 nt, Human
ccaccucugugaccucagg

SEQ ID NO: 3519108 - RNA, 23 nt, Human
ccaccucuucucuuccuguaaca

SEQ ID NO: 3519109 - RNA, 16 nt, Human
ccaccugacacaccag

SEQ ID NO: 3519110 - RNA, 12 nt, Human
ccaccugagcuu

SEQ ID NO: 3519111 - RNA, 20 nt, Human
ccaccugaggaacugucucg

SEQ ID NO: 3519112 - RNA, 15 nt, Human
ccaccugcagggcug

SEQ ID NO: 3519113 - RNA, 18 nt, Human
ccaccugcaucuggggcc

SEQ ID NO: 3519114 - RNA, 16 nt, Human
ccaccugccagggaca

SEQ ID NO: 3519115 - RNA, 22 nt, Human
ccaccugccagggacagagggg

SEQ ID NO: 3519116 - RNA, 20 nt, Human
ccaccugcccaucacagggu

SEQ ID NO: 3519117 - RNA, 12 nt, Human
ccaccugccccc

SEQ ID NO: 3519118 - RNA, 22 nt, Human
ccaccugcccccuucucccaca

SEQ ID NO: 3519119 - RNA, 22 nt, Human
ccaccugcccuuuuuucugccu

SEQ ID NO: 3519120 - RNA, 16 nt, Human
ccaccugccuggccgg

SEQ ID NO: 3519121 - RNA, 14 nt, Human
ccaccugcucugcu

SEQ ID NO: 3519122 - RNA, 14 nt, Human
ccaccuggaagccc

SEQ ID NO: 3519123 - RNA, 21 nt, Human
ccaccuggaccccugcauugg

SEQ ID NO: 3519124 - RNA, 21 nt, Human
ccaccuggccccaugucucuc

SEQ ID NO: 3519125 - RNA, 17 nt, Human
ccaccuggccucugcac

SEQ ID NO: 3519126 - RNA, 20 nt, Human
ccaccuggccucugcacucc

SEQ ID NO: 3519127 - RNA, 18 nt, Human
ccaccuggcucucaccuc

SEQ ID NO: 3519128 - RNA, 14 nt, Human
ccaccuggggcagu

SEQ ID NO: 3519129 - RNA, 23 nt, Human
ccaccugguacucccucucagga

SEQ ID NO: 3519130 - RNA, 14 nt, Human
ccaccugucccacc

SEQ ID NO: 3519131 - RNA, 18 nt, Human
ccaccugucccaccucaa

SEQ ID NO: 3519132 - RNA, 11 nt, Human
ccaccugucuc

SEQ ID NO: 3519133 - RNA, 12 nt, Human
ccaccugucuca

SEQ ID NO: 3519134 - RNA, 18 nt, Human
ccaccugucucagccucc

SEQ ID NO: 3519135 - RNA, 20 nt, Human
ccaccugucucagccuccca

SEQ ID NO: 3519136 - RNA, 14 nt, Human
ccaccuuaaauuaa

SEQ ID NO: 3519137 - RNA, 16 nt, Human
ccaccuuaaauuaaac

SEQ ID NO: 3519138 - RNA, 20 nt, Human
ccaccuuaaauuaaacaauu

SEQ ID NO: 3519139 - RNA, 19 nt, Human
ccaccuucaauuccugggc

SEQ ID NO: 3519140 - RNA, 20 nt, Human
ccaccuucaauuccugggcc

SEQ ID NO: 3519141 - RNA, 19 nt, Human
ccaccuucccagcucuccc

SEQ ID NO: 3519142 - RNA, 21 nt, Human
ccaccuucccagcucucccuc

SEQ ID NO: 3519143 - RNA, 14 nt, Human
ccaccuugcgggga

SEQ ID NO: 3519144 - RNA, 14 nt, Human
ccaccuuggcugca

SEQ ID NO: 3519145 - RNA, 18 nt, Human
ccaccuuggcugcaggga

SEQ ID NO: 3519146 - RNA, 18 nt, Human
ccaccuuguuggagccug

SEQ ID NO: 3519147 - RNA, 23 nt, Human
ccaccuuuccucaaauguugaca

SEQ ID NO: 3519148 - RNA, 20 nt, Human
ccaccuuuguuucuccccca

SEQ ID NO: 3519149 - RNA, 23 nt, Human
ccacgaauuugcuggggaaucuc

SEQ ID NO: 3519150 - RNA, 16 nt, Human
ccacgagagcgcagca

SEQ ID NO: 3519151 - RNA, 19 nt, Human
ccacgagggcuggcuggcc

SEQ ID NO: 3519152 - RNA, 19 nt, Human
ccacgauccugccacccug

SEQ ID NO: 3519153 - RNA, 17 nt, Human
ccacgauguggcccugg

SEQ ID NO: 3519154 - RNA, 19 nt, Human
ccacgauuuucuccagcuc

SEQ ID NO: 3519155 - RNA, 22 nt, Human
ccacgauuuucuccagcucaga

SEQ ID NO: 3519156 - RNA, 13 nt, Human
ccacgcacuccau

SEQ ID NO: 3519157 - RNA, 14 nt, Human
ccacgccacagccc

SEQ ID NO: 3519158 - RNA, 17 nt, Human
ccacgcccccacuggug

SEQ ID NO: 3519159 - RNA, 22 nt, Human
ccacgcccguccugccuguggc

SEQ ID NO: 3519160 - RNA, 21 nt, Human
ccacgcccuccccuccccugc

SEQ ID NO: 3519161 - RNA, 17 nt, Human
ccacgccuguaauccca

SEQ ID NO: 3519162 - RNA, 19 nt, Human
ccacgcugacuacagggcc

SEQ ID NO: 3519163 - RNA, 14 nt, Human
ccacgcugucucca

SEQ ID NO: 3519164 - RNA, 18 nt, Human
ccacgcugucuccagacc

SEQ ID NO: 3519165 - RNA, 14 nt, Human
ccacgcuucuccgg

SEQ ID NO: 3519166 - RNA, 17 nt, Human
ccacgcuucuccggauc

SEQ ID NO: 3519167 - RNA, 20 nt, Human
ccacggaaaaugccaaucuc

SEQ ID NO: 3519168 - RNA, 17 nt, Human
ccacggacgcuggcucc

SEQ ID NO: 3519169 - RNA, 20 nt, Human
ccacggacguuuccaucagg

SEQ ID NO: 3519170 - RNA, 17 nt, Human
ccacggacuccagucug

SEQ ID NO: 3519171 - RNA, 20 nt, Human
ccacggagccacuccucuga

SEQ ID NO: 3519172 - RNA, 20 nt, Human
ccacggcaccugggcccugg

SEQ ID NO: 3519173 - RNA, 13 nt, Human
ccacggccacugg

SEQ ID NO: 3519174 - RNA, 13 nt, Human
ccacggccaggcc

SEQ ID NO: 3519175 - RNA, 14 nt, Human
ccacggccaggcca

SEQ ID NO: 3519176 - RNA, 18 nt, Human
ccacggcucuaggugggg

SEQ ID NO: 3519177 - RNA, 22 nt, Human
ccacgggacaucacaggguggg

SEQ ID NO: 3519178 - RNA, 17 nt, Human
ccacggucuguucuuga

SEQ ID NO: 3519179 - RNA, 21 nt, Human
ccacggucuguucuugaagca

SEQ ID NO: 3519180 - RNA, 17 nt, Human
ccacgguggucacugga

SEQ ID NO: 3519181 - RNA, 14 nt, Human
ccacgguguucugu

SEQ ID NO: 3519182 - RNA, 15 nt, Human
ccacgucccccuggg

SEQ ID NO: 3519183 - RNA, 15 nt, Human
ccacguccugucagu

SEQ ID NO: 3519184 - RNA, 19 nt, Human
ccacguccugucagugccg

SEQ ID NO: 3519185 - RNA, 23 nt, Human
ccacgucuauuucaucagaacag

SEQ ID NO: 3519186 - RNA, 22 nt, Human
ccacgucugcgccgccgccgga

SEQ ID NO: 3519187 - RNA, 17 nt, Human
ccacgugacagugccug

SEQ ID NO: 3519188 - RNA, 23 nt, Human
ccacgugccaggcccggggcugg

SEQ ID NO: 3519189 - RNA, 17 nt, Human
ccacgugcguguuuucu

SEQ ID NO: 3519190 - RNA, 15 nt, Human
ccacgugcuaccccc

SEQ ID NO: 3519191 - RNA, 15 nt, Human
ccacgugucuuccac

SEQ ID NO: 3519192 - RNA, 15 nt, Human
ccacguucaccccuc

SEQ ID NO: 3519193 - RNA, 15 nt, Human
ccacguuccuuacug

SEQ ID NO: 3519194 - RNA, 14 nt, Human
ccacguucucucug

SEQ ID NO: 3519195 - RNA, 23 nt, Human
ccacguucugcucaucauucucu

SEQ ID NO: 3519196 - RNA, 20 nt, Human
ccacguuggagaagcccgug

SEQ ID NO: 3519197 - RNA, 12 nt, Human
ccacuaaaaaua

SEQ ID NO: 3519198 - RNA, 23 nt, Human
ccacuaaaaauauuguuucugca

SEQ ID NO: 3519199 - RNA, 11 nt, Human
ccacuaacuag

SEQ ID NO: 3519200 - RNA, 18 nt, Human
ccacuaagaacaccugca

SEQ ID NO: 3519201 - RNA, 13 nt, Human
ccacuguccuggg

SEQ ID NO: 3519202 - RNA, 14 nt, Human
ccacuguccugggc

SEQ ID NO: 3519203 - RNA, 19 nt, Human
ccacuguccugggccugca

SEQ ID NO: 3519204 - RNA, 16 nt, Human
ccacuguccugggcgc

SEQ ID NO: 3519205 - RNA, 15 nt, Human
ccacugugaagagaa

SEQ ID NO: 3519206 - RNA, 18 nt, Human
ccacugugccucagagac

SEQ ID NO: 3519207 - RNA, 20 nt, Human
ccacugugccucagagacca

SEQ ID NO: 3519208 - RNA, 15 nt, Human
ccacugugccuuugc

SEQ ID NO: 3519209 - RNA, 17 nt, Human
ccacuguuucucuugag

SEQ ID NO: 3519210 - RNA, 19 nt, Human
ccacuguuucucuugagcu

SEQ ID NO: 3519211 - RNA, 19 nt, Human
ccacuuaaaaaauguccau

SEQ ID NO: 3519212 - RNA, 21 nt, Human
ccacuuacauuuacaaacuga

SEQ ID NO: 3519213 - RNA, 14 nt, Human
ccacuuaccuucaa

SEQ ID NO: 3519214 - RNA, 22 nt, Human
ccacuuaccuucaauaaaguau

SEQ ID NO: 3519215 - RNA, 14 nt, Human
ccacuucaaaacaa

SEQ ID NO: 3519216 - RNA, 14 nt, Human
ccacuucagccucc

SEQ ID NO: 3519217 - RNA, 23 nt, Human
ccacuucauucuugaaagcugug

SEQ ID NO: 3519218 - RNA, 15 nt, Human
ccacuucccacccug

SEQ ID NO: 3519219 - RNA, 15 nt, Human
ccacuucccugacac

SEQ ID NO: 3519220 - RNA, 23 nt, Human
ccacuucccuggguuagacugcc

SEQ ID NO: 3519221 - RNA, 13 nt, Human
ccacuuccuuuua

SEQ ID NO: 3519222 - RNA, 18 nt, Human
ccacuucucaucacacac

SEQ ID NO: 3519223 - RNA, 20 nt, Human
ccacuucucaucacacacau

SEQ ID NO: 3519224 - RNA, 23 nt, Human
ccacuucucaucacacacaugga

SEQ ID NO: 3519225 - RNA, 19 nt, Human
ccacuucugacagccucag

SEQ ID NO: 3519226 - RNA, 14 nt, Human
ccacuucugccaga

SEQ ID NO: 3519227 - RNA, 15 nt, Human
ccacuucuggguggg

SEQ ID NO: 3519228 - RNA, 14 nt, Human
ccacuucuggucaa

SEQ ID NO: 3519229 - RNA, 18 nt, Human
ccacuucuuccuuucucu

SEQ ID NO: 3519230 - RNA, 20 nt, Human
ccacuucuuguuccccacug

SEQ ID NO: 3519231 - RNA, 17 nt, Human
ccacuugaaauguuagu

SEQ ID NO: 3519232 - RNA, 22 nt, Human
ccacuugaggccugaucugccc

SEQ ID NO: 3519233 - RNA, 12 nt, Human
ccacuugccucu

SEQ ID NO: 3519234 - RNA, 22 nt, Human
ccacuugccucuuccuugaaga

SEQ ID NO: 3519235 - RNA, 21 nt, Human
ccacuugcugcacucuugcac

SEQ ID NO: 3519236 - RNA, 18 nt, Human
ccacuuggcaucagcugg

SEQ ID NO: 3519237 - RNA, 21 nt, Human
ccacuuggcuacacagggaug

SEQ ID NO: 3519238 - RNA, 15 nt, Human
ccacuuggucuguga

SEQ ID NO: 3519239 - RNA, 18 nt, Human
ccacuugucacugacaca

SEQ ID NO: 3519240 - RNA, 20 nt, Human
ccacuugucccacuaucugg

SEQ ID NO: 3519241 - RNA, 21 nt, Human
ccacuuguccuuagccuggac

SEQ ID NO: 3519242 - RNA, 14 nt, Human
ccacuuuauugcca

SEQ ID NO: 3519243 - RNA, 15 nt, Human
ccacuuucagcuguc

SEQ ID NO: 3519244 - RNA, 20 nt, Human
ccacuuugcacagcucuccg

SEQ ID NO: 3519245 - RNA, 21 nt, Human
ccacuuugcauaugagccgug

SEQ ID NO: 3519246 - RNA, 17 nt, Human
ccacuuugcuguuccuu

SEQ ID NO: 3519247 - RNA, 15 nt, Human
ccacuuuguucuuua

SEQ ID NO: 3519248 - RNA, 20 nt, Human
ccacuuuguucuuuaggaga

SEQ ID NO: 3519249 - RNA, 16 nt, Human
ccacuuuuauucauuu

SEQ ID NO: 3519250 - RNA, 12 nt, Human
ccacuuuuccag

SEQ ID NO: 3519251 - RNA, 14 nt, Human
ccacuuuuguucuu

SEQ ID NO: 3519252 - RNA, 21 nt, Human
ccacuuuuguucuugguuugu

SEQ ID NO: 3519253 - RNA, 22 nt, Human
ccacuuuuguucuugguuugua

SEQ ID NO: 3519254 - RNA, 14 nt, Human
ccacuuuuugcagc

SEQ ID NO: 3519255 - RNA, 18 nt, Human
ccagaaacgccacauccc

SEQ ID NO: 3519256 - RNA, 15 nt, Human
cauuuuauauugaaa

SEQ ID NO: 3519257 - RNA, 18 nt, Human
cauuuuauauugaaaaaa

SEQ ID NO: 3519258 - RNA, 22 nt, Human
cauuuuauauugaaaaaaauaa

SEQ ID NO: 3519259 - RNA, 14 nt, Human
cauuuuauggugcc

SEQ ID NO: 3519260 - RNA, 17 nt, Human
cauuuuauggugccuag

SEQ ID NO: 3519261 - RNA, 13 nt, Human
cauuuuauugcuu

SEQ ID NO: 3519262 - RNA, 14 nt, Human
cauuuuauugcuug

SEQ ID NO: 3519263 - RNA, 22 nt, Human
cauuuuauuuuauuaugcauga

SEQ ID NO: 3519264 - RNA, 11 nt, Human
cauuuucaucu

SEQ ID NO: 3519265 - RNA, 17 nt, Human
cauuuuccauauccugg

SEQ ID NO: 3519266 - RNA, 12 nt, Human
cauuuucccaga

SEQ ID NO: 3519267 - RNA, 21 nt, Human
cauuuuccccccacucucccc

SEQ ID NO: 3519268 - RNA, 17 nt, Human
cauuuuccucugcuuug

SEQ ID NO: 3519269 - RNA, 20 nt, Human
cauuuuccucugcuuugaaa

SEQ ID NO: 3519270 - RNA, 14 nt, Human
cauuuucuaagaaa

SEQ ID NO: 3519271 - RNA, 12 nt, Human
cauuuucuagau

SEQ ID NO: 3519272 - RNA, 21 nt, Human
cauuuucuagauacaauaaau

SEQ ID NO: 3519273 - RNA, 23 nt, Human
cauuuucuagauacaauaaauug

SEQ ID NO: 3519274 - RNA, 14 nt, Human
cauuuucucucagg

SEQ ID NO: 3519275 - RNA, 12 nt, Human
cauuuucucuuu

SEQ ID NO: 3519276 - RNA, 15 nt, Human
cauuuucugaaacua

SEQ ID NO: 3519277 - RNA, 12 nt, Human
cauuuucugcaa

SEQ ID NO: 3519278 - RNA, 17 nt, Human
cauuuucugcaagccug

SEQ ID NO: 3519279 - RNA, 18 nt, Human
cauuuucugcaagccugc

SEQ ID NO: 3519280 - RNA, 10 nt, Human
cauuuucugg

SEQ ID NO: 3519281 - RNA, 16 nt, Human
cauuuucuuaauccag

SEQ ID NO: 3519282 - RNA, 20 nt, Human
cauuuucuuauugcgcugcu

SEQ ID NO: 3519283 - RNA, 12 nt, Human
cauuuugaaagu

SEQ ID NO: 3519284 - RNA, 22 nt, Human
cauuuugaagcuaauuauuuua

SEQ ID NO: 3519285 - RNA, 15 nt, Human
cauuuugagaacaaa

SEQ ID NO: 3519286 - RNA, 22 nt, Human
cauuuugagcugaaaugcugca

SEQ ID NO: 3519287 - RNA, 14 nt, Human
cauuuugcaaaauu

SEQ ID NO: 3519288 - RNA, 15 nt, Human
cauuuugcaaaauuu

SEQ ID NO: 3519289 - RNA, 17 nt, Human
cauuuugcaaaauuucc

SEQ ID NO: 3519290 - RNA, 16 nt, Human
cauuuugcagcaguga

SEQ ID NO: 3519291 - RNA, 18 nt, Human
cauuuugcagcagugagu

SEQ ID NO: 3519292 - RNA, 20 nt, Human
cauuuugcagcagugagucu

SEQ ID NO: 3519293 - RNA, 18 nt, Human
cauuuugcuaaaugugaa

SEQ ID NO: 3519294 - RNA, 17 nt, Human
cauuuugcuauuguaaa

SEQ ID NO: 3519295 - RNA, 19 nt, Human
cauuuugcuauuguaaaua

SEQ ID NO: 3519296 - RNA, 13 nt, Human
cauuuugcuuuaa

SEQ ID NO: 3519297 - RNA, 14 nt, Human
cauuuugcuuuaau

SEQ ID NO: 3519298 - RNA, 21 nt, Human
cauuuuggcgcuauuacaaau

SEQ ID NO: 3519299 - RNA, 19 nt, Human
cauuuuggcgcucgaaguu

SEQ ID NO: 3519300 - RNA, 20 nt, Human
cauuuugggguacccacugc

SEQ ID NO: 3519301 - RNA, 21 nt, Human
cauuuugggguacccacugcu

SEQ ID NO: 3519302 - RNA, 23 nt, Human
cauuuugggguacccacugcucu

SEQ ID NO: 3519303 - RNA, 22 nt, Human
cauuuuggugucuuucucuuuu

SEQ ID NO: 3519304 - RNA, 16 nt, Human
cauuuugguucuucuc

SEQ ID NO: 3519305 - RNA, 14 nt, Human
cauuuuguauaauu

SEQ ID NO: 3519306 - RNA, 15 nt, Human
cauuuuguauaauug

SEQ ID NO: 3519307 - RNA, 21 nt, Human
cauuuuguauaauuguaucgu

SEQ ID NO: 3519308 - RNA, 13 nt, Human
cauuuugugaagc

SEQ ID NO: 3519309 - RNA, 18 nt, Human
cauuuugugaagcccugu

SEQ ID NO: 3519310 - RNA, 12 nt, Human
cauuuugugaau

SEQ ID NO: 3519311 - RNA, 21 nt, Human
cauuuugugaauggauuggau

SEQ ID NO: 3519312 - RNA, 15 nt, Human
cauuuuguuguaaaa

SEQ ID NO: 3519313 - RNA, 19 nt, Human
cauuuuguuguaaaaagaa

SEQ ID NO: 3519314 - RNA, 23 nt, Human
cauuuuuaaaguagaagaggguu

SEQ ID NO: 3519315 - RNA, 16 nt, Human
cauuuuuaaauuguua

SEQ ID NO: 3519316 - RNA, 21 nt, Human
cauuuuuaagugcugcauuua

SEQ ID NO: 3519317 - RNA, 16 nt, Human
cauuuuuacaauguaa

SEQ ID NO: 3519318 - RNA, 18 nt, Human
cauuuuuaccaucacuga

SEQ ID NO: 3519319 - RNA, 20 nt, Human
cauuuuuacuauuguuacau

SEQ ID NO: 3519320 - RNA, 12 nt, Human
cauuuuuacugu

SEQ ID NO: 3519321 - RNA, 18 nt, Human
cauuuuuaguagagacag

SEQ ID NO: 3519322 - RNA, 19 nt, Human
cauuuuuaguagagacagg

SEQ ID NO: 3519323 - RNA, 12 nt, Human
cauuuuuaucua

SEQ ID NO: 3519324 - RNA, 22 nt, Human
cauuuuuauuacccuucuuucc

SEQ ID NO: 3519325 - RNA, 20 nt, Human
cauuuuuauuucaaaauaua

SEQ ID NO: 3519326 - RNA, 23 nt, Human
cauuuuuauuucagauuuugaua

SEQ ID NO: 3519327 - RNA, 14 nt, Human
cauuuuucaaagca

SEQ ID NO: 3519328 - RNA, 14 nt, Human
cauuuuucaacuuu

SEQ ID NO: 3519329 - RNA, 18 nt, Human
cauuuuucaacuuugaau

SEQ ID NO: 3519330 - RNA, 17 nt, Human
cauuuuucaauagcaca

SEQ ID NO: 3519331 - RNA, 18 nt, Human
cauuuuucagauauaaaa

SEQ ID NO: 3519332 - RNA, 18 nt, Human
cauuuuuccuaacaggau

SEQ ID NO: 3519333 - RNA, 17 nt, Human
cauuuuugauuuaugca

SEQ ID NO: 3519334 - RNA, 12 nt, Human
cauuuuuguaca

SEQ ID NO: 3519335 - RNA, 21 nt, Human
cauuuuuguacaguuugcugu

SEQ ID NO: 3519336 - RNA, 22 nt, Human
cauuuuuguacaguuugcugua

SEQ ID NO: 3519337 - RNA, 20 nt, Human
cauuuuuguacuaacuagca

SEQ ID NO: 3519338 - RNA, 23 nt, Human
cauuuuuguuucuaccucccaga

SEQ ID NO: 3519339 - RNA, 13 nt, Human
cauuuuuuaagcu

SEQ ID NO: 3519340 - RNA, 14 nt, Human
cauuuuuuaggaaa

SEQ ID NO: 3519341 - RNA, 15 nt, Human
cauuuuuuaggaaau

SEQ ID NO: 3519342 - RNA, 20 nt, Human
cauuuuuuauauauaugcau

SEQ ID NO: 3519343 - RNA, 19 nt, Human
cauuuuuugggcagcaauu

SEQ ID NO: 3519344 - RNA, 23 nt, Human
cauuuuuuuuaagaaaaaggaug

SEQ ID NO: 3519345 - RNA, 15 nt, Human
cauuuuuuuucuuug

SEQ ID NO: 3519346 - RNA, 22 nt, Human
ccaauuguugacaguucugaag

SEQ ID NO: 3519347 - RNA, 20 nt, Human
ccaauuuguaaaaacagcau

SEQ ID NO: 3519348 - RNA, 21 nt, Human
ccaauuuuaauuuaguaaaug

SEQ ID NO: 3519349 - RNA, 12 nt, Human
ccaauuuuccuu

SEQ ID NO: 3519350 - RNA, 13 nt, Human
ccaauuuuucugc

SEQ ID NO: 3519351 - RNA, 14 nt, Human
ccaauuuuucugca

SEQ ID NO: 3519352 - RNA, 17 nt, Human
ccaauuuuucugcacug

SEQ ID NO: 3519353 - RNA, 23 nt, Human
ccaauuuuuuaagugaaaauaua

SEQ ID NO: 3519354 - RNA, 23 nt, Human
ccaauuuuuuguucuucagagau

SEQ ID NO: 3519355 - RNA, 14 nt, Human
ccacaaagccuuau

SEQ ID NO: 3519356 - RNA, 23 nt, Human
ccacaaagccuuaucaagugucu

SEQ ID NO: 3519357 - RNA, 9 nt, Human
ccacaaagg

SEQ ID NO: 3519358 - RNA, 18 nt, Human
ccacaaaggagagcuagc

SEQ ID NO: 3519359 - RNA, 16 nt, Human
ccacaaaggcaaaggg

SEQ ID NO: 3519360 - RNA, 20 nt, Human
ccacaaaggcaaagggucca

SEQ ID NO: 3519361 - RNA, 17 nt, Human
ccacaaauaaaugacaa

SEQ ID NO: 3519362 - RNA, 22 nt, Human
ccacaaaugggaaaaccagacu

SEQ ID NO: 3519363 - RNA, 23 nt, Human
ccacaaaugggcgccccccccuc

SEQ ID NO: 3519364 - RNA, 12 nt, Human
ccacaacaugag

SEQ ID NO: 3519365 - RNA, 16 nt, Human
ccacaacaugaggcca

SEQ ID NO: 3519366 - RNA, 15 nt, Human
ccacaaccucuuccc

SEQ ID NO: 3519367 - RNA, 15 nt, Human
ccacaacuauuuuca

SEQ ID NO: 3519368 - RNA, 19 nt, Human
ccacaacuccuacaugaug

SEQ ID NO: 3519369 - RNA, 14 nt, Human
ccacaacugacaca

SEQ ID NO: 3519370 - RNA, 16 nt, Human
ccacaacugacacagg

SEQ ID NO: 3519371 - RNA, 16 nt, Human
ccacaagaaaugaaag

SEQ ID NO: 3519372 - RNA, 16 nt, Human
ccacaagagcccaggc

SEQ ID NO: 3519373 - RNA, 17 nt, Human
ccacaagagcccaggcc

SEQ ID NO: 3519374 - RNA, 19 nt, Human
ccacaagagcccaggccuc

SEQ ID NO: 3519375 - RNA, 20 nt, Human
ccacaagagcccaggccucc

SEQ ID NO: 3519376 - RNA, 21 nt, Human
ccacaagagcccaggccuccu

SEQ ID NO: 3519377 - RNA, 16 nt, Human
ccacaagauucccaga

SEQ ID NO: 3519378 - RNA, 17 nt, Human
ccacaagauucccagag

SEQ ID NO: 3519379 - RNA, 18 nt, Human
ccacaagauucccagaga

SEQ ID NO: 3519380 - RNA, 12 nt, Human
ccacaagccucu

SEQ ID NO: 3519381 - RNA, 21 nt, Human
ccacaagccucugcccaggca

SEQ ID NO: 3519382 - RNA, 20 nt, Human
ccacaagccugagggaaagg

SEQ ID NO: 3519383 - RNA, 14 nt, Human
ccacaagggcucuc

SEQ ID NO: 3519384 - RNA, 20 nt, Human
ccacaagggugcccaccucu

SEQ ID NO: 3519385 - RNA, 15 nt, Human
ccacaagucuuccag

SEQ ID NO: 3519386 - RNA, 22 nt, Human
ccacaaguggugguaacccugg

SEQ ID NO: 3519387 - RNA, 20 nt, Human
ccacaauauaaaacuguacu

SEQ ID NO: 3519388 - RNA, 16 nt, Human
ccacaaugcaguucug

SEQ ID NO: 3519389 - RNA, 22 nt, Human
ccacacaaggauagaugcuggc

SEQ ID NO: 3519390 - RNA, 13 nt, Human
ccacacacaacag

SEQ ID NO: 3519391 - RNA, 11 nt, Human
ccacacacaca

SEQ ID NO: 3519392 - RNA, 24 nt, Human
ccacacacacacacaugcauacac

SEQ ID NO: 3519393 - RNA, 12 nt, Human
ccacacacacag

SEQ ID NO: 3519394 - RNA, 15 nt, Human
ccacacacacagaaa

SEQ ID NO: 3519395 - RNA, 19 nt, Human
ccacacacacagaaaauau

SEQ ID NO: 3519396 - RNA, 16 nt, Human
ccacacacacccacac

SEQ ID NO: 3519397 - RNA, 23 nt, Human
ccacacacacccacacacucgcc

SEQ ID NO: 3519398 - RNA, 17 nt, Human
ccacacacagaggaaga

SEQ ID NO: 3519399 - RNA, 15 nt, Human
ccacacacgcaggaa

SEQ ID NO: 3519400 - RNA, 22 nt, Human
ccacacacgcaggaacucccag

SEQ ID NO: 3519401 - RNA, 20 nt, Human
ccacacagacuugggcaggg

SEQ ID NO: 3519402 - RNA, 13 nt, Human
ccacacagagugg

SEQ ID NO: 3519403 - RNA, 15 nt, Human
ccacacagcuacagc

SEQ ID NO: 3519404 - RNA, 16 nt, Human
ccacacagcugccggu

SEQ ID NO: 3519405 - RNA, 20 nt, Human
ccacacagugcucaaggcca

SEQ ID NO: 3519406 - RNA, 12 nt, Human
ccacacauccca

SEQ ID NO: 3519407 - RNA, 20 nt, Human
ccacacaugcaagggaugaa

SEQ ID NO: 3519408 - RNA, 18 nt, Human
ccacaccaagcugugcca

SEQ ID NO: 3519409 - RNA, 19 nt, Human
ccacaccagggccagccuc

SEQ ID NO: 3519410 - RNA, 20 nt, Human
ccacaccagggccagccucu

SEQ ID NO: 3519411 - RNA, 20 nt, Human
ccacaccauaagcuacugcc

SEQ ID NO: 3519412 - RNA, 15 nt, Human
ccacacccaaagcug

SEQ ID NO: 3519413 - RNA, 16 nt, Human
ccacacccacacucag

SEQ ID NO: 3519414 - RNA, 14 nt, Human
ccacacccagccca

SEQ ID NO: 3519415 - RNA, 16 nt, Human
ccacacccucacugcu

SEQ ID NO: 3519416 - RNA, 21 nt, Human
ccacacccucccccgccacuc

SEQ ID NO: 3519417 - RNA, 16 nt, Human
ccacacccuguacugu

SEQ ID NO: 3519418 - RNA, 16 nt, Human
ccacaccguguaaacc

SEQ ID NO: 3519419 - RNA, 23 nt, Human
ccacaccuccacaguucaguggc

SEQ ID NO: 3519420 - RNA, 17 nt, Human
ccacaccucccugaacc

SEQ ID NO: 3519421 - RNA, 13 nt, Human
ccacaccuccucu

SEQ ID NO: 3519422 - RNA, 16 nt, Human
ccacaccuccuucccu

SEQ ID NO: 3519423 - RNA, 13 nt, Human
ccacaccuggccc

SEQ ID NO: 3519424 - RNA, 23 nt, Human
ccacacuaaccuggguucccuuu

SEQ ID NO: 3519425 - RNA, 18 nt, Human
ccacacuauuaccaugag

SEQ ID NO: 3519426 - RNA, 17 nt, Human
ccacacucacuccugag

SEQ ID NO: 3519427 - RNA, 14 nt, Human
ccacacucagcaca

SEQ ID NO: 3519428 - RNA, 14 nt, Human
ccacacuccagcug

SEQ ID NO: 3519429 - RNA, 14 nt, Human
ccacacugcaacag

SEQ ID NO: 3519430 - RNA, 23 nt, Human
ccacacugcuaggugggccagcc

SEQ ID NO: 3519431 - RNA, 19 nt, Human
ccacacuggggugccgccu

SEQ ID NO: 3519432 - RNA, 20 nt, Human
ccacacuggggugccgccug

SEQ ID NO: 3519433 - RNA, 22 nt, Human
ccacacuggggugccgccugcc

SEQ ID NO: 3519434 - RNA, 23 nt, Human
ccacacuggggugccgccugccc

SEQ ID NO: 3519435 - RNA, 14 nt, Human
ccacacuggugacu

SEQ ID NO: 3519436 - RNA, 14 nt, Human
ccacacuucaaacu

SEQ ID NO: 3519437 - RNA, 20 nt, Human
ccacacuucaggcucuucuc

SEQ ID NO: 3519438 - RNA, 14 nt, Human
ccacacuucccugg

SEQ ID NO: 3519439 - RNA, 15 nt, Human
ccacacuucccuggc

SEQ ID NO: 3519440 - RNA, 20 nt, Human
ccacacuuccuguccagaga

SEQ ID NO: 3519441 - RNA, 23 nt, Human
ccacacuucucaggacacaggcc

SEQ ID NO: 3519442 - RNA, 17 nt, Human
ccacacuugaaaccuuu

SEQ ID NO: 3519443 - RNA, 19 nt, Human
ccacacuugagaggaugaa

SEQ ID NO: 3519444 - RNA, 21 nt, Human
ccacagaagacuucccagcuu

SEQ ID NO: 3519445 - RNA, 17 nt, Human
ccacagaagccaggagc

SEQ ID NO: 3519446 - RNA, 12 nt, Human
ccacagacacac

SEQ ID NO: 3519447 - RNA, 20 nt, Human
ccacagacacacacacgcac

SEQ ID NO: 3519448 - RNA, 18 nt, Human
ccacagacggaaggguaa

SEQ ID NO: 3519449 - RNA, 13 nt, Human
ccacagaggacac

SEQ ID NO: 3519450 - RNA, 19 nt, Human
ccacagcaaccccaggcug

SEQ ID NO: 3519451 - RNA, 19 nt, Human
ccacagcaaggcaccugca

SEQ ID NO: 3519452 - RNA, 22 nt, Human
ccacagcacagcucccugccaa

SEQ ID NO: 3519453 - RNA, 18 nt, Human
ccacagcagcauuuuuau

SEQ ID NO: 3519454 - RNA, 19 nt, Human
ccacagcagccucugaagu

SEQ ID NO: 3519455 - RNA, 12 nt, Human
ccacagcaggug

SEQ ID NO: 3519456 - RNA, 13 nt, Human
ccacagccauccc

SEQ ID NO: 3519457 - RNA, 20 nt, Human
ccacagccaucccagccuug

SEQ ID NO: 3519458 - RNA, 14 nt, Human
ccacagcccacguc

SEQ ID NO: 3519459 - RNA, 17 nt, Human
ccacagcccacguccug

SEQ ID NO: 3519460 - RNA, 13 nt, Human
ccacagcccaggc

SEQ ID NO: 3519461 - RNA, 11 nt, Human
cacucugcccc

SEQ ID NO: 3519462 - RNA, 15 nt, Human
cacucugccucugcc

SEQ ID NO: 3519463 - RNA, 17 nt, Human
cacucugccucugccug

SEQ ID NO: 3519464 - RNA, 20 nt, Human
cacucugccucugccugcau

SEQ ID NO: 3519465 - RNA, 18 nt, Human
cacucugcucgccuuagc

SEQ ID NO: 3519466 - RNA, 13 nt, Human
cacucugcucuga

SEQ ID NO: 3519467 - RNA, 15 nt, Human
cacucugcucugaug

SEQ ID NO: 3519468 - RNA, 16 nt, Human
cacucugcucugaugc

SEQ ID NO: 3519469 - RNA, 21 nt, Human
cacucugcucugcccuuguuc

SEQ ID NO: 3519470 - RNA, 12 nt, Human
cacucugcugcu

SEQ ID NO: 3519471 - RNA, 12 nt, Human
cacucugcuguu

SEQ ID NO: 3519472 - RNA, 19 nt, Human
cacucugcuucucugacuu

SEQ ID NO: 3519473 - RNA, 21 nt, Human
cacucugcuucucugacuucu

SEQ ID NO: 3519474 - RNA, 18 nt, Human
cacucuggaugauggauu

SEQ ID NO: 3519475 - RNA, 18 nt, Human
cacucuggauucagccuu

SEQ ID NO: 3519476 - RNA, 22 nt, Human
cacucuggauucagccuucuuu

SEQ ID NO: 3519477 - RNA, 12 nt, Human
cacucuggcagc

SEQ ID NO: 3519478 - RNA, 16 nt, Human
cacucuggcagcaccg

SEQ ID NO: 3519479 - RNA, 17 nt, Human
cacucuggcagcucaga

SEQ ID NO: 3519480 - RNA, 19 nt, Human
cacucuggcagcucagaga

SEQ ID NO: 3519481 - RNA, 21 nt, Human
cacucuggcagcucagagagg

SEQ ID NO: 3519482 - RNA, 12 nt, Human
cacucuggccuc

SEQ ID NO: 3519483 - RNA, 19 nt, Human
cacucuggcugguuuggaa

SEQ ID NO: 3519484 - RNA, 15 nt, Human
cacucugggcuccag

SEQ ID NO: 3519485 - RNA, 17 nt, Human
cacucugggcuccagag

SEQ ID NO: 3519486 - RNA, 13 nt, Human
cacucuguaauug

SEQ ID NO: 3519487 - RNA, 17 nt, Human
cacucuguaauugcaaa

SEQ ID NO: 3519488 - RNA, 20 nt, Human
cacucuguaauugcaaaaaa

SEQ ID NO: 3519489 - RNA, 16 nt, Human
cacucugucgcccagu

SEQ ID NO: 3519490 - RNA, 12 nt, Human
cacucugugccc

SEQ ID NO: 3519491 - RNA, 20 nt, Human
ccacccccuucagugcccac

SEQ ID NO: 3519492 - RNA, 17 nt, Human
ccaccccgcaagcacca

SEQ ID NO: 3519493 - RNA, 16 nt, Human
ccaccccgcucugcau

SEQ ID NO: 3519494 - RNA, 15 nt, Human
ccaccccggcccccu

SEQ ID NO: 3519495 - RNA, 14 nt, Human
ccaccccgggcucu

SEQ ID NO: 3519496 - RNA, 18 nt, Human
ccaccccggggacccugu

SEQ ID NO: 3519497 - RNA, 19 nt, Human
ccaccccggggacccugug

SEQ ID NO: 3519498 - RNA, 21 nt, Human
ccaccccggggacccugugac

SEQ ID NO: 3519499 - RNA, 13 nt, Human
ccaccccugcccc

SEQ ID NO: 3519500 - RNA, 22 nt, Human
ccaccccugcccccagccccgg

SEQ ID NO: 3519501 - RNA, 12 nt, Human
ccaccccugccu

SEQ ID NO: 3519502 - RNA, 18 nt, Human
ccaccccugccuccaccc

SEQ ID NO: 3519503 - RNA, 22 nt, Human
ccaccccugccuccacccucug

SEQ ID NO: 3519504 - RNA, 21 nt, Human
ccaccccuggaagagcccagu

SEQ ID NO: 3519505 - RNA, 17 nt, Human
ccaccccugggggcucu

SEQ ID NO: 3519506 - RNA, 20 nt, Human
ccaccccugggggcucucau

SEQ ID NO: 3519507 - RNA, 15 nt, Human
ccaccccugugcucc

SEQ ID NO: 3519508 - RNA, 14 nt, Human
ccaccccuuccugu

SEQ ID NO: 3519509 - RNA, 16 nt, Human
ccacccgccccugccc

SEQ ID NO: 3519510 - RNA, 19 nt, Human
ccacccgugguggcucaag

SEQ ID NO: 3519511 - RNA, 21 nt, Human
ccacccguucugcuggccugg

SEQ ID NO: 3519512 - RNA, 22 nt, Human
ccacccguucugcuggccugga

SEQ ID NO: 3519513 - RNA, 18 nt, Human
ccacccuagccaaugucu

SEQ ID NO: 3519514 - RNA, 12 nt, Human
ccacccucacug

SEQ ID NO: 3519515 - RNA, 19 nt, Human
ccacccucagcaccccuuc

SEQ ID NO: 3519516 - RNA, 13 nt, Human
ccacccuccacuc

SEQ ID NO: 3519517 - RNA, 15 nt, Human
ccacccucccagcuc

SEQ ID NO: 3519518 - RNA, 16 nt, Human
ccacccucccuggagu

SEQ ID NO: 3519519 - RNA, 12 nt, Human
ccacccuccugg

SEQ ID NO: 3519520 - RNA, 20 nt, Human
ccacccuccugucuucccag

SEQ ID NO: 3519521 - RNA, 21 nt, Human
ccacccuccugucuucccagg

SEQ ID NO: 3519522 - RNA, 22 nt, Human
ccacccuccugucuucccaggg

SEQ ID NO: 3519523 - RNA, 14 nt, Human
ccacccuccuuuca

SEQ ID NO: 3519524 - RNA, 17 nt, Human
ccacccucguggacacc

SEQ ID NO: 3519525 - RNA, 21 nt, Human
ccacccucguggacaccugcc

SEQ ID NO: 3519526 - RNA, 23 nt, Human
ccacccucugagcuuugcauguu

SEQ ID NO: 3519527 - RNA, 16 nt, Human
ccacccugaaagcccu

SEQ ID NO: 3519528 - RNA, 17 nt, Human
ccacccugaaagcccug

SEQ ID NO: 3519529 - RNA, 22 nt, Human
ccacccugagccggccccaggc

SEQ ID NO: 3519530 - RNA, 20 nt, Human
ccacccugaguugcuuuuca

SEQ ID NO: 3519531 - RNA, 21 nt, Human
ccacccugaguugcuuuucag

SEQ ID NO: 3519532 - RNA, 13 nt, Human
ccacccugccccu

SEQ ID NO: 3519533 - RNA, 11 nt, Human
ccacccugcuc

SEQ ID NO: 3519534 - RNA, 13 nt, Human
ccacccugcucau

SEQ ID NO: 3519535 - RNA, 12 nt, Human
ccacccugcucu

SEQ ID NO: 3519536 - RNA, 19 nt, Human
ccacccugcugccuucuga

SEQ ID NO: 3519537 - RNA, 21 nt, Human
ccacccugcugcuggugcaca

SEQ ID NO: 3519538 - RNA, 11 nt, Human
ccacccuggaa

SEQ ID NO: 3519539 - RNA, 10 nt, Human
ccacccuggg

SEQ ID NO: 3519540 - RNA, 13 nt, Human
ccacccugggacc

SEQ ID NO: 3519541 - RNA, 15 nt, Human
ccacccugggagaca

SEQ ID NO: 3519542 - RNA, 17 nt, Human
ccacccugggagacaga

SEQ ID NO: 3519543 - RNA, 16 nt, Human
ccacccugggcccugg

SEQ ID NO: 3519544 - RNA, 22 nt, Human
ccacccugggcccugggcugga

SEQ ID NO: 3519545 - RNA, 15 nt, Human
ccacccugugcagaa

SEQ ID NO: 3519546 - RNA, 15 nt, Human
ccacccuguuccugc

SEQ ID NO: 3519547 - RNA, 18 nt, Human
ccacccuguuccugcugc

SEQ ID NO: 3519548 - RNA, 12 nt, Human
ccacccuuggcc

SEQ ID NO: 3519549 - RNA, 13 nt, Human
ccacccuuggccu

SEQ ID NO: 3519550 - RNA, 14 nt, Human
ccacccuuggccug

SEQ ID NO: 3519551 - RNA, 15 nt, Human
ccacccuuggccugu

SEQ ID NO: 3519552 - RNA, 15 nt, Human
ccacccuuguuccag

SEQ ID NO: 3519553 - RNA, 20 nt, Human
ccacccuuucccccuucucu

SEQ ID NO: 3519554 - RNA, 13 nt, Human
ccaccgcagacag

SEQ ID NO: 3519555 - RNA, 22 nt, Human
ccaccgcagacaggaccaggga

SEQ ID NO: 3519556 - RNA, 17 nt, Human
ccaccgcaugcccccuc

SEQ ID NO: 3519557 - RNA, 14 nt, Human
ccaccgcuccccag

SEQ ID NO: 3519558 - RNA, 15 nt, Human
ccaccgcugccuaag

SEQ ID NO: 3519559 - RNA, 21 nt, Human
ccaccgcugccuaaguggcug

SEQ ID NO: 3519560 - RNA, 15 nt, Human
ccaccgggccacucc

SEQ ID NO: 3519561 - RNA, 20 nt, Human
ccaccgggccacuccuuccu

SEQ ID NO: 3519562 - RNA, 18 nt, Human
ccaccgguccagcuggcc

SEQ ID NO: 3519563 - RNA, 21 nt, Human
ccaccgguugcuucugggaag

SEQ ID NO: 3519564 - RNA, 13 nt, Human
ccaccguccccuc

SEQ ID NO: 3519565 - RNA, 14 nt, Human
ccaccguccccucc

SEQ ID NO: 3519566 - RNA, 18 nt, Human
ccaccguccgcccugcuc

SEQ ID NO: 3519567 - RNA, 20 nt, Human
ccaccguccgcccugcuccu

SEQ ID NO: 3519568 - RNA, 23 nt, Human
ccaccuaauucgaugaaggcugc

SEQ ID NO: 3519569 - RNA, 20 nt, Human
ccaccuaccuucaaagcuga

SEQ ID NO: 3519570 - RNA, 16 nt, Human
ccaccuagaacacuaa

SEQ ID NO: 3519571 - RNA, 19 nt, Human
ccaccuagaacacuaacuc

SEQ ID NO: 3519572 - RNA, 23 nt, Human
ccaccuagcagcaccguucugug

SEQ ID NO: 3519573 - RNA, 17 nt, Human
ccaccuaggccacuccu

SEQ ID NO: 3519574 - RNA, 18 nt, Human
ccaccuaggccacuccuc

SEQ ID NO: 3519575 - RNA, 22 nt, Human
ccaccuaggccacuccuccaaa

SEQ ID NO: 3519576 - RNA, 16 nt, Human
ccaccuaguggcuguc

SEQ ID NO: 3519577 - RNA, 18 nt, Human
ccaccuaguggcugucca

SEQ ID NO: 3519578 - RNA, 20 nt, Human
ccaccuaguggcuguccagu

SEQ ID NO: 3519579 - RNA, 20 nt, Human
ccaccuaucucgugggagag

SEQ ID NO: 3519580 - RNA, 19 nt, Human
ccaccucaccuagccugau

SEQ ID NO: 3519581 - RNA, 16 nt, Human
ccaccucacuccuguu

SEQ ID NO: 3519582 - RNA, 10 nt, Human
ccaccucagc

SEQ ID NO: 3519583 - RNA, 14 nt, Human
ccaccucagccuug

SEQ ID NO: 3519584 - RNA, 16 nt, Human
ccaccucagccuugga

SEQ ID NO: 3519585 - RNA, 12 nt, Human
ccaccuccagcc

SEQ ID NO: 3519586 - RNA, 14 nt, Human
ccaccuccagcccg

SEQ ID NO: 3519587 - RNA, 19 nt, Human
ccaccuccagcccgggagc

SEQ ID NO: 3519588 - RNA, 20 nt, Human
ccaccuccagcccgggagcc

SEQ ID NO: 3519589 - RNA, 13 nt, Human
ccaccuccccacg

SEQ ID NO: 3519590 - RNA, 23 nt, Human
ccaccuccccacgcccuccccuc

SEQ ID NO: 3519591 - RNA, 15 nt, Human
ccaccuccccagccu

SEQ ID NO: 3519592 - RNA, 23 nt, Human
ccaccuccccaggccguggcugc

SEQ ID NO: 3519593 - RNA, 15 nt, Human
ccaccuccccuugcc

SEQ ID NO: 3519594 - RNA, 13 nt, Human
ccaccucccucac

SEQ ID NO: 3519595 - RNA, 14 nt, Human
ccaccucccugcaa

SEQ ID NO: 3519596 - RNA, 18 nt, Human
ccaccucccugcccaggc

SEQ ID NO: 3519597 - RNA, 16 nt, Human
ccaccucccugccucc

SEQ ID NO: 3519598 - RNA, 20 nt, Human
ccaccuccuaaaaggcccag

SEQ ID NO: 3519599 - RNA, 22 nt, Human
ccaccuccuaaaaggcccagag

SEQ ID NO: 3519600 - RNA, 19 nt, Human
ccaccuccugacacccuuc

SEQ ID NO: 3519601 - RNA, 21 nt, Human
ccaccucgcagguucaagcaa

SEQ ID NO: 3519602 - RNA, 14 nt, Human
ccaccucggucacu

SEQ ID NO: 3519603 - RNA, 19 nt, Human
ccaccucggucacuccaac

SEQ ID NO: 3519604 - RNA, 23 nt, Human
ccaccucucaauauucaauaaag

SEQ ID NO: 3519605 - RNA, 12 nt, Human
ccaccucuccaa

SEQ ID NO: 3519606 - RNA, 15 nt, Human
ccaccucuccaaggg

SEQ ID NO: 3519607 - RNA, 16 nt, Human
ccaccucuccauccug

SEQ ID NO: 3519608 - RNA, 13 nt, Human
ccaccucucccuc

SEQ ID NO: 3519609 - RNA, 14 nt, Human
ccaccucucuccuu

SEQ ID NO: 3519610 - RNA, 19 nt, Human
ccaccucucuccuuugcug

SEQ ID NO: 3519611 - RNA, 24 nt, Human
ccaccucucuccuuugcugaggcc

SEQ ID NO: 3519612 - RNA, 11 nt, Human
ccaccucugcg

SEQ ID NO: 3519613 - RNA, 18 nt, Human
ccaccucugcggacccca

SEQ ID NO: 3519614 - RNA, 19 nt, Human
ccaccucugcggaccccag

SEQ ID NO: 3519615 - RNA, 13 nt, Human
ccaccucugcugc

SEQ ID NO: 3519616 - RNA, 17 nt, Human
ccaccucugcugccucc

SEQ ID NO: 3519617 - RNA, 17 nt, Human
ccaccucugugaccuca

SEQ ID NO: 3519618 - RNA, 23 nt, Human
ccaccucugugaccucaggcacu

SEQ ID NO: 3519619 - RNA, 14 nt, Human
ccaccucuguggca

SEQ ID NO: 3519620 - RNA, 21 nt, Human
ccaccucuguggcauugaaau

SEQ ID NO: 3519621 - RNA, 16 nt, Human
ccaccucuucucuucc

SEQ ID NO: 3519622 - RNA, 20 nt, Human
ccaccugaauaaagaaugaa

SEQ ID NO: 3519623 - RNA, 20 nt, Human
ccaccugacauuccuugcug

SEQ ID NO: 3519624 - RNA, 22 nt, Human
ccaccugagcuuuggacgcaca

SEQ ID NO: 3519625 - RNA, 15 nt, Human
ccaccugaggugggc

SEQ ID NO: 3519626 - RNA, 15 nt, Human
cacugccaugccagc

SEQ ID NO: 3519627 - RNA, 17 nt, Human
cacugccaugccagcuu

SEQ ID NO: 3519628 - RNA, 22 nt, Human
cacugccauggaggcacacagc

SEQ ID NO: 3519629 - RNA, 21 nt, Human
cacugccauuaaagaauauga

SEQ ID NO: 3519630 - RNA, 20 nt, Human
cacugcccaaagugcuucca

SEQ ID NO: 3519631 - RNA, 16 nt, Human
cacugcccacccccuc

SEQ ID NO: 3519632 - RNA, 20 nt, Human
cacugccccaggcugcggcu

SEQ ID NO: 3519633 - RNA, 21 nt, Human
cacugcccccagcucuucucc

SEQ ID NO: 3519634 - RNA, 20 nt, Human
cacugcccccugcugccaug

SEQ ID NO: 3519635 - RNA, 15 nt, Human
cacugcccgagcugg

SEQ ID NO: 3519636 - RNA, 14 nt, Human
ccaucccccugccc

SEQ ID NO: 3519637 - RNA, 19 nt, Human
ccaucccccugcccucgug

SEQ ID NO: 3519638 - RNA, 22 nt, Human
ccauccccuugaggucucagcc

SEQ ID NO: 3519639 - RNA, 19 nt, Human
ccaucccgaaaaucucucg

SEQ ID NO: 3519640 - RNA, 17 nt, Human
ccaucccgacauggacc

SEQ ID NO: 3519641 - RNA, 22 nt, Human
ccaucccgacauggacccggag

SEQ ID NO: 3519642 - RNA, 18 nt, Human
ccaucccgcucuuuuccu

SEQ ID NO: 3519643 - RNA, 14 nt, Human
ccaucccugaaggc

SEQ ID NO: 3519644 - RNA, 17 nt, Human
ccaucccugaaggcccc

SEQ ID NO: 3519645 - RNA, 22 nt, Human
ccaucccugaaggccccgccca

SEQ ID NO: 3519646 - RNA, 13 nt, Human
ccaucccugccug

SEQ ID NO: 3519647 - RNA, 15 nt, Human
ccaucccugccuggu

SEQ ID NO: 3519648 - RNA, 12 nt, Human
ccaucccugcgu

SEQ ID NO: 3519649 - RNA, 13 nt, Human
ccaucccuggccc

SEQ ID NO: 3519650 - RNA, 22 nt, Human
ccaucccuggcccccucccugg

SEQ ID NO: 3519651 - RNA, 12 nt, Human
ccaucccuguga

SEQ ID NO: 3519652 - RNA, 19 nt, Human
ccauccggcccccagagcg

SEQ ID NO: 3519653 - RNA, 15 nt, Human
ccauccuaaaagcca

SEQ ID NO: 3519654 - RNA, 17 nt, Human
ccauccuacccucgggc

SEQ ID NO: 3519655 - RNA, 13 nt, Human
ccauccuccagca

SEQ ID NO: 3519656 - RNA, 17 nt, Human
ccauccuccagcaggga

SEQ ID NO: 3519657 - RNA, 14 nt, Human
ccauccuccagcuu

SEQ ID NO: 3519658 - RNA, 16 nt, Human
ccauccuccagcuucu

SEQ ID NO: 3519659 - RNA, 17 nt, Human
ccauccuccccuucccu

SEQ ID NO: 3519660 - RNA, 18 nt, Human
ccauccuccccuucccug

SEQ ID NO: 3519661 - RNA, 12 nt, Human
ccauccucugua

SEQ ID NO: 3519662 - RNA, 13 nt, Human
ccauccugacuga

SEQ ID NO: 3519663 - RNA, 18 nt, Human
ccauccugaggcuccacu

SEQ ID NO: 3519664 - RNA, 22 nt, Human
ccauccuggcccagggcaucug

SEQ ID NO: 3519665 - RNA, 17 nt, Human
ccauccuguauucuuca

SEQ ID NO: 3519666 - RNA, 13 nt, Human
ccauccugugugu

SEQ ID NO: 3519667 - RNA, 20 nt, Human
ccauccuuucugccucucaa

SEQ ID NO: 3519668 - RNA, 21 nt, Human
ccaucgccagcugaugacuca

SEQ ID NO: 3519669 - RNA, 23 nt, Human
ccaucgccagcugaugacucaag

SEQ ID NO: 3519670 - RNA, 12 nt, Human
ccaucgccggga

SEQ ID NO: 3519671 - RNA, 16 nt, Human
ccaucgcugucaucuc

SEQ ID NO: 3519672 - RNA, 20 nt, Human
ccaucgguccugucuccccu

SEQ ID NO: 3519673 - RNA, 22 nt, Human
ccaucgguguccauuuauagaa

SEQ ID NO: 3519674 - RNA, 17 nt, Human
ccaucgugaagaagccu

SEQ ID NO: 3519675 - RNA, 15 nt, Human
ccaucuaagcugcag

SEQ ID NO: 3519676 - RNA, 13 nt, Human
ccaucuacccucc

SEQ ID NO: 3519677 - RNA, 23 nt, Human
ccaucuagccagccccucuuccc

SEQ ID NO: 3519678 - RNA, 11 nt, Human
ccaucucaggc

SEQ ID NO: 3519679 - RNA, 17 nt, Human
ccaucucaggccaccug

SEQ ID NO: 3519680 - RNA, 23 nt, Human
ccaucucaggccaccugcccccu

SEQ ID NO: 3519681 - RNA, 16 nt, Human
ccagaaaaggacagaa

SEQ ID NO: 3519682 - RNA, 21 nt, Human
ccagaaagcaguugagacaag

SEQ ID NO: 3519683 - RNA, 23 nt, Human
ccagaaaggauauuuaagaaaau

SEQ ID NO: 3519684 - RNA, 21 nt, Human
ccagaaauaaaguuggugaca

SEQ ID NO: 3519685 - RNA, 23 nt, Human
ccagaaauaaaguuggugacaga

SEQ ID NO: 3519686 - RNA, 18 nt, Human
ccagaaaugucccuuucu

SEQ ID NO: 3519687 - RNA, 17 nt, Human
ccagaaauuagaaaccu

SEQ ID NO: 3519688 - RNA, 22 nt, Human
ccagaacaagguucccucugag

SEQ ID NO: 3519689 - RNA, 17 nt, Human
ccagaacacacuccauc

SEQ ID NO: 3519690 - RNA, 13 nt, Human
ccagaacaguaug

SEQ ID NO: 3519691 - RNA, 17 nt, Human
ccagaacaguuuguaca

SEQ ID NO: 3519692 - RNA, 19 nt, Human
ccagaaccaccccggcccc

SEQ ID NO: 3519693 - RNA, 14 nt, Human
ccagaaccuguccu

SEQ ID NO: 3519694 - RNA, 19 nt, Human
ccagaacguggcucugcug

SEQ ID NO: 3519695 - RNA, 21 nt, Human
ccagaacguggcucugcuggc

SEQ ID NO: 3519696 - RNA, 15 nt, Human
ccagaacucuuccuc

SEQ ID NO: 3519697 - RNA, 23 nt, Human
ccagaagaagagaagcugcugac

SEQ ID NO: 3519698 - RNA, 16 nt, Human
ccagaagaauauucag

SEQ ID NO: 3519699 - RNA, 17 nt, Human
ccagaagaauauucagg

SEQ ID NO: 3519700 - RNA, 22 nt, Human
ccagaagauagcuucaccccaa

SEQ ID NO: 3519701 - RNA, 20 nt, Human
ccagaagaugaacagacuga

SEQ ID NO: 3519702 - RNA, 16 nt, Human
ccagaagccaaagacu

SEQ ID NO: 3519703 - RNA, 20 nt, Human
ccagaagccacccaaagcag

SEQ ID NO: 3519704 - RNA, 12 nt, Human
ccagaagcccag

SEQ ID NO: 3519705 - RNA, 19 nt, Human
ccagaagccucuggcuaga

SEQ ID NO: 3519706 - RNA, 18 nt, Human
ccagaagcucccccagca

SEQ ID NO: 3519707 - RNA, 15 nt, Human
ccagaagcuuccaua

SEQ ID NO: 3519708 - RNA, 14 nt, Human
ccagaaggagacag

SEQ ID NO: 3519709 - RNA, 14 nt, Human
ccagaagggguuug

SEQ ID NO: 3519710 - RNA, 16 nt, Human
ccagaaguaccagacu

SEQ ID NO: 3519711 - RNA, 20 nt, Human
ccagaaguaccagacuagau

SEQ ID NO: 3519712 - RNA, 18 nt, Human
ccagaagugugacuggcu

SEQ ID NO: 3519713 - RNA, 22 nt, Human
ccagaaguuguggauuucaguu

SEQ ID NO: 3519714 - RNA, 20 nt, Human
ccagaaguuugucaagucaa

SEQ ID NO: 3519715 - RNA, 16 nt, Human
ccagaauaaacccagc

SEQ ID NO: 3519716 - RNA, 22 nt, Human
ccagaauaaacuggcagcucag

SEQ ID NO: 3519717 - RNA, 15 nt, Human
ccagaauaaguuauu

SEQ ID NO: 3519718 - RNA, 21 nt, Human
ccagaauaaguuauugcaguu

SEQ ID NO: 3519719 - RNA, 12 nt, Human
ccagaauacuga

SEQ ID NO: 3519720 - RNA, 12 nt, Human
ccagaaucaaag

SEQ ID NO: 3519721 - RNA, 13 nt, Human
ccagaaucccagc

SEQ ID NO: 3519722 - RNA, 23 nt, Human
ccagaauggucuuucuaaugugu

SEQ ID NO: 3519723 - RNA, 18 nt, Human
ccagaauuucccaaagca

SEQ ID NO: 3519724 - RNA, 21 nt, Human
ccagaauuucccaaagcagug

SEQ ID NO: 3519725 - RNA, 15 nt, Human
ccagaauuuggaaau

SEQ ID NO: 3519726 - RNA, 21 nt, Human
ccagaauuuggaaauccuagu

SEQ ID NO: 3519727 - RNA, 23 nt, Human
ccagacaagcuguugaccaggca

SEQ ID NO: 3519728 - RNA, 12 nt, Human
ccagacacaaac

SEQ ID NO: 3519729 - RNA, 15 nt, Human
ccagacacccaggac

SEQ ID NO: 3519730 - RNA, 19 nt, Human
ccagacaccuugacagggc

SEQ ID NO: 3519731 - RNA, 20 nt, Human
ccagacaccuugacagggca

SEQ ID NO: 3519732 - RNA, 21 nt, Human
ccagacaccuugacagggcac

SEQ ID NO: 3519733 - RNA, 18 nt, Human
ccagacagacaucucugc

SEQ ID NO: 3519734 - RNA, 21 nt, Human
ccagacagcaacggggaggcc

SEQ ID NO: 3519735 - RNA, 13 nt, Human
ccagacagccugu

SEQ ID NO: 3519736 - RNA, 17 nt, Human
ccagacagccuguaucu

SEQ ID NO: 3519737 - RNA, 16 nt, Human
ccagacauaaaggaaa

SEQ ID NO: 3519738 - RNA, 19 nt, Human
ccagacaucaugaauuuua

SEQ ID NO: 3519739 - RNA, 19 nt, Human
ccagacauguggugggaca

SEQ ID NO: 3519740 - RNA, 18 nt, Human
ccagaccauugucucaga

SEQ ID NO: 3519741 - RNA, 14 nt, Human
ccagacccaguggg

SEQ ID NO: 3519742 - RNA, 12 nt, Human
ccagacccccac

SEQ ID NO: 3519743 - RNA, 14 nt, Human
ccagacccccaccc

SEQ ID NO: 3519744 - RNA, 24 nt, Human
ccagaccccucuggccaggaugga

SEQ ID NO: 3519745 - RNA, 15 nt, Human
ccagaccccuggcuu

SEQ ID NO: 3519746 - RNA, 16 nt, Human
ccagaccccuggcuuu

SEQ ID NO: 3519747 - RNA, 17 nt, Human
ccagaccccuggcuuuu

SEQ ID NO: 3519748 - RNA, 18 nt, Human
ccagaccccuggcuuuuc

SEQ ID NO: 3519749 - RNA, 14 nt, Human
ccagaccugaggcg

SEQ ID NO: 3519750 - RNA, 21 nt, Human
ccagaccugauccuggaggcc

SEQ ID NO: 3519751 - RNA, 23 nt, Human
ccagaccugauccuggaggccca

SEQ ID NO: 3519752 - RNA, 24 nt, Human
ccagaccugauccuggaggcccag

SEQ ID NO: 3519753 - RNA, 21 nt, Human
ccagaccugcagacgcccaga

SEQ ID NO: 3519754 - RNA, 14 nt, Human
ccagaccugccucu

SEQ ID NO: 3519755 - RNA, 12 nt, Human
ccagaccuggaa

SEQ ID NO: 3519756 - RNA, 20 nt, Human
ccagaccuguuagcagacag

SEQ ID NO: 3519757 - RNA, 18 nt, Human
ccagaccuuugaggauau

SEQ ID NO: 3519758 - RNA, 14 nt, Human
ccagaccuuuuauc

SEQ ID NO: 3519759 - RNA, 13 nt, Human
ccagacgaugucu

SEQ ID NO: 3519760 - RNA, 18 nt, Human
ccagacgcacgugggucu

SEQ ID NO: 3519761 - RNA, 15 nt, Human
ccagacggcacccac

SEQ ID NO: 3519762 - RNA, 20 nt, Human
ccagacggcuccacuaggac

SEQ ID NO: 3519763 - RNA, 15 nt, Human
ccagacggggcugga

SEQ ID NO: 3519764 - RNA, 17 nt, Human
ccagacgguucaccagc

SEQ ID NO: 3519765 - RNA, 19 nt, Human
ccagacgguucaccagccu

SEQ ID NO: 3519766 - RNA, 16 nt, Human
ccagacuacuugggag

SEQ ID NO: 3519767 - RNA, 22 nt, Human
ccagacuagauggaccugccug

SEQ ID NO: 3519768 - RNA, 18 nt, Human
ccagacuagauguaguau

SEQ ID NO: 3519769 - RNA, 17 nt, Human
ccagacucagagcucuc

SEQ ID NO: 3519770 - RNA, 22 nt, Human
ccagacucagagcucucucuac

SEQ ID NO: 3519771 - RNA, 23 nt, Human
ccagacucagagcucucucuaca

SEQ ID NO: 3519772 - RNA, 14 nt, Human
ccagacuccaccaa

SEQ ID NO: 3519773 - RNA, 21 nt, Human
ccagacuccugacugucuccc

SEQ ID NO: 3519774 - RNA, 14 nt, Human
ccagacucucugug

SEQ ID NO: 3519775 - RNA, 14 nt, Human
ccagacuugcugaa

SEQ ID NO: 3519776 - RNA, 16 nt, Human
ccagagaaaggggagc

SEQ ID NO: 3519777 - RNA, 23 nt, Human
ccagagaaaggggagcccacugu

SEQ ID NO: 3519778 - RNA, 12 nt, Human
ccagagaacagc

SEQ ID NO: 3519779 - RNA, 13 nt, Human
ccagagaacccag

SEQ ID NO: 3519780 - RNA, 18 nt, Human
ccagauuucacucuccuu

SEQ ID NO: 3519781 - RNA, 23 nt, Human
ccagauuugaagacaaaaauacu

SEQ ID NO: 3519782 - RNA, 23 nt, Human
ccagauuugucuuuuuguuguaa

SEQ ID NO: 3519783 - RNA, 22 nt, Human
ccagcaaaagagcuauugccaa

SEQ ID NO: 3519784 - RNA, 15 nt, Human
ccagcaaaagguugu

SEQ ID NO: 3519785 - RNA, 13 nt, Human
ccagcaaagcccc

SEQ ID NO: 3519786 - RNA, 21 nt, Human
ccagcaaagcccccagagccc

SEQ ID NO: 3519787 - RNA, 24 nt, Human
ccagcaaagcccccagagcccagg

SEQ ID NO: 3519788 - RNA, 21 nt, Human
ccagcaacacaagcuggaagc

SEQ ID NO: 3519789 - RNA, 16 nt, Human
ccagcaacacagccug

SEQ ID NO: 3519790 - RNA, 17 nt, Human
ccagcaacccuccuauc

SEQ ID NO: 3519791 - RNA, 16 nt, Human
ccagcaacugaauaaa

SEQ ID NO: 3519792 - RNA, 18 nt, Human
ccagcaagugagagcugg

SEQ ID NO: 3519793 - RNA, 21 nt, Human
ccagcaagugagagcugggug

SEQ ID NO: 3519794 - RNA, 22 nt, Human
ccagcaagugagagcugggugu

SEQ ID NO: 3519795 - RNA, 21 nt, Human
ccagcaaugacaucucagggg

SEQ ID NO: 3519796 - RNA, 22 nt, Human
ccagcaaugacaucucaggggc

SEQ ID NO: 3519797 - RNA, 23 nt, Human
ccagcaaugacaucucaggggcc

SEQ ID NO: 3519798 - RNA, 21 nt, Human
ccagcaauucauaaaaacugc

SEQ ID NO: 3519799 - RNA, 18 nt, Human
ccagcaauucuccugccu

SEQ ID NO: 3519800 - RNA, 12 nt, Human
ccagcacaaaca

SEQ ID NO: 3519801 - RNA, 20 nt, Human
ccagcacaaacacaagguca

SEQ ID NO: 3519802 - RNA, 14 nt, Human
ccagcacaaagcag

SEQ ID NO: 3519803 - RNA, 23 nt, Human
ccagcacaaccuucaagcugcuu

SEQ ID NO: 3519804 - RNA, 16 nt, Human
ccagcacacagggcag

SEQ ID NO: 3519805 - RNA, 20 nt, Human
ccagcacagcuuagauuuca

SEQ ID NO: 3519806 - RNA, 17 nt, Human
ccagcaccaucucuccu

SEQ ID NO: 3519807 - RNA, 18 nt, Human
ccagcacccccacgcccu

SEQ ID NO: 3519808 - RNA, 14 nt, Human
ccagcacccgggcu

SEQ ID NO: 3519809 - RNA, 18 nt, Human
ccagcacccgggcucagg

SEQ ID NO: 3519810 - RNA, 23 nt, Human
ccagcacccgggcucagggacca

SEQ ID NO: 3519811 - RNA, 22 nt, Human
ccagcaccggccccauuuaccc

SEQ ID NO: 3519812 - RNA, 15 nt, Human
ccagcaccugccucc

SEQ ID NO: 3519813 - RNA, 16 nt, Human
ccagcaccugccuccu

SEQ ID NO: 3519814 - RNA, 19 nt, Human
ccagcaccuugugccuggg

SEQ ID NO: 3519815 - RNA, 24 nt, Human
ccagcacuaaagcaguggacacca

SEQ ID NO: 3519816 - RNA, 20 nt, Human
ccagcacucgcuagcagugg

SEQ ID NO: 3519817 - RNA, 12 nt, Human
ccagcacugagg

SEQ ID NO: 3519818 - RNA, 12 nt, Human
ccagcacugcuu

SEQ ID NO: 3519819 - RNA, 18 nt, Human
ccagcacugcuugaggaa

SEQ ID NO: 3519820 - RNA, 19 nt, Human
ccagcacuuugggaggccu

SEQ ID NO: 3519821 - RNA, 13 nt, Human
ccagcagacagag

SEQ ID NO: 3519822 - RNA, 17 nt, Human
ccagcagacagagccag

SEQ ID NO: 3519823 - RNA, 18 nt, Human
ccagcagacagagccagg

SEQ ID NO: 3519824 - RNA, 22 nt, Human
ccagcagacagagccaggagaa

SEQ ID NO: 3519825 - RNA, 14 nt, Human
ccagcagacauugu

SEQ ID NO: 3519826 - RNA, 23 nt, Human
ccagcagagcaccuuagacaguc

SEQ ID NO: 3519827 - RNA, 15 nt, Human
ccagcagauuauuca

SEQ ID NO: 3519828 - RNA, 22 nt, Human
ccagcagauuauucacugauuu

SEQ ID NO: 3519829 - RNA, 15 nt, Human
ccagcagccagccaa

SEQ ID NO: 3519830 - RNA, 16 nt, Human
ccagcagccagccaaa

SEQ ID NO: 3519831 - RNA, 15 nt, Human
ccagcagccagcucu

SEQ ID NO: 3519832 - RNA, 21 nt, Human
ccagcagccagcucucagcca

SEQ ID NO: 3519833 - RNA, 21 nt, Human
ccagcagccccacaccagggc

SEQ ID NO: 3519834 - RNA, 15 nt, Human
ccagcagccuggacc

SEQ ID NO: 3519835 - RNA, 19 nt, Human
ccagcagccuggacccugu

SEQ ID NO: 3519836 - RNA, 18 nt, Human
ccagcagcgccuuuccca

SEQ ID NO: 3519837 - RNA, 10 nt, Human
ccagcagcug

SEQ ID NO: 3519838 - RNA, 12 nt, Human
ccagcaggaggg

SEQ ID NO: 3519839 - RNA, 20 nt, Human
ccagcaggagggacagucuc

SEQ ID NO: 3519840 - RNA, 21 nt, Human
ccagcaggcucucaggccagc

SEQ ID NO: 3519841 - RNA, 18 nt, Human
ccagcaggugcugacuuc

SEQ ID NO: 3519842 - RNA, 15 nt, Human
ccagcagguggggag

SEQ ID NO: 3519843 - RNA, 21 nt, Human
ccagcaguacaauaaaaguaa

SEQ ID NO: 3519844 - RNA, 20 nt, Human
ccaugcugugcgcccagggc

SEQ ID NO: 3519845 - RNA, 20 nt, Human
ccaugcuguugauugcuaaa

SEQ ID NO: 3519846 - RNA, 21 nt, Human
ccaugcuguuuucccuuugcc

SEQ ID NO: 3519847 - RNA, 19 nt, Human
ccaugcuuacgugauccuc

SEQ ID NO: 3519848 - RNA, 20 nt, Human
ccaugcuuagucacugccug

SEQ ID NO: 3519849 - RNA, 12 nt, Human
ccauggaaccug

SEQ ID NO: 3519850 - RNA, 18 nt, Human
ccauggaaugcuugaaaa

SEQ ID NO: 3519851 - RNA, 20 nt, Human
ccauggacacuacacccagc

SEQ ID NO: 3519852 - RNA, 21 nt, Human
ccauggacacuacacccagca

SEQ ID NO: 3519853 - RNA, 19 nt, Human
ccauggacacuccagugcc

SEQ ID NO: 3519854 - RNA, 15 nt, Human
ccauggacucugucc

SEQ ID NO: 3519855 - RNA, 18 nt, Human
ccauggacucuguccuga

SEQ ID NO: 3519856 - RNA, 13 nt, Human
ccauggagaaagc

SEQ ID NO: 3519857 - RNA, 18 nt, Human
ccauggagaaagcugacu

SEQ ID NO: 3519858 - RNA, 18 nt, Human
ccauggagccagcucccu

SEQ ID NO: 3519859 - RNA, 22 nt, Human
ccauggagccagcucccucuau

SEQ ID NO: 3519860 - RNA, 18 nt, Human
ccauggagccccagcccc

SEQ ID NO: 3519861 - RNA, 19 nt, Human
ccauggagccccagccccc

SEQ ID NO: 3519862 - RNA, 23 nt, Human
ccauggaggaaggcucuguucca

SEQ ID NO: 3519863 - RNA, 17 nt, Human
ccauggaggcacacagc

SEQ ID NO: 3519864 - RNA, 20 nt, Human
ccauggaguggcagcccagc

SEQ ID NO: 3519865 - RNA, 21 nt, Human
ccauggaguggcagcccagcc

SEQ ID NO: 3519866 - RNA, 23 nt, Human
ccauggcaccuucagacuuugcu

SEQ ID NO: 3519867 - RNA, 14 nt, Human
ccauggcaggaagg

SEQ ID NO: 3519868 - RNA, 16 nt, Human
ccauggccugcaaacu

SEQ ID NO: 3519869 - RNA, 21 nt, Human
ccauggccugcaaacugggaa

SEQ ID NO: 3519870 - RNA, 18 nt, Human
ccauggcuuaaugcuucu

SEQ ID NO: 3519871 - RNA, 14 nt, Human
ccauggcuuccucc

SEQ ID NO: 3519872 - RNA, 21 nt, Human
ccaugggaaaugucaacaagu

SEQ ID NO: 3519873 - RNA, 16 nt, Human
ccaugggacagggagg

SEQ ID NO: 3519874 - RNA, 19 nt, Human
ccaugggacagggaggacg

SEQ ID NO: 3519875 - RNA, 14 nt, Human
ccaugggaggccuu

SEQ ID NO: 3519876 - RNA, 13 nt, Human
ccaugggagggag

SEQ ID NO: 3519877 - RNA, 23 nt, Human
ccaugggauacaaccucccucuu

SEQ ID NO: 3519878 - RNA, 17 nt, Human
ccaugggcacugcuggg

SEQ ID NO: 3519879 - RNA, 20 nt, Human
ccaugggcacugcugggugg

SEQ ID NO: 3519880 - RNA, 22 nt, Human
ccaugggcacugcuggguggcc

SEQ ID NO: 3519881 - RNA, 18 nt, Human
ccaugggcacugugggua

SEQ ID NO: 3519882 - RNA, 17 nt, Human
ccaugggccuccugugu

SEQ ID NO: 3519883 - RNA, 11 nt, Human
ccauggggaag

SEQ ID NO: 3519884 - RNA, 23 nt, Human
ccauggggacgcccucagucuag

SEQ ID NO: 3519885 - RNA, 23 nt, Human
ccaugggguaggaggaugggcuc

SEQ ID NO: 3519886 - RNA, 17 nt, Human
ccauggggucucucaca

SEQ ID NO: 3519887 - RNA, 18 nt, Human
ccaugguacccccuucug

SEQ ID NO: 3519888 - RNA, 15 nt, Human
ccauggucacagaga

SEQ ID NO: 3519889 - RNA, 16 nt, Human
ccauggugauggugua

SEQ ID NO: 3519890 - RNA, 14 nt, Human
ccauggugccucug

SEQ ID NO: 3519891 - RNA, 22 nt, Human
ccauggugcuaggaagaggagu

SEQ ID NO: 3519892 - RNA, 18 nt, Human
ccauggugugaucgucug

SEQ ID NO: 3519893 - RNA, 20 nt, Human
ccaugguuaagaguccaaga

SEQ ID NO: 3519894 - RNA, 16 nt, Human
ccauguaacagaaagg

SEQ ID NO: 3519895 - RNA, 14 nt, Human
ccauguaacugccu

SEQ ID NO: 3519896 - RNA, 19 nt, Human
ccauguaacugccuagaaa

SEQ ID NO: 3519897 - RNA, 18 nt, Human
ccauguaagguaucaguu

SEQ ID NO: 3519898 - RNA, 16 nt, Human
ccauguacaugaagaa

SEQ ID NO: 3519899 - RNA, 14 nt, Human
ccauguaccucccc

SEQ ID NO: 3519900 - RNA, 19 nt, Human
ccauguaccuccccugccu

SEQ ID NO: 3519901 - RNA, 20 nt, Human
ccauguaccuccccugccuu

SEQ ID NO: 3519902 - RNA, 16 nt, Human
ccauguagaaaauuug

SEQ ID NO: 3519903 - RNA, 14 nt, Human
ccauguagaagcug

SEQ ID NO: 3519904 - RNA, 15 nt, Human
ccauguagaagcugc

SEQ ID NO: 3519905 - RNA, 16 nt, Human
ccauguagcaggacug

SEQ ID NO: 3519906 - RNA, 17 nt, Human
ccauguauaaaugugau

SEQ ID NO: 3519907 - RNA, 11 nt, Human
ccauguaugca

SEQ ID NO: 3519908 - RNA, 15 nt, Human
ccauguauggccagg

SEQ ID NO: 3519909 - RNA, 21 nt, Human
ccauguauggccaggaaguag

SEQ ID NO: 3519910 - RNA, 16 nt, Human
ccauguauuuaucucu

SEQ ID NO: 3519911 - RNA, 17 nt, Human
ccaugucaagauucagc

SEQ ID NO: 3519912 - RNA, 13 nt, Human
ccaugucagacac

SEQ ID NO: 3519913 - RNA, 15 nt, Human
ccaugucagacacag

SEQ ID NO: 3519914 - RNA, 13 nt, Human
ccauguccccucc

SEQ ID NO: 3519915 - RNA, 19 nt, Human
ccauguccuaugugugacu

SEQ ID NO: 3519916 - RNA, 12 nt, Human
ccaugucgccuc

SEQ ID NO: 3519917 - RNA, 16 nt, Human
ccaugucgccucugca

SEQ ID NO: 3519918 - RNA, 20 nt, Human
ccaugucucugagcauuaga

SEQ ID NO: 3519919 - RNA, 13 nt, Human
ccaugucugcauu

SEQ ID NO: 3519920 - RNA, 17 nt, Human
ccaugucugccccauca

SEQ ID NO: 3519921 - RNA, 21 nt, Human
ccaugucuuucuccaaaguua

SEQ ID NO: 3519922 - RNA, 21 nt, Human
ccaugugaaaaggcaaaaagc

SEQ ID NO: 3519923 - RNA, 21 nt, Human
cccagagaugggacugggagg

SEQ ID NO: 3519924 - RNA, 17 nt, Human
cccagagauucccaagc

SEQ ID NO: 3519925 - RNA, 17 nt, Human
cccagagcaccugcugu

SEQ ID NO: 3519926 - RNA, 16 nt, Human
cccagagcaggaagca

SEQ ID NO: 3519927 - RNA, 19 nt, Human
cccagagcaggaggccccu

SEQ ID NO: 3519928 - RNA, 23 nt, Human
cccagagcaggaggccccuggcc

SEQ ID NO: 3519929 - RNA, 13 nt, Human
cccagagccacac

SEQ ID NO: 3519930 - RNA, 14 nt, Human
cccagagccacaca

SEQ ID NO: 3519931 - RNA, 16 nt, Human
cccagagccacacaug

SEQ ID NO: 3519932 - RNA, 13 nt, Human
cccagagcccagc

SEQ ID NO: 3519933 - RNA, 14 nt, Human
cccagagcccaggc

SEQ ID NO: 3519934 - RNA, 16 nt, Human
cccagagcccaggcuc

SEQ ID NO: 3519935 - RNA, 19 nt, Human
cccagagcccaggcucggc

SEQ ID NO: 3519936 - RNA, 19 nt, Human
cccagagcugguggaccca

SEQ ID NO: 3519937 - RNA, 22 nt, Human
cccagagcuguuuauggccuca

SEQ ID NO: 3519938 - RNA, 23 nt, Human
cccagaggaaggggccagaggcu

SEQ ID NO: 3519939 - RNA, 20 nt, Human
cccagaggagccaccaguuc

SEQ ID NO: 3519940 - RNA, 22 nt, Human
cccagaggagcugggagccggg

SEQ ID NO: 3519941 - RNA, 13 nt, Human
cccagaggaggca

SEQ ID NO: 3519942 - RNA, 16 nt, Human
cccagaggcacagccg

SEQ ID NO: 3519943 - RNA, 14 nt, Human
cccagaggcguccc

SEQ ID NO: 3519944 - RNA, 15 nt, Human
cccagaggcugaguu

SEQ ID NO: 3519945 - RNA, 16 nt, Human
cccagagggcccaggc

SEQ ID NO: 3519946 - RNA, 22 nt, Human
cccagagggcccaggcaggcca

SEQ ID NO: 3519947 - RNA, 20 nt, Human
cccagagggccugcaaggga

SEQ ID NO: 3519948 - RNA, 19 nt, Human
cccagaggggccugccacc

SEQ ID NO: 3519949 - RNA, 21 nt, Human
cccagaggggccugccaccug

SEQ ID NO: 3519950 - RNA, 23 nt, Human
cccagaggggccugccaccugga

SEQ ID NO: 3519951 - RNA, 15 nt, Human
cccagagggucuggg

SEQ ID NO: 3519952 - RNA, 22 nt, Human
cccagagguaacagaacagcuu

SEQ ID NO: 3519953 - RNA, 13 nt, Human
cccagagguccag

SEQ ID NO: 3519954 - RNA, 18 nt, Human
cccagagguccagcccau

SEQ ID NO: 3519955 - RNA, 15 nt, Human
cccagagucccccca

SEQ ID NO: 3519956 - RNA, 20 nt, Human
cccagaguccccccacuccc

SEQ ID NO: 3519957 - RNA, 23 nt, Human
cccagagugugggaagggagagc

SEQ ID NO: 3519958 - RNA, 19 nt, Human
cccagaucagccagaagcc

SEQ ID NO: 3519959 - RNA, 16 nt, Human
cccagauuccccugug

SEQ ID NO: 3519960 - RNA, 19 nt, Human
cccagauuggcucacacug

SEQ ID NO: 3519961 - RNA, 21 nt, Human
cccagauuggcucacacugag

SEQ ID NO: 3519962 - RNA, 19 nt, Human
cccagauuucagucuuuuc

SEQ ID NO: 3519963 - RNA, 18 nt, Human
cccagauuuugcuguaua

SEQ ID NO: 3519964 - RNA, 15 nt, Human
cccagcaaagccccc

SEQ ID NO: 3519965 - RNA, 23 nt, Human
cccagcaaagcccccagagccca

SEQ ID NO: 3519966 - RNA, 15 nt, Human
cccagcaacacaagc

SEQ ID NO: 3519967 - RNA, 20 nt, Human
cccagcaacacaagcuggaa

SEQ ID NO: 3519968 - RNA, 22 nt, Human
cccagcaacacaagcuggaagc

SEQ ID NO: 3519969 - RNA, 16 nt, Human
cccagcaagugagagc

SEQ ID NO: 3519970 - RNA, 19 nt, Human
cccagcaagugagagcugg

SEQ ID NO: 3519971 - RNA, 21 nt, Human
cccagcaagugagagcugggu

SEQ ID NO: 3519972 - RNA, 22 nt, Human
cccagcaagugagagcugggug

SEQ ID NO: 3519973 - RNA, 23 nt, Human
cccagcaagugagagcugggugu

SEQ ID NO: 3519974 - RNA, 22 nt, Human
cccagcaagugguccuagaggc

SEQ ID NO: 3519975 - RNA, 13 nt, Human
cccagcacccagc

SEQ ID NO: 3519976 - RNA, 21 nt, Human
cccagcacccgggcucaggga

SEQ ID NO: 3519977 - RNA, 16 nt, Human
cccagcacuaaagcag

SEQ ID NO: 3519978 - RNA, 18 nt, Human
cccagcacuuguguuguc

SEQ ID NO: 3519979 - RNA, 12 nt, Human
cccagcacuuug

SEQ ID NO: 3519980 - RNA, 18 nt, Human
cccagcacuuugggaggc

SEQ ID NO: 3519981 - RNA, 20 nt, Human
cccagcacuuugggaggcca

SEQ ID NO: 3519982 - RNA, 23 nt, Human
cccagcacuuugggaggccgagg

SEQ ID NO: 3519983 - RNA, 14 nt, Human
cccagcagccagcc

SEQ ID NO: 3519984 - RNA, 22 nt, Human
cccagcagcccuaaggaucucu

SEQ ID NO: 3519985 - RNA, 14 nt, Human
cccagcagcugcca

SEQ ID NO: 3519986 - RNA, 18 nt, Human
cccagcagggccacuccc

SEQ ID NO: 3519987 - RNA, 19 nt, Human
cccagcagguggggagggg

SEQ ID NO: 3519988 - RNA, 16 nt, Human
cccagcaguuugggag

SEQ ID NO: 3519989 - RNA, 17 nt, Human
cccagcaugcaccacgg

SEQ ID NO: 3519990 - RNA, 22 nt, Human
cccagcauuccagccccucugg

SEQ ID NO: 3519991 - RNA, 19 nt, Human
cccagcauucucaggcacc

SEQ ID NO: 3519992 - RNA, 14 nt, Human
cccagccaccccgg

SEQ ID NO: 3519993 - RNA, 19 nt, Human
cccagccaccccgggcucu

SEQ ID NO: 3519994 - RNA, 22 nt, Human
cccagccaccccgggcucucug

SEQ ID NO: 3519995 - RNA, 22 nt, Human
cccagccacggacgcuggcucc

SEQ ID NO: 3519996 - RNA, 15 nt, Human
cccagccacucccca

SEQ ID NO: 3519997 - RNA, 17 nt, Human
cccagccagcaguucag

SEQ ID NO: 3519998 - RNA, 12 nt, Human
cccagccaggcc

SEQ ID NO: 3519999 - RNA, 15 nt, Human
cccagccaggcccag

SEQ ID NO: 3520000 - RNA, 21 nt, Human
cccagccaggccccaggcagg

SEQ ID NO: 3520001 - RNA, 16 nt, Human
cccagccagggcucaa

SEQ ID NO: 3520002 - RNA, 19 nt, Human
cccagccagggcucaaucu

SEQ ID NO: 3520003 - RNA, 18 nt, Human
cccagccaucugcccagg

SEQ ID NO: 3520004 - RNA, 21 nt, Human
cccagccaucugcccaggggu

SEQ ID NO: 3520005 - RNA, 23 nt, Human
cccagccaucugcccaggggugc

SEQ ID NO: 3520006 - RNA, 17 nt, Human
cccagccaugccagcug

SEQ ID NO: 3520007 - RNA, 19 nt, Human
cccagccaugccagcuggc

SEQ ID NO: 3520008 - RNA, 10 nt, Human
cccagccauu

SEQ ID NO: 3520009 - RNA, 20 nt, Human
cccagccauuaccauggaga

SEQ ID NO: 3520010 - RNA, 22 nt, Human
cccagccauuaccauggagaca

SEQ ID NO: 3520011 - RNA, 12 nt, Human
cccagcccaagu

SEQ ID NO: 3520012 - RNA, 13 nt, Human
cccagcccacccc

SEQ ID NO: 3520013 - RNA, 16 nt, Human
cccagcccaccccaug

SEQ ID NO: 3520014 - RNA, 13 nt, Human
cccagcccacccu

SEQ ID NO: 3520015 - RNA, 16 nt, Human
cccagcccacccuccu

SEQ ID NO: 3520016 - RNA, 19 nt, Human
cccagcccacuucugccau

SEQ ID NO: 3520017 - RNA, 16 nt, Human
cccagcccagagacau

SEQ ID NO: 3520018 - RNA, 12 nt, Human
cccagcccagau

SEQ ID NO: 3520019 - RNA, 21 nt, Human
cccagcccagauuccccugug

SEQ ID NO: 3520020 - RNA, 17 nt, Human
cccagcccagcccagcu

SEQ ID NO: 3520021 - RNA, 12 nt, Human
cccagcccagcu

SEQ ID NO: 3520022 - RNA, 13 nt, Human
cccagcccagcug

SEQ ID NO: 3520023 - RNA, 18 nt, Human
cccagcccagcugcucug

SEQ ID NO: 3520024 - RNA, 18 nt, Human
cccagcccagcugguggg

SEQ ID NO: 3520025 - RNA, 21 nt, Human
cccagcccaggguucccccag

SEQ ID NO: 3520026 - RNA, 22 nt, Human
cccagcccauccauuaggccag

SEQ ID NO: 3520027 - RNA, 21 nt, Human
cccagcccaucuugccuccau

SEQ ID NO: 3520028 - RNA, 17 nt, Human
cccagccccagccaggg

SEQ ID NO: 3520029 - RNA, 11 nt, Human
cccagccccau

SEQ ID NO: 3520030 - RNA, 16 nt, Human
cccagcccccacagug

SEQ ID NO: 3520031 - RNA, 17 nt, Human
cccagcccccacagugc

SEQ ID NO: 3520032 - RNA, 16 nt, Human
cccagcccccuuuggg

SEQ ID NO: 3520033 - RNA, 21 nt, Human
cccagcccccuuugggcccag

SEQ ID NO: 3520034 - RNA, 21 nt, Human
cccagccccgacuccagccag

SEQ ID NO: 3520035 - RNA, 14 nt, Human
cccagccccuagcc

SEQ ID NO: 3520036 - RNA, 22 nt, Human
cccagccccuagcccaggagag

SEQ ID NO: 3520037 - RNA, 18 nt, Human
cccagccccucccccauc

SEQ ID NO: 3520038 - RNA, 18 nt, Human
cccagccccugccccuca

SEQ ID NO: 3520039 - RNA, 23 nt, Human
cccagccccugccccucaugcca

SEQ ID NO: 3520040 - RNA, 18 nt, Human
cccagccccuucugaccc

SEQ ID NO: 3520041 - RNA, 20 nt, Human
cccagcccggaccuuggcag

SEQ ID NO: 3520042 - RNA, 14 nt, Human
cccagcccucaucc

SEQ ID NO: 3520043 - RNA, 11 nt, Human
cccagcccugc

SEQ ID NO: 3520044 - RNA, 14 nt, Human
cccagcccugcugg

SEQ ID NO: 3520045 - RNA, 20 nt, Human
cccagcccugcuggccgccu

SEQ ID NO: 3520046 - RNA, 14 nt, Human
cccagcccuggcuc

SEQ ID NO: 3520047 - RNA, 14 nt, Human
ccaggcugccgugg

SEQ ID NO: 3520048 - RNA, 13 nt, Human
ccaggcugccucc

SEQ ID NO: 3520049 - RNA, 21 nt, Human
ccaggcuggacaugcugacug

SEQ ID NO: 3520050 - RNA, 12 nt, Human
ccaggcuggcca

SEQ ID NO: 3520051 - RNA, 13 nt, Human
ccaggcuggccag

SEQ ID NO: 3520052 - RNA, 17 nt, Human
ccaggcuggccagcccc

SEQ ID NO: 3520053 - RNA, 20 nt, Human
ccaggcuggccagccccaca

SEQ ID NO: 3520054 - RNA, 21 nt, Human
ccaggcuggccagccccacag

SEQ ID NO: 3520055 - RNA, 21 nt, Human
ccaggcuggcgcagccaaggc

SEQ ID NO: 3520056 - RNA, 22 nt, Human
ccaggcuggcgcagccaaggcc

SEQ ID NO: 3520057 - RNA, 16 nt, Human
ccaggcuggcgugcag

SEQ ID NO: 3520058 - RNA, 17 nt, Human
ccaggcuggcgugcagu

SEQ ID NO: 3520059 - RNA, 18 nt, Human
ccaggcuggcgugcagug

SEQ ID NO: 3520060 - RNA, 15 nt, Human
ccaggcugggagagc

SEQ ID NO: 3520061 - RNA, 21 nt, Human
ccaggcugggucgcccuggac

SEQ ID NO: 3520062 - RNA, 23 nt, Human
ccaggcugggucgcccuggacug

SEQ ID NO: 3520063 - RNA, 16 nt, Human
ccaggcugggugacag

SEQ ID NO: 3520064 - RNA, 17 nt, Human
ccaggcugggugacaga

SEQ ID NO: 3520065 - RNA, 16 nt, Human
ccaggcuggucuaaaa

SEQ ID NO: 3520066 - RNA, 22 nt, Human
ccaggcuggucuugaaguccug

SEQ ID NO: 3520067 - RNA, 22 nt, Human
cagaggccccaauaccccaugg

SEQ ID NO: 3520068 - RNA, 16 nt, Human
cagaggccccagccuc

SEQ ID NO: 3520069 - RNA, 17 nt, Human
cagaggccccagccucc

SEQ ID NO: 3520070 - RNA, 16 nt, Human
cagaggcccccagccc

SEQ ID NO: 3520071 - RNA, 17 nt, Human
cagaggcccccagccca

SEQ ID NO: 3520072 - RNA, 12 nt, Human
cagaggcccuca

SEQ ID NO: 3520073 - RNA, 20 nt, Human
cagaggcccucgcugccagc

SEQ ID NO: 3520074 - RNA, 16 nt, Human
cagaggccuccugugg

SEQ ID NO: 3520075 - RNA, 21 nt, Human
cagaggccuccuguggccugc

SEQ ID NO: 3520076 - RNA, 16 nt, Human
cagaggccugggcugg

SEQ ID NO: 3520077 - RNA, 19 nt, Human
cagaggcgucccgcaccug

SEQ ID NO: 3520078 - RNA, 22 nt, Human
cagaggcgucccgcaccugucu

SEQ ID NO: 3520079 - RNA, 20 nt, Human
cagaggcuauuauuuucacu

SEQ ID NO: 3520080 - RNA, 14 nt, Human
cagaggcugcccca

SEQ ID NO: 3520081 - RNA, 23 nt, Human
cagaggcugccucucccaucacu

SEQ ID NO: 3520082 - RNA, 13 nt, Human
cagaggcuggagg

SEQ ID NO: 3520083 - RNA, 17 nt, Human
cagaggcuguggcuggu

SEQ ID NO: 3520084 - RNA, 20 nt, Human
cagaggcuucuucagaucag

SEQ ID NO: 3520085 - RNA, 23 nt, Human
cagagggaaaguaaauauuucag

SEQ ID NO: 3520086 - RNA, 22 nt, Human
cagagggaggaaucgaggaacc

SEQ ID NO: 3520087 - RNA, 14 nt, Human
cagagggagugaca

SEQ ID NO: 3520088 - RNA, 16 nt, Human
cagagggcagaggcug

SEQ ID NO: 3520089 - RNA, 15 nt, Human
cagagggcccaggca

SEQ ID NO: 3520090 - RNA, 19 nt, Human
cagagggccugcaagggag

SEQ ID NO: 3520091 - RNA, 11 nt, Human
cagagggcugg

SEQ ID NO: 3520092 - RNA, 12 nt, Human
cagagggcugga

SEQ ID NO: 3520093 - RNA, 13 nt, Human
cagagggcuggag

SEQ ID NO: 3520094 - RNA, 14 nt, Human
cagagggcuggagg

SEQ ID NO: 3520095 - RNA, 17 nt, Human
cagagggcuggaggccc

SEQ ID NO: 3520096 - RNA, 21 nt, Human
cagagggcuggaggcccaggc

SEQ ID NO: 3520097 - RNA, 12 nt, Human
cagaggggaagg

SEQ ID NO: 3520098 - RNA, 15 nt, Human
cagaggggacucugg

SEQ ID NO: 3520099 - RNA, 14 nt, Human
cagaggggcagaug

SEQ ID NO: 3520100 - RNA, 20 nt, Human
cagaggggccugccaccugg

SEQ ID NO: 3520101 - RNA, 21 nt, Human
cagaggggccugccaccugga

SEQ ID NO: 3520102 - RNA, 19 nt, Human
cagaggggcuuucuggaga

SEQ ID NO: 3520103 - RNA, 17 nt, Human
cagagggggacugcugc

SEQ ID NO: 3520104 - RNA, 19 nt, Human
cagaggggguggccuccca

SEQ ID NO: 3520105 - RNA, 23 nt, Human
cagaggggguggccucccaacuc

SEQ ID NO: 3520106 - RNA, 16 nt, Human
cagagggucacagugu

SEQ ID NO: 3520107 - RNA, 17 nt, Human
cagaggguguccugcac

SEQ ID NO: 3520108 - RNA, 20 nt, Human
cagagguaaaagugugagca

SEQ ID NO: 3520109 - RNA, 13 nt, Human
cagagguaacaga

SEQ ID NO: 3520110 - RNA, 23 nt, Human
cagagguaacagaacagcuucag

SEQ ID NO: 3520111 - RNA, 14 nt, Human
cagagguacccugg

SEQ ID NO: 3520112 - RNA, 22 nt, Human
cagagguauuaaaacuaaauuu

SEQ ID NO: 3520113 - RNA, 19 nt, Human
cagaggucucugccggcuc

SEQ ID NO: 3520114 - RNA, 23 nt, Human
cagaggucucugccggcucuuuc

SEQ ID NO: 3520115 - RNA, 14 nt, Human
cagaggucugugcu

SEQ ID NO: 3520116 - RNA, 21 nt, Human
cagaggugcuucacccugagu

SEQ ID NO: 3520117 - RNA, 17 nt, Human
cagagguggccagagcu

SEQ ID NO: 3520118 - RNA, 19 nt, Human
cagagguggccagagcugg

SEQ ID NO: 3520119 - RNA, 18 nt, Human
cagagguggcucuggaau

SEQ ID NO: 3520120 - RNA, 14 nt, Human
cagaggugggcagg

SEQ ID NO: 3520121 - RNA, 15 nt, Human
cagaggugggcaggu

SEQ ID NO: 3520122 - RNA, 17 nt, Human
cagaggugggcaggugg

SEQ ID NO: 3520123 - RNA, 20 nt, Human
cagaggugggcagguggugg

SEQ ID NO: 3520124 - RNA, 18 nt, Human
cagagguuaucuguccca

SEQ ID NO: 3520125 - RNA, 19 nt, Human
cagagguuaucugucccag

SEQ ID NO: 3520126 - RNA, 22 nt, Human
cagaguaggcuauuccugagag

SEQ ID NO: 3520127 - RNA, 22 nt, Human
cagaguaggggucugucuuuua

SEQ ID NO: 3520128 - RNA, 13 nt, Human
cagaguaugaaca

SEQ ID NO: 3520129 - RNA, 13 nt, Human
cagagucagcaga

SEQ ID NO: 3520130 - RNA, 15 nt, Human
cagagucagccagga

SEQ ID NO: 3520131 - RNA, 15 nt, Human
cagaguccaggcccc

SEQ ID NO: 3520132 - RNA, 15 nt, Human
cagaguccccccacu

SEQ ID NO: 3520133 - RNA, 13 nt, Human
cagaguccuggag

SEQ ID NO: 3520134 - RNA, 23 nt, Human
cagagucucacuguugcccaggc

SEQ ID NO: 3520135 - RNA, 23 nt, Human
cagagucucgcucuguugcccag

SEQ ID NO: 3520136 - RNA, 19 nt, Human
cagagugagacccugucuc

SEQ ID NO: 3520137 - RNA, 17 nt, Human
cagagugcacagcuguc

SEQ ID NO: 3520138 - RNA, 15 nt, Human
cagagugcccagaac

SEQ ID NO: 3520139 - RNA, 17 nt, Human
cagagugccccaccugc

SEQ ID NO: 3520140 - RNA, 18 nt, Human
cagagugccccaccugcc

SEQ ID NO: 3520141 - RNA, 23 nt, Human
cagagugccccaccugccacuag

SEQ ID NO: 3520142 - RNA, 21 nt, Human
cagagugcuuuaccaauugaa

SEQ ID NO: 3520143 - RNA, 15 nt, Human
cagaguggccuggcc

SEQ ID NO: 3520144 - RNA, 12 nt, Human
cagagugguggg

SEQ ID NO: 3520145 - RNA, 15 nt, Human
cagagugugcuggag

SEQ ID NO: 3520146 - RNA, 18 nt, Human
cagaguguggacucuggu

SEQ ID NO: 3520147 - RNA, 23 nt, Human
cagaguguggccuucggacaacu

SEQ ID NO: 3520148 - RNA, 20 nt, Human
cagagugugggaagggagag

SEQ ID NO: 3520149 - RNA, 12 nt, Human
cagaguuacagu

SEQ ID NO: 3520150 - RNA, 13 nt, Human
cagaguuacaguu

SEQ ID NO: 3520151 - RNA, 17 nt, Human
cagaguuacaguucugu

SEQ ID NO: 3520152 - RNA, 16 nt, Human
cagaguuccccaugca

SEQ ID NO: 3520153 - RNA, 19 nt, Human
cagaguugaagacagagcu

SEQ ID NO: 3520154 - RNA, 20 nt, Human
cagaguugacaugagauuua

SEQ ID NO: 3520155 - RNA, 20 nt, Human
cagaguugcugcaaaccuga

SEQ ID NO: 3520156 - RNA, 23 nt, Human
cagaguuguaaauauauaaauau

SEQ ID NO: 3520157 - RNA, 14 nt, Human
cagaguuguuacau

SEQ ID NO: 3520158 - RNA, 19 nt, Human
cagaguuugccuuccuuuc

SEQ ID NO: 3520159 - RNA, 22 nt, Human
cagaguuugccuuccuuucucc

SEQ ID NO: 3520160 - RNA, 17 nt, Human
cagaguuuguguguugu

SEQ ID NO: 3520161 - RNA, 17 nt, Human
cagaguuuucauuaaau

SEQ ID NO: 3520162 - RNA, 15 nt, Human
cagaguuuuuaugua

SEQ ID NO: 3520163 - RNA, 12 nt, Human
cagauaaagauu

SEQ ID NO: 3520164 - RNA, 21 nt, Human
cagauaaaugauucaaaaagu

SEQ ID NO: 3520165 - RNA, 23 nt, Human
cagauaaaugauucaaaaaguca

SEQ ID NO: 3520166 - RNA, 20 nt, Human
cagauaacaaugcagcaagg

SEQ ID NO: 3520167 - RNA, 14 nt, Human
cagauaacugagga

SEQ ID NO: 3520168 - RNA, 16 nt, Human
cagauaacuguuauuu

SEQ ID NO: 3520169 - RNA, 19 nt, Human
cagauaacuguuauuuaua

SEQ ID NO: 3520170 - RNA, 13 nt, Human
cagauaacuuuuu

SEQ ID NO: 3520171 - RNA, 20 nt, Human
cagauaacuuuuuuuuuucu

SEQ ID NO: 3520172 - RNA, 21 nt, Human
cagauaagaaugcugguuuuc

SEQ ID NO: 3520173 - RNA, 20 nt, Human
cagauaagcaagagagaugu

SEQ ID NO: 3520174 - RNA, 15 nt, Human
cagauaaucagccuc

SEQ ID NO: 3520175 - RNA, 17 nt, Human
cagauaaucagccucuu

SEQ ID NO: 3520176 - RNA, 16 nt, Human
cagauaaugugaaaau

SEQ ID NO: 3520177 - RNA, 20 nt, Human
cagauacaggaaaagcugcu

SEQ ID NO: 3520178 - RNA, 22 nt, Human
cagauacaggaaaagcugcuga

SEQ ID NO: 3520179 - RNA, 15 nt, Human
cagauacaucacugc

SEQ ID NO: 3520180 - RNA, 16 nt, Human
cagauacaucacugcu

SEQ ID NO: 3520181 - RNA, 19 nt, Human
cagauacaucacugcuuga

SEQ ID NO: 3520182 - RNA, 21 nt, Human
cagauaccuccaacccugccg

SEQ ID NO: 3520183 - RNA, 22 nt, Human
cagauacuacugaccagacaag

SEQ ID NO: 3520184 - RNA, 14 nt, Human
cagauacugcugug

SEQ ID NO: 3520185 - RNA, 21 nt, Human
cagauacuggaaguuuugcau

SEQ ID NO: 3520186 - RNA, 16 nt, Human
cagauagaaagcauua

SEQ ID NO: 3520187 - RNA, 20 nt, Human
cagauaguguagcugaggag

SEQ ID NO: 3520188 - RNA, 23 nt, Human
cagauauaaauggcugguuuuua

SEQ ID NO: 3520189 - RNA, 20 nt, Human
cagauauacuggaacccuuu

SEQ ID NO: 3520190 - RNA, 18 nt, Human
cagauauacuuuguggac

SEQ ID NO: 3520191 - RNA, 19 nt, Human
cagauauauuaagugacug

SEQ ID NO: 3520192 - RNA, 15 nt, Human
cagauaugauaugua

SEQ ID NO: 3520193 - RNA, 15 nt, Human
cagauaugauucaaa

SEQ ID NO: 3520194 - RNA, 16 nt, Human
cagauaugauucaaau

SEQ ID NO: 3520195 - RNA, 12 nt, Human
cagauauuuaua

SEQ ID NO: 3520196 - RNA, 20 nt, Human
cagauauuuauauuuuuauu

SEQ ID NO: 3520197 - RNA, 22 nt, Human
cagauauuuauauuuuuauuuu

SEQ ID NO: 3520198 - RNA, 15 nt, Human
cagauauuugucaug

SEQ ID NO: 3520199 - RNA, 15 nt, Human
cagauauuuuuucag

SEQ ID NO: 3520200 - RNA, 17 nt, Human
cagaucaagcugugaga

SEQ ID NO: 3520201 - RNA, 19 nt, Human
cagaucaagcugugagaca

SEQ ID NO: 3520202 - RNA, 19 nt, Human
cagaucaagggccuaucuu

SEQ ID NO: 3520203 - RNA, 18 nt, Human
cagaucacagcuucagcc

SEQ ID NO: 3520204 - RNA, 14 nt, Human
cagaucacaguguc

SEQ ID NO: 3520205 - RNA, 13 nt, Human
cagaucaccugag

SEQ ID NO: 3520206 - RNA, 15 nt, Human
cagaucauccagaag

SEQ ID NO: 3520207 - RNA, 17 nt, Human
cagaucauguuuuggug

SEQ ID NO: 3520208 - RNA, 19 nt, Human
cagaucauguuuuggugaa

SEQ ID NO: 3520209 - RNA, 23 nt, Human
cagaucauuaucagccugugcca

SEQ ID NO: 3520210 - RNA, 17 nt, Human
cagauccaggagcucca

SEQ ID NO: 3520211 - RNA, 19 nt, Human
ccccacucccuugcuggcc

SEQ ID NO: 3520212 - RNA, 23 nt, Human
ccccacucccuugcuggccccag

SEQ ID NO: 3520213 - RNA, 21 nt, Human
ccccacuccucugcugaccug

SEQ ID NO: 3520214 - RNA, 21 nt, Human
ccccacucuaggggucaggcu

SEQ ID NO: 3520215 - RNA, 16 nt, Human
ccccacucucagaggc

SEQ ID NO: 3520216 - RNA, 15 nt, Human
ccccacucucauucc

SEQ ID NO: 3520217 - RNA, 15 nt, Human
ccccacucuccccac

SEQ ID NO: 3520218 - RNA, 17 nt, Human
ccccacucugcucugau

SEQ ID NO: 3520219 - RNA, 21 nt, Human
ccccacugacagccucccacc

SEQ ID NO: 3520220 - RNA, 15 nt, Human
ccccacugaccagaa

SEQ ID NO: 3520221 - RNA, 17 nt, Human
ccccacugccagcagca

SEQ ID NO: 3520222 - RNA, 14 nt, Human
ccccacugcccuuc

SEQ ID NO: 3520223 - RNA, 12 nt, Human
ccccacugccug

SEQ ID NO: 3520224 - RNA, 16 nt, Human
ccccacugccugccca

SEQ ID NO: 3520225 - RNA, 22 nt, Human
ccccacuggcugugggcucccu

SEQ ID NO: 3520226 - RNA, 23 nt, Human
ccccacuggcugugggcucccuu

SEQ ID NO: 3520227 - RNA, 14 nt, Human
ccccacuggggaaa

SEQ ID NO: 3520228 - RNA, 18 nt, Human
ccccacuuaucccucucc

SEQ ID NO: 3520229 - RNA, 13 nt, Human
ccccacuugccuc

SEQ ID NO: 3520230 - RNA, 15 nt, Human
ccccacuugccucuu

SEQ ID NO: 3520231 - RNA, 16 nt, Human
ccccacuugccucuuc

SEQ ID NO: 3520232 - RNA, 19 nt, Human
ccccacuuguccuuagccu

SEQ ID NO: 3520233 - RNA, 23 nt, Human
ccccagacuuguuggcguaggcu

SEQ ID NO: 3520234 - RNA, 22 nt, Human
ccccagagaaagcgcagaugcu

SEQ ID NO: 3520235 - RNA, 15 nt, Human
ccccagagccacaca

SEQ ID NO: 3520236 - RNA, 14 nt, Human
ccccagagccacag

SEQ ID NO: 3520237 - RNA, 16 nt, Human
ccccagagccacaguu

SEQ ID NO: 3520238 - RNA, 13 nt, Human
ccccagagcccag

SEQ ID NO: 3520239 - RNA, 14 nt, Human
ccccagagcccagg

SEQ ID NO: 3520240 - RNA, 19 nt, Human
ccccagagccccuccucca

SEQ ID NO: 3520241 - RNA, 18 nt, Human
ccccagaggccucucucu

SEQ ID NO: 3520242 - RNA, 20 nt, Human
ccccagauagcuggcugggu

SEQ ID NO: 3520243 - RNA, 14 nt, Human
ccccagcaaagccc

SEQ ID NO: 3520244 - RNA, 22 nt, Human
ccccagcaauuaugaaaauaau

SEQ ID NO: 3520245 - RNA, 19 nt, Human
ccccagcacccgggcucag

SEQ ID NO: 3520246 - RNA, 12 nt, Human
ccccagcacuga

SEQ ID NO: 3520247 - RNA, 15 nt, Human
ccccagcacugagga

SEQ ID NO: 3520248 - RNA, 11 nt, Human
ccccagcacuu

SEQ ID NO: 3520249 - RNA, 11 nt, Human
ccccagcaggu

SEQ ID NO: 3520250 - RNA, 16 nt, Human
ccccagcaucacuccc

SEQ ID NO: 3520251 - RNA, 20 nt, Human
ccccagcaucacuccccaag

SEQ ID NO: 3520252 - RNA, 21 nt, Human
ccccagcauucucaggcacca

SEQ ID NO: 3520253 - RNA, 23 nt, Human
ccccagccagauggacuccagcc

SEQ ID NO: 3520254 - RNA, 22 nt, Human
ccccagccagccuggcugggac

SEQ ID NO: 3520255 - RNA, 17 nt, Human
ccccagccauccagggg

SEQ ID NO: 3520256 - RNA, 19 nt, Human
ccccagccaugccagcugg

SEQ ID NO: 3520257 - RNA, 23 nt, Human
ccccagccaugccagcuggccuu

SEQ ID NO: 3520258 - RNA, 14 nt, Human
ccccagcccaaagg

SEQ ID NO: 3520259 - RNA, 16 nt, Human
ccccagcccagagaca

SEQ ID NO: 3520260 - RNA, 18 nt, Human
ccccagcccagcccagcu

SEQ ID NO: 3520261 - RNA, 13 nt, Human
ccccagcccaggg

SEQ ID NO: 3520262 - RNA, 15 nt, Human
ccccagcccagggcu

SEQ ID NO: 3520263 - RNA, 13 nt, Human
ccccagccccacu

SEQ ID NO: 3520264 - RNA, 15 nt, Human
ccccagccccacuua

SEQ ID NO: 3520265 - RNA, 16 nt, Human
ccccagcccccuaaga

SEQ ID NO: 3520266 - RNA, 19 nt, Human
cagcagcccugccccacac

SEQ ID NO: 3520267 - RNA, 20 nt, Human
cagcagcccugccccacacc

SEQ ID NO: 3520268 - RNA, 21 nt, Human
cagcagccgccuuaagcugau

SEQ ID NO: 3520269 - RNA, 22 nt, Human
cagcagccgccuuaagcugauc

SEQ ID NO: 3520270 - RNA, 13 nt, Human
cagcagccucuga

SEQ ID NO: 3520271 - RNA, 16 nt, Human
cagcagccucugaagu

SEQ ID NO: 3520272 - RNA, 18 nt, Human
cagcagccucugaaguug

SEQ ID NO: 3520273 - RNA, 22 nt, Human
cagcagccuggacccuguggau

SEQ ID NO: 3520274 - RNA, 20 nt, Human
cagcagccuggggcuggccu

SEQ ID NO: 3520275 - RNA, 20 nt, Human
cagcagcgaccaccccugcc

SEQ ID NO: 3520276 - RNA, 15 nt, Human
cagcagcgguggccu

SEQ ID NO: 3520277 - RNA, 12 nt, Human
cagcagcucagg

SEQ ID NO: 3520278 - RNA, 21 nt, Human
cagcagcuuuagaaucccagc

SEQ ID NO: 3520279 - RNA, 15 nt, Human
cagcaggaggccagg

SEQ ID NO: 3520280 - RNA, 12 nt, Human
cagcaggaggga

SEQ ID NO: 3520281 - RNA, 23 nt, Human
cagcaggagggacagucucacca

SEQ ID NO: 3520282 - RNA, 15 nt, Human
cagcaggagggggga

SEQ ID NO: 3520283 - RNA, 13 nt, Human
cagcaggcagccu

SEQ ID NO: 3520284 - RNA, 11 nt, Human
cagcaggccca

SEQ ID NO: 3520285 - RNA, 14 nt, Human
cagcaggcccaugg

SEQ ID NO: 3520286 - RNA, 13 nt, Human
cagcaggccuguu

SEQ ID NO: 3520287 - RNA, 21 nt, Human
cagcaggccuguugcuuuuuu

SEQ ID NO: 3520288 - RNA, 14 nt, Human
cagcaggcucucag

SEQ ID NO: 3520289 - RNA, 15 nt, Human
cagcaggcugccagu

SEQ ID NO: 3520290 - RNA, 20 nt, Human
cagcagggagggcuucugcc

SEQ ID NO: 3520291 - RNA, 21 nt, Human
cagcagggaugcccuggaggu

SEQ ID NO: 3520292 - RNA, 15 nt, Human
cagcagggccucaaa

SEQ ID NO: 3520293 - RNA, 21 nt, Human
cagcagggcuacccugagcug

SEQ ID NO: 3520294 - RNA, 18 nt, Human
cagcagggcugcugugaa

SEQ ID NO: 3520295 - RNA, 18 nt, Human
cagcagguagccugcugg

SEQ ID NO: 3520296 - RNA, 22 nt, Human
cagcagguccuccaucccaaca

SEQ ID NO: 3520297 - RNA, 18 nt, Human
cagcaggugauuggacca

SEQ ID NO: 3520298 - RNA, 20 nt, Human
cagcaggugauuggaccagg

SEQ ID NO: 3520299 - RNA, 15 nt, Human
cagcagucucugccu

SEQ ID NO: 3520300 - RNA, 17 nt, Human
cagcagucucugccuug

SEQ ID NO: 3520301 - RNA, 23 nt, Human
cagcagugaaaacaagugcuggc

SEQ ID NO: 3520302 - RNA, 15 nt, Human
cagcagugagacugg

SEQ ID NO: 3520303 - RNA, 16 nt, Human
cagcagugagacuggg

SEQ ID NO: 3520304 - RNA, 19 nt, Human
cagcagugagucucuucag

SEQ ID NO: 3520305 - RNA, 16 nt, Human
cagcagugcagccggg

SEQ ID NO: 3520306 - RNA, 22 nt, Human
cagcagugugaggccagggcag

SEQ ID NO: 3520307 - RNA, 12 nt, Human
cagcaguguucc

SEQ ID NO: 3520308 - RNA, 13 nt, Human
cagcaguguuccc

SEQ ID NO: 3520309 - RNA, 19 nt, Human
cagcaguguuccccaucug

SEQ ID NO: 3520310 - RNA, 13 nt, Human
cagcaguucuguu

SEQ ID NO: 3520311 - RNA, 14 nt, Human
cagcaguucuguua

SEQ ID NO: 3520312 - RNA, 21 nt, Human
cagcaguugaaaagacuccaa

SEQ ID NO: 3520313 - RNA, 22 nt, Human
cagcaguugcugguaaaaugaa

SEQ ID NO: 3520314 - RNA, 14 nt, Human
cagcaguuguuauu

SEQ ID NO: 3520315 - RNA, 21 nt, Human
cagcaguuuucuuuuaauuuu

SEQ ID NO: 3520316 - RNA, 14 nt, Human
cagcauaaaggccu

SEQ ID NO: 3520317 - RNA, 15 nt, Human
cagcauaaaggccuu

SEQ ID NO: 3520318 - RNA, 16 nt, Human
cagcauaccugcuggu

SEQ ID NO: 3520319 - RNA, 19 nt, Human
cagcauagcaagacacauc

SEQ ID NO: 3520320 - RNA, 20 nt, Human
cagcauaugggggccuggau

SEQ ID NO: 3520321 - RNA, 16 nt, Human
cagcauauucaggaag

SEQ ID NO: 3520322 - RNA, 19 nt, Human
cagcauauucaggaagcuc

SEQ ID NO: 3520323 - RNA, 12 nt, Human
cagcauauuuau

SEQ ID NO: 3520324 - RNA, 14 nt, Human
cagcauauuuauag

SEQ ID NO: 3520325 - RNA, 18 nt, Human
cagcauauuuauagcaau

SEQ ID NO: 3520326 - RNA, 15 nt, Human
cagcaucaccugccu

SEQ ID NO: 3520327 - RNA, 15 nt, Human
cagcaucacucccca

SEQ ID NO: 3520328 - RNA, 20 nt, Human
cagcaucauggagguuugaa

SEQ ID NO: 3520329 - RNA, 22 nt, Human
cagcaucccuugaccaggccug

SEQ ID NO: 3520330 - RNA, 17 nt, Human
cagcauccgcaggugcu

SEQ ID NO: 3520331 - RNA, 23 nt, Human
cagcauccgcaggugcugguccc

SEQ ID NO: 3520332 - RNA, 14 nt, Human
cagcauccuggcac

SEQ ID NO: 3520333 - RNA, 16 nt, Human
cagcauccuggcaccc

SEQ ID NO: 3520334 - RNA, 18 nt, Human
cagcaucgcacucuggca

SEQ ID NO: 3520335 - RNA, 14 nt, Human
cagcaucucagcuc

SEQ ID NO: 3520336 - RNA, 16 nt, Human
cagcaucuccaagcag

SEQ ID NO: 3520337 - RNA, 18 nt, Human
cagcaucuccaagcagcu

SEQ ID NO: 3520338 - RNA, 14 nt, Human
cagcaucuggaaga

SEQ ID NO: 3520339 - RNA, 15 nt, Human
cagcaucugggccuu

SEQ ID NO: 3520340 - RNA, 17 nt, Human
cagcaugaauuuguaau

SEQ ID NO: 3520341 - RNA, 17 nt, Human
cagcaugcaccacgggc

SEQ ID NO: 3520342 - RNA, 20 nt, Human
cagcauggcacucccuccag

SEQ ID NO: 3520343 - RNA, 15 nt, Human
cagcauggcauccaa

SEQ ID NO: 3520344 - RNA, 20 nt, Human
cagcauggucccugccuuag

SEQ ID NO: 3520345 - RNA, 18 nt, Human
cagcauguauaguugcuu

SEQ ID NO: 3520346 - RNA, 19 nt, Human
cagcauguauaguugcuuu

SEQ ID NO: 3520347 - RNA, 18 nt, Human
cagcaugucuauucagcu

SEQ ID NO: 3520348 - RNA, 16 nt, Human
cagcauuagugggaaa

SEQ ID NO: 3520349 - RNA, 14 nt, Human
cagcauuccagccc

SEQ ID NO: 3520350 - RNA, 20 nt, Human
cagcauuccagccccucugg

SEQ ID NO: 3520351 - RNA, 17 nt, Human
cagcauucccagguagg

SEQ ID NO: 3520352 - RNA, 18 nt, Human
cagcauucccagguaggc

SEQ ID NO: 3520353 - RNA, 20 nt, Human
cagcauucccagguaggcca

SEQ ID NO: 3520354 - RNA, 16 nt, Human
cagcauucucacuccu

SEQ ID NO: 3520355 - RNA, 18 nt, Human
cagcauucucaggcacca

SEQ ID NO: 3520356 - RNA, 17 nt, Human
ccccaucucccugccug

SEQ ID NO: 3520357 - RNA, 13 nt, Human
ccccaucugugaa

SEQ ID NO: 3520358 - RNA, 16 nt, Human
ccccaucuucgggacc

SEQ ID NO: 3520359 - RNA, 19 nt, Human
ccccaucuucgggaccagg

SEQ ID NO: 3520360 - RNA, 15 nt, Human
ccccaugaggaagga

SEQ ID NO: 3520361 - RNA, 15 nt, Human
ccccaugauguaagu

SEQ ID NO: 3520362 - RNA, 13 nt, Human
ccccaugcagucu

SEQ ID NO: 3520363 - RNA, 16 nt, Human
ccccaugccacguucc

SEQ ID NO: 3520364 - RNA, 19 nt, Human
ccccaugccuguccagccu

SEQ ID NO: 3520365 - RNA, 21 nt, Human
ccccaugccuguccagccugg

SEQ ID NO: 3520366 - RNA, 23 nt, Human
ccccaugccuguccagccugggc

SEQ ID NO: 3520367 - RNA, 15 nt, Human
ccccaugcuggagcc

SEQ ID NO: 3520368 - RNA, 16 nt, Human
ccccaugcuggagccu

SEQ ID NO: 3520369 - RNA, 18 nt, Human
ccccaugcuggagccugu

SEQ ID NO: 3520370 - RNA, 21 nt, Human
ccccaugcuggagccugugua

SEQ ID NO: 3520371 - RNA, 23 nt, Human
ccccaugcuggagccuguguaac

SEQ ID NO: 3520372 - RNA, 18 nt, Human
ccccaugcuggccuugcc

SEQ ID NO: 3520373 - RNA, 19 nt, Human
ccccauggagcugggcuaa

SEQ ID NO: 3520374 - RNA, 17 nt, Human
ccccauggcccugagcg

SEQ ID NO: 3520375 - RNA, 17 nt, Human
ccccauggcugcacagu

SEQ ID NO: 3520376 - RNA, 19 nt, Human
ccccauggucagcccuagg

SEQ ID NO: 3520377 - RNA, 20 nt, Human
ccccauggugcuaggaagag

SEQ ID NO: 3520378 - RNA, 21 nt, Human
ccccauggugcuaggaagagg

SEQ ID NO: 3520379 - RNA, 18 nt, Human
ccccaugugccugcacca

SEQ ID NO: 3520380 - RNA, 16 nt, Human
ccccauguguccuggu

SEQ ID NO: 3520381 - RNA, 15 nt, Human
ccccauguucugucc

SEQ ID NO: 3520382 - RNA, 23 nt, Human
ccccauuagcuuucaauuccgua

SEQ ID NO: 3520383 - RNA, 14 nt, Human
ccccauucugccug

SEQ ID NO: 3520384 - RNA, 21 nt, Human
ccccauucugccugcccaggc

SEQ ID NO: 3520385 - RNA, 23 nt, Human
ccccauucuuccuaguuuucucc

SEQ ID NO: 3520386 - RNA, 18 nt, Human
ccccauuucccaucugca

SEQ ID NO: 3520387 - RNA, 19 nt, Human
ccccauuucccaucugcac

SEQ ID NO: 3520388 - RNA, 15 nt, Human
ccccauuuucugugg

SEQ ID NO: 3520389 - RNA, 16 nt, Human
cccccaacacugugcc

SEQ ID NO: 3520390 - RNA, 23 nt, Human
cccccaacacugugcccuggugg

SEQ ID NO: 3520391 - RNA, 14 nt, Human
cccccaaccccuga

SEQ ID NO: 3520392 - RNA, 16 nt, Human
cccccaaccccugagg

SEQ ID NO: 3520393 - RNA, 14 nt, Human
cccccaagccugca

SEQ ID NO: 3520394 - RNA, 23 nt, Human
cccccaaggggcagucuggaggg

SEQ ID NO: 3520395 - RNA, 11 nt, Human
cccccacacac

SEQ ID NO: 3520396 - RNA, 16 nt, Human
cccccacaccuggccc

SEQ ID NO: 3520397 - RNA, 17 nt, Human
cccccacacuucccugg

SEQ ID NO: 3520398 - RNA, 20 nt, Human
cccccacacuucccuggcgg

SEQ ID NO: 3520399 - RNA, 22 nt, Human
cccccaccacggccacuggcca

SEQ ID NO: 3520400 - RNA, 13 nt, Human
cccccacccaagg

SEQ ID NO: 3520401 - RNA, 17 nt, Human
cccccacccccagcuca

SEQ ID NO: 3520402 - RNA, 20 nt, Human
cccccaccccggggacccug

SEQ ID NO: 3520403 - RNA, 11 nt, Human
cccccacccug

SEQ ID NO: 3520404 - RNA, 14 nt, Human
cccccacccuguuc

SEQ ID NO: 3520405 - RNA, 16 nt, Human
cccccaccgguccagc

SEQ ID NO: 3520406 - RNA, 19 nt, Human
cccccaccgguccagcugg

SEQ ID NO: 3520407 - RNA, 21 nt, Human
cccccaccgguccagcuggcc

SEQ ID NO: 3520408 - RNA, 15 nt, Human
cccccaccuggcuca

SEQ ID NO: 3520409 - RNA, 19 nt, Human
cccccacugaaucccugua

SEQ ID NO: 3520410 - RNA, 14 nt, Human
cccccacugcaggc

SEQ ID NO: 3520411 - RNA, 11 nt, Human
cccccacuggu

SEQ ID NO: 3520412 - RNA, 15 nt, Human
cccccacuggugaca

SEQ ID NO: 3520413 - RNA, 15 nt, Human
cccccagaaccuguc

SEQ ID NO: 3520414 - RNA, 16 nt, Human
cccccagagccacagu

SEQ ID NO: 3520415 - RNA, 13 nt, Human
cccccagcacuga

SEQ ID NO: 3520416 - RNA, 19 nt, Human
cccccagccaugccagcug

SEQ ID NO: 3520417 - RNA, 13 nt, Human
cccccagcccagg

SEQ ID NO: 3520418 - RNA, 24 nt, Human
cccccagccccgacuccagccagc

SEQ ID NO: 3520419 - RNA, 13 nt, Human
cccccagccccgg

SEQ ID NO: 3520420 - RNA, 13 nt, Human
cccccagcccugu

SEQ ID NO: 3520421 - RNA, 13 nt, Human
cccccagccuaug

SEQ ID NO: 3520422 - RNA, 12 nt, Human
cccccagccugc

SEQ ID NO: 3520423 - RNA, 13 nt, Human
cccccagccuggg

SEQ ID NO: 3520424 - RNA, 16 nt, Human
cccccagccugggccu

SEQ ID NO: 3520425 - RNA, 22 nt, Human
cagccacuucggccaggucaca

SEQ ID NO: 3520426 - RNA, 17 nt, Human
cagccagaaccccgagc

SEQ ID NO: 3520427 - RNA, 20 nt, Human
cagccagaacguggcucugc

SEQ ID NO: 3520428 - RNA, 21 nt, Human
cagccagaacguggcucugcu

SEQ ID NO: 3520429 - RNA, 23 nt, Human
cagccagaacguggcucugcugg

SEQ ID NO: 3520430 - RNA, 23 nt, Human
cagccagaagccacccaaagcag

SEQ ID NO: 3520431 - RNA, 20 nt, Human
cagccagaccuauuccuccu

SEQ ID NO: 3520432 - RNA, 18 nt, Human
cagccagacuggcacagu

SEQ ID NO: 3520433 - RNA, 21 nt, Human
cagccagaguuccugcggagu

SEQ ID NO: 3520434 - RNA, 22 nt, Human
cagccagcaaugauguccagaa

SEQ ID NO: 3520435 - RNA, 12 nt, Human
cagccagcaccu

SEQ ID NO: 3520436 - RNA, 13 nt, Human
cagccagcaccug

SEQ ID NO: 3520437 - RNA, 13 nt, Human
cagccagcagcag

SEQ ID NO: 3520438 - RNA, 14 nt, Human
cagccagcagccag

SEQ ID NO: 3520439 - RNA, 15 nt, Human
cagccagcagccagc

SEQ ID NO: 3520440 - RNA, 19 nt, Human
cagccagcagccagcucuc

SEQ ID NO: 3520441 - RNA, 13 nt, Human
cagccagcaucug

SEQ ID NO: 3520442 - RNA, 14 nt, Human
cagccagcaucugg

SEQ ID NO: 3520443 - RNA, 15 nt, Human
cagccagcaucuggg

SEQ ID NO: 3520444 - RNA, 13 nt, Human
cagccagccacuc

SEQ ID NO: 3520445 - RNA, 14 nt, Human
cagccagccacucu

SEQ ID NO: 3520446 - RNA, 14 nt, Human
cagccagcccagcc

SEQ ID NO: 3520447 - RNA, 16 nt, Human
cagccagcccagccca

SEQ ID NO: 3520448 - RNA, 13 nt, Human
cagccagcccugc

SEQ ID NO: 3520449 - RNA, 14 nt, Human
cagccagcccugcc

SEQ ID NO: 3520450 - RNA, 15 nt, Human
cagccagcccugccu

SEQ ID NO: 3520451 - RNA, 13 nt, Human
cagccagccuggc

SEQ ID NO: 3520452 - RNA, 16 nt, Human
cagccagcgccucccu

SEQ ID NO: 3520453 - RNA, 19 nt, Human
cagccagcgccucccucca

SEQ ID NO: 3520454 - RNA, 20 nt, Human
cagccagcgccucccuccac

SEQ ID NO: 3520455 - RNA, 22 nt, Human
cagccagcgccucccuccaccc

SEQ ID NO: 3520456 - RNA, 17 nt, Human
cagccagcucucagcca

SEQ ID NO: 3520457 - RNA, 11 nt, Human
cagccaggaca

SEQ ID NO: 3520458 - RNA, 12 nt, Human
cagccaggacac

SEQ ID NO: 3520459 - RNA, 20 nt, Human
cagccaggacaccgggcagg

SEQ ID NO: 3520460 - RNA, 22 nt, Human
cagccaggacagucagcucucu

SEQ ID NO: 3520461 - RNA, 15 nt, Human
cagccaggagagcuu

SEQ ID NO: 3520462 - RNA, 12 nt, Human
cagccaggagcu

SEQ ID NO: 3520463 - RNA, 12 nt, Human
cagccaggccac

SEQ ID NO: 3520464 - RNA, 15 nt, Human
cagccaggcccagcc

SEQ ID NO: 3520465 - RNA, 15 nt, Human
cagccaggcgggcuc

SEQ ID NO: 3520466 - RNA, 19 nt, Human
cagccaggcucaggccaug

SEQ ID NO: 3520467 - RNA, 14 nt, Human
cagccaggcucugu

SEQ ID NO: 3520468 - RNA, 22 nt, Human
cagccagggaaagacuggcaag

SEQ ID NO: 3520469 - RNA, 23 nt, Human
cagccagggaaagacuggcaaga

SEQ ID NO: 3520470 - RNA, 20 nt, Human
cagccagggagagcccagga

SEQ ID NO: 3520471 - RNA, 21 nt, Human
cagccagggagagcccaggag

SEQ ID NO: 3520472 - RNA, 11 nt, Human
cagccagggcc

SEQ ID NO: 3520473 - RNA, 12 nt, Human
cagccagggcca

SEQ ID NO: 3520474 - RNA, 15 nt, Human
cagccagggccaggg

SEQ ID NO: 3520475 - RNA, 22 nt, Human
cagccagggccugcgagggcag

SEQ ID NO: 3520476 - RNA, 13 nt, Human
cagccagggcugc

SEQ ID NO: 3520477 - RNA, 14 nt, Human
cagccaggugccuu

SEQ ID NO: 3520478 - RNA, 13 nt, Human
cagccaguaaaug

SEQ ID NO: 3520479 - RNA, 19 nt, Human
cagccagugaccugaggaa

SEQ ID NO: 3520480 - RNA, 23 nt, Human
cagccauacuuaucucucugugc

SEQ ID NO: 3520481 - RNA, 14 nt, Human
cagccaucaacuaa

SEQ ID NO: 3520482 - RNA, 18 nt, Human
cagccaucaagagacuga

SEQ ID NO: 3520483 - RNA, 23 nt, Human
cagccaucucaugaggggagagg

SEQ ID NO: 3520484 - RNA, 15 nt, Human
cagccaucugcccag

SEQ ID NO: 3520485 - RNA, 18 nt, Human
cagccaucugcccagggg

SEQ ID NO: 3520486 - RNA, 16 nt, Human
cagccaugccagcugg

SEQ ID NO: 3520487 - RNA, 19 nt, Human
cagccauguacagacagag

SEQ ID NO: 3520488 - RNA, 17 nt, Human
cagccaugucugcauuu

SEQ ID NO: 3520489 - RNA, 20 nt, Human
cagccauuacccagcuaaau

SEQ ID NO: 3520490 - RNA, 23 nt, Human
cagccauuacccagcuaaauaau

SEQ ID NO: 3520491 - RNA, 21 nt, Human
cagccauugcacccagcccag

SEQ ID NO: 3520492 - RNA, 22 nt, Human
cagccauugcacccagcccaga

SEQ ID NO: 3520493 - RNA, 23 nt, Human
cagcccaaaccaccagaagccca

SEQ ID NO: 3520494 - RNA, 20 nt, Human
cagcccaaaggggacaggcc

SEQ ID NO: 3520495 - RNA, 11 nt, Human
cagcccacccc

SEQ ID NO: 3520496 - RNA, 14 nt, Human
cagcccaccccccu

SEQ ID NO: 3520497 - RNA, 16 nt, Human
cagcccaccccccuca

SEQ ID NO: 3520498 - RNA, 17 nt, Human
cagcccaccccccucau

SEQ ID NO: 3520499 - RNA, 19 nt, Human
cagcccaccccccucauuu

SEQ ID NO: 3520500 - RNA, 15 nt, Human
cagcccaccccucaa

SEQ ID NO: 3520501 - RNA, 13 nt, Human
cagcccacccugc

SEQ ID NO: 3520502 - RNA, 24 nt, Human
cagccucuccacucaugugacucu

SEQ ID NO: 3520503 - RNA, 19 nt, Human
cagccucuccccugauuac

SEQ ID NO: 3520504 - RNA, 21 nt, Human
cagccucucuuccuaucccau

SEQ ID NO: 3520505 - RNA, 20 nt, Human
cagccucugaaguuggacag

SEQ ID NO: 3520506 - RNA, 14 nt, Human
cagccucugacccc

SEQ ID NO: 3520507 - RNA, 16 nt, Human
cagccucugaccccuc

SEQ ID NO: 3520508 - RNA, 18 nt, Human
cagccucugaccccuccu

SEQ ID NO: 3520509 - RNA, 19 nt, Human
cagccucugaccccuccuc

SEQ ID NO: 3520510 - RNA, 21 nt, Human
cagccucugaccccuccucac

SEQ ID NO: 3520511 - RNA, 22 nt, Human
cagccucugaccccuccucacu

SEQ ID NO: 3520512 - RNA, 19 nt, Human
cagccucugagccccuggg

SEQ ID NO: 3520513 - RNA, 13 nt, Human
cagccucugggcc

SEQ ID NO: 3520514 - RNA, 19 nt, Human
cagccucuuaaagcugccu

SEQ ID NO: 3520515 - RNA, 20 nt, Human
cagccucuuaaagcugccug

SEQ ID NO: 3520516 - RNA, 15 nt, Human
cagccucuuucccuu

SEQ ID NO: 3520517 - RNA, 18 nt, Human
cagccucuuucccuucca

SEQ ID NO: 3520518 - RNA, 15 nt, Human
cagccugaccuuccu

SEQ ID NO: 3520519 - RNA, 22 nt, Human
cagccugaccuuccuuccuguu

SEQ ID NO: 3520520 - RNA, 16 nt, Human
cagccugagcaacucu

SEQ ID NO: 3520521 - RNA, 19 nt, Human
cagccugaggcugagacug

SEQ ID NO: 3520522 - RNA, 14 nt, Human
cagccugagucucc

SEQ ID NO: 3520523 - RNA, 17 nt, Human
cagccugagucuccugu

SEQ ID NO: 3520524 - RNA, 18 nt, Human
cagccugagucuccugug

SEQ ID NO: 3520525 - RNA, 19 nt, Human
cagccugagucuccugugc

SEQ ID NO: 3520526 - RNA, 16 nt, Human
cagccugccacucagg

SEQ ID NO: 3520527 - RNA, 14 nt, Human
cagccugccccgga

SEQ ID NO: 3520528 - RNA, 21 nt, Human
cagccugccuugcccacuccu

SEQ ID NO: 3520529 - RNA, 17 nt, Human
cagccugcgccugcugc

SEQ ID NO: 3520530 - RNA, 21 nt, Human
cagccugcgccugcugcaugc

SEQ ID NO: 3520531 - RNA, 18 nt, Human
cagccugcuagcuagcuc

SEQ ID NO: 3520532 - RNA, 12 nt, Human
cagccugcucca

SEQ ID NO: 3520533 - RNA, 16 nt, Human
cagccugcuccagcug

SEQ ID NO: 3520534 - RNA, 17 nt, Human
cagccugcuccagcugu

SEQ ID NO: 3520535 - RNA, 19 nt, Human
cagccugcuccagcuguuc

SEQ ID NO: 3520536 - RNA, 21 nt, Human
cagccugcucuagugggacag

SEQ ID NO: 3520537 - RNA, 14 nt, Human
cagccugcugccca

SEQ ID NO: 3520538 - RNA, 15 nt, Human
cagccugcugcccag

SEQ ID NO: 3520539 - RNA, 18 nt, Human
cagccuggacccccagcu

SEQ ID NO: 3520540 - RNA, 15 nt, Human
cagccuggacccugu

SEQ ID NO: 3520541 - RNA, 19 nt, Human
cagccuggacccuguggau

SEQ ID NO: 3520542 - RNA, 17 nt, Human
cagccuggagacccacc

SEQ ID NO: 3520543 - RNA, 17 nt, Human
cagccuggaucuccuca

SEQ ID NO: 3520544 - RNA, 21 nt, Human
cagccuggaugccauccaagu

SEQ ID NO: 3520545 - RNA, 13 nt, Human
cagccuggcacag

SEQ ID NO: 3520546 - RNA, 17 nt, Human
cagccuggccacgcagc

SEQ ID NO: 3520547 - RNA, 18 nt, Human
cagccuggccacgcagcc

SEQ ID NO: 3520548 - RNA, 22 nt, Human
cagccuggccacgcagccagga

SEQ ID NO: 3520549 - RNA, 14 nt, Human
cagccuggccagac

SEQ ID NO: 3520550 - RNA, 20 nt, Human
cagccuggccagacacaggc

SEQ ID NO: 3520551 - RNA, 16 nt, Human
cagccuggcccagcuc

SEQ ID NO: 3520552 - RNA, 17 nt, Human
cagccuggcccagcucc

SEQ ID NO: 3520553 - RNA, 18 nt, Human
cagccuggcccagcuccc

SEQ ID NO: 3520554 - RNA, 12 nt, Human
cagccuggccuc

SEQ ID NO: 3520555 - RNA, 21 nt, Human
cagccuggcucccacaggcag

SEQ ID NO: 3520556 - RNA, 22 nt, Human
cagccuggcucccacaggcagc

SEQ ID NO: 3520557 - RNA, 19 nt, Human
cagccuggcucccaggaca

SEQ ID NO: 3520558 - RNA, 18 nt, Human
cagccuggcuccccuggg

SEQ ID NO: 3520559 - RNA, 23 nt, Human
cagccuggcuguggccuaaccug

SEQ ID NO: 3520560 - RNA, 17 nt, Human
cagccugggaggcacag

SEQ ID NO: 3520561 - RNA, 20 nt, Human
cagccugggaggcacagcaa

SEQ ID NO: 3520562 - RNA, 20 nt, Human
cagccugggcaacagagcaa

SEQ ID NO: 3520563 - RNA, 19 nt, Human
cagccugggcaaugugaua

SEQ ID NO: 3520564 - RNA, 17 nt, Human
cagccugggcagccagg

SEQ ID NO: 3520565 - RNA, 21 nt, Human
cagccugggcagccaggcugc

SEQ ID NO: 3520566 - RNA, 13 nt, Human
cagccugggccca

SEQ ID NO: 3520567 - RNA, 17 nt, Human
cagccugggccuaugga

SEQ ID NO: 3520568 - RNA, 16 nt, Human
cagccugggcgcuggu

SEQ ID NO: 3520569 - RNA, 19 nt, Human
cagccugggcgcugguccu

SEQ ID NO: 3520570 - RNA, 13 nt, Human
cagccuggggccu

SEQ ID NO: 3520571 - RNA, 17 nt, Human
cagccuggggccuggca

SEQ ID NO: 3520572 - RNA, 18 nt, Human
cagccuggggccuggcag

SEQ ID NO: 3520573 - RNA, 17 nt, Human
cagccuggggcuggccu

SEQ ID NO: 3520574 - RNA, 21 nt, Human
cagccuggggcuggccuccca

SEQ ID NO: 3520575 - RNA, 20 nt, Human
cagccugggugacagaguga

SEQ ID NO: 3520576 - RNA, 19 nt, Human
cagccuggucgccuuccac

SEQ ID NO: 3520577 - RNA, 16 nt, Human
cagccuggugggccuc

SEQ ID NO: 3520578 - RNA, 17 nt, Human
cagccuguaucuugggg

SEQ ID NO: 3520579 - RNA, 16 nt, Human
cagccugucagaucca

SEQ ID NO: 3520580 - RNA, 17 nt, Human
cagccugucagauccag

SEQ ID NO: 3520581 - RNA, 21 nt, Human
cagccugucccauggacacuc

SEQ ID NO: 3520582 - RNA, 16 nt, Human
cagccuguuggacccg

SEQ ID NO: 3520583 - RNA, 21 nt, Human
cagccuucccccucccagggc

SEQ ID NO: 3520584 - RNA, 14 nt, Human
cagccuuccucugc

SEQ ID NO: 3520585 - RNA, 23 nt, Human
cagccuuccucugcagcugaccu

SEQ ID NO: 3520586 - RNA, 17 nt, Human
cagccuucuuuuucugg

SEQ ID NO: 3520587 - RNA, 19 nt, Human
cagccuucuuuuucuggac

SEQ ID NO: 3520588 - RNA, 19 nt, Human
cagccuugaacucugggcu

SEQ ID NO: 3520589 - RNA, 22 nt, Human
cagccuugaccauucuccaccu

SEQ ID NO: 3520590 - RNA, 15 nt, Human
cagccuugagcccug

SEQ ID NO: 3520591 - RNA, 14 nt, Human
cagccuugccagag

SEQ ID NO: 3520592 - RNA, 21 nt, Human
cagccuuggauaaugcuguug

SEQ ID NO: 3520593 - RNA, 17 nt, Human
cagccuuggcaucuaga

SEQ ID NO: 3520594 - RNA, 20 nt, Human
cagccuuucucccaggccag

SEQ ID NO: 3520595 - RNA, 23 nt, Human
cagccuuucucccaggccaggcu

SEQ ID NO: 3520596 - RNA, 20 nt, Human
cagccuuucuggcagguccu

SEQ ID NO: 3520597 - RNA, 23 nt, Human
cagccuuugaucagguggggagu

SEQ ID NO: 3520598 - RNA, 19 nt, Human
cagcgacauagcccauccc

SEQ ID NO: 3520599 - RNA, 20 nt, Human
cagcgacauagcccaucccu

SEQ ID NO: 3520600 - RNA, 18 nt, Human
cagcgaccgcccccuccu

SEQ ID NO: 3520601 - RNA, 12 nt, Human
cagcgacuggca

SEQ ID NO: 3520602 - RNA, 21 nt, Human
cagcgagauaccccaccuccc

SEQ ID NO: 3520603 - RNA, 13 nt, Human
cagcgagcccugg

SEQ ID NO: 3520604 - RNA, 17 nt, Human
cagcgagcccugguggc

SEQ ID NO: 3520605 - RNA, 13 nt, Human
cagcgagccugcu

SEQ ID NO: 3520606 - RNA, 16 nt, Human
cagcgaggaggcucca

SEQ ID NO: 3520607 - RNA, 15 nt, Human
cagcgagggcagcug

SEQ ID NO: 3520608 - RNA, 16 nt, Human
cagcgagggcagcugc

SEQ ID NO: 3520609 - RNA, 17 nt, Human
cagcgagggcagcugcu

SEQ ID NO: 3520610 - RNA, 20 nt, Human
cagcgaucucuccacugugc

SEQ ID NO: 3520611 - RNA, 22 nt, Human
cagcgauucccucucccaggcc

SEQ ID NO: 3520612 - RNA, 15 nt, Human
cagcgcacagcugcu

SEQ ID NO: 3520613 - RNA, 19 nt, Human
cagcgccaagcaaccuggg

SEQ ID NO: 3520614 - RNA, 23 nt, Human
cagcgccaagcaaccugggucca

SEQ ID NO: 3520615 - RNA, 23 nt, Human
cagcgccaagugcgugccgugug

SEQ ID NO: 3520616 - RNA, 20 nt, Human
cagcgccaggcugaccacag

SEQ ID NO: 3520617 - RNA, 14 nt, Human
cagcgcccgcuggg

SEQ ID NO: 3520618 - RNA, 18 nt, Human
cagcgcccuuccucucca

SEQ ID NO: 3520619 - RNA, 14 nt, Human
cagcgccucccucc

SEQ ID NO: 3520620 - RNA, 16 nt, Human
cagcgccucccuccac

SEQ ID NO: 3520621 - RNA, 22 nt, Human
cagcgccucccuccaccccagg

SEQ ID NO: 3520622 - RNA, 23 nt, Human
cagcgcuccugcuaacggugcuc

SEQ ID NO: 3520623 - RNA, 13 nt, Human
cagcgcucugccu

SEQ ID NO: 3520624 - RNA, 18 nt, Human
cagcgcucuggugcugca

SEQ ID NO: 3520625 - RNA, 20 nt, Human
cagcgcuggccgggaccccg

SEQ ID NO: 3520626 - RNA, 22 nt, Human
cagcgcuggccgggaccccgag

SEQ ID NO: 3520627 - RNA, 16 nt, Human
cagcggccccucccac

SEQ ID NO: 3520628 - RNA, 22 nt, Human
cccaggggucucccuggcuccc

SEQ ID NO: 3520629 - RNA, 23 nt, Human
cccaggggucucccuggcucccu

SEQ ID NO: 3520630 - RNA, 18 nt, Human
cccaggggugcccccucc

SEQ ID NO: 3520631 - RNA, 19 nt, Human
cccaggguagcccgccugc

SEQ ID NO: 3520632 - RNA, 18 nt, Human
cccaggguccugggagga

SEQ ID NO: 3520633 - RNA, 15 nt, Human
cccaggguggccaca

SEQ ID NO: 3520634 - RNA, 19 nt, Human
cccaggguggccacaccuc

SEQ ID NO: 3520635 - RNA, 19 nt, Human
cccaggguuaauagggccu

SEQ ID NO: 3520636 - RNA, 18 nt, Human
cccaggguucaguccuca

SEQ ID NO: 3520637 - RNA, 17 nt, Human
cccagguaagcaggagg

SEQ ID NO: 3520638 - RNA, 14 nt, Human
cccagguaccagcu

SEQ ID NO: 3520639 - RNA, 16 nt, Human
cccagguaccagcugc

SEQ ID NO: 3520640 - RNA, 17 nt, Human
cccagguaccagcugcg

SEQ ID NO: 3520641 - RNA, 16 nt, Human
cccagguagcugggau

SEQ ID NO: 3520642 - RNA, 20 nt, Human
cccagguagcugggauuaca

SEQ ID NO: 3520643 - RNA, 21 nt, Human
cccagguaggggccccucuca

SEQ ID NO: 3520644 - RNA, 22 nt, Human
cccagguaggggccccucucag

SEQ ID NO: 3520645 - RNA, 15 nt, Human
cagcggccccugcau

SEQ ID NO: 3520646 - RNA, 16 nt, Human
cagcggccccugcauc

SEQ ID NO: 3520647 - RNA, 20 nt, Human
cagcggccccugcauccccu

SEQ ID NO: 3520648 - RNA, 14 nt, Human
cagcggcccuguca

SEQ ID NO: 3520649 - RNA, 14 nt, Human
cagcggcuggugca

SEQ ID NO: 3520650 - RNA, 18 nt, Human
cagcggcuggugcagggc

SEQ ID NO: 3520651 - RNA, 21 nt, Human
cagcggcuugccugccugcuc

SEQ ID NO: 3520652 - RNA, 20 nt, Human
cagcgggcagguucugccug

SEQ ID NO: 3520653 - RNA, 17 nt, Human
cagcggggacagcuccu

SEQ ID NO: 3520654 - RNA, 21 nt, Human
cagcggggacagcuccuucug

SEQ ID NO: 3520655 - RNA, 18 nt, Human
cagcggggccccagggcu

SEQ ID NO: 3520656 - RNA, 23 nt, Human
cagcggggccuggcgggaugggc

SEQ ID NO: 3520657 - RNA, 18 nt, Human
cagcgggggccagggaag

SEQ ID NO: 3520658 - RNA, 14 nt, Human
cagcgguggccucu

SEQ ID NO: 3520659 - RNA, 14 nt, Human
cagcguaaaauggu

SEQ ID NO: 3520660 - RNA, 16 nt, Human
cagcguaaaaugguga

SEQ ID NO: 3520661 - RNA, 17 nt, Human
cagcguaaaauggugaa

SEQ ID NO: 3520662 - RNA, 17 nt, Human
cagcguagccucuccgg

SEQ ID NO: 3520663 - RNA, 23 nt, Human
cagcguauauauaagaaagacau

SEQ ID NO: 3520664 - RNA, 14 nt, Human
cagcgucccagucu

SEQ ID NO: 3520665 - RNA, 21 nt, Human
cagcgucccagucucuggcag

SEQ ID NO: 3520666 - RNA, 18 nt, Human
cagcgucccuagcaguga

SEQ ID NO: 3520667 - RNA, 18 nt, Human
cagcgucggucugugccc

SEQ ID NO: 3520668 - RNA, 15 nt, Human
cagcgugcuuuaaaa

SEQ ID NO: 3520669 - RNA, 13 nt, Human
cagcguugcaugu

SEQ ID NO: 3520670 - RNA, 17 nt, Human
cagcguugcaugucgug

SEQ ID NO: 3520671 - RNA, 14 nt, Human
cagcguuucuauga

SEQ ID NO: 3520672 - RNA, 20 nt, Human
cagcguuugaggggcuggcc

SEQ ID NO: 3520673 - RNA, 15 nt, Human
cagcguuuugcaagg

SEQ ID NO: 3520674 - RNA, 22 nt, Human
cagcuaaagcccaaccuccuga

SEQ ID NO: 3520675 - RNA, 17 nt, Human
cagcuaacaauugugaa

SEQ ID NO: 3520676 - RNA, 15 nt, Human
cagcuaacacacagc

SEQ ID NO: 3520677 - RNA, 20 nt, Human
cagcuaacacacagcuccca

SEQ ID NO: 3520678 - RNA, 16 nt, Human
cagcuaagaaccugga

SEQ ID NO: 3520679 - RNA, 15 nt, Human
cagcuaagcuaggaa

SEQ ID NO: 3520680 - RNA, 18 nt, Human
cagcuaagcuaggaauga

SEQ ID NO: 3520681 - RNA, 20 nt, Human
cagcuaagcucacguccuga

SEQ ID NO: 3520682 - RNA, 19 nt, Human
cagcuaaggacauuuccca

SEQ ID NO: 3520683 - RNA, 19 nt, Human
cagcuaagggguggggcug

SEQ ID NO: 3520684 - RNA, 12 nt, Human
cagcuaaucugu

SEQ ID NO: 3520685 - RNA, 16 nt, Human
cagcuaaugggacacu

SEQ ID NO: 3520686 - RNA, 13 nt, Human
cagcuacaacagc

SEQ ID NO: 3520687 - RNA, 21 nt, Human
cagcuacccuuuuucuccagc

SEQ ID NO: 3520688 - RNA, 17 nt, Human
cagcuacuaaugauguu

SEQ ID NO: 3520689 - RNA, 20 nt, Human
cagcuacucaagaggcugag

SEQ ID NO: 3520690 - RNA, 20 nt, Human
cagcuacucagaagccugag

SEQ ID NO: 3520691 - RNA, 22 nt, Human
cagcuacucagaagccugaggc

SEQ ID NO: 3520692 - RNA, 23 nt, Human
cagcuacucagaagccugaggcu

SEQ ID NO: 3520693 - RNA, 18 nt, Human
cagcuacucaggaggcug

SEQ ID NO: 3520694 - RNA, 23 nt, Human
cagcuacucgggaggcugaggca

SEQ ID NO: 3520695 - RNA, 13 nt, Human
cagcuacucuccc

SEQ ID NO: 3520696 - RNA, 17 nt, Human
cagcuacuuaagagaaa

SEQ ID NO: 3520697 - RNA, 18 nt, Human
cagcuagaaaacauuuuu

SEQ ID NO: 3520698 - RNA, 18 nt, Human
cagcuaggaacaaaucuu

SEQ ID NO: 3520699 - RNA, 20 nt, Human
cagcuaggaacaaaucuucc

SEQ ID NO: 3520700 - RNA, 21 nt, Human
cagcuaggaagagcaggacuc

SEQ ID NO: 3520701 - RNA, 20 nt, Human
cagcuaguccuagugaaccu

SEQ ID NO: 3520702 - RNA, 13 nt, Human
cagcuagugaccc

SEQ ID NO: 3520703 - RNA, 18 nt, Human
cagcuagugacccacaug

SEQ ID NO: 3520704 - RNA, 18 nt, Human
cagcuauaacaguaggga

SEQ ID NO: 3520705 - RNA, 20 nt, Human
cagcuauaacaguagggaug

SEQ ID NO: 3520706 - RNA, 21 nt, Human
cagcuauaccugugccucggc

SEQ ID NO: 3520707 - RNA, 22 nt, Human
cagcuauaccugugccucggcu

SEQ ID NO: 3520708 - RNA, 23 nt, Human
cagcuauaccugugccucggcuu

SEQ ID NO: 3520709 - RNA, 23 nt, Human
cagcuaucuggucaaccuccugg

SEQ ID NO: 3520710 - RNA, 14 nt, Human
cagcuaugagagga

SEQ ID NO: 3520711 - RNA, 13 nt, Human
cagcuaugggagc

SEQ ID NO: 3520712 - RNA, 21 nt, Human
cagcuauguuauauugaaaaa

SEQ ID NO: 3520713 - RNA, 13 nt, Human
cagcuauuuuuau

SEQ ID NO: 3520714 - RNA, 16 nt, Human
cagcucaauggacugg

SEQ ID NO: 3520715 - RNA, 20 nt, Human
cagcucaauggacuggaagg

SEQ ID NO: 3520716 - RNA, 20 nt, Human
cagcucacagugcugugugc

SEQ ID NO: 3520717 - RNA, 14 nt, Human
cagcucaccagccc

SEQ ID NO: 3520718 - RNA, 19 nt, Human
cagcucaccagccccagug

SEQ ID NO: 3520719 - RNA, 21 nt, Human
cagcucaccagccccagugcc

SEQ ID NO: 3520720 - RNA, 22 nt, Human
cagcucaccagccccagugccc

SEQ ID NO: 3520721 - RNA, 19 nt, Human
cagcucacgcuucacagug

SEQ ID NO: 3520722 - RNA, 15 nt, Human
cagcucacugcaacc

SEQ ID NO: 3520723 - RNA, 14 nt, Human
cagcucagaaccca

SEQ ID NO: 3520724 - RNA, 16 nt, Human
cagcucagaacccagg

SEQ ID NO: 3520725 - RNA, 20 nt, Human
cagcucagaacccagggcuc

SEQ ID NO: 3520726 - RNA, 20 nt, Human
cagcucagagagggugggag

SEQ ID NO: 3520727 - RNA, 14 nt, Human
cagcucagcacugc

SEQ ID NO: 3520728 - RNA, 14 nt, Human
cagcucagcuuccc

SEQ ID NO: 3520729 - RNA, 12 nt, Human
cagcucaggaca

SEQ ID NO: 3520730 - RNA, 18 nt, Human
cagcucaggacagaugcc

SEQ ID NO: 3520731 - RNA, 12 nt, Human
cagcucaggcac

SEQ ID NO: 3520732 - RNA, 21 nt, Human
cagcucaggcacacuucuucu

SEQ ID NO: 3520733 - RNA, 23 nt, Human
cagcucaggcuguuuuugggugc

SEQ ID NO: 3520734 - RNA, 17 nt, Human
cagcucaggggcagcuc

SEQ ID NO: 3520735 - RNA, 20 nt, Human
cagcucauagaguccccccu

SEQ ID NO: 3520736 - RNA, 15 nt, Human
cagcucaucucuguc

SEQ ID NO: 3520737 - RNA, 14 nt, Human
cagcucauuaaacu

SEQ ID NO: 3520738 - RNA, 16 nt, Human
cagcucauucauuuua

SEQ ID NO: 3520739 - RNA, 20 nt, Human
cagcucauucauuuuauauu

SEQ ID NO: 3520740 - RNA, 20 nt, Human
cagcuccaagaccuguuggu

SEQ ID NO: 3520741 - RNA, 15 nt, Human
cagcuccagcucacc

SEQ ID NO: 3520742 - RNA, 16 nt, Human
cagcuccagcucacca

SEQ ID NO: 3520743 - RNA, 20 nt, Human
cagcuccagcucaccagccc

SEQ ID NO: 3520744 - RNA, 22 nt, Human
cagcuccagcucaccagcccca

SEQ ID NO: 3520745 - RNA, 14 nt, Human
cagcuccagcugcu

SEQ ID NO: 3520746 - RNA, 20 nt, Human
cagcuccagggaauccaagc

SEQ ID NO: 3520747 - RNA, 14 nt, Human
cagcuccagggcca

SEQ ID NO: 3520748 - RNA, 14 nt, Human
cagcuccauuuucu

SEQ ID NO: 3520749 - RNA, 21 nt, Human
cagcucccacaagccucugcc

SEQ ID NO: 3520750 - RNA, 14 nt, Human
cagcucccacccca

SEQ ID NO: 3520751 - RNA, 22 nt, Human
cagcucccaccccacccccuuc

SEQ ID NO: 3520752 - RNA, 15 nt, Human
cagcucccaccuccc

SEQ ID NO: 3520753 - RNA, 18 nt, Human
cagcucccaggaccacag

SEQ ID NO: 3520754 - RNA, 20 nt, Human
cagcucccauuucuacucuu

SEQ ID NO: 3520755 - RNA, 13 nt, Human
cagcuccccagag

SEQ ID NO: 3520756 - RNA, 24 nt, Human
cagcuccccagaguccucuaugaa

SEQ ID NO: 3520757 - RNA, 14 nt, Human
cagcucccccagcu

SEQ ID NO: 3520758 - RNA, 15 nt, Human
cagcucccccagcuc

SEQ ID NO: 3520759 - RNA, 16 nt, Human
cagcucccccagcucc

SEQ ID NO: 3520760 - RNA, 22 nt, Human
cagcucccccgacggugggcau

SEQ ID NO: 3520761 - RNA, 22 nt, Human
cagcucccccuguccccucagc

SEQ ID NO: 3520762 - RNA, 18 nt, Human
cagcuccccucggagaag

SEQ ID NO: 3520763 - RNA, 14 nt, Human
cagcucccucugcc

SEQ ID NO: 3520764 - RNA, 15 nt, Human
cagcucccucugccu

SEQ ID NO: 3520765 - RNA, 14 nt, Human
cagcucccugccaa

SEQ ID NO: 3520766 - RNA, 12 nt, Human
cagcucccuggc

SEQ ID NO: 3520767 - RNA, 14 nt, Human
cagcucccuggcuu

SEQ ID NO: 3520768 - RNA, 20 nt, Human
cagcucccugugcccccagg

SEQ ID NO: 3520769 - RNA, 17 nt, Human
cagcucccuucuguuga

SEQ ID NO: 3520770 - RNA, 16 nt, Human
cagcuccggccugucc

SEQ ID NO: 3520771 - RNA, 21 nt, Human
cagcuccggccuguccuccaa

SEQ ID NO: 3520772 - RNA, 21 nt, Human
cagcuccucccuuguucucua

SEQ ID NO: 3520773 - RNA, 22 nt, Human
cagcuccuccgugcuuccucag

SEQ ID NO: 3520774 - RNA, 19 nt, Human
cagcuccucugucucgagc

SEQ ID NO: 3520775 - RNA, 15 nt, Human
cagcuccuguaacau

SEQ ID NO: 3520776 - RNA, 16 nt, Human
cagcuccuuccuggag

SEQ ID NO: 3520777 - RNA, 17 nt, Human
cagcuccuucuguccua

SEQ ID NO: 3520778 - RNA, 12 nt, Human
cagcuccuuggg

SEQ ID NO: 3520779 - RNA, 17 nt, Human
cagcuccuugggaggaa

SEQ ID NO: 3520780 - RNA, 21 nt, Human
cagcuccuugggaggaagcag

SEQ ID NO: 3520781 - RNA, 13 nt, Human
cagcuccuuuggg

SEQ ID NO: 3520782 - RNA, 20 nt, Human
cagcuccuuuuccagagcau

SEQ ID NO: 3520783 - RNA, 19 nt, Human
cagcucgcaccccccuguu

SEQ ID NO: 3520784 - RNA, 23 nt, Human
cagcucgcaccccccuguucuaa

SEQ ID NO: 3520785 - RNA, 16 nt, Human
cagcucggggagccuu

SEQ ID NO: 3520786 - RNA, 18 nt, Human
cagcucuaagucucaacu

SEQ ID NO: 3520787 - RNA, 20 nt, Human
cagcucuagacaacccugca

SEQ ID NO: 3520788 - RNA, 18 nt, Human
cagcucucaguugcagcc

SEQ ID NO: 3520789 - RNA, 12 nt, Human
cccuuccagaca

SEQ ID NO: 3520790 - RNA, 14 nt, Human
cccuuccaggccau

SEQ ID NO: 3520791 - RNA, 23 nt, Human
cccuucccacaggacauuucucu

SEQ ID NO: 3520792 - RNA, 12 nt, Human
cccuucccaccu

SEQ ID NO: 3520793 - RNA, 14 nt, Human
cccuucccagggca

SEQ ID NO: 3520794 - RNA, 12 nt, Human
cccuuccccacu

SEQ ID NO: 3520795 - RNA, 23 nt, Human
cccuuccccaugcuuccuugccu

SEQ ID NO: 3520796 - RNA, 14 nt, Human
cccuuccccauggg

SEQ ID NO: 3520797 - RNA, 14 nt, Human
cccuuccccgaggg

SEQ ID NO: 3520798 - RNA, 12 nt, Human
cccuuccccucc

SEQ ID NO: 3520799 - RNA, 19 nt, Human
cccuuccccucccuggcuc

SEQ ID NO: 3520800 - RNA, 14 nt, Human
cccuuccccuuccu

SEQ ID NO: 3520801 - RNA, 13 nt, Human
cccuucccucacc

SEQ ID NO: 3520802 - RNA, 17 nt, Human
cccuucccuccucccau

SEQ ID NO: 3520803 - RNA, 13 nt, Human
cccuucccugcaa

SEQ ID NO: 3520804 - RNA, 15 nt, Human
cccuucccugucccu

SEQ ID NO: 3520805 - RNA, 13 nt, Human
cccuucccuuccc

SEQ ID NO: 3520806 - RNA, 18 nt, Human
cccuuccgacccucuggg

SEQ ID NO: 3520807 - RNA, 19 nt, Human
cccuuccuaauuccacagc

SEQ ID NO: 3520808 - RNA, 20 nt, Human
cccuuccuaauuccacagcu

SEQ ID NO: 3520809 - RNA, 22 nt, Human
cccuuccuauuccaagcuucca

SEQ ID NO: 3520810 - RNA, 21 nt, Human
cccuuccucccuauuaaccua

SEQ ID NO: 3520811 - RNA, 14 nt, Human
cccuuccuccucca

SEQ ID NO: 3520812 - RNA, 17 nt, Human
cccuuccucuccacccu

SEQ ID NO: 3520813 - RNA, 20 nt, Human
cccuuccucuccacugccuu

SEQ ID NO: 3520814 - RNA, 12 nt, Human
cccuuccucuuc

SEQ ID NO: 3520815 - RNA, 22 nt, Human
cccuuccucuucggcccucaga

SEQ ID NO: 3520816 - RNA, 22 nt, Human
cccuuccugcugcgcaguucuc

SEQ ID NO: 3520817 - RNA, 16 nt, Human
cccuuccuggacagcu

SEQ ID NO: 3520818 - RNA, 17 nt, Human
cccuuccuggacagcug

SEQ ID NO: 3520819 - RNA, 14 nt, Human
cccuuccugggcac

SEQ ID NO: 3520820 - RNA, 23 nt, Human
cccuuccugggcacacgcugcuc

SEQ ID NO: 3520821 - RNA, 12 nt, Human
cccuuccuucuu

SEQ ID NO: 3520822 - RNA, 11 nt, Human
cccuuccuuua

SEQ ID NO: 3520823 - RNA, 21 nt, Human
cccuuccuuuucccugcuucc

SEQ ID NO: 3520824 - RNA, 21 nt, Human
cccuucuauacccacccagaa

SEQ ID NO: 3520825 - RNA, 15 nt, Human
cccuucucacagcac

SEQ ID NO: 3520826 - RNA, 19 nt, Human
cccuucucacagcacaugc

SEQ ID NO: 3520827 - RNA, 15 nt, Human
cccuucucaucacuc

SEQ ID NO: 3520828 - RNA, 19 nt, Human
cccuucucaucacuccccu

SEQ ID NO: 3520829 - RNA, 13 nt, Human
cccuucuccaucu

SEQ ID NO: 3520830 - RNA, 22 nt, Human
cccuucuccaucucucuggccc

SEQ ID NO: 3520831 - RNA, 14 nt, Human
cccuucucccacuc

SEQ ID NO: 3520832 - RNA, 16 nt, Human
cccuucuccccugcac

SEQ ID NO: 3520833 - RNA, 13 nt, Human
cccuucucccugg

SEQ ID NO: 3520834 - RNA, 17 nt, Human
cccuucuccucuuguaa

SEQ ID NO: 3520835 - RNA, 14 nt, Human
cccuucucuccagc

SEQ ID NO: 3520836 - RNA, 18 nt, Human
cccuucucugcccauucc

SEQ ID NO: 3520837 - RNA, 19 nt, Human
cccuucucugcccauuccc

SEQ ID NO: 3520838 - RNA, 20 nt, Human
cccuucucugcuccaccaca

SEQ ID NO: 3520839 - RNA, 13 nt, Human
cccuucucuguau

SEQ ID NO: 3520840 - RNA, 21 nt, Human
cccuucucugugacccacuuc

SEQ ID NO: 3520841 - RNA, 17 nt, Human
cccuucucuuccaggca

SEQ ID NO: 3520842 - RNA, 21 nt, Human
cccuucugacccaugcugccc

SEQ ID NO: 3520843 - RNA, 22 nt, Human
cccuucugacccaugcugcccu

SEQ ID NO: 3520844 - RNA, 13 nt, Human
cccuucugcuacu

SEQ ID NO: 3520845 - RNA, 22 nt, Human
cccuucugggcaucuguucugg

SEQ ID NO: 3520846 - RNA, 17 nt, Human
cccuucugugcccagcu

SEQ ID NO: 3520847 - RNA, 18 nt, Human
cccuucugugcccagcuc

SEQ ID NO: 3520848 - RNA, 12 nt, Human
cccuucuucccu

SEQ ID NO: 3520849 - RNA, 15 nt, Human
cccuucuugcugccc

SEQ ID NO: 3520850 - RNA, 16 nt, Human
cccgucuccagcugcu

SEQ ID NO: 3520851 - RNA, 17 nt, Human
cccgucuccagcugcug

SEQ ID NO: 3520852 - RNA, 22 nt, Human
cccgucucugguuccuccccuc

SEQ ID NO: 3520853 - RNA, 17 nt, Human
cccgucuguccaucugc

SEQ ID NO: 3520854 - RNA, 23 nt, Human
cccgucugugugugaccccuccu

SEQ ID NO: 3520855 - RNA, 15 nt, Human
cccgucuucagccua

SEQ ID NO: 3520856 - RNA, 13 nt, Human
cccgugaccuggu

SEQ ID NO: 3520857 - RNA, 13 nt, Human
cccgugcagacug

SEQ ID NO: 3520858 - RNA, 15 nt, Human
cccgugccaagucca

SEQ ID NO: 3520859 - RNA, 22 nt, Human
cccgugccaaguccagguccug

SEQ ID NO: 3520860 - RNA, 17 nt, Human
cccguggaggcugcucg

SEQ ID NO: 3520861 - RNA, 12 nt, Human
cccguggcccca

SEQ ID NO: 3520862 - RNA, 14 nt, Human
cccguggccccagc

SEQ ID NO: 3520863 - RNA, 20 nt, Human
cccguguaggaaccugcaca

SEQ ID NO: 3520864 - RNA, 15 nt, Human
cccguguccugccug

SEQ ID NO: 3520865 - RNA, 16 nt, Human
cccguugucucccugg

SEQ ID NO: 3520866 - RNA, 12 nt, Human
cccguuucucca

SEQ ID NO: 3520867 - RNA, 16 nt, Human
cccguuucuccaccua

SEQ ID NO: 3520868 - RNA, 14 nt, Human
cccguuucuggugg

SEQ ID NO: 3520869 - RNA, 19 nt, Human
cccguuuuaugauuuacuc

SEQ ID NO: 3520870 - RNA, 12 nt, Human
cccuaaacugua

SEQ ID NO: 3520871 - RNA, 14 nt, Human
cccuaacccuuugu

SEQ ID NO: 3520872 - RNA, 17 nt, Human
cccuaaccucuuuucug

SEQ ID NO: 3520873 - RNA, 12 nt, Human
cccuaagccagc

SEQ ID NO: 3520874 - RNA, 23 nt, Human
cccuaagccagccugguccaugc

SEQ ID NO: 3520875 - RNA, 17 nt, Human
cccuaagccagcugccc

SEQ ID NO: 3520876 - RNA, 14 nt, Human
cccuaauaaagcug

SEQ ID NO: 3520877 - RNA, 15 nt, Human
cccuaauaaagcugu

SEQ ID NO: 3520878 - RNA, 22 nt, Human
cccuaaugcgcaggcuggcccu

SEQ ID NO: 3520879 - RNA, 23 nt, Human
cccuaaugcgcaggcuggcccug

SEQ ID NO: 3520880 - RNA, 18 nt, Human
cccuacacccagacccca

SEQ ID NO: 3520881 - RNA, 13 nt, Human
cccuacaccuuga

SEQ ID NO: 3520882 - RNA, 17 nt, Human
cccuaccaccuccccag

SEQ ID NO: 3520883 - RNA, 17 nt, Human
cccuaccacugucuucu

SEQ ID NO: 3520884 - RNA, 20 nt, Human
cccuaccacugucuucuuca

SEQ ID NO: 3520885 - RNA, 14 nt, Human
cccuaccccaccac

SEQ ID NO: 3520886 - RNA, 14 nt, Human
cccuaccccuggcu

SEQ ID NO: 3520887 - RNA, 11 nt, Human
cccuacccucu

SEQ ID NO: 3520888 - RNA, 15 nt, Human
cccuacccucuagag

SEQ ID NO: 3520889 - RNA, 21 nt, Human
cccuaccgagucucuucucca

SEQ ID NO: 3520890 - RNA, 19 nt, Human
cccuaccucaaccuguaaa

SEQ ID NO: 3520891 - RNA, 22 nt, Human
cccuaccucaaccuguaaauua

SEQ ID NO: 3520892 - RNA, 16 nt, Human
cccuaccucaggcagg

SEQ ID NO: 3520893 - RNA, 22 nt, Human
cccuaccugauuggugcaaccc

SEQ ID NO: 3520894 - RNA, 13 nt, Human
cccuacggaccag

SEQ ID NO: 3520895 - RNA, 14 nt, Human
cccuacggaccagg

SEQ ID NO: 3520896 - RNA, 23 nt, Human
cccuacuauucaguggcgagaaa

SEQ ID NO: 3520897 - RNA, 22 nt, Human
cccuagaucuuucuauuccaaa

SEQ ID NO: 3520898 - RNA, 13 nt, Human
cccuagccauucc

SEQ ID NO: 3520899 - RNA, 18 nt, Human
cccuagccauuccuggua

SEQ ID NO: 3520900 - RNA, 17 nt, Human
cccuagcccaggagaga

SEQ ID NO: 3520901 - RNA, 18 nt, Human
cccuagcccaggagagag

SEQ ID NO: 3520902 - RNA, 18 nt, Human
cccuagccgguuccuguc

SEQ ID NO: 3520903 - RNA, 19 nt, Human
cccuagcgcuaucucccug

SEQ ID NO: 3520904 - RNA, 18 nt, Human
cccuagcuuuagacccug

SEQ ID NO: 3520905 - RNA, 23 nt, Human
cccuaggauaaaaagccagggcu

SEQ ID NO: 3520906 - RNA, 15 nt, Human
cccuagggcugggug

SEQ ID NO: 3520907 - RNA, 18 nt, Human
cccuaggggacacuuccc

SEQ ID NO: 3520908 - RNA, 16 nt, Human
cccuagguguuuuguu

SEQ ID NO: 3520909 - RNA, 17 nt, Human
cccuagguucccggucc

SEQ ID NO: 3520910 - RNA, 18 nt, Human
cccuaguaagugccuucc

SEQ ID NO: 3520911 - RNA, 19 nt, Human
cccuagugacccggaggcc

SEQ ID NO: 3520912 - RNA, 16 nt, Human
cccuaguucccucugc

SEQ ID NO: 3520913 - RNA, 23 nt, Human
cccuaguucccucugcucagcca

SEQ ID NO: 3520914 - RNA, 21 nt, Human
cccuaguuuucuuuccuccuu

SEQ ID NO: 3520915 - RNA, 11 nt, Human
cccuauaaauc

SEQ ID NO: 3520916 - RNA, 18 nt, Human
cccuauaaugcuggagcg

SEQ ID NO: 3520917 - RNA, 23 nt, Human
cccuauacugcuuggagcugagc

SEQ ID NO: 3520918 - RNA, 16 nt, Human
cccuauccacccagcc

SEQ ID NO: 3520919 - RNA, 16 nt, Human
cccuauccuuggcacc

SEQ ID NO: 3520920 - RNA, 16 nt, Human
cccuaucuccugacag

SEQ ID NO: 3520921 - RNA, 20 nt, Human
cccuaucuccugacagaagg

SEQ ID NO: 3520922 - RNA, 14 nt, Human
cccuaucuuugcca

SEQ ID NO: 3520923 - RNA, 20 nt, Human
cccuaugaaguaaagaacug

SEQ ID NO: 3520924 - RNA, 14 nt, Human
cccuaugggccugc

SEQ ID NO: 3520925 - RNA, 21 nt, Human
cccuaugggccugccgggcug

SEQ ID NO: 3520926 - RNA, 18 nt, Human
cccuauuagagaagagau

SEQ ID NO: 3520927 - RNA, 20 nt, Human
cccuauuuagaugauaaaga

SEQ ID NO: 3520928 - RNA, 19 nt, Human
cccucaaaugacccaaaga

SEQ ID NO: 3520929 - RNA, 16 nt, Human
cccucaaccucuucug

SEQ ID NO: 3520930 - RNA, 20 nt, Human
cccucaagagcaaaguagau

SEQ ID NO: 3520931 - RNA, 23 nt, Human
cccucaaggacaaagucuccagc

SEQ ID NO: 3520932 - RNA, 18 nt, Human
cccucaaggccucccaca

SEQ ID NO: 3520933 - RNA, 20 nt, Human
cccucaaggccucccacagu

SEQ ID NO: 3520934 - RNA, 22 nt, Human
cccuccuguugcacccagcccu

SEQ ID NO: 3520935 - RNA, 16 nt, Human
cccuccuucccagcug

SEQ ID NO: 3520936 - RNA, 16 nt, Human
cccuccuuccuugacc

SEQ ID NO: 3520937 - RNA, 20 nt, Human
cccuccuugcucugcaggca

SEQ ID NO: 3520938 - RNA, 14 nt, Human
cccuccuugggcac

SEQ ID NO: 3520939 - RNA, 16 nt, Human
cccuccuugggcacuu

SEQ ID NO: 3520940 - RNA, 19 nt, Human
cccucgaagcgcgccacuc

SEQ ID NO: 3520941 - RNA, 16 nt, Human
cccucgcccaguccca

SEQ ID NO: 3520942 - RNA, 14 nt, Human
cccucgcugccagc

SEQ ID NO: 3520943 - RNA, 13 nt, Human
cccucgcuggccc

SEQ ID NO: 3520944 - RNA, 14 nt, Human
cccucgcuggcccc

SEQ ID NO: 3520945 - RNA, 23 nt, Human
cccucgcuggcccccacuggcug

SEQ ID NO: 3520946 - RNA, 16 nt, Human
cccucgggcccaccug

SEQ ID NO: 3520947 - RNA, 19 nt, Human
cccucgggcccaccuggcc

SEQ ID NO: 3520948 - RNA, 20 nt, Human
cccucgggcccaccuggcca

SEQ ID NO: 3520949 - RNA, 21 nt, Human
cccucgggcccaccuggccac

SEQ ID NO: 3520950 - RNA, 20 nt, Human
cccucggggauguguccuga

SEQ ID NO: 3520951 - RNA, 21 nt, Human
cccucgggucuccucacuccc

SEQ ID NO: 3520952 - RNA, 14 nt, Human
cccucgucuuuccc

SEQ ID NO: 3520953 - RNA, 21 nt, Human
cccucgucuuucccaaaggca

SEQ ID NO: 3520954 - RNA, 16 nt, Human
cccucgugccagucgc

SEQ ID NO: 3520955 - RNA, 22 nt, Human
cccucgugccagucgcgcugcc

SEQ ID NO: 3520956 - RNA, 19 nt, Human
cccucguggacaccugccc

SEQ ID NO: 3520957 - RNA, 23 nt, Human
cccucguggacaccugcccugcc

SEQ ID NO: 3520958 - RNA, 19 nt, Human
cccucguggccagcccggc

SEQ ID NO: 3520959 - RNA, 18 nt, Human
cccucgugguccccaaca

SEQ ID NO: 3520960 - RNA, 20 nt, Human
cccucgugguccccaacagc

SEQ ID NO: 3520961 - RNA, 19 nt, Human
cccucuaaugcucacgcuc

SEQ ID NO: 3520962 - RNA, 21 nt, Human
cccucuacagagcuucccuga

SEQ ID NO: 3520963 - RNA, 15 nt, Human
cccucuaggcucugc

SEQ ID NO: 3520964 - RNA, 17 nt, Human
cccucucacugucugag

SEQ ID NO: 3520965 - RNA, 15 nt, Human
cccucucagcccuca

SEQ ID NO: 3520966 - RNA, 17 nt, Human
cccucucagcuccaggu

SEQ ID NO: 3520967 - RNA, 21 nt, Human
cccucucaggcaugccugugu

SEQ ID NO: 3520968 - RNA, 20 nt, Human
cccucucaucucagguagaa

SEQ ID NO: 3520969 - RNA, 13 nt, Human
cccucucccagga

SEQ ID NO: 3520970 - RNA, 13 nt, Human
cccucucccaggc

SEQ ID NO: 3520971 - RNA, 20 nt, Human
cccucuccccaccccuaccc

SEQ ID NO: 3520972 - RNA, 16 nt, Human
cccucucccucuaggc

SEQ ID NO: 3520973 - RNA, 13 nt, Human
cccucucccuucc

SEQ ID NO: 3520974 - RNA, 20 nt, Human
cccucucccuucccuccucc

SEQ ID NO: 3520975 - RNA, 13 nt, Human
cccucuccgagcu

SEQ ID NO: 3520976 - RNA, 17 nt, Human
cccucuccugccuacuc

SEQ ID NO: 3520977 - RNA, 11 nt, Human
cccucuccugg

SEQ ID NO: 3520978 - RNA, 13 nt, Human
cccucuccugggc

SEQ ID NO: 3520979 - RNA, 21 nt, Human
cccucuccuuuguucccggcu

SEQ ID NO: 3520980 - RNA, 11 nt, Human
cccucucucug

SEQ ID NO: 3520981 - RNA, 12 nt, Human
cccucucucuga

SEQ ID NO: 3520982 - RNA, 14 nt, Human
cccucucucuucug

SEQ ID NO: 3520983 - RNA, 12 nt, Human
cccucucugcau

SEQ ID NO: 3520984 - RNA, 20 nt, Human
cccucucugcaucugaccac

SEQ ID NO: 3520985 - RNA, 14 nt, Human
cccucucugcucug

SEQ ID NO: 3520986 - RNA, 14 nt, Human
cccucucuggagaa

SEQ ID NO: 3520987 - RNA, 14 nt, Human
cccucucugggccu

SEQ ID NO: 3520988 - RNA, 23 nt, Human
cccucucuugcacccgccucucc

SEQ ID NO: 3520989 - RNA, 19 nt, Human
cccucugaaaguuguacau

SEQ ID NO: 3520990 - RNA, 21 nt, Human
cccucugagaauuccaaggag

SEQ ID NO: 3520991 - RNA, 9 nt, Human
cccucugcc

SEQ ID NO: 3520992 - RNA, 19 nt, Human
cccucugccaccagagacc

SEQ ID NO: 3520993 - RNA, 11 nt, Human
cccucugccca

SEQ ID NO: 3520994 - RNA, 12 nt, Human
cccucugcccag

SEQ ID NO: 3520995 - RNA, 18 nt, Human
cccucugcccagcuuggg

SEQ ID NO: 3520996 - RNA, 14 nt, Human
cccucugcccugcg

SEQ ID NO: 3520997 - RNA, 12 nt, Human
cccucugccggc

SEQ ID NO: 3520998 - RNA, 21 nt, Human
cccucugccugaaccuuccau

SEQ ID NO: 3520999 - RNA, 13 nt, Human
cccucugccuguc

SEQ ID NO: 3521000 - RNA, 13 nt, Human
cccucugcucagc

SEQ ID NO: 3521001 - RNA, 14 nt, Human
cccucugcucagcc

SEQ ID NO: 3521002 - RNA, 15 nt, Human
cccucugcugaagac

SEQ ID NO: 3521003 - RNA, 21 nt, Human
cccucugcugaagacuugccc

SEQ ID NO: 3521004 - RNA, 14 nt, Human
cccucugcugcugu

SEQ ID NO: 3521005 - RNA, 15 nt, Human
cccucugcugcuguc

SEQ ID NO: 3521006 - RNA, 12 nt, Human
cccucuggaggg

SEQ ID NO: 3521007 - RNA, 22 nt, Human
cccucuggagggguguggcucc

SEQ ID NO: 3521008 - RNA, 22 nt, Human
cccucuggaguggccacuaagc

SEQ ID NO: 3521009 - RNA, 13 nt, Human
cccucuggccagg

SEQ ID NO: 3521010 - RNA, 22 nt, Human
cccucuggccaggauggagggg

SEQ ID NO: 3521011 - RNA, 22 nt, Human
cccucuggcuccagcuggccgg

SEQ ID NO: 3521012 - RNA, 19 nt, Human
cccucugggaaccucccag

SEQ ID NO: 3521013 - RNA, 21 nt, Human
cccucugggaaccucccagag

SEQ ID NO: 3521014 - RNA, 12 nt, Human
cccucugggcuc

SEQ ID NO: 3521015 - RNA, 12 nt, Human
cccucuggggcu

SEQ ID NO: 3521016 - RNA, 14 nt, Human
ccgagaagccagug

SEQ ID NO: 3521017 - RNA, 13 nt, Human
ccgagaagguuua

SEQ ID NO: 3521018 - RNA, 14 nt, Human
ccgagagccugcuc

SEQ ID NO: 3521019 - RNA, 20 nt, Human
ccgagagccugcucccccac

SEQ ID NO: 3521020 - RNA, 22 nt, Human
ccgagaucacgccacugcacuc

SEQ ID NO: 3521021 - RNA, 21 nt, Human
ccgagauugcaccacugcacu

SEQ ID NO: 3521022 - RNA, 23 nt, Human
ccgagcaaagaucaaaauaaaaa

SEQ ID NO: 3521023 - RNA, 12 nt, Human
ccgagcagcuga

SEQ ID NO: 3521024 - RNA, 15 nt, Human
ccgagcagcugagca

SEQ ID NO: 3521025 - RNA, 21 nt, Human
ccgagccucugucacugcagg

SEQ ID NO: 3521026 - RNA, 18 nt, Human
ccgagcgcuuucuggaaa

SEQ ID NO: 3521027 - RNA, 17 nt, Human
ccgagcuccagagcaac

SEQ ID NO: 3521028 - RNA, 19 nt, Human
ccgagcucguguauccugg

SEQ ID NO: 3521029 - RNA, 20 nt, Human
ccgagcucguguauccuggg

SEQ ID NO: 3521030 - RNA, 21 nt, Human
ccgagcucguguauccugggg

SEQ ID NO: 3521031 - RNA, 19 nt, Human
ccgagcugggggccaugag

SEQ ID NO: 3521032 - RNA, 21 nt, Human
ccgagcugggggccaugagcu

SEQ ID NO: 3521033 - RNA, 13 nt, Human
ccgaggacccaga

SEQ ID NO: 3521034 - RNA, 18 nt, Human
ccgaggaggugucucagg

SEQ ID NO: 3521035 - RNA, 20 nt, Human
ccgaggaggugucucaggcu

SEQ ID NO: 3521036 - RNA, 21 nt, Human
ccgaggaggugucucaggcug

SEQ ID NO: 3521037 - RNA, 20 nt, Human
ccgaggcagggucaggagag

SEQ ID NO: 3521038 - RNA, 11 nt, Human
ccgaggccagu

SEQ ID NO: 3521039 - RNA, 22 nt, Human
ccgaggccuaccccgcagacac

SEQ ID NO: 3521040 - RNA, 17 nt, Human
ccgaggccuucucugaa

SEQ ID NO: 3521041 - RNA, 19 nt, Human
ccgaggguccuggcuccug

SEQ ID NO: 3521042 - RNA, 17 nt, Human
ccgaggguugauuaagg

SEQ ID NO: 3521043 - RNA, 16 nt, Human
ccgagguggcugccug

SEQ ID NO: 3521044 - RNA, 21 nt, Human
ccgagguggcugccuggagcc

SEQ ID NO: 3521045 - RNA, 14 nt, Human
ccgaguacagucug

SEQ ID NO: 3521046 - RNA, 21 nt, Human
ccgaguagaaaaugugacccu

SEQ ID NO: 3521047 - RNA, 19 nt, Human
ccgaguagcugggauuaca

SEQ ID NO: 3521048 - RNA, 13 nt, Human
ccgaguccaagcu

SEQ ID NO: 3521049 - RNA, 20 nt, Human
ccgagucucuucuccacugg

SEQ ID NO: 3521050 - RNA, 21 nt, Human
ccgagucucuucuccacugga

SEQ ID NO: 3521051 - RNA, 17 nt, Human
ccgagucugggacacaa

SEQ ID NO: 3521052 - RNA, 21 nt, Human
ccgaguggauagaugcccugc

SEQ ID NO: 3521053 - RNA, 22 nt, Human
ccgaguuaaggugggcccggcc

SEQ ID NO: 3521054 - RNA, 17 nt, Human
ccgauagagggacggcc

SEQ ID NO: 3521055 - RNA, 19 nt, Human
ccgauccuccccuggacuc

SEQ ID NO: 3521056 - RNA, 15 nt, Human
ccgaugcuccagcca

SEQ ID NO: 3521057 - RNA, 19 nt, Human
ccgaugcuccagccaaccc

SEQ ID NO: 3521058 - RNA, 20 nt, Human
ccgaugcugcuuuccccugu

SEQ ID NO: 3521059 - RNA, 22 nt, Human
ccgaugcugcuuuccccugugg

SEQ ID NO: 3521060 - RNA, 14 nt, Human
ccgauuucccaggc

SEQ ID NO: 3521061 - RNA, 16 nt, Human
ccgcaaaccacacugg

SEQ ID NO: 3521062 - RNA, 21 nt, Human
ccgcaaacccccuuugugcug

SEQ ID NO: 3521063 - RNA, 14 nt, Human
ccgcaagcaccauc

SEQ ID NO: 3521064 - RNA, 13 nt, Human
ccgcacacccuca

SEQ ID NO: 3521065 - RNA, 19 nt, Human
ccgcacacccucacucugc

SEQ ID NO: 3521066 - RNA, 21 nt, Human
ccgcacagcagccugcuuccc

SEQ ID NO: 3521067 - RNA, 11 nt, Human
ccgcaccccag

SEQ ID NO: 3521068 - RNA, 17 nt, Human
ccgcaccccagagugug

SEQ ID NO: 3521069 - RNA, 20 nt, Human
ccgcaccccgauguggaccu

SEQ ID NO: 3521070 - RNA, 17 nt, Human
ccgcaccuaaagcagcc

SEQ ID NO: 3521071 - RNA, 17 nt, Human
ccgcacuuuccacuucu

SEQ ID NO: 3521072 - RNA, 22 nt, Human
ccgcacuuuccacuucuuccuu

SEQ ID NO: 3521073 - RNA, 14 nt, Human
ccgcagaagcagac

SEQ ID NO: 3521074 - RNA, 15 nt, Human
ccgcagacaccuugg

SEQ ID NO: 3521075 - RNA, 15 nt, Human
ccgcagacaggacca

SEQ ID NO: 3521076 - RNA, 16 nt, Human
ccgcagacaggaccag

SEQ ID NO: 3521077 - RNA, 17 nt, Human
ccgcagacaggaccagg

SEQ ID NO: 3521078 - RNA, 18 nt, Human
ccgcagaccuccccagcc

SEQ ID NO: 3521079 - RNA, 17 nt, Human
cccuuccaucugauucc

SEQ ID NO: 3521080 - RNA, 23 nt, Human
cccuuccaucugauuccagcaca

SEQ ID NO: 3521081 - RNA, 20 nt, Human
cccuuccaugucgccucugc

SEQ ID NO: 3521082 - RNA, 20 nt, Human
cccuucccaaucagcacuga

SEQ ID NO: 3521083 - RNA, 21 nt, Human
cccuucccaaucagcacugaa

SEQ ID NO: 3521084 - RNA, 14 nt, Human
cccuucccacagga

SEQ ID NO: 3521085 - RNA, 21 nt, Human
cccuuccccacugccugccca

SEQ ID NO: 3521086 - RNA, 13 nt, Human
cccuucccccacc

SEQ ID NO: 3521087 - RNA, 14 nt, Human
cccuuccccucccu

SEQ ID NO: 3521088 - RNA, 16 nt, Human
cccuuccccucccugg

SEQ ID NO: 3521089 - RNA, 17 nt, Human
cccuuccccucccuggc

SEQ ID NO: 3521090 - RNA, 22 nt, Human
cccuuccccucccuggcuccca

SEQ ID NO: 3521091 - RNA, 18 nt, Human
cccuuccccuuccuucuu

SEQ ID NO: 3521092 - RNA, 12 nt, Human
cccuucccugca

SEQ ID NO: 3521093 - RNA, 13 nt, Human
cccuucccugcac

SEQ ID NO: 3521094 - RNA, 13 nt, Human
cccuucccugucc

SEQ ID NO: 3521095 - RNA, 19 nt, Human
cccuucccuugagcccucu

SEQ ID NO: 3521096 - RNA, 15 nt, Human
cccuuccgacccucu

SEQ ID NO: 3521097 - RNA, 19 nt, Human
cccuuccgacccucuggga

SEQ ID NO: 3521098 - RNA, 20 nt, Human
cccuuccgacccucugggaa

SEQ ID NO: 3521099 - RNA, 16 nt, Human
cccuuccgccacuggg

SEQ ID NO: 3521100 - RNA, 18 nt, Human
cccuuccgccacuggggc

SEQ ID NO: 3521101 - RNA, 13 nt, Human
cccuuccuccucc

SEQ ID NO: 3521102 - RNA, 13 nt, Human
cccuuccucucca

SEQ ID NO: 3521103 - RNA, 16 nt, Human
cccuuccucuccacug

SEQ ID NO: 3521104 - RNA, 13 nt, Human
cccuuccucugcu

SEQ ID NO: 3521105 - RNA, 16 nt, Human
cccuuccucugcuccc

SEQ ID NO: 3521106 - RNA, 11 nt, Human
cccuuccucuu

SEQ ID NO: 3521107 - RNA, 16 nt, Human
cccuuccucuucggcc

SEQ ID NO: 3521108 - RNA, 11 nt, Human
cccuuccugga

SEQ ID NO: 3521109 - RNA, 22 nt, Human
cccuuccuggacagcugugccu

SEQ ID NO: 3521110 - RNA, 18 nt, Human
cccuuccugggcacacgc

SEQ ID NO: 3521111 - RNA, 17 nt, Human
cccuuccuguccgcccu

SEQ ID NO: 3521112 - RNA, 11 nt, Human
cccuuccugug

SEQ ID NO: 3521113 - RNA, 22 nt, Human
cccuuccuuuucccugcuucca

SEQ ID NO: 3521114 - RNA, 13 nt, Human
cccuucgcuccug

SEQ ID NO: 3521115 - RNA, 14 nt, Human
cccuucgcuccugu

SEQ ID NO: 3521116 - RNA, 18 nt, Human
cccuucgcuccugugucu

SEQ ID NO: 3521117 - RNA, 17 nt, Human
cccuucuacacucuccu

SEQ ID NO: 3521118 - RNA, 23 nt, Human
cccuucuacacucuccugggccc

SEQ ID NO: 3521119 - RNA, 16 nt, Human
cccuucuaccugccac

SEQ ID NO: 3521120 - RNA, 14 nt, Human
cccuucuacugcuu

SEQ ID NO: 3521121 - RNA, 18 nt, Human
cccuucuacugcuucuac

SEQ ID NO: 3521122 - RNA, 13 nt, Human
cccuucuauaccc

SEQ ID NO: 3521123 - RNA, 13 nt, Human
cccuucucacagc

SEQ ID NO: 3521124 - RNA, 23 nt, Human
cccuucuccauccacaugggagc

SEQ ID NO: 3521125 - RNA, 17 nt, Human
cccuucuccaucucucu

SEQ ID NO: 3521126 - RNA, 13 nt, Human
cccuucucccaca

SEQ ID NO: 3521127 - RNA, 14 nt, Human
cccuucucccacac

SEQ ID NO: 3521128 - RNA, 19 nt, Human
cccuucucccaccccugcc

SEQ ID NO: 3521129 - RNA, 20 nt, Human
cccuucucccacucuccuag

SEQ ID NO: 3521130 - RNA, 14 nt, Human
cccuucucccauga

SEQ ID NO: 3521131 - RNA, 14 nt, Human
cccuucuccccugc

SEQ ID NO: 3521132 - RNA, 15 nt, Human
cccuucuccccugca

SEQ ID NO: 3521133 - RNA, 21 nt, Human
cccuucuccccugcacuguaa

SEQ ID NO: 3521134 - RNA, 15 nt, Human
cccuucucccuggau

SEQ ID NO: 3521135 - RNA, 21 nt, Human
cccuucucucccugccagagg

SEQ ID NO: 3521136 - RNA, 14 nt, Human
cccuucucugcucc

SEQ ID NO: 3521137 - RNA, 15 nt, Human
cccuucucugcucca

SEQ ID NO: 3521138 - RNA, 23 nt, Human
cccuucucugcuccaccacaucc

SEQ ID NO: 3521139 - RNA, 19 nt, Human
cccuucucugugacccacu

SEQ ID NO: 3521140 - RNA, 13 nt, Human
cccuucucuucca

SEQ ID NO: 3521141 - RNA, 14 nt, Human
cccuucugcucagc

SEQ ID NO: 3521142 - RNA, 20 nt, Human
cccuucugggcaucuguucu

SEQ ID NO: 3521143 - RNA, 20 nt, Human
cccuucugugcccagcucag

SEQ ID NO: 3521144 - RNA, 16 nt, Human
cccuucuugcugcccu

SEQ ID NO: 3521145 - RNA, 19 nt, Human
cccuucuuuuucuucuuuu

SEQ ID NO: 3521146 - RNA, 17 nt, Human
cccuugaaauuuuaaac

SEQ ID NO: 3521147 - RNA, 19 nt, Human
cccuugacaacuggcaggc

SEQ ID NO: 3521148 - RNA, 15 nt, Human
cccuugacaccugcu

SEQ ID NO: 3521149 - RNA, 16 nt, Human
cccuugagaccucagc

SEQ ID NO: 3521150 - RNA, 17 nt, Human
cccuugagaccucagcc

SEQ ID NO: 3521151 - RNA, 18 nt, Human
cccuugagaccucagcca

SEQ ID NO: 3521152 - RNA, 12 nt, Human
cccuugagcccu

SEQ ID NO: 3521153 - RNA, 18 nt, Human
cccuugagcccuccccag

SEQ ID NO: 3521154 - RNA, 13 nt, Human
cccuugagggaga

SEQ ID NO: 3521155 - RNA, 16 nt, Human
cccuugaguccccauu

SEQ ID NO: 3521156 - RNA, 16 nt, Human
cccuugaugaagaagu

SEQ ID NO: 3521157 - RNA, 15 nt, Human
cccuugaugcacaga

SEQ ID NO: 3521158 - RNA, 19 nt, Human
cccuugauuuaaacacaca

SEQ ID NO: 3521159 - RNA, 16 nt, Human
cccuugcagcuaguuu

SEQ ID NO: 3521160 - RNA, 19 nt, Human
cccuugcagcuaguuuucu

SEQ ID NO: 3521161 - RNA, 23 nt, Human
cccuugcaguucagcaccacccu

SEQ ID NO: 3521162 - RNA, 15 nt, Human
cccuugccacuuugc

SEQ ID NO: 3521163 - RNA, 14 nt, Human
cccuugccagcugc

SEQ ID NO: 3521164 - RNA, 17 nt, Human
cccuugccccccuggcc

SEQ ID NO: 3521165 - RNA, 19 nt, Human
cccuugcccugaccuccca

SEQ ID NO: 3521166 - RNA, 16 nt, Human
cccuugcccuugcccu

SEQ ID NO: 3521167 - RNA, 18 nt, Human
cccuugcccuugcccuga

SEQ ID NO: 3521168 - RNA, 22 nt, Human
cccuugccgucuaccugagggg

SEQ ID NO: 3521169 - RNA, 12 nt, Human
cccuugccuccc

SEQ ID NO: 3521170 - RNA, 15 nt, Human
cccuugccuccccau

SEQ ID NO: 3521171 - RNA, 18 nt, Human
cccuugccuccccauuuc

SEQ ID NO: 3521172 - RNA, 19 nt, Human
cccuugccuccccauuucc

SEQ ID NO: 3521173 - RNA, 20 nt, Human
cccuugccuccccauuuccc

SEQ ID NO: 3521174 - RNA, 22 nt, Human
cccuugcuaccacggccuccuu

SEQ ID NO: 3521175 - RNA, 20 nt, Human
cccuugcuggccccagcccu

SEQ ID NO: 3521176 - RNA, 14 nt, Human
cccuugcuguaugc

SEQ ID NO: 3521177 - RNA, 11 nt, Human
cccuugcuuuu

SEQ ID NO: 3521178 - RNA, 14 nt, Human
cccuugcuuuuccc

SEQ ID NO: 3521179 - RNA, 17 nt, Human
cccuugcuuuucccucu

SEQ ID NO: 3521180 - RNA, 22 nt, Human
cccuuggacaagacaaaccaag

SEQ ID NO: 3521181 - RNA, 19 nt, Human
cccuuggagcguggacugg

SEQ ID NO: 3521182 - RNA, 17 nt, Human
cccuuggaggccagcca

SEQ ID NO: 3521183 - RNA, 20 nt, Human
cccuuggcagguccuggcca

SEQ ID NO: 3521184 - RNA, 21 nt, Human
cccuuggcagguccuggccag

SEQ ID NO: 3521185 - RNA, 15 nt, Human
cccuuggcucaaucc

SEQ ID NO: 3521186 - RNA, 22 nt, Human
cccuuggcugugaggccccugg

SEQ ID NO: 3521187 - RNA, 16 nt, Human
cccuuggcuucuguga

SEQ ID NO: 3521188 - RNA, 14 nt, Human
cccuugggcccaca

SEQ ID NO: 3521189 - RNA, 18 nt, Human
cccuuggggagcaggcuc

SEQ ID NO: 3521190 - RNA, 22 nt, Human
cccuuggggguccuccuccagg

SEQ ID NO: 3521191 - RNA, 15 nt, Human
cccuuggguucugau

SEQ ID NO: 3521192 - RNA, 21 nt, Human
cccuuguagcuccuccccugg

SEQ ID NO: 3521193 - RNA, 19 nt, Human
cccuugucggccccaccag

SEQ ID NO: 3521194 - RNA, 12 nt, Human
cccuugucugag

SEQ ID NO: 3521195 - RNA, 14 nt, Human
cccuugucugagau

SEQ ID NO: 3521196 - RNA, 10 nt, Human
cccuuguggg

SEQ ID NO: 3521197 - RNA, 19 nt, Human
cccuuguuugucccuucua

SEQ ID NO: 3521198 - RNA, 23 nt, Human
cccuuuacuugucuuucuggggu

SEQ ID NO: 3521199 - RNA, 18 nt, Human
cccuuuagaucucugaag

SEQ ID NO: 3521200 - RNA, 16 nt, Human
cccuuucagagacagc

SEQ ID NO: 3521201 - RNA, 17 nt, Human
cccuuucagaugucuuc

SEQ ID NO: 3521202 - RNA, 13 nt, Human
cccuuuccaguua

SEQ ID NO: 3521203 - RNA, 12 nt, Human
cccuuucccggg

SEQ ID NO: 3521204 - RNA, 15 nt, Human
cccuuucccucgcua

SEQ ID NO: 3521205 - RNA, 14 nt, Human
cccuuuccucaggc

SEQ ID NO: 3521206 - RNA, 12 nt, Human
cccuuuccuguc

SEQ ID NO: 3521207 - RNA, 22 nt, Human
cccuuucugggcaccggggccu

SEQ ID NO: 3521208 - RNA, 14 nt, Human
cccuuucuuggcca

SEQ ID NO: 3521209 - RNA, 16 nt, Human
cccuuucuuggccagu

SEQ ID NO: 3521210 - RNA, 17 nt, Human
cccuuugaagccucagc

SEQ ID NO: 3521211 - RNA, 14 nt, Human
cccuuugacgccau

SEQ ID NO: 3521212 - RNA, 20 nt, Human
cccuuugguuuuuuucuucu

SEQ ID NO: 3521213 - RNA, 22 nt, Human
cccuuuguccuccugcugccag

SEQ ID NO: 3521214 - RNA, 11 nt, Human
cccuuuuccuu

SEQ ID NO: 3521215 - RNA, 13 nt, Human
cccuuuucuguuu

SEQ ID NO: 3521216 - RNA, 21 nt, Human
cccuuuugcggaugggagggg

SEQ ID NO: 3521217 - RNA, 20 nt, Human
cccuuuuggcccccgagcug

SEQ ID NO: 3521218 - RNA, 22 nt, Human
cccuuuuggcccccgagcuggg

SEQ ID NO: 3521219 - RNA, 21 nt, Human
cccuuuuguuccccagcccua

SEQ ID NO: 3521220 - RNA, 18 nt, Human
cccuuuuuacuccccuug

SEQ ID NO: 3521221 - RNA, 13 nt, Human
cagggcccugcag

SEQ ID NO: 3521222 - RNA, 14 nt, Human
cagggccgaggagg

SEQ ID NO: 3521223 - RNA, 16 nt, Human
cagggccgccagggag

SEQ ID NO: 3521224 - RNA, 23 nt, Human
cagggccggggaacuggccaagc

SEQ ID NO: 3521225 - RNA, 13 nt, Human
ccgccagccuccu

SEQ ID NO: 3521226 - RNA, 14 nt, Human
ccgccagccuccuc

SEQ ID NO: 3521227 - RNA, 15 nt, Human
ccgccagccuccucu

SEQ ID NO: 3521228 - RNA, 18 nt, Human
ccgccagccuccucugga

SEQ ID NO: 3521229 - RNA, 12 nt, Human
ccgccagggccc

SEQ ID NO: 3521230 - RNA, 20 nt, Human
ccgccauucucaagcccugc

SEQ ID NO: 3521231 - RNA, 21 nt, Human
ccgccauucucaagcccugca

SEQ ID NO: 3521232 - RNA, 13 nt, Human
ccgcccaaggccu

SEQ ID NO: 3521233 - RNA, 23 nt, Human
ccgcccacaggaagccugcaguc

SEQ ID NO: 3521234 - RNA, 19 nt, Human
ccgcccacuguccugggcg

SEQ ID NO: 3521235 - RNA, 14 nt, Human
ccgcccagcccacc

SEQ ID NO: 3521236 - RNA, 22 nt, Human
ccucagacucauacagaaggug

SEQ ID NO: 3521237 - RNA, 10 nt, Human
ccucagacug

SEQ ID NO: 3521238 - RNA, 19 nt, Human
ccucagacugcacccagga

SEQ ID NO: 3521239 - RNA, 14 nt, Human
ccucagacugcuca

SEQ ID NO: 3521240 - RNA, 15 nt, Human
ccucagacugcucaa

SEQ ID NO: 3521241 - RNA, 15 nt, Human
ccucagacuggggca

SEQ ID NO: 3521242 - RNA, 22 nt, Human
ccucagacuuaccaggaagcag

SEQ ID NO: 3521243 - RNA, 14 nt, Human
ccucagagaccagg

SEQ ID NO: 3521244 - RNA, 17 nt, Human
ccucagagaccagggcu

SEQ ID NO: 3521245 - RNA, 15 nt, Human
ccucagagccccgca

SEQ ID NO: 3521246 - RNA, 15 nt, Human
ccucagaguccaggc

SEQ ID NO: 3521247 - RNA, 16 nt, Human
ccucagaguccaggcc

SEQ ID NO: 3521248 - RNA, 18 nt, Human
ccucagaguccaggcccc

SEQ ID NO: 3521249 - RNA, 20 nt, Human
ccucagaugcacaugagcug

SEQ ID NO: 3521250 - RNA, 14 nt, Human
ccucagauggcagc

SEQ ID NO: 3521251 - RNA, 15 nt, Human
ccucagauggcagcu

SEQ ID NO: 3521252 - RNA, 16 nt, Human
ccucagauggcagcuu

SEQ ID NO: 3521253 - RNA, 23 nt, Human
ccucagauggcagcuuuuaaaag

SEQ ID NO: 3521254 - RNA, 14 nt, Human
ccucagcaccccuu

SEQ ID NO: 3521255 - RNA, 15 nt, Human
ccucagcaccccuuc

SEQ ID NO: 3521256 - RNA, 14 nt, Human
ccucagccagccuc

SEQ ID NO: 3521257 - RNA, 16 nt, Human
ccucagccaugaggag

SEQ ID NO: 3521258 - RNA, 13 nt, Human
ccucagccccucu

SEQ ID NO: 3521259 - RNA, 19 nt, Human
ccucagcccgccaagguag

SEQ ID NO: 3521260 - RNA, 16 nt, Human
ccucagccuagacccu

SEQ ID NO: 3521261 - RNA, 21 nt, Human
ccucagccucccaaagugcug

SEQ ID NO: 3521262 - RNA, 22 nt, Human
ccucagccucccaaagugcugg

SEQ ID NO: 3521263 - RNA, 23 nt, Human
ccucagccucccaaagugcuggg

SEQ ID NO: 3521264 - RNA, 12 nt, Human
ccucagccuccg

SEQ ID NO: 3521265 - RNA, 12 nt, Human
ccucagccucuc

SEQ ID NO: 3521266 - RNA, 21 nt, Human
ccucagccugaaccccagggc

SEQ ID NO: 3521267 - RNA, 22 nt, Human
ccucagccugaaccccagggcu

SEQ ID NO: 3521268 - RNA, 11 nt, Human
ccucagccugg

SEQ ID NO: 3521269 - RNA, 15 nt, Human
ccucagccuggccag

SEQ ID NO: 3521270 - RNA, 21 nt, Human
ccucagccuggccagacacag

SEQ ID NO: 3521271 - RNA, 14 nt, Human
ccucagccugggcg

SEQ ID NO: 3521272 - RNA, 14 nt, Human
ccucagcucccaca

SEQ ID NO: 3521273 - RNA, 15 nt, Human
ccucagcucggcuca

SEQ ID NO: 3521274 - RNA, 18 nt, Human
ccucagcucggcucagcu

SEQ ID NO: 3521275 - RNA, 11 nt, Human
ccucagcucug

SEQ ID NO: 3521276 - RNA, 12 nt, Human
ccucagcucugg

SEQ ID NO: 3521277 - RNA, 16 nt, Human
ccucagcucugggaga

SEQ ID NO: 3521278 - RNA, 17 nt, Human
ccucagcucugggagag

SEQ ID NO: 3521279 - RNA, 18 nt, Human
ccucagcucugggagagg

SEQ ID NO: 3521280 - RNA, 20 nt, Human
ccucagcucugggagaggau

SEQ ID NO: 3521281 - RNA, 14 nt, Human
ccucagcugccuca

SEQ ID NO: 3521282 - RNA, 17 nt, Human
ccucagcugccucacuu

SEQ ID NO: 3521283 - RNA, 20 nt, Human
ccucagcugccucacuuccu

SEQ ID NO: 3521284 - RNA, 13 nt, Human
ccucagcuucccc

SEQ ID NO: 3521285 - RNA, 15 nt, Human
ccucagcuuccccag

SEQ ID NO: 3521286 - RNA, 15 nt, Human
ccucaggacccucgc

SEQ ID NO: 3521287 - RNA, 13 nt, Human
ccucaggacugca

SEQ ID NO: 3521288 - RNA, 12 nt, Human
ccucaggagccg

SEQ ID NO: 3521289 - RNA, 22 nt, Human
ccucaggagccgaagcccaggg

SEQ ID NO: 3521290 - RNA, 19 nt, Human
ccucaggcacuagccuuug

SEQ ID NO: 3521291 - RNA, 14 nt, Human
ccucaggcagcuca

SEQ ID NO: 3521292 - RNA, 13 nt, Human
ccucaggcaggaa

SEQ ID NO: 3521293 - RNA, 19 nt, Human
ccucaggcaggaagggcag

SEQ ID NO: 3521294 - RNA, 18 nt, Human
ccucaggcaggugggaug

SEQ ID NO: 3521295 - RNA, 22 nt, Human
ccucaggcauaggccugggugc

SEQ ID NO: 3521296 - RNA, 11 nt, Human
ccucaggccug

SEQ ID NO: 3521297 - RNA, 14 nt, Human
ccucaggcugcugg

SEQ ID NO: 3521298 - RNA, 15 nt, Human
ccucaggcugcugga

SEQ ID NO: 3521299 - RNA, 16 nt, Human
ccucaggcugcuggag

SEQ ID NO: 3521300 - RNA, 17 nt, Human
ccucaggcugcuggagg

SEQ ID NO: 3521301 - RNA, 11 nt, Human
ccucagggaca

SEQ ID NO: 3521302 - RNA, 20 nt, Human
ccucagggacagagacaccu

SEQ ID NO: 3521303 - RNA, 21 nt, Human
ccucagggacagagacaccug

SEQ ID NO: 3521304 - RNA, 24 nt, Human
ccucagggacagagacaccugcac

SEQ ID NO: 3521305 - RNA, 20 nt, Human
ccucagggagcagggaaggc

SEQ ID NO: 3521306 - RNA, 23 nt, Human
ccucagggauggccguuggccac

SEQ ID NO: 3521307 - RNA, 16 nt, Human
ccucagggcaaagcca

SEQ ID NO: 3521308 - RNA, 21 nt, Human
ccucagggcaaagccaggucc

SEQ ID NO: 3521309 - RNA, 18 nt, Human
ccucagggcagccugccu

SEQ ID NO: 3521310 - RNA, 20 nt, Human
ccucagggcagccugccugg

SEQ ID NO: 3521311 - RNA, 22 nt, Human
ccucagggcuccuugugggccu

SEQ ID NO: 3521312 - RNA, 23 nt, Human
ccucagggcuccuugugggccug

SEQ ID NO: 3521313 - RNA, 18 nt, Human
ccucaggggaaaacuguu

SEQ ID NO: 3521314 - RNA, 21 nt, Human
ccucaggggaaaacuguuacc

SEQ ID NO: 3521315 - RNA, 22 nt, Human
ccucaggggucugagcuccagc

SEQ ID NO: 3521316 - RNA, 23 nt, Human
ccucaggggucugagcuccagcu

SEQ ID NO: 3521317 - RNA, 15 nt, Human
ccucagggucccugg

SEQ ID NO: 3521318 - RNA, 16 nt, Human
ccucagggucccuggu

SEQ ID NO: 3521319 - RNA, 21 nt, Human
ccucagguaaucgaccugccu

SEQ ID NO: 3521320 - RNA, 23 nt, Human
ccucagguaaucgaccugccucg

SEQ ID NO: 3521321 - RNA, 14 nt, Human
ccucaggugcuguc

SEQ ID NO: 3521322 - RNA, 16 nt, Human
ccucaggugcugucca

SEQ ID NO: 3521323 - RNA, 11 nt, Human
ccucagguggc

SEQ ID NO: 3521324 - RNA, 23 nt, Human
ccucagguggccagccuggaucu

SEQ ID NO: 3521325 - RNA, 18 nt, Human
ccucagguggccaugccu

SEQ ID NO: 3521326 - RNA, 18 nt, Human
ccucaggugggccgcagg

SEQ ID NO: 3521327 - RNA, 15 nt, Human
ccucagguuccuaug

SEQ ID NO: 3521328 - RNA, 21 nt, Human
ccucaguagucccugcacagu

SEQ ID NO: 3521329 - RNA, 22 nt, Human
ccucagucccaaauccuuccca

SEQ ID NO: 3521330 - RNA, 11 nt, Human
ccucaguccuc

SEQ ID NO: 3521331 - RNA, 12 nt, Human
ccucaguccucc

SEQ ID NO: 3521332 - RNA, 19 nt, Human
ccucaguccuccccucaca

SEQ ID NO: 3521333 - RNA, 20 nt, Human
ccucaguggacuuuccaccc

SEQ ID NO: 3521334 - RNA, 16 nt, Human
ccucaguucccuuggc

SEQ ID NO: 3521335 - RNA, 17 nt, Human
ccucaguucccuuggcc

SEQ ID NO: 3521336 - RNA, 18 nt, Human
ccucaguucccuuggccu

SEQ ID NO: 3521337 - RNA, 20 nt, Human
ccucaguucccuuggccuca

SEQ ID NO: 3521338 - RNA, 22 nt, Human
ccucaguucccuuggccucaga

SEQ ID NO: 3521339 - RNA, 16 nt, Human
ccucaguugugcagcu

SEQ ID NO: 3521340 - RNA, 19 nt, Human
ccucaguuuuaucauuuuc

SEQ ID NO: 3521341 - RNA, 12 nt, Human
ccucauacccac

SEQ ID NO: 3521342 - RNA, 14 nt, Human
ccucaucaccaacg

SEQ ID NO: 3521343 - RNA, 14 nt, Human
ccucaucaggauga

SEQ ID NO: 3521344 - RNA, 19 nt, Human
ccucaucaggaugaaccca

SEQ ID NO: 3521345 - RNA, 23 nt, Human
ccucauccagggcucugaccagu

SEQ ID NO: 3521346 - RNA, 20 nt, Human
ccucaucccguguucuccuu

SEQ ID NO: 3521347 - RNA, 14 nt, Human
ccucauccgaggca

SEQ ID NO: 3521348 - RNA, 20 nt, Human
ccucauccgaggcaggguca

SEQ ID NO: 3521349 - RNA, 17 nt, Human
ccucauccuccuucuuc

SEQ ID NO: 3521350 - RNA, 19 nt, Human
ccucaucucucugcccaac

SEQ ID NO: 3521351 - RNA, 19 nt, Human
ccucaucugcucagcagcu

SEQ ID NO: 3521352 - RNA, 15 nt, Human
ccucaucugucccuc

SEQ ID NO: 3521353 - RNA, 22 nt, Human
ccucaucuugaagggcccagga

SEQ ID NO: 3521354 - RNA, 17 nt, Human
ccucaucuuucaucaau

SEQ ID NO: 3521355 - RNA, 13 nt, Human
ccucaugaaugua

SEQ ID NO: 3521356 - RNA, 17 nt, Human
ccucaugaauguaaauu

SEQ ID NO: 3521357 - RNA, 22 nt, Human
ccucaugaauguaaauuuguac

SEQ ID NO: 3521358 - RNA, 15 nt, Human
ccucaugcccacccc

SEQ ID NO: 3521359 - RNA, 20 nt, Human
ccucaugcccacccccugcc

SEQ ID NO: 3521360 - RNA, 21 nt, Human
ccucaugcccacccccugccc

SEQ ID NO: 3521361 - RNA, 22 nt, Human
ccucaugcccacccccugcccu

SEQ ID NO: 3521362 - RNA, 16 nt, Human
ccucaugcugccaaua

SEQ ID NO: 3521363 - RNA, 22 nt, Human
ccucauggcagccuacucuccu

SEQ ID NO: 3521364 - RNA, 15 nt, Human
ccucauggccccucu

SEQ ID NO: 3521365 - RNA, 13 nt, Human
ccucauguggcug

SEQ ID NO: 3521366 - RNA, 16 nt, Human
ccucauguggcuggaa

SEQ ID NO: 3521367 - RNA, 20 nt, Human
ccucauuaaccgaugcuuua

SEQ ID NO: 3521368 - RNA, 18 nt, Human
ccucauuagcauuuugcu

SEQ ID NO: 3521369 - RNA, 23 nt, Human
ccucauuauuuauguccaggugu

SEQ ID NO: 3521370 - RNA, 19 nt, Human
ccuauggagagcccuggga

SEQ ID NO: 3521371 - RNA, 22 nt, Human
ccuauggagagcccugggaccg

SEQ ID NO: 3521372 - RNA, 23 nt, Human
ccuauggcagaaaaaaugucugu

SEQ ID NO: 3521373 - RNA, 15 nt, Human
ccuauggccucaugu

SEQ ID NO: 3521374 - RNA, 14 nt, Human
ccuauguauuugca

SEQ ID NO: 3521375 - RNA, 18 nt, Human
ccuaugucauuucauuuc

SEQ ID NO: 3521376 - RNA, 20 nt, Human
ccuauguccuaaggacacac

SEQ ID NO: 3521377 - RNA, 24 nt, Human
ccuauguccuaaggacacacuaau

SEQ ID NO: 3521378 - RNA, 11 nt, Human
ccuauguguaa

SEQ ID NO: 3521379 - RNA, 20 nt, Human
ccuauguugauccauccagc

SEQ ID NO: 3521380 - RNA, 22 nt, Human
ccuauguuuuuguucaaagcca

SEQ ID NO: 3521381 - RNA, 17 nt, Human
ccuauuagagaagagau

SEQ ID NO: 3521382 - RNA, 11 nt, Human
ccuauuagugu

SEQ ID NO: 3521383 - RNA, 15 nt, Human
ccuauuaguguuaua

SEQ ID NO: 3521384 - RNA, 21 nt, Human
ccuauucaacacacacaugcu

SEQ ID NO: 3521385 - RNA, 18 nt, Human
ccuauuccugaacuauaa

SEQ ID NO: 3521386 - RNA, 16 nt, Human
ccuauucuauaaaacu

SEQ ID NO: 3521387 - RNA, 11 nt, Human
ccuauucucac

SEQ ID NO: 3521388 - RNA, 15 nt, Human
ccuauucucaccagg

SEQ ID NO: 3521389 - RNA, 16 nt, Human
ccuauucucaccagga

SEQ ID NO: 3521390 - RNA, 18 nt, Human
ccuauugauuuaagcuuu

SEQ ID NO: 3521391 - RNA, 22 nt, Human
ccuauugcaaagguuccaacug

SEQ ID NO: 3521392 - RNA, 18 nt, Human
ccuauugcuagagcuccu

SEQ ID NO: 3521393 - RNA, 13 nt, Human
ccuauuguaauau

SEQ ID NO: 3521394 - RNA, 15 nt, Human
ccuauugucauuaaa

SEQ ID NO: 3521395 - RNA, 12 nt, Human
ccuauugugauu

SEQ ID NO: 3521396 - RNA, 13 nt, Human
ccuauugugauuu

SEQ ID NO: 3521397 - RNA, 14 nt, Human
ccuauugugauuug

SEQ ID NO: 3521398 - RNA, 22 nt, Human
ccuauugugauuugacuguuuu

SEQ ID NO: 3521399 - RNA, 16 nt, Human
ccuauuuaccugcagg

SEQ ID NO: 3521400 - RNA, 15 nt, Human
ccuauuucaguacuu

SEQ ID NO: 3521401 - RNA, 19 nt, Human
ccuauuucaguguuaccug

SEQ ID NO: 3521402 - RNA, 18 nt, Human
ccuauuuccauucaacaa

SEQ ID NO: 3521403 - RNA, 13 nt, Human
ccuauuucucuuu

SEQ ID NO: 3521404 - RNA, 15 nt, Human
ccuauuucuugauaa

SEQ ID NO: 3521405 - RNA, 17 nt, Human
ccuauuugccaugggcu

SEQ ID NO: 3521406 - RNA, 20 nt, Human
ccuauuuugaaaaauuccua

SEQ ID NO: 3521407 - RNA, 22 nt, Human
ccuauuuugaaaaauuccuauu

SEQ ID NO: 3521408 - RNA, 23 nt, Human
ccuauuuugaaaaauuccuauug

SEQ ID NO: 3521409 - RNA, 19 nt, Human
ccuauuuuucucuccuguc

SEQ ID NO: 3521410 - RNA, 14 nt, Human
ccuauuuuuguaaa

SEQ ID NO: 3521411 - RNA, 13 nt, Human
ccuauuuuuguag

SEQ ID NO: 3521412 - RNA, 20 nt, Human
ccucaaaaagauuuccccau

SEQ ID NO: 3521413 - RNA, 13 nt, Human
ccucaaacacugc

SEQ ID NO: 3521414 - RNA, 18 nt, Human
ccucaaacacugcaggca

SEQ ID NO: 3521415 - RNA, 21 nt, Human
ccucaaacacugcaggcauca

SEQ ID NO: 3521416 - RNA, 13 nt, Human
ccucaaaccuccu

SEQ ID NO: 3521417 - RNA, 16 nt, Human
ccucaaaccuccucuu

SEQ ID NO: 3521418 - RNA, 18 nt, Human
ccucaaaccuccucuucu

SEQ ID NO: 3521419 - RNA, 16 nt, Human
ccucaaagaaagugua

SEQ ID NO: 3521420 - RNA, 20 nt, Human
ccucaaagcuuggauuaaau

SEQ ID NO: 3521421 - RNA, 13 nt, Human
ccucaaagcuuuu

SEQ ID NO: 3521422 - RNA, 16 nt, Human
ccucaaaggcccgcuc

SEQ ID NO: 3521423 - RNA, 14 nt, Human
ccucaaagucugca

SEQ ID NO: 3521424 - RNA, 22 nt, Human
ccucaaauaaaaagugcuuuug

SEQ ID NO: 3521425 - RNA, 19 nt, Human
ccucaaauccaggacccug

SEQ ID NO: 3521426 - RNA, 15 nt, Human
ccucaaaucguccag

SEQ ID NO: 3521427 - RNA, 23 nt, Human
ccucaaaugaugugccugcuuca

SEQ ID NO: 3521428 - RNA, 22 nt, Human
ccucaaauuuuuugacuuuuuu

SEQ ID NO: 3521429 - RNA, 15 nt, Human
ccucaacaagggaga

SEQ ID NO: 3521430 - RNA, 16 nt, Human
ccucaacaccucugca

SEQ ID NO: 3521431 - RNA, 21 nt, Human
ccucaacccucccucagcccc

SEQ ID NO: 3521432 - RNA, 12 nt, Human
ccucaaccuccc

SEQ ID NO: 3521433 - RNA, 14 nt, Human
ccucaaccucccaa

SEQ ID NO: 3521434 - RNA, 16 nt, Human
ccucaaccuccugugg

SEQ ID NO: 3521435 - RNA, 21 nt, Human
ccucaaccugcuguccuccag

SEQ ID NO: 3521436 - RNA, 23 nt, Human
ccucaacucuccuccagagucag

SEQ ID NO: 3521437 - RNA, 14 nt, Human
ccucaacucugcug

SEQ ID NO: 3521438 - RNA, 19 nt, Human
ccucaacucugcugagggu

SEQ ID NO: 3521439 - RNA, 16 nt, Human
ccucaagaaauaaaag

SEQ ID NO: 3521440 - RNA, 15 nt, Human
ccucaagagaaggca

SEQ ID NO: 3521441 - RNA, 17 nt, Human
ccucaagaugaaggcaa

SEQ ID NO: 3521442 - RNA, 16 nt, Human
ccucaagccaaucccc

SEQ ID NO: 3521443 - RNA, 20 nt, Human
ccucaaggacuugaaagcau

SEQ ID NO: 3521444 - RNA, 21 nt, Human
ccucaaggacuugaaagcauc

SEQ ID NO: 3521445 - RNA, 22 nt, Human
ccucaaggacuugaaagcaucc

SEQ ID NO: 3521446 - RNA, 18 nt, Human
ccucaaggccucccacag

SEQ ID NO: 3521447 - RNA, 20 nt, Human
ccucaaggccucccacagug

SEQ ID NO: 3521448 - RNA, 20 nt, Human
ccucaaggggccauccuguc

SEQ ID NO: 3521449 - RNA, 20 nt, Human
ccucaagguuuuagguucua

SEQ ID NO: 3521450 - RNA, 18 nt, Human
ccucuccaagggcuucug

SEQ ID NO: 3521451 - RNA, 19 nt, Human
ccucuccaagggcuucugc

SEQ ID NO: 3521452 - RNA, 18 nt, Human
ccucuccacacagugcuc

SEQ ID NO: 3521453 - RNA, 23 nt, Human
ccucuccacacagugcucaaggc

SEQ ID NO: 3521454 - RNA, 23 nt, Human
ccucuccaccuaguggcugucca

SEQ ID NO: 3521455 - RNA, 12 nt, Human
ccucuccacugc

SEQ ID NO: 3521456 - RNA, 14 nt, Human
ccucuccacugccu

SEQ ID NO: 3521457 - RNA, 19 nt, Human
ccucuccacugccuucgau

SEQ ID NO: 3521458 - RNA, 13 nt, Human
ccucuccagccuc

SEQ ID NO: 3521459 - RNA, 14 nt, Human
ccucuccagcuaua

SEQ ID NO: 3521460 - RNA, 18 nt, Human
ccucuccaguuugcaccu

SEQ ID NO: 3521461 - RNA, 20 nt, Human
ccucuccaguuugcaccugu

SEQ ID NO: 3521462 - RNA, 21 nt, Human
ccucuccaguuugcaccuguc

SEQ ID NO: 3521463 - RNA, 23 nt, Human
ccucuccaguuugcaccuguccc

SEQ ID NO: 3521464 - RNA, 19 nt, Human
ccucuccauaaccccaccc

SEQ ID NO: 3521465 - RNA, 14 nt, Human
ccucuccaucuuca

SEQ ID NO: 3521466 - RNA, 16 nt, Human
ccucuccaucuucagc

SEQ ID NO: 3521467 - RNA, 14 nt, Human
ccucucccacccuc

SEQ ID NO: 3521468 - RNA, 15 nt, Human
ccucucccacccucu

SEQ ID NO: 3521469 - RNA, 18 nt, Human
ccucucccacccucuucc

SEQ ID NO: 3521470 - RNA, 19 nt, Human
ccucucccacccucuuccu

SEQ ID NO: 3521471 - RNA, 14 nt, Human
ccucucccaggacc

SEQ ID NO: 3521472 - RNA, 12 nt, Human
ccucucccaggc

SEQ ID NO: 3521473 - RNA, 15 nt, Human
ccucucccaggcccc

SEQ ID NO: 3521474 - RNA, 18 nt, Human
ccucucccaggccccaug

SEQ ID NO: 3521475 - RNA, 15 nt, Human
ccucucccaguuguc

SEQ ID NO: 3521476 - RNA, 17 nt, Human
ccucucccaucccccug

SEQ ID NO: 3521477 - RNA, 19 nt, Human
ccucucccaucccccugcc

SEQ ID NO: 3521478 - RNA, 22 nt, Human
ccucucccauugucccucugcc

SEQ ID NO: 3521479 - RNA, 22 nt, Human
ccucuccccaagacuugguguc

SEQ ID NO: 3521480 - RNA, 12 nt, Human
ccucuccccagc

SEQ ID NO: 3521481 - RNA, 15 nt, Human
ccucuccccagcaag

SEQ ID NO: 3521482 - RNA, 14 nt, Human
ccucuccccagccc

SEQ ID NO: 3521483 - RNA, 16 nt, Human
ccucuccccagcccag

SEQ ID NO: 3521484 - RNA, 18 nt, Human
ccucuccccagcccagag

SEQ ID NO: 3521485 - RNA, 21 nt, Human
ccucuccccagguccagcucu

SEQ ID NO: 3521486 - RNA, 20 nt, Human
ccucuccccccccccuccaa

SEQ ID NO: 3521487 - RNA, 16 nt, Human
ccucuccccucagccu

SEQ ID NO: 3521488 - RNA, 12 nt, Human
ccucuccccucc

SEQ ID NO: 3521489 - RNA, 14 nt, Human
ccucuccccuccag

SEQ ID NO: 3521490 - RNA, 17 nt, Human
ccucuccccuccagccu

SEQ ID NO: 3521491 - RNA, 12 nt, Human
ccucuccccugc

SEQ ID NO: 3521492 - RNA, 23 nt, Human
ccucuccccugcccccugcagga

SEQ ID NO: 3521493 - RNA, 17 nt, Human
ccucucccgucagggcc

SEQ ID NO: 3521494 - RNA, 10 nt, Human
ccucucccug

SEQ ID NO: 3521495 - RNA, 17 nt, Human
ccucucccugcugcucc

SEQ ID NO: 3521496 - RNA, 23 nt, Human
ccucucccugcugcuccuaggac

SEQ ID NO: 3521497 - RNA, 18 nt, Human
ccucuccucauguucugc

SEQ ID NO: 3521498 - RNA, 12 nt, Human
ccucuccugccu

SEQ ID NO: 3521499 - RNA, 16 nt, Human
ccucuccugccuacuc

SEQ ID NO: 3521500 - RNA, 12 nt, Human
ccucuccuggag

SEQ ID NO: 3521501 - RNA, 11 nt, Human
ccucuccuggg

SEQ ID NO: 3521502 - RNA, 13 nt, Human
ccucuccugggca

SEQ ID NO: 3521503 - RNA, 14 nt, Human
ccucuccugggcag

SEQ ID NO: 3521504 - RNA, 13 nt, Human
ccucuccuuccua

SEQ ID NO: 3521505 - RNA, 15 nt, Human
ccucuccuuccugug

SEQ ID NO: 3521506 - RNA, 17 nt, Human
ccucuccuuccuuaccc

SEQ ID NO: 3521507 - RNA, 16 nt, Human
ccucuccuuccuuguu

SEQ ID NO: 3521508 - RNA, 14 nt, Human
ccucuccuuuguau

SEQ ID NO: 3521509 - RNA, 16 nt, Human
ccucuccuuuguauau

SEQ ID NO: 3521510 - RNA, 14 nt, Human
ccucucgcggcccu

SEQ ID NO: 3521511 - RNA, 20 nt, Human
ccucucgcuccucaaccccu

SEQ ID NO: 3521512 - RNA, 22 nt, Human
ccucucgcuccucaaccccucc

SEQ ID NO: 3521513 - RNA, 21 nt, Human
ccucucggaaggcuggcuggg

SEQ ID NO: 3521514 - RNA, 17 nt, Human
ccucucgguugaaaccu

SEQ ID NO: 3521515 - RNA, 13 nt, Human
ccucugucugccc

SEQ ID NO: 3521516 - RNA, 22 nt, Human
ccucugucuggcaaugccacag

SEQ ID NO: 3521517 - RNA, 20 nt, Human
ccucugucuucagcacccuc

SEQ ID NO: 3521518 - RNA, 20 nt, Human
ccucugucuuggcuuucaug

SEQ ID NO: 3521519 - RNA, 17 nt, Human
ccucugugaccucaggc

SEQ ID NO: 3521520 - RNA, 14 nt, Human
ccucugugccuucu

SEQ ID NO: 3521521 - RNA, 13 nt, Human
ccucugugcugug

SEQ ID NO: 3521522 - RNA, 16 nt, Human
ccucugugcugugugu

SEQ ID NO: 3521523 - RNA, 14 nt, Human
ccucugugucacug

SEQ ID NO: 3521524 - RNA, 17 nt, Human
ccucugugucacuggcu

SEQ ID NO: 3521525 - RNA, 21 nt, Human
ccucugugucacuggcugccu

SEQ ID NO: 3521526 - RNA, 22 nt, Human
ccucugugucacuggcugccuc

SEQ ID NO: 3521527 - RNA, 13 nt, Human
ccucuguguccuu

SEQ ID NO: 3521528 - RNA, 19 nt, Human
ccucuguguccuucccugc

SEQ ID NO: 3521529 - RNA, 16 nt, Human
ccucuguucaguguaa

SEQ ID NO: 3521530 - RNA, 16 nt, Human
ccucuguuccuucccu

SEQ ID NO: 3521531 - RNA, 15 nt, Human
ccucuguuguccucc

SEQ ID NO: 3521532 - RNA, 18 nt, Human
ccucuuaaaaaauaaaaa

SEQ ID NO: 3521533 - RNA, 20 nt, Human
ccucuuaaagaaaacccacc

SEQ ID NO: 3521534 - RNA, 21 nt, Human
ccucuuaaagcugccuguagu

SEQ ID NO: 3521535 - RNA, 23 nt, Human
ccucuuaccaguauuuaacuucu

SEQ ID NO: 3521536 - RNA, 16 nt, Human
ccucuuacuaauguaa

SEQ ID NO: 3521537 - RNA, 23 nt, Human
ccucuuagaugcaguucugaaga

SEQ ID NO: 3521538 - RNA, 14 nt, Human
ccucuuagcugagu

SEQ ID NO: 3521539 - RNA, 17 nt, Human
ccucuuagcugagugga

SEQ ID NO: 3521540 - RNA, 14 nt, Human
ccucuuaugggcug

SEQ ID NO: 3521541 - RNA, 17 nt, Human
ccucuuaugggcugggu

SEQ ID NO: 3521542 - RNA, 18 nt, Human
ccucuuauguaccucuuu

SEQ ID NO: 3521543 - RNA, 13 nt, Human
ccucuucagaggc

SEQ ID NO: 3521544 - RNA, 16 nt, Human
ccucuucagaggcccu

SEQ ID NO: 3521545 - RNA, 15 nt, Human
ccucuuccaggcccc

SEQ ID NO: 3521546 - RNA, 14 nt, Human
ccucuuccccagaa

SEQ ID NO: 3521547 - RNA, 22 nt, Human
ccucuuccccagaaaggagacu

SEQ ID NO: 3521548 - RNA, 22 nt, Human
ccucuuccccagacgccuggcu

SEQ ID NO: 3521549 - RNA, 15 nt, Human
ccucuucccccugcu

SEQ ID NO: 3521550 - RNA, 15 nt, Human
ccucuucccccuucc

SEQ ID NO: 3521551 - RNA, 17 nt, Human
ccucuuccccuugcccu

SEQ ID NO: 3521552 - RNA, 19 nt, Human
ccucuuccgacucuuucug

SEQ ID NO: 3521553 - RNA, 18 nt, Human
ccucuuccgugacgucac

SEQ ID NO: 3521554 - RNA, 21 nt, Human
ccucuuccuacuggucucucu

SEQ ID NO: 3521555 - RNA, 12 nt, Human
ccucuuccucug

SEQ ID NO: 3521556 - RNA, 13 nt, Human
ccucuuccucuga

SEQ ID NO: 3521557 - RNA, 15 nt, Human
ccucuucuacucacu

SEQ ID NO: 3521558 - RNA, 17 nt, Human
ccucuucuauuuuguaa

SEQ ID NO: 3521559 - RNA, 18 nt, Human
ccucuucuauuuuguaaa

SEQ ID NO: 3521560 - RNA, 15 nt, Human
ccucuucucaagugc

SEQ ID NO: 3521561 - RNA, 19 nt, Human
ccucuucucaagugccuua

SEQ ID NO: 3521562 - RNA, 13 nt, Human
ccucuucucucag

SEQ ID NO: 3521563 - RNA, 12 nt, Human
ccucuucucuuc

SEQ ID NO: 3521564 - RNA, 14 nt, Human
ccucuucugagcuu

SEQ ID NO: 3521565 - RNA, 16 nt, Human
ccucuucugccaagag

SEQ ID NO: 3521566 - RNA, 16 nt, Human
ccucuucugggccuga

SEQ ID NO: 3521567 - RNA, 15 nt, Human
ccucuucuucucaag

SEQ ID NO: 3521568 - RNA, 16 nt, Human
ccucuucuucuucaga

SEQ ID NO: 3521569 - RNA, 17 nt, Human
ccucuugacccugcacc

SEQ ID NO: 3521570 - RNA, 17 nt, Human
ccucuugagcaguggcu

SEQ ID NO: 3521571 - RNA, 19 nt, Human
ccucuugagccuugaacuu

SEQ ID NO: 3521572 - RNA, 23 nt, Human
ccucuugccacugccucuuccuc

SEQ ID NO: 3521573 - RNA, 13 nt, Human
ccucuugcccauc

SEQ ID NO: 3521574 - RNA, 12 nt, Human
ccucuugcccca

SEQ ID NO: 3521575 - RNA, 15 nt, Human
ccucuugccccaacc

SEQ ID NO: 3521576 - RNA, 16 nt, Human
ccucuugccccaaccc

SEQ ID NO: 3521577 - RNA, 23 nt, Human
ccucuugccccccaccccagccu

SEQ ID NO: 3521578 - RNA, 16 nt, Human
ccucuugcugucucug

SEQ ID NO: 3521579 - RNA, 17 nt, Human
ccucuuggaccucugcu

SEQ ID NO: 3521580 - RNA, 19 nt, Human
ccucuuggaccucugcucu

SEQ ID NO: 3521581 - RNA, 18 nt, Human
ccucuuggagaagucuca

SEQ ID NO: 3521582 - RNA, 13 nt, Human
ccucuuggccuga

SEQ ID NO: 3521583 - RNA, 15 nt, Human
ccucuuggcugccuu

SEQ ID NO: 3521584 - RNA, 23 nt, Human
ccucuuggggaguuuaggguggg

SEQ ID NO: 3521585 - RNA, 13 nt, Human
ccucuuggguuca

SEQ ID NO: 3521586 - RNA, 16 nt, Human
ccucuuguaaagacug

SEQ ID NO: 3521587 - RNA, 12 nt, Human
ccucuuguaaau

SEQ ID NO: 3521588 - RNA, 14 nt, Human
ccucuuguaaauaa

SEQ ID NO: 3521589 - RNA, 22 nt, Human
ccucuugucuuccuauuucaga

SEQ ID NO: 3521590 - RNA, 12 nt, Human
ccucuuuagagu

SEQ ID NO: 3521591 - RNA, 17 nt, Human
ccucuuuagaguuagac

SEQ ID NO: 3521592 - RNA, 12 nt, Human
ccucuuucagcu

SEQ ID NO: 3521593 - RNA, 14 nt, Human
ccucuuucagcucc

SEQ ID NO: 3521594 - RNA, 13 nt, Human
ccucuuucaucca

SEQ ID NO: 3521595 - RNA, 15 nt, Human
ccucuuucccuucca

SEQ ID NO: 3521596 - RNA, 18 nt, Human
ccucuuucccuuccaguu

SEQ ID NO: 3521597 - RNA, 13 nt, Human
ccucuuucucucc

SEQ ID NO: 3521598 - RNA, 15 nt, Human
ccucuuucucucccc

SEQ ID NO: 3521599 - RNA, 18 nt, Human
ccucuuucucuccccaac

SEQ ID NO: 3521600 - RNA, 21 nt, Human
ccucuuucucuccccaacccc

SEQ ID NO: 3521601 - RNA, 20 nt, Human
ccucuuucucuuucuuccuu

SEQ ID NO: 3521602 - RNA, 21 nt, Human
ccucuuugcuuugcuuucugc

SEQ ID NO: 3521603 - RNA, 14 nt, Human
ccucuuuggcuccc

SEQ ID NO: 3521604 - RNA, 19 nt, Human
ccucuuuggcuccccugua

SEQ ID NO: 3521605 - RNA, 15 nt, Human
ccucuuugucuaaaa

SEQ ID NO: 3521606 - RNA, 22 nt, Human
ccucuuugucuaaaacaauaaa

SEQ ID NO: 3521607 - RNA, 15 nt, Human
ccucuuuuaccugcu

SEQ ID NO: 3521608 - RNA, 16 nt, Human
ccucuuuuaccugcug

SEQ ID NO: 3521609 - RNA, 19 nt, Human
ccucuuuuaccugcugcuu

SEQ ID NO: 3521610 - RNA, 21 nt, Human
ccucuuuuaccugcugcuucu

SEQ ID NO: 3521611 - RNA, 22 nt, Human
ccucuuuuaccugcugcuucuc

SEQ ID NO: 3521612 - RNA, 21 nt, Human
ccucuuuucuuacuccuccuc

SEQ ID NO: 3521613 - RNA, 19 nt, Human
ccucuuuuguuaaauaaua

SEQ ID NO: 3521614 - RNA, 21 nt, Human
ccucuuuuuaaaguucaaacu

SEQ ID NO: 3521615 - RNA, 23 nt, Human
ccucuuuuuccaacuuggcugca

SEQ ID NO: 3521616 - RNA, 13 nt, Human
ccucuuuuuucgu

SEQ ID NO: 3521617 - RNA, 23 nt, Human
ccucagggcagccugccuggagu

SEQ ID NO: 3521618 - RNA, 18 nt, Human
ccucagggcucccagggg

SEQ ID NO: 3521619 - RNA, 13 nt, Human
ccucaggggucug

SEQ ID NO: 3521620 - RNA, 16 nt, Human
ccucaggggucugagc

SEQ ID NO: 3521621 - RNA, 17 nt, Human
ccucagggucccuggug

SEQ ID NO: 3521622 - RNA, 20 nt, Human
ccucagggucccugguggca

SEQ ID NO: 3521623 - RNA, 17 nt, Human
ccucaggugagaagcag

SEQ ID NO: 3521624 - RNA, 17 nt, Human
ccucaggugauccaccc

SEQ ID NO: 3521625 - RNA, 18 nt, Human
ccucaggugcuguccaug

SEQ ID NO: 3521626 - RNA, 12 nt, Human
ccucagguggcc

SEQ ID NO: 3521627 - RNA, 15 nt, Human
ccucagguggccaug

SEQ ID NO: 3521628 - RNA, 15 nt, Human
ccucaggugggccgc

SEQ ID NO: 3521629 - RNA, 16 nt, Human
ccucagguugcugguu

SEQ ID NO: 3521630 - RNA, 21 nt, Human
ccucagguugcugguugcugu

SEQ ID NO: 3521631 - RNA, 19 nt, Human
ccucagguuugccugaggg

SEQ ID NO: 3521632 - RNA, 15 nt, Human
ccucaguagucccug

SEQ ID NO: 3521633 - RNA, 23 nt, Human
ccucaguagucccugcacaguga

SEQ ID NO: 3521634 - RNA, 17 nt, Human
ccucaguccuccccuca

SEQ ID NO: 3521635 - RNA, 21 nt, Human
ccucaguccuccccucacagc

SEQ ID NO: 3521636 - RNA, 22 nt, Human
ccucaguccuccccucacagcc

SEQ ID NO: 3521637 - RNA, 15 nt, Human
ccucagucuggcccu

SEQ ID NO: 3521638 - RNA, 20 nt, Human
ccucagucuggcccuuccuu

SEQ ID NO: 3521639 - RNA, 17 nt, Human
ccucagugacccuggcu

SEQ ID NO: 3521640 - RNA, 19 nt, Human
ccucagugacccuggcucc

SEQ ID NO: 3521641 - RNA, 20 nt, Human
ccucagugacccuggcuccu

SEQ ID NO: 3521642 - RNA, 11 nt, Human
ccucagugcca

SEQ ID NO: 3521643 - RNA, 16 nt, Human
ccucaguggacuuucc

SEQ ID NO: 3521644 - RNA, 18 nt, Human
ccucaguggacuuuccac

SEQ ID NO: 3521645 - RNA, 13 nt, Human
ccucaguguauuu

SEQ ID NO: 3521646 - RNA, 11 nt, Human
ccucaguguca

SEQ ID NO: 3521647 - RNA, 23 nt, Human
ccucagugucauuuaugaaaaga

SEQ ID NO: 3521648 - RNA, 15 nt, Human
ccucaguucccuugg

SEQ ID NO: 3521649 - RNA, 19 nt, Human
ccucaguucccuuggccuc

SEQ ID NO: 3521650 - RNA, 14 nt, Human
ccucaguugugcag

SEQ ID NO: 3521651 - RNA, 23 nt, Human
ccucaguuuaauccuucuaguuu

SEQ ID NO: 3521652 - RNA, 21 nt, Human
ccucauagcccucacccuggg

SEQ ID NO: 3521653 - RNA, 20 nt, Human
ccucauaguaugguggcugg

SEQ ID NO: 3521654 - RNA, 21 nt, Human
ccucauaguaugguggcuggg

SEQ ID NO: 3521655 - RNA, 13 nt, Human
ccucaucaccaac

SEQ ID NO: 3521656 - RNA, 21 nt, Human
ccucaucaggaugaacccagg

SEQ ID NO: 3521657 - RNA, 23 nt, Human
ccucaucaggaugaacccaggac

SEQ ID NO: 3521658 - RNA, 13 nt, Human
ccucaucccauga

SEQ ID NO: 3521659 - RNA, 17 nt, Human
ccucauccgaggcaggg

SEQ ID NO: 3521660 - RNA, 18 nt, Human
cauauggguuagauguug

SEQ ID NO: 3521661 - RNA, 20 nt, Human
cauauggucuccauuuuaca

SEQ ID NO: 3521662 - RNA, 13 nt, Human
cauauguaaaaua

SEQ ID NO: 3521663 - RNA, 15 nt, Human
cauauguaaacauaa

SEQ ID NO: 3521664 - RNA, 19 nt, Human
cauauguacauaaauugca

SEQ ID NO: 3521665 - RNA, 17 nt, Human
cauauguagacuauaua

SEQ ID NO: 3521666 - RNA, 19 nt, Human
cauauguagacuauauaca

SEQ ID NO: 3521667 - RNA, 21 nt, Human
cauauguagacuauauacaug

SEQ ID NO: 3521668 - RNA, 23 nt, Human
cauauguagacuauauacaugug

SEQ ID NO: 3521669 - RNA, 17 nt, Human
cauauguagccuucaca

SEQ ID NO: 3521670 - RNA, 24 nt, Human
cauauguagccuucacacagauag

SEQ ID NO: 3521671 - RNA, 15 nt, Human
cauauguauacaugu

SEQ ID NO: 3521672 - RNA, 17 nt, Human
ccugcaccggggccugg

SEQ ID NO: 3521673 - RNA, 18 nt, Human
ccugcaccuccccccacu

SEQ ID NO: 3521674 - RNA, 19 nt, Human
ccugcaccuccccccacug

SEQ ID NO: 3521675 - RNA, 16 nt, Human
ccugcacggugggccu

SEQ ID NO: 3521676 - RNA, 17 nt, Human
ccugcacggugggccuu

SEQ ID NO: 3521677 - RNA, 18 nt, Human
ccugcacggugggccuug

SEQ ID NO: 3521678 - RNA, 20 nt, Human
ccugcacggugggccuugcu

SEQ ID NO: 3521679 - RNA, 21 nt, Human
ccugcacggugggccuugcug

SEQ ID NO: 3521680 - RNA, 23 nt, Human
ccugcacggugggccuugcuggg

SEQ ID NO: 3521681 - RNA, 14 nt, Human
ccugcacuaaagcc

SEQ ID NO: 3521682 - RNA, 21 nt, Human
ccugcacuaaagccagccuga

SEQ ID NO: 3521683 - RNA, 15 nt, Human
ccugcacuguaaaau

SEQ ID NO: 3521684 - RNA, 16 nt, Human
ccugcacuguaaaaug

SEQ ID NO: 3521685 - RNA, 12 nt, Human
ccugcacugucc

SEQ ID NO: 3521686 - RNA, 16 nt, Human
ccugcacuguccugcu

SEQ ID NO: 3521687 - RNA, 19 nt, Human
ccugcacuguccugcucca

SEQ ID NO: 3521688 - RNA, 18 nt, Human
ccugcacuugcagacucu

SEQ ID NO: 3521689 - RNA, 22 nt, Human
ccugcacuugcagacucuacag

SEQ ID NO: 3521690 - RNA, 15 nt, Human
ccugcacuugggggc

SEQ ID NO: 3521691 - RNA, 16 nt, Human
ccugcacuugggggcu

SEQ ID NO: 3521692 - RNA, 14 nt, Human
ccugcagacccugc

SEQ ID NO: 3521693 - RNA, 18 nt, Human
ccugcagacccugcccuu

SEQ ID NO: 3521694 - RNA, 15 nt, Human
ccugcagacucacug

SEQ ID NO: 3521695 - RNA, 15 nt, Human
ccugcagagagaagc

SEQ ID NO: 3521696 - RNA, 16 nt, Human
ccugcagagagaagcc

SEQ ID NO: 3521697 - RNA, 12 nt, Human
ccugcagagaug

SEQ ID NO: 3521698 - RNA, 12 nt, Human
ccugcagagcug

SEQ ID NO: 3521699 - RNA, 17 nt, Human
ccugcagagcugcgggc

SEQ ID NO: 3521700 - RNA, 19 nt, Human
ccugcagaggggaaaccag

SEQ ID NO: 3521701 - RNA, 22 nt, Human
ccugcagaggucugugcugagg

SEQ ID NO: 3521702 - RNA, 15 nt, Human
ccugcagaugccacc

SEQ ID NO: 3521703 - RNA, 19 nt, Human
ccugcagcaaacacuccac

SEQ ID NO: 3521704 - RNA, 24 nt, Human
ccugcagcaaacacuccacccucc

SEQ ID NO: 3521705 - RNA, 15 nt, Human
ccugcagcacggaca

SEQ ID NO: 3521706 - RNA, 16 nt, Human
ccugcagcacggacaa

SEQ ID NO: 3521707 - RNA, 21 nt, Human
ccugcagcagagccuggaaga

SEQ ID NO: 3521708 - RNA, 18 nt, Human
ccugcagcauggucccug

SEQ ID NO: 3521709 - RNA, 19 nt, Human
ccugcagcauggucccugc

SEQ ID NO: 3521710 - RNA, 23 nt, Human
ccugcagcauggucccugccuua

SEQ ID NO: 3521711 - RNA, 23 nt, Human
ccugcagccucccuccgcggcgg

SEQ ID NO: 3521712 - RNA, 16 nt, Human
ccugcagccugcagga

SEQ ID NO: 3521713 - RNA, 16 nt, Human
ccugcagccuggaggc

SEQ ID NO: 3521714 - RNA, 20 nt, Human
ccugcagcuuguagccagcc

SEQ ID NO: 3521715 - RNA, 21 nt, Human
ccugcagcuuguagccagccg

SEQ ID NO: 3521716 - RNA, 13 nt, Human
ccugcaggaagga

SEQ ID NO: 3521717 - RNA, 17 nt, Human
ccugcaggaaggagcug

SEQ ID NO: 3521718 - RNA, 21 nt, Human
ccugcaggaaggagcugccug

SEQ ID NO: 3521719 - RNA, 18 nt, Human
ccugcaggaccucgugcc

SEQ ID NO: 3521720 - RNA, 16 nt, Human
ccugcaggaccugccu

SEQ ID NO: 3521721 - RNA, 14 nt, Human
ccugcaggcagcca

SEQ ID NO: 3521722 - RNA, 18 nt, Human
ccugcaggcagccaggcc

SEQ ID NO: 3521723 - RNA, 21 nt, Human
ccugcaggccaagagcagagg

SEQ ID NO: 3521724 - RNA, 17 nt, Human
ccugcagggccauggcu

SEQ ID NO: 3521725 - RNA, 19 nt, Human
ccugcaggguggugcuggg

SEQ ID NO: 3521726 - RNA, 15 nt, Human
ccugcaggugcugcu

SEQ ID NO: 3521727 - RNA, 20 nt, Human
ccugcaggugcugcugcgug

SEQ ID NO: 3521728 - RNA, 18 nt, Human
ccugcaguacuuuaccuc

SEQ ID NO: 3521729 - RNA, 20 nt, Human
ccugcaguacuuuaccuccu

SEQ ID NO: 3521730 - RNA, 16 nt, Human
ccugcagucuggcuga

SEQ ID NO: 3521731 - RNA, 21 nt, Human
ccugcagucuggcugagcccu

SEQ ID NO: 3521732 - RNA, 21 nt, Human
ccugcaguguucgcuuggcuc

SEQ ID NO: 3521733 - RNA, 13 nt, Human
ccugcaguucccc

SEQ ID NO: 3521734 - RNA, 22 nt, Human
ccugcauaauguuucuggauuu

SEQ ID NO: 3521735 - RNA, 22 nt, Human
ccugcauccauucuccugagga

SEQ ID NO: 3521736 - RNA, 19 nt, Human
ccugcauccguaguucccu

SEQ ID NO: 3521737 - RNA, 17 nt, Human
ccugcaucuaagcccau

SEQ ID NO: 3521738 - RNA, 19 nt, Human
ccugcaucugaccagcagc

SEQ ID NO: 3521739 - RNA, 15 nt, Human
ccugcaucuggggcc

SEQ ID NO: 3521740 - RNA, 14 nt, Human
ccugcaucuuuagu

SEQ ID NO: 3521741 - RNA, 18 nt, Human
ccugcauggcauccucca

SEQ ID NO: 3521742 - RNA, 20 nt, Human
ccugcauggcauccuccagc

SEQ ID NO: 3521743 - RNA, 22 nt, Human
ccugcauggcauccuccagccc

SEQ ID NO: 3521744 - RNA, 16 nt, Human
ccugcauggcugagcu

SEQ ID NO: 3521745 - RNA, 21 nt, Human
ccugcauggcugagcugccca

SEQ ID NO: 3521746 - RNA, 18 nt, Human
ccugcaugggccagcccc

SEQ ID NO: 3521747 - RNA, 21 nt, Human
ccugcauguaaacacgccugc

SEQ ID NO: 3521748 - RNA, 22 nt, Human
ccugcauuggaacuggaggcag

SEQ ID NO: 3521749 - RNA, 23 nt, Human
ccugcauuggaacuggaggcagg

SEQ ID NO: 3521750 - RNA, 14 nt, Human
ccugcauuguaaau

SEQ ID NO: 3521751 - RNA, 12 nt, Human
ccugcauuguua

SEQ ID NO: 3521752 - RNA, 14 nt, Human
ccugcauuucugag

SEQ ID NO: 3521753 - RNA, 18 nt, Human
ccugccacauuagaacuu

SEQ ID NO: 3521754 - RNA, 15 nt, Human
ccugccaccacgccc

SEQ ID NO: 3521755 - RNA, 18 nt, Human
ccugccaccaggccaccu

SEQ ID NO: 3521756 - RNA, 14 nt, Human
ccugccaccaguca

SEQ ID NO: 3521757 - RNA, 17 nt, Human
ccugccacccagcccca

SEQ ID NO: 3521758 - RNA, 24 nt, Human
ccugccacccugggccuggcagcu

SEQ ID NO: 3521759 - RNA, 16 nt, Human
ccugccacccugggga

SEQ ID NO: 3521760 - RNA, 14 nt, Human
ccugccacccugua

SEQ ID NO: 3521761 - RNA, 16 nt, Human
ccugccaccucccuga

SEQ ID NO: 3521762 - RNA, 17 nt, Human
ccugccaccuccugccu

SEQ ID NO: 3521763 - RNA, 15 nt, Human
ccugccaccuggacc

SEQ ID NO: 3521764 - RNA, 13 nt, Human
ccugccaccuggg

SEQ ID NO: 3521765 - RNA, 12 nt, Human
ccugccaccugu

SEQ ID NO: 3521766 - RNA, 13 nt, Human
ccugccaccuguc

SEQ ID NO: 3521767 - RNA, 14 nt, Human
ccugccaccugucu

SEQ ID NO: 3521768 - RNA, 16 nt, Human
ccugccaccugucugu

SEQ ID NO: 3521769 - RNA, 21 nt, Human
ccugccacucacacagccagg

SEQ ID NO: 3521770 - RNA, 13 nt, Human
ccugccacucacu

SEQ ID NO: 3521771 - RNA, 23 nt, Human
ccugccacucaggcccaaagccu

SEQ ID NO: 3521772 - RNA, 23 nt, Human
ccugccacuuugguacauggcca

SEQ ID NO: 3521773 - RNA, 14 nt, Human
ccugccagaccccc

SEQ ID NO: 3521774 - RNA, 14 nt, Human
ccugccagcacccc

SEQ ID NO: 3521775 - RNA, 14 nt, Human
ccugccagccccug

SEQ ID NO: 3521776 - RNA, 14 nt, Human
ccugccagccuggc

SEQ ID NO: 3521777 - RNA, 21 nt, Human
ccugccagccuggcuucugga

SEQ ID NO: 3521778 - RNA, 14 nt, Human
ccugccagcugcac

SEQ ID NO: 3521779 - RNA, 16 nt, Human
ccugccagcugcacug

SEQ ID NO: 3521780 - RNA, 18 nt, Human
ccugccagcugcacugau

SEQ ID NO: 3521781 - RNA, 19 nt, Human
ccugccaggaagccagcag

SEQ ID NO: 3521782 - RNA, 22 nt, Human
ccugccaggaagccagcaggcu

SEQ ID NO: 3521783 - RNA, 23 nt, Human
ccugccaggaagccagcaggcuc

SEQ ID NO: 3521784 - RNA, 13 nt, Human
ccugccaggagga

SEQ ID NO: 3521785 - RNA, 19 nt, Human
ccugccaggaggacccagg

SEQ ID NO: 3521786 - RNA, 22 nt, Human
ccugccaggaggacccagggcu

SEQ ID NO: 3521787 - RNA, 23 nt, Human
ccugccaggaggacccagggcuc

SEQ ID NO: 3521788 - RNA, 15 nt, Human
ccugccaggcacagg

SEQ ID NO: 3521789 - RNA, 16 nt, Human
ccugccaggcacaggc

SEQ ID NO: 3521790 - RNA, 18 nt, Human
ccugccaggcacaggcag

SEQ ID NO: 3521791 - RNA, 19 nt, Human
ccugccaggcacaggcagg

SEQ ID NO: 3521792 - RNA, 20 nt, Human
ccugccaggcacaggcaggg

SEQ ID NO: 3521793 - RNA, 21 nt, Human
ccugccaggcacaggcagggc

SEQ ID NO: 3521794 - RNA, 12 nt, Human
ccugccagggac

SEQ ID NO: 3521795 - RNA, 13 nt, Human
ccugccagggaca

SEQ ID NO: 3521796 - RNA, 16 nt, Human
ccugccagggacagag

SEQ ID NO: 3521797 - RNA, 22 nt, Human
ccugccagggacagagggggug

SEQ ID NO: 3521798 - RNA, 19 nt, Human
ccugccagggagacagagc

SEQ ID NO: 3521799 - RNA, 20 nt, Human
ccugccagggagacagagcu

SEQ ID NO: 3521800 - RNA, 17 nt, Human
ccugccagggcagggcc

SEQ ID NO: 3521801 - RNA, 19 nt, Human
ccugccagggcagggcccc

SEQ ID NO: 3521802 - RNA, 21 nt, Human
ccugccaguccuagcugcaca

SEQ ID NO: 3521803 - RNA, 14 nt, Human
ccugccagugccuu

SEQ ID NO: 3521804 - RNA, 13 nt, Human
ccugcccccaccc

SEQ ID NO: 3521805 - RNA, 19 nt, Human
ccugcccccaccccauucc

SEQ ID NO: 3521806 - RNA, 14 nt, Human
ccugcccccacuuc

SEQ ID NO: 3521807 - RNA, 14 nt, Human
ccugcccccagccc

SEQ ID NO: 3521808 - RNA, 18 nt, Human
ccugcccccaggacuggg

SEQ ID NO: 3521809 - RNA, 22 nt, Human
ccugcccccaggacugggccac

SEQ ID NO: 3521810 - RNA, 23 nt, Human
ccugcccccgcauccccugccuc

SEQ ID NO: 3521811 - RNA, 14 nt, Human
ccugcccccugcag

SEQ ID NO: 3521812 - RNA, 19 nt, Human
ccugcccccugcaggaagg

SEQ ID NO: 3521813 - RNA, 14 nt, Human
ccugcccccuggug

SEQ ID NO: 3521814 - RNA, 15 nt, Human
ccugcccccuggugg

SEQ ID NO: 3521815 - RNA, 22 nt, Human
ccugcccccuucucccacacug

SEQ ID NO: 3521816 - RNA, 13 nt, Human
ccugccccgcccc

SEQ ID NO: 3521817 - RNA, 15 nt, Human
ccugccccucccaga

SEQ ID NO: 3521818 - RNA, 20 nt, Human
ccugccccuccucucugccc

SEQ ID NO: 3521819 - RNA, 22 nt, Human
ccugccccuccucucugcccua

SEQ ID NO: 3521820 - RNA, 15 nt, Human
ccugccccucuuucu

SEQ ID NO: 3521821 - RNA, 19 nt, Human
ccugccccucuuucucuuu

SEQ ID NO: 3521822 - RNA, 23 nt, Human
ccugccccucuuucucuuucuuc

SEQ ID NO: 3521823 - RNA, 17 nt, Human
ccugccccugccccguc

SEQ ID NO: 3521824 - RNA, 21 nt, Human
ccugccccuucuacacucucc

SEQ ID NO: 3521825 - RNA, 13 nt, Human
ccugcccgcacag

SEQ ID NO: 3521826 - RNA, 20 nt, Human
ccugcccgcagaccucugga

SEQ ID NO: 3521827 - RNA, 17 nt, Human
ccugcccgucucucucc

SEQ ID NO: 3521828 - RNA, 18 nt, Human
ccugcccuaccugcccca

SEQ ID NO: 3521829 - RNA, 14 nt, Human
ccugcccuccccag

SEQ ID NO: 3521830 - RNA, 13 nt, Human
ccugcccucgugg

SEQ ID NO: 3521831 - RNA, 16 nt, Human
ccugcccucguggcca

SEQ ID NO: 3521832 - RNA, 17 nt, Human
ccugcccucguggccag

SEQ ID NO: 3521833 - RNA, 19 nt, Human
ccugcccucguggccagcc

SEQ ID NO: 3521834 - RNA, 20 nt, Human
ccugcccucguggccagccc

SEQ ID NO: 3521835 - RNA, 22 nt, Human
ccugcccucguggccagcccgg

SEQ ID NO: 3521836 - RNA, 14 nt, Human
ccugcccugccacc

SEQ ID NO: 3521837 - RNA, 15 nt, Human
ccugcccugcccugc

SEQ ID NO: 3521838 - RNA, 14 nt, Human
ccugcccugguuuc

SEQ ID NO: 3521839 - RNA, 20 nt, Human
ccugcccugguuuccugccc

SEQ ID NO: 3521840 - RNA, 21 nt, Human
ccugcccugguuuccugcccu

SEQ ID NO: 3521841 - RNA, 18 nt, Human
ccugcccugucaggaggc

SEQ ID NO: 3521842 - RNA, 11 nt, Human
ccugcccugug

SEQ ID NO: 3521843 - RNA, 14 nt, Human
ccugcccugugggc

SEQ ID NO: 3521844 - RNA, 13 nt, Human
ccugcccuuggca

SEQ ID NO: 3521845 - RNA, 16 nt, Human
ccugcccuugucccac

SEQ ID NO: 3521846 - RNA, 19 nt, Human
ccugcccuugucccacuca

SEQ ID NO: 3521847 - RNA, 21 nt, Human
ccugcccuuguuuggggcagg

SEQ ID NO: 3521848 - RNA, 22 nt, Human
ccugcccuuguuuggggcagga

SEQ ID NO: 3521849 - RNA, 19 nt, Human
ccugcccuuuguccuccug

SEQ ID NO: 3521850 - RNA, 21 nt, Human
ccugcccuuuguccuccugcu

SEQ ID NO: 3521851 - RNA, 20 nt, Human
ccugccgacacgcucccucc

SEQ ID NO: 3521852 - RNA, 21 nt, Human
ccugccgacacgcucccuccc

SEQ ID NO: 3521853 - RNA, 18 nt, Human
ccugccgaccucguccuc

SEQ ID NO: 3521854 - RNA, 17 nt, Human
ccugccgcagagcuggc

SEQ ID NO: 3521855 - RNA, 16 nt, Human
ccugccgggcugaggg

SEQ ID NO: 3521856 - RNA, 20 nt, Human
ccugccgggcugagggccug

SEQ ID NO: 3521857 - RNA, 21 nt, Human
ccugccgguaaacacgccugc

SEQ ID NO: 3521858 - RNA, 18 nt, Human
ccugccgucaccaccacc

SEQ ID NO: 3521859 - RNA, 22 nt, Human
ccugccgucaccaccaccccua

SEQ ID NO: 3521860 - RNA, 16 nt, Human
ccugccucagccuccc

SEQ ID NO: 3521861 - RNA, 12 nt, Human
ccugccucagga

SEQ ID NO: 3521862 - RNA, 16 nt, Human
ccugccuccacccucu

SEQ ID NO: 3521863 - RNA, 16 nt, Human
ccugccuccagggcug

SEQ ID NO: 3521864 - RNA, 21 nt, Human
ccugccuccagggcuggacug

SEQ ID NO: 3521865 - RNA, 17 nt, Human
ccugccuccauccuagu

SEQ ID NO: 3521866 - RNA, 16 nt, Human
ccugccucccuucaug

SEQ ID NO: 3521867 - RNA, 17 nt, Human
ccugccucccuugacuu

SEQ ID NO: 3521868 - RNA, 11 nt, Human
ccugccuccug

SEQ ID NO: 3521869 - RNA, 12 nt, Human
ccugccuccugc

SEQ ID NO: 3521870 - RNA, 23 nt, Human
ccugccuccugccggcuccuugg

SEQ ID NO: 3521871 - RNA, 15 nt, Human
ccugccuccuuugug

SEQ ID NO: 3521872 - RNA, 20 nt, Human
ccugccuccuuugugaggaa

SEQ ID NO: 3521873 - RNA, 21 nt, Human
ccugccuccuuugugaggaag

SEQ ID NO: 3521874 - RNA, 21 nt, Human
ccugccucuacugggaaggcu

SEQ ID NO: 3521875 - RNA, 18 nt, Human
ccugccucucccaggcag

SEQ ID NO: 3521876 - RNA, 16 nt, Human
ccugccucuccgcccc

SEQ ID NO: 3521877 - RNA, 18 nt, Human
ccugccucuccgccccug

SEQ ID NO: 3521878 - RNA, 23 nt, Human
ccugccucuccgccccugagccc

SEQ ID NO: 3521879 - RNA, 15 nt, Human
ccugccucucugcag

SEQ ID NO: 3521880 - RNA, 17 nt, Human
ccugccucucugcaggu

SEQ ID NO: 3521881 - RNA, 21 nt, Human
ccugccucucugcaggucccu

SEQ ID NO: 3521882 - RNA, 13 nt, Human
ccugccucugccc

SEQ ID NO: 3521883 - RNA, 14 nt, Human
ccugccucuguuug

SEQ ID NO: 3521884 - RNA, 15 nt, Human
ccugccucuucucua

SEQ ID NO: 3521885 - RNA, 14 nt, Human
ccugccugagggcc

SEQ ID NO: 3521886 - RNA, 21 nt, Human
ccugccugagggccccucugc

SEQ ID NO: 3521887 - RNA, 11 nt, Human
ccugccuggag

SEQ ID NO: 3521888 - RNA, 20 nt, Human
ccuggggcuccuuucuccag

SEQ ID NO: 3521889 - RNA, 14 nt, Human
ccuggggcugcugg

SEQ ID NO: 3521890 - RNA, 16 nt, Human
ccuggggcuggccucc

SEQ ID NO: 3521891 - RNA, 13 nt, Human
ccuggggcugggc

SEQ ID NO: 3521892 - RNA, 17 nt, Human
ccuggggcuucuccuga

SEQ ID NO: 3521893 - RNA, 21 nt, Human
ccuggggcuucuccugaccca

SEQ ID NO: 3521894 - RNA, 18 nt, Human
ccugggggaguuuuccuc

SEQ ID NO: 3521895 - RNA, 19 nt, Human
ccugggggaguuuuccucu

SEQ ID NO: 3521896 - RNA, 11 nt, Human
ccugggggccu

SEQ ID NO: 3521897 - RNA, 12 nt, Human
ccugggggccug

SEQ ID NO: 3521898 - RNA, 22 nt, Human
ccugggggccugaccucccccu

SEQ ID NO: 3521899 - RNA, 13 nt, Human
ccugggggccugg

SEQ ID NO: 3521900 - RNA, 14 nt, Human
ccugggggccuggc

SEQ ID NO: 3521901 - RNA, 23 nt, Human
ccugggggccuggcuggcugagg

SEQ ID NO: 3521902 - RNA, 17 nt, Human
ccugggggccuggguug

SEQ ID NO: 3521903 - RNA, 14 nt, Human
ccugggggcucuca

SEQ ID NO: 3521904 - RNA, 21 nt, Human
ccugggggcugggcagaggaa

SEQ ID NO: 3521905 - RNA, 14 nt, Human
ccugggggugccag

SEQ ID NO: 3521906 - RNA, 16 nt, Human
ccugggggugccagga

SEQ ID NO: 3521907 - RNA, 12 nt, Human
ccuggggguggg

SEQ ID NO: 3521908 - RNA, 21 nt, Human
ccuggggguucuuucuuccuc

SEQ ID NO: 3521909 - RNA, 23 nt, Human
ccuggggguucuuucuuccucug

SEQ ID NO: 3521910 - RNA, 21 nt, Human
ccugggguauaaaacuuuccu

SEQ ID NO: 3521911 - RNA, 20 nt, Human
ccuggggucaggccgggcag

SEQ ID NO: 3521912 - RNA, 22 nt, Human
ccuggggucaggccgggcagag

SEQ ID NO: 3521913 - RNA, 14 nt, Human
ccuggggugcaggc

SEQ ID NO: 3521914 - RNA, 15 nt, Human
ccuggggugggguca

SEQ ID NO: 3521915 - RNA, 21 nt, Human
ccugggguguuaguggcaccg

SEQ ID NO: 3521916 - RNA, 14 nt, Human
ccugggucagucug

SEQ ID NO: 3521917 - RNA, 17 nt, Human
ccuggguccaaauaaaa

SEQ ID NO: 3521918 - RNA, 14 nt, Human
ccuggguccuuuuc

SEQ ID NO: 3521919 - RNA, 17 nt, Human
ccugggucugugucucu

SEQ ID NO: 3521920 - RNA, 13 nt, Human
ccugggugacauu

SEQ ID NO: 3521921 - RNA, 21 nt, Human
ccuggguggcuacucugugcc

SEQ ID NO: 3521922 - RNA, 19 nt, Human
ccuggguggggcugcuccu

SEQ ID NO: 3521923 - RNA, 13 nt, Human
ccugggugggugg

SEQ ID NO: 3521924 - RNA, 20 nt, Human
ccugggugggugguggggag

SEQ ID NO: 3521925 - RNA, 22 nt, Human
ccugggugggugguggggaggg

SEQ ID NO: 3521926 - RNA, 18 nt, Human
ccuggguuccaauccugg

SEQ ID NO: 3521927 - RNA, 13 nt, Human
ccuggguucccuu

SEQ ID NO: 3521928 - RNA, 20 nt, Human
ccuggguuuuguauucucug

SEQ ID NO: 3521929 - RNA, 17 nt, Human
ccuggguuuuguucccu

SEQ ID NO: 3521930 - RNA, 19 nt, Human
ccugguaagaaaaagcaaa

SEQ ID NO: 3521931 - RNA, 15 nt, Human
ccugguacccuccug

SEQ ID NO: 3521932 - RNA, 15 nt, Human
ccugguacucaagcc

SEQ ID NO: 3521933 - RNA, 17 nt, Human
ccugguagaauagauau

SEQ ID NO: 3521934 - RNA, 15 nt, Human
ccugguauggcugca

SEQ ID NO: 3521935 - RNA, 21 nt, Human
ccugguauggguuucucccag

SEQ ID NO: 3521936 - RNA, 23 nt, Human
ccuggucacaggacucugccucc

SEQ ID NO: 3521937 - RNA, 20 nt, Human
ccuggucacagggcaugccc

SEQ ID NO: 3521938 - RNA, 21 nt, Human
ccuggucaccuaggaagccuc

SEQ ID NO: 3521939 - RNA, 14 nt, Human
ccuggucagcccaa

SEQ ID NO: 3521940 - RNA, 17 nt, Human
ccugguccacagggcac

SEQ ID NO: 3521941 - RNA, 19 nt, Human
ccugguccaugcagggggc

SEQ ID NO: 3521942 - RNA, 15 nt, Human
ccugguccccuccuu

SEQ ID NO: 3521943 - RNA, 19 nt, Human
ccugguccuaggcuggaag

SEQ ID NO: 3521944 - RNA, 24 nt, Human
ccugguccuaggcuggaaggagga

SEQ ID NO: 3521945 - RNA, 16 nt, Human
ccuggucgccuuccac

SEQ ID NO: 3521946 - RNA, 16 nt, Human
ccuggucuccugcccc

SEQ ID NO: 3521947 - RNA, 14 nt, Human
ccuggucucugguc

SEQ ID NO: 3521948 - RNA, 22 nt, Human
ccuggucugguugggcagccag

SEQ ID NO: 3521949 - RNA, 19 nt, Human
ccugucagugcagcccgug

SEQ ID NO: 3521950 - RNA, 12 nt, Human
ccugucagugcc

SEQ ID NO: 3521951 - RNA, 13 nt, Human
ccugucagugccg

SEQ ID NO: 3521952 - RNA, 14 nt, Human
ccugucagugccgc

SEQ ID NO: 3521953 - RNA, 14 nt, Human
ccugucaugccccc

SEQ ID NO: 3521954 - RNA, 15 nt, Human
ccugucaugcccccc

SEQ ID NO: 3521955 - RNA, 16 nt, Human
ccugucaugccccccu

SEQ ID NO: 3521956 - RNA, 17 nt, Human
ccuguccaaacugccua

SEQ ID NO: 3521957 - RNA, 19 nt, Human
ccuguccaaacugccuaag

SEQ ID NO: 3521958 - RNA, 16 nt, Human
ccuguccaaucuuuga

SEQ ID NO: 3521959 - RNA, 18 nt, Human
ccuguccacacccagcuc

SEQ ID NO: 3521960 - RNA, 19 nt, Human
ccuguccacacccagcuca

SEQ ID NO: 3521961 - RNA, 21 nt, Human
ccuguccacacccagcucagc

SEQ ID NO: 3521962 - RNA, 22 nt, Human
ccuguccacccccgccucccuc

SEQ ID NO: 3521963 - RNA, 14 nt, Human
ccuguccagccugg

SEQ ID NO: 3521964 - RNA, 16 nt, Human
ccuguccagccugggc

SEQ ID NO: 3521965 - RNA, 18 nt, Human
ccuguccaucagccagga

SEQ ID NO: 3521966 - RNA, 15 nt, Human
ccugucccaccccca

SEQ ID NO: 3521967 - RNA, 17 nt, Human
ccugucccacccccacc

SEQ ID NO: 3521968 - RNA, 19 nt, Human
ccuguccccacccuccacu

SEQ ID NO: 3521969 - RNA, 16 nt, Human
ccuguccccaucuguc

SEQ ID NO: 3521970 - RNA, 21 nt, Human
ccuguccccaucugucggccu

SEQ ID NO: 3521971 - RNA, 15 nt, Human
ccugucccccugaca

SEQ ID NO: 3521972 - RNA, 22 nt, Human
ccugucccccugagaucagagu

SEQ ID NO: 3521973 - RNA, 18 nt, Human
ccuguccccucagcucca

SEQ ID NO: 3521974 - RNA, 21 nt, Human
ccuguccccucagcuccagac

SEQ ID NO: 3521975 - RNA, 19 nt, Human
ccugucccucccaccucug

SEQ ID NO: 3521976 - RNA, 21 nt, Human
ccugucccucccaccucugug

SEQ ID NO: 3521977 - RNA, 22 nt, Human
ccugucccucucaggcaugccu

SEQ ID NO: 3521978 - RNA, 23 nt, Human
ccugucccugcgccuuuccuuuu

SEQ ID NO: 3521979 - RNA, 17 nt, Human
ccugucccuggccaucu

SEQ ID NO: 3521980 - RNA, 19 nt, Human
ccuguccgcccucuucccc

SEQ ID NO: 3521981 - RNA, 17 nt, Human
ccuguccuaaggaaccu

SEQ ID NO: 3521982 - RNA, 14 nt, Human
ccuguccucacugc

SEQ ID NO: 3521983 - RNA, 13 nt, Human
ccuguccuccaac

SEQ ID NO: 3521984 - RNA, 22 nt, Human
ccuguccuccugguggguccag

SEQ ID NO: 3521985 - RNA, 21 nt, Human
ccuguccucuuucagcuccug

SEQ ID NO: 3521986 - RNA, 13 nt, Human
ccuguccugaugg

SEQ ID NO: 3521987 - RNA, 11 nt, Human
ccuguccugcc

SEQ ID NO: 3521988 - RNA, 18 nt, Human
ccuguccugccaugcaag

SEQ ID NO: 3521989 - RNA, 18 nt, Human
ccuguccugggcuggugg

SEQ ID NO: 3521990 - RNA, 21 nt, Human
ccuguccuucucucaccuccu

SEQ ID NO: 3521991 - RNA, 12 nt, Human
ccuguccuugca

SEQ ID NO: 3521992 - RNA, 15 nt, Human
ccugucgagacacuu

SEQ ID NO: 3521993 - RNA, 23 nt, Human
ccugucgaguucggcucugggug

SEQ ID NO: 3521994 - RNA, 17 nt, Human
ccugucggccugguguu

SEQ ID NO: 3521995 - RNA, 15 nt, Human
ccugucuaaugaaac

SEQ ID NO: 3521996 - RNA, 16 nt, Human
ccugucuagagaggga

SEQ ID NO: 3521997 - RNA, 18 nt, Human
ccugucuagucucuccug

SEQ ID NO: 3521998 - RNA, 23 nt, Human
ccugucuagucucuccuguaagc

SEQ ID NO: 3521999 - RNA, 14 nt, Human
ccugucucagccuc

SEQ ID NO: 3522000 - RNA, 15 nt, Human
ccugucucagccucc

SEQ ID NO: 3522001 - RNA, 18 nt, Human
ccugucucauccccaggg

SEQ ID NO: 3522002 - RNA, 15 nt, Human
ccugucuccacugug

SEQ ID NO: 3522003 - RNA, 16 nt, Human
ccugucuccacugugc

SEQ ID NO: 3522004 - RNA, 19 nt, Human
ccugucuccccucugcugg

SEQ ID NO: 3522005 - RNA, 20 nt, Human
ccugucuccccucugcuggc

SEQ ID NO: 3522006 - RNA, 13 nt, Human
ccugucuccuggc

SEQ ID NO: 3522007 - RNA, 16 nt, Human
ccugucuccuggcggu

SEQ ID NO: 3522008 - RNA, 23 nt, Human
ccugucuccuuucaccccagggc

SEQ ID NO: 3522009 - RNA, 20 nt, Human
ccugucucucagggccaggc

SEQ ID NO: 3522010 - RNA, 21 nt, Human
ccugucucucagggccaggcc

SEQ ID NO: 3522011 - RNA, 13 nt, Human
ccugucucugccc

SEQ ID NO: 3522012 - RNA, 13 nt, Human
ccugucucuucca

SEQ ID NO: 3522013 - RNA, 21 nt, Human
ccugucugaaggacacuuccu

SEQ ID NO: 3522014 - RNA, 19 nt, Human
ccugucugaauguaccugu

SEQ ID NO: 3522015 - RNA, 14 nt, Human
ccugucugccagcc

SEQ ID NO: 3522016 - RNA, 16 nt, Human
ccugucugccagccag

SEQ ID NO: 3522017 - RNA, 20 nt, Human
ccugucugccagccagcagc

SEQ ID NO: 3522018 - RNA, 13 nt, Human
ccugucugcucca

SEQ ID NO: 3522019 - RNA, 15 nt, Human
ccugucugcuccagc

SEQ ID NO: 3522020 - RNA, 21 nt, Human
ccugucuguagagggcccugg

SEQ ID NO: 3522021 - RNA, 23 nt, Human
ccugucuguagagggcccuggug

SEQ ID NO: 3522022 - RNA, 17 nt, Human
ccugucugucucuccau

SEQ ID NO: 3522023 - RNA, 18 nt, Human
ccugucugucucuccauc

SEQ ID NO: 3522024 - RNA, 21 nt, Human
ccugucugucucuccaucugu

SEQ ID NO: 3522025 - RNA, 20 nt, Human
ccugucugucugucuguccc

SEQ ID NO: 3522026 - RNA, 11 nt, Human
ccugucuguga

SEQ ID NO: 3522027 - RNA, 14 nt, Human
ccugucuucugcuu

SEQ ID NO: 3522028 - RNA, 16 nt, Human
ccugucuucugcuuug

SEQ ID NO: 3522029 - RNA, 21 nt, Human
ccugucuucugcuuuguugug

SEQ ID NO: 3522030 - RNA, 17 nt, Human
ccugucuuuaaggaaaa

SEQ ID NO: 3522031 - RNA, 22 nt, Human
ccugugaaagacucaaugagcu

SEQ ID NO: 3522032 - RNA, 14 nt, Human
ccugugaacccagg

SEQ ID NO: 3522033 - RNA, 16 nt, Human
ccugugaacccaggac

SEQ ID NO: 3522034 - RNA, 17 nt, Human
ccugugaacccaggaca

SEQ ID NO: 3522035 - RNA, 17 nt, Human
ccugugaacugaacucu

SEQ ID NO: 3522036 - RNA, 18 nt, Human
ccugugaaguaaggaugu

SEQ ID NO: 3522037 - RNA, 17 nt, Human
ccugugaaugccacugc

SEQ ID NO: 3522038 - RNA, 22 nt, Human
ccugugaaugccacugccuucg

SEQ ID NO: 3522039 - RNA, 19 nt, Human
ccugugacauggugccuga

SEQ ID NO: 3522040 - RNA, 21 nt, Human
ccugugacauggugccugaga

SEQ ID NO: 3522041 - RNA, 18 nt, Human
ccugugaccacaacauga

SEQ ID NO: 3522042 - RNA, 14 nt, Human
ccugugagaugugu

SEQ ID NO: 3522043 - RNA, 22 nt, Human
ccugugagcuaggaauuguguu

SEQ ID NO: 3522044 - RNA, 16 nt, Human
ccugugagcugcacca

SEQ ID NO: 3522045 - RNA, 21 nt, Human
ccugugaggagccccaucugu

SEQ ID NO: 3522046 - RNA, 14 nt, Human
ccugugaggcaggg

SEQ ID NO: 3522047 - RNA, 23 nt, Human
ccugugaggugcagagugcccag

SEQ ID NO: 3522048 - RNA, 17 nt, Human
ccugugagguuucccaa

SEQ ID NO: 3522049 - RNA, 17 nt, Human
ccugugaucuuauuuuu

SEQ ID NO: 3522050 - RNA, 17 nt, Human
ccugugcaaaaaaauua

SEQ ID NO: 3522051 - RNA, 22 nt, Human
ccugugcacacacacacacaug

SEQ ID NO: 3522052 - RNA, 19 nt, Human
ccugugccacccaccaggg

SEQ ID NO: 3522053 - RNA, 24 nt, Human
ccugcugggcucuccaccucagcc

SEQ ID NO: 3522054 - RNA, 12 nt, Human
ccugcugggugu

SEQ ID NO: 3522055 - RNA, 20 nt, Human
ccugcuggguguggcgcagc

SEQ ID NO: 3522056 - RNA, 12 nt, Human
ccugcugucccc

SEQ ID NO: 3522057 - RNA, 14 nt, Human
ccugcuguguuccc

SEQ ID NO: 3522058 - RNA, 21 nt, Human
ccugcuucagauguggagcca

SEQ ID NO: 3522059 - RNA, 23 nt, Human
ccugcuucagauguggagccagg

SEQ ID NO: 3522060 - RNA, 17 nt, Human
ccugcuucagccuccca

SEQ ID NO: 3522061 - RNA, 23 nt, Human
ccugcuucagccucccacagugc

SEQ ID NO: 3522062 - RNA, 21 nt, Human
ccugcuuccaccucaccccac

SEQ ID NO: 3522063 - RNA, 15 nt, Human
ccugcuuccauggcc

SEQ ID NO: 3522064 - RNA, 12 nt, Human
ccugcuucccac

SEQ ID NO: 3522065 - RNA, 14 nt, Human
ccugcuucccaccu

SEQ ID NO: 3522066 - RNA, 20 nt, Human
ccugcuucccaccucccugc

SEQ ID NO: 3522067 - RNA, 15 nt, Human
ccugcuuccucagag

SEQ ID NO: 3522068 - RNA, 15 nt, Human
ccugcuuccugcuug

SEQ ID NO: 3522069 - RNA, 22 nt, Human
ccugcuuccugucuuugggaga

SEQ ID NO: 3522070 - RNA, 15 nt, Human
ccugcuucuccagcc

SEQ ID NO: 3522071 - RNA, 17 nt, Human
ccugcuucucugcccag

SEQ ID NO: 3522072 - RNA, 13 nt, Human
ccugcuuggccca

SEQ ID NO: 3522073 - RNA, 15 nt, Human
ccugcuuggcccagg

SEQ ID NO: 3522074 - RNA, 22 nt, Human
ccugcuuggguggagaagccau

SEQ ID NO: 3522075 - RNA, 20 nt, Human
ccugcuuugaauaaaugugu

SEQ ID NO: 3522076 - RNA, 19 nt, Human
ccugcuuugcgugcccggg

SEQ ID NO: 3522077 - RNA, 20 nt, Human
ccugcuuugggcugcccugg

SEQ ID NO: 3522078 - RNA, 22 nt, Human
ccugcuuugggcugcccuggug

SEQ ID NO: 3522079 - RNA, 22 nt, Human
ccugcuuugucuccucuauccu

SEQ ID NO: 3522080 - RNA, 13 nt, Human
ccugcuuuucaau

SEQ ID NO: 3522081 - RNA, 21 nt, Human
ccugcuuuucacugcugcaag

SEQ ID NO: 3522082 - RNA, 22 nt, Human
ccugcuuuuugaaaugaaauuu

SEQ ID NO: 3522083 - RNA, 15 nt, Human
ccuggaaaccugucu

SEQ ID NO: 3522084 - RNA, 14 nt, Human
ccuggaaaccuucc

SEQ ID NO: 3522085 - RNA, 17 nt, Human
ccuggaaaccuuccacc

SEQ ID NO: 3522086 - RNA, 18 nt, Human
ccuggaaaccuuccaccc

SEQ ID NO: 3522087 - RNA, 20 nt, Human
ccuggaaaccuuccacccag

SEQ ID NO: 3522088 - RNA, 20 nt, Human
ccuggaaaggcucagucuca

SEQ ID NO: 3522089 - RNA, 20 nt, Human
ccuggaacaauauuuuaugg

SEQ ID NO: 3522090 - RNA, 15 nt, Human
ccuggaaccuugcug

SEQ ID NO: 3522091 - RNA, 18 nt, Human
ccuggaacugucucucau

SEQ ID NO: 3522092 - RNA, 16 nt, Human
ccuggaagaacaggcc

SEQ ID NO: 3522093 - RNA, 21 nt, Human
cauguuuacuuuucagggcau

SEQ ID NO: 3522094 - RNA, 12 nt, Human
cauguuuauaaa

SEQ ID NO: 3522095 - RNA, 21 nt, Human
cauguuuauaacuauucaguu

SEQ ID NO: 3522096 - RNA, 15 nt, Human
cauguuuaugaaaau

SEQ ID NO: 3522097 - RNA, 16 nt, Human
cauguuuaugaaaaua

SEQ ID NO: 3522098 - RNA, 19 nt, Human
cauguuuaugaaaauaaau

SEQ ID NO: 3522099 - RNA, 23 nt, Human
cauguuuaugaaaauaaauagcu

SEQ ID NO: 3522100 - RNA, 20 nt, Human
cauguuuauuacaguauaau

SEQ ID NO: 3522101 - RNA, 23 nt, Human
cauguuuauuacaguauaauuaa

SEQ ID NO: 3522102 - RNA, 22 nt, Human
cauguuucauguuuugugacua

SEQ ID NO: 3522103 - RNA, 13 nt, Human
cauguuuccagca

SEQ ID NO: 3522104 - RNA, 20 nt, Human
cauguuuccagcauucccag

SEQ ID NO: 3522105 - RNA, 13 nt, Human
cauguuuccucua

SEQ ID NO: 3522106 - RNA, 13 nt, Human
cauguuucuucau

SEQ ID NO: 3522107 - RNA, 21 nt, Human
ccuucuggauucuuggcccgc

SEQ ID NO: 3522108 - RNA, 10 nt, Human
ccuucuggcc

SEQ ID NO: 3522109 - RNA, 18 nt, Human
ccuucuggccucccacag

SEQ ID NO: 3522110 - RNA, 13 nt, Human
ccuucuggccuuu

SEQ ID NO: 3522111 - RNA, 20 nt, Human
ccuucugggcagaccuugac

SEQ ID NO: 3522112 - RNA, 19 nt, Human
ccuucugggcaucuguucu

SEQ ID NO: 3522113 - RNA, 22 nt, Human
ccuucugggcaucuguucuggu

SEQ ID NO: 3522114 - RNA, 22 nt, Human
ccuucuguccuacucuguguca

SEQ ID NO: 3522115 - RNA, 17 nt, Human
ccuucuguccugguguc

SEQ ID NO: 3522116 - RNA, 15 nt, Human
ccuucugugaaagua

SEQ ID NO: 3522117 - RNA, 14 nt, Human
ccuucugugcccag

SEQ ID NO: 3522118 - RNA, 15 nt, Human
ccuucugugcccagc

SEQ ID NO: 3522119 - RNA, 17 nt, Human
ccuucugugcccagcuc

SEQ ID NO: 3522120 - RNA, 14 nt, Human
ccuucuguggcuca

SEQ ID NO: 3522121 - RNA, 20 nt, Human
ccuucuguggggacuccggc

SEQ ID NO: 3522122 - RNA, 17 nt, Human
ccuucuuauuauauaua

SEQ ID NO: 3522123 - RNA, 18 nt, Human
ccuucuuauucucacucc

SEQ ID NO: 3522124 - RNA, 15 nt, Human
ccuucuucacccagc

SEQ ID NO: 3522125 - RNA, 18 nt, Human
ccuucuucaggcugccua

SEQ ID NO: 3522126 - RNA, 16 nt, Human
ccuucuucagggccug

SEQ ID NO: 3522127 - RNA, 15 nt, Human
ccuucuucauguuca

SEQ ID NO: 3522128 - RNA, 14 nt, Human
ccuucuuccauccc

SEQ ID NO: 3522129 - RNA, 16 nt, Human
ccuucuuccaucccag

SEQ ID NO: 3522130 - RNA, 19 nt, Human
ccuucuuccaucccaggac

SEQ ID NO: 3522131 - RNA, 23 nt, Human
ccuucuucccaauagcaaggcug

SEQ ID NO: 3522132 - RNA, 23 nt, Human
ccuucuuucacucugucaucuuu

SEQ ID NO: 3522133 - RNA, 20 nt, Human
ccuucuuucuagagagggaa

SEQ ID NO: 3522134 - RNA, 18 nt, Human
ccuucuuugauaauguua

SEQ ID NO: 3522135 - RNA, 21 nt, Human
ccuucuuugauaauguuaaau

SEQ ID NO: 3522136 - RNA, 19 nt, Human
ccuucuuugggauagagaa

SEQ ID NO: 3522137 - RNA, 14 nt, Human
ccuucuuuuaugag

SEQ ID NO: 3522138 - RNA, 23 nt, Human
ccuucuuuuucuggacucuggac

SEQ ID NO: 3522139 - RNA, 17 nt, Human
ccuugaaaaaaaacagu

SEQ ID NO: 3522140 - RNA, 22 nt, Human
ccuugaaaacacuguucucugc

SEQ ID NO: 3522141 - RNA, 19 nt, Human
ccuugaaacuuugggaaaa

SEQ ID NO: 3522142 - RNA, 20 nt, Human
ccuugaacacugggggaggg

SEQ ID NO: 3522143 - RNA, 18 nt, Human
ccuugaaccacuucccuc

SEQ ID NO: 3522144 - RNA, 16 nt, Human
ccuugaaccugugagu

SEQ ID NO: 3522145 - RNA, 17 nt, Human
ccuugaaccugugagua

SEQ ID NO: 3522146 - RNA, 21 nt, Human
ccuugaaccugugaguaaaua

SEQ ID NO: 3522147 - RNA, 13 nt, Human
ccuugaacuagga

SEQ ID NO: 3522148 - RNA, 19 nt, Human
ccuugaacuuugaccucug

SEQ ID NO: 3522149 - RNA, 22 nt, Human
ccuugaagaacugcaggcccug

SEQ ID NO: 3522150 - RNA, 13 nt, Human
ccuugaagauauc

SEQ ID NO: 3522151 - RNA, 13 nt, Human
ccuugaaggacua

SEQ ID NO: 3522152 - RNA, 21 nt, Human
ccuugaauauccccucccagu

SEQ ID NO: 3522153 - RNA, 18 nt, Human
ccuugaaugcugccagug

SEQ ID NO: 3522154 - RNA, 14 nt, Human
ccuugacaaacuuc

SEQ ID NO: 3522155 - RNA, 23 nt, Human
ccuugacaaagucaagccacaug

SEQ ID NO: 3522156 - RNA, 14 nt, Human
ccuugacaccugcu

SEQ ID NO: 3522157 - RNA, 14 nt, Human
ccuugacagggcac

SEQ ID NO: 3522158 - RNA, 23 nt, Human
ccuugacauuguagagcuucugg

SEQ ID NO: 3522159 - RNA, 20 nt, Human
ccuugaccauucuccaccug

SEQ ID NO: 3522160 - RNA, 21 nt, Human
ccuugaccauucuccaccugc

SEQ ID NO: 3522161 - RNA, 19 nt, Human
ccuugaccugcauuguaaa

SEQ ID NO: 3522162 - RNA, 20 nt, Human
ccuugaccugcauuguaaau

SEQ ID NO: 3522163 - RNA, 22 nt, Human
ccuugaccuuccucuggggcuc

SEQ ID NO: 3522164 - RNA, 16 nt, Human
ccuugacuguugaugu

SEQ ID NO: 3522165 - RNA, 16 nt, Human
ccuugacuuagauucu

SEQ ID NO: 3522166 - RNA, 13 nt, Human
ccuugacuuugcu

SEQ ID NO: 3522167 - RNA, 16 nt, Human
ccuugagaccacaggg

SEQ ID NO: 3522168 - RNA, 17 nt, Human
ccuugagaccucagcca

SEQ ID NO: 3522169 - RNA, 21 nt, Human
ccuugaggaaacaacagcuuu

SEQ ID NO: 3522170 - RNA, 21 nt, Human
ccuugaggggagccaggaggg

SEQ ID NO: 3522171 - RNA, 20 nt, Human
ccuugaguaguuuuuaucug

SEQ ID NO: 3522172 - RNA, 23 nt, Human
ccuugaguugauucagcucugca

SEQ ID NO: 3522173 - RNA, 23 nt, Human
ccuugauuguucgggugugcaau

SEQ ID NO: 3522174 - RNA, 20 nt, Human
ccuugauuuuagccuucucu

SEQ ID NO: 3522175 - RNA, 22 nt, Human
ccuugauuuuagccuucucugu

SEQ ID NO: 3522176 - RNA, 22 nt, Human
ccuugcaacacacagacacacg

SEQ ID NO: 3522177 - RNA, 12 nt, Human
ccuugcaccugc

SEQ ID NO: 3522178 - RNA, 14 nt, Human
ccuugcaccugcau

SEQ ID NO: 3522179 - RNA, 13 nt, Human
ccuugcacuuuca

SEQ ID NO: 3522180 - RNA, 13 nt, Human
ccuugcagaacug

SEQ ID NO: 3522181 - RNA, 16 nt, Human
ccuugcagaacugcca

SEQ ID NO: 3522182 - RNA, 21 nt, Human
ccuugcagcacucacacagga

SEQ ID NO: 3522183 - RNA, 19 nt, Human
ccuugcaguucagcaccac

SEQ ID NO: 3522184 - RNA, 14 nt, Human
ccuugcauaauggu

SEQ ID NO: 3522185 - RNA, 15 nt, Human
ccuugcauacaaaca

SEQ ID NO: 3522186 - RNA, 13 nt, Human
ccuugccacacuc

SEQ ID NO: 3522187 - RNA, 12 nt, Human
ccuugccagaga

SEQ ID NO: 3522188 - RNA, 13 nt, Human
ccuugccagagau

SEQ ID NO: 3522189 - RNA, 16 nt, Human
ccuugccagagaucca

SEQ ID NO: 3522190 - RNA, 13 nt, Human
ccuugccagcugc

SEQ ID NO: 3522191 - RNA, 14 nt, Human
ccuugccagcugcu

SEQ ID NO: 3522192 - RNA, 22 nt, Human
ccuugccagcugcugagccgca

SEQ ID NO: 3522193 - RNA, 12 nt, Human
ccuugccagucu

SEQ ID NO: 3522194 - RNA, 20 nt, Human
ccuugcccacuccugcucug

SEQ ID NO: 3522195 - RNA, 13 nt, Human
ccuugcccagaga

SEQ ID NO: 3522196 - RNA, 19 nt, Human
ccuugcccagagaugccuc

SEQ ID NO: 3522197 - RNA, 21 nt, Human
ccuugcccagagaugccucca

SEQ ID NO: 3522198 - RNA, 17 nt, Human
ccuugcccagccuggau

SEQ ID NO: 3522199 - RNA, 18 nt, Human
ccuugcccagggcucagc

SEQ ID NO: 3522200 - RNA, 20 nt, Human
ccuugcccagggcucagccu

SEQ ID NO: 3522201 - RNA, 20 nt, Human
ccuugccccaacccuucuuc

SEQ ID NO: 3522202 - RNA, 13 nt, Human
ccuugcccugacc

SEQ ID NO: 3522203 - RNA, 14 nt, Human
ccuugcccugaccu

SEQ ID NO: 3522204 - RNA, 15 nt, Human
ccuugcccugaccuc

SEQ ID NO: 3522205 - RNA, 19 nt, Human
ccuugcccugaccucccag

SEQ ID NO: 3522206 - RNA, 23 nt, Human
ccuugcccugaccucccagcccu

SEQ ID NO: 3522207 - RNA, 17 nt, Human
ccuugcccuugcccuga

SEQ ID NO: 3522208 - RNA, 20 nt, Human
ccuugccgucuaccugaggg

SEQ ID NO: 3522209 - RNA, 22 nt, Human
ccuugccuaaauuuaaugcugc

SEQ ID NO: 3522210 - RNA, 20 nt, Human
ccuugccucaaugccaguaa

SEQ ID NO: 3522211 - RNA, 17 nt, Human
ccuugccuccccauuuc

SEQ ID NO: 3522212 - RNA, 23 nt, Human
ccuugccuccccauuucccaucu

SEQ ID NO: 3522213 - RNA, 15 nt, Human
ccuugccugguacag

SEQ ID NO: 3522214 - RNA, 18 nt, Human
ccuugcggcuccucaggg

SEQ ID NO: 3522215 - RNA, 21 nt, Human
ccuugcggggauaaagagaga

SEQ ID NO: 3522216 - RNA, 12 nt, Human
ccuugcuaccuc

SEQ ID NO: 3522217 - RNA, 23 nt, Human
ccuugcucaaccauggcugaagg

SEQ ID NO: 3522218 - RNA, 18 nt, Human
ccuugcucucccucuucu

SEQ ID NO: 3522219 - RNA, 22 nt, Human
ccuugcuggacggggacugggg

SEQ ID NO: 3522220 - RNA, 12 nt, Human
ccuugcuggccc

SEQ ID NO: 3522221 - RNA, 13 nt, Human
ccuugcuggcccc

SEQ ID NO: 3522222 - RNA, 21 nt, Human
ccuugcuggccccagcccugc

SEQ ID NO: 3522223 - RNA, 22 nt, Human
ccuugcuggccccagcccugcu

SEQ ID NO: 3522224 - RNA, 14 nt, Human
ccuugcuguccuga

SEQ ID NO: 3522225 - RNA, 20 nt, Human
ccuugcuguuggucaugugg

SEQ ID NO: 3522226 - RNA, 16 nt, Human
ccuugcuugccugcag

SEQ ID NO: 3522227 - RNA, 18 nt, Human
ccuugcuugccugcaggg

SEQ ID NO: 3522228 - RNA, 21 nt, Human
ccuugcuugccugcagggcca

SEQ ID NO: 3522229 - RNA, 16 nt, Human
ccuugcuuuucccucu

SEQ ID NO: 3522230 - RNA, 19 nt, Human
ccuugcuuuucccucuuuu

SEQ ID NO: 3522231 - RNA, 20 nt, Human
ccuugcuuuucccucuuuuc

SEQ ID NO: 3522232 - RNA, 19 nt, Human
ccuuggaaaccugcccugc

SEQ ID NO: 3522233 - RNA, 20 nt, Human
ccuuggaaaucaaauguaaa

SEQ ID NO: 3522234 - RNA, 22 nt, Human
ccuuggaaaucaaauguaaagu

SEQ ID NO: 3522235 - RNA, 15 nt, Human
ccuuggaaguuucau

SEQ ID NO: 3522236 - RNA, 18 nt, Human
ccuuagagguccucugga

SEQ ID NO: 3522237 - RNA, 16 nt, Human
ccuuagauuagcucug

SEQ ID NO: 3522238 - RNA, 19 nt, Human
ccuuagauuuaguagugua

SEQ ID NO: 3522239 - RNA, 22 nt, Human
ccuuagcacaggggggccgccg

SEQ ID NO: 3522240 - RNA, 16 nt, Human
ccuuagccucccugaa

SEQ ID NO: 3522241 - RNA, 14 nt, Human
ccuuagccuggacc

SEQ ID NO: 3522242 - RNA, 19 nt, Human
ccuuagccuggaccucuga

SEQ ID NO: 3522243 - RNA, 19 nt, Human
ccuuagcuggcauuacagc

SEQ ID NO: 3522244 - RNA, 17 nt, Human
ccuuagcuuagaccuca

SEQ ID NO: 3522245 - RNA, 22 nt, Human
ccuuagcuuagaccucagccug

SEQ ID NO: 3522246 - RNA, 23 nt, Human
ccuuagcuuagaccucagccugu

SEQ ID NO: 3522247 - RNA, 14 nt, Human
ccuuagcuucagga

SEQ ID NO: 3522248 - RNA, 23 nt, Human
ccuuaggaagagccuuccaccca

SEQ ID NO: 3522249 - RNA, 13 nt, Human
ccuuaggcaggga

SEQ ID NO: 3522250 - RNA, 15 nt, Human
ccuuaggcagggaag

SEQ ID NO: 3522251 - RNA, 21 nt, Human
ccuuagggaagcuggccugag

SEQ ID NO: 3522252 - RNA, 16 nt, Human
ccuuagggcacugggc

SEQ ID NO: 3522253 - RNA, 20 nt, Human
ccuuagucucaguuugugug

SEQ ID NO: 3522254 - RNA, 13 nt, Human
ccuuagucuucuc

SEQ ID NO: 3522255 - RNA, 15 nt, Human
ccuuagugcaguuau

SEQ ID NO: 3522256 - RNA, 20 nt, Human
ccuuaguggcuuuuuuccuc

SEQ ID NO: 3522257 - RNA, 22 nt, Human
ccuuagugggccagggcugccc

SEQ ID NO: 3522258 - RNA, 16 nt, Human
ccuuaguguuucugug

SEQ ID NO: 3522259 - RNA, 12 nt, Human
ccuuauaaaauc

SEQ ID NO: 3522260 - RNA, 15 nt, Human
ccuuaucaagugucu

SEQ ID NO: 3522261 - RNA, 16 nt, Human
ccuuaucaagugucuu

SEQ ID NO: 3522262 - RNA, 13 nt, Human
ccuuaucaccagc

SEQ ID NO: 3522263 - RNA, 13 nt, Human
ccuuaucagagcu

SEQ ID NO: 3522264 - RNA, 16 nt, Human
ccuuaucauaaauuca

SEQ ID NO: 3522265 - RNA, 15 nt, Human
ccuuaucauucauuc

SEQ ID NO: 3522266 - RNA, 16 nt, Human
ccuuaucauucauucu

SEQ ID NO: 3522267 - RNA, 13 nt, Human
ccuuauccaggac

SEQ ID NO: 3522268 - RNA, 14 nt, Human
ccuuauccaggacu

SEQ ID NO: 3522269 - RNA, 15 nt, Human
ccuuauccaggacuc

SEQ ID NO: 3522270 - RNA, 14 nt, Human
ccuuauccccacuu

SEQ ID NO: 3522271 - RNA, 19 nt, Human
ccuuucuuccucauucccu

SEQ ID NO: 3522272 - RNA, 13 nt, Human
ccuuucuuggcca

SEQ ID NO: 3522273 - RNA, 17 nt, Human
ccuuucuuuucuuucuu

SEQ ID NO: 3522274 - RNA, 14 nt, Human
ccuuugaagaggaa

SEQ ID NO: 3522275 - RNA, 20 nt, Human
ccuuugaauccucucucugu

SEQ ID NO: 3522276 - RNA, 18 nt, Human
ccuuugaauguuaauuuu

SEQ ID NO: 3522277 - RNA, 15 nt, Human
ccuuugaccugccuc

SEQ ID NO: 3522278 - RNA, 17 nt, Human
ccuuugacgccauccca

SEQ ID NO: 3522279 - RNA, 20 nt, Human
ccuuugacgccaucccagcc

SEQ ID NO: 3522280 - RNA, 19 nt, Human
ccuuugagacaguuucuua

SEQ ID NO: 3522281 - RNA, 22 nt, Human
ccuuugagcccacaaagccuua

SEQ ID NO: 3522282 - RNA, 19 nt, Human
ccuuugagugcaguccuga

SEQ ID NO: 3522283 - RNA, 18 nt, Human
ccuuugcacugagggcca

SEQ ID NO: 3522284 - RNA, 12 nt, Human
ccuuugcaggca

SEQ ID NO: 3522285 - RNA, 21 nt, Human
ccuuugccccaccuuuauuaa

SEQ ID NO: 3522286 - RNA, 11 nt, Human
ccuuugccccu

SEQ ID NO: 3522287 - RNA, 14 nt, Human
ccuuugccuccaga

SEQ ID NO: 3522288 - RNA, 14 nt, Human
ccuuugcuccaccc

SEQ ID NO: 3522289 - RNA, 19 nt, Human
ccuuugcuccaccccacuc

SEQ ID NO: 3522290 - RNA, 17 nt, Human
ccuuugcugacccuccc

SEQ ID NO: 3522291 - RNA, 18 nt, Human
ccuuugcugacccucccc

SEQ ID NO: 3522292 - RNA, 14 nt, Human
ccuuugcuucccuu

SEQ ID NO: 3522293 - RNA, 14 nt, Human
ccuuuggagaccau

SEQ ID NO: 3522294 - RNA, 15 nt, Human
ccuuuggagaugcug

SEQ ID NO: 3522295 - RNA, 15 nt, Human
ccuuuggccuuggcu

SEQ ID NO: 3522296 - RNA, 14 nt, Human
ccuuuggcucugga

SEQ ID NO: 3522297 - RNA, 19 nt, Human
ccuuuggcucuggagacag

SEQ ID NO: 3522298 - RNA, 15 nt, Human
ccuuugggcccugca

SEQ ID NO: 3522299 - RNA, 16 nt, Human
ccuuugggcccugcau

SEQ ID NO: 3522300 - RNA, 22 nt, Human
ccuuugguccuaagucccugcc

SEQ ID NO: 3522301 - RNA, 17 nt, Human
ccuuugguccugucccc

SEQ ID NO: 3522302 - RNA, 15 nt, Human
ccuuugguucuggcc

SEQ ID NO: 3522303 - RNA, 21 nt, Human
ccuuuguaaauugucagaugc

SEQ ID NO: 3522304 - RNA, 14 nt, Human
ccuuuguauauuau

SEQ ID NO: 3522305 - RNA, 18 nt, Human
ccuuuguauucucuccug

SEQ ID NO: 3522306 - RNA, 23 nt, Human
ccuuuguauucucuccuguaccu

SEQ ID NO: 3522307 - RNA, 24 nt, Human
ccuuuguauucucuccuguaccuc

SEQ ID NO: 3522308 - RNA, 23 nt, Human
ccuuugucaucauuguauauaug

SEQ ID NO: 3522309 - RNA, 18 nt, Human
ccuuugucaucuuucuuc

SEQ ID NO: 3522310 - RNA, 14 nt, Human
ccuuuguccccacc

SEQ ID NO: 3522311 - RNA, 18 nt, Human
ccuuuguccccaccgcag

SEQ ID NO: 3522312 - RNA, 15 nt, Human
ccuuugucuuucaaa

SEQ ID NO: 3522313 - RNA, 14 nt, Human
ccuuugugaggaag

SEQ ID NO: 3522314 - RNA, 16 nt, Human
ccuuugugaggaagcc

SEQ ID NO: 3522315 - RNA, 17 nt, Human
ccuuugugaggaagccg

SEQ ID NO: 3522316 - RNA, 23 nt, Human
ccuuugugaggaagccgcugggg

SEQ ID NO: 3522317 - RNA, 22 nt, Human
ccuuugugcacauuuauuuccu

SEQ ID NO: 3522318 - RNA, 13 nt, Human
ccuuugugcccua

SEQ ID NO: 3522319 - RNA, 13 nt, Human
ccuuugugcugug

SEQ ID NO: 3522320 - RNA, 17 nt, Human
ccuuugugugcucucca

SEQ ID NO: 3522321 - RNA, 18 nt, Human
ccuuugugugcucuccau

SEQ ID NO: 3522322 - RNA, 16 nt, Human
ccuuuguguguguguc

SEQ ID NO: 3522323 - RNA, 21 nt, Human
ccuuugugugugugucagcug

SEQ ID NO: 3522324 - RNA, 20 nt, Human
ccuuuguuccccacuggagc

SEQ ID NO: 3522325 - RNA, 21 nt, Human
ccuuuguuccccacuggagca

SEQ ID NO: 3522326 - RNA, 14 nt, Human
ccuuuguugcucag

SEQ ID NO: 3522327 - RNA, 23 nt, Human
ccuuuguuuugauguuuguggcc

SEQ ID NO: 3522328 - RNA, 16 nt, Human
ccuuuuaaaguguuuc

SEQ ID NO: 3522329 - RNA, 19 nt, Human
ccuuuuaaaguguuucagc

SEQ ID NO: 3522330 - RNA, 21 nt, Human
ccuuuuaaauccuguugaaaa

SEQ ID NO: 3522331 - RNA, 18 nt, Human
ccuuuuaacaccugaugu

SEQ ID NO: 3522332 - RNA, 20 nt, Human
ccuuuuaacauuuuguucuu

SEQ ID NO: 3522333 - RNA, 17 nt, Human
ccuuuuacauacugcug

SEQ ID NO: 3522334 - RNA, 20 nt, Human
ccuuuuacuacagcuaugaa

SEQ ID NO: 3522335 - RNA, 18 nt, Human
ccuuuuacugguugcaug

SEQ ID NO: 3522336 - RNA, 19 nt, Human
ccuuuuacugguugcaugg

SEQ ID NO: 3522337 - RNA, 13 nt, Human
ccuuuuauuucuu

SEQ ID NO: 3522338 - RNA, 20 nt, Human
ccuuuucacccuucuacucu

SEQ ID NO: 3522339 - RNA, 20 nt, Human
ccuuuucagcuucugcuggg

SEQ ID NO: 3522340 - RNA, 22 nt, Human
ccuuuucauaggucugaaauuu

SEQ ID NO: 3522341 - RNA, 15 nt, Human
ccuuuuccagagcau

SEQ ID NO: 3522342 - RNA, 21 nt, Human
ccuuuucccggggaggagaga

SEQ ID NO: 3522343 - RNA, 15 nt, Human
ccuuuucccugcuuc

SEQ ID NO: 3522344 - RNA, 17 nt, Human
ccuuuucgccuuuccuc

SEQ ID NO: 3522345 - RNA, 22 nt, Human
ccuuuucuagcccgaauacaaa

SEQ ID NO: 3522346 - RNA, 15 nt, Human
ccuuuucuggcaccg

SEQ ID NO: 3522347 - RNA, 22 nt, Human
ccuuuucuggggaaagacacug

SEQ ID NO: 3522348 - RNA, 13 nt, Human
ccuuuucuguguu

SEQ ID NO: 3522349 - RNA, 17 nt, Human
ccuuuucuucuauguag

SEQ ID NO: 3522350 - RNA, 23 nt, Human
ccuuuucuuuucuacccuagcca

SEQ ID NO: 3522351 - RNA, 14 nt, Human
ccuuuucuuuuguu

SEQ ID NO: 3522352 - RNA, 15 nt, Human
ccuuuucuuuuguua

SEQ ID NO: 3522353 - RNA, 22 nt, Human
ccuuuucuuuuguuacuguucu

SEQ ID NO: 3522354 - RNA, 21 nt, Human
ccuuuugaggagccccagcua

SEQ ID NO: 3522355 - RNA, 17 nt, Human
ccuuuugagugccuuac

SEQ ID NO: 3522356 - RNA, 11 nt, Human
ccuuuugcaaa

SEQ ID NO: 3522357 - RNA, 17 nt, Human
ccuuuugcaccccuccc

SEQ ID NO: 3522358 - RNA, 19 nt, Human
ccuuuugcaccccucccau

SEQ ID NO: 3522359 - RNA, 17 nt, Human
ccuuuugcaccugcucu

SEQ ID NO: 3522360 - RNA, 19 nt, Human
ccuuuugcagaagagggug

SEQ ID NO: 3522361 - RNA, 19 nt, Human
ccuuuugcggaugggaggg

SEQ ID NO: 3522362 - RNA, 12 nt, Human
ccuuuuggcacu

SEQ ID NO: 3522363 - RNA, 21 nt, Human
ccuuuuggguuucugcccugc

SEQ ID NO: 3522364 - RNA, 13 nt, Human
ccuuuuggugugu

SEQ ID NO: 3522365 - RNA, 12 nt, Human
ccuuuuguaaag

SEQ ID NO: 3522366 - RNA, 19 nt, Human
ccuuuuguaccauggugug

SEQ ID NO: 3522367 - RNA, 19 nt, Human
ccuuuuguauacauccugg

SEQ ID NO: 3522368 - RNA, 20 nt, Human
ccuuuuguauacauccuggg

SEQ ID NO: 3522369 - RNA, 15 nt, Human
ccuuuugucugccuc

SEQ ID NO: 3522370 - RNA, 14 nt, Human
ccuuuuuacucccc

SEQ ID NO: 3522371 - RNA, 15 nt, Human
ccuuuuuacuccccu

SEQ ID NO: 3522372 - RNA, 16 nt, Human
ccuuuuuaugaggcaa

SEQ ID NO: 3522373 - RNA, 22 nt, Human
ccuuuuuauuuauauguaugug

SEQ ID NO: 3522374 - RNA, 18 nt, Human
ccuuuuucucccucugga

SEQ ID NO: 3522375 - RNA, 14 nt, Human
ccuuuuucugcacu

SEQ ID NO: 3522376 - RNA, 15 nt, Human
ccuuuuucugcacua

SEQ ID NO: 3522377 - RNA, 17 nt, Human
ccuuuuucugcacuaua

SEQ ID NO: 3522378 - RNA, 13 nt, Human
ccuuuuugacacu

SEQ ID NO: 3522379 - RNA, 21 nt, Human
ccuuuuugguacuuauuacug

SEQ ID NO: 3522380 - RNA, 14 nt, Human
ccuuuuuuaagauu

SEQ ID NO: 3522381 - RNA, 14 nt, Human
ccuuuauucuggca

SEQ ID NO: 3522382 - RNA, 21 nt, Human
ccuuuauuggguaucaagaca

SEQ ID NO: 3522383 - RNA, 15 nt, Human
ccuuuauuguguuug

SEQ ID NO: 3522384 - RNA, 20 nt, Human
ccuuuauuguguuugucauu

SEQ ID NO: 3522385 - RNA, 21 nt, Human
ccuuuauuuuuggcguggcug

SEQ ID NO: 3522386 - RNA, 13 nt, Human
ccuuucaaagcuu

SEQ ID NO: 3522387 - RNA, 15 nt, Human
ccuuucaaauuuaga

SEQ ID NO: 3522388 - RNA, 21 nt, Human
ccuuucaaauuuagaaacuaa

SEQ ID NO: 3522389 - RNA, 22 nt, Human
ccuuucaaauuuagaaacuaau

SEQ ID NO: 3522390 - RNA, 15 nt, Human
ccuuucaaauuucac

SEQ ID NO: 3522391 - RNA, 21 nt, Human
ccuuucaauaggaaaaacuga

SEQ ID NO: 3522392 - RNA, 22 nt, Human
ccuuucacaaaauuuuauuccu

SEQ ID NO: 3522393 - RNA, 22 nt, Human
ccuuucacaggcagccagugcc

SEQ ID NO: 3522394 - RNA, 17 nt, Human
ccuuucaccccagggcc

SEQ ID NO: 3522395 - RNA, 21 nt, Human
ccuuucaccccagggccugag

SEQ ID NO: 3522396 - RNA, 22 nt, Human
ccuuucaccuuuguguauuuuu

SEQ ID NO: 3522397 - RNA, 17 nt, Human
ccuuucacuucuuuccc

SEQ ID NO: 3522398 - RNA, 14 nt, Human
ccuuucagaugucu

SEQ ID NO: 3522399 - RNA, 16 nt, Human
ccuuucagcaggcagc

SEQ ID NO: 3522400 - RNA, 17 nt, Human
ccuuucagcaggcagcc

SEQ ID NO: 3522401 - RNA, 15 nt, Human
ccuuucagcccacgu

SEQ ID NO: 3522402 - RNA, 12 nt, Human
ccuuucagcugu

SEQ ID NO: 3522403 - RNA, 19 nt, Human
ccuuucaggaucuauuuuu

SEQ ID NO: 3522404 - RNA, 20 nt, Human
ccuuucagggaauuucagga

SEQ ID NO: 3522405 - RNA, 12 nt, Human
ccuuucauauuu

SEQ ID NO: 3522406 - RNA, 17 nt, Human
ccuuucauccccaccuu

SEQ ID NO: 3522407 - RNA, 14 nt, Human
ccuuucauuuacug

SEQ ID NO: 3522408 - RNA, 16 nt, Human
ccuuuccaaggcuucu

SEQ ID NO: 3522409 - RNA, 20 nt, Human
ccuuuccauaaauccuugau

SEQ ID NO: 3522410 - RNA, 18 nt, Human
ccuuucccaccccaaccu

SEQ ID NO: 3522411 - RNA, 22 nt, Human
ccuuucccaccccaaccugcuc

SEQ ID NO: 3522412 - RNA, 19 nt, Human
ccuuucccaggugcuacac

SEQ ID NO: 3522413 - RNA, 17 nt, Human
ccuuuccccagcaucac

SEQ ID NO: 3522414 - RNA, 14 nt, Human
ccuuuccccagccc

SEQ ID NO: 3522415 - RNA, 17 nt, Human
ccuuuccccagcccagg

SEQ ID NO: 3522416 - RNA, 20 nt, Human
ccuuuccccgacgcccaccc

SEQ ID NO: 3522417 - RNA, 22 nt, Human
ccuuucccgggcuguccacuag

SEQ ID NO: 3522418 - RNA, 14 nt, Human
ccuuucccuaaaga

SEQ ID NO: 3522419 - RNA, 17 nt, Human
ccuuucccuaagccagc

SEQ ID NO: 3522420 - RNA, 19 nt, Human
ccuuucccucacccccucc

SEQ ID NO: 3522421 - RNA, 21 nt, Human
ccuuucccucacccccuccca

SEQ ID NO: 3522422 - RNA, 12 nt, Human
ccuuucccuucc

SEQ ID NO: 3522423 - RNA, 14 nt, Human
ccuuucccuuccuc

SEQ ID NO: 3522424 - RNA, 16 nt, Human
ccuuucccuuccucuu

SEQ ID NO: 3522425 - RNA, 19 nt, Human
ccuuucccuuguagcuccu

SEQ ID NO: 3522426 - RNA, 12 nt, Human
ccuuucccuuua

SEQ ID NO: 3522427 - RNA, 17 nt, Human
ccuuuccucucuccugu

SEQ ID NO: 3522428 - RNA, 22 nt, Human
ccuuuccuggacacucagaccu

SEQ ID NO: 3522429 - RNA, 13 nt, Human
ccuuuccuguagc

SEQ ID NO: 3522430 - RNA, 15 nt, Human
ccuuuccugucccac

SEQ ID NO: 3522431 - RNA, 18 nt, Human
ccuuuccuguucagcauu

SEQ ID NO: 3522432 - RNA, 20 nt, Human
ccuuuccuguucagcauucu

SEQ ID NO: 3522433 - RNA, 16 nt, Human
ccuuucgaggccugaa

SEQ ID NO: 3522434 - RNA, 15 nt, Human
ccuuucuagccuggc

SEQ ID NO: 3522435 - RNA, 22 nt, Human
ccuuucuaguccuauucuauug

SEQ ID NO: 3522436 - RNA, 14 nt, Human
ccuuucuaguugaa

SEQ ID NO: 3522437 - RNA, 15 nt, Human
ccuuucuaguugaaa

SEQ ID NO: 3522438 - RNA, 16 nt, Human
ccuuucuauaauuuua

SEQ ID NO: 3522439 - RNA, 17 nt, Human
ccuuucuauaauuuuac

SEQ ID NO: 3522440 - RNA, 15 nt, Human
ccuuucuccagccag

SEQ ID NO: 3522441 - RNA, 12 nt, Human
ccuuucuccagg

SEQ ID NO: 3522442 - RNA, 14 nt, Human
ccuuucucccaggc

SEQ ID NO: 3522443 - RNA, 15 nt, Human
ccuuucuccccugcc

SEQ ID NO: 3522444 - RNA, 19 nt, Human
ccuuucuccccugccccca

SEQ ID NO: 3522445 - RNA, 20 nt, Human
ccuuucuccccugcccccag

SEQ ID NO: 3522446 - RNA, 15 nt, Human
ccuuucucucucuaa

SEQ ID NO: 3522447 - RNA, 22 nt, Human
ccuuucucucuuuauacagcug

SEQ ID NO: 3522448 - RNA, 17 nt, Human
ccuuucucuucucuguu

SEQ ID NO: 3522449 - RNA, 14 nt, Human
ccuuucucuuucuc

SEQ ID NO: 3522450 - RNA, 17 nt, Human
ccuuucucuuucucucu

SEQ ID NO: 3522451 - RNA, 23 nt, Human
ccuuucuggauuauucugggggc

SEQ ID NO: 3522452 - RNA, 14 nt, Human
ccuuucuggcucuc

SEQ ID NO: 3522453 - RNA, 19 nt, Human
ccuuucugugcccuacuca

SEQ ID NO: 3522454 - RNA, 13 nt, Human
ccuuucugugugc

SEQ ID NO: 3522455 - RNA, 15 nt, Human
ccuuucuuccucauu

SEQ ID NO: 3522456 - RNA, 17 nt, Human
ccuuucuucucccccau

SEQ ID NO: 3522457 - RNA, 14 nt, Human
ccuuucuugacaaa

SEQ ID NO: 3522458 - RNA, 13 nt, Human
ccuuucuugguuc

SEQ ID NO: 3522459 - RNA, 12 nt, Human
ccuuucuuuucc

SEQ ID NO: 3522460 - RNA, 19 nt, Human
ccuuucuuuucccccuuug

SEQ ID NO: 3522461 - RNA, 17 nt, Human
ccuuucuuuuucuucuu

SEQ ID NO: 3522462 - RNA, 23 nt, Human
ccuuucuuuuucuucuucccucc

SEQ ID NO: 3522463 - RNA, 17 nt, Human
ccuuugaaaccugcucu

SEQ ID NO: 3522464 - RNA, 20 nt, Human
ccuuugaagccucagcuacc

SEQ ID NO: 3522465 - RNA, 14 nt, Human
ccuuugacaaaggu

SEQ ID NO: 3522466 - RNA, 16 nt, Human
ccuuugacauuuaauu

SEQ ID NO: 3522467 - RNA, 21 nt, Human
ccuuugaccugccucccuuca

SEQ ID NO: 3522468 - RNA, 18 nt, Human
ccuuugacgccaucccag

SEQ ID NO: 3522469 - RNA, 21 nt, Human
ccuuugacgccaucccagccc

SEQ ID NO: 3522470 - RNA, 13 nt, Human
ccuuugagacagu

SEQ ID NO: 3522471 - RNA, 14 nt, Human
ccuuugauaaaugu

SEQ ID NO: 3522472 - RNA, 21 nt, Human
ccuuugauuaaagacuccagu

SEQ ID NO: 3522473 - RNA, 13 nt, Human
ccuuugcacugag

SEQ ID NO: 3522474 - RNA, 15 nt, Human
ccuuugcagcucaga

SEQ ID NO: 3522475 - RNA, 13 nt, Human
ccuuugcaggcau

SEQ ID NO: 3522476 - RNA, 12 nt, Human
cgccuuguucuu

SEQ ID NO: 3522477 - RNA, 14 nt, Human
cgccuuucccaacu

SEQ ID NO: 3522478 - RNA, 13 nt, Human
cgccuuucccagg

SEQ ID NO: 3522479 - RNA, 13 nt, Human
cgccuuuccucuc

SEQ ID NO: 3522480 - RNA, 15 nt, Human
cgccuuuuguauaca

SEQ ID NO: 3522481 - RNA, 22 nt, Human
cgcgaaaguaucaccagggugc

SEQ ID NO: 3522482 - RNA, 22 nt, Human
cgcgacuaauuucaaaaugcuu

SEQ ID NO: 3522483 - RNA, 14 nt, Human
cgcgaucccacaca

SEQ ID NO: 3522484 - RNA, 19 nt, Human
cgcgccaaauaaugucucu

SEQ ID NO: 3522485 - RNA, 14 nt, Human
cgcgccacaggacc

SEQ ID NO: 3522486 - RNA, 21 nt, Human
cgcgccacaggacccucgccg

SEQ ID NO: 3522487 - RNA, 20 nt, Human
cgcgccccccucccagaggc

SEQ ID NO: 3522488 - RNA, 11 nt, Human
cgcgcgcacac

SEQ ID NO: 3522489 - RNA, 14 nt, Human
cgcgcgcacacaca

SEQ ID NO: 3522490 - RNA, 19 nt, Human
cgcgcgcacacacacacau

SEQ ID NO: 3522491 - RNA, 14 nt, Human
cgcgcucugcucag

SEQ ID NO: 3522492 - RNA, 23 nt, Human
cgcgcugcgugugggacccgccg

SEQ ID NO: 3522493 - RNA, 15 nt, Human
cgcggccagccccgg

SEQ ID NO: 3522494 - RNA, 14 nt, Human
cgcggcccucagua

SEQ ID NO: 3522495 - RNA, 14 nt, Human
cgcggccucaaccc

SEQ ID NO: 3522496 - RNA, 20 nt, Human
cgcggccucuucucucagac

SEQ ID NO: 3522497 - RNA, 17 nt, Human
cgcggcggagcuggccc

SEQ ID NO: 3522498 - RNA, 21 nt, Human
cgcggcggagcuggccccgcc

SEQ ID NO: 3522499 - RNA, 23 nt, Human
cgcggcggagcuggccccgccgc

SEQ ID NO: 3522500 - RNA, 16 nt, Human
cgcggcugggaggagg

SEQ ID NO: 3522501 - RNA, 16 nt, Human
cgcggggcacccgccg

SEQ ID NO: 3522502 - RNA, 22 nt, Human
cgcggugccaugucugcagugu

SEQ ID NO: 3522503 - RNA, 19 nt, Human
cgcgguggcucacgccugu

SEQ ID NO: 3522504 - RNA, 21 nt, Human
cgcgucgcccucccaggcucu

SEQ ID NO: 3522505 - RNA, 15 nt, Human
cgcgucgccgccacc

SEQ ID NO: 3522506 - RNA, 15 nt, Human
cgcgucuacccuggg

SEQ ID NO: 3522507 - RNA, 16 nt, Human
cgcgucuacccuggga

SEQ ID NO: 3522508 - RNA, 17 nt, Human
cgcgucuacccugggau

SEQ ID NO: 3522509 - RNA, 12 nt, Human
cgcgucuccugu

SEQ ID NO: 3522510 - RNA, 21 nt, Human
cgcgucuccuguuuuucuggg

SEQ ID NO: 3522511 - RNA, 12 nt, Human
cgcgucuuccug

SEQ ID NO: 3522512 - RNA, 14 nt, Human
cgcgucuuccugag

SEQ ID NO: 3522513 - RNA, 20 nt, Human
cgcgugcacacaccagagcc

SEQ ID NO: 3522514 - RNA, 19 nt, Human
cgcgugcccucgcugcuuc

SEQ ID NO: 3522515 - RNA, 23 nt, Human
cgcguguccccggggcccagggg

SEQ ID NO: 3522516 - RNA, 24 nt, Human
cgcguugaaauuguaauuauaucu

SEQ ID NO: 3522517 - RNA, 13 nt, Human
cgcuaaaagaaac

SEQ ID NO: 3522518 - RNA, 15 nt, Human
cgcuaaaagaaacuu

SEQ ID NO: 3522519 - RNA, 18 nt, Human
cgcuaaacuuuucugaua

SEQ ID NO: 3522520 - RNA, 19 nt, Human
cgcuaaacuuuucugauag

SEQ ID NO: 3522521 - RNA, 22 nt, Human
cgcuaacuugcuuaaaugugaa

SEQ ID NO: 3522522 - RNA, 14 nt, Human
cgcuaagagggagg

SEQ ID NO: 3522523 - RNA, 22 nt, Human
cgcuaagagggagggagggcuc

SEQ ID NO: 3522524 - RNA, 11 nt, Human
cgcuacccacu

SEQ ID NO: 3522525 - RNA, 13 nt, Human
cgcuaccucccuc

SEQ ID NO: 3522526 - RNA, 14 nt, Human
cgcuaccucccucc

SEQ ID NO: 3522527 - RNA, 21 nt, Human
cggaccaaagggagucugcca

SEQ ID NO: 3522528 - RNA, 17 nt, Human
cggaccccacuccggcc

SEQ ID NO: 3522529 - RNA, 16 nt, Human
cggacccucuaaccuc

SEQ ID NO: 3522530 - RNA, 22 nt, Human
cggaccgcuuguggggacccag

SEQ ID NO: 3522531 - RNA, 23 nt, Human
cggaccgcuuguggggacccagg

SEQ ID NO: 3522532 - RNA, 12 nt, Human
cggacgggcugu

SEQ ID NO: 3522533 - RNA, 15 nt, Human
cggacguuuccauca

SEQ ID NO: 3522534 - RNA, 20 nt, Human
cggacuaagccuaccugcuc

SEQ ID NO: 3522535 - RNA, 15 nt, Human
cggacuccuccuuuc

SEQ ID NO: 3522536 - RNA, 19 nt, Human
cggacuccuccuuucuccu

SEQ ID NO: 3522537 - RNA, 21 nt, Human
cggacuuagaaaaccagcuca

SEQ ID NO: 3522538 - RNA, 16 nt, Human
cggacuuagcugggag

SEQ ID NO: 3522539 - RNA, 15 nt, Human
cggagaaaggaaggg

SEQ ID NO: 3522540 - RNA, 18 nt, Human
cggagaacaugaaucaaa

SEQ ID NO: 3522541 - RNA, 18 nt, Human
cggagaaccuugugccug

SEQ ID NO: 3522542 - RNA, 16 nt, Human
cggagaagagcgcagu

SEQ ID NO: 3522543 - RNA, 24 nt, Human
cggagaagagcuguucacagccag

SEQ ID NO: 3522544 - RNA, 15 nt, Human
cggagacggaguccc

SEQ ID NO: 3522545 - RNA, 17 nt, Human
cggagacggagucccac

SEQ ID NO: 3522546 - RNA, 14 nt, Human
cggagagaaaaaag

SEQ ID NO: 3522547 - RNA, 13 nt, Human
cggagaggacagu

SEQ ID NO: 3522548 - RNA, 19 nt, Human
cggagaguacagugagcca

SEQ ID NO: 3522549 - RNA, 19 nt, Human
cggagauuggacggccuga

SEQ ID NO: 3522550 - RNA, 17 nt, Human
cggagccacuccucuga

SEQ ID NO: 3522551 - RNA, 12 nt, Human
cggagccccagg

SEQ ID NO: 3522552 - RNA, 21 nt, Human
cggagccucauccgaggcagg

SEQ ID NO: 3522553 - RNA, 19 nt, Human
cggagcuaacacuggcccc

SEQ ID NO: 3522554 - RNA, 21 nt, Human
cggagcuaacacuggccccua

SEQ ID NO: 3522555 - RNA, 19 nt, Human
cggaggaaagacaacacaa

SEQ ID NO: 3522556 - RNA, 17 nt, Human
cggaggauaguaugagc

SEQ ID NO: 3522557 - RNA, 18 nt, Human
cggaggauaguaugagcc

SEQ ID NO: 3522558 - RNA, 20 nt, Human
cggaggccugcgacccuggg

SEQ ID NO: 3522559 - RNA, 21 nt, Human
cggaggccugcgacccugggg

SEQ ID NO: 3522560 - RNA, 17 nt, Human
cggaggcuugggaccgc

SEQ ID NO: 3522561 - RNA, 12 nt, Human
cggagggcugcg

SEQ ID NO: 3522562 - RNA, 23 nt, Human
cggagggugggggccaccugccu

SEQ ID NO: 3522563 - RNA, 13 nt, Human
cggagguugcagg

SEQ ID NO: 3522564 - RNA, 19 nt, Human
cggagucagccaggagcug

SEQ ID NO: 3522565 - RNA, 14 nt, Human
cggagucccaccuu

SEQ ID NO: 3522566 - RNA, 20 nt, Human
cggagucccaccuuggcugc

SEQ ID NO: 3522567 - RNA, 23 nt, Human
cggagucccaccuuggcugcagg

SEQ ID NO: 3522568 - RNA, 15 nt, Human
cggagucguggggug

SEQ ID NO: 3522569 - RNA, 22 nt, Human
cggagugaagaggggcagcccu

SEQ ID NO: 3522570 - RNA, 23 nt, Human
cggagugaagaggggcagcccuu

SEQ ID NO: 3522571 - RNA, 18 nt, Human
cggagugaguuuuuuagu

SEQ ID NO: 3522572 - RNA, 23 nt, Human
cggagugcggaccacccucacug

SEQ ID NO: 3522573 - RNA, 19 nt, Human
cggaguguguaugccaaga

SEQ ID NO: 3522574 - RNA, 19 nt, Human
cggaucagagcaggaccuc

SEQ ID NO: 3522575 - RNA, 14 nt, Human
cggaucagcugagc

SEQ ID NO: 3522576 - RNA, 17 nt, Human
cggaucaggcucccagg

SEQ ID NO: 3522577 - RNA, 21 nt, Human
cggaucaucaacaagauuucc

SEQ ID NO: 3522578 - RNA, 20 nt, Human
cggauccuaagcaucuaagu

SEQ ID NO: 3522579 - RNA, 14 nt, Human
cggauccugggugg

SEQ ID NO: 3522580 - RNA, 16 nt, Human
cggauggauggaaggu

SEQ ID NO: 3522581 - RNA, 20 nt, Human
cggauuauuuuuucagaccg

SEQ ID NO: 3522582 - RNA, 24 nt, Human
cggauuccaaagaguagaauugca

SEQ ID NO: 3522583 - RNA, 12 nt, Human
cggauuccagcc

SEQ ID NO: 3522584 - RNA, 16 nt, Human
cggauuccagcccaca

SEQ ID NO: 3522585 - RNA, 17 nt, Human
cggauugcauuagaaau

SEQ ID NO: 3522586 - RNA, 16 nt, Human
cggauuuauuuuucca

SEQ ID NO: 3522587 - RNA, 15 nt, Human
cggauuuggggugga

SEQ ID NO: 3522588 - RNA, 13 nt, Human
cggauuuuuucca

SEQ ID NO: 3522589 - RNA, 13 nt, Human
cggcaaaaggaaa

SEQ ID NO: 3522590 - RNA, 17 nt, Human
cggcaauaaaagcccag

SEQ ID NO: 3522591 - RNA, 14 nt, Human
cggcacagaugcuc

SEQ ID NO: 3522592 - RNA, 18 nt, Human
cggcacagaugcuccagg

SEQ ID NO: 3522593 - RNA, 18 nt, Human
cggcacagggucugcucu

SEQ ID NO: 3522594 - RNA, 19 nt, Human
cggcacagggucugcucuu

SEQ ID NO: 3522595 - RNA, 16 nt, Human
cggcacccccugcagc

SEQ ID NO: 3522596 - RNA, 20 nt, Human
cggcacccccugcagcuugu

SEQ ID NO: 3522597 - RNA, 13 nt, Human
cggcacccucugg

SEQ ID NO: 3522598 - RNA, 17 nt, Human
cggcaccugggcccugg

SEQ ID NO: 3522599 - RNA, 15 nt, Human
cggcacuguggccuu

SEQ ID NO: 3522600 - RNA, 14 nt, Human
cggcagcagccauc

SEQ ID NO: 3522601 - RNA, 15 nt, Human
cggcagcauggagcu

SEQ ID NO: 3522602 - RNA, 16 nt, Human
cggcagccccagccug

SEQ ID NO: 3522603 - RNA, 17 nt, Human
cggcagccccagccugc

SEQ ID NO: 3522604 - RNA, 23 nt, Human
cggcagcuucugcccccugcaga

SEQ ID NO: 3522605 - RNA, 21 nt, Human
cggcaggacaacgaggaagcc

SEQ ID NO: 3522606 - RNA, 11 nt, Human
cggcaggacac

SEQ ID NO: 3522607 - RNA, 14 nt, Human
cggcaggcccugca

SEQ ID NO: 3522608 - RNA, 17 nt, Human
cggcaggcccugcagug

SEQ ID NO: 3522609 - RNA, 20 nt, Human
cggcagggcgggcagagggc

SEQ ID NO: 3522610 - RNA, 23 nt, Human
cggcagggcgggcagagggcugg

SEQ ID NO: 3522611 - RNA, 17 nt, Human
cggcaggggccuggaga

SEQ ID NO: 3522612 - RNA, 20 nt, Human
cggcagguucacaggcgagg

SEQ ID NO: 3522613 - RNA, 20 nt, Human
cggcaguucugggugcuccc

SEQ ID NO: 3522614 - RNA, 21 nt, Human
cggcaguucugggugcucccu

SEQ ID NO: 3522615 - RNA, 18 nt, Human
cggcauguuuccagcaga

SEQ ID NO: 3522616 - RNA, 14 nt, Human
cggcauuccugcuu

SEQ ID NO: 3522617 - RNA, 13 nt, Human
cggcauuuguuuc

SEQ ID NO: 3522618 - RNA, 19 nt, Human
cggccaagauaggaccuug

SEQ ID NO: 3522619 - RNA, 22 nt, Human
cggccaagauaggaccuugggc

SEQ ID NO: 3522620 - RNA, 14 nt, Human
cggccaauggaaac

SEQ ID NO: 3522621 - RNA, 18 nt, Human
cggccacacagcugccgg

SEQ ID NO: 3522622 - RNA, 13 nt, Human
cggccaccucugc

SEQ ID NO: 3522623 - RNA, 16 nt, Human
cggccaccugcggugc

SEQ ID NO: 3522624 - RNA, 14 nt, Human
cggccacuggccau

SEQ ID NO: 3522625 - RNA, 21 nt, Human
cggccagcugggaucugacug

SEQ ID NO: 3522626 - RNA, 12 nt, Human
cggccaggccag

SEQ ID NO: 3522627 - RNA, 24 nt, Human
cggccaggccagagggagugacag

SEQ ID NO: 3522628 - RNA, 19 nt, Human
cggccaggugccuccugac

SEQ ID NO: 3522629 - RNA, 22 nt, Human
cggccaucucuuuguacaggaa

SEQ ID NO: 3522630 - RNA, 22 nt, Human
cggcccaagcccgacuugcugu

SEQ ID NO: 3522631 - RNA, 15 nt, Human
cggcccacagcuccc

SEQ ID NO: 3522632 - RNA, 13 nt, Human
cggccccaccagu

SEQ ID NO: 3522633 - RNA, 18 nt, Human
cggccccaccagugccuc

SEQ ID NO: 3522634 - RNA, 20 nt, Human
cggccccaccagugccucuc

SEQ ID NO: 3522635 - RNA, 14 nt, Human
cggccccagccaga

SEQ ID NO: 3522636 - RNA, 18 nt, Human
cggcccccagagcgcccc

SEQ ID NO: 3522637 - RNA, 18 nt, Human
cggcccccuggucucugg

SEQ ID NO: 3522638 - RNA, 15 nt, Human
cggccccggccccag

SEQ ID NO: 3522639 - RNA, 17 nt, Human
cggccccuccccuccaa

SEQ ID NO: 3522640 - RNA, 19 nt, Human
cggccccugcugguucagg

SEQ ID NO: 3522641 - RNA, 15 nt, Human
cauuuuuaagugcug

SEQ ID NO: 3522642 - RNA, 19 nt, Human
cauuuuuaaucaugaaauu

SEQ ID NO: 3522643 - RNA, 20 nt, Human
cauuuuuaguagagacaggg

SEQ ID NO: 3522644 - RNA, 21 nt, Human
cauuuuuauaccuguuuaaau

SEQ ID NO: 3522645 - RNA, 12 nt, Human
cauuuuuauagc

SEQ ID NO: 3522646 - RNA, 16 nt, Human
cauuuuuauuuaugaa

SEQ ID NO: 3522647 - RNA, 22 nt, Human
cauuuuuauuucagauuuugau

SEQ ID NO: 3522648 - RNA, 10 nt, Human
cauuuuucaa

SEQ ID NO: 3522649 - RNA, 21 nt, Human
cauuuuucaaaaaguaaaaag

SEQ ID NO: 3522650 - RNA, 19 nt, Human
cauuuuucaacuuugaaua

SEQ ID NO: 3522651 - RNA, 20 nt, Human
cauuuuucaacuuugaauaa

SEQ ID NO: 3522652 - RNA, 14 nt, Human
cauuuuucaauaua

SEQ ID NO: 3522653 - RNA, 16 nt, Human
cauuuuucaugauaau

SEQ ID NO: 3522654 - RNA, 13 nt, Human
cauuuuucauuca

SEQ ID NO: 3522655 - RNA, 19 nt, Human
cauuuuuccguuugcuuuu

SEQ ID NO: 3522656 - RNA, 21 nt, Human
cauuuuuccuucccuucucca

SEQ ID NO: 3522657 - RNA, 12 nt, Human
cauuuuucugca

SEQ ID NO: 3522658 - RNA, 23 nt, Human
cauuuuucuuagggaaggauaca

SEQ ID NO: 3522659 - RNA, 13 nt, Human
cauuuuuguaaau

SEQ ID NO: 3522660 - RNA, 13 nt, Human
cauuuuuguauuu

SEQ ID NO: 3522661 - RNA, 15 nt, Human
cauuuuuuaaaacaa

SEQ ID NO: 3522662 - RNA, 17 nt, Human
cauuuuuuaaaacaaga

SEQ ID NO: 3522663 - RNA, 16 nt, Human
cauuuuuuaaaugcac

SEQ ID NO: 3522664 - RNA, 17 nt, Human
cauuuuuuaaggaaaca

SEQ ID NO: 3522665 - RNA, 16 nt, Human
cauuuuuuaauuuacu

SEQ ID NO: 3522666 - RNA, 21 nt, Human
cauuuuuuaauuuacuuguuu

SEQ ID NO: 3522667 - RNA, 22 nt, Human
cauuuuuuauggcugcauagua

SEQ ID NO: 3522668 - RNA, 20 nt, Human
cauuuuuugaaaugcugaaa

SEQ ID NO: 3522669 - RNA, 20 nt, Human
cauuuuuuuaauuuauuauu

SEQ ID NO: 3522670 - RNA, 17 nt, Human
cauuuuuuuccaggcug

SEQ ID NO: 3522671 - RNA, 13 nt, Human
ccacacccagccc

SEQ ID NO: 3522672 - RNA, 15 nt, Human
ccacacccagcccac

SEQ ID NO: 3522673 - RNA, 13 nt, Human
ccacacccagccu

SEQ ID NO: 3522674 - RNA, 21 nt, Human
ccacaccccaacacuuccagc

SEQ ID NO: 3522675 - RNA, 13 nt, Human
ccacacccccacc

SEQ ID NO: 3522676 - RNA, 11 nt, Human
ccacacccucc

SEQ ID NO: 3522677 - RNA, 18 nt, Human
ccacacccucucccagga

SEQ ID NO: 3522678 - RNA, 23 nt, Human
ccacacccuguacuguucugugu

SEQ ID NO: 3522679 - RNA, 15 nt, Human
ccacaccgcagaagc

SEQ ID NO: 3522680 - RNA, 18 nt, Human
ccacaccucaguucccuu

SEQ ID NO: 3522681 - RNA, 22 nt, Human
ccacaccucaguucccuuggcc

SEQ ID NO: 3522682 - RNA, 14 nt, Human
ccacaccuccacag

SEQ ID NO: 3522683 - RNA, 16 nt, Human
ccacaccucccugaac

SEQ ID NO: 3522684 - RNA, 14 nt, Human
ccacaccuccuggg

SEQ ID NO: 3522685 - RNA, 19 nt, Human
ccacaccuccuucccucuc

SEQ ID NO: 3522686 - RNA, 14 nt, Human
ccacaccucugcca

SEQ ID NO: 3522687 - RNA, 15 nt, Human
ccacaccucugccag

SEQ ID NO: 3522688 - RNA, 17 nt, Human
ccacaccuggcacugcu

SEQ ID NO: 3522689 - RNA, 18 nt, Human
ccacaccuggcccugggg

SEQ ID NO: 3522690 - RNA, 20 nt, Human
ccacaccuggcccuggggcc

SEQ ID NO: 3522691 - RNA, 17 nt, Human
ccacacgagaaccugaa

SEQ ID NO: 3522692 - RNA, 19 nt, Human
ccacacgcuccucccucug

SEQ ID NO: 3522693 - RNA, 16 nt, Human
ccacacuaaccugggu

SEQ ID NO: 3522694 - RNA, 22 nt, Human
ccacacuaaccuggguucccuu

SEQ ID NO: 3522695 - RNA, 20 nt, Human
ccacacuauuaccaugagaa

SEQ ID NO: 3522696 - RNA, 18 nt, Human
ccacacucagauccuccu

SEQ ID NO: 3522697 - RNA, 21 nt, Human
ccacacucagauccuccucau

SEQ ID NO: 3522698 - RNA, 18 nt, Human
ccacacucuuucuccugc

SEQ ID NO: 3522699 - RNA, 19 nt, Human
cguggagagcuaggagcaa

SEQ ID NO: 3522700 - RNA, 15 nt, Human
cguggagaugucuuc

SEQ ID NO: 3522701 - RNA, 16 nt, Human
cguggagaugucuucg

SEQ ID NO: 3522702 - RNA, 18 nt, Human
cguggagcagaaucagua

SEQ ID NO: 3522703 - RNA, 22 nt, Human
cguggagcgggguaugaagagc

SEQ ID NO: 3522704 - RNA, 15 nt, Human
cguggagcugccuga

SEQ ID NO: 3522705 - RNA, 17 nt, Human
cguggaggaggaaggca

SEQ ID NO: 3522706 - RNA, 23 nt, Human
cguggagggguaggggcugggaa

SEQ ID NO: 3522707 - RNA, 17 nt, Human
cguggauucgcuugagu

SEQ ID NO: 3522708 - RNA, 17 nt, Human
cguggauugcacguggc

SEQ ID NO: 3522709 - RNA, 17 nt, Human
cguggcaaauauaaaac

SEQ ID NO: 3522710 - RNA, 18 nt, Human
cguggcaaauauaaaacu

SEQ ID NO: 3522711 - RNA, 16 nt, Human
cguggcauagcccaga

SEQ ID NO: 3522712 - RNA, 19 nt, Human
cguggcauguggccugugg

SEQ ID NO: 3522713 - RNA, 11 nt, Human
cguggccagcc

SEQ ID NO: 3522714 - RNA, 17 nt, Human
cguggccaucccuguga

SEQ ID NO: 3522715 - RNA, 19 nt, Human
cguggccaucccugugagg

SEQ ID NO: 3522716 - RNA, 13 nt, Human
cguggcccaaggc

SEQ ID NO: 3522717 - RNA, 15 nt, Human
cguggcccagagaag

SEQ ID NO: 3522718 - RNA, 16 nt, Human
cguggcccagagaagc

SEQ ID NO: 3522719 - RNA, 12 nt, Human
cguggccccagc

SEQ ID NO: 3522720 - RNA, 21 nt, Human
cguggccccagccuggcccag

SEQ ID NO: 3522721 - RNA, 23 nt, Human
cguggccccagccuggcccagcu

SEQ ID NO: 3522722 - RNA, 15 nt, Human
cguggcccugcccuc

SEQ ID NO: 3522723 - RNA, 20 nt, Human
cguggcccuuccuggacagc

SEQ ID NO: 3522724 - RNA, 18 nt, Human
cguggcucagccagcacu

SEQ ID NO: 3522725 - RNA, 14 nt, Human
cguggcugcuucaa

SEQ ID NO: 3522726 - RNA, 19 nt, Human
cguggcuucccgcucagcc

SEQ ID NO: 3522727 - RNA, 20 nt, Human
cguggcuucccgcucagccc

SEQ ID NO: 3522728 - RNA, 21 nt, Human
cguggcuucccgcucagcccu

SEQ ID NO: 3522729 - RNA, 22 nt, Human
cgugggaaccccccucccaccc

SEQ ID NO: 3522730 - RNA, 13 nt, Human
cgugggccauggc

SEQ ID NO: 3522731 - RNA, 15 nt, Human
cgugggcuccccucu

SEQ ID NO: 3522732 - RNA, 19 nt, Human
cgugggcuccccucuuccu

SEQ ID NO: 3522733 - RNA, 12 nt, Human
cgugggcucccg

SEQ ID NO: 3522734 - RNA, 20 nt, Human
cgugggcucccguguuuugu

SEQ ID NO: 3522735 - RNA, 13 nt, Human
cgugggcucccug

SEQ ID NO: 3522736 - RNA, 17 nt, Human
cgugggcucccugacug

SEQ ID NO: 3522737 - RNA, 16 nt, Human
cgugggggggcgugga

SEQ ID NO: 3522738 - RNA, 18 nt, Human
cguggggugugcugggag

SEQ ID NO: 3522739 - RNA, 22 nt, Human
cgugggucuucagggggccagg

SEQ ID NO: 3522740 - RNA, 15 nt, Human
cguggucacugcugu

SEQ ID NO: 3522741 - RNA, 16 nt, Human
cguggucacugcuguc

SEQ ID NO: 3522742 - RNA, 20 nt, Human
cgugguggacaugcacagcu

SEQ ID NO: 3522743 - RNA, 17 nt, Human
cgugguggucccugggu

SEQ ID NO: 3522744 - RNA, 18 nt, Human
cgugguguuauuuaaaga

SEQ ID NO: 3522745 - RNA, 21 nt, Human
cgugguugggaacacagcauu

SEQ ID NO: 3522746 - RNA, 18 nt, Human
cguguacuggcuccucug

SEQ ID NO: 3522747 - RNA, 19 nt, Human
cguguaguguccauuuugu

SEQ ID NO: 3522748 - RNA, 14 nt, Human
cguguauccugggg

SEQ ID NO: 3522749 - RNA, 16 nt, Human
cguguccccggccuca

SEQ ID NO: 3522750 - RNA, 19 nt, Human
cguguccccugacagggcc

SEQ ID NO: 3522751 - RNA, 17 nt, Human
cguguccgacucuucug

SEQ ID NO: 3522752 - RNA, 13 nt, Human
cgugucuggcaca

SEQ ID NO: 3522753 - RNA, 14 nt, Human
cgugucuggcacag

SEQ ID NO: 3522754 - RNA, 13 nt, Human
cgugucuuccacu

SEQ ID NO: 3522755 - RNA, 22 nt, Human
cgugugagaagugaaugcuggg

SEQ ID NO: 3522756 - RNA, 11 nt, Human
cgugugauuuu

SEQ ID NO: 3522757 - RNA, 18 nt, Human
cgugugauuuuucuggag

SEQ ID NO: 3522758 - RNA, 16 nt, Human
cgugugcgugcaugug

SEQ ID NO: 3522759 - RNA, 14 nt, Human
cgugugcuguguuu

SEQ ID NO: 3522760 - RNA, 20 nt, Human
cguguggcucacguguguga

SEQ ID NO: 3522761 - RNA, 19 nt, Human
cgugugggacccgccgcgg

SEQ ID NO: 3522762 - RNA, 15 nt, Human
cguguguagaguuaa

SEQ ID NO: 3522763 - RNA, 16 nt, Human
cguguucuccuuuucc

SEQ ID NO: 3522764 - RNA, 14 nt, Human
cguguuucugacuc

SEQ ID NO: 3522765 - RNA, 11 nt, Human
cguguuugcac

SEQ ID NO: 3522766 - RNA, 16 nt, Human
cguguuugucucuucu

SEQ ID NO: 3522767 - RNA, 11 nt, Human
cguuaacauug

SEQ ID NO: 3522768 - RNA, 17 nt, Human
cguuaacuguguaugua

SEQ ID NO: 3522769 - RNA, 14 nt, Human
cguuaccaggcagg

SEQ ID NO: 3522770 - RNA, 23 nt, Human
cguuacucagggcuccucccagc

SEQ ID NO: 3522771 - RNA, 15 nt, Human
cguuagcuccugugg

SEQ ID NO: 3522772 - RNA, 16 nt, Human
cguuagcuccuguggc

SEQ ID NO: 3522773 - RNA, 16 nt, Human
cguuagggaagagaaa

SEQ ID NO: 3522774 - RNA, 16 nt, Human
cguuaguaaucuguau

SEQ ID NO: 3522775 - RNA, 20 nt, Human
cguuagucgugagcucuugu

SEQ ID NO: 3522776 - RNA, 18 nt, Human
cguuauaaagugugccac

SEQ ID NO: 3522777 - RNA, 16 nt, Human
cguuaugguguuucuc

SEQ ID NO: 3522778 - RNA, 16 nt, Human
cguuauuauaauugua

SEQ ID NO: 3522779 - RNA, 15 nt, Human
cguuauuguugacuu

SEQ ID NO: 3522780 - RNA, 23 nt, Human
cguucauggaacgcguugaaauu

SEQ ID NO: 3522781 - RNA, 14 nt, Human
cguuccacaguugc

SEQ ID NO: 3522782 - RNA, 16 nt, Human
cguuccacaguugcca

SEQ ID NO: 3522783 - RNA, 22 nt, Human
cguuccacaguugccaccaccu

SEQ ID NO: 3522784 - RNA, 11 nt, Human
cguuccagccg

SEQ ID NO: 3522785 - RNA, 21 nt, Human
cguuccagccggcauggcugg

SEQ ID NO: 3522786 - RNA, 13 nt, Human
cguuccaguuccc

SEQ ID NO: 3522787 - RNA, 23 nt, Human
cguuccuagagaagacaggcugg

SEQ ID NO: 3522788 - RNA, 20 nt, Human
cguuccuauugucauuaaag

SEQ ID NO: 3522789 - RNA, 21 nt, Human
cguuccugacaucacagcagc

SEQ ID NO: 3522790 - RNA, 18 nt, Human
cguuccuuacugcagaau

SEQ ID NO: 3522791 - RNA, 22 nt, Human
cguuccuucaaagcaaaugucu

SEQ ID NO: 3522792 - RNA, 14 nt, Human
cguucucacaccca

SEQ ID NO: 3522793 - RNA, 16 nt, Human
cguucucacacccacc

SEQ ID NO: 3522794 - RNA, 12 nt, Human
cguucucccugg

SEQ ID NO: 3522795 - RNA, 19 nt, Human
cguucucucuuugcaugga

SEQ ID NO: 3522796 - RNA, 14 nt, Human
cguucugcucauca

SEQ ID NO: 3522797 - RNA, 12 nt, Human
cguucuguuuac

SEQ ID NO: 3522798 - RNA, 20 nt, Human
cguucuuaggcugcugggau

SEQ ID NO: 3522799 - RNA, 12 nt, Human
cguucuuguaau

SEQ ID NO: 3522800 - RNA, 18 nt, Human
cguucuuguaauuuuaca

SEQ ID NO: 3522801 - RNA, 19 nt, Human
cguucuuguucuguuuugu

SEQ ID NO: 3522802 - RNA, 19 nt, Human
cguugaaguugacucugcu

SEQ ID NO: 3522803 - RNA, 16 nt, Human
cguugaggaugaggcc

SEQ ID NO: 3522804 - RNA, 19 nt, Human
cguugaggaugaggccgcu

SEQ ID NO: 3522805 - RNA, 18 nt, Human
cguugcugacuuagaauc

SEQ ID NO: 3522806 - RNA, 11 nt, Human
cguugcugugg

SEQ ID NO: 3522807 - RNA, 18 nt, Human
cguuggaauuaaaacaau

SEQ ID NO: 3522808 - RNA, 23 nt, Human
cguuggacuuuucguuaacauug

SEQ ID NO: 3522809 - RNA, 21 nt, Human
cguugggccccagccuucuuu

SEQ ID NO: 3522810 - RNA, 13 nt, Human
cguuggucucugc

SEQ ID NO: 3522811 - RNA, 23 nt, Human
cguuggucucugcauuuuucugc

SEQ ID NO: 3522812 - RNA, 16 nt, Human
cguuguccucagcccc

SEQ ID NO: 3522813 - RNA, 16 nt, Human
cguugucucccuggcc

SEQ ID NO: 3522814 - RNA, 17 nt, Human
cguugucucccuggccc

SEQ ID NO: 3522815 - RNA, 17 nt, Human
cguugucuguggauggu

SEQ ID NO: 3522816 - RNA, 11 nt, Human
cguugugaggg

SEQ ID NO: 3522817 - RNA, 21 nt, Human
cuaaauaugaacccuuuguuu

SEQ ID NO: 3522818 - RNA, 23 nt, Human
cuaaauaugaacccuuuguuucu

SEQ ID NO: 3522819 - RNA, 22 nt, Human
cuaaauauggacugcucaggaa

SEQ ID NO: 3522820 - RNA, 20 nt, Human
cuaaauauuaugagaugcug

SEQ ID NO: 3522821 - RNA, 22 nt, Human
cuaaauauuuccuuaaacugug

SEQ ID NO: 3522822 - RNA, 14 nt, Human
cuaaaucagagaca

SEQ ID NO: 3522823 - RNA, 14 nt, Human
cuaaaucuauuuau

SEQ ID NO: 3522824 - RNA, 21 nt, Human
cuaaaucuauuuauuaauauu

SEQ ID NO: 3522825 - RNA, 18 nt, Human
cuaaaucuccuauuuuuu

SEQ ID NO: 3522826 - RNA, 22 nt, Human
cuaaaucuguaagcucuuugaa

SEQ ID NO: 3522827 - RNA, 20 nt, Human
cuaaaucuuuuauaggauuu

SEQ ID NO: 3522828 - RNA, 22 nt, Human
cuaaaugaaaaucgugacaaca

SEQ ID NO: 3522829 - RNA, 16 nt, Human
cuaaaugaauguuuac

SEQ ID NO: 3522830 - RNA, 14 nt, Human
cuaaaugcccugcu

SEQ ID NO: 3522831 - RNA, 17 nt, Human
cuaaaugccuaauaaac

SEQ ID NO: 3522832 - RNA, 17 nt, Human
cuaaaugccuaguuuuu

SEQ ID NO: 3522833 - RNA, 21 nt, Human
cuaaaugccuaguuuuuagua

SEQ ID NO: 3522834 - RNA, 16 nt, Human
cuaaauggaaccacuc

SEQ ID NO: 3522835 - RNA, 17 nt, Human
cuaaauggaaccacucu

SEQ ID NO: 3522836 - RNA, 18 nt, Human
cuaaauggaaccacucua

SEQ ID NO: 3522837 - RNA, 19 nt, Human
cuaaauggccucauguggc

SEQ ID NO: 3522838 - RNA, 20 nt, Human
cuaaauggucgcccaggaga

SEQ ID NO: 3522839 - RNA, 15 nt, Human
cuaaauguaacaguc

SEQ ID NO: 3522840 - RNA, 16 nt, Human
cuaaauguaacagucu

SEQ ID NO: 3522841 - RNA, 18 nt, Human
cuaaauguaacagucuga

SEQ ID NO: 3522842 - RNA, 18 nt, Human
cuaaauguaagaaucauu

SEQ ID NO: 3522843 - RNA, 22 nt, Human
cuaaauguaagaaucauuguaa

SEQ ID NO: 3522844 - RNA, 22 nt, Human
cuaaauguaguucugcuccaga

SEQ ID NO: 3522845 - RNA, 21 nt, Human
cuaaaugugcaauagaaggug

SEQ ID NO: 3522846 - RNA, 22 nt, Human
cuaaauguucuaugguuaugaa

SEQ ID NO: 3522847 - RNA, 14 nt, Human
cuaaauuccacacu

SEQ ID NO: 3522848 - RNA, 17 nt, Human
cuaaauucuuuauuucu

SEQ ID NO: 3522849 - RNA, 19 nt, Human
cuaaauucuuucauuuuag

SEQ ID NO: 3522850 - RNA, 17 nt, Human
cuaaauugaaaccugga

SEQ ID NO: 3522851 - RNA, 13 nt, Human
cuaaauugaauaa

SEQ ID NO: 3522852 - RNA, 14 nt, Human
cuaaauuguaaacu

SEQ ID NO: 3522853 - RNA, 19 nt, Human
cuaaauuuaaauuuaaaga

SEQ ID NO: 3522854 - RNA, 13 nt, Human
cgcuggcucccca

SEQ ID NO: 3522855 - RNA, 14 nt, Human
cgcuggcugggggc

SEQ ID NO: 3522856 - RNA, 23 nt, Human
cgcugggcacuucccugcugccu

SEQ ID NO: 3522857 - RNA, 22 nt, Human
cgcugggugguacccucuggag

SEQ ID NO: 3522858 - RNA, 12 nt, Human
cgcuggugcuga

SEQ ID NO: 3522859 - RNA, 20 nt, Human
cgcugucaggauugcgagag

SEQ ID NO: 3522860 - RNA, 19 nt, Human
cgcugugagccccuggucc

SEQ ID NO: 3522861 - RNA, 15 nt, Human
cgcugugcugcccug

SEQ ID NO: 3522862 - RNA, 19 nt, Human
cgcugugcugcccugccca

SEQ ID NO: 3522863 - RNA, 21 nt, Human
cgcugugcugcccugcccacc

SEQ ID NO: 3522864 - RNA, 13 nt, Human
cgcuucccccaua

SEQ ID NO: 3522865 - RNA, 15 nt, Human
cgcuucccuccugcc

SEQ ID NO: 3522866 - RNA, 14 nt, Human
cgcuucugccugca

SEQ ID NO: 3522867 - RNA, 20 nt, Human
cgcuucuguguaucucuuuc

SEQ ID NO: 3522868 - RNA, 16 nt, Human
cgcuucuugccucugu

SEQ ID NO: 3522869 - RNA, 17 nt, Human
cgcuucuugccucugug

SEQ ID NO: 3522870 - RNA, 21 nt, Human
cgcuugccucggcuccugcug

SEQ ID NO: 3522871 - RNA, 22 nt, Human
cgcuuggagcuauuuuccaggc

SEQ ID NO: 3522872 - RNA, 16 nt, Human
cgcuuggcuccaugcu

SEQ ID NO: 3522873 - RNA, 19 nt, Human
cgcuuguagaacucacucu

SEQ ID NO: 3522874 - RNA, 17 nt, Human
cgcuuguccagcgccua

SEQ ID NO: 3522875 - RNA, 18 nt, Human
cgcuugugcagaaaacau

SEQ ID NO: 3522876 - RNA, 17 nt, Human
cgcuuucuacacuguau

SEQ ID NO: 3522877 - RNA, 13 nt, Human
cgcuuucuaugua

SEQ ID NO: 3522878 - RNA, 21 nt, Human
cggaaaacgguggaggccagg

SEQ ID NO: 3522879 - RNA, 20 nt, Human
cggaaaagguuuuauuuugu

SEQ ID NO: 3522880 - RNA, 15 nt, Human
cggaaaccuuggugu

SEQ ID NO: 3522881 - RNA, 18 nt, Human
cggaaagaagagcgagag

SEQ ID NO: 3522882 - RNA, 13 nt, Human
cggaaagcagcuc

SEQ ID NO: 3522883 - RNA, 12 nt, Human
cggaacagcaga

SEQ ID NO: 3522884 - RNA, 17 nt, Human
cggaacccaagcuuaga

SEQ ID NO: 3522885 - RNA, 19 nt, Human
cggaacccaagcuuagaac

SEQ ID NO: 3522886 - RNA, 18 nt, Human
cggaaccugugagcugca

SEQ ID NO: 3522887 - RNA, 17 nt, Human
cggaacugcaugcugcu

SEQ ID NO: 3522888 - RNA, 17 nt, Human
cggaacuguccuuuccu

SEQ ID NO: 3522889 - RNA, 22 nt, Human
cggaagaagagaucaggaagag

SEQ ID NO: 3522890 - RNA, 20 nt, Human
cggaagaccugaagaguggu

SEQ ID NO: 3522891 - RNA, 13 nt, Human
cggaagagccuug

SEQ ID NO: 3522892 - RNA, 22 nt, Human
cggaagcagugccuuccauaau

SEQ ID NO: 3522893 - RNA, 14 nt, Human
cggaagcuccuggu

SEQ ID NO: 3522894 - RNA, 18 nt, Human
cggaaggaccuauguuug

SEQ ID NO: 3522895 - RNA, 12 nt, Human
cggaagggcaca

SEQ ID NO: 3522896 - RNA, 18 nt, Human
cggaaggguaaacaauau

SEQ ID NO: 3522897 - RNA, 14 nt, Human
cggaauaguuggcu

SEQ ID NO: 3522898 - RNA, 16 nt, Human
cggaauaguuggcuag

SEQ ID NO: 3522899 - RNA, 18 nt, Human
cggaauccuguccucagc

SEQ ID NO: 3522900 - RNA, 22 nt, Human
cggaauccugucgauuagacug

SEQ ID NO: 3522901 - RNA, 13 nt, Human
cggaauuuaccug

SEQ ID NO: 3522902 - RNA, 13 nt, Human
cggacaaaauauc

SEQ ID NO: 3522903 - RNA, 12 nt, Human
cggacaauaaac

SEQ ID NO: 3522904 - RNA, 14 nt, Human
cggacacccccucg

SEQ ID NO: 3522905 - RNA, 15 nt, Human
cggacacuccuagag

SEQ ID NO: 3522906 - RNA, 16 nt, Human
cggacagccacggcca

SEQ ID NO: 3522907 - RNA, 18 nt, Human
cggacagccacggccagg

SEQ ID NO: 3522908 - RNA, 21 nt, Human
cggacagccacggccaggcca

SEQ ID NO: 3522909 - RNA, 21 nt, Human
cggacaguuccagaaguguga

SEQ ID NO: 3522910 - RNA, 19 nt, Human
cggaccaaagggagucugc

SEQ ID NO: 3522911 - RNA, 15 nt, Human
cggaccccagccauc

SEQ ID NO: 3522912 - RNA, 14 nt, Human
cggaccccagcugu

SEQ ID NO: 3522913 - RNA, 20 nt, Human
cggacccggaggccgaggcc

SEQ ID NO: 3522914 - RNA, 21 nt, Human
cggaccuuguagugagccgag

SEQ ID NO: 3522915 - RNA, 14 nt, Human
cggacgcuggcucc

SEQ ID NO: 3522916 - RNA, 15 nt, Human
cggacgcuggcuccc

SEQ ID NO: 3522917 - RNA, 14 nt, Human
cggacguuccagcc

SEQ ID NO: 3522918 - RNA, 15 nt, Human
cggacguuccagccg

SEQ ID NO: 3522919 - RNA, 16 nt, Human
cggacguuccagccgg

SEQ ID NO: 3522920 - RNA, 21 nt, Human
cggacuaagccuaccugcucu

SEQ ID NO: 3522921 - RNA, 15 nt, Human
cggacuggugcccuc

SEQ ID NO: 3522922 - RNA, 16 nt, Human
cggacuggugcccucc

SEQ ID NO: 3522923 - RNA, 22 nt, Human
cggacuuagaaaaccagcucag

SEQ ID NO: 3522924 - RNA, 14 nt, Human
cggacuuuucugca

SEQ ID NO: 3522925 - RNA, 17 nt, Human
cggagaaaggaagggcu

SEQ ID NO: 3522926 - RNA, 12 nt, Human
cggagacagggu

SEQ ID NO: 3522927 - RNA, 15 nt, Human
cggagacagugaucu

SEQ ID NO: 3522928 - RNA, 13 nt, Human
cggagagccagcu

SEQ ID NO: 3522929 - RNA, 19 nt, Human
cggagaggaagagacacuc

SEQ ID NO: 3522930 - RNA, 21 nt, Human
cggagaguacagugagccaag

SEQ ID NO: 3522931 - RNA, 16 nt, Human
cggagcaucccggagg

SEQ ID NO: 3522932 - RNA, 13 nt, Human
cggagccacuccu

SEQ ID NO: 3522933 - RNA, 21 nt, Human
cggagccacuccucugacuca

SEQ ID NO: 3522934 - RNA, 22 nt, Human
cggagccccaggccucuguguc

SEQ ID NO: 3522935 - RNA, 20 nt, Human
cggagccgggaaagaagagc

SEQ ID NO: 3522936 - RNA, 22 nt, Human
cggagccucauccgaggcaggg

SEQ ID NO: 3522937 - RNA, 22 nt, Human
cggagcugccccucucugggcc

SEQ ID NO: 3522938 - RNA, 12 nt, Human
cggaggaaaucu

SEQ ID NO: 3522939 - RNA, 19 nt, Human
cggaggaaggaggacccag

SEQ ID NO: 3522940 - RNA, 21 nt, Human
cggaggaaggaggacccagga

SEQ ID NO: 3522941 - RNA, 15 nt, Human
cggaggaccagggcu

SEQ ID NO: 3522942 - RNA, 14 nt, Human
cggaggacucacca

SEQ ID NO: 3522943 - RNA, 15 nt, Human
cggaggccccaaagg

SEQ ID NO: 3522944 - RNA, 17 nt, Human
cggaggccccacugaug

SEQ ID NO: 3522945 - RNA, 18 nt, Human
cggaggccugcgacccug

SEQ ID NO: 3522946 - RNA, 22 nt, Human
cggaggccugcgacccuggggg

SEQ ID NO: 3522947 - RNA, 17 nt, Human
cggaggcggugggccug

SEQ ID NO: 3522948 - RNA, 20 nt, Human
cggaggcugaggcaggagaa

SEQ ID NO: 3522949 - RNA, 13 nt, Human
cggaggcugcccc

SEQ ID NO: 3522950 - RNA, 19 nt, Human
cggaggcugcccccggccc

SEQ ID NO: 3522951 - RNA, 22 nt, Human
cggaggcugcccccggcccccu

SEQ ID NO: 3522952 - RNA, 20 nt, Human
cggaggcuugucagagcugg

SEQ ID NO: 3522953 - RNA, 21 nt, Human
cggaggcuugucagagcuggg

SEQ ID NO: 3522954 - RNA, 11 nt, Human
cggaggggagu

SEQ ID NO: 3522955 - RNA, 18 nt, Human
cggaggggccuggcagcc

SEQ ID NO: 3522956 - RNA, 22 nt, Human
cggagguugcagugagcugaga

SEQ ID NO: 3522957 - RNA, 18 nt, Human
cggaguaucugggaacug

SEQ ID NO: 3522958 - RNA, 20 nt, Human
cggaguccacucccagugcu

SEQ ID NO: 3522959 - RNA, 21 nt, Human
cggagucccaccuuggcugca

SEQ ID NO: 3522960 - RNA, 22 nt, Human
cggagucccaccuuggcugcag

SEQ ID NO: 3522961 - RNA, 16 nt, Human
cggcuggccuggcccc

SEQ ID NO: 3522962 - RNA, 21 nt, Human
cggcuggcuccccugcagccc

SEQ ID NO: 3522963 - RNA, 16 nt, Human
cggcugggcacacgcc

SEQ ID NO: 3522964 - RNA, 17 nt, Human
cggcugggcacacgccu

SEQ ID NO: 3522965 - RNA, 16 nt, Human
cggcuggggucccagc

SEQ ID NO: 3522966 - RNA, 18 nt, Human
cggcuggggucccagcag

SEQ ID NO: 3522967 - RNA, 15 nt, Human
cggcuucaugccagc

SEQ ID NO: 3522968 - RNA, 16 nt, Human
cggcuucaugccagcu

SEQ ID NO: 3522969 - RNA, 14 nt, Human
cggcuuccuuuccc

SEQ ID NO: 3522970 - RNA, 15 nt, Human
cggcuuccuuuccca

SEQ ID NO: 3522971 - RNA, 19 nt, Human
cggcuuccuuucccaagcc

SEQ ID NO: 3522972 - RNA, 20 nt, Human
cggcuucguuagaccgcucu

SEQ ID NO: 3522973 - RNA, 16 nt, Human
cggcuugccacacccc

SEQ ID NO: 3522974 - RNA, 16 nt, Human
cggcuuuucucagcug

SEQ ID NO: 3522975 - RNA, 20 nt, Human
cgggaaagccagugacucca

SEQ ID NO: 3522976 - RNA, 22 nt, Human
cgggaaagccagugacuccagg

SEQ ID NO: 3522977 - RNA, 17 nt, Human
cgggaacaugcccccug

SEQ ID NO: 3522978 - RNA, 16 nt, Human
cgggaaccaagcagga

SEQ ID NO: 3522979 - RNA, 16 nt, Human
cgggaaccuccccagc

SEQ ID NO: 3522980 - RNA, 22 nt, Human
cgggaaccuccccagccugcgc

SEQ ID NO: 3522981 - RNA, 12 nt, Human
cgggaagagagg

SEQ ID NO: 3522982 - RNA, 14 nt, Human
cgggaagagaggag

SEQ ID NO: 3522983 - RNA, 16 nt, Human
cgggaaggucaccagc

SEQ ID NO: 3522984 - RNA, 17 nt, Human
cgggaauauuguuucuu

SEQ ID NO: 3522985 - RNA, 18 nt, Human
cgggaauuuucaucuagg

SEQ ID NO: 3522986 - RNA, 23 nt, Human
cgggacaucacagggugggccuc

SEQ ID NO: 3522987 - RNA, 22 nt, Human
cgggacccagggcccucggugg

SEQ ID NO: 3522988 - RNA, 23 nt, Human
cgggaccccgagccuggcuccaa

SEQ ID NO: 3522989 - RNA, 15 nt, Human
cgggacguggcaccu

SEQ ID NO: 3522990 - RNA, 19 nt, Human
cgggacguggcaccuccuc

SEQ ID NO: 3522991 - RNA, 16 nt, Human
cgggacucaggcggga

SEQ ID NO: 3522992 - RNA, 22 nt, Human
cgggacucaggcgggacagugc

SEQ ID NO: 3522993 - RNA, 21 nt, Human
cgggagaaucaugugaacccg

SEQ ID NO: 3522994 - RNA, 19 nt, Human
cgggagccucccugccuca

SEQ ID NO: 3522995 - RNA, 17 nt, Human
cgggagcgguggcccug

SEQ ID NO: 3522996 - RNA, 18 nt, Human
cgggaggaauuucugagu

SEQ ID NO: 3522997 - RNA, 13 nt, Human
cgggaggaggugu

SEQ ID NO: 3522998 - RNA, 20 nt, Human
cgggaggcagagguuguagu

SEQ ID NO: 3522999 - RNA, 17 nt, Human
cgggaggcugagacagg

SEQ ID NO: 3523000 - RNA, 17 nt, Human
cgggaggcugaggcagg

SEQ ID NO: 3523001 - RNA, 15 nt, Human
cgggaggggcccgcu

SEQ ID NO: 3523002 - RNA, 16 nt, Human
cgggaugguucuggcu

SEQ ID NO: 3523003 - RNA, 17 nt, Human
cgggcaaaugccagggc

SEQ ID NO: 3523004 - RNA, 18 nt, Human
cgggcaaaugccagggcc

SEQ ID NO: 3523005 - RNA, 20 nt, Human
cgggcaaaugccagggcccg

SEQ ID NO: 3523006 - RNA, 15 nt, Human
cgggcacaauaaauc

SEQ ID NO: 3523007 - RNA, 14 nt, Human
cgggcacagcugug

SEQ ID NO: 3523008 - RNA, 14 nt, Human
cgggcacucagaag

SEQ ID NO: 3523009 - RNA, 14 nt, Human
cgggcagagggcug

SEQ ID NO: 3523010 - RNA, 15 nt, Human
cgggcagagggcugg

SEQ ID NO: 3523011 - RNA, 19 nt, Human
cgggcagagggcuggaggc

SEQ ID NO: 3523012 - RNA, 22 nt, Human
cgggcagagggcuggaggccca

SEQ ID NO: 3523013 - RNA, 14 nt, Human
cgggcagcacagca

SEQ ID NO: 3523014 - RNA, 23 nt, Human
cgggcagccuggcucccaggaca

SEQ ID NO: 3523015 - RNA, 16 nt, Human
cgggcagggcucccac

SEQ ID NO: 3523016 - RNA, 15 nt, Human
cgggcaucauucucu

SEQ ID NO: 3523017 - RNA, 14 nt, Human
cgggcaucuuuggg

SEQ ID NO: 3523018 - RNA, 12 nt, Human
ccaccagugccu

SEQ ID NO: 3523019 - RNA, 19 nt, Human
ccaccagugccucucccug

SEQ ID NO: 3523020 - RNA, 17 nt, Human
ccaccauaugaauugua

SEQ ID NO: 3523021 - RNA, 20 nt, Human
ccaccauaugaauuguacag

SEQ ID NO: 3523022 - RNA, 20 nt, Human
ccaccaucaagccaccaaca

SEQ ID NO: 3523023 - RNA, 14 nt, Human
ccaccauccugcag

SEQ ID NO: 3523024 - RNA, 17 nt, Human
ccaccaugcccagucga

SEQ ID NO: 3523025 - RNA, 16 nt, Human
ccaccaugccucacua

SEQ ID NO: 3523026 - RNA, 22 nt, Human
ccaccauggcuaaggcaccagc

SEQ ID NO: 3523027 - RNA, 16 nt, Human
ccaccauuccuggaaa

SEQ ID NO: 3523028 - RNA, 21 nt, Human
ccaccauuccuggaaaccaca

SEQ ID NO: 3523029 - RNA, 17 nt, Human
ccaccauuuggcauccc

SEQ ID NO: 3523030 - RNA, 21 nt, Human
ccaccauuuggcaucccuggg

SEQ ID NO: 3523031 - RNA, 21 nt, Human
ccacccaaccccaagccagcc

SEQ ID NO: 3523032 - RNA, 13 nt, Human
ccacccaacccua

SEQ ID NO: 3523033 - RNA, 19 nt, Human
ccacccaacccuaucuccu

SEQ ID NO: 3523034 - RNA, 16 nt, Human
ccacccaagggccugg

SEQ ID NO: 3523035 - RNA, 19 nt, Human
ccacccaagggccuggccu

SEQ ID NO: 3523036 - RNA, 14 nt, Human
ccacccaccucagc

SEQ ID NO: 3523037 - RNA, 15 nt, Human
ccacccaccucagcc

SEQ ID NO: 3523038 - RNA, 13 nt, Human
ccacccagcccau

SEQ ID NO: 3523039 - RNA, 12 nt, Human
ccacccaggagg

SEQ ID NO: 3523040 - RNA, 18 nt, Human
ccacccaggagggagggg

SEQ ID NO: 3523041 - RNA, 23 nt, Human
ccacccaggggaaugaucucuga

SEQ ID NO: 3523042 - RNA, 17 nt, Human
ccacccaucgcugugug

SEQ ID NO: 3523043 - RNA, 16 nt, Human
ccaccccaaccugcuc

SEQ ID NO: 3523044 - RNA, 15 nt, Human
ccaccccaagagaac

SEQ ID NO: 3523045 - RNA, 15 nt, Human
ccaccccacccacuu

SEQ ID NO: 3523046 - RNA, 13 nt, Human
ccaccccaggacg

SEQ ID NO: 3523047 - RNA, 19 nt, Human
ccaccccagugcacccacu

SEQ ID NO: 3523048 - RNA, 18 nt, Human
ccaccccauccaguucau

SEQ ID NO: 3523049 - RNA, 23 nt, Human
ccaccccaugucaccggauccug

SEQ ID NO: 3523050 - RNA, 13 nt, Human
ccacccccacacc

SEQ ID NO: 3523051 - RNA, 14 nt, Human
ccacccccacaccu

SEQ ID NO: 3523052 - RNA, 15 nt, Human
ccacccccagccccg

SEQ ID NO: 3523053 - RNA, 16 nt, Human
ccacccccagcucaau

SEQ ID NO: 3523054 - RNA, 18 nt, Human
ccacccccugcccugcac

SEQ ID NO: 3523055 - RNA, 22 nt, Human
ccacccccuucagugcccacca

SEQ ID NO: 3523056 - RNA, 13 nt, Human
ccacccccuucuc

SEQ ID NO: 3523057 - RNA, 23 nt, Human
ccaccccgagggcugagccuggu

SEQ ID NO: 3523058 - RNA, 16 nt, Human
ccaccccgccugcccu

SEQ ID NO: 3523059 - RNA, 18 nt, Human
ccaccccgggcucucugc

SEQ ID NO: 3523060 - RNA, 20 nt, Human
ccaccccguagauucccauc

SEQ ID NO: 3523061 - RNA, 16 nt, Human
ccaccccuaccccugg

SEQ ID NO: 3523062 - RNA, 19 nt, Human
ccaccccucaacaccucug

SEQ ID NO: 3523063 - RNA, 15 nt, Human
ccaccccuccuuccu

SEQ ID NO: 3523064 - RNA, 14 nt, Human
ccaccccugccucc

SEQ ID NO: 3523065 - RNA, 12 nt, Human
ccaccccugugc

SEQ ID NO: 3523066 - RNA, 13 nt, Human
ccaccccugugcu

SEQ ID NO: 3523067 - RNA, 13 nt, Human
ccaccccuuccug

SEQ ID NO: 3523068 - RNA, 13 nt, Human
ccaccccuugcuc

SEQ ID NO: 3523069 - RNA, 23 nt, Human
ccaccccuuucuagaccaauaaa

SEQ ID NO: 3523070 - RNA, 13 nt, Human
ccacccgaugcug

SEQ ID NO: 3523071 - RNA, 14 nt, Human
ccacccgaugcugc

SEQ ID NO: 3523072 - RNA, 17 nt, Human
ccacccgguucaguguu

SEQ ID NO: 3523073 - RNA, 20 nt, Human
ccacccgguucaguguuucu

SEQ ID NO: 3523074 - RNA, 14 nt, Human
ccacccucacuggc

SEQ ID NO: 3523075 - RNA, 13 nt, Human
ccacccucagcac

SEQ ID NO: 3523076 - RNA, 17 nt, Human
ccacccuccaccuucca

SEQ ID NO: 3523077 - RNA, 17 nt, Human
ccacccucccuggagug

SEQ ID NO: 3523078 - RNA, 13 nt, Human
ccacccuccuggc

SEQ ID NO: 3523079 - RNA, 17 nt, Human
ccacccuccuggccuca

SEQ ID NO: 3523080 - RNA, 23 nt, Human
ccacccuccuggccucagacugc

SEQ ID NO: 3523081 - RNA, 12 nt, Human
ccacccuccugu

SEQ ID NO: 3523082 - RNA, 17 nt, Human
ccacccuccugucuucc

SEQ ID NO: 3523083 - RNA, 22 nt, Human
ccacccucggggauguguccug

SEQ ID NO: 3523084 - RNA, 22 nt, Human
ccacccucguggacaccugccc

SEQ ID NO: 3523085 - RNA, 21 nt, Human
ccacccugagccggccccagg

SEQ ID NO: 3523086 - RNA, 13 nt, Human
ccacccugccugc

SEQ ID NO: 3523087 - RNA, 16 nt, Human
ccacccugcugccuuc

SEQ ID NO: 3523088 - RNA, 18 nt, Human
ccacccugcugcuggugc

SEQ ID NO: 3523089 - RNA, 20 nt, Human
ccacccugcuuggcccaggg

SEQ ID NO: 3523090 - RNA, 12 nt, Human
ccacccugggcc

SEQ ID NO: 3523091 - RNA, 15 nt, Human
ccacccugggcccug

SEQ ID NO: 3523092 - RNA, 12 nt, Human
ccacccugggcu

SEQ ID NO: 3523093 - RNA, 16 nt, Human
ccacccugggcucugg

SEQ ID NO: 3523094 - RNA, 17 nt, Human
ccacccugggcucugug

SEQ ID NO: 3523095 - RNA, 20 nt, Human
ccacccugggcucugugggc

SEQ ID NO: 3523096 - RNA, 14 nt, Human
ccacccuguccccc

SEQ ID NO: 3523097 - RNA, 16 nt, Human
ccacccugucccccag

SEQ ID NO: 3523098 - RNA, 19 nt, Human
ccacccuguuccugcugcu

SEQ ID NO: 3523099 - RNA, 12 nt, Human
ccacccuugccc

SEQ ID NO: 3523100 - RNA, 13 nt, Human
ccacccuugccca

SEQ ID NO: 3523101 - RNA, 17 nt, Human
ccacccuuggccugucu

SEQ ID NO: 3523102 - RNA, 19 nt, Human
ccacccuuggccugucuca

SEQ ID NO: 3523103 - RNA, 15 nt, Human
ccacccuuugggggg

SEQ ID NO: 3523104 - RNA, 13 nt, Human
ccaccgcccagag

SEQ ID NO: 3523105 - RNA, 17 nt, Human
ccaccgcccagagaccc

SEQ ID NO: 3523106 - RNA, 13 nt, Human
ccaccgccuccua

SEQ ID NO: 3523107 - RNA, 13 nt, Human
cguucucccuggg

SEQ ID NO: 3523108 - RNA, 18 nt, Human
cguucugcuggccuggau

SEQ ID NO: 3523109 - RNA, 13 nt, Human
cguucuuguaauu

SEQ ID NO: 3523110 - RNA, 15 nt, Human
cguucuuguaauuuu

SEQ ID NO: 3523111 - RNA, 18 nt, Human
cguugaagaggaagggca

SEQ ID NO: 3523112 - RNA, 23 nt, Human
cguugcaaccacugcaauaucuu

SEQ ID NO: 3523113 - RNA, 12 nt, Human
cguugcaugucg

SEQ ID NO: 3523114 - RNA, 21 nt, Human
cguugcccccauuucugaggu

SEQ ID NO: 3523115 - RNA, 14 nt, Human
cguugcugugggaa

SEQ ID NO: 3523116 - RNA, 15 nt, Human
cguugcugugggaac

SEQ ID NO: 3523117 - RNA, 14 nt, Human
cguugcuuucacuc

SEQ ID NO: 3523118 - RNA, 17 nt, Human
cguuggaauuaaaacaa

SEQ ID NO: 3523119 - RNA, 14 nt, Human
cguuguaaaauaua

SEQ ID NO: 3523120 - RNA, 20 nt, Human
cguuguugcauguuugaaau

SEQ ID NO: 3523121 - RNA, 20 nt, Human
cguuguuuacuuaaagauuu

SEQ ID NO: 3523122 - RNA, 19 nt, Human
cguuuaaaguucuguguau

SEQ ID NO: 3523123 - RNA, 23 nt, Human
cguuuacaagcccccccuuccac

SEQ ID NO: 3523124 - RNA, 15 nt, Human
cguuuaccuagaaga

SEQ ID NO: 3523125 - RNA, 14 nt, Human
cguuuacuaugccu

SEQ ID NO: 3523126 - RNA, 15 nt, Human
cguuuagaccaagga

SEQ ID NO: 3523127 - RNA, 17 nt, Human
cguuucaguaauaaaac

SEQ ID NO: 3523128 - RNA, 18 nt, Human
cguuucaguaauaaaaca

SEQ ID NO: 3523129 - RNA, 23 nt, Human
cguuucagugucaaauaaacacu

SEQ ID NO: 3523130 - RNA, 22 nt, Human
cguuucauuuagucaugugacc

SEQ ID NO: 3523131 - RNA, 20 nt, Human
cguuuccagguguuuauagu

SEQ ID NO: 3523132 - RNA, 11 nt, Human
cguuuccauca

SEQ ID NO: 3523133 - RNA, 19 nt, Human
cguuucuaaaggcuaccuu

SEQ ID NO: 3523134 - RNA, 21 nt, Human
cguuucuaaaggcuaccuuug

SEQ ID NO: 3523135 - RNA, 22 nt, Human
cguuucuccaccuagacuguaa

SEQ ID NO: 3523136 - RNA, 15 nt, Human
cguuucuucacuuuu

SEQ ID NO: 3523137 - RNA, 19 nt, Human
cguuugauuugucacugcu

SEQ ID NO: 3523138 - RNA, 14 nt, Human
cguuuguaugugug

SEQ ID NO: 3523139 - RNA, 19 nt, Human
cguuuguguucuguuuugu

SEQ ID NO: 3523140 - RNA, 9 nt, Human
cguuuguuu

SEQ ID NO: 3523141 - RNA, 19 nt, Human
cguuuguuuguuuguuuaa

SEQ ID NO: 3523142 - RNA, 16 nt, Human
cguuuguuuguuuugu

SEQ ID NO: 3523143 - RNA, 16 nt, Human
cguuuuauaagcauca

SEQ ID NO: 3523144 - RNA, 18 nt, Human
cguuuuauuguguuuuua

SEQ ID NO: 3523145 - RNA, 22 nt, Human
cguuuugcaagguaaaauuuua

SEQ ID NO: 3523146 - RNA, 17 nt, Human
cguuuuuuaaauguaua

SEQ ID NO: 3523147 - RNA, 15 nt, Human
cguuuuuuucauucc

SEQ ID NO: 3523148 - RNA, 16 nt, Human
cuaaaaaaaaaaaagu

SEQ ID NO: 3523149 - RNA, 17 nt, Human
cuaaaaaaaaaaaagua

SEQ ID NO: 3523150 - RNA, 14 nt, Human
cuaaaaaaaagaug

SEQ ID NO: 3523151 - RNA, 15 nt, Human
cuaaaaaaaagauga

SEQ ID NO: 3523152 - RNA, 11 nt, Human
cuaaaaaagau

SEQ ID NO: 3523153 - RNA, 13 nt, Human
cuaaaaaagauau

SEQ ID NO: 3523154 - RNA, 19 nt, Human
cuaaaaaagauauauuaaa

SEQ ID NO: 3523155 - RNA, 20 nt, Human
cuaaaaaagcugaaucagac

SEQ ID NO: 3523156 - RNA, 15 nt, Human
cuaaaaagauuagca

SEQ ID NO: 3523157 - RNA, 17 nt, Human
cuaaaaaguauaaaaua

SEQ ID NO: 3523158 - RNA, 17 nt, Human
cuaaaaauaacuguaau

SEQ ID NO: 3523159 - RNA, 11 nt, Human
cuaaaaauaua

SEQ ID NO: 3523160 - RNA, 23 nt, Human
cuaaaaauauacauguuuaugua

SEQ ID NO: 3523161 - RNA, 14 nt, Human
cuaaaaauauuguu

SEQ ID NO: 3523162 - RNA, 17 nt, Human
cuaaaacaauaaaauuu

SEQ ID NO: 3523163 - RNA, 11 nt, Human
cuaaaaccauu

SEQ ID NO: 3523164 - RNA, 14 nt, Human
cuaaaaccugaaau

SEQ ID NO: 3523165 - RNA, 19 nt, Human
cuaaaacuacaaaaauuaa

SEQ ID NO: 3523166 - RNA, 13 nt, Human
cuaaaacuguacu

SEQ ID NO: 3523167 - RNA, 16 nt, Human
cuaaaacuguacuuug

SEQ ID NO: 3523168 - RNA, 13 nt, Human
cuaaaagacaggc

SEQ ID NO: 3523169 - RNA, 20 nt, Human
cuaaaagauccuuuuuaaau

SEQ ID NO: 3523170 - RNA, 12 nt, Human
cuaaaagcaccu

SEQ ID NO: 3523171 - RNA, 15 nt, Human
cuaaaagccacccca

SEQ ID NO: 3523172 - RNA, 23 nt, Human
cuaaaagguaugcaaucaaaucu

SEQ ID NO: 3523173 - RNA, 15 nt, Human
cuaaaaguaaacauu

SEQ ID NO: 3523174 - RNA, 12 nt, Human
cuaaaaguucau

SEQ ID NO: 3523175 - RNA, 18 nt, Human
cuaaaaguucauaacagu

SEQ ID NO: 3523176 - RNA, 22 nt, Human
cuaaaaguucauaacagugcca

SEQ ID NO: 3523177 - RNA, 14 nt, Human
cuaaaauacauuua

SEQ ID NO: 3523178 - RNA, 18 nt, Human
cuaaaauauauaauuuau

SEQ ID NO: 3523179 - RNA, 22 nt, Human
cuaaaauaucuggguggcuuaa

SEQ ID NO: 3523180 - RNA, 20 nt, Human
cuaaaauauuuaugaagaaa

SEQ ID NO: 3523181 - RNA, 15 nt, Human
cuaaaauauuuauuu

SEQ ID NO: 3523182 - RNA, 12 nt, Human
cuaaaaucauga

SEQ ID NO: 3523183 - RNA, 22 nt, Human
cuaaaaucugcuuguauuccaa

SEQ ID NO: 3523184 - RNA, 23 nt, Human
cuaaaaugauuuuaucugugaau

SEQ ID NO: 3523185 - RNA, 22 nt, Human
cuaaaaugccucaguguauuug

SEQ ID NO: 3523186 - RNA, 12 nt, Human
cuaaaaugcuuc

SEQ ID NO: 3523187 - RNA, 13 nt, Human
cuaaaaugcuuca

SEQ ID NO: 3523188 - RNA, 22 nt, Human
cuaaaauggacuguggugacuu

SEQ ID NO: 3523189 - RNA, 18 nt, Human
cuaaaaugugauguucua

SEQ ID NO: 3523190 - RNA, 14 nt, Human
cuaaaauguuuuca

SEQ ID NO: 3523191 - RNA, 15 nt, Human
cuaaaauguuuucag

SEQ ID NO: 3523192 - RNA, 18 nt, Human
cuaaaauuccacugcguu

SEQ ID NO: 3523193 - RNA, 17 nt, Human
cuaaaauuuuuaaggac

SEQ ID NO: 3523194 - RNA, 19 nt, Human
cuaaacacugcgcuuuauu

SEQ ID NO: 3523195 - RNA, 17 nt, Human
cuaaacauaugauuuca

SEQ ID NO: 3523196 - RNA, 18 nt, Human
cuaaacauccaauauuuu

SEQ ID NO: 3523197 - RNA, 17 nt, Human
cuaaacauuuuguuauu

SEQ ID NO: 3523198 - RNA, 15 nt, Human
cuaaacccaauccaa

SEQ ID NO: 3523199 - RNA, 21 nt, Human
cuaaacgagucaauccccuca

SEQ ID NO: 3523200 - RNA, 17 nt, Human
cuaaacggauuccaaag

SEQ ID NO: 3523201 - RNA, 20 nt, Human
cuaaacgguucaguuucuuc

SEQ ID NO: 3523202 - RNA, 18 nt, Human
cuaaacguaagcacuguu

SEQ ID NO: 3523203 - RNA, 17 nt, Human
cuaaacguguauguuuu

SEQ ID NO: 3523204 - RNA, 21 nt, Human
cuaaacguguauguuuuucag

SEQ ID NO: 3523205 - RNA, 16 nt, Human
cuaaacuaguuuuucc

SEQ ID NO: 3523206 - RNA, 14 nt, Human
cuaaacuaucuuuu

SEQ ID NO: 3523207 - RNA, 14 nt, Human
cuaaacucauuuau

SEQ ID NO: 3523208 - RNA, 15 nt, Human
cuaaacucauuuaua

SEQ ID NO: 3523209 - RNA, 20 nt, Human
cuaaacuccaaacauccucu

SEQ ID NO: 3523210 - RNA, 17 nt, Human
cuaaacuccuuccuggc

SEQ ID NO: 3523211 - RNA, 22 nt, Human
cuaaacucucuuugggaauguu

SEQ ID NO: 3523212 - RNA, 20 nt, Human
cuaaacugagacaaugccuu

SEQ ID NO: 3523213 - RNA, 12 nt, Human
cuaaacugcccc

SEQ ID NO: 3523214 - RNA, 22 nt, Human
cuaaacugcccccucugcccug

SEQ ID NO: 3523215 - RNA, 12 nt, Human
cuaaacuggaga

SEQ ID NO: 3523216 - RNA, 13 nt, Human
cuaaacuggagac

SEQ ID NO: 3523217 - RNA, 16 nt, Human
cuaaacuuccccaucu

SEQ ID NO: 3523218 - RNA, 15 nt, Human
cuaaacuuuuuuucu

SEQ ID NO: 3523219 - RNA, 17 nt, Human
cuaaacuuuuuuucugu

SEQ ID NO: 3523220 - RNA, 19 nt, Human
cuaaagaaaaagucaucca

SEQ ID NO: 3523221 - RNA, 21 nt, Human
cuaaagaaaaauaucuuggcc

SEQ ID NO: 3523222 - RNA, 23 nt, Human
cuaaagaaaaauaucuuggccua

SEQ ID NO: 3523223 - RNA, 21 nt, Human
cuaaagaaagauuacuuagag

SEQ ID NO: 3523224 - RNA, 14 nt, Human
cuaaagaagaucug

SEQ ID NO: 3523225 - RNA, 14 nt, Human
cuagaaacccaagc

SEQ ID NO: 3523226 - RNA, 18 nt, Human
cuagaaacccaagcuccu

SEQ ID NO: 3523227 - RNA, 16 nt, Human
cuagaaacuuccaaau

SEQ ID NO: 3523228 - RNA, 21 nt, Human
cuagaaagcagagauuuucaa

SEQ ID NO: 3523229 - RNA, 23 nt, Human
cuagaaagugaauaaaaauuaag

SEQ ID NO: 3523230 - RNA, 13 nt, Human
cuagaaauaugau

SEQ ID NO: 3523231 - RNA, 15 nt, Human
cuagaaauaugauuu

SEQ ID NO: 3523232 - RNA, 23 nt, Human
cuagaaaugauccccagcuguuu

SEQ ID NO: 3523233 - RNA, 19 nt, Human
cuagaaaugugaaugagga

SEQ ID NO: 3523234 - RNA, 16 nt, Human
cuagaaauugacacaa

SEQ ID NO: 3523235 - RNA, 18 nt, Human
cuagaaauugccuauccu

SEQ ID NO: 3523236 - RNA, 12 nt, Human
cuagaaauuuuc

SEQ ID NO: 3523237 - RNA, 14 nt, Human
cuagaacacaggca

SEQ ID NO: 3523238 - RNA, 22 nt, Human
cuagaacacaggcaaaauccuu

SEQ ID NO: 3523239 - RNA, 19 nt, Human
cuagaacacuaacucacca

SEQ ID NO: 3523240 - RNA, 14 nt, Human
cuagaacccucugu

SEQ ID NO: 3523241 - RNA, 17 nt, Human
cuagaaccuagaagggc

SEQ ID NO: 3523242 - RNA, 14 nt, Human
cuagaaccuggaga

SEQ ID NO: 3523243 - RNA, 17 nt, Human
cuagaacucccuuucaa

SEQ ID NO: 3523244 - RNA, 15 nt, Human
cuagaacugaauuuu

SEQ ID NO: 3523245 - RNA, 10 nt, Human
cuagaacuuu

SEQ ID NO: 3523246 - RNA, 13 nt, Human
cuagaacuuuuuu

SEQ ID NO: 3523247 - RNA, 15 nt, Human
cuagaacuuuuuuaa

SEQ ID NO: 3523248 - RNA, 16 nt, Human
cuagaacuuuuuuaaa

SEQ ID NO: 3523249 - RNA, 14 nt, Human
cuagaagaaaugaa

SEQ ID NO: 3523250 - RNA, 17 nt, Human
cuagaagagucuauugu

SEQ ID NO: 3523251 - RNA, 16 nt, Human
cuagaagccaagggaa

SEQ ID NO: 3523252 - RNA, 20 nt, Human
cuagaagccaagggaaaggg

SEQ ID NO: 3523253 - RNA, 21 nt, Human
cuagcaugccaacaagaaugc

SEQ ID NO: 3523254 - RNA, 17 nt, Human
cuagcauggcugccaau

SEQ ID NO: 3523255 - RNA, 16 nt, Human
cuagccaaaccaggac

SEQ ID NO: 3523256 - RNA, 15 nt, Human
cuagccagacacucu

SEQ ID NO: 3523257 - RNA, 19 nt, Human
cuagccagacacucugcuc

SEQ ID NO: 3523258 - RNA, 19 nt, Human
cuagccagaggagagagga

SEQ ID NO: 3523259 - RNA, 19 nt, Human
cuagccagugcuccaggca

SEQ ID NO: 3523260 - RNA, 21 nt, Human
cuagccauacgcucagcucau

SEQ ID NO: 3523261 - RNA, 17 nt, Human
cuagcccacccugcugc

SEQ ID NO: 3523262 - RNA, 19 nt, Human
cuagcccacccugcugccu

SEQ ID NO: 3523263 - RNA, 20 nt, Human
cuagcccacccugcugccuu

SEQ ID NO: 3523264 - RNA, 14 nt, Human
cuagcccaggagag

SEQ ID NO: 3523265 - RNA, 22 nt, Human
cuagcccauggacuucacauaa

SEQ ID NO: 3523266 - RNA, 15 nt, Human
cuagccccuggggug

SEQ ID NO: 3523267 - RNA, 14 nt, Human
cuagccccugugga

SEQ ID NO: 3523268 - RNA, 14 nt, Human
cuagcccucucccu

SEQ ID NO: 3523269 - RNA, 13 nt, Human
cuagcccugcccg

SEQ ID NO: 3523270 - RNA, 14 nt, Human
cuagccgaccucag

SEQ ID NO: 3523271 - RNA, 18 nt, Human
cuagccggccacuuugga

SEQ ID NO: 3523272 - RNA, 16 nt, Human
cuagccgguuccuguc

SEQ ID NO: 3523273 - RNA, 22 nt, Human
cuagccucacgcuccuuucuga

SEQ ID NO: 3523274 - RNA, 23 nt, Human
cuagccucacgcuccuuucugau

SEQ ID NO: 3523275 - RNA, 20 nt, Human
cuagccugaugagauuuuua

SEQ ID NO: 3523276 - RNA, 21 nt, Human
cuagccugugccucugggacu

SEQ ID NO: 3523277 - RNA, 18 nt, Human
cuagccuuauccucugau

SEQ ID NO: 3523278 - RNA, 19 nt, Human
cuagccuugaggaguguga

SEQ ID NO: 3523279 - RNA, 16 nt, Human
cuagccuuuggcucug

SEQ ID NO: 3523280 - RNA, 17 nt, Human
cuagccuuuggcucugg

SEQ ID NO: 3523281 - RNA, 18 nt, Human
cuagccuuuggcucugga

SEQ ID NO: 3523282 - RNA, 21 nt, Human
cuagccuuuggcucuggagac

SEQ ID NO: 3523283 - RNA, 16 nt, Human
cuagcgaucucuccug

SEQ ID NO: 3523284 - RNA, 19 nt, Human
cuagcgaucucuccuggcc

SEQ ID NO: 3523285 - RNA, 20 nt, Human
cuagcgaucucuccuggccu

SEQ ID NO: 3523286 - RNA, 21 nt, Human
cuagcgcaguuuuuuuuuucu

SEQ ID NO: 3523287 - RNA, 12 nt, Human
cuagcgcugccg

SEQ ID NO: 3523288 - RNA, 22 nt, Human
cuagcgcugccgcaccccagag

SEQ ID NO: 3523289 - RNA, 16 nt, Human
cuagcgggauggggcu

SEQ ID NO: 3523290 - RNA, 19 nt, Human
cuagcguagugcagcaggg

SEQ ID NO: 3523291 - RNA, 22 nt, Human
cuagcuaauguaauaacuguga

SEQ ID NO: 3523292 - RNA, 14 nt, Human
cuagcuaauuauuu

SEQ ID NO: 3523293 - RNA, 16 nt, Human
cuagcuaauuauuuaa

SEQ ID NO: 3523294 - RNA, 15 nt, Human
cuagcuagaaauaug

SEQ ID NO: 3523295 - RNA, 21 nt, Human
cuagcuaugcuguaucugugc

SEQ ID NO: 3523296 - RNA, 10 nt, Human
cuagcucccc

SEQ ID NO: 3523297 - RNA, 14 nt, Human
cuagcuccccuccu

SEQ ID NO: 3523298 - RNA, 16 nt, Human
cuagcuccccuccucu

SEQ ID NO: 3523299 - RNA, 23 nt, Human
cuagcucuauguuuacaaaugga

SEQ ID NO: 3523300 - RNA, 16 nt, Human
cuagcucucuaggccu

SEQ ID NO: 3523301 - RNA, 14 nt, Human
cuagcucugagcca

SEQ ID NO: 3523302 - RNA, 20 nt, Human
cuagcugcacagggcagcug

SEQ ID NO: 3523303 - RNA, 18 nt, Human
cuagcuggagaggagccc

SEQ ID NO: 3523304 - RNA, 22 nt, Human
cuagcuggagaggagcccugcc

SEQ ID NO: 3523305 - RNA, 23 nt, Human
cuagcuggagaggagcccugccu

SEQ ID NO: 3523306 - RNA, 19 nt, Human
cuagcugggggugggccag

SEQ ID NO: 3523307 - RNA, 20 nt, Human
cuagcugggggugggccagg

SEQ ID NO: 3523308 - RNA, 22 nt, Human
cuagcugggggugggccaggcu

SEQ ID NO: 3523309 - RNA, 15 nt, Human
cuagcuggugguuuc

SEQ ID NO: 3523310 - RNA, 17 nt, Human
cuagcuguccuuuuucc

SEQ ID NO: 3523311 - RNA, 14 nt, Human
cuagcugugggggu

SEQ ID NO: 3523312 - RNA, 23 nt, Human
cuagcugugugaauaccugcuca

SEQ ID NO: 3523313 - RNA, 20 nt, Human
cuagcuuacaugagaacaga

SEQ ID NO: 3523314 - RNA, 22 nt, Human
cuagcuuagagccucccucaau

SEQ ID NO: 3523315 - RNA, 21 nt, Human
cuagcuucugcuuuucugccc

SEQ ID NO: 3523316 - RNA, 20 nt, Human
cuagcuugggaggcuucccc

SEQ ID NO: 3523317 - RNA, 14 nt, Human
cuagcuuuuuaauu

SEQ ID NO: 3523318 - RNA, 14 nt, Human
cuaggaaaagaaau

SEQ ID NO: 3523319 - RNA, 14 nt, Human
cuaggaaaauaaaa

SEQ ID NO: 3523320 - RNA, 15 nt, Human
cuaggaaaauuauuc

SEQ ID NO: 3523321 - RNA, 19 nt, Human
cuaggaaauauuuauuuua

SEQ ID NO: 3523322 - RNA, 20 nt, Human
cuaggaaauauuuauuuuaa

SEQ ID NO: 3523323 - RNA, 16 nt, Human
cuaggaacaaaucuuc

SEQ ID NO: 3523324 - RNA, 19 nt, Human
cuaggaagaauuuuaaaaa

SEQ ID NO: 3523325 - RNA, 23 nt, Human
cuaggaagaauuuuaaaaaugaa

SEQ ID NO: 3523326 - RNA, 15 nt, Human
cuaggaagacuuugg

SEQ ID NO: 3523327 - RNA, 21 nt, Human
cuaggaagacuuuggaaagag

SEQ ID NO: 3523328 - RNA, 15 nt, Human
cuaggaagaggagug

SEQ ID NO: 3523329 - RNA, 16 nt, Human
cuaggaagaggagugg

SEQ ID NO: 3523330 - RNA, 14 nt, Human
cuaggaagccucag

SEQ ID NO: 3523331 - RNA, 22 nt, Human
cuaggaaggcacuucugccuga

SEQ ID NO: 3523332 - RNA, 16 nt, Human
cuaggaaugaaauccu

SEQ ID NO: 3523333 - RNA, 15 nt, Human
cuaggaauucccagc

SEQ ID NO: 3523334 - RNA, 19 nt, Human
cuaggacacaguuccuggg

SEQ ID NO: 3523335 - RNA, 16 nt, Human
cuaggacauguucccu

SEQ ID NO: 3523336 - RNA, 19 nt, Human
cuaggaccacucagccccu

SEQ ID NO: 3523337 - RNA, 20 nt, Human
cuaggaccacucagccccua

SEQ ID NO: 3523338 - RNA, 20 nt, Human
cuaggacccgucuccagcug

SEQ ID NO: 3523339 - RNA, 21 nt, Human
cuaggacccgucuccagcugc

SEQ ID NO: 3523340 - RNA, 12 nt, Human
cuaggacuccuu

SEQ ID NO: 3523341 - RNA, 12 nt, Human
cuaggacucuga

SEQ ID NO: 3523342 - RNA, 16 nt, Human
cuaggacucugaggcu

SEQ ID NO: 3523343 - RNA, 22 nt, Human
cuaggacucugaggcucuuucu

SEQ ID NO: 3523344 - RNA, 21 nt, Human
cuaggagaaccaaaucuggaa

SEQ ID NO: 3523345 - RNA, 23 nt, Human
cuaggagaaccaaaucuggaagc

SEQ ID NO: 3523346 - RNA, 23 nt, Human
cuaggagaaggaggggaaccaga

SEQ ID NO: 3523347 - RNA, 19 nt, Human
cuaggagaggagaaccaga

SEQ ID NO: 3523348 - RNA, 13 nt, Human
cuaggagcacugu

SEQ ID NO: 3523349 - RNA, 21 nt, Human
cuaggagcuuugacucaggag

SEQ ID NO: 3523350 - RNA, 18 nt, Human
cuaggagggagacacugg

SEQ ID NO: 3523351 - RNA, 22 nt, Human
cuaggagggagacacuggcccc

SEQ ID NO: 3523352 - RNA, 18 nt, Human
cuaggaugcggaaauccc

SEQ ID NO: 3523353 - RNA, 20 nt, Human
cuaggauucacaccccaccu

SEQ ID NO: 3523354 - RNA, 21 nt, Human
cuaggauucacaccccaccug

SEQ ID NO: 3523355 - RNA, 13 nt, Human
cuaggauucuaaa

SEQ ID NO: 3523356 - RNA, 13 nt, Human
cuaggauuucaug

SEQ ID NO: 3523357 - RNA, 17 nt, Human
cuaggauuugaacacuu

SEQ ID NO: 3523358 - RNA, 15 nt, Human
cuaggcaggaccugu

SEQ ID NO: 3523359 - RNA, 17 nt, Human
cuaggcagggugucugc

SEQ ID NO: 3523360 - RNA, 19 nt, Human
cuaggcagggugucugccc

SEQ ID NO: 3523361 - RNA, 15 nt, Human
cuaggcaucccaggg

SEQ ID NO: 3523362 - RNA, 17 nt, Human
cuaggcaucucuguacu

SEQ ID NO: 3523363 - RNA, 14 nt, Human
cuaggcauucugga

SEQ ID NO: 3523364 - RNA, 16 nt, Human
cuaggcauuuguaaau

SEQ ID NO: 3523365 - RNA, 14 nt, Human
cuaggccacuccuc

SEQ ID NO: 3523366 - RNA, 14 nt, Human
cuaggccaggugca

SEQ ID NO: 3523367 - RNA, 19 nt, Human
cuaggcccccacuugccuc

SEQ ID NO: 3523368 - RNA, 23 nt, Human
cuaggcccccacuugccucuucc

SEQ ID NO: 3523369 - RNA, 20 nt, Human
cuaggccucaacuccuccca

SEQ ID NO: 3523370 - RNA, 17 nt, Human
cuaggccucagccagag

SEQ ID NO: 3523371 - RNA, 19 nt, Human
cuaggccucagccagagaa

SEQ ID NO: 3523372 - RNA, 20 nt, Human
cuaggccuggcauggcaccu

SEQ ID NO: 3523373 - RNA, 15 nt, Human
cuaggccugggcagu

SEQ ID NO: 3523374 - RNA, 16 nt, Human
cuaggccugggcagug

SEQ ID NO: 3523375 - RNA, 12 nt, Human
cuaggccugggg

SEQ ID NO: 3523376 - RNA, 13 nt, Human
cuaggccugggga

SEQ ID NO: 3523377 - RNA, 12 nt, Human
cuaggcucagag

SEQ ID NO: 3523378 - RNA, 13 nt, Human
cuaggcucagaga

SEQ ID NO: 3523379 - RNA, 13 nt, Human
cuaggcucugccu

SEQ ID NO: 3523380 - RNA, 21 nt, Human
cuaggcugacaccuaacucuu

SEQ ID NO: 3523381 - RNA, 13 nt, Human
cuaggcuggaagg

SEQ ID NO: 3523382 - RNA, 13 nt, Human
cuaggcuggggaa

SEQ ID NO: 3523383 - RNA, 22 nt, Human
cuaggcuggggaaguccucugg

SEQ ID NO: 3523384 - RNA, 21 nt, Human
ccagagcugggugagugggga

SEQ ID NO: 3523385 - RNA, 14 nt, Human
ccagagcuggugga

SEQ ID NO: 3523386 - RNA, 19 nt, Human
ccagagcuguuuauggccu

SEQ ID NO: 3523387 - RNA, 24 nt, Human
ccagagcuguuuauggccucagcu

SEQ ID NO: 3523388 - RNA, 20 nt, Human
ccagaggaacuguccagaga

SEQ ID NO: 3523389 - RNA, 21 nt, Human
ccagaggaacuguccagagag

SEQ ID NO: 3523390 - RNA, 20 nt, Human
ccagaggaauccuggcagcc

SEQ ID NO: 3523391 - RNA, 23 nt, Human
ccagaggaauccuggcagcccag

SEQ ID NO: 3523392 - RNA, 20 nt, Human
ccagaggacucccaacccug

SEQ ID NO: 3523393 - RNA, 19 nt, Human
ccagaggagccaccaguuc

SEQ ID NO: 3523394 - RNA, 12 nt, Human
ccagaggagggc

SEQ ID NO: 3523395 - RNA, 21 nt, Human
ccagaggauugcugccccauc

SEQ ID NO: 3523396 - RNA, 13 nt, Human
ccagaggcacagc

SEQ ID NO: 3523397 - RNA, 20 nt, Human
ccaggaagccgugcccugcc

SEQ ID NO: 3523398 - RNA, 15 nt, Human
ccaggaagcuuuggu

SEQ ID NO: 3523399 - RNA, 16 nt, Human
ccaggaaggggcugga

SEQ ID NO: 3523400 - RNA, 21 nt, Human
ccaggaaggggguccacccag

SEQ ID NO: 3523401 - RNA, 22 nt, Human
ccaggaaggggguccacccagc

SEQ ID NO: 3523402 - RNA, 16 nt, Human
ccaggaaguagcacag

SEQ ID NO: 3523403 - RNA, 19 nt, Human
ccaggaaguagcacaggcu

SEQ ID NO: 3523404 - RNA, 21 nt, Human
ccaggaaguagcacaggcuga

SEQ ID NO: 3523405 - RNA, 15 nt, Human
ccaggaaugaagaua

SEQ ID NO: 3523406 - RNA, 23 nt, Human
ccaggaauuucccaggacccuga

SEQ ID NO: 3523407 - RNA, 19 nt, Human
ccaggaauuugggacccug

SEQ ID NO: 3523408 - RNA, 15 nt, Human
ccaggacaagcaugg

SEQ ID NO: 3523409 - RNA, 17 nt, Human
ccaggacaccacaccca

SEQ ID NO: 3523410 - RNA, 22 nt, Human
ccaggacaccacacccagccuc

SEQ ID NO: 3523411 - RNA, 15 nt, Human
ccaggacaggcccgg

SEQ ID NO: 3523412 - RNA, 17 nt, Human
ccaggacaggcccggcg

SEQ ID NO: 3523413 - RNA, 13 nt, Human
ccaggacagucag

SEQ ID NO: 3523414 - RNA, 12 nt, Human
ccaggaccacag

SEQ ID NO: 3523415 - RNA, 21 nt, Human
ccaggaccacaggcucaggca

SEQ ID NO: 3523416 - RNA, 17 nt, Human
ccaggaccagcucagga

SEQ ID NO: 3523417 - RNA, 20 nt, Human
ccaggaccagcucaggacag

SEQ ID NO: 3523418 - RNA, 15 nt, Human
ccaggaccaucaucc

SEQ ID NO: 3523419 - RNA, 23 nt, Human
ccaggacccugaaggggccauga

SEQ ID NO: 3523420 - RNA, 13 nt, Human
ccaggacccugcc

SEQ ID NO: 3523421 - RNA, 21 nt, Human
ccaggacccugccaggcacag

SEQ ID NO: 3523422 - RNA, 22 nt, Human
ccaggacccugccaggcacagg

SEQ ID NO: 3523423 - RNA, 18 nt, Human
ccaggacccuggacccag

SEQ ID NO: 3523424 - RNA, 15 nt, Human
ccaggaccuggcugc

SEQ ID NO: 3523425 - RNA, 20 nt, Human
ccaggacgccacucauuuca

SEQ ID NO: 3523426 - RNA, 16 nt, Human
ccaggacggggccggc

SEQ ID NO: 3523427 - RNA, 20 nt, Human
ccaggacggggccggccagg

SEQ ID NO: 3523428 - RNA, 20 nt, Human
ccaggacuauagcccagguc

SEQ ID NO: 3523429 - RNA, 17 nt, Human
ccaggacuccccaggcc

SEQ ID NO: 3523430 - RNA, 22 nt, Human
ccaggacucccuccucaccucu

SEQ ID NO: 3523431 - RNA, 23 nt, Human
ccaggacucccuccucaccucug

SEQ ID NO: 3523432 - RNA, 17 nt, Human
ccaggacuccuccccac

SEQ ID NO: 3523433 - RNA, 18 nt, Human
ccaggacucugaccccag

SEQ ID NO: 3523434 - RNA, 21 nt, Human
ccaggacucugcagccucaga

SEQ ID NO: 3523435 - RNA, 16 nt, Human
ccaggacugagccccg

SEQ ID NO: 3523436 - RNA, 12 nt, Human
ccaggacugggc

SEQ ID NO: 3523437 - RNA, 13 nt, Human
ccaggacugggcc

SEQ ID NO: 3523438 - RNA, 14 nt, Human
ccaggacugggcca

SEQ ID NO: 3523439 - RNA, 14 nt, Human
cuauugcauuuaua

SEQ ID NO: 3523440 - RNA, 12 nt, Human
cuauugcccagg

SEQ ID NO: 3523441 - RNA, 11 nt, Human
cuauugccucu

SEQ ID NO: 3523442 - RNA, 13 nt, Human
cuauugccucuga

SEQ ID NO: 3523443 - RNA, 12 nt, Human
cuauugccuucu

SEQ ID NO: 3523444 - RNA, 17 nt, Human
cuauugcuagagcuccu

SEQ ID NO: 3523445 - RNA, 21 nt, Human
cuauugcuagagcuccucccu

SEQ ID NO: 3523446 - RNA, 14 nt, Human
cuauugcuucacca

SEQ ID NO: 3523447 - RNA, 21 nt, Human
cuauugcuucaccauggccuu

SEQ ID NO: 3523448 - RNA, 19 nt, Human
cuauuggggaacucauugu

SEQ ID NO: 3523449 - RNA, 23 nt, Human
cuauuggguucauuauuggaauu

SEQ ID NO: 3523450 - RNA, 12 nt, Human
cuauuguaauau

SEQ ID NO: 3523451 - RNA, 19 nt, Human
cuauuguaauauagaaaaa

SEQ ID NO: 3523452 - RNA, 14 nt, Human
cuauuguagagcca

SEQ ID NO: 3523453 - RNA, 19 nt, Human
cuauugucaccagggcugg

SEQ ID NO: 3523454 - RNA, 15 nt, Human
cuauugucauuaaag

SEQ ID NO: 3523455 - RNA, 19 nt, Human
cuauugugauuugacuguu

SEQ ID NO: 3523456 - RNA, 21 nt, Human
cuauugugggacuuauuacaa

SEQ ID NO: 3523457 - RNA, 18 nt, Human
cuauuguuagucucuuga

SEQ ID NO: 3523458 - RNA, 14 nt, Human
cuauuguuuauucu

SEQ ID NO: 3523459 - RNA, 17 nt, Human
cuauuuaaaacuuguaa

SEQ ID NO: 3523460 - RNA, 21 nt, Human
cuauuuaaagaaauauguauu

SEQ ID NO: 3523461 - RNA, 13 nt, Human
cuauuuaaauucu

SEQ ID NO: 3523462 - RNA, 13 nt, Human
cuauuuaacugac

SEQ ID NO: 3523463 - RNA, 14 nt, Human
cuauuuaacugacu

SEQ ID NO: 3523464 - RNA, 15 nt, Human
cuauuuaacugacua

SEQ ID NO: 3523465 - RNA, 22 nt, Human
cuauuuaacuggcuucagccuc

SEQ ID NO: 3523466 - RNA, 14 nt, Human
cuauuuaacuugag

SEQ ID NO: 3523467 - RNA, 15 nt, Human
cuauuuaagauguga

SEQ ID NO: 3523468 - RNA, 14 nt, Human
cuauuuaauauuua

SEQ ID NO: 3523469 - RNA, 12 nt, Human
cuauuuaaugga

SEQ ID NO: 3523470 - RNA, 18 nt, Human
cuauuuaauuaggaaaaa

SEQ ID NO: 3523471 - RNA, 23 nt, Human
cuauuuaccugcaggcugagcca

SEQ ID NO: 3523472 - RNA, 15 nt, Human
cuauuuagaugcaua

SEQ ID NO: 3523473 - RNA, 17 nt, Human
cuauuuauauguacaug

SEQ ID NO: 3523474 - RNA, 17 nt, Human
cuauuuauuaauauuua

SEQ ID NO: 3523475 - RNA, 19 nt, Human
cuauuuauuuauuuauuca

SEQ ID NO: 3523476 - RNA, 13 nt, Human
cuauuuauuuucc

SEQ ID NO: 3523477 - RNA, 18 nt, Human
cuauuuauuuuccuaaag

SEQ ID NO: 3523478 - RNA, 19 nt, Human
cuauuucaaaaauuuggaa

SEQ ID NO: 3523479 - RNA, 11 nt, Human
cuauuucagaa

SEQ ID NO: 3523480 - RNA, 13 nt, Human
cuauuucauuuuu

SEQ ID NO: 3523481 - RNA, 21 nt, Human
cuauuuccccaggggaaaaug

SEQ ID NO: 3523482 - RNA, 19 nt, Human
cuauuucccccuuucuucc

SEQ ID NO: 3523483 - RNA, 22 nt, Human
cuauuucuacacagugggaacu

SEQ ID NO: 3523484 - RNA, 20 nt, Human
cuauuucuagggcugggaaa

SEQ ID NO: 3523485 - RNA, 19 nt, Human
cuauuucuauauuuucauu

SEQ ID NO: 3523486 - RNA, 20 nt, Human
cuauuucugcugaauuuuca

SEQ ID NO: 3523487 - RNA, 21 nt, Human
cuauuucugcugaauuuucac

SEQ ID NO: 3523488 - RNA, 14 nt, Human
cuauuugaacaagu

SEQ ID NO: 3523489 - RNA, 18 nt, Human
cuauuugcaauuccugcu

SEQ ID NO: 3523490 - RNA, 18 nt, Human
cuauuuguaaaucugcca

SEQ ID NO: 3523491 - RNA, 22 nt, Human
cuauuuguucuucaagaacuuu

SEQ ID NO: 3523492 - RNA, 16 nt, Human
cuauuuguuuucaugg

SEQ ID NO: 3523493 - RNA, 18 nt, Human
cuauuuuacugucuuaau

SEQ ID NO: 3523494 - RNA, 23 nt, Human
cuauuuuacugucuuaauuaagu

SEQ ID NO: 3523495 - RNA, 15 nt, Human
cuauuuuagaauaaa

SEQ ID NO: 3523496 - RNA, 22 nt, Human
cuauuuucagaaucugaaugua

SEQ ID NO: 3523497 - RNA, 23 nt, Human
cuauuuucagaaucugaauguaa

SEQ ID NO: 3523498 - RNA, 18 nt, Human
cuauuuucagaugugaac

SEQ ID NO: 3523499 - RNA, 18 nt, Human
cuauuuucauuguaaaac

SEQ ID NO: 3523500 - RNA, 23 nt, Human
cuauuuuccaggcuucugcuggg

SEQ ID NO: 3523501 - RNA, 11 nt, Human
cuauuuucuau

SEQ ID NO: 3523502 - RNA, 16 nt, Human
cuauuuucuauguacu

SEQ ID NO: 3523503 - RNA, 15 nt, Human
cuauuuucuuuuuua

SEQ ID NO: 3523504 - RNA, 19 nt, Human
cuauuuugacaguuauuuu

SEQ ID NO: 3523505 - RNA, 13 nt, Human
cuauuuugaugca

SEQ ID NO: 3523506 - RNA, 17 nt, Human
cuauuuugugaagccau

SEQ ID NO: 3523507 - RNA, 19 nt, Human
cuauuuuuaauguuuguac

SEQ ID NO: 3523508 - RNA, 18 nt, Human
cuauuuuuacuagaacac

SEQ ID NO: 3523509 - RNA, 21 nt, Human
cuauuuuuacuagaacacaga

SEQ ID NO: 3523510 - RNA, 15 nt, Human
cuauuuuuauuuaua

SEQ ID NO: 3523511 - RNA, 15 nt, Human
cuauuuuucuaacua

SEQ ID NO: 3523512 - RNA, 14 nt, Human
cuauuuuucucucc

SEQ ID NO: 3523513 - RNA, 16 nt, Human
cuauuuuucucuccug

SEQ ID NO: 3523514 - RNA, 18 nt, Human
cuauuuuuggcagucuga

SEQ ID NO: 3523515 - RNA, 12 nt, Human
cuauuuuuguac

SEQ ID NO: 3523516 - RNA, 14 nt, Human
cuauuuuuguagaa

SEQ ID NO: 3523517 - RNA, 15 nt, Human
cuauuuuuguagaag

SEQ ID NO: 3523518 - RNA, 21 nt, Human
cuauuuuuguuuuuauuaaaa

SEQ ID NO: 3523519 - RNA, 17 nt, Human
cuauuuuuuuaaaauca

SEQ ID NO: 3523520 - RNA, 23 nt, Human
cucaaaaaaaaaauuuuuuuccu

SEQ ID NO: 3523521 - RNA, 17 nt, Human
cucaaaaaaagaaaaag

SEQ ID NO: 3523522 - RNA, 14 nt, Human
cucaaaaagaaauc

SEQ ID NO: 3523523 - RNA, 14 nt, Human
cucaaaacaaaggc

SEQ ID NO: 3523524 - RNA, 20 nt, Human
cucaaaacuggacagucacu

SEQ ID NO: 3523525 - RNA, 20 nt, Human
cucaaaagcacccuugacgu

SEQ ID NO: 3523526 - RNA, 21 nt, Human
cucaaaagcauuuaucauucu

SEQ ID NO: 3523527 - RNA, 23 nt, Human
cucaaaauaccaugccauuuaaa

SEQ ID NO: 3523528 - RNA, 12 nt, Human
cucaaaaugugu

SEQ ID NO: 3523529 - RNA, 14 nt, Human
cucaaaauguguaa

SEQ ID NO: 3523530 - RNA, 22 nt, Human
cucaaaccaaaucacugaacuu

SEQ ID NO: 3523531 - RNA, 16 nt, Human
cucaaaccccugaccu

SEQ ID NO: 3523532 - RNA, 13 nt, Human
cucaaacuccuga

SEQ ID NO: 3523533 - RNA, 17 nt, Human
cucaaacugccuuggcu

SEQ ID NO: 3523534 - RNA, 16 nt, Human
cucaaagaaaguguau

SEQ ID NO: 3523535 - RNA, 17 nt, Human
cucaaagaaaguguauu

SEQ ID NO: 3523536 - RNA, 22 nt, Human
cucaaagaaauuuccacucagg

SEQ ID NO: 3523537 - RNA, 22 nt, Human
cucaaagacaauguuauuuucc

SEQ ID NO: 3523538 - RNA, 18 nt, Human
cucaaagagggagugcau

SEQ ID NO: 3523539 - RNA, 23 nt, Human
cucaaagcuuggauuaaauacau

SEQ ID NO: 3523540 - RNA, 11 nt, Human
cucaaaggcac

SEQ ID NO: 3523541 - RNA, 17 nt, Human
cucaaagguuuggaagg

SEQ ID NO: 3523542 - RNA, 21 nt, Human
cucacaaguggguacccccag

SEQ ID NO: 3523543 - RNA, 21 nt, Human
cucacaauaaaaauggcucag

SEQ ID NO: 3523544 - RNA, 22 nt, Human
cucacaauaaaaauggcucaga

SEQ ID NO: 3523545 - RNA, 17 nt, Human
cucacaauccuugccac

SEQ ID NO: 3523546 - RNA, 16 nt, Human
cucacacagccaggug

SEQ ID NO: 3523547 - RNA, 22 nt, Human
cucacacagccaggugccuugg

SEQ ID NO: 3523548 - RNA, 13 nt, Human
cucacacaggacc

SEQ ID NO: 3523549 - RNA, 22 nt, Human
cucacacaugagcaucaggcca

SEQ ID NO: 3523550 - RNA, 23 nt, Human
cucacaccaggcuugccugcagg

SEQ ID NO: 3523551 - RNA, 15 nt, Human
cucacacccaccguc

SEQ ID NO: 3523552 - RNA, 16 nt, Human
cucacaccucacucuu

SEQ ID NO: 3523553 - RNA, 20 nt, Human
cucacacugagaauguaaga

SEQ ID NO: 3523554 - RNA, 19 nt, Human
cucacacuggucugcuguc

SEQ ID NO: 3523555 - RNA, 23 nt, Human
cucacacugguucucaaugaaaa

SEQ ID NO: 3523556 - RNA, 21 nt, Human
cucacacuuacuguaagacau

SEQ ID NO: 3523557 - RNA, 22 nt, Human
cucacacuuacuguaagacauu

SEQ ID NO: 3523558 - RNA, 15 nt, Human
cucacagaagaugaa

SEQ ID NO: 3523559 - RNA, 22 nt, Human
cucacagacaggaccccugcag

SEQ ID NO: 3523560 - RNA, 23 nt, Human
cucacagaccuggagccccuggg

SEQ ID NO: 3523561 - RNA, 12 nt, Human
cucacagaguca

SEQ ID NO: 3523562 - RNA, 14 nt, Human
cucacagcacagag

SEQ ID NO: 3523563 - RNA, 21 nt, Human
cucacagcacaugcuggccag

SEQ ID NO: 3523564 - RNA, 22 nt, Human
cucacagcacaugcuggccagc

SEQ ID NO: 3523565 - RNA, 12 nt, Human
cucacagccagc

SEQ ID NO: 3523566 - RNA, 14 nt, Human
cucacagccucuga

SEQ ID NO: 3523567 - RNA, 19 nt, Human
cucacagccucugaccccu

SEQ ID NO: 3523568 - RNA, 22 nt, Human
cucacagccucugaccccuccu

SEQ ID NO: 3523569 - RNA, 22 nt, Human
cucacagcuaugcaaaaagcua

SEQ ID NO: 3523570 - RNA, 18 nt, Human
cucacagguuggaagaga

SEQ ID NO: 3523571 - RNA, 19 nt, Human
cucacagguuggaagagaa

SEQ ID NO: 3523572 - RNA, 22 nt, Human
cucacagguuggaagagaauca

SEQ ID NO: 3523573 - RNA, 20 nt, Human
cucacaguacagcaugugcc

SEQ ID NO: 3523574 - RNA, 22 nt, Human
cucacaguacagcaugugccuu

SEQ ID NO: 3523575 - RNA, 14 nt, Human
cucacagucccacu

SEQ ID NO: 3523576 - RNA, 15 nt, Human
cucacaguccuuacc

SEQ ID NO: 3523577 - RNA, 19 nt, Human
cucacagucucuuuaaucu

SEQ ID NO: 3523578 - RNA, 15 nt, Human
cucacagugcuuuua

SEQ ID NO: 3523579 - RNA, 13 nt, Human
cucacaguuauua

SEQ ID NO: 3523580 - RNA, 16 nt, Human
cucacaguuccucgcc

SEQ ID NO: 3523581 - RNA, 17 nt, Human
cucacaguuccucgccc

SEQ ID NO: 3523582 - RNA, 22 nt, Human
cucacaguuccucgcccugggu

SEQ ID NO: 3523583 - RNA, 20 nt, Human
cucacaucuuucacacuucc

SEQ ID NO: 3523584 - RNA, 23 nt, Human
cucacauggugcuacgccugcau

SEQ ID NO: 3523585 - RNA, 16 nt, Human
cucacauuagaucuag

SEQ ID NO: 3523586 - RNA, 15 nt, Human
cucacauuccuaggg

SEQ ID NO: 3523587 - RNA, 21 nt, Human
cucaccacugcccccugcugc

SEQ ID NO: 3523588 - RNA, 20 nt, Human
cucaccagccccacugccag

SEQ ID NO: 3523589 - RNA, 17 nt, Human
cucaccagccccagugc

SEQ ID NO: 3523590 - RNA, 20 nt, Human
cucaccagccccagugccca

SEQ ID NO: 3523591 - RNA, 17 nt, Human
cucaccagcugcaaagu

SEQ ID NO: 3523592 - RNA, 18 nt, Human
cucaccagcugcaaagug

SEQ ID NO: 3523593 - RNA, 20 nt, Human
cucaccagcugcaaaguguu

SEQ ID NO: 3523594 - RNA, 19 nt, Human
cucaccagcugcugcucug

SEQ ID NO: 3523595 - RNA, 13 nt, Human
cucaccagcugug

SEQ ID NO: 3523596 - RNA, 15 nt, Human
cucaccaggggcagg

SEQ ID NO: 3523597 - RNA, 22 nt, Human
cucaccaggggcaggcacagca

SEQ ID NO: 3523598 - RNA, 22 nt, Human
cucaccauuccaagucuccacc

SEQ ID NO: 3523599 - RNA, 18 nt, Human
cucaccauuuccccaggg

SEQ ID NO: 3523600 - RNA, 17 nt, Human
cucaccauuuggauccu

SEQ ID NO: 3523601 - RNA, 16 nt, Human
cucacccaacaauccc

SEQ ID NO: 3523602 - RNA, 23 nt, Human
cuagccuuuggcucuggagacag

SEQ ID NO: 3523603 - RNA, 14 nt, Human
cuagcgcaguuuuu

SEQ ID NO: 3523604 - RNA, 22 nt, Human
cuagcgcguugccugucgcuuu

SEQ ID NO: 3523605 - RNA, 17 nt, Human
cuagcgcuaucucccug

SEQ ID NO: 3523606 - RNA, 16 nt, Human
cuagcgcugccgcacc

SEQ ID NO: 3523607 - RNA, 22 nt, Human
cuagcuaauggaaaaugauuuu

SEQ ID NO: 3523608 - RNA, 15 nt, Human
cuagcuaauuauuua

SEQ ID NO: 3523609 - RNA, 19 nt, Human
cuagcuagaagugggccag

SEQ ID NO: 3523610 - RNA, 16 nt, Human
cuagcuaucaagaggc

SEQ ID NO: 3523611 - RNA, 13 nt, Human
cuagcuccccucc

SEQ ID NO: 3523612 - RNA, 15 nt, Human
cuagcuccccuccuc

SEQ ID NO: 3523613 - RNA, 15 nt, Human
cuagcuccuccccuu

SEQ ID NO: 3523614 - RNA, 19 nt, Human
cuagcucuauguuuacaaa

SEQ ID NO: 3523615 - RNA, 19 nt, Human
cuagcucugagccaguuca

SEQ ID NO: 3523616 - RNA, 17 nt, Human
cuagcugaauguuuuuc

SEQ ID NO: 3523617 - RNA, 16 nt, Human
cuagcugcacagggca

SEQ ID NO: 3523618 - RNA, 20 nt, Human
cuagcugccuagcaagcugg

SEQ ID NO: 3523619 - RNA, 14 nt, Human
cuagcugcuacaaa

SEQ ID NO: 3523620 - RNA, 21 nt, Human
cuagcugcuacaaagaagaca

SEQ ID NO: 3523621 - RNA, 23 nt, Human
cuagcugcuacaaagaagacaug

SEQ ID NO: 3523622 - RNA, 19 nt, Human
cuagcuggaauuuuuuauu

SEQ ID NO: 3523623 - RNA, 22 nt, Human
cuagcuggaauuuuuuauucuu

SEQ ID NO: 3523624 - RNA, 23 nt, Human
cuagcuggaauuuuuuauucuug

SEQ ID NO: 3523625 - RNA, 13 nt, Human
cuagcuggagagg

SEQ ID NO: 3523626 - RNA, 19 nt, Human
cuagcuggagaggagcccu

SEQ ID NO: 3523627 - RNA, 13 nt, Human
cuagcuggcucug

SEQ ID NO: 3523628 - RNA, 21 nt, Human
cuagcugggggugggccaggc

SEQ ID NO: 3523629 - RNA, 22 nt, Human
cuagcuggugguuucacggugc

SEQ ID NO: 3523630 - RNA, 14 nt, Human
cuagcuucugcuuu

SEQ ID NO: 3523631 - RNA, 18 nt, Human
cuagcuucugcuuuucug

SEQ ID NO: 3523632 - RNA, 19 nt, Human
cuagcuuuagacccugggu

SEQ ID NO: 3523633 - RNA, 19 nt, Human
cuagcuuuauauauggaca

SEQ ID NO: 3523634 - RNA, 21 nt, Human
cuagcuuuauauauggacaug

SEQ ID NO: 3523635 - RNA, 22 nt, Human
cuagcuuuauauauggacaugg

SEQ ID NO: 3523636 - RNA, 15 nt, Human
cuagcuuuuaggaaa

SEQ ID NO: 3523637 - RNA, 11 nt, Human
cuaggaaaaaa

SEQ ID NO: 3523638 - RNA, 15 nt, Human
cuaggaaaauauuuu

SEQ ID NO: 3523639 - RNA, 14 nt, Human
cuaggaaacucaca

SEQ ID NO: 3523640 - RNA, 22 nt, Human
cuaggaaauauuuauuuuaaua

SEQ ID NO: 3523641 - RNA, 14 nt, Human
cuaggaacaaaucu

SEQ ID NO: 3523642 - RNA, 14 nt, Human
cuaggaagaauuuu

SEQ ID NO: 3523643 - RNA, 23 nt, Human
cuaggaagagcaggacuccaggc

SEQ ID NO: 3523644 - RNA, 16 nt, Human
cuaggaagagucuacc

SEQ ID NO: 3523645 - RNA, 15 nt, Human
cuaggaagccucaga

SEQ ID NO: 3523646 - RNA, 16 nt, Human
cuaggaagccucagau

SEQ ID NO: 3523647 - RNA, 17 nt, Human
cuaggaauauagauuaa

SEQ ID NO: 3523648 - RNA, 17 nt, Human
cuaggaaugaaauccug

SEQ ID NO: 3523649 - RNA, 22 nt, Human
cuaggacauguucccuucuccu

SEQ ID NO: 3523650 - RNA, 18 nt, Human
cuaggaccacucagcccc

SEQ ID NO: 3523651 - RNA, 21 nt, Human
cuaggaccaugguuaagaguc

SEQ ID NO: 3523652 - RNA, 23 nt, Human
cuaggaccaugguuaagagucca

SEQ ID NO: 3523653 - RNA, 22 nt, Human
cuaggacccgucuccagcugcu

SEQ ID NO: 3523654 - RNA, 23 nt, Human
cuaggacccgucuccagcugcug

SEQ ID NO: 3523655 - RNA, 22 nt, Human
cuaggacgccacccagcaaaag

SEQ ID NO: 3523656 - RNA, 18 nt, Human
cuaggagaaccaaaucug

SEQ ID NO: 3523657 - RNA, 20 nt, Human
cuaggagaccaaggcgggag

SEQ ID NO: 3523658 - RNA, 23 nt, Human
cuaggagauaucugagggaggag

SEQ ID NO: 3523659 - RNA, 15 nt, Human
cuaggagcugggagg

SEQ ID NO: 3523660 - RNA, 16 nt, Human
cuaggagcugggagga

SEQ ID NO: 3523661 - RNA, 19 nt, Human
cuaggagcugggaggaaaa

SEQ ID NO: 3523662 - RNA, 17 nt, Human
cuaggagcuuugacuca

SEQ ID NO: 3523663 - RNA, 20 nt, Human
cuaggagcuuugacucagga

SEQ ID NO: 3523664 - RNA, 23 nt, Human
cuaggagcuuugacucaggagcc

SEQ ID NO: 3523665 - RNA, 20 nt, Human
cuaggaggguccucugagac

SEQ ID NO: 3523666 - RNA, 19 nt, Human
cuaggaguauauuuccgca

SEQ ID NO: 3523667 - RNA, 19 nt, Human
cuaggauaaaaagccaggg

SEQ ID NO: 3523668 - RNA, 22 nt, Human
cuaggauaaaaagccagggcug

SEQ ID NO: 3523669 - RNA, 17 nt, Human
cuaggauaucuucucca

SEQ ID NO: 3523670 - RNA, 22 nt, Human
cuaggaugugcauucuccagcc

SEQ ID NO: 3523671 - RNA, 22 nt, Human
cuaggauucacaccccaccugc

SEQ ID NO: 3523672 - RNA, 16 nt, Human
cuaggauuugaacacu

SEQ ID NO: 3523673 - RNA, 13 nt, Human
cuaggcaacauag

SEQ ID NO: 3523674 - RNA, 19 nt, Human
cuaggcacuguaguucuaa

SEQ ID NO: 3523675 - RNA, 21 nt, Human
cuaggcacuguaguucuaaga

SEQ ID NO: 3523676 - RNA, 23 nt, Human
cuaggcaguuagagaugccuccc

SEQ ID NO: 3523677 - RNA, 14 nt, Human
cuaggcaucccagg

SEQ ID NO: 3523678 - RNA, 18 nt, Human
cuaggcaucccaggggac

SEQ ID NO: 3523679 - RNA, 19 nt, Human
cuaggcaucccaggggacc

SEQ ID NO: 3523680 - RNA, 21 nt, Human
cuaggcauucuggaccucugg

SEQ ID NO: 3523681 - RNA, 21 nt, Human
cuaggcauuugcugaauacag

SEQ ID NO: 3523682 - RNA, 16 nt, Human
cuaggccacuccucca

SEQ ID NO: 3523683 - RNA, 19 nt, Human
cuaggccacuccuccaaag

SEQ ID NO: 3523684 - RNA, 16 nt, Human
cucagugugacuccuc

SEQ ID NO: 3523685 - RNA, 16 nt, Human
cucaguuaaaauguga

SEQ ID NO: 3523686 - RNA, 23 nt, Human
cucaguuauuacauguaauuuga

SEQ ID NO: 3523687 - RNA, 20 nt, Human
cucaguucauccauucuauu

SEQ ID NO: 3523688 - RNA, 22 nt, Human
cucaguuccgauuucccaggcu

SEQ ID NO: 3523689 - RNA, 20 nt, Human
cucaguucuagucucucugg

SEQ ID NO: 3523690 - RNA, 17 nt, Human
cucaguucucuucacuc

SEQ ID NO: 3523691 - RNA, 17 nt, Human
cucaguugcuaaacacu

SEQ ID NO: 3523692 - RNA, 18 nt, Human
cucaguugcuaaacacug

SEQ ID NO: 3523693 - RNA, 16 nt, Human
cucaguuguagaaugu

SEQ ID NO: 3523694 - RNA, 12 nt, Human
cucaguugugca

SEQ ID NO: 3523695 - RNA, 14 nt, Human
cucaguugugcagc

SEQ ID NO: 3523696 - RNA, 12 nt, Human
cucaguuucccu

SEQ ID NO: 3523697 - RNA, 16 nt, Human
cucaguuucccuaucu

SEQ ID NO: 3523698 - RNA, 22 nt, Human
cucaguuugugugucuuaauua

SEQ ID NO: 3523699 - RNA, 13 nt, Human
cucaguuuucaua

SEQ ID NO: 3523700 - RNA, 14 nt, Human
cucaguuuucauaa

SEQ ID NO: 3523701 - RNA, 14 nt, Human
cucaguuuuucuua

SEQ ID NO: 3523702 - RNA, 14 nt, Human
cucauaaaaagcaa

SEQ ID NO: 3523703 - RNA, 22 nt, Human
cucauaacucugugaucuugcu

SEQ ID NO: 3523704 - RNA, 20 nt, Human
cucauaacuugagaccuaau

SEQ ID NO: 3523705 - RNA, 15 nt, Human
cucauaaugugaagu

SEQ ID NO: 3523706 - RNA, 17 nt, Human
cucauaaugugaagugu

SEQ ID NO: 3523707 - RNA, 21 nt, Human
cucauacccacccccacccaa

SEQ ID NO: 3523708 - RNA, 16 nt, Human
cucauaccuuuaaagg

SEQ ID NO: 3523709 - RNA, 14 nt, Human
cucauagcauuaac

SEQ ID NO: 3523710 - RNA, 21 nt, Human
cucauaggaaaaguacauuua

SEQ ID NO: 3523711 - RNA, 19 nt, Human
cucauagggaagaccugcu

SEQ ID NO: 3523712 - RNA, 16 nt, Human
cucauagguugagcaa

SEQ ID NO: 3523713 - RNA, 23 nt, Human
cucauaguaugguggcuggguug

SEQ ID NO: 3523714 - RNA, 19 nt, Human
cucauauauaucuaucuua

SEQ ID NO: 3523715 - RNA, 15 nt, Human
cucauaucaguuugc

SEQ ID NO: 3523716 - RNA, 14 nt, Human
cucauauuuucaug

SEQ ID NO: 3523717 - RNA, 14 nt, Human
cucaucaacaaaga

SEQ ID NO: 3523718 - RNA, 13 nt, Human
cucaucaacugaa

SEQ ID NO: 3523719 - RNA, 15 nt, Human
cucaucacuccccuc

SEQ ID NO: 3523720 - RNA, 16 nt, Human
cucaucacuccccucc

SEQ ID NO: 3523721 - RNA, 17 nt, Human
cucaucacuccccucca

SEQ ID NO: 3523722 - RNA, 13 nt, Human
cucaucacugugg

SEQ ID NO: 3523723 - RNA, 16 nt, Human
cucaucaggaugaacc

SEQ ID NO: 3523724 - RNA, 12 nt, Human
cucaucaguagu

SEQ ID NO: 3523725 - RNA, 12 nt, Human
cucaucauaaaa

SEQ ID NO: 3523726 - RNA, 16 nt, Human
cucaucauaaaauaaa

SEQ ID NO: 3523727 - RNA, 13 nt, Human
cucaucauucucu

SEQ ID NO: 3523728 - RNA, 15 nt, Human
cucaucauucucugu

SEQ ID NO: 3523729 - RNA, 12 nt, Human
cucaucauuuuu

SEQ ID NO: 3523730 - RNA, 13 nt, Human
cucauccacccca

SEQ ID NO: 3523731 - RNA, 22 nt, Human
cucauccacucuacuaaugccu

SEQ ID NO: 3523732 - RNA, 22 nt, Human
cucaucccaugagacccuggug

SEQ ID NO: 3523733 - RNA, 19 nt, Human
cucauccccagucccaaug

SEQ ID NO: 3523734 - RNA, 16 nt, Human
cucauccccucacuug

SEQ ID NO: 3523735 - RNA, 22 nt, Human
cucaucccgagcaccuccacau

SEQ ID NO: 3523736 - RNA, 18 nt, Human
cucaucccuaaugcugca

SEQ ID NO: 3523737 - RNA, 21 nt, Human
cucaucccuaaugcugcagau

SEQ ID NO: 3523738 - RNA, 15 nt, Human
cucauccgaggcagg

SEQ ID NO: 3523739 - RNA, 17 nt, Human
cucauccgaggcagggu

SEQ ID NO: 3523740 - RNA, 22 nt, Human
cucauccucagaugcucaaagu

SEQ ID NO: 3523741 - RNA, 16 nt, Human
cucauccugaacagca

SEQ ID NO: 3523742 - RNA, 18 nt, Human
cucauccugaacagcaug

SEQ ID NO: 3523743 - RNA, 13 nt, Human
cucauccugcagg

SEQ ID NO: 3523744 - RNA, 17 nt, Human
cucauccuuuucuccua

SEQ ID NO: 3523745 - RNA, 12 nt, Human
cucaucucaggu

SEQ ID NO: 3523746 - RNA, 11 nt, Human
cucaucucagu

SEQ ID NO: 3523747 - RNA, 18 nt, Human
cucaucucuaacagcuca

SEQ ID NO: 3523748 - RNA, 24 nt, Human
cucaucucuaacagcucaggaucu

SEQ ID NO: 3523749 - RNA, 19 nt, Human
cucaucugaaauguuacaa

SEQ ID NO: 3523750 - RNA, 21 nt, Human
cucaucugaaauguuacaaaa

SEQ ID NO: 3523751 - RNA, 15 nt, Human
cucaucugcacccuu

SEQ ID NO: 3523752 - RNA, 19 nt, Human
cucaucugcacccuucuuu

SEQ ID NO: 3523753 - RNA, 21 nt, Human
cucaucugcacccuucuuuuc

SEQ ID NO: 3523754 - RNA, 16 nt, Human
cucaucugcugguccg

SEQ ID NO: 3523755 - RNA, 21 nt, Human
cucaucuggggagcaggcagc

SEQ ID NO: 3523756 - RNA, 18 nt, Human
cucaucugggggagugga

SEQ ID NO: 3523757 - RNA, 19 nt, Human
cucaucugggggaguggaa

SEQ ID NO: 3523758 - RNA, 23 nt, Human
cucaucugucuggaggggagcuc

SEQ ID NO: 3523759 - RNA, 13 nt, Human
cucaucuuacugu

SEQ ID NO: 3523760 - RNA, 20 nt, Human
cucaucuugaagggcccagg

SEQ ID NO: 3523761 - RNA, 22 nt, Human
cucaucuuucauuaaaggcuuc

SEQ ID NO: 3523762 - RNA, 17 nt, Human
cucaucuuucccuccuu

SEQ ID NO: 3523763 - RNA, 17 nt, Human
cucaugaggaggggccc

SEQ ID NO: 3523764 - RNA, 23 nt, Human
cucaugaggaggggccccccugc

SEQ ID NO: 3523765 - RNA, 20 nt, Human
cucaugaucuugugacauau

SEQ ID NO: 3523766 - RNA, 17 nt, Human
cucaugcaucuccaccu

SEQ ID NO: 3523767 - RNA, 20 nt, Human
cucaugcaucuccaccugcu

SEQ ID NO: 3523768 - RNA, 22 nt, Human
cucaugccaguaacaggcucaa

SEQ ID NO: 3523769 - RNA, 13 nt, Human
cucaugcccaccc

SEQ ID NO: 3523770 - RNA, 20 nt, Human
cucaugcccacccccugccc

SEQ ID NO: 3523771 - RNA, 14 nt, Human
cucaugccccuggc

SEQ ID NO: 3523772 - RNA, 16 nt, Human
cucaugccucagccuc

SEQ ID NO: 3523773 - RNA, 13 nt, Human
cucaugcugaaag

SEQ ID NO: 3523774 - RNA, 14 nt, Human
cucaugcugccccu

SEQ ID NO: 3523775 - RNA, 20 nt, Human
cucaugcugccccugccuug

SEQ ID NO: 3523776 - RNA, 12 nt, Human
cucaugggcccc

SEQ ID NO: 3523777 - RNA, 16 nt, Human
cucaugggccccucug

SEQ ID NO: 3523778 - RNA, 20 nt, Human
cucaugggccccucugacuc

SEQ ID NO: 3523779 - RNA, 20 nt, Human
cucaugguccccauggcaug

SEQ ID NO: 3523780 - RNA, 16 nt, Human
cucauguacauacccu

SEQ ID NO: 3523781 - RNA, 12 nt, Human
cucauguagcaa

SEQ ID NO: 3523782 - RNA, 14 nt, Human
cucaugugacucuu

SEQ ID NO: 3523783 - RNA, 12 nt, Human
cucaugugaucc

SEQ ID NO: 3523784 - RNA, 14 nt, Human
cucaugugauccuu

SEQ ID NO: 3523785 - RNA, 16 nt, Human
cucaugugauccuuuu

SEQ ID NO: 3523786 - RNA, 12 nt, Human
cucauguggcug

SEQ ID NO: 3523787 - RNA, 12 nt, Human
cucauguguaug

SEQ ID NO: 3523788 - RNA, 15 nt, Human
cucauguguuugcau

SEQ ID NO: 3523789 - RNA, 16 nt, Human
cucauguucugcuuuc

SEQ ID NO: 3523790 - RNA, 12 nt, Human
cucauguucuua

SEQ ID NO: 3523791 - RNA, 21 nt, Human
cucauguuuaugaaaauaaau

SEQ ID NO: 3523792 - RNA, 17 nt, Human
cucauguuuucaacugc

SEQ ID NO: 3523793 - RNA, 20 nt, Human
cucauguuuucaacugccaa

SEQ ID NO: 3523794 - RNA, 21 nt, Human
cucauguuuuccauuguuuga

SEQ ID NO: 3523795 - RNA, 23 nt, Human
cucauuaaccgaugcuuuaccaa

SEQ ID NO: 3523796 - RNA, 15 nt, Human
cucauuaaugacacu

SEQ ID NO: 3523797 - RNA, 17 nt, Human
cucauuacggcuccucu

SEQ ID NO: 3523798 - RNA, 15 nt, Human
cucauuacugggccu

SEQ ID NO: 3523799 - RNA, 16 nt, Human
cucauuacugggccuu

SEQ ID NO: 3523800 - RNA, 23 nt, Human
cucauuacuuuaccacccccaca

SEQ ID NO: 3523801 - RNA, 17 nt, Human
cucauuacuuuugaagu

SEQ ID NO: 3523802 - RNA, 22 nt, Human
cucauuauuuauguccaggugu

SEQ ID NO: 3523803 - RNA, 15 nt, Human
cucauucaaaaguug

SEQ ID NO: 3523804 - RNA, 14 nt, Human
cucauucagcaucu

SEQ ID NO: 3523805 - RNA, 15 nt, Human
cucauucagcaucug

SEQ ID NO: 3523806 - RNA, 16 nt, Human
cucauucagcaucuga

SEQ ID NO: 3523807 - RNA, 19 nt, Human
cucaagagaucccaaguag

SEQ ID NO: 3523808 - RNA, 16 nt, Human
cucaagaggcugaggc

SEQ ID NO: 3523809 - RNA, 22 nt, Human
cucaagauacugcuacuguaau

SEQ ID NO: 3523810 - RNA, 20 nt, Human
cucaagaugggggcagggcu

SEQ ID NO: 3523811 - RNA, 17 nt, Human
cucaagauucccaggag

SEQ ID NO: 3523812 - RNA, 21 nt, Human
cucaagauucccaggaguucu

SEQ ID NO: 3523813 - RNA, 20 nt, Human
cucaagcaauccuccugagu

SEQ ID NO: 3523814 - RNA, 12 nt, Human
cucaagcacuga

SEQ ID NO: 3523815 - RNA, 14 nt, Human
cucaagcacugaua

SEQ ID NO: 3523816 - RNA, 14 nt, Human
cucaagcagucuac

SEQ ID NO: 3523817 - RNA, 16 nt, Human
cucaagccaagcagcc

SEQ ID NO: 3523818 - RNA, 19 nt, Human
cucaagccagacucugcca

SEQ ID NO: 3523819 - RNA, 15 nt, Human
cucaagcccaggagg

SEQ ID NO: 3523820 - RNA, 17 nt, Human
cucaagcccgcggggac

SEQ ID NO: 3523821 - RNA, 12 nt, Human
cucaagcccugc

SEQ ID NO: 3523822 - RNA, 13 nt, Human
cucaagcccugca

SEQ ID NO: 3523823 - RNA, 18 nt, Human
cucaagcggguggcucug

SEQ ID NO: 3523824 - RNA, 17 nt, Human
cucaagcugcaucuaga

SEQ ID NO: 3523825 - RNA, 13 nt, Human
cucaaggaaucuu

SEQ ID NO: 3523826 - RNA, 21 nt, Human
cucaaggaaucuuuaagcaga

SEQ ID NO: 3523827 - RNA, 10 nt, Human
cucaaggacu

SEQ ID NO: 3523828 - RNA, 16 nt, Human
cucaaggacuuugcag

SEQ ID NO: 3523829 - RNA, 22 nt, Human
cucaaggacuuugcagccggca

SEQ ID NO: 3523830 - RNA, 20 nt, Human
ccauggcuaaggcaccagcc

SEQ ID NO: 3523831 - RNA, 16 nt, Human
ccauggcucagggugg

SEQ ID NO: 3523832 - RNA, 17 nt, Human
ccauggcugcacaguug

SEQ ID NO: 3523833 - RNA, 15 nt, Human
cuccacucagcuguc

SEQ ID NO: 3523834 - RNA, 19 nt, Human
cuccacucugacuggcaca

SEQ ID NO: 3523835 - RNA, 12 nt, Human
cuccacucugcu

SEQ ID NO: 3523836 - RNA, 14 nt, Human
cuccacucugcuuc

SEQ ID NO: 3523837 - RNA, 16 nt, Human
cuccacucugcuucuc

SEQ ID NO: 3523838 - RNA, 20 nt, Human
cuccacucugcuucucugac

SEQ ID NO: 3523839 - RNA, 14 nt, Human
cuccacucuuucuu

SEQ ID NO: 3523840 - RNA, 13 nt, Human
cuccacugcccuc

SEQ ID NO: 3523841 - RNA, 14 nt, Human
cuccacugcccucu

SEQ ID NO: 3523842 - RNA, 14 nt, Human
cuccacugccuucg

SEQ ID NO: 3523843 - RNA, 16 nt, Human
cuccacugccuucgau

SEQ ID NO: 3523844 - RNA, 14 nt, Human
cuccacuggaugga

SEQ ID NO: 3523845 - RNA, 15 nt, Human
cuccacuuggucugu

SEQ ID NO: 3523846 - RNA, 16 nt, Human
cuccacuuggucugug

SEQ ID NO: 3523847 - RNA, 16 nt, Human
cuccacuuucagcugu

SEQ ID NO: 3523848 - RNA, 19 nt, Human
cuccacuuucagcugucuu

SEQ ID NO: 3523849 - RNA, 20 nt, Human
cuccacuuucuagccagagg

SEQ ID NO: 3523850 - RNA, 15 nt, Human
cuccagaaacggcca

SEQ ID NO: 3523851 - RNA, 19 nt, Human
cuccagaaccgcagaagcc

SEQ ID NO: 3523852 - RNA, 20 nt, Human
cuccagaaccgcagaagccu

SEQ ID NO: 3523853 - RNA, 16 nt, Human
cuccagaacucuuccu

SEQ ID NO: 3523854 - RNA, 16 nt, Human
cuccagaagcacuggg

SEQ ID NO: 3523855 - RNA, 17 nt, Human
cuccagaagccucuggc

SEQ ID NO: 3523856 - RNA, 19 nt, Human
cuccagaagccucuggcua

SEQ ID NO: 3523857 - RNA, 20 nt, Human
cuccagaauuuggaaauccu

SEQ ID NO: 3523858 - RNA, 11 nt, Human
cuccagacaca

SEQ ID NO: 3523859 - RNA, 17 nt, Human
cuccagacacaugucca

SEQ ID NO: 3523860 - RNA, 12 nt, Human
cuccagaccccc

SEQ ID NO: 3523861 - RNA, 14 nt, Human
cuccagaccccugg

SEQ ID NO: 3523862 - RNA, 20 nt, Human
cuccagaccccuggcuuuuc

SEQ ID NO: 3523863 - RNA, 14 nt, Human
cuccagaccugauc

SEQ ID NO: 3523864 - RNA, 13 nt, Human
cuccagacucucu

SEQ ID NO: 3523865 - RNA, 15 nt, Human
cuccagacucucugu

SEQ ID NO: 3523866 - RNA, 21 nt, Human
cuccagagaguaucugaggca

SEQ ID NO: 3523867 - RNA, 19 nt, Human
cuccagagcaacgaccagg

SEQ ID NO: 3523868 - RNA, 13 nt, Human
cuccagaucugca

SEQ ID NO: 3523869 - RNA, 18 nt, Human
cuccagaugcagggcagu

SEQ ID NO: 3523870 - RNA, 19 nt, Human
cuccagauguuuccagacu

SEQ ID NO: 3523871 - RNA, 17 nt, Human
cuccagcaacacagccu

SEQ ID NO: 3523872 - RNA, 18 nt, Human
cuccagcacaaacacaag

SEQ ID NO: 3523873 - RNA, 14 nt, Human
cuccagcaggccca

SEQ ID NO: 3523874 - RNA, 17 nt, Human
cuccagccaaccccugu

SEQ ID NO: 3523875 - RNA, 19 nt, Human
cuccagccaaccccugugg

SEQ ID NO: 3523876 - RNA, 20 nt, Human
cuccagccaaccccugugga

SEQ ID NO: 3523877 - RNA, 16 nt, Human
cuccagccagcaauga

SEQ ID NO: 3523878 - RNA, 23 nt, Human
cuccagccagcaaugauguccag

SEQ ID NO: 3523879 - RNA, 13 nt, Human
cuccagccagcgc

SEQ ID NO: 3523880 - RNA, 15 nt, Human
cuccagccagcgccu

SEQ ID NO: 3523881 - RNA, 23 nt, Human
cuccagccagcgccucccuccac

SEQ ID NO: 3523882 - RNA, 20 nt, Human
cuccagccaucaagagacug

SEQ ID NO: 3523883 - RNA, 18 nt, Human
cuccagccccucuuggag

SEQ ID NO: 3523884 - RNA, 17 nt, Human
cuccagccccuggaugc

SEQ ID NO: 3523885 - RNA, 13 nt, Human
cuccagccccugu

SEQ ID NO: 3523886 - RNA, 19 nt, Human
cuccagccccuucucagaa

SEQ ID NO: 3523887 - RNA, 14 nt, Human
cuccagcccgggag

SEQ ID NO: 3523888 - RNA, 19 nt, Human
cuccagcccgggagccuag

SEQ ID NO: 3523889 - RNA, 20 nt, Human
cuccagcccgggagccuagg

SEQ ID NO: 3523890 - RNA, 21 nt, Human
cuccagcccgggagccuagga

SEQ ID NO: 3523891 - RNA, 22 nt, Human
cuccagcccgggagccuaggac

SEQ ID NO: 3523892 - RNA, 18 nt, Human
cuccagccucagcccccu

SEQ ID NO: 3523893 - RNA, 17 nt, Human
cuccagccucagccucc

SEQ ID NO: 3523894 - RNA, 20 nt, Human
cuccagccugaacagaagcu

SEQ ID NO: 3523895 - RNA, 13 nt, Human
cuccagccugaca

SEQ ID NO: 3523896 - RNA, 17 nt, Human
cuccagccugccuggca

SEQ ID NO: 3523897 - RNA, 23 nt, Human
cuccagccuggaaaccugucuga

SEQ ID NO: 3523898 - RNA, 20 nt, Human
cuccagccuggacccccagc

SEQ ID NO: 3523899 - RNA, 12 nt, Human
cuccagccuggg

SEQ ID NO: 3523900 - RNA, 14 nt, Human
cuccagcucaccag

SEQ ID NO: 3523901 - RNA, 15 nt, Human
cuccagcucaccagc

SEQ ID NO: 3523902 - RNA, 19 nt, Human
cuccagcucaccagcccca

SEQ ID NO: 3523903 - RNA, 16 nt, Human
cuccagcucagaaccc

SEQ ID NO: 3523904 - RNA, 19 nt, Human
cuccagcucagaacccagg

SEQ ID NO: 3523905 - RNA, 21 nt, Human
cuccagcucagaacccagggc

SEQ ID NO: 3523906 - RNA, 24 nt, Human
cuccagcucagaacccagggcucu

SEQ ID NO: 3523907 - RNA, 13 nt, Human
cuccagcuccaag

SEQ ID NO: 3523908 - RNA, 21 nt, Human
cuccagcuccaagaccuguug

SEQ ID NO: 3523909 - RNA, 13 nt, Human
cuccagcucccug

SEQ ID NO: 3523910 - RNA, 22 nt, Human
cuccagcucuggcauggcuagg

SEQ ID NO: 3523911 - RNA, 11 nt, Human
cuccagcugcc

SEQ ID NO: 3523912 - RNA, 14 nt, Human
cuccagcugccccg

SEQ ID NO: 3523913 - RNA, 20 nt, Human
cuccagcugcugagauccug

SEQ ID NO: 3523914 - RNA, 21 nt, Human
cuccagcugcugagauccugg

SEQ ID NO: 3523915 - RNA, 23 nt, Human
cuccagcuggccgggagccugau

SEQ ID NO: 3523916 - RNA, 18 nt, Human
cuccagcuguucagcugg

SEQ ID NO: 3523917 - RNA, 13 nt, Human
cuccagcuuuccu

SEQ ID NO: 3523918 - RNA, 20 nt, Human
cuccaggaaggggcuggacu

SEQ ID NO: 3523919 - RNA, 11 nt, Human
cuccaggacca

SEQ ID NO: 3523920 - RNA, 22 nt, Human
cuccaggagaggagcgggaccu

SEQ ID NO: 3523921 - RNA, 13 nt, Human
cuccaggagcagc

SEQ ID NO: 3523922 - RNA, 15 nt, Human
cuccaggagcagcca

SEQ ID NO: 3523923 - RNA, 17 nt, Human
cuccaggagcagccaca

SEQ ID NO: 3523924 - RNA, 16 nt, Human
cuccaggcaccaucuc

SEQ ID NO: 3523925 - RNA, 16 nt, Human
cuccaggcacccuucu

SEQ ID NO: 3523926 - RNA, 21 nt, Human
cuccaggcacccuucuuuccu

SEQ ID NO: 3523927 - RNA, 11 nt, Human
cuccaggcagc

SEQ ID NO: 3523928 - RNA, 19 nt, Human
cuccaggcagcagacacau

SEQ ID NO: 3523929 - RNA, 20 nt, Human
cuccaggcauuuagcccuca

SEQ ID NO: 3523930 - RNA, 17 nt, Human
cuccaggcccgucuguc

SEQ ID NO: 3523931 - RNA, 13 nt, Human
cuccaggcccucc

SEQ ID NO: 3523932 - RNA, 17 nt, Human
cuccaggccugcagcag

SEQ ID NO: 3523933 - RNA, 15 nt, Human
cuccaggccugccuc

SEQ ID NO: 3523934 - RNA, 17 nt, Human
cuccaggccugccuccc

SEQ ID NO: 3523935 - RNA, 18 nt, Human
cuccaggccugccuccca

SEQ ID NO: 3523936 - RNA, 13 nt, Human
cuccaggccuguu

SEQ ID NO: 3523937 - RNA, 20 nt, Human
cuccaggccuguugcuauag

SEQ ID NO: 3523938 - RNA, 11 nt, Human
cuccaggcucc

SEQ ID NO: 3523939 - RNA, 14 nt, Human
cuccagggacacac

SEQ ID NO: 3523940 - RNA, 19 nt, Human
cuccagggacacacagccu

SEQ ID NO: 3523941 - RNA, 17 nt, Human
cuccagggaguccccuc

SEQ ID NO: 3523942 - RNA, 22 nt, Human
cuccagggaugauucaagccau

SEQ ID NO: 3523943 - RNA, 19 nt, Human
cuccagggccacgugccag

SEQ ID NO: 3523944 - RNA, 18 nt, Human
cuccaggggcugcuuccu

SEQ ID NO: 3523945 - RNA, 22 nt, Human
cuccagggguccuaggccucaa

SEQ ID NO: 3523946 - RNA, 20 nt, Human
cuccagggucagaaacagga

SEQ ID NO: 3523947 - RNA, 21 nt, Human
cuccagggucagaaacaggac

SEQ ID NO: 3523948 - RNA, 15 nt, Human
cuccagggugauuuu

SEQ ID NO: 3523949 - RNA, 17 nt, Human
cuccagguaccuugacc

SEQ ID NO: 3523950 - RNA, 23 nt, Human
cuccagguauucguuaucuaaua

SEQ ID NO: 3523951 - RNA, 22 nt, Human
cuccagguccucuacuuaauga

SEQ ID NO: 3523952 - RNA, 11 nt, Human
cuccaggugca

SEQ ID NO: 3523953 - RNA, 14 nt, Human
cuccaggugcagag

SEQ ID NO: 3523954 - RNA, 15 nt, Human
cuccaggugcagagg

SEQ ID NO: 3523955 - RNA, 18 nt, Human
cuccagguuuuucaauua

SEQ ID NO: 3523956 - RNA, 19 nt, Human
cuccagguuuuucaauuaa

SEQ ID NO: 3523957 - RNA, 16 nt, Human
cuccaguaccuugcuu

SEQ ID NO: 3523958 - RNA, 16 nt, Human
cuccaguacuggagcu

SEQ ID NO: 3523959 - RNA, 21 nt, Human
cuccaguacuggagcuucucu

SEQ ID NO: 3523960 - RNA, 14 nt, Human
cuccaguccccaga

SEQ ID NO: 3523961 - RNA, 16 nt, Human
cuccaguccccagaac

SEQ ID NO: 3523962 - RNA, 21 nt, Human
cuccagucccccuauccuugg

SEQ ID NO: 3523963 - RNA, 15 nt, Human
cuccaguccugcucu

SEQ ID NO: 3523964 - RNA, 16 nt, Human
cuccaguccugcucuc

SEQ ID NO: 3523965 - RNA, 12 nt, Human
cuccagucugcu

SEQ ID NO: 3523966 - RNA, 19 nt, Human
cuccagucuuccaccugga

SEQ ID NO: 3523967 - RNA, 20 nt, Human
cuccaguguccugagcucag

SEQ ID NO: 3523968 - RNA, 14 nt, Human
cuccauaaccccac

SEQ ID NO: 3523969 - RNA, 17 nt, Human
cuccauacacacgcugc

SEQ ID NO: 3523970 - RNA, 20 nt, Human
cuccauacacacgcugccuu

SEQ ID NO: 3523971 - RNA, 19 nt, Human
cuccauagaccuuuucauu

SEQ ID NO: 3523972 - RNA, 20 nt, Human
cuccauaguuuggcauuugc

SEQ ID NO: 3523973 - RNA, 15 nt, Human
cuccaucagcuguaa

SEQ ID NO: 3523974 - RNA, 13 nt, Human
cuccauccaaggc

SEQ ID NO: 3523975 - RNA, 18 nt, Human
cccaccaugucugcccca

SEQ ID NO: 3523976 - RNA, 18 nt, Human
cccaccauuuggcauccc

SEQ ID NO: 3523977 - RNA, 23 nt, Human
cccaccauuuggcaucccugggc

SEQ ID NO: 3523978 - RNA, 15 nt, Human
cccacccaagcuugg

SEQ ID NO: 3523979 - RNA, 21 nt, Human
cccacccaagggccuggccug

SEQ ID NO: 3523980 - RNA, 23 nt, Human
cccacccagaugccccuuucugg

SEQ ID NO: 3523981 - RNA, 13 nt, Human
cccacccagccug

SEQ ID NO: 3523982 - RNA, 13 nt, Human
cccacccaggagg

SEQ ID NO: 3523983 - RNA, 14 nt, Human
cccaccccacacuu

SEQ ID NO: 3523984 - RNA, 15 nt, Human
cccaccccaccugca

SEQ ID NO: 3523985 - RNA, 14 nt, Human
cccaccccagccua

SEQ ID NO: 3523986 - RNA, 13 nt, Human
cccaccccauucc

SEQ ID NO: 3523987 - RNA, 13 nt, Human
cccacccccaagg

SEQ ID NO: 3523988 - RNA, 12 nt, Human
cccacccccacc

SEQ ID NO: 3523989 - RNA, 13 nt, Human
cccacccccagcc

SEQ ID NO: 3523990 - RNA, 18 nt, Human
cccacccccagccccgac

SEQ ID NO: 3523991 - RNA, 13 nt, Human
cccacccccagcu

SEQ ID NO: 3523992 - RNA, 14 nt, Human
cccaccccccucau

SEQ ID NO: 3523993 - RNA, 17 nt, Human
cccacccccuccccagg

SEQ ID NO: 3523994 - RNA, 14 nt, Human
cccacccccugccc

SEQ ID NO: 3523995 - RNA, 15 nt, Human
cccacccccugcccu

SEQ ID NO: 3523996 - RNA, 17 nt, Human
cccacccccugcccugc

SEQ ID NO: 3523997 - RNA, 16 nt, Human
cccacccccuucucug

SEQ ID NO: 3523998 - RNA, 15 nt, Human
cccaccccgcucugc

SEQ ID NO: 3523999 - RNA, 16 nt, Human
cccaccccgcucugca

SEQ ID NO: 3524000 - RNA, 13 nt, Human
cccaccccuagga

SEQ ID NO: 3524001 - RNA, 13 nt, Human
cccaccccugugc

SEQ ID NO: 3524002 - RNA, 16 nt, Human
cccaccccugugcucc

SEQ ID NO: 3524003 - RNA, 13 nt, Human
cccaccccuuccc

SEQ ID NO: 3524004 - RNA, 22 nt, Human
cccaccccuuccccacugccug

SEQ ID NO: 3524005 - RNA, 14 nt, Human
cccaccccuugcuc

SEQ ID NO: 3524006 - RNA, 12 nt, Human
cccacccucagc

SEQ ID NO: 3524007 - RNA, 14 nt, Human
cccacccucagcac

SEQ ID NO: 3524008 - RNA, 18 nt, Human
cccacccucagcaccccu

SEQ ID NO: 3524009 - RNA, 21 nt, Human
cccacccucagcaccccuucc

SEQ ID NO: 3524010 - RNA, 13 nt, Human
cccacccuccacu

SEQ ID NO: 3524011 - RNA, 14 nt, Human
cccacccuccacuc

SEQ ID NO: 3524012 - RNA, 15 nt, Human
cccacccuccccuuc

SEQ ID NO: 3524013 - RNA, 13 nt, Human
cccacccuccugu

SEQ ID NO: 3524014 - RNA, 15 nt, Human
cccacccuccugucu

SEQ ID NO: 3524015 - RNA, 20 nt, Human
cccacccucguggacaccug

SEQ ID NO: 3524016 - RNA, 22 nt, Human
cccacccucguggacaccugcc

SEQ ID NO: 3524017 - RNA, 23 nt, Human
cccacccucguggacaccugccc

SEQ ID NO: 3524018 - RNA, 18 nt, Human
cccacccugaaagcccug

SEQ ID NO: 3524019 - RNA, 11 nt, Human
cccacccugcu

SEQ ID NO: 3524020 - RNA, 16 nt, Human
cccacccugcugccuu

SEQ ID NO: 3524021 - RNA, 21 nt, Human
cccacccugcuuggcccaggg

SEQ ID NO: 3524022 - RNA, 20 nt, Human
cccacccuggccuagaccag

SEQ ID NO: 3524023 - RNA, 12 nt, Human
cccacccuggga

SEQ ID NO: 3524024 - RNA, 13 nt, Human
cccacccugggcc

SEQ ID NO: 3524025 - RNA, 17 nt, Human
cccacccuguuccugcu

SEQ ID NO: 3524026 - RNA, 17 nt, Human
cccacccuguuuggauu

SEQ ID NO: 3524027 - RNA, 15 nt, Human
cccaccgcagacagg

SEQ ID NO: 3524028 - RNA, 18 nt, Human
cccaccgcaugcccccuc

SEQ ID NO: 3524029 - RNA, 19 nt, Human
cccaccgggccacuccuuc

SEQ ID NO: 3524030 - RNA, 22 nt, Human
cccaccgggccacuccuuccug

SEQ ID NO: 3524031 - RNA, 16 nt, Human
cccaccgguccagcug

SEQ ID NO: 3524032 - RNA, 17 nt, Human
cccaccgguugcuucug

SEQ ID NO: 3524033 - RNA, 19 nt, Human
cccaccgguugcuucuggg

SEQ ID NO: 3524034 - RNA, 22 nt, Human
cccaccguaaagugagcaugcu

SEQ ID NO: 3524035 - RNA, 15 nt, Human
cccaccgugggcagg

SEQ ID NO: 3524036 - RNA, 21 nt, Human
cccaccucagccucccaaagu

SEQ ID NO: 3524037 - RNA, 13 nt, Human
cccaccuccccac

SEQ ID NO: 3524038 - RNA, 15 nt, Human
cccaccuccccacgc

SEQ ID NO: 3524039 - RNA, 16 nt, Human
cccaccuccccacgcc

SEQ ID NO: 3524040 - RNA, 13 nt, Human
cucauguuuucca

SEQ ID NO: 3524041 - RNA, 18 nt, Human
cucauguuuuccauuguu

SEQ ID NO: 3524042 - RNA, 11 nt, Human
cucauuaaauu

SEQ ID NO: 3524043 - RNA, 19 nt, Human
cucauuaaccgaugcuuua

SEQ ID NO: 3524044 - RNA, 16 nt, Human
cucauuaaugacacuu

SEQ ID NO: 3524045 - RNA, 19 nt, Human
cucauuacuuguugccuau

SEQ ID NO: 3524046 - RNA, 21 nt, Human
cucauuaucgccuuuugacag

SEQ ID NO: 3524047 - RNA, 17 nt, Human
cucauucaguauuaaag

SEQ ID NO: 3524048 - RNA, 13 nt, Human
cucauucauuuua

SEQ ID NO: 3524049 - RNA, 22 nt, Human
cucauucauuuuauauugaaaa

SEQ ID NO: 3524050 - RNA, 17 nt, Human
cucauuccaacagugag

SEQ ID NO: 3524051 - RNA, 12 nt, Human
cucauuccccag

SEQ ID NO: 3524052 - RNA, 14 nt, Human
cucauuccccaggu

SEQ ID NO: 3524053 - RNA, 18 nt, Human
cucauuccuccaccugcc

SEQ ID NO: 3524054 - RNA, 12 nt, Human
cucauuccugua

SEQ ID NO: 3524055 - RNA, 21 nt, Human
cucauucuaaugauggcccau

SEQ ID NO: 3524056 - RNA, 12 nt, Human
cucauucuucug

SEQ ID NO: 3524057 - RNA, 23 nt, Human
cucauucuucuguacgucugaca

SEQ ID NO: 3524058 - RNA, 10 nt, Human
cucauugaaa

SEQ ID NO: 3524059 - RNA, 11 nt, Human
cucauugaaau

SEQ ID NO: 3524060 - RNA, 13 nt, Human
cucauugaaaugu

SEQ ID NO: 3524061 - RNA, 15 nt, Human
cucauugaaauguca

SEQ ID NO: 3524062 - RNA, 18 nt, Human
cucauugacaagaacuga

SEQ ID NO: 3524063 - RNA, 13 nt, Human
cucauugaccuga

SEQ ID NO: 3524064 - RNA, 12 nt, Human
cucauugacuuu

SEQ ID NO: 3524065 - RNA, 22 nt, Human
cucauugacuuuuauaaagcau

SEQ ID NO: 3524066 - RNA, 16 nt, Human
cucauugcugagccuc

SEQ ID NO: 3524067 - RNA, 18 nt, Human
cucauuggaaauuuagca

SEQ ID NO: 3524068 - RNA, 20 nt, Human
cucauuggaaauuuagcauu

SEQ ID NO: 3524069 - RNA, 13 nt, Human
cucauuucaucuc

SEQ ID NO: 3524070 - RNA, 17 nt, Human
cucauuuccaagcaagu

SEQ ID NO: 3524071 - RNA, 14 nt, Human
cucauuucuagcag

SEQ ID NO: 3524072 - RNA, 20 nt, Human
cucauuugggguagcuagag

SEQ ID NO: 3524073 - RNA, 17 nt, Human
cucauuugucacacacu

SEQ ID NO: 3524074 - RNA, 20 nt, Human
cucauuuuaaugauuguuua

SEQ ID NO: 3524075 - RNA, 16 nt, Human
cucauuuuaguugccu

SEQ ID NO: 3524076 - RNA, 20 nt, Human
cucauuuucuauaacagaua

SEQ ID NO: 3524077 - RNA, 13 nt, Human
cucauuuugcuug

SEQ ID NO: 3524078 - RNA, 19 nt, Human
cucauuuuuuuccuugcaa

SEQ ID NO: 3524079 - RNA, 22 nt, Human
cucauuuuuuuuuuuguuucug

SEQ ID NO: 3524080 - RNA, 23 nt, Human
cuccaaaaaaaaaaaaaauacaa

SEQ ID NO: 3524081 - RNA, 17 nt, Human
cuccaaaaaucugccug

SEQ ID NO: 3524082 - RNA, 18 nt, Human
cuccaaaaaucugccugg

SEQ ID NO: 3524083 - RNA, 16 nt, Human
cuccaaaacuccugcc

SEQ ID NO: 3524084 - RNA, 19 nt, Human
cuccaaaacuucguuuaau

SEQ ID NO: 3524085 - RNA, 15 nt, Human
cuccaaaaugugccu

SEQ ID NO: 3524086 - RNA, 14 nt, Human
cuccaaaccuucac

SEQ ID NO: 3524087 - RNA, 23 nt, Human
cuccaaacugaagcagccucucc

SEQ ID NO: 3524088 - RNA, 14 nt, Human
cuccaaaggccccc

SEQ ID NO: 3524089 - RNA, 15 nt, Human
cuccaaaggcccccu

SEQ ID NO: 3524090 - RNA, 16 nt, Human
cuccaaagucucugga

SEQ ID NO: 3524091 - RNA, 15 nt, Human
cuccaaaugagaucu

SEQ ID NO: 3524092 - RNA, 20 nt, Human
cuccaaauggagaagcugca

SEQ ID NO: 3524093 - RNA, 14 nt, Human
cuccaaauuuuucu

SEQ ID NO: 3524094 - RNA, 14 nt, Human
cuccaacauccacu

SEQ ID NO: 3524095 - RNA, 20 nt, Human
cuccaacccaaccucauccu

SEQ ID NO: 3524096 - RNA, 18 nt, Human
cuccaaccccccagcacu

SEQ ID NO: 3524097 - RNA, 20 nt, Human
cuccaaccccccagcacuga

SEQ ID NO: 3524098 - RNA, 21 nt, Human
cuccaaccccccagcacugag

SEQ ID NO: 3524099 - RNA, 23 nt, Human
cuccaaccccccagcacugagga

SEQ ID NO: 3524100 - RNA, 18 nt, Human
cuccaaccccucgcccag

SEQ ID NO: 3524101 - RNA, 13 nt, Human
cuccaacccugcc

SEQ ID NO: 3524102 - RNA, 23 nt, Human
cuccaacccugccgucaccacca

SEQ ID NO: 3524103 - RNA, 22 nt, Human
cuccaaccgggaugggagccgg

SEQ ID NO: 3524104 - RNA, 14 nt, Human
cuccaaccuaaccu

SEQ ID NO: 3524105 - RNA, 15 nt, Human
cuccaaccuaaccug

SEQ ID NO: 3524106 - RNA, 13 nt, Human
cuccaaccugcaa

SEQ ID NO: 3524107 - RNA, 14 nt, Human
cuccaagaaugcug

SEQ ID NO: 3524108 - RNA, 13 nt, Human
cuccaagaauuuc

SEQ ID NO: 3524109 - RNA, 14 nt, Human
cuccaagaccuagg

SEQ ID NO: 3524110 - RNA, 16 nt, Human
cuccaagaccuaggcu

SEQ ID NO: 3524111 - RNA, 17 nt, Human
cuccaagaccuucuccu

SEQ ID NO: 3524112 - RNA, 22 nt, Human
cuccaagaccuucuccuucacc

SEQ ID NO: 3524113 - RNA, 14 nt, Human
cuccaagauucuag

SEQ ID NO: 3524114 - RNA, 18 nt, Human
cuccaagauucuagauga

SEQ ID NO: 3524115 - RNA, 14 nt, Human
cuccaagcaggaca

SEQ ID NO: 3524116 - RNA, 15 nt, Human
cuccaagccagcaag

SEQ ID NO: 3524117 - RNA, 16 nt, Human
cuccaagccagcaagc

SEQ ID NO: 3524118 - RNA, 22 nt, Human
cuccaagcccagcccauggaga

SEQ ID NO: 3524119 - RNA, 18 nt, Human
cuccaagccccaucuucu

SEQ ID NO: 3524120 - RNA, 14 nt, Human
cuccaagcucccag

SEQ ID NO: 3524121 - RNA, 17 nt, Human
cuccaaggacagaaggc

SEQ ID NO: 3524122 - RNA, 20 nt, Human
cuccagcucaccagccccag

SEQ ID NO: 3524123 - RNA, 17 nt, Human
cuccagcucagaaccca

SEQ ID NO: 3524124 - RNA, 20 nt, Human
cuccagcucagaacccaggg

SEQ ID NO: 3524125 - RNA, 23 nt, Human
cuccagcucagaacccagggcuc

SEQ ID NO: 3524126 - RNA, 21 nt, Human
cuccagcucccugugccccca

SEQ ID NO: 3524127 - RNA, 17 nt, Human
cuccagcuccuuugggc

SEQ ID NO: 3524128 - RNA, 16 nt, Human
cuccagcucuggcaug

SEQ ID NO: 3524129 - RNA, 20 nt, Human
cuccagcugacuaaacuuuu

SEQ ID NO: 3524130 - RNA, 17 nt, Human
cuccagcugcaccagag

SEQ ID NO: 3524131 - RNA, 16 nt, Human
cuccagcugccccggc

SEQ ID NO: 3524132 - RNA, 20 nt, Human
cuccagcugcucugucuucu

SEQ ID NO: 3524133 - RNA, 23 nt, Human
cuccagcugcugagauccuggac

SEQ ID NO: 3524134 - RNA, 19 nt, Human
cuccagcugggcucugcaa

SEQ ID NO: 3524135 - RNA, 13 nt, Human
cuccagcuguuca

SEQ ID NO: 3524136 - RNA, 12 nt, Human
cuccagcuuccc

SEQ ID NO: 3524137 - RNA, 11 nt, Human
cuccagcuucu

SEQ ID NO: 3524138 - RNA, 13 nt, Human
cuccagcuucugg

SEQ ID NO: 3524139 - RNA, 20 nt, Human
cuccagcuucugguacucuc

SEQ ID NO: 3524140 - RNA, 22 nt, Human
cuccagcuucugguacucuccu

SEQ ID NO: 3524141 - RNA, 18 nt, Human
cuccagcuuguggagccc

SEQ ID NO: 3524142 - RNA, 19 nt, Human
cuccaggaagccuuccccu

SEQ ID NO: 3524143 - RNA, 16 nt, Human
cuccaggaaggggcug

SEQ ID NO: 3524144 - RNA, 18 nt, Human
cuccaggaaggggcugga

SEQ ID NO: 3524145 - RNA, 20 nt, Human
cuccaggaaugccuccuccc

SEQ ID NO: 3524146 - RNA, 14 nt, Human
cuccaggagcagcc

SEQ ID NO: 3524147 - RNA, 18 nt, Human
cuccaggagcagccacau

SEQ ID NO: 3524148 - RNA, 20 nt, Human
cuccaggcacccuucuuucc

SEQ ID NO: 3524149 - RNA, 12 nt, Human
cuccaggcagca

SEQ ID NO: 3524150 - RNA, 15 nt, Human
cuccaggcaggcuaa

SEQ ID NO: 3524151 - RNA, 12 nt, Human
cuccaggcccaa

SEQ ID NO: 3524152 - RNA, 23 nt, Human
cuccaggcccgucuguccaucug

SEQ ID NO: 3524153 - RNA, 18 nt, Human
cuccaggcccuccucucc

SEQ ID NO: 3524154 - RNA, 20 nt, Human
cuccaggcccuccucuccca

SEQ ID NO: 3524155 - RNA, 15 nt, Human
cuccaggccugcagc

SEQ ID NO: 3524156 - RNA, 22 nt, Human
cuccaggccugcagcaggagug

SEQ ID NO: 3524157 - RNA, 14 nt, Human
cuccaggccugccu

SEQ ID NO: 3524158 - RNA, 16 nt, Human
cuccaggccugccucc

SEQ ID NO: 3524159 - RNA, 15 nt, Human
cuccaggcuccuuua

SEQ ID NO: 3524160 - RNA, 21 nt, Human
cuccaggcugggugacagagc

SEQ ID NO: 3524161 - RNA, 20 nt, Human
cuccaggcuguaucccauga

SEQ ID NO: 3524162 - RNA, 19 nt, Human
cuccagggaauccaagccu

SEQ ID NO: 3524163 - RNA, 22 nt, Human
cuccagggacacacagccuagc

SEQ ID NO: 3524164 - RNA, 22 nt, Human
cuccagggagccuagaagcugg

SEQ ID NO: 3524165 - RNA, 23 nt, Human
cuccagggccacgugccaggccc

SEQ ID NO: 3524166 - RNA, 21 nt, Human
cuccagggcucaacacuguga

SEQ ID NO: 3524167 - RNA, 20 nt, Human
cuccagggcuggacugaggc

SEQ ID NO: 3524168 - RNA, 21 nt, Human
cuccagggcuggacugaggcc

SEQ ID NO: 3524169 - RNA, 14 nt, Human
cuccaggggcugcu

SEQ ID NO: 3524170 - RNA, 15 nt, Human
cuccaggggcugcuu

SEQ ID NO: 3524171 - RNA, 23 nt, Human
cuccaggggcugcuuccuccugg

SEQ ID NO: 3524172 - RNA, 19 nt, Human
cuccaggggggacaauaug

SEQ ID NO: 3524173 - RNA, 20 nt, Human
cuccagggguccuaggccuc

SEQ ID NO: 3524174 - RNA, 22 nt, Human
cuccaggugcacaagcuccaag

SEQ ID NO: 3524175 - RNA, 14 nt, Human
cuccagguggcucu

SEQ ID NO: 3524176 - RNA, 14 nt, Human
cuccaggugugcac

SEQ ID NO: 3524177 - RNA, 14 nt, Human
cuccagguuuuuca

SEQ ID NO: 3524178 - RNA, 15 nt, Human
cuccagguuuuucaa

SEQ ID NO: 3524179 - RNA, 16 nt, Human
cuccagguuuuucaau

SEQ ID NO: 3524180 - RNA, 20 nt, Human
cuccagguuuuucaauuaaa

SEQ ID NO: 3524181 - RNA, 14 nt, Human
cuccaguauucuug

SEQ ID NO: 3524182 - RNA, 16 nt, Human
cuccaguccaaggaaa

SEQ ID NO: 3524183 - RNA, 23 nt, Human
cuccaguccccagaacucugccu

SEQ ID NO: 3524184 - RNA, 23 nt, Human
cuccagucccccuauccuuggca

SEQ ID NO: 3524185 - RNA, 14 nt, Human
cuccaguccugcuc

SEQ ID NO: 3524186 - RNA, 22 nt, Human
cuccaguccugcucucuaccca

SEQ ID NO: 3524187 - RNA, 21 nt, Human
cuccagucugcugcccuccau

SEQ ID NO: 3524188 - RNA, 16 nt, Human
cuccagucuuccaccu

SEQ ID NO: 3524189 - RNA, 20 nt, Human
cuccagucuuccaccuggaa

SEQ ID NO: 3524190 - RNA, 14 nt, Human
cuccagugccaaca

SEQ ID NO: 3524191 - RNA, 22 nt, Human
cuccagugcuguccaugcuucu

SEQ ID NO: 3524192 - RNA, 15 nt, Human
cuccagugguugcug

SEQ ID NO: 3524193 - RNA, 19 nt, Human
cuccagugguugcuguuga

SEQ ID NO: 3524194 - RNA, 14 nt, Human
cuccaguguacaua

SEQ ID NO: 3524195 - RNA, 16 nt, Human
cuccaguguccugagc

SEQ ID NO: 3524196 - RNA, 18 nt, Human
cuccaguguccugagcuc

SEQ ID NO: 3524197 - RNA, 22 nt, Human
cuccagugugggcuugaccagg

SEQ ID NO: 3524198 - RNA, 17 nt, Human
cuccaguuugcaccugu

SEQ ID NO: 3524199 - RNA, 20 nt, Human
cuccaguuugcaccuguccc

SEQ ID NO: 3524200 - RNA, 22 nt, Human
cuccauaaacaugaaaacacuu

SEQ ID NO: 3524201 - RNA, 15 nt, Human
cuccauaaccccacc

SEQ ID NO: 3524202 - RNA, 22 nt, Human
cuccauaaccccacccuugccc

SEQ ID NO: 3524203 - RNA, 19 nt, Human
cuccauacacacgcugccu

SEQ ID NO: 3524204 - RNA, 21 nt, Human
cuccauaguuuggcauuugca

SEQ ID NO: 3524205 - RNA, 19 nt, Human
cccagauuuugcuguauau

SEQ ID NO: 3524206 - RNA, 17 nt, Human
cccagcaaagcccccag

SEQ ID NO: 3524207 - RNA, 13 nt, Human
cccagcaacccuc

SEQ ID NO: 3524208 - RNA, 19 nt, Human
cccagcaacccuccuauca

SEQ ID NO: 3524209 - RNA, 20 nt, Human
cccagcaagugagagcuggg

SEQ ID NO: 3524210 - RNA, 18 nt, Human
cccagcaauuaugaaaau

SEQ ID NO: 3524211 - RNA, 20 nt, Human
cccagcacaaagcagauccu

SEQ ID NO: 3524212 - RNA, 18 nt, Human
cccagcacagcuugaccu

SEQ ID NO: 3524213 - RNA, 17 nt, Human
cccagcaccaccagguc

SEQ ID NO: 3524214 - RNA, 17 nt, Human
cccagcacuaaagcagu

SEQ ID NO: 3524215 - RNA, 14 nt, Human
cccagcacugagga

SEQ ID NO: 3524216 - RNA, 22 nt, Human
cccagcacuuugggaggccaag

SEQ ID NO: 3524217 - RNA, 21 nt, Human
cccagcacuuugggaggccua

SEQ ID NO: 3524218 - RNA, 21 nt, Human
cccagcacuuugggaggcuga

SEQ ID NO: 3524219 - RNA, 15 nt, Human
cccagcagcugccag

SEQ ID NO: 3524220 - RNA, 13 nt, Human
cccagcagggccu

SEQ ID NO: 3524221 - RNA, 15 nt, Human
cccagcaggugggga

SEQ ID NO: 3524222 - RNA, 17 nt, Human
cccagcauaugggggcc

SEQ ID NO: 3524223 - RNA, 21 nt, Human
cccagcauccuuuucugcaga

SEQ ID NO: 3524224 - RNA, 21 nt, Human
cccagcaucgcacucuggcag

SEQ ID NO: 3524225 - RNA, 23 nt, Human
cccagcaugacauaacagugcag

SEQ ID NO: 3524226 - RNA, 23 nt, Human
cccagcaugcaccacgggcccgg

SEQ ID NO: 3524227 - RNA, 19 nt, Human
cccagcauuccagccccuc

SEQ ID NO: 3524228 - RNA, 13 nt, Human
cccagcauucuca

SEQ ID NO: 3524229 - RNA, 17 nt, Human
cccagccaaacccuguc

SEQ ID NO: 3524230 - RNA, 22 nt, Human
cccagccagaguuccugcggag

SEQ ID NO: 3524231 - RNA, 24 nt, Human
cccagccagcaguucagagcugcc

SEQ ID NO: 3524232 - RNA, 14 nt, Human
cccagccaggccca

SEQ ID NO: 3524233 - RNA, 17 nt, Human
cccagccaggcccagcc

SEQ ID NO: 3524234 - RNA, 22 nt, Human
cccagccagggcucaaucucug

SEQ ID NO: 3524235 - RNA, 13 nt, Human
cccagccauccag

SEQ ID NO: 3524236 - RNA, 17 nt, Human
cccagccaucugcccag

SEQ ID NO: 3524237 - RNA, 22 nt, Human
cccagccaucugcccaggggug

SEQ ID NO: 3524238 - RNA, 15 nt, Human
cccagccaugccagc

SEQ ID NO: 3524239 - RNA, 19 nt, Human
cccagccauuaccauggag

SEQ ID NO: 3524240 - RNA, 16 nt, Human
cccagcccaaagcugu

SEQ ID NO: 3524241 - RNA, 19 nt, Human
cccagcccaaaggggacag

SEQ ID NO: 3524242 - RNA, 14 nt, Human
cccagcccaagucc

SEQ ID NO: 3524243 - RNA, 12 nt, Human
cccagcccaauc

SEQ ID NO: 3524244 - RNA, 12 nt, Human
cccagcccaccc

SEQ ID NO: 3524245 - RNA, 14 nt, Human
cccagcccacccuc

SEQ ID NO: 3524246 - RNA, 15 nt, Human
cccagcccagcugcu

SEQ ID NO: 3524247 - RNA, 20 nt, Human
cccagcccagcugcucugcc

SEQ ID NO: 3524248 - RNA, 11 nt, Human
cccagcccagg

SEQ ID NO: 3524249 - RNA, 18 nt, Human
cccagcccagggcuccug

SEQ ID NO: 3524250 - RNA, 16 nt, Human
cccagcccaucuugcc

SEQ ID NO: 3524251 - RNA, 15 nt, Human
cccagcccauggaga

SEQ ID NO: 3524252 - RNA, 21 nt, Human
cccagcccauucucucuccug

SEQ ID NO: 3524253 - RNA, 21 nt, Human
cccagccccaaaacucuccuc

SEQ ID NO: 3524254 - RNA, 22 nt, Human
cccagccccacuccucugcuga

SEQ ID NO: 3524255 - RNA, 13 nt, Human
cccagccccacuu

SEQ ID NO: 3524256 - RNA, 15 nt, Human
cccagccccagccag

SEQ ID NO: 3524257 - RNA, 12 nt, Human
cccagccccauc

SEQ ID NO: 3524258 - RNA, 14 nt, Human
cccagccccauccc

SEQ ID NO: 3524259 - RNA, 18 nt, Human
cccagcccccuaagagag

SEQ ID NO: 3524260 - RNA, 21 nt, Human
cccagcccccuaagagagcac

SEQ ID NO: 3524261 - RNA, 22 nt, Human
cccagcccccuuugggcccagg

SEQ ID NO: 3524262 - RNA, 23 nt, Human
cccagccccgacuccagccagcg

SEQ ID NO: 3524263 - RNA, 22 nt, Human
cccagccccgguggcugggcag

SEQ ID NO: 3524264 - RNA, 15 nt, Human
cccagccccuacugc

SEQ ID NO: 3524265 - RNA, 18 nt, Human
cccaugcuggagccugug

SEQ ID NO: 3524266 - RNA, 18 nt, Human
cccaugcugggcucccgu

SEQ ID NO: 3524267 - RNA, 22 nt, Human
cccaugcuuaacauacccgccu

SEQ ID NO: 3524268 - RNA, 20 nt, Human
cccaugcuuacgugauccuc

SEQ ID NO: 3524269 - RNA, 17 nt, Human
cccauggaaaaaugcca

SEQ ID NO: 3524270 - RNA, 13 nt, Human
cccauggaauauu

SEQ ID NO: 3524271 - RNA, 17 nt, Human
cccauggaauauuucca

SEQ ID NO: 3524272 - RNA, 22 nt, Human
cccauggacacuccagugccag

SEQ ID NO: 3524273 - RNA, 20 nt, Human
cccauggacaggcuggcucc

SEQ ID NO: 3524274 - RNA, 14 nt, Human
cccauggaccaugc

SEQ ID NO: 3524275 - RNA, 19 nt, Human
cccauggagccagcucccu

SEQ ID NO: 3524276 - RNA, 13 nt, Human
cccauggagcccc

SEQ ID NO: 3524277 - RNA, 15 nt, Human
cccauggagccccag

SEQ ID NO: 3524278 - RNA, 21 nt, Human
cccauggagccccagcccccu

SEQ ID NO: 3524279 - RNA, 22 nt, Human
cccauggcagugggaaaaaugu

SEQ ID NO: 3524280 - RNA, 20 nt, Human
cccauggcaugggggccuca

SEQ ID NO: 3524281 - RNA, 15 nt, Human
cccauggcccugugc

SEQ ID NO: 3524282 - RNA, 21 nt, Human
cccaugggaagacgaggcccu

SEQ ID NO: 3524283 - RNA, 16 nt, Human
cccaugggaggcugga

SEQ ID NO: 3524284 - RNA, 23 nt, Human
cccaugggagggagcugagaaga

SEQ ID NO: 3524285 - RNA, 17 nt, Human
cccaugggcacugcugg

SEQ ID NO: 3524286 - RNA, 20 nt, Human
cccaugggcacugcugggug

SEQ ID NO: 3524287 - RNA, 14 nt, Human
cccaugggcucuga

SEQ ID NO: 3524288 - RNA, 21 nt, Human
cccauguagcccccuggccuc

SEQ ID NO: 3524289 - RNA, 18 nt, Human
cccaugucgcgcucagca

SEQ ID NO: 3524290 - RNA, 19 nt, Human
cccauguggagucagccuc

SEQ ID NO: 3524291 - RNA, 20 nt, Human
cccaugugugagugugugca

SEQ ID NO: 3524292 - RNA, 21 nt, Human
cccauguucugcccccagccc

SEQ ID NO: 3524293 - RNA, 15 nt, Human
cccauguucuguccc

SEQ ID NO: 3524294 - RNA, 16 nt, Human
cccauuagcaaaaauu

SEQ ID NO: 3524295 - RNA, 12 nt, Human
cccauuauucaa

SEQ ID NO: 3524296 - RNA, 23 nt, Human
cccauuauucaaaguugccuaaa

SEQ ID NO: 3524297 - RNA, 22 nt, Human
cccauucauuccauucuggaag

SEQ ID NO: 3524298 - RNA, 17 nt, Human
cccauucccugggaucu

SEQ ID NO: 3524299 - RNA, 13 nt, Human
cccauuccugaag

SEQ ID NO: 3524300 - RNA, 18 nt, Human
cccauuccugaagaacca

SEQ ID NO: 3524301 - RNA, 17 nt, Human
cccauucgcgcucugcu

SEQ ID NO: 3524302 - RNA, 20 nt, Human
cccauucgcgcucugcucag

SEQ ID NO: 3524303 - RNA, 21 nt, Human
cccauucgguguggugcagug

SEQ ID NO: 3524304 - RNA, 18 nt, Human
cccauucuacacagagca

SEQ ID NO: 3524305 - RNA, 13 nt, Human
cccauucuacuug

SEQ ID NO: 3524306 - RNA, 14 nt, Human
cccauucuacuugc

SEQ ID NO: 3524307 - RNA, 15 nt, Human
cccauucuacuugcu

SEQ ID NO: 3524308 - RNA, 17 nt, Human
cccauucuacuugcucu

SEQ ID NO: 3524309 - RNA, 21 nt, Human
cccauucuacuugcucuggac

SEQ ID NO: 3524310 - RNA, 18 nt, Human
cccauucucucuccuguc

SEQ ID NO: 3524311 - RNA, 19 nt, Human
cccauucucucuccugucc

SEQ ID NO: 3524312 - RNA, 20 nt, Human
cccauucucucuccugucca

SEQ ID NO: 3524313 - RNA, 15 nt, Human
cccauucugccugcc

SEQ ID NO: 3524314 - RNA, 19 nt, Human
cccauucugccugcccagg

SEQ ID NO: 3524315 - RNA, 23 nt, Human
cccauucugccugcccaggcccc

SEQ ID NO: 3524316 - RNA, 20 nt, Human
cccauucuuccuaguuuucu

SEQ ID NO: 3524317 - RNA, 21 nt, Human
cccauucuuccuaguuuucuc

SEQ ID NO: 3524318 - RNA, 14 nt, Human
cccauucuuggccc

SEQ ID NO: 3524319 - RNA, 21 nt, Human
cccauucuuugcuugaacaca

SEQ ID NO: 3524320 - RNA, 20 nt, Human
cccauucuuuuguaauuuaa

SEQ ID NO: 3524321 - RNA, 21 nt, Human
cccauucuuuuguaauuuaaa

SEQ ID NO: 3524322 - RNA, 14 nt, Human
cccauugccuccuc

SEQ ID NO: 3524323 - RNA, 21 nt, Human
cccauugguguugucauugua

SEQ ID NO: 3524324 - RNA, 12 nt, Human
cccauugucuuc

SEQ ID NO: 3524325 - RNA, 16 nt, Human
cccauuuacacuuuug

SEQ ID NO: 3524326 - RNA, 19 nt, Human
cccauuuauagauggggga

SEQ ID NO: 3524327 - RNA, 19 nt, Human
cccauuuauccaccuccau

SEQ ID NO: 3524328 - RNA, 14 nt, Human
cccauuucaaugug

SEQ ID NO: 3524329 - RNA, 13 nt, Human
cccauuucagcug

SEQ ID NO: 3524330 - RNA, 14 nt, Human
cccauuucccaucu

SEQ ID NO: 3524331 - RNA, 16 nt, Human
cccauuucccaucugc

SEQ ID NO: 3524332 - RNA, 19 nt, Human
cccauuucccaucugcacc

SEQ ID NO: 3524333 - RNA, 22 nt, Human
cccauuucuacucuuaaguuuc

SEQ ID NO: 3524334 - RNA, 13 nt, Human
cccauuucugagg

SEQ ID NO: 3524335 - RNA, 19 nt, Human
cccauuuggagggccuggg

SEQ ID NO: 3524336 - RNA, 14 nt, Human
cccauuuuagucac

SEQ ID NO: 3524337 - RNA, 22 nt, Human
cccauuuugcaaaauuuccagu

SEQ ID NO: 3524338 - RNA, 15 nt, Human
ccccaaaaccacagc

SEQ ID NO: 3524339 - RNA, 20 nt, Human
ccccaaaaccacagcccugu

SEQ ID NO: 3524340 - RNA, 23 nt, Human
ccccaaaacucuccucugcugcu

SEQ ID NO: 3524341 - RNA, 22 nt, Human
ccccaaacaccuuccagcuccu

SEQ ID NO: 3524342 - RNA, 15 nt, Human
ccccaaagaagaagu

SEQ ID NO: 3524343 - RNA, 22 nt, Human
ccccaaagauagacagguccug

SEQ ID NO: 3524344 - RNA, 19 nt, Human
ccccaaagcuuuccugccc

SEQ ID NO: 3524345 - RNA, 21 nt, Human
ccccaaagcuuuccugcccca

SEQ ID NO: 3524346 - RNA, 23 nt, Human
ccccaaauccgaaccuccucugu

SEQ ID NO: 3524347 - RNA, 21 nt, Human
ccccaaauggaaaugggcaga

SEQ ID NO: 3524348 - RNA, 22 nt, Human
ccccaaauggaaaugggcagag

SEQ ID NO: 3524349 - RNA, 19 nt, Human
ccccaacacugugcccugg

SEQ ID NO: 3524350 - RNA, 20 nt, Human
ccccaacacugugcccuggu

SEQ ID NO: 3524351 - RNA, 22 nt, Human
ccccaacacugugcccuggugg

SEQ ID NO: 3524352 - RNA, 20 nt, Human
ccccaacagcgacauagccc

SEQ ID NO: 3524353 - RNA, 22 nt, Human
ccccaacagcgacauagcccau

SEQ ID NO: 3524354 - RNA, 14 nt, Human
ccccaacagcgccc

SEQ ID NO: 3524355 - RNA, 17 nt, Human
ccccaacagcgcccaaa

SEQ ID NO: 3524356 - RNA, 18 nt, Human
ccccaacauauaaaauaa

SEQ ID NO: 3524357 - RNA, 19 nt, Human
ccccaacaucucccuccca

SEQ ID NO: 3524358 - RNA, 18 nt, Human
ccccaacccaaaccugga

SEQ ID NO: 3524359 - RNA, 14 nt, Human
ccccaaccccagcc

SEQ ID NO: 3524360 - RNA, 16 nt, Human
ccccaaccccugagga

SEQ ID NO: 3524361 - RNA, 23 nt, Human
ccccaacccguggaggcugcucg

SEQ ID NO: 3524362 - RNA, 17 nt, Human
ccccaacccugccccug

SEQ ID NO: 3524363 - RNA, 18 nt, Human
ccccaacccugccccugc

SEQ ID NO: 3524364 - RNA, 22 nt, Human
ccccaaccucagggcucccagg

SEQ ID NO: 3524365 - RNA, 16 nt, Human
ccccaacgaaaagcac

SEQ ID NO: 3524366 - RNA, 20 nt, Human
ccccaacgaaaagcacaucc

SEQ ID NO: 3524367 - RNA, 14 nt, Human
ccccaacuccugga

SEQ ID NO: 3524368 - RNA, 20 nt, Human
ccccaacucgggcucccggg

SEQ ID NO: 3524369 - RNA, 16 nt, Human
ccccaagaaggcuggg

SEQ ID NO: 3524370 - RNA, 22 nt, Human
ccccaagauugagcucucugcc

SEQ ID NO: 3524371 - RNA, 13 nt, Human
ccccaagccuggc

SEQ ID NO: 3524372 - RNA, 17 nt, Human
ccccaagcgcccuggcc

SEQ ID NO: 3524373 - RNA, 14 nt, Human
ccccaagcuguuuu

SEQ ID NO: 3524374 - RNA, 14 nt, Human
ccccaaggggcagu

SEQ ID NO: 3524375 - RNA, 16 nt, Human
ccccaaggggcagucu

SEQ ID NO: 3524376 - RNA, 18 nt, Human
ccccaaggggcagucugg

SEQ ID NO: 3524377 - RNA, 22 nt, Human
ccccaaggggcagucuggaggg

SEQ ID NO: 3524378 - RNA, 21 nt, Human
ccccaaguugggggucagugc

SEQ ID NO: 3524379 - RNA, 19 nt, Human
ccccaauaccccauggacc

SEQ ID NO: 3524380 - RNA, 14 nt, Human
ccccaauccuccca

SEQ ID NO: 3524381 - RNA, 15 nt, Human
ccccaauuccuugua

SEQ ID NO: 3524382 - RNA, 11 nt, Human
ccccacacaca

SEQ ID NO: 3524383 - RNA, 20 nt, Human
ccccacaccagggccagccu

SEQ ID NO: 3524384 - RNA, 14 nt, Human
ccccacaccucagu

SEQ ID NO: 3524385 - RNA, 16 nt, Human
ccccacaccuggcccu

SEQ ID NO: 3524386 - RNA, 17 nt, Human
ccccacaccuggcccug

SEQ ID NO: 3524387 - RNA, 13 nt, Human
ccccacacugggg

SEQ ID NO: 3524388 - RNA, 16 nt, Human
ccccacacuucccugg

SEQ ID NO: 3524389 - RNA, 18 nt, Human
ccccacacuucccuggcg

SEQ ID NO: 3524390 - RNA, 22 nt, Human
ccccacacuuguuccagcucuu

SEQ ID NO: 3524391 - RNA, 23 nt, Human
ccccacacuuguuccagcucuuu

SEQ ID NO: 3524392 - RNA, 15 nt, Human
ccccacagcccacgu

SEQ ID NO: 3524393 - RNA, 13 nt, Human
ccccacaguugcu

SEQ ID NO: 3524394 - RNA, 19 nt, Human
ccccaccaagggcgcaaga

SEQ ID NO: 3524395 - RNA, 21 nt, Human
ccccaccaagggcgcaagagu

SEQ ID NO: 3524396 - RNA, 13 nt, Human
ccccaccagugcc

SEQ ID NO: 3524397 - RNA, 14 nt, Human
ccccaccagugccu

SEQ ID NO: 3524398 - RNA, 19 nt, Human
ccccaccauaugaauugua

SEQ ID NO: 3524399 - RNA, 13 nt, Human
ccccaccaucugc

SEQ ID NO: 3524400 - RNA, 14 nt, Human
ccccaccaucugcu

SEQ ID NO: 3524401 - RNA, 19 nt, Human
ccccacccaagcuuggcag

SEQ ID NO: 3524402 - RNA, 14 nt, Human
ccccacccaagggc

SEQ ID NO: 3524403 - RNA, 14 nt, Human
ccccaccccagggc

SEQ ID NO: 3524404 - RNA, 19 nt, Human
ccccaccccggggacccug

SEQ ID NO: 3524405 - RNA, 22 nt, Human
ccccaccccggggacccuguga

SEQ ID NO: 3524406 - RNA, 23 nt, Human
ccccaccccggggacccugugac

SEQ ID NO: 3524407 - RNA, 14 nt, Human
ccccaccccugccc

SEQ ID NO: 3524408 - RNA, 17 nt, Human
cuccuuaacacugagcu

SEQ ID NO: 3524409 - RNA, 13 nt, Human
cuccuuagaaaaa

SEQ ID NO: 3524410 - RNA, 13 nt, Human
cuccuuagaagug

SEQ ID NO: 3524411 - RNA, 22 nt, Human
cuccuuagcugccaagccccau

SEQ ID NO: 3524412 - RNA, 22 nt, Human
cuccuucaacaaggcuugcugc

SEQ ID NO: 3524413 - RNA, 12 nt, Human
cuccuucagaca

SEQ ID NO: 3524414 - RNA, 13 nt, Human
cuccuucagacac

SEQ ID NO: 3524415 - RNA, 14 nt, Human
cuccuucagcccuc

SEQ ID NO: 3524416 - RNA, 19 nt, Human
cuccuucaugacagccucc

SEQ ID NO: 3524417 - RNA, 15 nt, Human
cuccuuccaccuccc

SEQ ID NO: 3524418 - RNA, 10 nt, Human
cuccuuccca

SEQ ID NO: 3524419 - RNA, 13 nt, Human
cuccuucccaagu

SEQ ID NO: 3524420 - RNA, 14 nt, Human
cuccuucccaagug

SEQ ID NO: 3524421 - RNA, 19 nt, Human
cuccuucccagcugccccu

SEQ ID NO: 3524422 - RNA, 22 nt, Human
cuccuucccagcugccccuccc

SEQ ID NO: 3524423 - RNA, 16 nt, Human
cuccuucccaucgcug

SEQ ID NO: 3524424 - RNA, 12 nt, Human
ccccaccccugg

SEQ ID NO: 3524425 - RNA, 13 nt, Human
ccccaccccuucc

SEQ ID NO: 3524426 - RNA, 17 nt, Human
ccccaccccuuccccac

SEQ ID NO: 3524427 - RNA, 13 nt, Human
ccccacccucagc

SEQ ID NO: 3524428 - RNA, 15 nt, Human
ccccacccucccugg

SEQ ID NO: 3524429 - RNA, 12 nt, Human
ccccacccuggg

SEQ ID NO: 3524430 - RNA, 15 nt, Human
ccccaccgcagacag

SEQ ID NO: 3524431 - RNA, 18 nt, Human
ccccaccgguccagcugg

SEQ ID NO: 3524432 - RNA, 19 nt, Human
ccccaccgguccagcuggc

SEQ ID NO: 3524433 - RNA, 21 nt, Human
ccccaccgguccagcuggccu

SEQ ID NO: 3524434 - RNA, 12 nt, Human
ccccaccuccac

SEQ ID NO: 3524435 - RNA, 11 nt, Human
ccccaccugcc

SEQ ID NO: 3524436 - RNA, 13 nt, Human
ccccaccugccac

SEQ ID NO: 3524437 - RNA, 17 nt, Human
ccccaccugccacuagg

SEQ ID NO: 3524438 - RNA, 14 nt, Human
ccccaccugcgcuu

SEQ ID NO: 3524439 - RNA, 20 nt, Human
ccccaccuggcccucucuga

SEQ ID NO: 3524440 - RNA, 21 nt, Human
ccccaccuucaauuccugggc

SEQ ID NO: 3524441 - RNA, 13 nt, Human
ccccacgagggcu

SEQ ID NO: 3524442 - RNA, 17 nt, Human
ccccacgagggcuggcu

SEQ ID NO: 3524443 - RNA, 18 nt, Human
ccccacgagggcuggcug

SEQ ID NO: 3524444 - RNA, 21 nt, Human
ccccacgagggcuggcuggcc

SEQ ID NO: 3524445 - RNA, 17 nt, Human
ccccacgagggucagga

SEQ ID NO: 3524446 - RNA, 14 nt, Human
ccccacgcccucau

SEQ ID NO: 3524447 - RNA, 14 nt, Human
ccccacgcccuccc

SEQ ID NO: 3524448 - RNA, 19 nt, Human
ccccacggccgcuccaggg

SEQ ID NO: 3524449 - RNA, 13 nt, Human
ccccacuccagcu

SEQ ID NO: 3524450 - RNA, 14 nt, Human
ccccacucccacau

SEQ ID NO: 3524451 - RNA, 13 nt, Human
ccccacucccuca

SEQ ID NO: 3524452 - RNA, 15 nt, Human
ccccacucccucaca

SEQ ID NO: 3524453 - RNA, 21 nt, Human
ccccacucccuugcuggcccc

SEQ ID NO: 3524454 - RNA, 16 nt, Human
ccccacuccggcccuc

SEQ ID NO: 3524455 - RNA, 20 nt, Human
ccccacuccggcccuccaga

SEQ ID NO: 3524456 - RNA, 13 nt, Human
ccccacucucaga

SEQ ID NO: 3524457 - RNA, 17 nt, Human
ccccacucucagaggcc

SEQ ID NO: 3524458 - RNA, 20 nt, Human
ccccacucucauuccccagg

SEQ ID NO: 3524459 - RNA, 18 nt, Human
ccccacucuccccacacu

SEQ ID NO: 3524460 - RNA, 16 nt, Human
ccccacucugcucuga

SEQ ID NO: 3524461 - RNA, 12 nt, Human
ccccacucugug

SEQ ID NO: 3524462 - RNA, 13 nt, Human
ccccacucugugc

SEQ ID NO: 3524463 - RNA, 19 nt, Human
ccccacugaugcuguucuc

SEQ ID NO: 3524464 - RNA, 12 nt, Human
ccccacugcagg

SEQ ID NO: 3524465 - RNA, 18 nt, Human
ccccacugcaggccccgc

SEQ ID NO: 3524466 - RNA, 19 nt, Human
ccccacugccagcagcagc

SEQ ID NO: 3524467 - RNA, 22 nt, Human
ccccacugccagcagcagcagg

SEQ ID NO: 3524468 - RNA, 19 nt, Human
ccccacugccuacugcauc

SEQ ID NO: 3524469 - RNA, 12 nt, Human
ccccacuggacu

SEQ ID NO: 3524470 - RNA, 19 nt, Human
ccccacuggacugaccugg

SEQ ID NO: 3524471 - RNA, 24 nt, Human
ccccacuggagcagaaggggagau

SEQ ID NO: 3524472 - RNA, 22 nt, Human
ccccacuggggaaauaacagcu

SEQ ID NO: 3524473 - RNA, 13 nt, Human
ccccacuggugac

SEQ ID NO: 3524474 - RNA, 14 nt, Human
ccccacuggugaca

SEQ ID NO: 3524475 - RNA, 14 nt, Human
ccccacuguaucua

SEQ ID NO: 3524476 - RNA, 18 nt, Human
ccccacuuaccgcguaau

SEQ ID NO: 3524477 - RNA, 15 nt, Human
ccccacuuucuuucu

SEQ ID NO: 3524478 - RNA, 15 nt, Human
ccccagaaccugucc

SEQ ID NO: 3524479 - RNA, 21 nt, Human
ccccagaaccuguccuugcac

SEQ ID NO: 3524480 - RNA, 21 nt, Human
ccccagagacucagagggagg

SEQ ID NO: 3524481 - RNA, 13 nt, Human
ccccagagcacug

SEQ ID NO: 3524482 - RNA, 13 nt, Human
ccccagagccaca

SEQ ID NO: 3524483 - RNA, 15 nt, Human
ccccagagccacagu

SEQ ID NO: 3524484 - RNA, 11 nt, Human
ccccagagcug

SEQ ID NO: 3524485 - RNA, 22 nt, Human
ccccagagcuguuuauggccuc

SEQ ID NO: 3524486 - RNA, 23 nt, Human
ccccagagcuguuuauggccuca

SEQ ID NO: 3524487 - RNA, 13 nt, Human
ccccagaggcugg

SEQ ID NO: 3524488 - RNA, 18 nt, Human
ccccagaucaccagcccg

SEQ ID NO: 3524489 - RNA, 21 nt, Human
ccccagauugcaacaggcugg

SEQ ID NO: 3524490 - RNA, 24 nt, Human
ccccagcaaagcccccagagccca

SEQ ID NO: 3524491 - RNA, 20 nt, Human
ccccagcaagugagagcugg

SEQ ID NO: 3524492 - RNA, 22 nt, Human
ccccagcaagugagagcugggu

SEQ ID NO: 3524493 - RNA, 15 nt, Human
ccccagcacccgggc

SEQ ID NO: 3524494 - RNA, 11 nt, Human
ccccagcacua

SEQ ID NO: 3524495 - RNA, 18 nt, Human
ccccagcaggugcugacu

SEQ ID NO: 3524496 - RNA, 23 nt, Human
ccccagcaguugaaugacaacag

SEQ ID NO: 3524497 - RNA, 19 nt, Human
ccccagcauuccagccccu

SEQ ID NO: 3524498 - RNA, 20 nt, Human
ccccagcauucucaggcacc

SEQ ID NO: 3524499 - RNA, 22 nt, Human
ccccagcauucucaggcaccag

SEQ ID NO: 3524500 - RNA, 14 nt, Human
ccccagccacuccc

SEQ ID NO: 3524501 - RNA, 21 nt, Human
ccccagccacuccccagccag

SEQ ID NO: 3524502 - RNA, 18 nt, Human
ccccagccagccuggcug

SEQ ID NO: 3524503 - RNA, 16 nt, Human
ccccagccagggcuca

SEQ ID NO: 3524504 - RNA, 22 nt, Human
ccccagcccaaaggggacaggc

SEQ ID NO: 3524505 - RNA, 15 nt, Human
ccccagcccaagucc

SEQ ID NO: 3524506 - RNA, 11 nt, Human
ccccagcccac

SEQ ID NO: 3524507 - RNA, 12 nt, Human
ccccagcccacc

SEQ ID NO: 3524508 - RNA, 16 nt, Human
ccccagcccacccucc

SEQ ID NO: 3524509 - RNA, 20 nt, Human
ccccagcccacccuccuguc

SEQ ID NO: 3524510 - RNA, 18 nt, Human
ccccagcccacuggauca

SEQ ID NO: 3524511 - RNA, 15 nt, Human
ccccagcccagagac

SEQ ID NO: 3524512 - RNA, 12 nt, Human
ccccagcccagc

SEQ ID NO: 3524513 - RNA, 21 nt, Human
ccccagcccaggguuccccca

SEQ ID NO: 3524514 - RNA, 10 nt, Human
ccccagcccc

SEQ ID NO: 3524515 - RNA, 14 nt, Human
ccccagccccaucc

SEQ ID NO: 3524516 - RNA, 15 nt, Human
ccccagccccauccu

SEQ ID NO: 3524517 - RNA, 18 nt, Human
ccccagccccgacuccag

SEQ ID NO: 3524518 - RNA, 23 nt, Human
ccccagccccgacuccagccagc

SEQ ID NO: 3524519 - RNA, 18 nt, Human
ccccagccccucccccau

SEQ ID NO: 3524520 - RNA, 19 nt, Human
ccccagcccuggcucugca

SEQ ID NO: 3524521 - RNA, 19 nt, Human
ccccagccuaagaugaaga

SEQ ID NO: 3524522 - RNA, 16 nt, Human
ccccagccucucuucc

SEQ ID NO: 3524523 - RNA, 15 nt, Human
ccccagccucuggca

SEQ ID NO: 3524524 - RNA, 10 nt, Human
ccccagccug

SEQ ID NO: 3524525 - RNA, 11 nt, Human
ccccagccugc

SEQ ID NO: 3524526 - RNA, 12 nt, Human
ccccagccugcg

SEQ ID NO: 3524527 - RNA, 12 nt, Human
ccccagccugcu

SEQ ID NO: 3524528 - RNA, 12 nt, Human
ccccagccuggc

SEQ ID NO: 3524529 - RNA, 23 nt, Human
ccccagccuggccacgcagccag

SEQ ID NO: 3524530 - RNA, 18 nt, Human
ccccagccuggcccagcu

SEQ ID NO: 3524531 - RNA, 19 nt, Human
ccccagccuggcccagcuc

SEQ ID NO: 3524532 - RNA, 21 nt, Human
ccccagccuggcccagcuccc

SEQ ID NO: 3524533 - RNA, 15 nt, Human
ccccagccugggccc

SEQ ID NO: 3524534 - RNA, 15 nt, Human
ccccagccugggccu

SEQ ID NO: 3524535 - RNA, 16 nt, Human
ccccagccugggccua

SEQ ID NO: 3524536 - RNA, 12 nt, Human
ccccagccuucu

SEQ ID NO: 3524537 - RNA, 19 nt, Human
ccccagcuaagaaccugga

SEQ ID NO: 3524538 - RNA, 14 nt, Human
ccccagcucagggg

SEQ ID NO: 3524539 - RNA, 14 nt, Human
ccccagcucccagg

SEQ ID NO: 3524540 - RNA, 13 nt, Human
ccccagcuccggc

SEQ ID NO: 3524541 - RNA, 16 nt, Human
ccccagcucugcuugc

SEQ ID NO: 3524542 - RNA, 11 nt, Human
ccccagcuggg

SEQ ID NO: 3524543 - RNA, 23 nt, Human
ccccagcuggggccaggcugggu

SEQ ID NO: 3524544 - RNA, 14 nt, Human
ccccagcugugagc

SEQ ID NO: 3524545 - RNA, 16 nt, Human
ccccagcugugagccu

SEQ ID NO: 3524546 - RNA, 19 nt, Human
ccccagcugugagccuugg

SEQ ID NO: 3524547 - RNA, 14 nt, Human
ccccagcuuugccc

SEQ ID NO: 3524548 - RNA, 24 nt, Human
ccccagcuuugcccaacaccagcc

SEQ ID NO: 3524549 - RNA, 23 nt, Human
ccccaggaagccgugcccugccc

SEQ ID NO: 3524550 - RNA, 14 nt, Human
ccccaggacaggcu

SEQ ID NO: 3524551 - RNA, 15 nt, Human
ccccaggacaggcug

SEQ ID NO: 3524552 - RNA, 14 nt, Human
ccccaggaccagaa

SEQ ID NO: 3524553 - RNA, 17 nt, Human
ccccaggaccuggcugc

SEQ ID NO: 3524554 - RNA, 14 nt, Human
ccccaggacugggc

SEQ ID NO: 3524555 - RNA, 13 nt, Human
cugaaaugucagu

SEQ ID NO: 3524556 - RNA, 20 nt, Human
cugaaaugucaguucugaua

SEQ ID NO: 3524557 - RNA, 11 nt, Human
cugaaaugugu

SEQ ID NO: 3524558 - RNA, 18 nt, Human
cugaaaugugugugaugu

SEQ ID NO: 3524559 - RNA, 22 nt, Human
cugaaaugugugugaugugaca

SEQ ID NO: 3524560 - RNA, 14 nt, Human
cugaaauuccaaag

SEQ ID NO: 3524561 - RNA, 15 nt, Human
cugaaauuccaaagu

SEQ ID NO: 3524562 - RNA, 16 nt, Human
cugaaauuccaaaguc

SEQ ID NO: 3524563 - RNA, 20 nt, Human
cugaaauuccaaagucucua

SEQ ID NO: 3524564 - RNA, 13 nt, Human
cugaaauuucaga

SEQ ID NO: 3524565 - RNA, 13 nt, Human
cugaaauuuccug

SEQ ID NO: 3524566 - RNA, 16 nt, Human
cugaaauuuccuggga

SEQ ID NO: 3524567 - RNA, 13 nt, Human
cugaaauuuuaua

SEQ ID NO: 3524568 - RNA, 22 nt, Human
cugaaauuuuauaugcuuacug

SEQ ID NO: 3524569 - RNA, 11 nt, Human
cugaacaaaaa

SEQ ID NO: 3524570 - RNA, 16 nt, Human
cugaacaauucucucu

SEQ ID NO: 3524571 - RNA, 13 nt, Human
cugaacacaggca

SEQ ID NO: 3524572 - RNA, 15 nt, Human
cugaacacaggcagc

SEQ ID NO: 3524573 - RNA, 22 nt, Human
cugaacacaggcagcuuucuag

SEQ ID NO: 3524574 - RNA, 20 nt, Human
cugaacaccauugaaggcuu

SEQ ID NO: 3524575 - RNA, 14 nt, Human
cugaacauuggaga

SEQ ID NO: 3524576 - RNA, 14 nt, Human
cugaaccacuugua

SEQ ID NO: 3524577 - RNA, 22 nt, Human
cugaaccacuuguagauuugau

SEQ ID NO: 3524578 - RNA, 16 nt, Human
cugaaccaucccugau

SEQ ID NO: 3524579 - RNA, 15 nt, Human
cugaaccccagggcu

SEQ ID NO: 3524580 - RNA, 18 nt, Human
cugaacccugugcuggug

SEQ ID NO: 3524581 - RNA, 15 nt, Human
cugaaccgcacagcu

SEQ ID NO: 3524582 - RNA, 21 nt, Human
cugaaccgcacagcucaggag

SEQ ID NO: 3524583 - RNA, 23 nt, Human
cugaaccgcacagcucaggaggc

SEQ ID NO: 3524584 - RNA, 17 nt, Human
cugaaccggcuuuacca

SEQ ID NO: 3524585 - RNA, 14 nt, Human
cugaaccugaugcu

SEQ ID NO: 3524586 - RNA, 16 nt, Human
cugaaccugucuuuug

SEQ ID NO: 3524587 - RNA, 15 nt, Human
cugaacuaaagugcu

SEQ ID NO: 3524588 - RNA, 19 nt, Human
cugaacuaaagugcugcac

SEQ ID NO: 3524589 - RNA, 15 nt, Human
cugaacucaaacuga

SEQ ID NO: 3524590 - RNA, 22 nt, Human
cugaacuucaggauaauaaagu

SEQ ID NO: 3524591 - RNA, 17 nt, Human
cugaacuugcauuguga

SEQ ID NO: 3524592 - RNA, 15 nt, Human
cugaacuuggcgcug

SEQ ID NO: 3524593 - RNA, 16 nt, Human
cugaacuuggcgcugc

SEQ ID NO: 3524594 - RNA, 13 nt, Human
cugaacuuugcug

SEQ ID NO: 3524595 - RNA, 16 nt, Human
cugaacuuugggaagc

SEQ ID NO: 3524596 - RNA, 13 nt, Human
cugaagaacagua

SEQ ID NO: 3524597 - RNA, 14 nt, Human
cugaagaaccaguc

SEQ ID NO: 3524598 - RNA, 22 nt, Human
cugaagaaccaguccccccacc

SEQ ID NO: 3524599 - RNA, 20 nt, Human
cugaagaauuaagauacaaa

SEQ ID NO: 3524600 - RNA, 19 nt, Human
cugaagaauugaaaaacca

SEQ ID NO: 3524601 - RNA, 18 nt, Human
cugaagaauugaaaaguu

SEQ ID NO: 3524602 - RNA, 23 nt, Human
cugaagacaccguucauucaggc

SEQ ID NO: 3524603 - RNA, 21 nt, Human
cugaagacucauucuucugua

SEQ ID NO: 3524604 - RNA, 15 nt, Human
cugaagacugaggac

SEQ ID NO: 3524605 - RNA, 14 nt, Human
cugaagacuugccc

SEQ ID NO: 3524606 - RNA, 21 nt, Human
cugaagagaagggcagggcug

SEQ ID NO: 3524607 - RNA, 22 nt, Human
cugaagagacaguuauuuauag

SEQ ID NO: 3524608 - RNA, 12 nt, Human
cugaagagcauu

SEQ ID NO: 3524609 - RNA, 19 nt, Human
cugaagaggaacugggccu

SEQ ID NO: 3524610 - RNA, 20 nt, Human
cugaagaggcgggccagcca

SEQ ID NO: 3524611 - RNA, 21 nt, Human
cugaagaggcgggccagccag

SEQ ID NO: 3524612 - RNA, 15 nt, Human
cugaagaguccucug

SEQ ID NO: 3524613 - RNA, 16 nt, Human
cugaagaguccucuga

SEQ ID NO: 3524614 - RNA, 18 nt, Human
cugaagaguccucugaau

SEQ ID NO: 3524615 - RNA, 20 nt, Human
cugaagaguggguuucacaa

SEQ ID NO: 3524616 - RNA, 21 nt, Human
cugaagauacaugucuuucuc

SEQ ID NO: 3524617 - RNA, 17 nt, Human
cugaagauagaagaaaa

SEQ ID NO: 3524618 - RNA, 22 nt, Human
cugaagauagaagaaaaaagaa

SEQ ID NO: 3524619 - RNA, 17 nt, Human
cugaagaugaucauuug

SEQ ID NO: 3524620 - RNA, 15 nt, Human
cugaagaugcagcuc

SEQ ID NO: 3524621 - RNA, 20 nt, Human
cugaagauggcauccuguga

SEQ ID NO: 3524622 - RNA, 23 nt, Human
cugaagauggcauccugugaagu

SEQ ID NO: 3524623 - RNA, 17 nt, Human
cugaagaugggagccuu

SEQ ID NO: 3524624 - RNA, 22 nt, Human
cugaagauuguuuaucuagaug

SEQ ID NO: 3524625 - RNA, 16 nt, Human
cugaagcaacauuuua

SEQ ID NO: 3524626 - RNA, 13 nt, Human
cugaagcauguuu

SEQ ID NO: 3524627 - RNA, 18 nt, Human
cugaagcauguuucaugu

SEQ ID NO: 3524628 - RNA, 20 nt, Human
cugaagcauguuucauguuu

SEQ ID NO: 3524629 - RNA, 14 nt, Human
cugaagccagccuu

SEQ ID NO: 3524630 - RNA, 18 nt, Human
cugaagcccauuucuccg

SEQ ID NO: 3524631 - RNA, 15 nt, Human
cugaagcccucccag

SEQ ID NO: 3524632 - RNA, 12 nt, Human
cugaagccgcca

SEQ ID NO: 3524633 - RNA, 15 nt, Human
cccgaguacagucug

SEQ ID NO: 3524634 - RNA, 13 nt, Human
cccgaguagcugg

SEQ ID NO: 3524635 - RNA, 18 nt, Human
cccgaguagcugggacua

SEQ ID NO: 3524636 - RNA, 21 nt, Human
cccgagucauucguucugugg

SEQ ID NO: 3524637 - RNA, 16 nt, Human
cccgaugcugcuuucc

SEQ ID NO: 3524638 - RNA, 20 nt, Human
cccgaugcugcuuuccccug

SEQ ID NO: 3524639 - RNA, 23 nt, Human
cccgaugcugcuuuccccugugg

SEQ ID NO: 3524640 - RNA, 21 nt, Human
cccgcacacccucacucugcc

SEQ ID NO: 3524641 - RNA, 12 nt, Human
cccgcacagcag

SEQ ID NO: 3524642 - RNA, 13 nt, Human
cccgcacagcagc

SEQ ID NO: 3524643 - RNA, 13 nt, Human
cccgcacccccac

SEQ ID NO: 3524644 - RNA, 17 nt, Human
cccgcacccccacccuu

SEQ ID NO: 3524645 - RNA, 14 nt, Human
cccgcaccugucug

SEQ ID NO: 3524646 - RNA, 16 nt, Human
cccgcagacaccuugg

SEQ ID NO: 3524647 - RNA, 12 nt, Human
cccgcagaccuc

SEQ ID NO: 3524648 - RNA, 14 nt, Human
cccgcagaccuccc

SEQ ID NO: 3524649 - RNA, 19 nt, Human
cccgcagugugcacuaagg

SEQ ID NO: 3524650 - RNA, 22 nt, Human
cccgcaugcagcagcuugcugc

SEQ ID NO: 3524651 - RNA, 19 nt, Human
cccgcccacuguccugggc

SEQ ID NO: 3524652 - RNA, 20 nt, Human
cccgcccacuguccugggcg

SEQ ID NO: 3524653 - RNA, 12 nt, Human
cccgcccaggcu

SEQ ID NO: 3524654 - RNA, 14 nt, Human
cccgcccaggcugg

SEQ ID NO: 3524655 - RNA, 20 nt, Human
cccgcccaggcuuagucacu

SEQ ID NO: 3524656 - RNA, 15 nt, Human
cccgccccacauucc

SEQ ID NO: 3524657 - RNA, 14 nt, Human
cccgccccugcagc

SEQ ID NO: 3524658 - RNA, 17 nt, Human
cccgccgcccagcccac

SEQ ID NO: 3524659 - RNA, 19 nt, Human
cccgccgcuuuucuccucu

SEQ ID NO: 3524660 - RNA, 16 nt, Human
cccgccuagcugcugu

SEQ ID NO: 3524661 - RNA, 18 nt, Human
cccgccucccuccccugc

SEQ ID NO: 3524662 - RNA, 13 nt, Human
cccgccucucccg

SEQ ID NO: 3524663 - RNA, 14 nt, Human
cccgccugccaguc

SEQ ID NO: 3524664 - RNA, 17 nt, Human
cccgccuggcagaacug

SEQ ID NO: 3524665 - RNA, 14 nt, Human
cccgccuggccagg

SEQ ID NO: 3524666 - RNA, 15 nt, Human
cccgccuggccagga

SEQ ID NO: 3524667 - RNA, 21 nt, Human
cccgccuggccaggagcaggc

SEQ ID NO: 3524668 - RNA, 13 nt, Human
cccgccuguuccc

SEQ ID NO: 3524669 - RNA, 13 nt, Human
cccgccuuggccu

SEQ ID NO: 3524670 - RNA, 17 nt, Human
cccgcgauguggaacug

SEQ ID NO: 3524671 - RNA, 22 nt, Human
cccgcgauguggaacugcugcc

SEQ ID NO: 3524672 - RNA, 23 nt, Human
cccgcgauguggaacugcugcca

SEQ ID NO: 3524673 - RNA, 17 nt, Human
cccgcgcccgcgcccuc

SEQ ID NO: 3524674 - RNA, 22 nt, Human
cccgcggggcugucggcgcugc

SEQ ID NO: 3524675 - RNA, 21 nt, Human
cccgcguguccccggggccca

SEQ ID NO: 3524676 - RNA, 12 nt, Human
cccgcucagccc

SEQ ID NO: 3524677 - RNA, 13 nt, Human
cccgcucaggcug

SEQ ID NO: 3524678 - RNA, 13 nt, Human
cccgcucccagug

SEQ ID NO: 3524679 - RNA, 14 nt, Human
cccgcucccagugu

SEQ ID NO: 3524680 - RNA, 11 nt, Human
cccgcucugga

SEQ ID NO: 3524681 - RNA, 14 nt, Human
cccgcucuggacca

SEQ ID NO: 3524682 - RNA, 17 nt, Human
cccgcugaguggacugg

SEQ ID NO: 3524683 - RNA, 16 nt, Human
cccgcugcugcugcug

SEQ ID NO: 3524684 - RNA, 12 nt, Human
cccgcugcugug

SEQ ID NO: 3524685 - RNA, 22 nt, Human
cccgcuggaggaugugggcagc

SEQ ID NO: 3524686 - RNA, 22 nt, Human
cccgcuggcugggggccucacu

SEQ ID NO: 3524687 - RNA, 17 nt, Human
cccgcuugccucggcuc

SEQ ID NO: 3524688 - RNA, 20 nt, Human
cccgcuugccucggcuccug

SEQ ID NO: 3524689 - RNA, 23 nt, Human
cccgcuugccucggcuccugcug

SEQ ID NO: 3524690 - RNA, 14 nt, Human
cccgcuuggcuucu

SEQ ID NO: 3524691 - RNA, 14 nt, Human
cccgcuuguccagc

SEQ ID NO: 3524692 - RNA, 18 nt, Human
cccgcuuguccagcgccu

SEQ ID NO: 3524693 - RNA, 20 nt, Human
cccggacgcccaggacccca

SEQ ID NO: 3524694 - RNA, 21 nt, Human
cccggagcuaacacuggcccc

SEQ ID NO: 3524695 - RNA, 20 nt, Human
cccggaggaaaucugcagag

SEQ ID NO: 3524696 - RNA, 21 nt, Human
cccggaggccgaggccaugug

SEQ ID NO: 3524697 - RNA, 18 nt, Human
cccggaggggccuggcag

SEQ ID NO: 3524698 - RNA, 16 nt, Human
cccggaucagagcagg

SEQ ID NO: 3524699 - RNA, 17 nt, Human
cccggaucagagcagga

SEQ ID NO: 3524700 - RNA, 15 nt, Human
cccggaugcugcuuc

SEQ ID NO: 3524701 - RNA, 22 nt, Human
aaaucuuaaugaaugagucugu

SEQ ID NO: 3524702 - RNA, 16 nt, Human
aaaucuuauuaaaguu

SEQ ID NO: 3524703 - RNA, 12 nt, Human
aaaucuuccaau

SEQ ID NO: 3524704 - RNA, 14 nt, Human
aaaucuucuccaga

SEQ ID NO: 3524705 - RNA, 14 nt, Human
aaaucuugaucagu

SEQ ID NO: 3524706 - RNA, 16 nt, Human
aaaucuuggcaauauu

SEQ ID NO: 3524707 - RNA, 17 nt, Human
aaaucuuggcacagaaa

SEQ ID NO: 3524708 - RNA, 14 nt, Human
aaaucuugucaugu

SEQ ID NO: 3524709 - RNA, 16 nt, Human
aaaucuugucaugugu

SEQ ID NO: 3524710 - RNA, 20 nt, Human
aaaucuugucauguguauaa

SEQ ID NO: 3524711 - RNA, 18 nt, Human
aaaucuuuccauauccau

SEQ ID NO: 3524712 - RNA, 18 nt, Human
aaaucuuucuuucuuaga

SEQ ID NO: 3524713 - RNA, 20 nt, Human
aaaucuuucuuucuuagaaa

SEQ ID NO: 3524714 - RNA, 22 nt, Human
aaaucuuucuuucuuagaaauu

SEQ ID NO: 3524715 - RNA, 18 nt, Human
aaaucuuuuagucauuau

SEQ ID NO: 3524716 - RNA, 23 nt, Human
aaaucuuuuccaggaaaaagaac

SEQ ID NO: 3524717 - RNA, 15 nt, Human
aaaucuuuugaagca

SEQ ID NO: 3524718 - RNA, 18 nt, Human
aaaugaaaacauguaaua

SEQ ID NO: 3524719 - RNA, 20 nt, Human
aaaugaaagaugauuugcaa

SEQ ID NO: 3524720 - RNA, 15 nt, Human
aaaugaaagcaugug

SEQ ID NO: 3524721 - RNA, 14 nt, Human
aaaugaaagugaga

SEQ ID NO: 3524722 - RNA, 14 nt, Human
aaaugaaaugcaua

SEQ ID NO: 3524723 - RNA, 15 nt, Human
aaaugaaaugcauau

SEQ ID NO: 3524724 - RNA, 12 nt, Human
aaaugaaauugu

SEQ ID NO: 3524725 - RNA, 14 nt, Human
aaaugaaauuguaa

SEQ ID NO: 3524726 - RNA, 19 nt, Human
aaaugaaauuuaaacauua

SEQ ID NO: 3524727 - RNA, 13 nt, Human
aaaugaaauuuua

SEQ ID NO: 3524728 - RNA, 15 nt, Human
aaaugaaauuuuacc

SEQ ID NO: 3524729 - RNA, 17 nt, Human
aaaugaaauuuuaccaa

SEQ ID NO: 3524730 - RNA, 20 nt, Human
aaaugaaauuuuaccaaguu

SEQ ID NO: 3524731 - RNA, 13 nt, Human
aaaugaacacaaa

SEQ ID NO: 3524732 - RNA, 22 nt, Human
aaaugaacgauauguagcagaa

SEQ ID NO: 3524733 - RNA, 14 nt, Human
aaaugaacugaagu

SEQ ID NO: 3524734 - RNA, 13 nt, Human
aaaugaagaauuu

SEQ ID NO: 3524735 - RNA, 15 nt, Human
aaaugaagaauuuaa

SEQ ID NO: 3524736 - RNA, 17 nt, Human
aaaugaaguuuauacag

SEQ ID NO: 3524737 - RNA, 18 nt, Human
aaaugaauaauuucccaa

SEQ ID NO: 3524738 - RNA, 18 nt, Human
aaaugaauaucuauuaau

SEQ ID NO: 3524739 - RNA, 15 nt, Human
aaaugaauauuuuga

SEQ ID NO: 3524740 - RNA, 16 nt, Human
aaaugaauauuuugau

SEQ ID NO: 3524741 - RNA, 11 nt, Human
aaaugaaugag

SEQ ID NO: 3524742 - RNA, 19 nt, Human
aaaugaaugucacuucugg

SEQ ID NO: 3524743 - RNA, 21 nt, Human
aaaugaaugucacuucuggau

SEQ ID NO: 3524744 - RNA, 12 nt, Human
aaaugaaugugu

SEQ ID NO: 3524745 - RNA, 19 nt, Human
aaaugaaugugugugguuu

SEQ ID NO: 3524746 - RNA, 15 nt, Human
aaaugaauguugucu

SEQ ID NO: 3524747 - RNA, 16 nt, Human
aaaugacaaucaugug

SEQ ID NO: 3524748 - RNA, 17 nt, Human
aaaugacaaucaugugu

SEQ ID NO: 3524749 - RNA, 15 nt, Human
aaaugacaaugauga

SEQ ID NO: 3524750 - RNA, 22 nt, Human
aaaugacaccaucuuuuauucu

SEQ ID NO: 3524751 - RNA, 17 nt, Human
aaaugacaucuuuuuaa

SEQ ID NO: 3524752 - RNA, 20 nt, Human
aaaugacaucuuuuuaaagc

SEQ ID NO: 3524753 - RNA, 21 nt, Human
aaaugacaucuuuuuaaagcu

SEQ ID NO: 3524754 - RNA, 22 nt, Human
aaaugacaucuuuuuaaagcuu

SEQ ID NO: 3524755 - RNA, 16 nt, Human
aaaugacccaaagacc

SEQ ID NO: 3524756 - RNA, 20 nt, Human
aaaugaccucuguccucccu

SEQ ID NO: 3524757 - RNA, 22 nt, Human
aaaugacuaaaaaacaaagaag

SEQ ID NO: 3524758 - RNA, 17 nt, Human
aaaugacuaaaaauauu

SEQ ID NO: 3524759 - RNA, 14 nt, Human
aaaugacuuuauua

SEQ ID NO: 3524760 - RNA, 15 nt, Human
aaaugacuuuauuau

SEQ ID NO: 3524761 - RNA, 18 nt, Human
aaaugacuuuauuauuua

SEQ ID NO: 3524762 - RNA, 21 nt, Human
aaaugacuuuauuauuuauuu

SEQ ID NO: 3524763 - RNA, 14 nt, Human
aaaugagaaaucua

SEQ ID NO: 3524764 - RNA, 22 nt, Human
aaaugagaucaggcucugccuc

SEQ ID NO: 3524765 - RNA, 13 nt, Human
aaaugagccuggc

SEQ ID NO: 3524766 - RNA, 15 nt, Human
aaaugagcucugaaa

SEQ ID NO: 3524767 - RNA, 19 nt, Human
aaaugagcuugauuaaauc

SEQ ID NO: 3524768 - RNA, 13 nt, Human
aaaugaggaaacu

SEQ ID NO: 3524769 - RNA, 14 nt, Human
aaaugaggacaugu

SEQ ID NO: 3524770 - RNA, 18 nt, Human
aaaugaguaacauuugcu

SEQ ID NO: 3524771 - RNA, 22 nt, Human
aaaugaguccaaacuggaauga

SEQ ID NO: 3524772 - RNA, 15 nt, Human
aaaugaguugugaaa

SEQ ID NO: 3524773 - RNA, 19 nt, Human
aaaugaguugugaaaguuu

SEQ ID NO: 3524774 - RNA, 23 nt, Human
aaaugaguugugaaaguuuugag

SEQ ID NO: 3524775 - RNA, 19 nt, Human
aaaugauagauuugaccuc

SEQ ID NO: 3524776 - RNA, 11 nt, Human
aaaugauauua

SEQ ID NO: 3524777 - RNA, 15 nt, Human
aaaugaucaguuuuu

SEQ ID NO: 3524778 - RNA, 13 nt, Human
aaaugaucuaaac

SEQ ID NO: 3524779 - RNA, 16 nt, Human
aaaugaugugcaaaac

SEQ ID NO: 3524780 - RNA, 18 nt, Human
aaaugauguguacccaaa

SEQ ID NO: 3524781 - RNA, 17 nt, Human
aaaugauugcuuuuaaa

SEQ ID NO: 3524782 - RNA, 21 nt, Human
aaaugauuuccucuguaaucu

SEQ ID NO: 3524783 - RNA, 18 nt, Human
aaaugcaaaaaaaauuag

SEQ ID NO: 3524784 - RNA, 19 nt, Human
aaaugcaaaaacucuuuga

SEQ ID NO: 3524785 - RNA, 15 nt, Human
aaaugcaaaaaucuc

SEQ ID NO: 3524786 - RNA, 14 nt, Human
aaaugcaaauaaca

SEQ ID NO: 3524787 - RNA, 14 nt, Human
aaaugcaaauccua

SEQ ID NO: 3524788 - RNA, 14 nt, Human
aaaugcacaaacaa

SEQ ID NO: 3524789 - RNA, 18 nt, Human
aaaugcacaaugucuugg

SEQ ID NO: 3524790 - RNA, 18 nt, Human
aaaugcaccuggaauaua

SEQ ID NO: 3524791 - RNA, 22 nt, Human
aaaugcaccuggaauauauaac

SEQ ID NO: 3524792 - RNA, 21 nt, Human
aaaugcagcgaaccaauauuu

SEQ ID NO: 3524793 - RNA, 15 nt, Human
aaaugcauaaaugca

SEQ ID NO: 3524794 - RNA, 15 nt, Human
aaaugcauauuguau

SEQ ID NO: 3524795 - RNA, 17 nt, Human
aaaugcaucaauccugu

SEQ ID NO: 3524796 - RNA, 18 nt, Human
aaaugcaucaauccugug

SEQ ID NO: 3524797 - RNA, 14 nt, Human
aaaugcaucuuuga

SEQ ID NO: 3524798 - RNA, 18 nt, Human
aaaugcaucuuugaugug

SEQ ID NO: 3524799 - RNA, 20 nt, Human
aaaugcaucuuugauguguu

SEQ ID NO: 3524800 - RNA, 23 nt, Human
cucugcccuaaugcgcaggcugg

SEQ ID NO: 3524801 - RNA, 15 nt, Human
cucugcccugcccua

SEQ ID NO: 3524802 - RNA, 19 nt, Human
cucugcccugcccuagcuc

SEQ ID NO: 3524803 - RNA, 20 nt, Human
cucugcccugcccuagcucc

SEQ ID NO: 3524804 - RNA, 12 nt, Human
cucugcccuugg

SEQ ID NO: 3524805 - RNA, 20 nt, Human
cucugccgcaauacaggaac

SEQ ID NO: 3524806 - RNA, 21 nt, Human
cucugccgcaauacaggaacc

SEQ ID NO: 3524807 - RNA, 14 nt, Human
cucugccgcuaccu

SEQ ID NO: 3524808 - RNA, 18 nt, Human
cucugccggcucuuuccu

SEQ ID NO: 3524809 - RNA, 20 nt, Human
cucugccggcucuuuccuug

SEQ ID NO: 3524810 - RNA, 23 nt, Human
cucugccggcucuuuccuugcuc

SEQ ID NO: 3524811 - RNA, 17 nt, Human
cucugccgucucuggag

SEQ ID NO: 3524812 - RNA, 19 nt, Human
cucugccucaccgcuuccc

SEQ ID NO: 3524813 - RNA, 13 nt, Human
cucugccucccau

SEQ ID NO: 3524814 - RNA, 14 nt, Human
cucugccuccucuu

SEQ ID NO: 3524815 - RNA, 14 nt, Human
cucugccucugaca

SEQ ID NO: 3524816 - RNA, 16 nt, Human
cucugccucugacaca

SEQ ID NO: 3524817 - RNA, 14 nt, Human
cucugccugucccu

SEQ ID NO: 3524818 - RNA, 19 nt, Human
cucugccugucccucucag

SEQ ID NO: 3524819 - RNA, 20 nt, Human
cucugccugucccucucagg

SEQ ID NO: 3524820 - RNA, 21 nt, Human
cucugccugucccucucaggc

SEQ ID NO: 3524821 - RNA, 15 nt, Human
cucugccuuugcucu

SEQ ID NO: 3524822 - RNA, 14 nt, Human
cucugcggacccca

SEQ ID NO: 3524823 - RNA, 16 nt, Human
cucugcggaccccagc

SEQ ID NO: 3524824 - RNA, 20 nt, Human
cucugcggaccccagcugug

SEQ ID NO: 3524825 - RNA, 17 nt, Human
cucugcggagcacacug

SEQ ID NO: 3524826 - RNA, 19 nt, Human
cucugcggagcacacuggc

SEQ ID NO: 3524827 - RNA, 23 nt, Human
cucugcggagcacacuggcucac

SEQ ID NO: 3524828 - RNA, 19 nt, Human
cucugcgucgguccuggug

SEQ ID NO: 3524829 - RNA, 20 nt, Human
cucugcgucgguccuggugc

SEQ ID NO: 3524830 - RNA, 23 nt, Human
cucugcgugcagggacaaagagg

SEQ ID NO: 3524831 - RNA, 13 nt, Human
cucugcuaaauug

SEQ ID NO: 3524832 - RNA, 17 nt, Human
cucugcuaaauugaugu

SEQ ID NO: 3524833 - RNA, 22 nt, Human
cucugcucaccgcccaucaggg

SEQ ID NO: 3524834 - RNA, 22 nt, Human
cucugcuccaaccgggauggga

SEQ ID NO: 3524835 - RNA, 13 nt, Human
cucugcuccaccu

SEQ ID NO: 3524836 - RNA, 19 nt, Human
cucugcuccaccuuucagc

SEQ ID NO: 3524837 - RNA, 13 nt, Human
cucugcucccccu

SEQ ID NO: 3524838 - RNA, 13 nt, Human
cucugcuccucuc

SEQ ID NO: 3524839 - RNA, 21 nt, Human
cucugcuccucuccccagcaa

SEQ ID NO: 3524840 - RNA, 21 nt, Human
cucugcucgcccuccuuucug

SEQ ID NO: 3524841 - RNA, 15 nt, Human
cucugcucgccuuag

SEQ ID NO: 3524842 - RNA, 13 nt, Human
cucugcucugcgu

SEQ ID NO: 3524843 - RNA, 20 nt, Human
cucugcugacagacacaggc

SEQ ID NO: 3524844 - RNA, 23 nt, Human
cucugcugacagacacaggcccg

SEQ ID NO: 3524845 - RNA, 13 nt, Human
cucugcugaccug

SEQ ID NO: 3524846 - RNA, 11 nt, Human
cugaucugccc

SEQ ID NO: 3524847 - RNA, 12 nt, Human
cugaucugccca

SEQ ID NO: 3524848 - RNA, 13 nt, Human
cugaucugcccau

SEQ ID NO: 3524849 - RNA, 16 nt, Human
cugaucugcccaucgu

SEQ ID NO: 3524850 - RNA, 17 nt, Human
cugaucugcccaucgug

SEQ ID NO: 3524851 - RNA, 12 nt, Human
cugaucugcgga

SEQ ID NO: 3524852 - RNA, 20 nt, Human
cugaucugugcuuuccagcu

SEQ ID NO: 3524853 - RNA, 18 nt, Human
cugaugaaaauaaagaau

SEQ ID NO: 3524854 - RNA, 20 nt, Human
cugaugaaaauaaagaaugg

SEQ ID NO: 3524855 - RNA, 21 nt, Human
cugaugaaacucacaaaugau

SEQ ID NO: 3524856 - RNA, 21 nt, Human
cugaugaacucuuaaucaaau

SEQ ID NO: 3524857 - RNA, 20 nt, Human
cugacacugcuggagaggcc

SEQ ID NO: 3524858 - RNA, 21 nt, Human
cugacacugcuggagaggccc

SEQ ID NO: 3524859 - RNA, 14 nt, Human
cugacagaaggacu

SEQ ID NO: 3524860 - RNA, 16 nt, Human
cugacagacacaggcc

SEQ ID NO: 3524861 - RNA, 18 nt, Human
cugacagacacaggcccg

SEQ ID NO: 3524862 - RNA, 21 nt, Human
cugacagacacaggcccggcu

SEQ ID NO: 3524863 - RNA, 17 nt, Human
cugacagacagcccucc

SEQ ID NO: 3524864 - RNA, 11 nt, Human
cugacagcagc

SEQ ID NO: 3524865 - RNA, 14 nt, Human
cugacagccagaac

SEQ ID NO: 3524866 - RNA, 15 nt, Human
cugacagccgcugcu

SEQ ID NO: 3524867 - RNA, 12 nt, Human
cugacagccucc

SEQ ID NO: 3524868 - RNA, 13 nt, Human
cugacagccuccc

SEQ ID NO: 3524869 - RNA, 16 nt, Human
cugacagcugcuccua

SEQ ID NO: 3524870 - RNA, 19 nt, Human
cugacagcugucccugccc

SEQ ID NO: 3524871 - RNA, 19 nt, Human
cugacaggcaaugcuggcu

SEQ ID NO: 3524872 - RNA, 15 nt, Human
cugacaggcagccug

SEQ ID NO: 3524873 - RNA, 20 nt, Human
cugacaggcagccuggacau

SEQ ID NO: 3524874 - RNA, 17 nt, Human
cugacaucaaaaaaggc

SEQ ID NO: 3524875 - RNA, 17 nt, Human
cugacaucacagcagcc

SEQ ID NO: 3524876 - RNA, 21 nt, Human
cugacaucuuaguauuugcau

SEQ ID NO: 3524877 - RNA, 13 nt, Human
cugacaucuugaa

SEQ ID NO: 3524878 - RNA, 22 nt, Human
cugacaucuugaauccuuccau

SEQ ID NO: 3524879 - RNA, 15 nt, Human
cugacaugauuccuu

SEQ ID NO: 3524880 - RNA, 15 nt, Human
cugacaugcccuccc

SEQ ID NO: 3524881 - RNA, 17 nt, Human
cugacaugcccucccuu

SEQ ID NO: 3524882 - RNA, 19 nt, Human
cugacaugcccucccuucu

SEQ ID NO: 3524883 - RNA, 14 nt, Human
cugacauuaacagu

SEQ ID NO: 3524884 - RNA, 15 nt, Human
cugacauuaacaguu

SEQ ID NO: 3524885 - RNA, 20 nt, Human
cugacauuaacaguuuucca

SEQ ID NO: 3524886 - RNA, 23 nt, Human
cugacauuaacaguuuuccauga

SEQ ID NO: 3524887 - RNA, 19 nt, Human
cugacauucucaggaagcc

SEQ ID NO: 3524888 - RNA, 21 nt, Human
cugacauugccaaaaaggaua

SEQ ID NO: 3524889 - RNA, 20 nt, Human
cugacauuguggcacauucu

SEQ ID NO: 3524890 - RNA, 18 nt, Human
cugacauuucuucuagug

SEQ ID NO: 3524891 - RNA, 12 nt, Human
cugaccaacagg

SEQ ID NO: 3524892 - RNA, 13 nt, Human
cugaccaacaggc

SEQ ID NO: 3524893 - RNA, 15 nt, Human
cugaccaacaggcug

SEQ ID NO: 3524894 - RNA, 18 nt, Human
cugaccaacaggcuguuc

SEQ ID NO: 3524895 - RNA, 18 nt, Human
cugaccaauauuguacag

SEQ ID NO: 3524896 - RNA, 14 nt, Human
cugaccaauugugc

SEQ ID NO: 3524897 - RNA, 21 nt, Human
cugaccaauugugcugccauu

SEQ ID NO: 3524898 - RNA, 22 nt, Human
cugaccaauugugcugccauuu

SEQ ID NO: 3524899 - RNA, 14 nt, Human
cugaccacagcaca

SEQ ID NO: 3524900 - RNA, 17 nt, Human
cugaccacccuccccuc

SEQ ID NO: 3524901 - RNA, 23 nt, Human
cugaccacggacguuuccaucag

SEQ ID NO: 3524902 - RNA, 14 nt, Human
cugaccacucagag

SEQ ID NO: 3524903 - RNA, 22 nt, Human
cugaccacucagagacaugcag

SEQ ID NO: 3524904 - RNA, 17 nt, Human
cugaccacuugaggccu

SEQ ID NO: 3524905 - RNA, 12 nt, Human
cugaccagcagc

SEQ ID NO: 3524906 - RNA, 13 nt, Human
cugaccagcuccc

SEQ ID NO: 3524907 - RNA, 14 nt, Human
cugaccagcucccc

SEQ ID NO: 3524908 - RNA, 21 nt, Human
cugaccagcucccccucccuc

SEQ ID NO: 3524909 - RNA, 16 nt, Human
cugaccauccacucua

SEQ ID NO: 3524910 - RNA, 19 nt, Human
cugaccauccacucuaccc

SEQ ID NO: 3524911 - RNA, 15 nt, Human
cugaccaugcauuuu

SEQ ID NO: 3524912 - RNA, 22 nt, Human
cugaccaugcucaucugcuggu

SEQ ID NO: 3524913 - RNA, 18 nt, Human
cugaccauuucagggguc

SEQ ID NO: 3524914 - RNA, 13 nt, Human
cugacccaggccg

SEQ ID NO: 3524915 - RNA, 15 nt, Human
cugacccaggccgca

SEQ ID NO: 3524916 - RNA, 18 nt, Human
cugacccaggccgcagcu

SEQ ID NO: 3524917 - RNA, 10 nt, Human
cugacccagu

SEQ ID NO: 3524918 - RNA, 17 nt, Human
cugacccagucccuggg

SEQ ID NO: 3524919 - RNA, 18 nt, Human
cugacccagugcccccac

SEQ ID NO: 3524920 - RNA, 21 nt, Human
cugacccagugcccccacuga

SEQ ID NO: 3524921 - RNA, 22 nt, Human
cugaccccaaacaccuuccagc

SEQ ID NO: 3524922 - RNA, 14 nt, Human
cugaccccccucag

SEQ ID NO: 3524923 - RNA, 15 nt, Human
cugaccccccucagg

SEQ ID NO: 3524924 - RNA, 23 nt, Human
cugaccccccucaggacccucgc

SEQ ID NO: 3524925 - RNA, 17 nt, Human
cugaccccucauagccc

SEQ ID NO: 3524926 - RNA, 14 nt, Human
cugaccccugcuca

SEQ ID NO: 3524927 - RNA, 18 nt, Human
cugacccuacucccuugc

SEQ ID NO: 3524928 - RNA, 18 nt, Human
cugacccucaucuuucuu

SEQ ID NO: 3524929 - RNA, 15 nt, Human
cugacccuccccaaa

SEQ ID NO: 3524930 - RNA, 17 nt, Human
cugacccuccuguugca

SEQ ID NO: 3524931 - RNA, 23 nt, Human
cugacccugcuucaaauauuucc

SEQ ID NO: 3524932 - RNA, 14 nt, Human
cugacccuggggcu

SEQ ID NO: 3524933 - RNA, 19 nt, Human
cugacccuggggcuggcuu

SEQ ID NO: 3524934 - RNA, 15 nt, Human
cugacccuguauaua

SEQ ID NO: 3524935 - RNA, 18 nt, Human
cugacccuguauauagcc

SEQ ID NO: 3524936 - RNA, 22 nt, Human
cugacccuuacagccucugacu

SEQ ID NO: 3524937 - RNA, 14 nt, Human
cugacccuuccaga

SEQ ID NO: 3524938 - RNA, 18 nt, Human
cugacccuuccagacaua

SEQ ID NO: 3524939 - RNA, 22 nt, Human
cugaccgugggcggggccuugc

SEQ ID NO: 3524940 - RNA, 17 nt, Human
cugaccuaucacuucca

SEQ ID NO: 3524941 - RNA, 17 nt, Human
cugaccucaagugaucu

SEQ ID NO: 3524942 - RNA, 16 nt, Human
cugaccuccacagcuu

SEQ ID NO: 3524943 - RNA, 16 nt, Human
cugaccuccgccaucc

SEQ ID NO: 3524944 - RNA, 18 nt, Human
cugaccucuugcugucuc

SEQ ID NO: 3524945 - RNA, 23 nt, Human
cugaccucuugcugucucugcuc

SEQ ID NO: 3524946 - RNA, 14 nt, Human
cugaccugcacugg

SEQ ID NO: 3524947 - RNA, 13 nt, Human
cugaccugcaggc

SEQ ID NO: 3524948 - RNA, 19 nt, Human
cugaccugcugaccugugc

SEQ ID NO: 3524949 - RNA, 23 nt, Human
cugaccuggcaucuaauucugau

SEQ ID NO: 3524950 - RNA, 12 nt, Human
cugaccuggccc

SEQ ID NO: 3524951 - RNA, 13 nt, Human
cugaccuggcccc

SEQ ID NO: 3524952 - RNA, 14 nt, Human
cugaccuggccccc

SEQ ID NO: 3524953 - RNA, 16 nt, Human
cugaccugguccacag

SEQ ID NO: 3524954 - RNA, 17 nt, Human
cugaccugguccacagg

SEQ ID NO: 3524955 - RNA, 18 nt, Human
cugaccugguccacaggg

SEQ ID NO: 3524956 - RNA, 20 nt, Human
cugaccugguccacagggca

SEQ ID NO: 3524957 - RNA, 23 nt, Human
cugaccugucaugccccccucaa

SEQ ID NO: 3524958 - RNA, 15 nt, Human
cugaccuuaaaugca

SEQ ID NO: 3524959 - RNA, 17 nt, Human
cugaccuuccucgcaga

SEQ ID NO: 3524960 - RNA, 22 nt, Human
cugaccuuccucgcagagaggc

SEQ ID NO: 3524961 - RNA, 13 nt, Human
cugaccuuccuuc

SEQ ID NO: 3524962 - RNA, 20 nt, Human
cugaccuuggagagacacag

SEQ ID NO: 3524963 - RNA, 21 nt, Human
cugaccuuugucaucuuucuu

SEQ ID NO: 3524964 - RNA, 17 nt, Human
cugacgaaacuggcccc

SEQ ID NO: 3524965 - RNA, 20 nt, Human
cugacgaaacuggccccgga

SEQ ID NO: 3524966 - RNA, 13 nt, Human
cugacgaggcugg

SEQ ID NO: 3524967 - RNA, 14 nt, Human
cugacgaggcuggg

SEQ ID NO: 3524968 - RNA, 16 nt, Human
cugacgaggcugggcc

SEQ ID NO: 3524969 - RNA, 21 nt, Human
cugacgaggcugggccaagcc

SEQ ID NO: 3524970 - RNA, 18 nt, Human
cugacgcaaugaaaaguc

SEQ ID NO: 3524971 - RNA, 16 nt, Human
cugacggaagccaacu

SEQ ID NO: 3524972 - RNA, 23 nt, Human
cugacggaagccaacuuggcuuu

SEQ ID NO: 3524973 - RNA, 19 nt, Human
cugacggccagggagaagc

SEQ ID NO: 3524974 - RNA, 17 nt, Human
cugacggcccugcaaug

SEQ ID NO: 3524975 - RNA, 22 nt, Human
cugacggcgcccccagugugca

SEQ ID NO: 3524976 - RNA, 21 nt, Human
cugacggggaggaaccacugc

SEQ ID NO: 3524977 - RNA, 18 nt, Human
cugacggugcagucuggg

SEQ ID NO: 3524978 - RNA, 22 nt, Human
cugacguagcugcaaaggacag

SEQ ID NO: 3524979 - RNA, 23 nt, Human
cugacgucugaagcuugacuccc

SEQ ID NO: 3524980 - RNA, 15 nt, Human
cugacguuccgggca

SEQ ID NO: 3524981 - RNA, 17 nt, Human
cugacuacuggcucuca

SEQ ID NO: 3524982 - RNA, 16 nt, Human
cugacuacugggcaaa

SEQ ID NO: 3524983 - RNA, 22 nt, Human
cugacuagaagggccaguccug

SEQ ID NO: 3524984 - RNA, 23 nt, Human
cugacuauucuugauguaaaauc

SEQ ID NO: 3524985 - RNA, 14 nt, Human
cugacucacaagaa

SEQ ID NO: 3524986 - RNA, 23 nt, Human
cugacucccaaagagcugccuaa

SEQ ID NO: 3524987 - RNA, 22 nt, Human
cugacuccuaccugcccuggaa

SEQ ID NO: 3524988 - RNA, 19 nt, Human
cugacuccucuaagccacu

SEQ ID NO: 3524989 - RNA, 21 nt, Human
cugacucuaggugcccuugga

SEQ ID NO: 3524990 - RNA, 19 nt, Human
cugccacugacugcaggga

SEQ ID NO: 3524991 - RNA, 13 nt, Human
cugccacuuccca

SEQ ID NO: 3524992 - RNA, 16 nt, Human
cugccacuucccaggu

SEQ ID NO: 3524993 - RNA, 16 nt, Human
cugccacuugaacaaa

SEQ ID NO: 3524994 - RNA, 17 nt, Human
cugccacuuugcacauu

SEQ ID NO: 3524995 - RNA, 19 nt, Human
cugccacuuugguacaugg

SEQ ID NO: 3524996 - RNA, 22 nt, Human
cugccagaagauccccucagga

SEQ ID NO: 3524997 - RNA, 15 nt, Human
cugccagacuuaaaa

SEQ ID NO: 3524998 - RNA, 17 nt, Human
cugccagaugcugaugu

SEQ ID NO: 3524999 - RNA, 18 nt, Human
cugccagaugcugauguu

SEQ ID NO: 3525000 - RNA, 22 nt, Human
cugccagaugcugauguucagu

SEQ ID NO: 3525001 - RNA, 23 nt, Human
cugccagaugcugauguucagug

SEQ ID NO: 3525002 - RNA, 16 nt, Human
cugccagcacccccac

SEQ ID NO: 3525003 - RNA, 11 nt, Human
cugccagcagc

SEQ ID NO: 3525004 - RNA, 12 nt, Human
cugccagccaca

SEQ ID NO: 3525005 - RNA, 13 nt, Human
cugccagccagca

SEQ ID NO: 3525006 - RNA, 18 nt, Human
cugccagccagcagccag

SEQ ID NO: 3525007 - RNA, 23 nt, Human
cugccagccagcagccagcucuc

SEQ ID NO: 3525008 - RNA, 13 nt, Human
cugccagccccac

SEQ ID NO: 3525009 - RNA, 18 nt, Human
cugccagccccacacagc

SEQ ID NO: 3525010 - RNA, 16 nt, Human
cugccagccccugcca

SEQ ID NO: 3525011 - RNA, 12 nt, Human
cugccagccugg

SEQ ID NO: 3525012 - RNA, 15 nt, Human
cugccagccuggcuu

SEQ ID NO: 3525013 - RNA, 16 nt, Human
cugccagccuggcuuc

SEQ ID NO: 3525014 - RNA, 20 nt, Human
cugccagccuggcuucugga

SEQ ID NO: 3525015 - RNA, 15 nt, Human
cugccagccuugagc

SEQ ID NO: 3525016 - RNA, 17 nt, Human
cugccagcucuguauca

SEQ ID NO: 3525017 - RNA, 14 nt, Human
cugccagcucuucc

SEQ ID NO: 3525018 - RNA, 19 nt, Human
cugccagcucuuccuagcu

SEQ ID NO: 3525019 - RNA, 11 nt, Human
cugccagcugc

SEQ ID NO: 3525020 - RNA, 12 nt, Human
cugccagcugca

SEQ ID NO: 3525021 - RNA, 17 nt, Human
cugccagcugcacugau

SEQ ID NO: 3525022 - RNA, 18 nt, Human
cugccaggaagccagcag

SEQ ID NO: 3525023 - RNA, 20 nt, Human
cugccaggaagccagcaggc

SEQ ID NO: 3525024 - RNA, 22 nt, Human
cugccaggaagccagcaggcuc

SEQ ID NO: 3525025 - RNA, 11 nt, Human
cugccaggagg

SEQ ID NO: 3525026 - RNA, 23 nt, Human
cugccaggaggacccagggcucu

SEQ ID NO: 3525027 - RNA, 22 nt, Human
cugccaggagggacaaaggagc

SEQ ID NO: 3525028 - RNA, 23 nt, Human
cugccaggagggacaaaggagcc

SEQ ID NO: 3525029 - RNA, 20 nt, Human
cugccaggcacaggcagggc

SEQ ID NO: 3525030 - RNA, 22 nt, Human
cugccaggcacaggcagggcag

SEQ ID NO: 3525031 - RNA, 20 nt, Human
cugccaggcagggguggggg

SEQ ID NO: 3525032 - RNA, 13 nt, Human
cugccaggcaugg

SEQ ID NO: 3525033 - RNA, 13 nt, Human
cugccaggccagc

SEQ ID NO: 3525034 - RNA, 16 nt, Human
cugccaggccagccuc

SEQ ID NO: 3525035 - RNA, 18 nt, Human
cugccaggccagccuccg

SEQ ID NO: 3525036 - RNA, 19 nt, Human
cugccaggccagccuccga

SEQ ID NO: 3525037 - RNA, 18 nt, Human
cugccaggcccccaagcc

SEQ ID NO: 3525038 - RNA, 21 nt, Human
cugccaggcccccaagccugc

SEQ ID NO: 3525039 - RNA, 19 nt, Human
cugccaggcccccaccaca

SEQ ID NO: 3525040 - RNA, 20 nt, Human
cugccaggcccccaccacac

SEQ ID NO: 3525041 - RNA, 21 nt, Human
cugccaggcccccaccacaca

SEQ ID NO: 3525042 - RNA, 22 nt, Human
cugccaggcccccaccacacau

SEQ ID NO: 3525043 - RNA, 23 nt, Human
cugccagggacagaggggguggc

SEQ ID NO: 3525044 - RNA, 17 nt, Human
cugccagggagacagag

SEQ ID NO: 3525045 - RNA, 12 nt, Human
cugccagggagc

SEQ ID NO: 3525046 - RNA, 11 nt, Human
cugccagggca

SEQ ID NO: 3525047 - RNA, 16 nt, Human
cugccagggcagugcu

SEQ ID NO: 3525048 - RNA, 11 nt, Human
cugccagggcc

SEQ ID NO: 3525049 - RNA, 16 nt, Human
cugccagggccccucu

SEQ ID NO: 3525050 - RNA, 17 nt, Human
cugccagggccccucuc

SEQ ID NO: 3525051 - RNA, 18 nt, Human
cugccagggccccucucc

SEQ ID NO: 3525052 - RNA, 23 nt, Human
cugccagggccccucuccccagg

SEQ ID NO: 3525053 - RNA, 20 nt, Human
cugccagucccccugcccca

SEQ ID NO: 3525054 - RNA, 21 nt, Human
cugccagucccccugccccag

SEQ ID NO: 3525055 - RNA, 17 nt, Human
cugccaguccuagcugc

SEQ ID NO: 3525056 - RNA, 18 nt, Human
cugccaguccuagcugca

SEQ ID NO: 3525057 - RNA, 21 nt, Human
cugccagugacagacaggcuc

SEQ ID NO: 3525058 - RNA, 16 nt, Human
cugccagugccugggu

SEQ ID NO: 3525059 - RNA, 17 nt, Human
cugccagugccugggug

SEQ ID NO: 3525060 - RNA, 13 nt, Human
cugccagugccuu

SEQ ID NO: 3525061 - RNA, 17 nt, Human
cugccaguguccugagc

SEQ ID NO: 3525062 - RNA, 13 nt, Human
cugccauaaaaca

SEQ ID NO: 3525063 - RNA, 20 nt, Human
cugccauaaaacauuaagaa

SEQ ID NO: 3525064 - RNA, 18 nt, Human
cugccauaugauuuacau

SEQ ID NO: 3525065 - RNA, 16 nt, Human
cugccauauucuguug

SEQ ID NO: 3525066 - RNA, 22 nt, Human
cugccaucauguuuacagagga

SEQ ID NO: 3525067 - RNA, 12 nt, Human
cugccauccagg

SEQ ID NO: 3525068 - RNA, 13 nt, Human
cugccauccuggc

SEQ ID NO: 3525069 - RNA, 17 nt, Human
cugccauccuggcccag

SEQ ID NO: 3525070 - RNA, 17 nt, Human
cugaugcuguucucuuc

SEQ ID NO: 3525071 - RNA, 19 nt, Human
cugaugcuucuucagagac

SEQ ID NO: 3525072 - RNA, 17 nt, Human
cugaugcuuugcuucaa

SEQ ID NO: 3525073 - RNA, 14 nt, Human
cugauggaaacaaa

SEQ ID NO: 3525074 - RNA, 20 nt, Human
cugauggaaguaaagccuca

SEQ ID NO: 3525075 - RNA, 13 nt, Human
cugauggagaagg

SEQ ID NO: 3525076 - RNA, 14 nt, Human
cugauggagaagga

SEQ ID NO: 3525077 - RNA, 15 nt, Human
cugauggagaaggaa

SEQ ID NO: 3525078 - RNA, 22 nt, Human
cugauggaucccgaagaaugga

SEQ ID NO: 3525079 - RNA, 22 nt, Human
cugauggcaggauggccuggcc

SEQ ID NO: 3525080 - RNA, 18 nt, Human
cugauggcuucuccaggg

SEQ ID NO: 3525081 - RNA, 22 nt, Human
cugaugggcaacccccagccug

SEQ ID NO: 3525082 - RNA, 24 nt, Human
cugaugggcaacccccagccugcu

SEQ ID NO: 3525083 - RNA, 16 nt, Human
cugauggucagcuccc

SEQ ID NO: 3525084 - RNA, 19 nt, Human
cugauggucagcucccuuc

SEQ ID NO: 3525085 - RNA, 17 nt, Human
cugauguaaaugaagua

SEQ ID NO: 3525086 - RNA, 18 nt, Human
cugaugucaauuucugug

SEQ ID NO: 3525087 - RNA, 20 nt, Human
cugaugucaauuucuguguu

SEQ ID NO: 3525088 - RNA, 13 nt, Human
cugauguguacau

SEQ ID NO: 3525089 - RNA, 16 nt, Human
cugauguguugccacu

SEQ ID NO: 3525090 - RNA, 15 nt, Human
cugauguuaggcugg

SEQ ID NO: 3525091 - RNA, 16 nt, Human
cugauguuaggcuggg

SEQ ID NO: 3525092 - RNA, 23 nt, Human
cugauguuaggcugggcccagag

SEQ ID NO: 3525093 - RNA, 14 nt, Human
cugauguucagugu

SEQ ID NO: 3525094 - RNA, 19 nt, Human
cugauguucaguguaauuu

SEQ ID NO: 3525095 - RNA, 21 nt, Human
cugauguucaguguaauuucu

SEQ ID NO: 3525096 - RNA, 16 nt, Human
cugauguucccuccgg

SEQ ID NO: 3525097 - RNA, 13 nt, Human
cugauguuugugc

SEQ ID NO: 3525098 - RNA, 15 nt, Human
cugauuaaaugacac

SEQ ID NO: 3525099 - RNA, 16 nt, Human
cugauuacacaaaaca

SEQ ID NO: 3525100 - RNA, 13 nt, Human
cugauuacuguca

SEQ ID NO: 3525101 - RNA, 23 nt, Human
cugauuagaaaugaccaauauua

SEQ ID NO: 3525102 - RNA, 18 nt, Human
cugauuagcuuuguguuu

SEQ ID NO: 3525103 - RNA, 16 nt, Human
cugauuauaggauuuu

SEQ ID NO: 3525104 - RNA, 17 nt, Human
cugauucacaucucauu

SEQ ID NO: 3525105 - RNA, 21 nt, Human
cugauucacaucucauuuuuc

SEQ ID NO: 3525106 - RNA, 15 nt, Human
cugauucacugcaug

SEQ ID NO: 3525107 - RNA, 15 nt, Human
cugauucccaagcuc

SEQ ID NO: 3525108 - RNA, 19 nt, Human
cugauucccaagcucugcu

SEQ ID NO: 3525109 - RNA, 20 nt, Human
cugauucccaagcucugcuc

SEQ ID NO: 3525110 - RNA, 17 nt, Human
cugauucggcugucuca

SEQ ID NO: 3525111 - RNA, 14 nt, Human
cugauucucagggu

SEQ ID NO: 3525112 - RNA, 17 nt, Human
cugauucucagggucuc

SEQ ID NO: 3525113 - RNA, 20 nt, Human
cugauucucagggucucugc

SEQ ID NO: 3525114 - RNA, 14 nt, Human
cugauucuggcuuu

SEQ ID NO: 3525115 - RNA, 15 nt, Human
cugauucuggcuuua

SEQ ID NO: 3525116 - RNA, 18 nt, Human
cugauucuggcuuuaagc

SEQ ID NO: 3525117 - RNA, 23 nt, Human
cugauugaccguguuggucugua

SEQ ID NO: 3525118 - RNA, 17 nt, Human
cugauugaccugcuccg

SEQ ID NO: 3525119 - RNA, 20 nt, Human
cugauugaccugcuccgcug

SEQ ID NO: 3525120 - RNA, 20 nt, Human
cugauuggcuuguagaauug

SEQ ID NO: 3525121 - RNA, 23 nt, Human
cugauuggcuuguagaauuguua

SEQ ID NO: 3525122 - RNA, 19 nt, Human
cugauugguuucucuucuc

SEQ ID NO: 3525123 - RNA, 21 nt, Human
cugauugguuucucuucuccc

SEQ ID NO: 3525124 - RNA, 12 nt, Human
cugauuguaaac

SEQ ID NO: 3525125 - RNA, 18 nt, Human
cugauuguaacguugcug

SEQ ID NO: 3525126 - RNA, 22 nt, Human
cugauuuaaacacauuaaaggu

SEQ ID NO: 3525127 - RNA, 21 nt, Human
cugauuuaggagaagccagga

SEQ ID NO: 3525128 - RNA, 19 nt, Human
cugauuuccccuuuugcau

SEQ ID NO: 3525129 - RNA, 13 nt, Human
cugauuucuugcu

SEQ ID NO: 3525130 - RNA, 14 nt, Human
cugauuucuugcuu

SEQ ID NO: 3525131 - RNA, 20 nt, Human
cugauuugggcugaauguau

SEQ ID NO: 3525132 - RNA, 18 nt, Human
cugauuuguaacccacug

SEQ ID NO: 3525133 - RNA, 16 nt, Human
cugauuuguuccuucu

SEQ ID NO: 3525134 - RNA, 19 nt, Human
ccgccucgcccaccgcaug

SEQ ID NO: 3525135 - RNA, 21 nt, Human
ccgccucgcccaccgcaugcc

SEQ ID NO: 3525136 - RNA, 20 nt, Human
ccgccucucccgucagggcc

SEQ ID NO: 3525137 - RNA, 16 nt, Human
ccgccugaaucauucu

SEQ ID NO: 3525138 - RNA, 21 nt, Human
ccgccugcccaccugccuggc

SEQ ID NO: 3525139 - RNA, 14 nt, Human
ccgccuggccagga

SEQ ID NO: 3525140 - RNA, 16 nt, Human
ccgccuggccaggagc

SEQ ID NO: 3525141 - RNA, 17 nt, Human
ccgccuggccaggagca

SEQ ID NO: 3525142 - RNA, 23 nt, Human
ccgccuggccaggagcaggcacg

SEQ ID NO: 3525143 - RNA, 14 nt, Human
ccgccuggccuggc

SEQ ID NO: 3525144 - RNA, 23 nt, Human
ccgccugucucuuuaagggcaug

SEQ ID NO: 3525145 - RNA, 20 nt, Human
ccgccuguucccccgccgcu

SEQ ID NO: 3525146 - RNA, 16 nt, Human
ccgccuuaagcugauc

SEQ ID NO: 3525147 - RNA, 13 nt, Human
ccgccuuaccagg

SEQ ID NO: 3525148 - RNA, 23 nt, Human
ccgccuucacuccggugugccug

SEQ ID NO: 3525149 - RNA, 16 nt, Human
ccgccuugcccagccu

SEQ ID NO: 3525150 - RNA, 17 nt, Human
ccgccuugcccagccug

SEQ ID NO: 3525151 - RNA, 17 nt, Human
ccgccuuggccuguguu

SEQ ID NO: 3525152 - RNA, 15 nt, Human
ccgcgaccauguggc

SEQ ID NO: 3525153 - RNA, 22 nt, Human
ccgcgauguggaacugcugcca

SEQ ID NO: 3525154 - RNA, 15 nt, Human
ccgcgccacaggacc

SEQ ID NO: 3525155 - RNA, 16 nt, Human
ccgcgccacaggaccc

SEQ ID NO: 3525156 - RNA, 17 nt, Human
ccgcgcgcgccccgaaa

SEQ ID NO: 3525157 - RNA, 17 nt, Human
ccgcgcguccagcugcc

SEQ ID NO: 3525158 - RNA, 19 nt, Human
ccgcggcgggcccugccca

SEQ ID NO: 3525159 - RNA, 20 nt, Human
ccgcggggacauugggaagg

SEQ ID NO: 3525160 - RNA, 17 nt, Human
ccgcgucgcccucccag

SEQ ID NO: 3525161 - RNA, 13 nt, Human
ccgcgucuacccu

SEQ ID NO: 3525162 - RNA, 15 nt, Human
ccgcgucuacccugg

SEQ ID NO: 3525163 - RNA, 16 nt, Human
ccgcgucuacccuggg

SEQ ID NO: 3525164 - RNA, 14 nt, Human
ccgcgugugccugu

SEQ ID NO: 3525165 - RNA, 19 nt, Human
ccgcguuuagaccaaggaa

SEQ ID NO: 3525166 - RNA, 14 nt, Human
ccgcuaaaagaaac

SEQ ID NO: 3525167 - RNA, 21 nt, Human
ccgcuaagagggagggagggc

SEQ ID NO: 3525168 - RNA, 16 nt, Human
ccgcuacaccacucug

SEQ ID NO: 3525169 - RNA, 20 nt, Human
ccgcuaggcucgccuucccu

SEQ ID NO: 3525170 - RNA, 22 nt, Human
ccgcuaggcucgccuucccucc

SEQ ID NO: 3525171 - RNA, 17 nt, Human
ccgcucaccuagagcca

SEQ ID NO: 3525172 - RNA, 18 nt, Human
ccgcucaccuagagccag

SEQ ID NO: 3525173 - RNA, 19 nt, Human
ccgcucaccuagagccaga

SEQ ID NO: 3525174 - RNA, 15 nt, Human
ccgcucccagugucu

SEQ ID NO: 3525175 - RNA, 20 nt, Human
ccgcucccagugucuuccug

SEQ ID NO: 3525176 - RNA, 14 nt, Human
ccgcuccccagccc

SEQ ID NO: 3525177 - RNA, 15 nt, Human
ccgcuccugucugcc

SEQ ID NO: 3525178 - RNA, 18 nt, Human
ccgcucggaggccccaaa

SEQ ID NO: 3525179 - RNA, 20 nt, Human
ccgcucggaggccccaaagg

SEQ ID NO: 3525180 - RNA, 21 nt, Human
ccgcucggaggccccaaagga

SEQ ID NO: 3525181 - RNA, 23 nt, Human
ccgcucggaggccccaaaggaaa

SEQ ID NO: 3525182 - RNA, 15 nt, Human
ccgcucuccugccac

SEQ ID NO: 3525183 - RNA, 11 nt, Human
ccgcugccacc

SEQ ID NO: 3525184 - RNA, 16 nt, Human
ccgcugccacccaccu

SEQ ID NO: 3525185 - RNA, 23 nt, Human
ccgcugccacccaccucccugcc

SEQ ID NO: 3525186 - RNA, 20 nt, Human
ccgcugccacguuggagaag

SEQ ID NO: 3525187 - RNA, 19 nt, Human
ccgcugcccggcgcccucu

SEQ ID NO: 3525188 - RNA, 19 nt, Human
ccgcugccuaaguggcugc

SEQ ID NO: 3525189 - RNA, 20 nt, Human
ccgcugccuaaguggcugcu

SEQ ID NO: 3525190 - RNA, 15 nt, Human
ccgcugcuccacgcg

SEQ ID NO: 3525191 - RNA, 11 nt, Human
ccgcugcugcu

SEQ ID NO: 3525192 - RNA, 14 nt, Human
ccgcugcugcugcu

SEQ ID NO: 3525193 - RNA, 11 nt, Human
ccgcuggagga

SEQ ID NO: 3525194 - RNA, 21 nt, Human
ccgcuggaggaugugggcagc

SEQ ID NO: 3525195 - RNA, 11 nt, Human
ccgcuggaggu

SEQ ID NO: 3525196 - RNA, 19 nt, Human
ccgcuggagguggggccug

SEQ ID NO: 3525197 - RNA, 11 nt, Human
ccgcuggggcc

SEQ ID NO: 3525198 - RNA, 18 nt, Human
ccgcuguaagcuccuuug

SEQ ID NO: 3525199 - RNA, 20 nt, Human
ccgcuguaagcuccuuugug

SEQ ID NO: 3525200 - RNA, 15 nt, Human
ccgcugugagccccu

SEQ ID NO: 3525201 - RNA, 16 nt, Human
ccgcuguucacccaca

SEQ ID NO: 3525202 - RNA, 19 nt, Human
ccgcuugaaaagcuagugu

SEQ ID NO: 3525203 - RNA, 15 nt, Human
ccgcuuggagcagag

SEQ ID NO: 3525204 - RNA, 13 nt, Human
ccgcuuuggccug

SEQ ID NO: 3525205 - RNA, 19 nt, Human
ccgcuuuuguucucgcaaa

SEQ ID NO: 3525206 - RNA, 16 nt, Human
ccggaaugccacccac

SEQ ID NO: 3525207 - RNA, 20 nt, Human
ccggaaugccacccacaucu

SEQ ID NO: 3525208 - RNA, 16 nt, Human
ccggacacuccuagag

SEQ ID NO: 3525209 - RNA, 14 nt, Human
ccggaccagccugg

SEQ ID NO: 3525210 - RNA, 20 nt, Human
ccggacucaagccccggacu

SEQ ID NO: 3525211 - RNA, 17 nt, Human
ccggacuggugcccucc

SEQ ID NO: 3525212 - RNA, 15 nt, Human
ccggacuuuucugca

SEQ ID NO: 3525213 - RNA, 20 nt, Human
ccggagaggaagagacacuc

SEQ ID NO: 3525214 - RNA, 16 nt, Human
ccggagagugggggug

SEQ ID NO: 3525215 - RNA, 18 nt, Human
ccggagauguagcaaaac

SEQ ID NO: 3525216 - RNA, 20 nt, Human
ccggagauuggacggccuga

SEQ ID NO: 3525217 - RNA, 19 nt, Human
ccggagcaaacucugcugu

SEQ ID NO: 3525218 - RNA, 14 nt, Human
ccggagccuccagc

SEQ ID NO: 3525219 - RNA, 20 nt, Human
ccggagcuaacacuggcccc

SEQ ID NO: 3525220 - RNA, 18 nt, Human
ccggagcugccccucucu

SEQ ID NO: 3525221 - RNA, 23 nt, Human
ccggagcugccccucucugggcc

SEQ ID NO: 3525222 - RNA, 15 nt, Human
ccggagcuuucaaag

SEQ ID NO: 3525223 - RNA, 14 nt, Human
ccggaggaaaucug

SEQ ID NO: 3525224 - RNA, 15 nt, Human
ccggagugagaagcu

SEQ ID NO: 3525225 - RNA, 17 nt, Human
ccggaucagagcaggac

SEQ ID NO: 3525226 - RNA, 20 nt, Human
ccggaucagagcaggaccuc

SEQ ID NO: 3525227 - RNA, 21 nt, Human
ccggaucagagcaggaccucc

SEQ ID NO: 3525228 - RNA, 15 nt, Human
ccggauccugggugg

SEQ ID NO: 3525229 - RNA, 20 nt, Human
ccggcaauaaaagcccagga

SEQ ID NO: 3525230 - RNA, 13 nt, Human
ccggcagaaggga

SEQ ID NO: 3525231 - RNA, 19 nt, Human
ccggcagccccagccugcu

SEQ ID NO: 3525232 - RNA, 21 nt, Human
ccggcagccccagccugcuag

SEQ ID NO: 3525233 - RNA, 19 nt, Human
ccggcagcuucugcccccu

SEQ ID NO: 3525234 - RNA, 22 nt, Human
ccggcagcuucugcccccugca

SEQ ID NO: 3525235 - RNA, 17 nt, Human
cugcacagggcagcugg

SEQ ID NO: 3525236 - RNA, 21 nt, Human
cugcacagggcagcugggccc

SEQ ID NO: 3525237 - RNA, 14 nt, Human
cugcacagugacuu

SEQ ID NO: 3525238 - RNA, 19 nt, Human
cugcacagugacuucugag

SEQ ID NO: 3525239 - RNA, 15 nt, Human
cugcacaguugaagg

SEQ ID NO: 3525240 - RNA, 13 nt, Human
cugcacaugaaga

SEQ ID NO: 3525241 - RNA, 14 nt, Human
cugcacaugaagaa

SEQ ID NO: 3525242 - RNA, 23 nt, Human
cugcacaugaaucccacccacau

SEQ ID NO: 3525243 - RNA, 17 nt, Human
cugcacaugauuucaca

SEQ ID NO: 3525244 - RNA, 18 nt, Human
cugcacaugauuucacaa

SEQ ID NO: 3525245 - RNA, 14 nt, Human
cugcacaugucuug

SEQ ID NO: 3525246 - RNA, 16 nt, Human
cugcacaugucuugua

SEQ ID NO: 3525247 - RNA, 16 nt, Human
cugcaccaacccagcc

SEQ ID NO: 3525248 - RNA, 22 nt, Human
cugcaccagguagaacgccagg

SEQ ID NO: 3525249 - RNA, 17 nt, Human
cugcaccaguugcugcu

SEQ ID NO: 3525250 - RNA, 19 nt, Human
cugcaccaugcugcugggg

SEQ ID NO: 3525251 - RNA, 21 nt, Human
cugcaccaugcugcuggggaa

SEQ ID NO: 3525252 - RNA, 14 nt, Human
cugcaccauugcug

SEQ ID NO: 3525253 - RNA, 16 nt, Human
cugcaccauugcugcu

SEQ ID NO: 3525254 - RNA, 13 nt, Human
cugcacccaggag

SEQ ID NO: 3525255 - RNA, 12 nt, Human
cugcacccaggg

SEQ ID NO: 3525256 - RNA, 13 nt, Human
cugcacccagggg

SEQ ID NO: 3525257 - RNA, 13 nt, Human
cugcacccccucc

SEQ ID NO: 3525258 - RNA, 14 nt, Human
cugcacccccuccu

SEQ ID NO: 3525259 - RNA, 15 nt, Human
cugcaccccuuccug

SEQ ID NO: 3525260 - RNA, 20 nt, Human
cugcaccccuuccugggcac

SEQ ID NO: 3525261 - RNA, 21 nt, Human
cugcaccccuuccugggcaca

SEQ ID NO: 3525262 - RNA, 13 nt, Human
cugcacccucagg

SEQ ID NO: 3525263 - RNA, 16 nt, Human
cugcacccucaggcag

SEQ ID NO: 3525264 - RNA, 17 nt, Human
cugcacccucaggcagg

SEQ ID NO: 3525265 - RNA, 14 nt, Human
cugcacccuccacc

SEQ ID NO: 3525266 - RNA, 20 nt, Human
cugcacccuccacccugucc

SEQ ID NO: 3525267 - RNA, 20 nt, Human
cugcacccuggauuugcaua

SEQ ID NO: 3525268 - RNA, 21 nt, Human
cugcacccuggggccuggacc

SEQ ID NO: 3525269 - RNA, 18 nt, Human
cugcacccuucuuuucuc

SEQ ID NO: 3525270 - RNA, 19 nt, Human
cugcacccuucuuuucuca

SEQ ID NO: 3525271 - RNA, 22 nt, Human
cugcacccuucuuuucucaugu

SEQ ID NO: 3525272 - RNA, 16 nt, Human
cugcaccggcuggccu

SEQ ID NO: 3525273 - RNA, 17 nt, Human
cugcaccggcuggccug

SEQ ID NO: 3525274 - RNA, 20 nt, Human
cugcaccggcuggccuggcc

SEQ ID NO: 3525275 - RNA, 20 nt, Human
cugcaccgggccacagagaa

SEQ ID NO: 3525276 - RNA, 16 nt, Human
cugcaccggggccugg

SEQ ID NO: 3525277 - RNA, 19 nt, Human
cugcaccggggccugggca

SEQ ID NO: 3525278 - RNA, 14 nt, Human
cugcaccucccccc

SEQ ID NO: 3525279 - RNA, 18 nt, Human
ccuagcccaggagagaga

SEQ ID NO: 3525280 - RNA, 15 nt, Human
ccuagccgaccucag

SEQ ID NO: 3525281 - RNA, 17 nt, Human
ccuagccgguuccuguc

SEQ ID NO: 3525282 - RNA, 23 nt, Human
ccuagccgguuccugucccugcg

SEQ ID NO: 3525283 - RNA, 23 nt, Human
ccuagccugugccucugggacug

SEQ ID NO: 3525284 - RNA, 22 nt, Human
ccuagccuuagaagucacacag

SEQ ID NO: 3525285 - RNA, 19 nt, Human
ccuagccuuauccucugau

SEQ ID NO: 3525286 - RNA, 22 nt, Human
ccuagccuuauccucugaucuc

SEQ ID NO: 3525287 - RNA, 20 nt, Human
ccuagcugaauguuuuucua

SEQ ID NO: 3525288 - RNA, 18 nt, Human
ccuagcugcuacaaagaa

SEQ ID NO: 3525289 - RNA, 15 nt, Human
cugcucugcccagag

SEQ ID NO: 3525290 - RNA, 22 nt, Human
cugcucugcccuuguucccuag

SEQ ID NO: 3525291 - RNA, 11 nt, Human
cugcucugcuc

SEQ ID NO: 3525292 - RNA, 12 nt, Human
cugcucugcucg

SEQ ID NO: 3525293 - RNA, 13 nt, Human
cugcucuggaaaa

SEQ ID NO: 3525294 - RNA, 17 nt, Human
cugcucugguuguuucu

SEQ ID NO: 3525295 - RNA, 21 nt, Human
cugcucugguuguuucuguuc

SEQ ID NO: 3525296 - RNA, 18 nt, Human
cugcucuugaacuccuga

SEQ ID NO: 3525297 - RNA, 15 nt, Human
cugcucuuggcugga

SEQ ID NO: 3525298 - RNA, 14 nt, Human
cugcucuuguuucu

SEQ ID NO: 3525299 - RNA, 18 nt, Human
cugcucuuucucugccag

SEQ ID NO: 3525300 - RNA, 21 nt, Human
cugcugaaaaccaucuggccu

SEQ ID NO: 3525301 - RNA, 18 nt, Human
cugcugaagacuugcccc

SEQ ID NO: 3525302 - RNA, 15 nt, Human
cugcugaagcugccu

SEQ ID NO: 3525303 - RNA, 16 nt, Human
cugcugaauaauaaac

SEQ ID NO: 3525304 - RNA, 17 nt, Human
cugcugaauuuucacau

SEQ ID NO: 3525305 - RNA, 15 nt, Human
cugcugacagacaca

SEQ ID NO: 3525306 - RNA, 12 nt, Human
cugcugacagug

SEQ ID NO: 3525307 - RNA, 9 nt, Human
cugcugacc

SEQ ID NO: 3525308 - RNA, 21 nt, Human
cugcugaccaauugugcugcc

SEQ ID NO: 3525309 - RNA, 15 nt, Human
cugcugaccugcuga

SEQ ID NO: 3525310 - RNA, 21 nt, Human
cugcugaccugcugaccugug

SEQ ID NO: 3525311 - RNA, 21 nt, Human
cugcugacuguuuucucuuga

SEQ ID NO: 3525312 - RNA, 12 nt, Human
cugcugagaacc

SEQ ID NO: 3525313 - RNA, 15 nt, Human
cugcugagaaccugg

SEQ ID NO: 3525314 - RNA, 15 nt, Human
cugcugagagaccca

SEQ ID NO: 3525315 - RNA, 21 nt, Human
cugcugagagacccaaggagg

SEQ ID NO: 3525316 - RNA, 22 nt, Human
cugcugagagacccaaggagga

SEQ ID NO: 3525317 - RNA, 18 nt, Human
cugcugagauccuggacu

SEQ ID NO: 3525318 - RNA, 19 nt, Human
cugcugagauccuggacug

SEQ ID NO: 3525319 - RNA, 14 nt, Human
cugcugagccgcag

SEQ ID NO: 3525320 - RNA, 22 nt, Human
cugcugagccucacagcaguga

SEQ ID NO: 3525321 - RNA, 14 nt, Human
cugcugagcucuga

SEQ ID NO: 3525322 - RNA, 17 nt, Human
cugcugagcucugagag

SEQ ID NO: 3525323 - RNA, 18 nt, Human
cugcugagcucugagagg

SEQ ID NO: 3525324 - RNA, 19 nt, Human
cugcugagcucugagaggc

SEQ ID NO: 3525325 - RNA, 18 nt, Human
cugcugagggaccagcca

SEQ ID NO: 3525326 - RNA, 11 nt, Human
cugcugagggu

SEQ ID NO: 3525327 - RNA, 12 nt, Human
cugcugaggguc

SEQ ID NO: 3525328 - RNA, 22 nt, Human
cugcugagucccaggcugagcc

SEQ ID NO: 3525329 - RNA, 22 nt, Human
cugcugaguccgaccuggccug

SEQ ID NO: 3525330 - RNA, 22 nt, Human
cugcugagucuguucugguaau

SEQ ID NO: 3525331 - RNA, 17 nt, Human
cugcugauauuuucucu

SEQ ID NO: 3525332 - RNA, 18 nt, Human
cugcugauauuuucucua

SEQ ID NO: 3525333 - RNA, 16 nt, Human
cugcugaucgccuucc

SEQ ID NO: 3525334 - RNA, 22 nt, Human
cugcugaugacccccccagcuu

SEQ ID NO: 3525335 - RNA, 18 nt, Human
cugcugauguggcaacug

SEQ ID NO: 3525336 - RNA, 21 nt, Human
cugcugcaaggccuuucugug

SEQ ID NO: 3525337 - RNA, 23 nt, Human
cugcugcaaggccuuucugugug

SEQ ID NO: 3525338 - RNA, 15 nt, Human
cugcugcaccaaccc

SEQ ID NO: 3525339 - RNA, 17 nt, Human
cugcugcaccaacccag

SEQ ID NO: 3525340 - RNA, 20 nt, Human
cugcugcaccaacccagccg

SEQ ID NO: 3525341 - RNA, 14 nt, Human
cugcugcagagcag

SEQ ID NO: 3525342 - RNA, 15 nt, Human
cugcugcagagcagu

SEQ ID NO: 3525343 - RNA, 17 nt, Human
cugcugcagaggggcag

SEQ ID NO: 3525344 - RNA, 21 nt, Human
cugcugcagaggggcaggccc

SEQ ID NO: 3525345 - RNA, 16 nt, Human
cugcugcaggggcucu

SEQ ID NO: 3525346 - RNA, 19 nt, Human
cugcugcaggggcucugga

SEQ ID NO: 3525347 - RNA, 21 nt, Human
cugcugcaggggcucuggaga

SEQ ID NO: 3525348 - RNA, 10 nt, Human
cugcugcagu

SEQ ID NO: 3525349 - RNA, 15 nt, Human
cugcugcaguugcca

SEQ ID NO: 3525350 - RNA, 17 nt, Human
cugcugcaugcccucuc

SEQ ID NO: 3525351 - RNA, 12 nt, Human
cugcugccacug

SEQ ID NO: 3525352 - RNA, 14 nt, Human
cugcugccacugag

SEQ ID NO: 3525353 - RNA, 15 nt, Human
cugcugccacugagg

SEQ ID NO: 3525354 - RNA, 11 nt, Human
cugcugccagu

SEQ ID NO: 3525355 - RNA, 22 nt, Human
cugcugcccagccuccaagcuc

SEQ ID NO: 3525356 - RNA, 17 nt, Human
cugcugcccauguuuca

SEQ ID NO: 3525357 - RNA, 15 nt, Human
cugcugcccccaccc

SEQ ID NO: 3525358 - RNA, 21 nt, Human
cugcugcccccaccccgggga

SEQ ID NO: 3525359 - RNA, 16 nt, Human
cugcugccccugcaca

SEQ ID NO: 3525360 - RNA, 23 nt, Human
cugcugccccugcacagcaggcu

SEQ ID NO: 3525361 - RNA, 23 nt, Human
cugcugcccuaguuuucuuuccu

SEQ ID NO: 3525362 - RNA, 14 nt, Human
cugcugcccuccau

SEQ ID NO: 3525363 - RNA, 23 nt, Human
cugcugcccuuaggccacauggg

SEQ ID NO: 3525364 - RNA, 16 nt, Human
cugcugccucaggaau

SEQ ID NO: 3525365 - RNA, 19 nt, Human
cugcugccuccccaacccu

SEQ ID NO: 3525366 - RNA, 13 nt, Human
cugcugccucuuu

SEQ ID NO: 3525367 - RNA, 20 nt, Human
cugcugccucuuucccuagg

SEQ ID NO: 3525368 - RNA, 22 nt, Human
cugcugccugcccgcacagcag

SEQ ID NO: 3525369 - RNA, 13 nt, Human
cugcugccugccu

SEQ ID NO: 3525370 - RNA, 23 nt, Human
cugcugccugcuuuuuauggccu

SEQ ID NO: 3525371 - RNA, 16 nt, Human
cugcugcgcccugggc

SEQ ID NO: 3525372 - RNA, 17 nt, Human
cugcugcgcccugggcu

SEQ ID NO: 3525373 - RNA, 17 nt, Human
cugcugcgcccuuaccu

SEQ ID NO: 3525374 - RNA, 20 nt, Human
cugcugcgcccuuaccuucc

SEQ ID NO: 3525375 - RNA, 14 nt, Human
cugcugcucccuca

SEQ ID NO: 3525376 - RNA, 16 nt, Human
cugcugcucccucaga

SEQ ID NO: 3525377 - RNA, 23 nt, Human
cugcugcucccucagacuggggc

SEQ ID NO: 3525378 - RNA, 15 nt, Human
cugcugcucuuggcu

SEQ ID NO: 3525379 - RNA, 21 nt, Human
cugcugcucuuggcuggaccc

SEQ ID NO: 3525380 - RNA, 15 nt, Human
cugcugcugcgcccu

SEQ ID NO: 3525381 - RNA, 12 nt, Human
cugcugcuggcu

SEQ ID NO: 3525382 - RNA, 17 nt, Human
cugcugcugggcucagu

SEQ ID NO: 3525383 - RNA, 17 nt, Human
cugcugcugucugggug

SEQ ID NO: 3525384 - RNA, 14 nt, Human
cugcugcuguggcg

SEQ ID NO: 3525385 - RNA, 16 nt, Human
cugcugcuucuccaaa

SEQ ID NO: 3525386 - RNA, 20 nt, Human
cugcugcuuuuugagguggc

SEQ ID NO: 3525387 - RNA, 14 nt, Human
cugcuggaagccca

SEQ ID NO: 3525388 - RNA, 22 nt, Human
cugcuggacaguaucacugucu

SEQ ID NO: 3525389 - RNA, 11 nt, Human
cugcuggagga

SEQ ID NO: 3525390 - RNA, 16 nt, Human
cugcuggaggccucag

SEQ ID NO: 3525391 - RNA, 21 nt, Human
cugcuggaucacagcugcuuu

SEQ ID NO: 3525392 - RNA, 16 nt, Human
cugcuggcacccaccg

SEQ ID NO: 3525393 - RNA, 15 nt, Human
cugcuggcccagcca

SEQ ID NO: 3525394 - RNA, 14 nt, Human
cugcuggccccuca

SEQ ID NO: 3525395 - RNA, 15 nt, Human
cugcuggccccucac

SEQ ID NO: 3525396 - RNA, 21 nt, Human
cugcuggccgggcacagcugu

SEQ ID NO: 3525397 - RNA, 15 nt, Human
cugcuggccucugcg

SEQ ID NO: 3525398 - RNA, 20 nt, Human
cugcuggccuggccggcaac

SEQ ID NO: 3525399 - RNA, 20 nt, Human
cugcuggcgccucugcaagg

SEQ ID NO: 3525400 - RNA, 19 nt, Human
cugcuggcucuucugccca

SEQ ID NO: 3525401 - RNA, 12 nt, Human
cugcuggcugcc

SEQ ID NO: 3525402 - RNA, 16 nt, Human
cugcuggcuugcagug

SEQ ID NO: 3525403 - RNA, 17 nt, Human
cugcugggacuggccag

SEQ ID NO: 3525404 - RNA, 19 nt, Human
cugcugggauggugggcuu

SEQ ID NO: 3525405 - RNA, 16 nt, Human
cugcugggcucuccac

SEQ ID NO: 3525406 - RNA, 14 nt, Human
cugcuggggaagac

SEQ ID NO: 3525407 - RNA, 20 nt, Human
cugcuggggaagacaguggc

SEQ ID NO: 3525408 - RNA, 13 nt, Human
cugcuggggaucc

SEQ ID NO: 3525409 - RNA, 14 nt, Human
cugcuggggauccc

SEQ ID NO: 3525410 - RNA, 17 nt, Human
cugcuggggauccccgc

SEQ ID NO: 3525411 - RNA, 23 nt, Human
cugcuggggccucagacgagacc

SEQ ID NO: 3525412 - RNA, 15 nt, Human
cugcuggggccuggg

SEQ ID NO: 3525413 - RNA, 14 nt, Human
cugcuggguggccc

SEQ ID NO: 3525414 - RNA, 16 nt, Human
cugcuggguggcccau

SEQ ID NO: 3525415 - RNA, 15 nt, Human
cugcuggguguggcg

SEQ ID NO: 3525416 - RNA, 18 nt, Human
cugcuggucacagccucc

SEQ ID NO: 3525417 - RNA, 19 nt, Human
cugcuggucacuucuucug

SEQ ID NO: 3525418 - RNA, 21 nt, Human
cugcugguuaacuuguuuggc

SEQ ID NO: 3525419 - RNA, 15 nt, Human
cugcuguaagaaauc

SEQ ID NO: 3525420 - RNA, 14 nt, Human
cugcuguacugaag

SEQ ID NO: 3525421 - RNA, 15 nt, Human
cugcuguacugaagu

SEQ ID NO: 3525422 - RNA, 18 nt, Human
cugcugucaccucuccca

SEQ ID NO: 3525423 - RNA, 21 nt, Human
cugcugucaccucucccacgg

SEQ ID NO: 3525424 - RNA, 20 nt, Human
cuggaacacuagacaagcca

SEQ ID NO: 3525425 - RNA, 21 nt, Human
cuggaacagauucacacuguc

SEQ ID NO: 3525426 - RNA, 18 nt, Human
cuggaacauccuuugcag

SEQ ID NO: 3525427 - RNA, 23 nt, Human
cuggaacauccuuugcagggcag

SEQ ID NO: 3525428 - RNA, 17 nt, Human
cuggaaccacauugaag

SEQ ID NO: 3525429 - RNA, 20 nt, Human
cuggaaccacauugaagaau

SEQ ID NO: 3525430 - RNA, 16 nt, Human
cuggaaccaucagaaa

SEQ ID NO: 3525431 - RNA, 18 nt, Human
cuggaacccagacucaga

SEQ ID NO: 3525432 - RNA, 19 nt, Human
cuggaacccagacucagac

SEQ ID NO: 3525433 - RNA, 20 nt, Human
cuggaaccucagccuggcca

SEQ ID NO: 3525434 - RNA, 21 nt, Human
cuggaaccugcaaaaaauacu

SEQ ID NO: 3525435 - RNA, 15 nt, Human
cuggaaccuugcugu

SEQ ID NO: 3525436 - RNA, 19 nt, Human
cuggaacuccuaaaccuuu

SEQ ID NO: 3525437 - RNA, 22 nt, Human
cuggaacucuaucugggccugg

SEQ ID NO: 3525438 - RNA, 14 nt, Human
cuggaacuugggga

SEQ ID NO: 3525439 - RNA, 18 nt, Human
cuggaagaaaaaaaccac

SEQ ID NO: 3525440 - RNA, 18 nt, Human
cuggaagaacaggccucu

SEQ ID NO: 3525441 - RNA, 21 nt, Human
cuggaagacagagaccuccug

SEQ ID NO: 3525442 - RNA, 22 nt, Human
cuggaagagcccagucuguuga

SEQ ID NO: 3525443 - RNA, 17 nt, Human
cuggaagagcuaggcag

SEQ ID NO: 3525444 - RNA, 19 nt, Human
cuggaagauagcugugacu

SEQ ID NO: 3525445 - RNA, 14 nt, Human
cuggaagaugggga

SEQ ID NO: 3525446 - RNA, 23 nt, Human
cuggaagauggggaccagcagcc

SEQ ID NO: 3525447 - RNA, 14 nt, Human
cuggaagcacagcu

SEQ ID NO: 3525448 - RNA, 18 nt, Human
cuggaagcagugcccagg

SEQ ID NO: 3525449 - RNA, 23 nt, Human
cuggaagcauguaggagaaucca

SEQ ID NO: 3525450 - RNA, 16 nt, Human
cuggaagccagcuuuc

SEQ ID NO: 3525451 - RNA, 17 nt, Human
cuggaagcccagccccu

SEQ ID NO: 3525452 - RNA, 20 nt, Human
cuggaagccccugggcccag

SEQ ID NO: 3525453 - RNA, 17 nt, Human
cuggaagcuaauuugca

SEQ ID NO: 3525454 - RNA, 13 nt, Human
ccucaaccucauc

SEQ ID NO: 3525455 - RNA, 14 nt, Human
ccucaaccucaucc

SEQ ID NO: 3525456 - RNA, 16 nt, Human
ccucaaccuccugggc

SEQ ID NO: 3525457 - RNA, 20 nt, Human
ccucaaccuccuguggaacc

SEQ ID NO: 3525458 - RNA, 12 nt, Human
ccucaaccucuu

SEQ ID NO: 3525459 - RNA, 17 nt, Human
ccucaaccucuucuggc

SEQ ID NO: 3525460 - RNA, 14 nt, Human
ccucaaccuguaaa

SEQ ID NO: 3525461 - RNA, 14 nt, Human
ccucaaccugugau

SEQ ID NO: 3525462 - RNA, 17 nt, Human
ccucaacuccucccaua

SEQ ID NO: 3525463 - RNA, 15 nt, Human
ccucaacucuccucc

SEQ ID NO: 3525464 - RNA, 19 nt, Human
ccucaacucuccuccagag

SEQ ID NO: 3525465 - RNA, 14 nt, Human
ccucaacugccuac

SEQ ID NO: 3525466 - RNA, 15 nt, Human
ccucaacugccuacu

SEQ ID NO: 3525467 - RNA, 16 nt, Human
ccucaagaucauucag

SEQ ID NO: 3525468 - RNA, 20 nt, Human
ccucaagccaauccccuccu

SEQ ID NO: 3525469 - RNA, 15 nt, Human
ccucaagcugcaucu

SEQ ID NO: 3525470 - RNA, 17 nt, Human
ccucaaggccucccaca

SEQ ID NO: 3525471 - RNA, 19 nt, Human
ccucaagggggacugucuu

SEQ ID NO: 3525472 - RNA, 14 nt, Human
ccucaagucuuucu

SEQ ID NO: 3525473 - RNA, 15 nt, Human
ccucaagucuuucuc

SEQ ID NO: 3525474 - RNA, 19 nt, Human
ccucaagucuuucucuuuc

SEQ ID NO: 3525475 - RNA, 21 nt, Human
ccucaagucuuucucuuuccc

SEQ ID NO: 3525476 - RNA, 15 nt, Human
ccucaauaagccuug

SEQ ID NO: 3525477 - RNA, 18 nt, Human
ccucaauccagcuauguu

SEQ ID NO: 3525478 - RNA, 20 nt, Human
ccucaaugugaaucagaccc

SEQ ID NO: 3525479 - RNA, 21 nt, Human
ccucaaugugaaucagacccu

SEQ ID NO: 3525480 - RNA, 16 nt, Human
ccucaaugugaccagg

SEQ ID NO: 3525481 - RNA, 14 nt, Human
ccucaauugugaaa

SEQ ID NO: 3525482 - RNA, 16 nt, Human
ccucaauuucugaaca

SEQ ID NO: 3525483 - RNA, 16 nt, Human
ccucaauuuucacugu

SEQ ID NO: 3525484 - RNA, 19 nt, Human
ccucaauuuuugucucaga

SEQ ID NO: 3525485 - RNA, 21 nt, Human
ccucaauuuuugucucagaag

SEQ ID NO: 3525486 - RNA, 17 nt, Human
ccucacacacccugagg

SEQ ID NO: 3525487 - RNA, 14 nt, Human
ccucacagccucug

SEQ ID NO: 3525488 - RNA, 19 nt, Human
ccucacagccucugacccc

SEQ ID NO: 3525489 - RNA, 20 nt, Human
ccucacagccucugaccccu

SEQ ID NO: 3525490 - RNA, 23 nt, Human
ccucacagucccacugugcaggu

SEQ ID NO: 3525491 - RNA, 17 nt, Human
ccucacaguccuuacca

SEQ ID NO: 3525492 - RNA, 22 nt, Human
ccucaccaggggcaggcacagc

SEQ ID NO: 3525493 - RNA, 23 nt, Human
ccucaccaggggcaggcacagca

SEQ ID NO: 3525494 - RNA, 12 nt, Human
ccucaccauucc

SEQ ID NO: 3525495 - RNA, 18 nt, Human
ccucaccccugcccuggg

SEQ ID NO: 3525496 - RNA, 15 nt, Human
ccucaccccugguuc

SEQ ID NO: 3525497 - RNA, 23 nt, Human
ccucaccccugguucucaucuuu

SEQ ID NO: 3525498 - RNA, 20 nt, Human
ccucaccccuguccucacug

SEQ ID NO: 3525499 - RNA, 19 nt, Human
ccucacccgaggcugccca

SEQ ID NO: 3525500 - RNA, 23 nt, Human
ccucacccggugaccucuagccc

SEQ ID NO: 3525501 - RNA, 18 nt, Human
ccucacccugagccccuu

SEQ ID NO: 3525502 - RNA, 14 nt, Human
ccucacccugccuu

SEQ ID NO: 3525503 - RNA, 14 nt, Human
ccucaccgcuuccc

SEQ ID NO: 3525504 - RNA, 12 nt, Human
ccucaccucaug

SEQ ID NO: 3525505 - RNA, 17 nt, Human
ccucaccucaugcccac

SEQ ID NO: 3525506 - RNA, 13 nt, Human
ccucaccucugga

SEQ ID NO: 3525507 - RNA, 20 nt, Human
ccucaccucuggacuggcua

SEQ ID NO: 3525508 - RNA, 14 nt, Human
ccucaccugggcac

SEQ ID NO: 3525509 - RNA, 19 nt, Human
ccucaccugggcaccuggg

SEQ ID NO: 3525510 - RNA, 15 nt, Human
ccucaccuucugagu

SEQ ID NO: 3525511 - RNA, 17 nt, Human
ccucacgcaccucccau

SEQ ID NO: 3525512 - RNA, 13 nt, Human
ccucacgcugggu

SEQ ID NO: 3525513 - RNA, 20 nt, Human
ccucacucccuucccauaag

SEQ ID NO: 3525514 - RNA, 20 nt, Human
ccucacucccuucuaccugc

SEQ ID NO: 3525515 - RNA, 22 nt, Human
ccucacucccuucuaccugcca

SEQ ID NO: 3525516 - RNA, 13 nt, Human
ccucacuccuguu

SEQ ID NO: 3525517 - RNA, 13 nt, Human
ccucacucugcca

SEQ ID NO: 3525518 - RNA, 14 nt, Human
ccucacucugccag

SEQ ID NO: 3525519 - RNA, 16 nt, Human
ccucacucugccaggg

SEQ ID NO: 3525520 - RNA, 22 nt, Human
ccucacucugccagggcagugc

SEQ ID NO: 3525521 - RNA, 20 nt, Human
ccucacucugcuaccuugcc

SEQ ID NO: 3525522 - RNA, 22 nt, Human
ccucacucugcuaccuugcccc

SEQ ID NO: 3525523 - RNA, 17 nt, Human
ccucacucuugccaacc

SEQ ID NO: 3525524 - RNA, 23 nt, Human
ccucacucuuuauagugcacaaa

SEQ ID NO: 3525525 - RNA, 20 nt, Human
ccucacugaaaacaucugga

SEQ ID NO: 3525526 - RNA, 16 nt, Human
ccucacugcccgcaca

SEQ ID NO: 3525527 - RNA, 20 nt, Human
ccucacugcccgcacacccu

SEQ ID NO: 3525528 - RNA, 21 nt, Human
ccucacugcccgcacacccuc

SEQ ID NO: 3525529 - RNA, 16 nt, Human
ccucacugcucccuga

SEQ ID NO: 3525530 - RNA, 18 nt, Human
ccucacuggccaucccuc

SEQ ID NO: 3525531 - RNA, 16 nt, Human
ccucacuggcucuccu

SEQ ID NO: 3525532 - RNA, 19 nt, Human
ccucacuggcucuccuggc

SEQ ID NO: 3525533 - RNA, 19 nt, Human
ccucacugggguccugggg

SEQ ID NO: 3525534 - RNA, 23 nt, Human
ccucacugggguccuggggccuc

SEQ ID NO: 3525535 - RNA, 13 nt, Human
ccucacugggugg

SEQ ID NO: 3525536 - RNA, 22 nt, Human
ccucacugugguaaaugccaca

SEQ ID NO: 3525537 - RNA, 21 nt, Human
ccucacuuccauacagcucua

SEQ ID NO: 3525538 - RNA, 19 nt, Human
ccucacuuggucugccagg

SEQ ID NO: 3525539 - RNA, 20 nt, Human
ccucagaaaacaaggaugaa

SEQ ID NO: 3525540 - RNA, 16 nt, Human
ccucagaaaaugagua

SEQ ID NO: 3525541 - RNA, 21 nt, Human
ccucagaaacacuggggcugg

SEQ ID NO: 3525542 - RNA, 21 nt, Human
ccucagaacaaagugagacag

SEQ ID NO: 3525543 - RNA, 23 nt, Human
ccucagacgagacccaagggcag

SEQ ID NO: 3525544 - RNA, 16 nt, Human
ccucagacugcaccca

SEQ ID NO: 3525545 - RNA, 17 nt, Human
ccucagacugcacccag

SEQ ID NO: 3525546 - RNA, 21 nt, Human
ccucagacugcacccaggagg

SEQ ID NO: 3525547 - RNA, 16 nt, Human
ccucagagccaccccu

SEQ ID NO: 3525548 - RNA, 19 nt, Human
ccucagaguccaggcccca

SEQ ID NO: 3525549 - RNA, 21 nt, Human
ccucagagugcaagccccugc

SEQ ID NO: 3525550 - RNA, 17 nt, Human
ccucagauggcagcuuu

SEQ ID NO: 3525551 - RNA, 17 nt, Human
ccucagaugucccuuga

SEQ ID NO: 3525552 - RNA, 23 nt, Human
ccucagaugucccuugaugcaca

SEQ ID NO: 3525553 - RNA, 22 nt, Human
ccucagcaaccuguaagacuga

SEQ ID NO: 3525554 - RNA, 14 nt, Human
ccucagcaagcccu

SEQ ID NO: 3525555 - RNA, 19 nt, Human
ccucagcaccccugucucu

SEQ ID NO: 3525556 - RNA, 16 nt, Human
ccucagcaccccuucc

SEQ ID NO: 3525557 - RNA, 17 nt, Human
ccucagcaccccuucca

SEQ ID NO: 3525558 - RNA, 20 nt, Human
ccucagcaccccuuccaugu

SEQ ID NO: 3525559 - RNA, 16 nt, Human
ccucagcauccuggca

SEQ ID NO: 3525560 - RNA, 17 nt, Human
ccucagcauccuggcac

SEQ ID NO: 3525561 - RNA, 11 nt, Human
ccucagccaga

SEQ ID NO: 3525562 - RNA, 16 nt, Human
ccucagccagagaagc

SEQ ID NO: 3525563 - RNA, 12 nt, Human
ccucagccagcc

SEQ ID NO: 3525564 - RNA, 21 nt, Human
ccucagccaugaggaguugcu

SEQ ID NO: 3525565 - RNA, 16 nt, Human
ccucagccauucacug

SEQ ID NO: 3525566 - RNA, 19 nt, Human
ccucagccccucuugcccc

SEQ ID NO: 3525567 - RNA, 22 nt, Human
cuggccucacccaccccugcac

SEQ ID NO: 3525568 - RNA, 13 nt, Human
cuggccucagacu

SEQ ID NO: 3525569 - RNA, 21 nt, Human
cuggccucagacucauacaga

SEQ ID NO: 3525570 - RNA, 13 nt, Human
cuggccucccaca

SEQ ID NO: 3525571 - RNA, 17 nt, Human
cuggccucccacagacu

SEQ ID NO: 3525572 - RNA, 15 nt, Human
cuggccucccacccg

SEQ ID NO: 3525573 - RNA, 23 nt, Human
cuggccucccacccgaugcugcu

SEQ ID NO: 3525574 - RNA, 14 nt, Human
cuggccucccccac

SEQ ID NO: 3525575 - RNA, 17 nt, Human
cuggccucccccacuuu

SEQ ID NO: 3525576 - RNA, 21 nt, Human
cuggccuccggcgucagccuc

SEQ ID NO: 3525577 - RNA, 12 nt, Human
cuggccucgccu

SEQ ID NO: 3525578 - RNA, 19 nt, Human
cuggccucgccuggccuga

SEQ ID NO: 3525579 - RNA, 13 nt, Human
cuggccucucacu

SEQ ID NO: 3525580 - RNA, 20 nt, Human
cuggccucucacugccuccc

SEQ ID NO: 3525581 - RNA, 16 nt, Human
cuggccucucuagcac

SEQ ID NO: 3525582 - RNA, 17 nt, Human
cuggccucucuagcaca

SEQ ID NO: 3525583 - RNA, 12 nt, Human
cuggccucugca

SEQ ID NO: 3525584 - RNA, 14 nt, Human
cuggccucugcacu

SEQ ID NO: 3525585 - RNA, 21 nt, Human
cuggccucugcacuccccugc

SEQ ID NO: 3525586 - RNA, 14 nt, Human
cuggccucugucau

SEQ ID NO: 3525587 - RNA, 15 nt, Human
cuggccucugugccu

SEQ ID NO: 3525588 - RNA, 21 nt, Human
cuggccugaaccacaggagag

SEQ ID NO: 3525589 - RNA, 23 nt, Human
cuggccugagagucagcucucug

SEQ ID NO: 3525590 - RNA, 16 nt, Human
cuggccugagcuggga

SEQ ID NO: 3525591 - RNA, 16 nt, Human
cuggccugaggagcag

SEQ ID NO: 3525592 - RNA, 20 nt, Human
cuggccugaggucucgcuga

SEQ ID NO: 3525593 - RNA, 24 nt, Human
cuggccugaggucucgcugaugcu

SEQ ID NO: 3525594 - RNA, 20 nt, Human
cuggccugcugggcucucca

SEQ ID NO: 3525595 - RNA, 22 nt, Human
cuggccuggacuguuuucucuc

SEQ ID NO: 3525596 - RNA, 12 nt, Human
cuggccuggauc

SEQ ID NO: 3525597 - RNA, 14 nt, Human
cuggccuggaucuc

SEQ ID NO: 3525598 - RNA, 13 nt, Human
cuggccuggcaca

SEQ ID NO: 3525599 - RNA, 14 nt, Human
cuggccuggcacac

SEQ ID NO: 3525600 - RNA, 18 nt, Human
cuggccuggcacacauca

SEQ ID NO: 3525601 - RNA, 16 nt, Human
cuggccuggccccuca

SEQ ID NO: 3525602 - RNA, 13 nt, Human
cuggccuggcccu

SEQ ID NO: 3525603 - RNA, 14 nt, Human
cuggccuggccugg

SEQ ID NO: 3525604 - RNA, 16 nt, Human
cuggccuggccuggcc

SEQ ID NO: 3525605 - RNA, 13 nt, Human
cuggccuggcuuc

SEQ ID NO: 3525606 - RNA, 13 nt, Human
cuggccugucugu

SEQ ID NO: 3525607 - RNA, 12 nt, Human
cuggccuguucu

SEQ ID NO: 3525608 - RNA, 16 nt, Human
cuggccuucggccucc

SEQ ID NO: 3525609 - RNA, 21 nt, Human
cuggccuucggccuccauccu

SEQ ID NO: 3525610 - RNA, 22 nt, Human
cuggccuucggccuccauccug

SEQ ID NO: 3525611 - RNA, 23 nt, Human
cuggccuucggccuccauccuga

SEQ ID NO: 3525612 - RNA, 19 nt, Human
cuggccuugaaaccaccuu

SEQ ID NO: 3525613 - RNA, 18 nt, Human
cuggccuugccacacucu

SEQ ID NO: 3525614 - RNA, 20 nt, Human
cuggccuugggauccaggcc

SEQ ID NO: 3525615 - RNA, 19 nt, Human
cuggccuuguccucagcca

SEQ ID NO: 3525616 - RNA, 21 nt, Human
cuggccuuguccucagccagu

SEQ ID NO: 3525617 - RNA, 14 nt, Human
cuggccuuucauau

SEQ ID NO: 3525618 - RNA, 14 nt, Human
cuggccuuuguaag

SEQ ID NO: 3525619 - RNA, 13 nt, Human
cuggccuuuuccu

SEQ ID NO: 3525620 - RNA, 19 nt, Human
cuggccuuuuucauuuauc

SEQ ID NO: 3525621 - RNA, 19 nt, Human
cuggcgacaguuuuccuuc

SEQ ID NO: 3525622 - RNA, 23 nt, Human
cuggcgagagucuggcccuagac

SEQ ID NO: 3525623 - RNA, 23 nt, Human
cuggcgcagaacgaaccuuggcc

SEQ ID NO: 3525624 - RNA, 16 nt, Human
cuggcgcagccaaggc

SEQ ID NO: 3525625 - RNA, 12 nt, Human
cuggcgccucug

SEQ ID NO: 3525626 - RNA, 13 nt, Human
cuggcgccucugc

SEQ ID NO: 3525627 - RNA, 12 nt, Human
cuggcggcccca

SEQ ID NO: 3525628 - RNA, 16 nt, Human
cuggcggcuacucagc

SEQ ID NO: 3525629 - RNA, 20 nt, Human
cuggcggcuacucagcagcc

SEQ ID NO: 3525630 - RNA, 19 nt, Human
cuggcggcuggggucccag

SEQ ID NO: 3525631 - RNA, 16 nt, Human
cuggcgggaugggcca

SEQ ID NO: 3525632 - RNA, 21 nt, Human
cuggcguagaaguuuuuguac

SEQ ID NO: 3525633 - RNA, 13 nt, Human
cuggcgugugggu

SEQ ID NO: 3525634 - RNA, 13 nt, Human
cuggcuaaagcuc

SEQ ID NO: 3525635 - RNA, 20 nt, Human
cuggcuagaguccucacucc

SEQ ID NO: 3525636 - RNA, 16 nt, Human
cuggcuaugcauuuga

SEQ ID NO: 3525637 - RNA, 22 nt, Human
cuggcuaugcauuugaaaauuu

SEQ ID NO: 3525638 - RNA, 17 nt, Human
cuggcucacccaguccu

SEQ ID NO: 3525639 - RNA, 21 nt, Human
cuggcucauauuccugcagcc

SEQ ID NO: 3525640 - RNA, 13 nt, Human
cuggcucaucucu

SEQ ID NO: 3525641 - RNA, 18 nt, Human
cuggcuccagcuggccgg

SEQ ID NO: 3525642 - RNA, 20 nt, Human
cuggcucccacaggcagcuu

SEQ ID NO: 3525643 - RNA, 22 nt, Human
cuggcucccacaggcccuuccu

SEQ ID NO: 3525644 - RNA, 14 nt, Human
cuggcucccaggac

SEQ ID NO: 3525645 - RNA, 15 nt, Human
cuggcucccaggaca

SEQ ID NO: 3525646 - RNA, 15 nt, Human
cuggcuccccugcag

SEQ ID NO: 3525647 - RNA, 21 nt, Human
cuggcuccccugcagcccugg

SEQ ID NO: 3525648 - RNA, 16 nt, Human
cuggcuccccuggggu

SEQ ID NO: 3525649 - RNA, 12 nt, Human
cuggcuccucaa

SEQ ID NO: 3525650 - RNA, 24 nt, Human
cuggcuccucuguggugucugccu

SEQ ID NO: 3525651 - RNA, 13 nt, Human
cuggcuccugauc

SEQ ID NO: 3525652 - RNA, 22 nt, Human
cuggcucuaauucacagugcuc

SEQ ID NO: 3525653 - RNA, 14 nt, Human
cuggcucuacacau

SEQ ID NO: 3525654 - RNA, 17 nt, Human
cuggcucucaugggguc

SEQ ID NO: 3525655 - RNA, 12 nt, Human
cuggcucuccaa

SEQ ID NO: 3525656 - RNA, 17 nt, Human
cuggcucuccaagugcc

SEQ ID NO: 3525657 - RNA, 20 nt, Human
cuggcucuccaagugccaga

SEQ ID NO: 3525658 - RNA, 22 nt, Human
cuggcucuccaagugccagagg

SEQ ID NO: 3525659 - RNA, 15 nt, Human
cuggcucuccuggcc

SEQ ID NO: 3525660 - RNA, 14 nt, Human
cuggacaggcaugu

SEQ ID NO: 3525661 - RNA, 23 nt, Human
cuggacaggcauguucucugagg

SEQ ID NO: 3525662 - RNA, 19 nt, Human
cuggacaggcucugcuucu

SEQ ID NO: 3525663 - RNA, 19 nt, Human
cuggacaguaucacugucu

SEQ ID NO: 3525664 - RNA, 16 nt, Human
cuggacaguaucccac

SEQ ID NO: 3525665 - RNA, 17 nt, Human
cuggacauuuuuucagu

SEQ ID NO: 3525666 - RNA, 22 nt, Human
cuggaccaacccuguuuccuga

SEQ ID NO: 3525667 - RNA, 14 nt, Human
cuggaccacugggc

SEQ ID NO: 3525668 - RNA, 12 nt, Human
cuggaccagccu

SEQ ID NO: 3525669 - RNA, 14 nt, Human
cuggaccagccucu

SEQ ID NO: 3525670 - RNA, 18 nt, Human
cuggaccagccucuccac

SEQ ID NO: 3525671 - RNA, 12 nt, Human
cuggacccagcc

SEQ ID NO: 3525672 - RNA, 14 nt, Human
cuggacccagccag

SEQ ID NO: 3525673 - RNA, 18 nt, Human
cuggacccagccaggccc

SEQ ID NO: 3525674 - RNA, 21 nt, Human
cuggacccagccaggcccagc

SEQ ID NO: 3525675 - RNA, 22 nt, Human
cuggacccagccaggcccagcc

SEQ ID NO: 3525676 - RNA, 14 nt, Human
cuggaccccagccu

SEQ ID NO: 3525677 - RNA, 15 nt, Human
cuggaccccagccuc

SEQ ID NO: 3525678 - RNA, 16 nt, Human
cuggaccccagccuca

SEQ ID NO: 3525679 - RNA, 17 nt, Human
cuggaccccagccucaa

SEQ ID NO: 3525680 - RNA, 20 nt, Human
cuggaccccaucugugaaua

SEQ ID NO: 3525681 - RNA, 22 nt, Human
cuggaccccaucugugaauaag

SEQ ID NO: 3525682 - RNA, 19 nt, Human
cuggaccccccuuucacag

SEQ ID NO: 3525683 - RNA, 15 nt, Human
cuggaccccugcauu

SEQ ID NO: 3525684 - RNA, 16 nt, Human
cuggacccuguugcua

SEQ ID NO: 3525685 - RNA, 18 nt, Human
cuggacccuguugcuaag

SEQ ID NO: 3525686 - RNA, 17 nt, Human
cuggacccuuauaaaau

SEQ ID NO: 3525687 - RNA, 15 nt, Human
cuggaccuauguccu

SEQ ID NO: 3525688 - RNA, 20 nt, Human
cuggaccuauguccuaagga

SEQ ID NO: 3525689 - RNA, 13 nt, Human
cuggaccucugac

SEQ ID NO: 3525690 - RNA, 15 nt, Human
cuggaccucugacag

SEQ ID NO: 3525691 - RNA, 17 nt, Human
cuggaccugcccccgca

SEQ ID NO: 3525692 - RNA, 15 nt, Human
cuggaccugccuccu

SEQ ID NO: 3525693 - RNA, 17 nt, Human
cuggaccugccuccugc

SEQ ID NO: 3525694 - RNA, 15 nt, Human
cuggaccugguggcu

SEQ ID NO: 3525695 - RNA, 20 nt, Human
cuggacggcaggcucacugc

SEQ ID NO: 3525696 - RNA, 20 nt, Human
cuggacggcauuccugcuua

SEQ ID NO: 3525697 - RNA, 13 nt, Human
cuggacucaggau

SEQ ID NO: 3525698 - RNA, 22 nt, Human
cuggacucaggaugcccagggc

SEQ ID NO: 3525699 - RNA, 15 nt, Human
cuggacuccagaucu

SEQ ID NO: 3525700 - RNA, 16 nt, Human
cuggacuccagaucug

SEQ ID NO: 3525701 - RNA, 15 nt, Human
cuggacucccucaag

SEQ ID NO: 3525702 - RNA, 15 nt, Human
cuggacuccggcccu

SEQ ID NO: 3525703 - RNA, 17 nt, Human
cuggacuccucugucca

SEQ ID NO: 3525704 - RNA, 18 nt, Human
cuggacuccucuguccag

SEQ ID NO: 3525705 - RNA, 22 nt, Human
cuggacuccucuguccaggcac

SEQ ID NO: 3525706 - RNA, 17 nt, Human
cuggacucucagucucu

SEQ ID NO: 3525707 - RNA, 21 nt, Human
cuggacucucagucucugagc

SEQ ID NO: 3525708 - RNA, 18 nt, Human
cuggacucugcaucccag

SEQ ID NO: 3525709 - RNA, 24 nt, Human
cuggacucugcaucccagcaccug

SEQ ID NO: 3525710 - RNA, 16 nt, Human
cuggacucuggacuuu

SEQ ID NO: 3525711 - RNA, 14 nt, Human
cuggacucuucaaa

SEQ ID NO: 3525712 - RNA, 16 nt, Human
cuggcuucuggagccc

SEQ ID NO: 3525713 - RNA, 20 nt, Human
cuggcuucuggagcccuugg

SEQ ID NO: 3525714 - RNA, 13 nt, Human
cuggcuucuggcc

SEQ ID NO: 3525715 - RNA, 19 nt, Human
cuggcuucuggccaggaag

SEQ ID NO: 3525716 - RNA, 14 nt, Human
cuggcuucuguggg

SEQ ID NO: 3525717 - RNA, 13 nt, Human
cuggcuuggccua

SEQ ID NO: 3525718 - RNA, 16 nt, Human
cuggcuugggcagcau

SEQ ID NO: 3525719 - RNA, 20 nt, Human
cuggcuuguaacuccaccaa

SEQ ID NO: 3525720 - RNA, 15 nt, Human
cuggcuuucagagua

SEQ ID NO: 3525721 - RNA, 22 nt, Human
cuggcuuucauuuucucucagg

SEQ ID NO: 3525722 - RNA, 23 nt, Human
cuggcuuucauuuucucucaggu

SEQ ID NO: 3525723 - RNA, 15 nt, Human
cuggcuuucuccgac

SEQ ID NO: 3525724 - RNA, 22 nt, Human
cuggcuuucuccgacugcuagg

SEQ ID NO: 3525725 - RNA, 14 nt, Human
cuggcuuugcccaa

SEQ ID NO: 3525726 - RNA, 15 nt, Human
cuggcuuugcccaac

SEQ ID NO: 3525727 - RNA, 22 nt, Human
cuggcuuugcccaaccucagca

SEQ ID NO: 3525728 - RNA, 15 nt, Human
cuggcuuugucccac

SEQ ID NO: 3525729 - RNA, 20 nt, Human
cuggcuuugucccacagcuu

SEQ ID NO: 3525730 - RNA, 21 nt, Human
cuggcuuugucccacagcuug

SEQ ID NO: 3525731 - RNA, 14 nt, Human
cuggcuuuuauuaa

SEQ ID NO: 3525732 - RNA, 15 nt, Human
cuggcuuuucacugc

SEQ ID NO: 3525733 - RNA, 16 nt, Human
cuggcuuuucacugcu

SEQ ID NO: 3525734 - RNA, 17 nt, Human
cuggcuuuucacugcug

SEQ ID NO: 3525735 - RNA, 12 nt, Human
cuggcuuuucug

SEQ ID NO: 3525736 - RNA, 15 nt, Human
cuggcuuuugagcac

SEQ ID NO: 3525737 - RNA, 14 nt, Human
cuggcuuuuggaag

SEQ ID NO: 3525738 - RNA, 19 nt, Human
cuggcuuuuuauuguauuu

SEQ ID NO: 3525739 - RNA, 14 nt, Human
cugggaaaauaccc

SEQ ID NO: 3525740 - RNA, 17 nt, Human
cugggaaaauaccccau

SEQ ID NO: 3525741 - RNA, 19 nt, Human
cugggaaacacuccuugca

SEQ ID NO: 3525742 - RNA, 21 nt, Human
cugggaaacacuccuugcauc

SEQ ID NO: 3525743 - RNA, 15 nt, Human
cugggaaacagaggc

SEQ ID NO: 3525744 - RNA, 23 nt, Human
cugggaaaccccuucucugugac

SEQ ID NO: 3525745 - RNA, 16 nt, Human
cugggaaauauucccu

SEQ ID NO: 3525746 - RNA, 20 nt, Human
cugggaaaugagaaggcagc

SEQ ID NO: 3525747 - RNA, 17 nt, Human
cugggaaccccuuuccc

SEQ ID NO: 3525748 - RNA, 18 nt, Human
cugggaaccccuuuccca

SEQ ID NO: 3525749 - RNA, 19 nt, Human
cugggaaccuuccugucuu

SEQ ID NO: 3525750 - RNA, 20 nt, Human
cugggaacucaccuggggcu

SEQ ID NO: 3525751 - RNA, 24 nt, Human
cugggaagauaggcucugcacaga

SEQ ID NO: 3525752 - RNA, 19 nt, Human
cugggaaggcuacucaccu

SEQ ID NO: 3525753 - RNA, 16 nt, Human
cugggaaggcuacuuc

SEQ ID NO: 3525754 - RNA, 23 nt, Human
cugggaagucguccuuacuccug

SEQ ID NO: 3525755 - RNA, 23 nt, Human
cugggaauggaggggcagagcca

SEQ ID NO: 3525756 - RNA, 19 nt, Human
cugggaauguauaguauuu

SEQ ID NO: 3525757 - RNA, 23 nt, Human
cugggaauguauaguauuugaaa

SEQ ID NO: 3525758 - RNA, 16 nt, Human
cugggacacaaaacuc

SEQ ID NO: 3525759 - RNA, 21 nt, Human
cugggacacaaaacuccgccc

SEQ ID NO: 3525760 - RNA, 12 nt, Human
cugggacacagu

SEQ ID NO: 3525761 - RNA, 12 nt, Human
cugggacauggg

SEQ ID NO: 3525762 - RNA, 18 nt, Human
cugggacaugggaaaggg

SEQ ID NO: 3525763 - RNA, 20 nt, Human
cugggacccuuuccuuccuu

SEQ ID NO: 3525764 - RNA, 16 nt, Human
cugggaccgcuacacc

SEQ ID NO: 3525765 - RNA, 20 nt, Human
cugggaccuccccugaggcu

SEQ ID NO: 3525766 - RNA, 17 nt, Human
cugggaccugccaggca

SEQ ID NO: 3525767 - RNA, 13 nt, Human
cugggaccuuuag

SEQ ID NO: 3525768 - RNA, 15 nt, Human
cugggacgcucugcu

SEQ ID NO: 3525769 - RNA, 17 nt, Human
cugggacguggcucagc

SEQ ID NO: 3525770 - RNA, 18 nt, Human
cugggacguggcucagcc

SEQ ID NO: 3525771 - RNA, 14 nt, Human
cugggacucagccu

SEQ ID NO: 3525772 - RNA, 13 nt, Human
cugggacugagcc

SEQ ID NO: 3525773 - RNA, 14 nt, Human
cugggacugagcca

SEQ ID NO: 3525774 - RNA, 15 nt, Human
cugggacugagccag

SEQ ID NO: 3525775 - RNA, 16 nt, Human
cugggacugagccagu

SEQ ID NO: 3525776 - RNA, 20 nt, Human
cugggacugagccaguccca

SEQ ID NO: 3525777 - RNA, 13 nt, Human
cugggacuggcca

SEQ ID NO: 3525778 - RNA, 16 nt, Human
cugggacuuccuugcu

SEQ ID NO: 3525779 - RNA, 16 nt, Human
cugggagaaaaucauc

SEQ ID NO: 3525780 - RNA, 13 nt, Human
cugggagaaaucu

SEQ ID NO: 3525781 - RNA, 18 nt, Human
cugggagaaaucuggcuu

SEQ ID NO: 3525782 - RNA, 16 nt, Human
cugggagaaaugaaaa

SEQ ID NO: 3525783 - RNA, 17 nt, Human
cugggagaaaugaaaaa

SEQ ID NO: 3525784 - RNA, 12 nt, Human
cugggagaaccu

SEQ ID NO: 3525785 - RNA, 14 nt, Human
cugggagaaccuca

SEQ ID NO: 3525786 - RNA, 14 nt, Human
cugggagacagacc

SEQ ID NO: 3525787 - RNA, 17 nt, Human
cugggagagccuuccag

SEQ ID NO: 3525788 - RNA, 13 nt, Human
cugggagaggcag

SEQ ID NO: 3525789 - RNA, 18 nt, Human
cugggagaggcagcccag

SEQ ID NO: 3525790 - RNA, 19 nt, Human
cugggagaggugccagcaa

SEQ ID NO: 3525791 - RNA, 15 nt, Human
cugggagauucaagg

SEQ ID NO: 3525792 - RNA, 16 nt, Human
cugggagcccccagcc

SEQ ID NO: 3525793 - RNA, 19 nt, Human
cugggagcccccagccugu

SEQ ID NO: 3525794 - RNA, 21 nt, Human
cugggagcccccagccuguca

SEQ ID NO: 3525795 - RNA, 23 nt, Human
cugggagcccccagccugucaga

SEQ ID NO: 3525796 - RNA, 16 nt, Human
cugggagccuacccac

SEQ ID NO: 3525797 - RNA, 22 nt, Human
cugggagccuacccacccccag

SEQ ID NO: 3525798 - RNA, 16 nt, Human
cugggagcuccacucu

SEQ ID NO: 3525799 - RNA, 17 nt, Human
cugggagcuccacucug

SEQ ID NO: 3525800 - RNA, 16 nt, Human
cugggagcuuuuguag

SEQ ID NO: 3525801 - RNA, 13 nt, Human
cugggaggaaaag

SEQ ID NO: 3525802 - RNA, 18 nt, Human
cugggaggaaccgagggg

SEQ ID NO: 3525803 - RNA, 17 nt, Human
cugggaggaauggacag

SEQ ID NO: 3525804 - RNA, 22 nt, Human
cugggaggaauggacagacaga

SEQ ID NO: 3525805 - RNA, 16 nt, Human
cugggaggagggagag

SEQ ID NO: 3525806 - RNA, 20 nt, Human
cugggaggagggagagggag

SEQ ID NO: 3525807 - RNA, 23 nt, Human
cugggaggcagagguugcaguga

SEQ ID NO: 3525808 - RNA, 18 nt, Human
cugggaggcucuggagcc

SEQ ID NO: 3525809 - RNA, 19 nt, Human
cugggagggcagcagggcu

SEQ ID NO: 3525810 - RNA, 22 nt, Human
cugggagggguuuucgaagcuc

SEQ ID NO: 3525811 - RNA, 18 nt, Human
cugggaggucaaggcugc

SEQ ID NO: 3525812 - RNA, 19 nt, Human
cugggaggucaaggcugca

SEQ ID NO: 3525813 - RNA, 20 nt, Human
cugggagguuaaaaagaaaa

SEQ ID NO: 3525814 - RNA, 21 nt, Human
cugggagguugguuuaaugca

SEQ ID NO: 3525815 - RNA, 22 nt, Human
cugggagucacacaguguugga

SEQ ID NO: 3525816 - RNA, 12 nt, Human
cugggagugagc

SEQ ID NO: 3525817 - RNA, 23 nt, Human
cugggaguugaucgccuuuccca

SEQ ID NO: 3525818 - RNA, 17 nt, Human
cugggauaggggcagag

SEQ ID NO: 3525819 - RNA, 17 nt, Human
cugggauccuaagggcu

SEQ ID NO: 3525820 - RNA, 17 nt, Human
cugggaugagccgcugu

SEQ ID NO: 3525821 - RNA, 16 nt, Human
cugggaugggccugcu

SEQ ID NO: 3525822 - RNA, 22 nt, Human
cugggaugggccugcuuccugu

SEQ ID NO: 3525823 - RNA, 18 nt, Human
cugggauuacaggcguga

SEQ ID NO: 3525824 - RNA, 13 nt, Human
ccucucccuggcc

SEQ ID NO: 3525825 - RNA, 14 nt, Human
ccucucccuucccu

SEQ ID NO: 3525826 - RNA, 16 nt, Human
ccucucccuucccucc

SEQ ID NO: 3525827 - RNA, 20 nt, Human
ccucucccuugggcucugau

SEQ ID NO: 3525828 - RNA, 19 nt, Human
ccucuccgccccugagccc

SEQ ID NO: 3525829 - RNA, 22 nt, Human
ccucuccgccccugagcccacu

SEQ ID NO: 3525830 - RNA, 14 nt, Human
ccucuccguuuauu

SEQ ID NO: 3525831 - RNA, 15 nt, Human
ccucuccuacucacu

SEQ ID NO: 3525832 - RNA, 13 nt, Human
ccucuccugccua

SEQ ID NO: 3525833 - RNA, 11 nt, Human
ccucuccugga

SEQ ID NO: 3525834 - RNA, 19 nt, Human
ccucuccugggcagcugcc

SEQ ID NO: 3525835 - RNA, 20 nt, Human
ccucuccugggcagcugccu

SEQ ID NO: 3525836 - RNA, 22 nt, Human
ccucuccugggcagcugccucc

SEQ ID NO: 3525837 - RNA, 15 nt, Human
ccucuccuuccuugu

SEQ ID NO: 3525838 - RNA, 21 nt, Human
ccucuccuucguaucccgagu

SEQ ID NO: 3525839 - RNA, 21 nt, Human
ccucuccuuguggccugggcc

SEQ ID NO: 3525840 - RNA, 15 nt, Human
ccucuccuuuguaua

SEQ ID NO: 3525841 - RNA, 18 nt, Human
ccucuccuuuguauauua

SEQ ID NO: 3525842 - RNA, 22 nt, Human
ccucuccuuuguauauuauuuc

SEQ ID NO: 3525843 - RNA, 17 nt, Human
ccucucggaaggcuggc

SEQ ID NO: 3525844 - RNA, 19 nt, Human
ccucucgguggccagcagg

SEQ ID NO: 3525845 - RNA, 19 nt, Human
ccucucuauccucucuucc

SEQ ID NO: 3525846 - RNA, 12 nt, Human
ccucucucaggc

SEQ ID NO: 3525847 - RNA, 14 nt, Human
ccucucucaggcca

SEQ ID NO: 3525848 - RNA, 14 nt, Human
ccucucuccuuugc

SEQ ID NO: 3525849 - RNA, 11 nt, Human
ccucucucuga

SEQ ID NO: 3525850 - RNA, 12 nt, Human
ccucucucugac

SEQ ID NO: 3525851 - RNA, 16 nt, Human
ccucucucuucugcuc

SEQ ID NO: 3525852 - RNA, 18 nt, Human
ccucucugaaggaggcca

SEQ ID NO: 3525853 - RNA, 20 nt, Human
ccucucugaaggaggccacc

SEQ ID NO: 3525854 - RNA, 23 nt, Human
ccucucugaaggaggccaccucc

SEQ ID NO: 3525855 - RNA, 17 nt, Human
ccucucugcagacuucc

SEQ ID NO: 3525856 - RNA, 21 nt, Human
ccucucugcagacuucccagc

SEQ ID NO: 3525857 - RNA, 20 nt, Human
ccugcacagugucccccagg

SEQ ID NO: 3525858 - RNA, 14 nt, Human
ccugcacccuccua

SEQ ID NO: 3525859 - RNA, 17 nt, Human
ccugcaccuccccccac

SEQ ID NO: 3525860 - RNA, 22 nt, Human
ccugcaccuccccccacugcag

SEQ ID NO: 3525861 - RNA, 14 nt, Human
ccugcaccugugca

SEQ ID NO: 3525862 - RNA, 15 nt, Human
ccugcaccugugcag

SEQ ID NO: 3525863 - RNA, 20 nt, Human
ccugcacggugaauggcuuu

SEQ ID NO: 3525864 - RNA, 18 nt, Human
ccugcacgucaugggagg

SEQ ID NO: 3525865 - RNA, 19 nt, Human
ccugcacgucaugggaggg

SEQ ID NO: 3525866 - RNA, 23 nt, Human
ccugcacgucaugggagggggcu

SEQ ID NO: 3525867 - RNA, 19 nt, Human
ccugcacuaaagccagccu

SEQ ID NO: 3525868 - RNA, 20 nt, Human
ccugcacuaaagccagccug

SEQ ID NO: 3525869 - RNA, 21 nt, Human
ccugcacuaauuugauguuua

SEQ ID NO: 3525870 - RNA, 12 nt, Human
ccugcacuccuc

SEQ ID NO: 3525871 - RNA, 18 nt, Human
ccugcacugacucuggaa

SEQ ID NO: 3525872 - RNA, 11 nt, Human
ccugcacugua

SEQ ID NO: 3525873 - RNA, 14 nt, Human
ccugcacuguaaaa

SEQ ID NO: 3525874 - RNA, 14 nt, Human
ccugcacuguccug

SEQ ID NO: 3525875 - RNA, 14 nt, Human
ccugcacuuacuug

SEQ ID NO: 3525876 - RNA, 17 nt, Human
ccugcacuugcagacuc

SEQ ID NO: 3525877 - RNA, 22 nt, Human
ccugcacuugggggcucagcaa

SEQ ID NO: 3525878 - RNA, 21 nt, Human
ccugcagaaccggagagccag

SEQ ID NO: 3525879 - RNA, 16 nt, Human
ccugcagaauuugggu

SEQ ID NO: 3525880 - RNA, 17 nt, Human
cuggggccuguacugcc

SEQ ID NO: 3525881 - RNA, 19 nt, Human
cuggggccuguacugccug

SEQ ID NO: 3525882 - RNA, 21 nt, Human
cuggggccuguacugccugcu

SEQ ID NO: 3525883 - RNA, 15 nt, Human
cuggggcgggccccu

SEQ ID NO: 3525884 - RNA, 19 nt, Human
cuggggcuaggcuggagcc

SEQ ID NO: 3525885 - RNA, 12 nt, Human
cuggggcucaga

SEQ ID NO: 3525886 - RNA, 23 nt, Human
cuggggcuccuuucuccagccag

SEQ ID NO: 3525887 - RNA, 21 nt, Human
cuggggcucuaacgccugagc

SEQ ID NO: 3525888 - RNA, 14 nt, Human
cuggggcucuggga

SEQ ID NO: 3525889 - RNA, 15 nt, Human
cuggggcucugggau

SEQ ID NO: 3525890 - RNA, 14 nt, Human
cuggggcugaccuu

SEQ ID NO: 3525891 - RNA, 16 nt, Human
cuggggcugaucucag

SEQ ID NO: 3525892 - RNA, 12 nt, Human
cuggggcugcug

SEQ ID NO: 3525893 - RNA, 14 nt, Human
cuggggcugcuggc

SEQ ID NO: 3525894 - RNA, 18 nt, Human
cuggggcuggccucccaa

SEQ ID NO: 3525895 - RNA, 14 nt, Human
cuggggcugggccc

SEQ ID NO: 3525896 - RNA, 16 nt, Human
cuggggcuguguuuug

SEQ ID NO: 3525897 - RNA, 19 nt, Human
cuggggcuguugaagucac

SEQ ID NO: 3525898 - RNA, 15 nt, Human
cuggggcuucuccug

SEQ ID NO: 3525899 - RNA, 20 nt, Human
cuggggcuucuccugaccca

SEQ ID NO: 3525900 - RNA, 16 nt, Human
cugggggaugggccug

SEQ ID NO: 3525901 - RNA, 20 nt, Human
cugggggcacaagacugacg

SEQ ID NO: 3525902 - RNA, 19 nt, Human
cugggggcacaggaggcag

SEQ ID NO: 3525903 - RNA, 12 nt, Human
cugggggcagga

SEQ ID NO: 3525904 - RNA, 19 nt, Human
cugggggcaggagggcccu

SEQ ID NO: 3525905 - RNA, 17 nt, Human
cugggggccaugagcuc

SEQ ID NO: 3525906 - RNA, 18 nt, Human
cugggggccaugagcucc

SEQ ID NO: 3525907 - RNA, 20 nt, Human
cugggggccaugagcuccag

SEQ ID NO: 3525908 - RNA, 14 nt, Human
cugggggccucacu

SEQ ID NO: 3525909 - RNA, 13 nt, Human
cugggggccucag

SEQ ID NO: 3525910 - RNA, 16 nt, Human
cugggggccugaccuc

SEQ ID NO: 3525911 - RNA, 22 nt, Human
cugggggccugaccucccccuc

SEQ ID NO: 3525912 - RNA, 12 nt, Human
cugggggccugg

SEQ ID NO: 3525913 - RNA, 14 nt, Human
cugggggcugcagu

SEQ ID NO: 3525914 - RNA, 18 nt, Human
cugggggcugcaguucga

SEQ ID NO: 3525915 - RNA, 20 nt, Human
cuggggggacccagugcaga

SEQ ID NO: 3525916 - RNA, 16 nt, Human
cugggggugggccagg

SEQ ID NO: 3525917 - RNA, 16 nt, Human
cugggguaccaagaga

SEQ ID NO: 3525918 - RNA, 21 nt, Human
cugggguaccaagagacuccu

SEQ ID NO: 3525919 - RNA, 20 nt, Human
cugggguauaaaacuuuccu

SEQ ID NO: 3525920 - RNA, 13 nt, Human
cuggggucccagc

SEQ ID NO: 3525921 - RNA, 20 nt, Human
cuggggucccagcagcugcc

SEQ ID NO: 3525922 - RNA, 22 nt, Human
cuggggucccagcagcugccag

SEQ ID NO: 3525923 - RNA, 13 nt, Human
cugggguccccag

SEQ ID NO: 3525924 - RNA, 14 nt, Human
cugggguccccagg

SEQ ID NO: 3525925 - RNA, 15 nt, Human
cugggguccuggggc

SEQ ID NO: 3525926 - RNA, 20 nt, Human
cuggggugcagggauguggg

SEQ ID NO: 3525927 - RNA, 21 nt, Human
cuggggugcccuccacugccc

SEQ ID NO: 3525928 - RNA, 17 nt, Human
cuggggugccgccugcc

SEQ ID NO: 3525929 - RNA, 19 nt, Human
cuggggugccgccugcccg

SEQ ID NO: 3525930 - RNA, 18 nt, Human
cuggggugggcaguuuuu

SEQ ID NO: 3525931 - RNA, 19 nt, Human
cugggguggggaccucagg

SEQ ID NO: 3525932 - RNA, 15 nt, Human
cugggguucagcccc

SEQ ID NO: 3525933 - RNA, 16 nt, Human
cuggguaaaugcagcg

SEQ ID NO: 3525934 - RNA, 17 nt, Human
cuggguacugaaagccu

SEQ ID NO: 3525935 - RNA, 16 nt, Human
cuggguacuuguggac

SEQ ID NO: 3525936 - RNA, 18 nt, Human
cuggguacuuguggacac

SEQ ID NO: 3525937 - RNA, 13 nt, Human
cuggguagcugua

SEQ ID NO: 3525938 - RNA, 19 nt, Human
cuggguaggaaagaggaag

SEQ ID NO: 3525939 - RNA, 13 nt, Human
cuggguaugugua

SEQ ID NO: 3525940 - RNA, 13 nt, Human
cugggucagucug

SEQ ID NO: 3525941 - RNA, 17 nt, Human
cugggucagucuggugg

SEQ ID NO: 3525942 - RNA, 18 nt, Human
cugggucagucugguggg

SEQ ID NO: 3525943 - RNA, 19 nt, Human
cuggguccaaauaaaaacu

SEQ ID NO: 3525944 - RNA, 21 nt, Human
cuggguccaaauaaaaacuaa

SEQ ID NO: 3525945 - RNA, 13 nt, Human
cuggguccagaag

SEQ ID NO: 3525946 - RNA, 20 nt, Human
cuggguccauaucacacaca

SEQ ID NO: 3525947 - RNA, 16 nt, Human
cuggguccccagcccu

SEQ ID NO: 3525948 - RNA, 21 nt, Human
cuggguccuaauuaccagucu

SEQ ID NO: 3525949 - RNA, 15 nt, Human
cuggguccuuccuga

SEQ ID NO: 3525950 - RNA, 19 nt, Human
cuggguccuuccugaaacu

SEQ ID NO: 3525951 - RNA, 16 nt, Human
cugggucgcccuggac

SEQ ID NO: 3525952 - RNA, 23 nt, Human
cugggucucaccggcucucaccu

SEQ ID NO: 3525953 - RNA, 22 nt, Human
cugggucucgcuuuguugccca

SEQ ID NO: 3525954 - RNA, 19 nt, Human
cugggugacagagcaagac

SEQ ID NO: 3525955 - RNA, 20 nt, Human
cugggugcccaagcucagaa

SEQ ID NO: 3525956 - RNA, 21 nt, Human
cugggugcccaagcucagaag

SEQ ID NO: 3525957 - RNA, 12 nt, Human
cugggugcccac

SEQ ID NO: 3525958 - RNA, 14 nt, Human
cugggugcccacag

SEQ ID NO: 3525959 - RNA, 15 nt, Human
cugggugcccacagc

SEQ ID NO: 3525960 - RNA, 16 nt, Human
cugggugcccacagcc

SEQ ID NO: 3525961 - RNA, 22 nt, Human
cugggugcgaccccaucugccc

SEQ ID NO: 3525962 - RNA, 17 nt, Human
cugggugcuacugggga

SEQ ID NO: 3525963 - RNA, 21 nt, Human
cugggugcuacuggggaaacu

SEQ ID NO: 3525964 - RNA, 15 nt, Human
cugggugcucccuac

SEQ ID NO: 3525965 - RNA, 20 nt, Human
cugggugcugauccuugcac

SEQ ID NO: 3525966 - RNA, 15 nt, Human
cugggugcuggcugc

SEQ ID NO: 3525967 - RNA, 16 nt, Human
cuggguggcacugcca

SEQ ID NO: 3525968 - RNA, 16 nt, Human
cuggguggcccauccc

SEQ ID NO: 3525969 - RNA, 13 nt, Human
cuggguggccucg

SEQ ID NO: 3525970 - RNA, 16 nt, Human
cuggguggccucggga

SEQ ID NO: 3525971 - RNA, 19 nt, Human
cuggguggcuacucugugc

SEQ ID NO: 3525972 - RNA, 22 nt, Human
cuggguggcuacucugugccag

SEQ ID NO: 3525973 - RNA, 14 nt, Human
cugggugggcucug

SEQ ID NO: 3525974 - RNA, 20 nt, Human
cuggguggggcugcuccucc

SEQ ID NO: 3525975 - RNA, 16 nt, Human
cuggguggggugagga

SEQ ID NO: 3525976 - RNA, 12 nt, Human
cugggugggugg

SEQ ID NO: 3525977 - RNA, 20 nt, Human
cugggugggugguggggagg

SEQ ID NO: 3525978 - RNA, 16 nt, Human
cugggugguacccucu

SEQ ID NO: 3525979 - RNA, 15 nt, Human
cuggguguaaacaca

SEQ ID NO: 3525980 - RNA, 19 nt, Human
cuggguguauuaggacugg

SEQ ID NO: 3525981 - RNA, 17 nt, Human
cuggguguggcgcagca

SEQ ID NO: 3525982 - RNA, 19 nt, Human
cuggguuagacugccagcu

SEQ ID NO: 3525983 - RNA, 20 nt, Human
cuggguuagacugccagcuc

SEQ ID NO: 3525984 - RNA, 15 nt, Human
cuggguucacugcaa

SEQ ID NO: 3525985 - RNA, 18 nt, Human
cuggguucagaaaugcug

SEQ ID NO: 3525986 - RNA, 17 nt, Human
cuggguuccaauccugg

SEQ ID NO: 3525987 - RNA, 22 nt, Human
cuggguuccagcaauucuccug

SEQ ID NO: 3525988 - RNA, 14 nt, Human
cuggguucccuuuc

SEQ ID NO: 3525989 - RNA, 16 nt, Human
cuggguucccuuuccu

SEQ ID NO: 3525990 - RNA, 16 nt, Human
cuggguucuacccagg

SEQ ID NO: 3525991 - RNA, 19 nt, Human
cuggguucuacccaggugc

SEQ ID NO: 3525992 - RNA, 20 nt, Human
cuggguuggcgcacccuccc

SEQ ID NO: 3525993 - RNA, 23 nt, Human
cuggguuggcgcacccuccccuc

SEQ ID NO: 3525994 - RNA, 14 nt, Human
cuggguugggauca

SEQ ID NO: 3525995 - RNA, 18 nt, Human
cuggguuuaaggggagag

SEQ ID NO: 3525996 - RNA, 23 nt, Human
cuggguuuauuacauggcagugu

SEQ ID NO: 3525997 - RNA, 22 nt, Human
cuggguuuggaccccagcuggg

SEQ ID NO: 3525998 - RNA, 20 nt, Human
cuggguuuuguauucucuga

SEQ ID NO: 3525999 - RNA, 22 nt, Human
cuggguuuuguauucucugagc

SEQ ID NO: 3526000 - RNA, 15 nt, Human
cugguaaaaugaaga

SEQ ID NO: 3526001 - RNA, 19 nt, Human
cugguaaacuauuugucuu

SEQ ID NO: 3526002 - RNA, 16 nt, Human
aaauuugaagaaugaa

SEQ ID NO: 3526003 - RNA, 16 nt, Human
aaauuugacuaauuuu

SEQ ID NO: 3526004 - RNA, 20 nt, Human
aaauuugacuaauuuuacau

SEQ ID NO: 3526005 - RNA, 16 nt, Human
aaauuugacuuuucug

SEQ ID NO: 3526006 - RNA, 13 nt, Human
aaauuugauacuu

SEQ ID NO: 3526007 - RNA, 20 nt, Human
aaauuuggaauucuguucau

SEQ ID NO: 3526008 - RNA, 14 nt, Human
aaauuuguaaguuu

SEQ ID NO: 3526009 - RNA, 22 nt, Human
aaauuuguaaguuucaggugac

SEQ ID NO: 3526010 - RNA, 13 nt, Human
aaauuuguacuau

SEQ ID NO: 3526011 - RNA, 17 nt, Human
aaauuuguacuauuuaa

SEQ ID NO: 3526012 - RNA, 19 nt, Human
aaauuuguacuauuuaacu

SEQ ID NO: 3526013 - RNA, 19 nt, Human
aaauuuguuauuuugcaac

SEQ ID NO: 3526014 - RNA, 19 nt, Human
aaauuuguuuaaaguauac

SEQ ID NO: 3526015 - RNA, 10 nt, Human
aaauuuuaaa

SEQ ID NO: 3526016 - RNA, 13 nt, Human
aaauuuuaaaaaa

SEQ ID NO: 3526017 - RNA, 14 nt, Human
aaauuuuaaaaaag

SEQ ID NO: 3526018 - RNA, 15 nt, Human
aaauuuuaaaaaucu

SEQ ID NO: 3526019 - RNA, 15 nt, Human
aaauuuuaacuaaau

SEQ ID NO: 3526020 - RNA, 21 nt, Human
aaauuuuacaagggcauaaag

SEQ ID NO: 3526021 - RNA, 14 nt, Human
aaauuuuaccaagu

SEQ ID NO: 3526022 - RNA, 22 nt, Human
aaauuuuaccaaguuauauaaa

SEQ ID NO: 3526023 - RNA, 18 nt, Human
aaauuuuauuuccuggac

SEQ ID NO: 3526024 - RNA, 13 nt, Human
aaauuuucacaua

SEQ ID NO: 3526025 - RNA, 13 nt, Human
aaauuuucagcau

SEQ ID NO: 3526026 - RNA, 22 nt, Human
aaauuuuccuguccucuuucag

SEQ ID NO: 3526027 - RNA, 17 nt, Human
aaauuuucuucaguugg

SEQ ID NO: 3526028 - RNA, 13 nt, Human
aaauuuugaaaag

SEQ ID NO: 3526029 - RNA, 21 nt, Human
aaauuuugaaaaguaauauuu

SEQ ID NO: 3526030 - RNA, 23 nt, Human
aaauuuugauguuuuaaggaugc

SEQ ID NO: 3526031 - RNA, 12 nt, Human
aaauuuugcaaa

SEQ ID NO: 3526032 - RNA, 15 nt, Human
aaauuuugcaaauau

SEQ ID NO: 3526033 - RNA, 20 nt, Human
aaauuuugcaaauauaaaca

SEQ ID NO: 3526034 - RNA, 12 nt, Human
aaauuuuggcca

SEQ ID NO: 3526035 - RNA, 12 nt, Human
aaauuuuguaag

SEQ ID NO: 3526036 - RNA, 14 nt, Human
aaauuuuguaauuu

SEQ ID NO: 3526037 - RNA, 15 nt, Human
aaauuuuguaauuuu

SEQ ID NO: 3526038 - RNA, 18 nt, Human
aaauuuuuaggaaacuca

SEQ ID NO: 3526039 - RNA, 20 nt, Human
aaauuuuucagaugcuucug

SEQ ID NO: 3526040 - RNA, 13 nt, Human
aaauuuuucauau

SEQ ID NO: 3526041 - RNA, 13 nt, Human
ccugcagacccug

SEQ ID NO: 3526042 - RNA, 13 nt, Human
ccugcagagcugc

SEQ ID NO: 3526043 - RNA, 18 nt, Human
ccugcagaggucugugcu

SEQ ID NO: 3526044 - RNA, 21 nt, Human
ccugcagaggucugugcugag

SEQ ID NO: 3526045 - RNA, 16 nt, Human
ccugcagaguuuggau

SEQ ID NO: 3526046 - RNA, 13 nt, Human
ccugcagaugcca

SEQ ID NO: 3526047 - RNA, 21 nt, Human
ccugcagcacggacaauaaac

SEQ ID NO: 3526048 - RNA, 23 nt, Human
ccugcagcacggacaauaaaccu

SEQ ID NO: 3526049 - RNA, 16 nt, Human
ccugcagccucccucc

SEQ ID NO: 3526050 - RNA, 22 nt, Human
ccugcagccuccuccaccucac

SEQ ID NO: 3526051 - RNA, 18 nt, Human
ccugcagccuccuccuga

SEQ ID NO: 3526052 - RNA, 13 nt, Human
ccugcagccugga

SEQ ID NO: 3526053 - RNA, 15 nt, Human
ccugcagccuggagg

SEQ ID NO: 3526054 - RNA, 16 nt, Human
ccugcagcuaguccua

SEQ ID NO: 3526055 - RNA, 12 nt, Human
ccugcagcuccc

SEQ ID NO: 3526056 - RNA, 12 nt, Human
ccugcagcuugu

SEQ ID NO: 3526057 - RNA, 16 nt, Human
ccugcagcuuguagcc

SEQ ID NO: 3526058 - RNA, 14 nt, Human
ccugcaggaaggag

SEQ ID NO: 3526059 - RNA, 20 nt, Human
ccugcaggaccugccuguag

SEQ ID NO: 3526060 - RNA, 23 nt, Human
ccugcaggaucucaccaggcagc

SEQ ID NO: 3526061 - RNA, 20 nt, Human
ccugcaggcagccaggccac

SEQ ID NO: 3526062 - RNA, 22 nt, Human
ccugcaggccaagagcagaggc

SEQ ID NO: 3526063 - RNA, 15 nt, Human
ccugcaggccaggcc

SEQ ID NO: 3526064 - RNA, 16 nt, Human
ccugcaggcugagcca

SEQ ID NO: 3526065 - RNA, 23 nt, Human
ccugcaggguggugcugggacug

SEQ ID NO: 3526066 - RNA, 21 nt, Human
ccugcagguugggccauacug

SEQ ID NO: 3526067 - RNA, 15 nt, Human
ccugcagucaucuug

SEQ ID NO: 3526068 - RNA, 12 nt, Human
ccugcaguguuc

SEQ ID NO: 3526069 - RNA, 22 nt, Human
ccugcaguuccccuggaagcag

SEQ ID NO: 3526070 - RNA, 18 nt, Human
ccugcauccccuuggcug

SEQ ID NO: 3526071 - RNA, 24 nt, Human
ccugcauccccuuggcugugaggc

SEQ ID NO: 3526072 - RNA, 22 nt, Human
ccugcauccguaguucccugaa

SEQ ID NO: 3526073 - RNA, 16 nt, Human
ccugcaucuaagccca

SEQ ID NO: 3526074 - RNA, 18 nt, Human
ccugcaucuuuagugcuu

SEQ ID NO: 3526075 - RNA, 12 nt, Human
ccugcaugcaga

SEQ ID NO: 3526076 - RNA, 16 nt, Human
ccugcauucuuucugu

SEQ ID NO: 3526077 - RNA, 16 nt, Human
ccugcauuggaacugg

SEQ ID NO: 3526078 - RNA, 19 nt, Human
ccugccaccaggccaccuc

SEQ ID NO: 3526079 - RNA, 19 nt, Human
ccugccaccagucacuguc

SEQ ID NO: 3526080 - RNA, 12 nt, Human
ccugccacccug

SEQ ID NO: 3526081 - RNA, 13 nt, Human
ccugccaccugga

SEQ ID NO: 3526082 - RNA, 16 nt, Human
ccugccaccuggaccc

SEQ ID NO: 3526083 - RNA, 16 nt, Human
ccugccaccuggggca

SEQ ID NO: 3526084 - RNA, 17 nt, Human
ccugccacuaggcuggg

SEQ ID NO: 3526085 - RNA, 19 nt, Human
ccugccacuaggcugggug

SEQ ID NO: 3526086 - RNA, 20 nt, Human
ccugccacuaggcugggugc

SEQ ID NO: 3526087 - RNA, 13 nt, Human
ccugccacucaca

SEQ ID NO: 3526088 - RNA, 14 nt, Human
ccugccacucacac

SEQ ID NO: 3526089 - RNA, 22 nt, Human
ccugccacucacacagccaggu

SEQ ID NO: 3526090 - RNA, 23 nt, Human
ccugccacucacacagccaggug

SEQ ID NO: 3526091 - RNA, 22 nt, Human
ccugccacucaggcccaaagcc

SEQ ID NO: 3526092 - RNA, 15 nt, Human
ccugccagccccaca

SEQ ID NO: 3526093 - RNA, 13 nt, Human
ccugccagccccu

SEQ ID NO: 3526094 - RNA, 17 nt, Human
ccugccagccuggcuuc

SEQ ID NO: 3526095 - RNA, 12 nt, Human
ccugccagcugc

SEQ ID NO: 3526096 - RNA, 17 nt, Human
ccugccagcugcacuga

SEQ ID NO: 3526097 - RNA, 15 nt, Human
ccugccaggaagcca

SEQ ID NO: 3526098 - RNA, 17 nt, Human
ccugccaggaagccagc

SEQ ID NO: 3526099 - RNA, 21 nt, Human
ccugccaggaagccagcaggc

SEQ ID NO: 3526100 - RNA, 11 nt, Human
ccugccaggag

SEQ ID NO: 3526101 - RNA, 21 nt, Human
ccugccaggagcuuuggaccu

SEQ ID NO: 3526102 - RNA, 12 nt, Human
ccugccaggagg

SEQ ID NO: 3526103 - RNA, 22 nt, Human
ccugccaggcacaggcagggca

SEQ ID NO: 3526104 - RNA, 23 nt, Human
ccugccaggcacaggcagggcag

SEQ ID NO: 3526105 - RNA, 14 nt, Human
ccugccaggcaggg

SEQ ID NO: 3526106 - RNA, 19 nt, Human
ccugccaggcagggguggg

SEQ ID NO: 3526107 - RNA, 15 nt, Human
ccugccaggcauggu

SEQ ID NO: 3526108 - RNA, 17 nt, Human
ccugccagggagacaga

SEQ ID NO: 3526109 - RNA, 22 nt, Human
ccugccaguccuagcugcacag

SEQ ID NO: 3526110 - RNA, 18 nt, Human
ccugccagugccuuaccu

SEQ ID NO: 3526111 - RNA, 20 nt, Human
ccugccagugccuuaccucc

SEQ ID NO: 3526112 - RNA, 21 nt, Human
ccugccagugccuuaccuccu

SEQ ID NO: 3526113 - RNA, 22 nt, Human
ccugccagugccuuaccuccug

SEQ ID NO: 3526114 - RNA, 18 nt, Human
ccugccaucauguuuaca

SEQ ID NO: 3526115 - RNA, 19 nt, Human
ccugccaugccaggaaccu

SEQ ID NO: 3526116 - RNA, 20 nt, Human
ccugccauggaacuguuucc

SEQ ID NO: 3526117 - RNA, 22 nt, Human
ccugccauggaacuguuuccuu

SEQ ID NO: 3526118 - RNA, 19 nt, Human
ccugccauguaccuccccu

SEQ ID NO: 3526119 - RNA, 18 nt, Human
ccugccauuuaaaaaguu

SEQ ID NO: 3526120 - RNA, 17 nt, Human
ccugcccaagcccaggc

SEQ ID NO: 3526121 - RNA, 23 nt, Human
ccugcccaaugagacucuagggu

SEQ ID NO: 3526122 - RNA, 17 nt, Human
ccugcccacaccuccug

SEQ ID NO: 3526123 - RNA, 13 nt, Human
ccugcccacccgu

SEQ ID NO: 3526124 - RNA, 22 nt, Human
ccugcccacccguggagauggg

SEQ ID NO: 3526125 - RNA, 12 nt, Human
ccugcccaccug

SEQ ID NO: 3526126 - RNA, 13 nt, Human
ccugcccaccugg

SEQ ID NO: 3526127 - RNA, 15 nt, Human
ccugcccaccuggcc

SEQ ID NO: 3526128 - RNA, 13 nt, Human
ccugcccaccugu

SEQ ID NO: 3526129 - RNA, 14 nt, Human
ccugcccaccuguc

SEQ ID NO: 3526130 - RNA, 13 nt, Human
ccugcccagacaa

SEQ ID NO: 3526131 - RNA, 14 nt, Human
ccugcccagaucag

SEQ ID NO: 3526132 - RNA, 13 nt, Human
ccugcccaggccc

SEQ ID NO: 3526133 - RNA, 16 nt, Human
ccugcccaggccggcc

SEQ ID NO: 3526134 - RNA, 22 nt, Human
ccugcccagucccccaacccca

SEQ ID NO: 3526135 - RNA, 23 nt, Human
ccugcccagucccccaaccccag

SEQ ID NO: 3526136 - RNA, 11 nt, Human
ccugcccagug

SEQ ID NO: 3526137 - RNA, 12 nt, Human
ccugcccagugu

SEQ ID NO: 3526138 - RNA, 13 nt, Human
ccugcccaguguu

SEQ ID NO: 3526139 - RNA, 14 nt, Human
ccugccccaacucc

SEQ ID NO: 3526140 - RNA, 17 nt, Human
ccugccccaacuccuuc

SEQ ID NO: 3526141 - RNA, 19 nt, Human
ccugccccacaccuccucu

SEQ ID NO: 3526142 - RNA, 14 nt, Human
ccugccccagccca

SEQ ID NO: 3526143 - RNA, 16 nt, Human
ccugcccccacaccug

SEQ ID NO: 3526144 - RNA, 20 nt, Human
ccugcccccacaccuggccc

SEQ ID NO: 3526145 - RNA, 23 nt, Human
ccugcccccaccacggccacugg

SEQ ID NO: 3526146 - RNA, 18 nt, Human
ccugcccccaccccauuc

SEQ ID NO: 3526147 - RNA, 15 nt, Human
ccugcccccacuucc

SEQ ID NO: 3526148 - RNA, 23 nt, Human
cugguggagaaagcacugaccug

SEQ ID NO: 3526149 - RNA, 20 nt, Human
cugguggagaacucuggcuu

SEQ ID NO: 3526150 - RNA, 15 nt, Human
cugguggcacaggag

SEQ ID NO: 3526151 - RNA, 12 nt, Human
cugguggcagcu

SEQ ID NO: 3526152 - RNA, 18 nt, Human
cugguggcagugggagcu

SEQ ID NO: 3526153 - RNA, 20 nt, Human
cugguggcccgacagccugg

SEQ ID NO: 3526154 - RNA, 23 nt, Human
cugguggcccgacagccuggcac

SEQ ID NO: 3526155 - RNA, 17 nt, Human
cugguggcucuuugggc

SEQ ID NO: 3526156 - RNA, 21 nt, Human
cuggugggcaccaagagccaa

SEQ ID NO: 3526157 - RNA, 17 nt, Human
cuggugggccuccucug

SEQ ID NO: 3526158 - RNA, 21 nt, Human
cugguggggauaggccagccg

SEQ ID NO: 3526159 - RNA, 17 nt, Human
cugguggguccaggggc

SEQ ID NO: 3526160 - RNA, 17 nt, Human
cuggugggugaaagaaa

SEQ ID NO: 3526161 - RNA, 19 nt, Human
cuggugggugaaagaaauc

SEQ ID NO: 3526162 - RNA, 15 nt, Human
cuggugguauuuuca

SEQ ID NO: 3526163 - RNA, 12 nt, Human
cugguggucagc

SEQ ID NO: 3526164 - RNA, 15 nt, Human
cugguggucagcccu

SEQ ID NO: 3526165 - RNA, 16 nt, Human
cugguggucagcccua

SEQ ID NO: 3526166 - RNA, 20 nt, Human
cugguggucuguuggcaggc

SEQ ID NO: 3526167 - RNA, 22 nt, Human
cugguggucuguuggcaggcug

SEQ ID NO: 3526168 - RNA, 23 nt, Human
cugguggucuguuggcaggcugg

SEQ ID NO: 3526169 - RNA, 12 nt, Human
cugguguagcua

SEQ ID NO: 3526170 - RNA, 20 nt, Human
cugguguagcuacagagaaa

SEQ ID NO: 3526171 - RNA, 23 nt, Human
cugguguagcuacagagaaacca

SEQ ID NO: 3526172 - RNA, 15 nt, Human
cugguguauguguga

SEQ ID NO: 3526173 - RNA, 16 nt, Human
cuggugucaccccaga

SEQ ID NO: 3526174 - RNA, 23 nt, Human
cuggugucaccccagagccacac

SEQ ID NO: 3526175 - RNA, 14 nt, Human
cugguguccagcug

SEQ ID NO: 3526176 - RNA, 15 nt, Human
cugguguccugacca

SEQ ID NO: 3526177 - RNA, 20 nt, Human
cugguguccugaccacccuc

SEQ ID NO: 3526178 - RNA, 22 nt, Human
cugguguccugaccacccuccc

SEQ ID NO: 3526179 - RNA, 17 nt, Human
cuggugucugcuuucuc

SEQ ID NO: 3526180 - RNA, 17 nt, Human
cuggugugaccugaggg

SEQ ID NO: 3526181 - RNA, 18 nt, Human
cuggugugaccugagggc

SEQ ID NO: 3526182 - RNA, 18 nt, Human
cuggugugguacagagaa

SEQ ID NO: 3526183 - RNA, 23 nt, Human
cuggugugguacagagaagccag

SEQ ID NO: 3526184 - RNA, 14 nt, Human
cugguguuaacaga

SEQ ID NO: 3526185 - RNA, 22 nt, Human
cugguguuaacagaagggaggg

SEQ ID NO: 3526186 - RNA, 20 nt, Human
cugguguuggacaagcuucu

SEQ ID NO: 3526187 - RNA, 22 nt, Human
cugguguuggacaagcuucuga

SEQ ID NO: 3526188 - RNA, 20 nt, Human
cugguuaacagcaguccuuu

SEQ ID NO: 3526189 - RNA, 13 nt, Human
cugguuagcagag

SEQ ID NO: 3526190 - RNA, 15 nt, Human
cugguuagcucagcc

SEQ ID NO: 3526191 - RNA, 23 nt, Human
cugguuagcucagccccagccca

SEQ ID NO: 3526192 - RNA, 19 nt, Human
cugguuaggauggcaggac

SEQ ID NO: 3526193 - RNA, 19 nt, Human
cugguucaagcgauucucu

SEQ ID NO: 3526194 - RNA, 13 nt, Human
cugguuccagggu

SEQ ID NO: 3526195 - RNA, 16 nt, Human
cugguuccauggccuc

SEQ ID NO: 3526196 - RNA, 18 nt, Human
cugguucccguuucucca

SEQ ID NO: 3526197 - RNA, 21 nt, Human
cugguucccguuucuccaccu

SEQ ID NO: 3526198 - RNA, 23 nt, Human
cugguuccuaggggaaugagggg

SEQ ID NO: 3526199 - RNA, 12 nt, Human
cugguuccuccc

SEQ ID NO: 3526200 - RNA, 22 nt, Human
cugucaagaguaguuauauaau

SEQ ID NO: 3526201 - RNA, 13 nt, Human
cugucaaggcuca

SEQ ID NO: 3526202 - RNA, 22 nt, Human
cugucaaugagagcauaauuua

SEQ ID NO: 3526203 - RNA, 15 nt, Human
cugucaaugggaccu

SEQ ID NO: 3526204 - RNA, 17 nt, Human
cugucaauuucccugac

SEQ ID NO: 3526205 - RNA, 18 nt, Human
cugucaauuucccugacu

SEQ ID NO: 3526206 - RNA, 15 nt, Human
cugucacaaccaaga

SEQ ID NO: 3526207 - RNA, 15 nt, Human
cugucacaccagcca

SEQ ID NO: 3526208 - RNA, 19 nt, Human
cugucacaguaaaaauaaa

SEQ ID NO: 3526209 - RNA, 18 nt, Human
cugucacauugcauucua

SEQ ID NO: 3526210 - RNA, 14 nt, Human
cugucaccaagcuc

SEQ ID NO: 3526211 - RNA, 15 nt, Human
cugucaccaaggaaa

SEQ ID NO: 3526212 - RNA, 16 nt, Human
cugucaccaaggaaac

SEQ ID NO: 3526213 - RNA, 13 nt, Human
cugucacccaggc

SEQ ID NO: 3526214 - RNA, 14 nt, Human
cugucacccuccac

SEQ ID NO: 3526215 - RNA, 16 nt, Human
cugucacccuccaccu

SEQ ID NO: 3526216 - RNA, 17 nt, Human
cugucaccucucccacg

SEQ ID NO: 3526217 - RNA, 15 nt, Human
cugucaccucuuccg

SEQ ID NO: 3526218 - RNA, 14 nt, Human
cugucacggaggga

SEQ ID NO: 3526219 - RNA, 17 nt, Human
cugucacucaggcugga

SEQ ID NO: 3526220 - RNA, 14 nt, Human
cugucacucauugc

SEQ ID NO: 3526221 - RNA, 23 nt, Human
cugucacucauugcugagccucu

SEQ ID NO: 3526222 - RNA, 12 nt, Human
cugucacuuugc

SEQ ID NO: 3526223 - RNA, 17 nt, Human
cugucacuuugcucugg

SEQ ID NO: 3526224 - RNA, 18 nt, Human
cugucacuuugcucuggg

SEQ ID NO: 3526225 - RNA, 12 nt, Human
cugucagaaugc

SEQ ID NO: 3526226 - RNA, 21 nt, Human
cugucagauccaggagcucca

SEQ ID NO: 3526227 - RNA, 23 nt, Human
cugucagauccaggagcuccagu

SEQ ID NO: 3526228 - RNA, 16 nt, Human
cugucagaugagaaca

SEQ ID NO: 3526229 - RNA, 14 nt, Human
cugucagcaugaau

SEQ ID NO: 3526230 - RNA, 16 nt, Human
cugucagccgggcccu

SEQ ID NO: 3526231 - RNA, 18 nt, Human
cugucagccgggcccuga

SEQ ID NO: 3526232 - RNA, 22 nt, Human
cugucagccgggcccugaguaa

SEQ ID NO: 3526233 - RNA, 17 nt, Human
cugucagcgcagguuua

SEQ ID NO: 3526234 - RNA, 12 nt, Human
cugucagcugca

SEQ ID NO: 3526235 - RNA, 15 nt, Human
cugucaggaggcaga

SEQ ID NO: 3526236 - RNA, 16 nt, Human
cugucaggccuucagg

SEQ ID NO: 3526237 - RNA, 14 nt, Human
cugucauagaaauu

SEQ ID NO: 3526238 - RNA, 22 nt, Human
cugucauaugcucugauuuauc

SEQ ID NO: 3526239 - RNA, 15 nt, Human
cugucaucaauugaa

SEQ ID NO: 3526240 - RNA, 16 nt, Human
cugucaucaucauggc

SEQ ID NO: 3526241 - RNA, 17 nt, Human
cugucaucaucauggcc

SEQ ID NO: 3526242 - RNA, 19 nt, Human
cugucaucaucauggccag

SEQ ID NO: 3526243 - RNA, 21 nt, Human
cugucauccucaaagaaagug

SEQ ID NO: 3526244 - RNA, 14 nt, Human
cugucaucugaauu

SEQ ID NO: 3526245 - RNA, 22 nt, Human
cugucaucugagaaugaacaaa

SEQ ID NO: 3526246 - RNA, 14 nt, Human
cugucaucugugca

SEQ ID NO: 3526247 - RNA, 15 nt, Human
cugucaucugugcac

SEQ ID NO: 3526248 - RNA, 20 nt, Human
cugucaugaacauguuccug

SEQ ID NO: 3526249 - RNA, 13 nt, Human
cugucaugccccc

SEQ ID NO: 3526250 - RNA, 17 nt, Human
cugucaugccccccuca

SEQ ID NO: 3526251 - RNA, 19 nt, Human
cugucauucaaauggguga

SEQ ID NO: 3526252 - RNA, 16 nt, Human
cugucauucagaaaaa

SEQ ID NO: 3526253 - RNA, 15 nt, Human
cugucauugcacaua

SEQ ID NO: 3526254 - RNA, 14 nt, Human
cugucauuugagca

SEQ ID NO: 3526255 - RNA, 18 nt, Human
cugucauuugagcagggc

SEQ ID NO: 3526256 - RNA, 21 nt, Human
cugucauuugagcagggcuca

SEQ ID NO: 3526257 - RNA, 23 nt, Human
cugucauuugagcagggcucagc

SEQ ID NO: 3526258 - RNA, 20 nt, Human
cuguccaaacugccuaagcc

SEQ ID NO: 3526259 - RNA, 17 nt, Human
cuguccaaaggaggcug

SEQ ID NO: 3526260 - RNA, 18 nt, Human
cuguccaaaggaggcugg

SEQ ID NO: 3526261 - RNA, 15 nt, Human
cuguccaagcagauu

SEQ ID NO: 3526262 - RNA, 15 nt, Human
cuguccacacccagc

SEQ ID NO: 3526263 - RNA, 12 nt, Human
cuguccagacag

SEQ ID NO: 3526264 - RNA, 13 nt, Human
cuguccagacagc

SEQ ID NO: 3526265 - RNA, 16 nt, Human
cuguccagacagccug

SEQ ID NO: 3526266 - RNA, 13 nt, Human
cuguccagccugg

SEQ ID NO: 3526267 - RNA, 23 nt, Human
cuguccaggcacugcugcccagc

SEQ ID NO: 3526268 - RNA, 12 nt, Human
cuguccaucugc

SEQ ID NO: 3526269 - RNA, 22 nt, Human
cuguccaucugcccgccugccc

SEQ ID NO: 3526270 - RNA, 14 nt, Human
cuguccaugcuucu

SEQ ID NO: 3526271 - RNA, 22 nt, Human
cugucccagugccgagaaggaa

SEQ ID NO: 3526272 - RNA, 15 nt, Human
cugucccaugcaggc

SEQ ID NO: 3526273 - RNA, 18 nt, Human
cugucccaugcaggcccu

SEQ ID NO: 3526274 - RNA, 19 nt, Human
cugucccauggacacucca

SEQ ID NO: 3526275 - RNA, 15 nt, Human
cugucccauucccug

SEQ ID NO: 3526276 - RNA, 17 nt, Human
cugucccauucccuggg

SEQ ID NO: 3526277 - RNA, 18 nt, Human
cugucccauucccuggga

SEQ ID NO: 3526278 - RNA, 19 nt, Human
cuguccccacccuccacuc

SEQ ID NO: 3526279 - RNA, 15 nt, Human
cuguccccagccugg

SEQ ID NO: 3526280 - RNA, 16 nt, Human
cuguccccagccuggg

SEQ ID NO: 3526281 - RNA, 14 nt, Human
cugucccccagcuc

SEQ ID NO: 3526282 - RNA, 16 nt, Human
cugucccccagcucug

SEQ ID NO: 3526283 - RNA, 22 nt, Human
cugucccccugagaucagaguc

SEQ ID NO: 3526284 - RNA, 18 nt, Human
cuguccccgcacugggcu

SEQ ID NO: 3526285 - RNA, 22 nt, Human
cuguccccgcacugggcuuggg

SEQ ID NO: 3526286 - RNA, 15 nt, Human
cuguccccgcagccc

SEQ ID NO: 3526287 - RNA, 17 nt, Human
cuguccccgcagcccug

SEQ ID NO: 3526288 - RNA, 18 nt, Human
cuguccccguguugcaug

SEQ ID NO: 3526289 - RNA, 16 nt, Human
cuguccccucagcucc

SEQ ID NO: 3526290 - RNA, 17 nt, Human
cuguccccucagcucca

SEQ ID NO: 3526291 - RNA, 12 nt, Human
cuguccccucuu

SEQ ID NO: 3526292 - RNA, 19 nt, Human
cugucccuaguaaaaauac

SEQ ID NO: 3526293 - RNA, 16 nt, Human
cugucucuccaucugu

SEQ ID NO: 3526294 - RNA, 16 nt, Human
cugucucugccucccu

SEQ ID NO: 3526295 - RNA, 13 nt, Human
cugucucugcucg

SEQ ID NO: 3526296 - RNA, 21 nt, Human
cugucucugcucgcccuccuu

SEQ ID NO: 3526297 - RNA, 13 nt, Human
cugucucuggccu

SEQ ID NO: 3526298 - RNA, 14 nt, Human
cugucucugucaug

SEQ ID NO: 3526299 - RNA, 23 nt, Human
cugucucuuuaagggcaugccuu

SEQ ID NO: 3526300 - RNA, 14 nt, Human
cugucugauuggcu

SEQ ID NO: 3526301 - RNA, 15 nt, Human
cugucugcagccuug

SEQ ID NO: 3526302 - RNA, 11 nt, Human
cugucugcccc

SEQ ID NO: 3526303 - RNA, 14 nt, Human
cugucugcuccagc

SEQ ID NO: 3526304 - RNA, 17 nt, Human
cugucuggaagaugggg

SEQ ID NO: 3526305 - RNA, 18 nt, Human
cugucuggaagaugggga

SEQ ID NO: 3526306 - RNA, 20 nt, Human
cugucuggaggggagcucug

SEQ ID NO: 3526307 - RNA, 13 nt, Human
cugucuggcacag

SEQ ID NO: 3526308 - RNA, 15 nt, Human
cugucuggcacagcc

SEQ ID NO: 3526309 - RNA, 18 nt, Human
cugucuggcacagccugc

SEQ ID NO: 3526310 - RNA, 15 nt, Human
cugucuggccccccu

SEQ ID NO: 3526311 - RNA, 20 nt, Human
cugucuggcugaggauuuca

SEQ ID NO: 3526312 - RNA, 13 nt, Human
cugucugguggcc

SEQ ID NO: 3526313 - RNA, 18 nt, Human
cugucugguuuuaacaau

SEQ ID NO: 3526314 - RNA, 14 nt, Human
cugucuguaccuaa

SEQ ID NO: 3526315 - RNA, 12 nt, Human
cugucuguggcu

SEQ ID NO: 3526316 - RNA, 15 nt, Human
cugucuguuacacug

SEQ ID NO: 3526317 - RNA, 21 nt, Human
cugucuuaaacuaaaugugca

SEQ ID NO: 3526318 - RNA, 17 nt, Human
cugucuucaccugauuc

SEQ ID NO: 3526319 - RNA, 19 nt, Human
cugucuucauagcagauuu

SEQ ID NO: 3526320 - RNA, 13 nt, Human
cugucuucccagg

SEQ ID NO: 3526321 - RNA, 14 nt, Human
cugucuucccaggg

SEQ ID NO: 3526322 - RNA, 16 nt, Human
cugucuucccagggua

SEQ ID NO: 3526323 - RNA, 20 nt, Human
cugucuuccucaaaauaaag

SEQ ID NO: 3526324 - RNA, 16 nt, Human
cugucuuccugcauuc

SEQ ID NO: 3526325 - RNA, 11 nt, Human
cugucuuccuu

SEQ ID NO: 3526326 - RNA, 18 nt, Human
cugucuucugcuuuguug

SEQ ID NO: 3526327 - RNA, 13 nt, Human
cugucuucuggac

SEQ ID NO: 3526328 - RNA, 18 nt, Human
cugucuuguaauauuuug

SEQ ID NO: 3526329 - RNA, 19 nt, Human
cugucuuguaauauuuugu

SEQ ID NO: 3526330 - RNA, 16 nt, Human
cugucuuucagauaca

SEQ ID NO: 3526331 - RNA, 20 nt, Human
cugucuuucagauacauggu

SEQ ID NO: 3526332 - RNA, 11 nt, Human
cugucuuucca

SEQ ID NO: 3526333 - RNA, 13 nt, Human
cugucuuuccacu

SEQ ID NO: 3526334 - RNA, 19 nt, Human
cugucuuuccacucuggau

SEQ ID NO: 3526335 - RNA, 20 nt, Human
cugucuuuggaaaaauguuu

SEQ ID NO: 3526336 - RNA, 17 nt, Human
cugucuuuucuuugcca

SEQ ID NO: 3526337 - RNA, 21 nt, Human
cugucuuuucuuugccaucuc

SEQ ID NO: 3526338 - RNA, 19 nt, Human
cugugaaaccugugaagcu

SEQ ID NO: 3526339 - RNA, 15 nt, Human
cugugaaacuggcac

SEQ ID NO: 3526340 - RNA, 15 nt, Human
cugugaaaggaaaga

SEQ ID NO: 3526341 - RNA, 16 nt, Human
cugugaaaggaaagag

SEQ ID NO: 3526342 - RNA, 18 nt, Human
cugugaaaguacauuugg

SEQ ID NO: 3526343 - RNA, 14 nt, Human
cugugaaauaucau

SEQ ID NO: 3526344 - RNA, 14 nt, Human
cugugaaauuccca

SEQ ID NO: 3526345 - RNA, 19 nt, Human
cugugaacagagagacccu

SEQ ID NO: 3526346 - RNA, 21 nt, Human
cugugaacaggcugggcugcu

SEQ ID NO: 3526347 - RNA, 16 nt, Human
cugugaacgauuuaga

SEQ ID NO: 3526348 - RNA, 15 nt, Human
cugugaacugaaauu

SEQ ID NO: 3526349 - RNA, 15 nt, Human
cugugaacuugaaau

SEQ ID NO: 3526350 - RNA, 14 nt, Human
cugugaacuugggg

SEQ ID NO: 3526351 - RNA, 21 nt, Human
cugugaagaucucacucugcc

SEQ ID NO: 3526352 - RNA, 13 nt, Human
cugugaaguguua

SEQ ID NO: 3526353 - RNA, 21 nt, Human
cugugaauugagcugcagaaa

SEQ ID NO: 3526354 - RNA, 13 nt, Human
cugugacacacua

SEQ ID NO: 3526355 - RNA, 21 nt, Human
cugugacacacuacaccacac

SEQ ID NO: 3526356 - RNA, 18 nt, Human
cugugacaggcagcagag

SEQ ID NO: 3526357 - RNA, 21 nt, Human
cugugacaucucuauucccca

SEQ ID NO: 3526358 - RNA, 18 nt, Human
cugugacauggugccuga

SEQ ID NO: 3526359 - RNA, 20 nt, Human
cugugacauggugccugaga

SEQ ID NO: 3526360 - RNA, 14 nt, Human
cugugaccacaaca

SEQ ID NO: 3526361 - RNA, 17 nt, Human
cugugaccacaacauga

SEQ ID NO: 3526362 - RNA, 23 nt, Human
cugugaccaggaaggaagucagc

SEQ ID NO: 3526363 - RNA, 21 nt, Human
cugugacccacuucucaucac

SEQ ID NO: 3526364 - RNA, 23 nt, Human
cugugacccacuucucaucacac

SEQ ID NO: 3526365 - RNA, 15 nt, Human
cugugacccccagcu

SEQ ID NO: 3526366 - RNA, 17 nt, Human
cugugacccccagcucc

SEQ ID NO: 3526367 - RNA, 22 nt, Human
cugugaccucaggcacuagccu

SEQ ID NO: 3526368 - RNA, 14 nt, Human
cugugaccugcuga

SEQ ID NO: 3526369 - RNA, 21 nt, Human
cugugaccugcugagcucuga

SEQ ID NO: 3526370 - RNA, 16 nt, Human
cugugaccugugggga

SEQ ID NO: 3526371 - RNA, 21 nt, Human
cugugacugauguuaggcugg

SEQ ID NO: 3526372 - RNA, 18 nt, Human
cugugacuuaagaagccu

SEQ ID NO: 3526373 - RNA, 22 nt, Human
cugugacuucagcucuguuuua

SEQ ID NO: 3526374 - RNA, 23 nt, Human
cugugagaacccaguuucccguc

SEQ ID NO: 3526375 - RNA, 16 nt, Human
cugugagacccccaca

SEQ ID NO: 3526376 - RNA, 17 nt, Human
cugugagacccccacac

SEQ ID NO: 3526377 - RNA, 18 nt, Human
cugugagacucgagaacu

SEQ ID NO: 3526378 - RNA, 20 nt, Human
cugugagacucgagaacuuu

SEQ ID NO: 3526379 - RNA, 16 nt, Human
cugugagaugcuagaa

SEQ ID NO: 3526380 - RNA, 23 nt, Human
cugugagcaaggagcacaagcca

SEQ ID NO: 3526381 - RNA, 16 nt, Human
cugugagcaucacagu

SEQ ID NO: 3526382 - RNA, 14 nt, Human
cugugagcccagcu

SEQ ID NO: 3526383 - RNA, 17 nt, Human
cugugagcccagcuggg

SEQ ID NO: 3526384 - RNA, 21 nt, Human
cugugagccccugguccugag

SEQ ID NO: 3526385 - RNA, 12 nt, Human
cugugagccuug

SEQ ID NO: 3526386 - RNA, 17 nt, Human
cugugagccuuggcugu

SEQ ID NO: 3526387 - RNA, 20 nt, Human
cugugaggaaagcacacagu

SEQ ID NO: 3526388 - RNA, 17 nt, Human
cugugaggccccuggac

SEQ ID NO: 3526389 - RNA, 16 nt, Human
cugugaggcuguccug

SEQ ID NO: 3526390 - RNA, 22 nt, Human
cugugagggaggggaaaagcau

SEQ ID NO: 3526391 - RNA, 19 nt, Human
cugugaggggcucucucau

SEQ ID NO: 3526392 - RNA, 22 nt, Human
cugugaggugcagagugcccag

SEQ ID NO: 3526393 - RNA, 16 nt, Human
cugugagguuucccaa

SEQ ID NO: 3526394 - RNA, 22 nt, Human
cugugagguuucccaauggugu

SEQ ID NO: 3526395 - RNA, 18 nt, Human
cugugaguaaauauugag

SEQ ID NO: 3526396 - RNA, 21 nt, Human
cugugaguacuacaguccucc

SEQ ID NO: 3526397 - RNA, 22 nt, Human
cugugagucuuugguucuaagg

SEQ ID NO: 3526398 - RNA, 14 nt, Human
cugugaguguaagu

SEQ ID NO: 3526399 - RNA, 15 nt, Human
cugugaguucucccu

SEQ ID NO: 3526400 - RNA, 17 nt, Human
cugugaguucucccugu

SEQ ID NO: 3526401 - RNA, 17 nt, Human
cugugaguuuaaagcaa

SEQ ID NO: 3526402 - RNA, 15 nt, Human
cugugaucauuuauu

SEQ ID NO: 3526403 - RNA, 14 nt, Human
cugugaucuuauuu

SEQ ID NO: 3526404 - RNA, 17 nt, Human
cugugaucuuauuuuuc

SEQ ID NO: 3526405 - RNA, 18 nt, Human
cugugaucuuauuuuucu

SEQ ID NO: 3526406 - RNA, 19 nt, Human
cugugaugacauucccugc

SEQ ID NO: 3526407 - RNA, 15 nt, Human
cugugaugagcugau

SEQ ID NO: 3526408 - RNA, 18 nt, Human
cuguguugguguggccca

SEQ ID NO: 3526409 - RNA, 15 nt, Human
cuguguuguacagcu

SEQ ID NO: 3526410 - RNA, 21 nt, Human
cuguguuguauuaacaaaagu

SEQ ID NO: 3526411 - RNA, 19 nt, Human
cuguguugucucuagagca

SEQ ID NO: 3526412 - RNA, 14 nt, Human
cuguguuuaauuug

SEQ ID NO: 3526413 - RNA, 16 nt, Human
cuguguuuaauuugac

SEQ ID NO: 3526414 - RNA, 16 nt, Human
cuguguuuauaaaaua

SEQ ID NO: 3526415 - RNA, 17 nt, Human
cuguguuuauaaaauau

SEQ ID NO: 3526416 - RNA, 12 nt, Human
cuguguuuauuc

SEQ ID NO: 3526417 - RNA, 23 nt, Human
cuguguuuccaucucaaagaagg

SEQ ID NO: 3526418 - RNA, 15 nt, Human
cuguguuucuugccu

SEQ ID NO: 3526419 - RNA, 18 nt, Human
cuguguuucuugccucau

SEQ ID NO: 3526420 - RNA, 20 nt, Human
cuguguuugagcucugcagc

SEQ ID NO: 3526421 - RNA, 19 nt, Human
cuguguuugcuccccuucc

SEQ ID NO: 3526422 - RNA, 18 nt, Human
cuguguuuggcuuucagg

SEQ ID NO: 3526423 - RNA, 15 nt, Human
cuguguuuguuccua

SEQ ID NO: 3526424 - RNA, 22 nt, Human
cuguguuuugaaugguguugua

SEQ ID NO: 3526425 - RNA, 15 nt, Human
cuguuaaaagaugaa

SEQ ID NO: 3526426 - RNA, 19 nt, Human
cuguuaaaaucuauucugu

SEQ ID NO: 3526427 - RNA, 14 nt, Human
cuguuaaaaugcau

SEQ ID NO: 3526428 - RNA, 19 nt, Human
cuguuaaacuguuagcacu

SEQ ID NO: 3526429 - RNA, 17 nt, Human
cuguuaaauacaggaaa

SEQ ID NO: 3526430 - RNA, 16 nt, Human
cuguuaaauugcugug

SEQ ID NO: 3526431 - RNA, 12 nt, Human
cuguuaacugaa

SEQ ID NO: 3526432 - RNA, 19 nt, Human
cuguuaacugaauaccacu

SEQ ID NO: 3526433 - RNA, 15 nt, Human
cuguuaacuuauuca

SEQ ID NO: 3526434 - RNA, 14 nt, Human
cuguuaagagagga

SEQ ID NO: 3526435 - RNA, 19 nt, Human
cuguuaauguauuuguuca

SEQ ID NO: 3526436 - RNA, 14 nt, Human
cuguuacaguaaug

SEQ ID NO: 3526437 - RNA, 18 nt, Human
cuguuaccaugucacugu

SEQ ID NO: 3526438 - RNA, 17 nt, Human
aaauuuuuuuucauguu

SEQ ID NO: 3526439 - RNA, 17 nt, Human
aaauuuuuuuuguuuca

SEQ ID NO: 3526440 - RNA, 17 nt, Human
aaauuuuuuuuuuaaua

SEQ ID NO: 3526441 - RNA, 12 nt, Human
aacaaaaaccaa

SEQ ID NO: 3526442 - RNA, 12 nt, Human
aacaaaaagaac

SEQ ID NO: 3526443 - RNA, 13 nt, Human
aacaaaaagaaca

SEQ ID NO: 3526444 - RNA, 14 nt, Human
aacaaaaauuaggu

SEQ ID NO: 3526445 - RNA, 13 nt, Human
aacaaaaauuguc

SEQ ID NO: 3526446 - RNA, 9 nt, Human
aacaaaaca

SEQ ID NO: 3526447 - RNA, 12 nt, Human
aacaaaacaaaa

SEQ ID NO: 3526448 - RNA, 14 nt, Human
aacaaaacuauacu

SEQ ID NO: 3526449 - RNA, 17 nt, Human
aacaaaacugcauuuca

SEQ ID NO: 3526450 - RNA, 22 nt, Human
aacaaaagaagcccggcuccug

SEQ ID NO: 3526451 - RNA, 13 nt, Human
aacaaaauacauu

SEQ ID NO: 3526452 - RNA, 22 nt, Human
aacaaaauuuaguuuuuguucu

SEQ ID NO: 3526453 - RNA, 20 nt, Human
aacaaaauuugacuaauuuu

SEQ ID NO: 3526454 - RNA, 14 nt, Human
aacaaacagaugcu

SEQ ID NO: 3526455 - RNA, 18 nt, Human
aacaaacauugaugcuga

SEQ ID NO: 3526456 - RNA, 20 nt, Human
aacaaacauuguguugacau

SEQ ID NO: 3526457 - RNA, 18 nt, Human
aacaaacauuugcugaau

SEQ ID NO: 3526458 - RNA, 22 nt, Human
aacaaaccuguuucugcagcca

SEQ ID NO: 3526459 - RNA, 24 nt, Human
aacaaacugcacaugauuucacaa

SEQ ID NO: 3526460 - RNA, 12 nt, Human
aacaaagaaaua

SEQ ID NO: 3526461 - RNA, 17 nt, Human
aacaaagaguucaagaa

SEQ ID NO: 3526462 - RNA, 19 nt, Human
aacaaagauaucuuuucuu

SEQ ID NO: 3526463 - RNA, 22 nt, Human
aacaaagauaucuuuucuuuag

SEQ ID NO: 3526464 - RNA, 19 nt, Human
aacaaagcaauucuuucaa

SEQ ID NO: 3526465 - RNA, 15 nt, Human
aacaaagcacagugu

SEQ ID NO: 3526466 - RNA, 14 nt, Human
aacaaagcagccac

SEQ ID NO: 3526467 - RNA, 11 nt, Human
aacaaagccag

SEQ ID NO: 3526468 - RNA, 14 nt, Human
aacaaagccagaag

SEQ ID NO: 3526469 - RNA, 17 nt, Human
aacaaagccagaagcug

SEQ ID NO: 3526470 - RNA, 15 nt, Human
aacaaagcuguuaaa

SEQ ID NO: 3526471 - RNA, 17 nt, Human
aacaaagcuguuaaacu

SEQ ID NO: 3526472 - RNA, 19 nt, Human
aacaaagcuguuaaacugu

SEQ ID NO: 3526473 - RNA, 22 nt, Human
aacaaaggauuaauugcugcaa

SEQ ID NO: 3526474 - RNA, 19 nt, Human
aacaaaggcaaguuaagag

SEQ ID NO: 3526475 - RNA, 21 nt, Human
aacaaaggcaaguuaagagaa

SEQ ID NO: 3526476 - RNA, 17 nt, Human
aacaaaguggaaggaaa

SEQ ID NO: 3526477 - RNA, 18 nt, Human
aacaaaguggaaggaaag

SEQ ID NO: 3526478 - RNA, 13 nt, Human
aacaaaguuacua

SEQ ID NO: 3526479 - RNA, 23 nt, Human
aacaaaguuacuagguaacuuca

SEQ ID NO: 3526480 - RNA, 16 nt, Human
aacaaauaauuuuuaa

SEQ ID NO: 3526481 - RNA, 19 nt, Human
aacaaaucuaggaaaauau

SEQ ID NO: 3526482 - RNA, 20 nt, Human
aacaaaucuaggaaaauauu

SEQ ID NO: 3526483 - RNA, 23 nt, Human
aacaaaucuaggaaaauauuuug

SEQ ID NO: 3526484 - RNA, 14 nt, Human
aacaaaucuuccug

SEQ ID NO: 3526485 - RNA, 19 nt, Human
aacaaaugccaaauuaaaa

SEQ ID NO: 3526486 - RNA, 14 nt, Human
aacaaaugugaagg

SEQ ID NO: 3526487 - RNA, 21 nt, Human
aacaaauuagguuuuguacaa

SEQ ID NO: 3526488 - RNA, 23 nt, Human
aacaaauucugaauauuuuuuga

SEQ ID NO: 3526489 - RNA, 13 nt, Human
aacaacaaaaaau

SEQ ID NO: 3526490 - RNA, 21 nt, Human
aacaacaaauaauuuuuuagu

SEQ ID NO: 3526491 - RNA, 14 nt, Human
aacaacauauacaa

SEQ ID NO: 3526492 - RNA, 17 nt, Human
aacaacauuuauaugua

SEQ ID NO: 3526493 - RNA, 13 nt, Human
aacaaccuggaga

SEQ ID NO: 3526494 - RNA, 22 nt, Human
aacaaccuggccgcguuuagac

SEQ ID NO: 3526495 - RNA, 22 nt, Human
aacaacgcuugugaauguauuu

SEQ ID NO: 3526496 - RNA, 21 nt, Human
aacaacuccuagggccacuga

SEQ ID NO: 3526497 - RNA, 22 nt, Human
aacaacuuaauguucugaauaa

SEQ ID NO: 3526498 - RNA, 12 nt, Human
aacaagaaaaca

SEQ ID NO: 3526499 - RNA, 14 nt, Human
aacaagaaaacaua

SEQ ID NO: 3526500 - RNA, 12 nt, Human
aacaagaaagga

SEQ ID NO: 3526501 - RNA, 16 nt, Human
aacaagaaaggagagu

SEQ ID NO: 3526502 - RNA, 17 nt, Human
aacaagaaaggagaguc

SEQ ID NO: 3526503 - RNA, 16 nt, Human
aacaagaaaguuuccc

SEQ ID NO: 3526504 - RNA, 22 nt, Human
aacaagaaauaauagaaauguc

SEQ ID NO: 3526505 - RNA, 14 nt, Human
aacaagaagaugaa

SEQ ID NO: 3526506 - RNA, 21 nt, Human
aacaagaagccacagaccuag

SEQ ID NO: 3526507 - RNA, 11 nt, Human
aacaagaaugc

SEQ ID NO: 3526508 - RNA, 20 nt, Human
aacaagaccacguuucuaaa

SEQ ID NO: 3526509 - RNA, 23 nt, Human
aacaagaccucagugccuuccug

SEQ ID NO: 3526510 - RNA, 13 nt, Human
aacaagagugauu

SEQ ID NO: 3526511 - RNA, 17 nt, Human
aacaagaucuuucagga

SEQ ID NO: 3526512 - RNA, 17 nt, Human
aacaagaugaaauucca

SEQ ID NO: 3526513 - RNA, 20 nt, Human
aacaagauuuuaaagacaug

SEQ ID NO: 3526514 - RNA, 17 nt, Human
aacaagcauauaaaaug

SEQ ID NO: 3526515 - RNA, 22 nt, Human
aacaagccugacccuguaaaau

SEQ ID NO: 3526516 - RNA, 23 nt, Human
aacaagcuaauugggaguccagg

SEQ ID NO: 3526517 - RNA, 19 nt, Human
aacaagcuaggugcuaauu

SEQ ID NO: 3526518 - RNA, 15 nt, Human
aacaaggaugaauua

SEQ ID NO: 3526519 - RNA, 18 nt, Human
aacaaggcaaggcuguca

SEQ ID NO: 3526520 - RNA, 16 nt, Human
aacaaggcgaaauccu

SEQ ID NO: 3526521 - RNA, 16 nt, Human
aacaaggcuugcugca

SEQ ID NO: 3526522 - RNA, 13 nt, Human
aacaaguaccaaa

SEQ ID NO: 3526523 - RNA, 12 nt, Human
aacaaguauuug

SEQ ID NO: 3526524 - RNA, 20 nt, Human
aacaaguauuuguuaauuua

SEQ ID NO: 3526525 - RNA, 20 nt, Human
aacaaguuuuaauguauagu

SEQ ID NO: 3526526 - RNA, 17 nt, Human
aacaaguuuuucuguca

SEQ ID NO: 3526527 - RNA, 15 nt, Human
aacaauaaaacauua

SEQ ID NO: 3526528 - RNA, 12 nt, Human
aacaauaaaaga

SEQ ID NO: 3526529 - RNA, 19 nt, Human
aacaauaaaaguguccauu

SEQ ID NO: 3526530 - RNA, 14 nt, Human
aacaauaaaauuuu

SEQ ID NO: 3526531 - RNA, 15 nt, Human
aacaauaaagcaaua

SEQ ID NO: 3526532 - RNA, 21 nt, Human
aacaauaacuacuguguuccu

SEQ ID NO: 3526533 - RNA, 20 nt, Human
aacaauaagagcguuugccc

SEQ ID NO: 3526534 - RNA, 12 nt, Human
aacaauaccuga

SEQ ID NO: 3526535 - RNA, 20 nt, Human
aacaauaccugaaugcucug

SEQ ID NO: 3526536 - RNA, 22 nt, Human
aacaauccuagugcuuuccuuu

SEQ ID NO: 3526537 - RNA, 20 nt, Human
aacaaucuggaagaaaaaaa

SEQ ID NO: 3526538 - RNA, 16 nt, Human
aacaaucuguauauaa

SEQ ID NO: 3526539 - RNA, 18 nt, Human
aacaaugaaaacucuuug

SEQ ID NO: 3526540 - RNA, 12 nt, Human
aacaaugaaguu

SEQ ID NO: 3526541 - RNA, 21 nt, Human
aacaaugacuaauucuugcau

SEQ ID NO: 3526542 - RNA, 15 nt, Human
aacaaugauauaugg

SEQ ID NO: 3526543 - RNA, 17 nt, Human
aacaaugccuauuguaa

SEQ ID NO: 3526544 - RNA, 17 nt, Human
aacaaugcuguauuuua

SEQ ID NO: 3526545 - RNA, 22 nt, Human
aacaaugcuguauuuuaaaaga

SEQ ID NO: 3526546 - RNA, 17 nt, Human
aacaauggaaacugaau

SEQ ID NO: 3526547 - RNA, 17 nt, Human
aacaauggaguauucuc

SEQ ID NO: 3526548 - RNA, 13 nt, Human
aacaaugguaaca

SEQ ID NO: 3526549 - RNA, 21 nt, Human
aacaaugucaaggugcuguug

SEQ ID NO: 3526550 - RNA, 22 nt, Human
aacaaugucaaggugcuguugu

SEQ ID NO: 3526551 - RNA, 13 nt, Human
aacaauguuaagg

SEQ ID NO: 3526552 - RNA, 20 nt, Human
aacaauguuguuuuaagacu

SEQ ID NO: 3526553 - RNA, 14 nt, Human
aacaauucuaaaau

SEQ ID NO: 3526554 - RNA, 19 nt, Human
aacaauucuaaaaugauug

SEQ ID NO: 3526555 - RNA, 17 nt, Human
aacaauugaaguaaacu

SEQ ID NO: 3526556 - RNA, 23 nt, Human
aacaauuguguagccuuuuugua

SEQ ID NO: 3526557 - RNA, 13 nt, Human
aacaauuuaugaa

SEQ ID NO: 3526558 - RNA, 13 nt, Human
aacaauuuuaaug

SEQ ID NO: 3526559 - RNA, 21 nt, Human
aacaauuuucagauuugcaca

SEQ ID NO: 3526560 - RNA, 14 nt, Human
aacaauuuucugca

SEQ ID NO: 3526561 - RNA, 20 nt, Human
aacacaaagagaaaaagaaa

SEQ ID NO: 3526562 - RNA, 20 nt, Human
aacacaaagcuuuugcauau

SEQ ID NO: 3526563 - RNA, 21 nt, Human
aacacaaauuaugcuaagaau

SEQ ID NO: 3526564 - RNA, 18 nt, Human
aacacaagauugguguuu

SEQ ID NO: 3526565 - RNA, 19 nt, Human
aacacaagauugguguuuu

SEQ ID NO: 3526566 - RNA, 13 nt, Human
aacacaagcaaaa

SEQ ID NO: 3526567 - RNA, 16 nt, Human
aacacaagcaaaaaaa

SEQ ID NO: 3526568 - RNA, 21 nt, Human
aacacaaggucauggccacac

SEQ ID NO: 3526569 - RNA, 21 nt, Human
aacacacacacacacaacaaa

SEQ ID NO: 3526570 - RNA, 21 nt, Human
aacacacaggugcaacagacu

SEQ ID NO: 3526571 - RNA, 14 nt, Human
aacacacauaaagg

SEQ ID NO: 3526572 - RNA, 15 nt, Human
aacacacauaaagga

SEQ ID NO: 3526573 - RNA, 12 nt, Human
aacacaccuggu

SEQ ID NO: 3526574 - RNA, 13 nt, Human
cuguugcacccag

SEQ ID NO: 3526575 - RNA, 18 nt, Human
cuguugcacccagcccug

SEQ ID NO: 3526576 - RNA, 21 nt, Human
cuguugcacccagcccugguc

SEQ ID NO: 3526577 - RNA, 23 nt, Human
cuguugcacccagcccuggucuc

SEQ ID NO: 3526578 - RNA, 15 nt, Human
cuguugcacgugugu

SEQ ID NO: 3526579 - RNA, 12 nt, Human
cuguugcaguga

SEQ ID NO: 3526580 - RNA, 12 nt, Human
cuguugcauggg

SEQ ID NO: 3526581 - RNA, 21 nt, Human
cuguugccaggcuggagugca

SEQ ID NO: 3526582 - RNA, 18 nt, Human
cuguugccauggugaugg

SEQ ID NO: 3526583 - RNA, 18 nt, Human
cuuaauacuaccuugaaa

SEQ ID NO: 3526584 - RNA, 12 nt, Human
cuuaauauaaau

SEQ ID NO: 3526585 - RNA, 23 nt, Human
cuuaauauauuucuaaauguuug

SEQ ID NO: 3526586 - RNA, 15 nt, Human
cuuaauauuucuuca

SEQ ID NO: 3526587 - RNA, 15 nt, Human
cuuaauauuuuuaca

SEQ ID NO: 3526588 - RNA, 16 nt, Human
cuuaauauuuuuacau

SEQ ID NO: 3526589 - RNA, 18 nt, Human
cuuaaucaauuaauuuuu

SEQ ID NO: 3526590 - RNA, 21 nt, Human
cuuaaucagauagauauuccu

SEQ ID NO: 3526591 - RNA, 22 nt, Human
cuuaaucagguccucagagaau

SEQ ID NO: 3526592 - RNA, 18 nt, Human
cuuaauccagcugaugag

SEQ ID NO: 3526593 - RNA, 14 nt, Human
cuuaaucuaaaugg

SEQ ID NO: 3526594 - RNA, 14 nt, Human
cuuaaucuuugaaa

SEQ ID NO: 3526595 - RNA, 18 nt, Human
cuuaaucuuuucacaaau

SEQ ID NO: 3526596 - RNA, 20 nt, Human
cuuaaucuuuucacaaauaa

SEQ ID NO: 3526597 - RNA, 20 nt, Human
cuuaaugaaguuugaauguu

SEQ ID NO: 3526598 - RNA, 19 nt, Human
cuuaaugagacuuuaaaag

SEQ ID NO: 3526599 - RNA, 21 nt, Human
cuuaaugauccguuccauugc

SEQ ID NO: 3526600 - RNA, 18 nt, Human
cuuaaugccacuaaauug

SEQ ID NO: 3526601 - RNA, 16 nt, Human
cuuaauggcugauaau

SEQ ID NO: 3526602 - RNA, 20 nt, Human
cuuaauggcugauaauuuua

SEQ ID NO: 3526603 - RNA, 21 nt, Human
cuuaauguauguuaccaaaaa

SEQ ID NO: 3526604 - RNA, 22 nt, Human
cuuaaugugauuacugcucuau

SEQ ID NO: 3526605 - RNA, 13 nt, Human
cuuaauguucuua

SEQ ID NO: 3526606 - RNA, 20 nt, Human
cuuaauuaaaagaauauuuu

SEQ ID NO: 3526607 - RNA, 13 nt, Human
cuuaauuaaguaa

SEQ ID NO: 3526608 - RNA, 14 nt, Human
cuuaauuaauuuga

SEQ ID NO: 3526609 - RNA, 18 nt, Human
cuuaauuaauuugauuaa

SEQ ID NO: 3526610 - RNA, 17 nt, Human
cuuaauuacuuaaaaaa

SEQ ID NO: 3526611 - RNA, 20 nt, Human
cuuaauuauuauaaaaauau

SEQ ID NO: 3526612 - RNA, 18 nt, Human
cuuaauuauuauuugugu

SEQ ID NO: 3526613 - RNA, 19 nt, Human
cuuaauuauuauuuguguu

SEQ ID NO: 3526614 - RNA, 20 nt, Human
cuuaauugccaccucuaaca

SEQ ID NO: 3526615 - RNA, 16 nt, Human
cuuaauuuauuauuaa

SEQ ID NO: 3526616 - RNA, 13 nt, Human
cuuaauuuccuuu

SEQ ID NO: 3526617 - RNA, 17 nt, Human
cuuaauuuccuuuuuga

SEQ ID NO: 3526618 - RNA, 20 nt, Human
cuuaauuuccuuuuugacac

SEQ ID NO: 3526619 - RNA, 12 nt, Human
cuuaauuuggaa

SEQ ID NO: 3526620 - RNA, 18 nt, Human
cuuaauuuggaaacuaau

SEQ ID NO: 3526621 - RNA, 20 nt, Human
cuuaauuuggaaacuaauaa

SEQ ID NO: 3526622 - RNA, 22 nt, Human
cuuaauuuggaaacuaauaaaa

SEQ ID NO: 3526623 - RNA, 14 nt, Human
cuuacaaaaacacu

SEQ ID NO: 3526624 - RNA, 20 nt, Human
cuuacaaaugauugcuuuua

SEQ ID NO: 3526625 - RNA, 22 nt, Human
cuuacaaaugauugcuuuuaaa

SEQ ID NO: 3526626 - RNA, 16 nt, Human
cuuacaauucccugcu

SEQ ID NO: 3526627 - RNA, 19 nt, Human
cuuacaauucccugcuguc

SEQ ID NO: 3526628 - RNA, 16 nt, Human
cuuauuccauauuaga

SEQ ID NO: 3526629 - RNA, 22 nt, Human
cuuauuccauauuagaaaacuu

SEQ ID NO: 3526630 - RNA, 14 nt, Human
cuuauuccaugacu

SEQ ID NO: 3526631 - RNA, 17 nt, Human
cuuauuccaugacugcu

SEQ ID NO: 3526632 - RNA, 18 nt, Human
cuuauuccaugacugcuu

SEQ ID NO: 3526633 - RNA, 22 nt, Human
cuuauugacaaccgagaagguu

SEQ ID NO: 3526634 - RNA, 14 nt, Human
cuuauugaccauuu

SEQ ID NO: 3526635 - RNA, 16 nt, Human
cuuauugaccauuuuu

SEQ ID NO: 3526636 - RNA, 13 nt, Human
cuuauugcccacg

SEQ ID NO: 3526637 - RNA, 14 nt, Human
cuuauugccucacu

SEQ ID NO: 3526638 - RNA, 19 nt, Human
cuuauugccucacuucagg

SEQ ID NO: 3526639 - RNA, 16 nt, Human
cuuauugcgcugcuac

SEQ ID NO: 3526640 - RNA, 14 nt, Human
cuuauugcugauuu

SEQ ID NO: 3526641 - RNA, 20 nt, Human
cuuauugcuuugaaacuaga

SEQ ID NO: 3526642 - RNA, 15 nt, Human
cuuauuggaacucug

SEQ ID NO: 3526643 - RNA, 18 nt, Human
cuuauuggaacucugcuu

SEQ ID NO: 3526644 - RNA, 13 nt, Human
cuuauuguaccuc

SEQ ID NO: 3526645 - RNA, 18 nt, Human
cuuauuguaccucucuua

SEQ ID NO: 3526646 - RNA, 23 nt, Human
cuuauuguagcauccuggaauau

SEQ ID NO: 3526647 - RNA, 17 nt, Human
cuuauuguuccaagaca

SEQ ID NO: 3526648 - RNA, 20 nt, Human
cuuauuguuccaagacauug

SEQ ID NO: 3526649 - RNA, 21 nt, Human
cuuauuguuccaagacauugu

SEQ ID NO: 3526650 - RNA, 14 nt, Human
cuuauuuaaauaga

SEQ ID NO: 3526651 - RNA, 21 nt, Human
cuuauuuauucauauuuucuu

SEQ ID NO: 3526652 - RNA, 14 nt, Human
cuuauuuauuguau

SEQ ID NO: 3526653 - RNA, 15 nt, Human
cuuauuucaucauuc

SEQ ID NO: 3526654 - RNA, 18 nt, Human
cuuauuucaucauucacu

SEQ ID NO: 3526655 - RNA, 14 nt, Human
cuuauuucauuucu

SEQ ID NO: 3526656 - RNA, 23 nt, Human
cuuauuugcugccacaccugagc

SEQ ID NO: 3526657 - RNA, 15 nt, Human
cuuauuugcuucauu

SEQ ID NO: 3526658 - RNA, 18 nt, Human
cuuauuuggcgugacccg

SEQ ID NO: 3526659 - RNA, 12 nt, Human
cuuauuuuaaug

SEQ ID NO: 3526660 - RNA, 14 nt, Human
cuuauuuucaagaa

SEQ ID NO: 3526661 - RNA, 15 nt, Human
cuuauuuuuucccaa

SEQ ID NO: 3526662 - RNA, 19 nt, Human
cuuauuuuuucccaaagcc

SEQ ID NO: 3526663 - RNA, 20 nt, Human
cuucaaaaguaaugccucug

SEQ ID NO: 3526664 - RNA, 16 nt, Human
cuucaaaaguauuuuc

SEQ ID NO: 3526665 - RNA, 22 nt, Human
cuucaaaauauugagcagaauu

SEQ ID NO: 3526666 - RNA, 15 nt, Human
cuucaaaauguauau

SEQ ID NO: 3526667 - RNA, 20 nt, Human
cuucaaaauguuaucuucuc

SEQ ID NO: 3526668 - RNA, 14 nt, Human
cuucaaacuacuuu

SEQ ID NO: 3526669 - RNA, 13 nt, Human
cuucaaagucuca

SEQ ID NO: 3526670 - RNA, 20 nt, Human
cuucaaagucucaaugaaau

SEQ ID NO: 3526671 - RNA, 13 nt, Human
cuucaaauuagaa

SEQ ID NO: 3526672 - RNA, 23 nt, Human
cuucaacagacccccucuagaaa

SEQ ID NO: 3526673 - RNA, 23 nt, Human
cuucaacauaacccacuugucac

SEQ ID NO: 3526674 - RNA, 19 nt, Human
cuucaacaucaauguucau

SEQ ID NO: 3526675 - RNA, 22 nt, Human
cuucaacaucaauguucauugu

SEQ ID NO: 3526676 - RNA, 17 nt, Human
cuucaacauccugccag

SEQ ID NO: 3526677 - RNA, 15 nt, Human
cuucaacauuuacau

SEQ ID NO: 3526678 - RNA, 20 nt, Human
cuucaaccauuccccauggg

SEQ ID NO: 3526679 - RNA, 22 nt, Human
cuucaacuccucgacaucacug

SEQ ID NO: 3526680 - RNA, 23 nt, Human
cuucaacugaccagccuccaugc

SEQ ID NO: 3526681 - RNA, 18 nt, Human
cuucaacuugugccuggg

SEQ ID NO: 3526682 - RNA, 18 nt, Human
cuucaagaaaacaggcac

SEQ ID NO: 3526683 - RNA, 18 nt, Human
cuucaagcaccagggaag

SEQ ID NO: 3526684 - RNA, 13 nt, Human
cuucaagcucuga

SEQ ID NO: 3526685 - RNA, 14 nt, Human
cuucaagcucugag

SEQ ID NO: 3526686 - RNA, 18 nt, Human
cuucaagcucugagggaa

SEQ ID NO: 3526687 - RNA, 18 nt, Human
cuucaagcugcuuuuugu

SEQ ID NO: 3526688 - RNA, 10 nt, Human
cuucaaggau

SEQ ID NO: 3526689 - RNA, 22 nt, Human
cuucaaggauccugagccagau

SEQ ID NO: 3526690 - RNA, 14 nt, Human
cuucaaggcuucag

SEQ ID NO: 3526691 - RNA, 17 nt, Human
cuucaaggcuucagucu

SEQ ID NO: 3526692 - RNA, 19 nt, Human
cuucaaggcuucagucuca

SEQ ID NO: 3526693 - RNA, 14 nt, Human
cuucaagucugugc

SEQ ID NO: 3526694 - RNA, 15 nt, Human
cuucaagucugugcc

SEQ ID NO: 3526695 - RNA, 16 nt, Human
cuucaaguuagcucag

SEQ ID NO: 3526696 - RNA, 16 nt, Human
cuucaauaauugucca

SEQ ID NO: 3526697 - RNA, 23 nt, Human
cuucaaucaauaacagccgcucc

SEQ ID NO: 3526698 - RNA, 18 nt, Human
cuucaauuuauugcacaa

SEQ ID NO: 3526699 - RNA, 19 nt, Human
cuucaauuuguauaaaaug

SEQ ID NO: 3526700 - RNA, 12 nt, Human
cuucacaacaga

SEQ ID NO: 3526701 - RNA, 14 nt, Human
cuucacacagacac

SEQ ID NO: 3526702 - RNA, 13 nt, Human
cuucacacugcaa

SEQ ID NO: 3526703 - RNA, 23 nt, Human
cuucacagaugggugcuuggagg

SEQ ID NO: 3526704 - RNA, 16 nt, Human
cuucacagcucugugu

SEQ ID NO: 3526705 - RNA, 14 nt, Human
cuucacauaguuuu

SEQ ID NO: 3526706 - RNA, 23 nt, Human
cuucacauauugauuuccguuaa

SEQ ID NO: 3526707 - RNA, 21 nt, Human
cuucacauccuguguuucuag

SEQ ID NO: 3526708 - RNA, 23 nt, Human
cuucaccaauaaguauucugugu

SEQ ID NO: 3526709 - RNA, 17 nt, Human
cuucaccauuuggcaau

SEQ ID NO: 3526710 - RNA, 22 nt, Human
cuucacccagcuaaucuguagg

SEQ ID NO: 3526711 - RNA, 14 nt, Human
cuucacccaggccu

SEQ ID NO: 3526712 - RNA, 17 nt, Human
cuucacccaggccuaug

SEQ ID NO: 3526713 - RNA, 14 nt, Human
cuucaccccagugg

SEQ ID NO: 3526714 - RNA, 17 nt, Human
cuucaccccggcaggcc

SEQ ID NO: 3526715 - RNA, 20 nt, Human
cuucaccccggcaggcccug

SEQ ID NO: 3526716 - RNA, 19 nt, Human
cuucaccuaagucucugug

SEQ ID NO: 3526717 - RNA, 15 nt, Human
cuucaccucacugaa

SEQ ID NO: 3526718 - RNA, 17 nt, Human
cuucaccuucaccuuca

SEQ ID NO: 3526719 - RNA, 15 nt, Human
cuucacgcccuuggc

SEQ ID NO: 3526720 - RNA, 15 nt, Human
cuucacggaagagcc

SEQ ID NO: 3526721 - RNA, 19 nt, Human
cuucacggaagagccuugc

SEQ ID NO: 3526722 - RNA, 21 nt, Human
cuucacguagaacauugguau

SEQ ID NO: 3526723 - RNA, 12 nt, Human
cuucacuacuuu

SEQ ID NO: 3526724 - RNA, 15 nt, Human
cuucacucacuguca

SEQ ID NO: 3526725 - RNA, 14 nt, Human
cuucacuccggugu

SEQ ID NO: 3526726 - RNA, 14 nt, Human
cuucacuccugcug

SEQ ID NO: 3526727 - RNA, 17 nt, Human
cuucacucgcccccggg

SEQ ID NO: 3526728 - RNA, 20 nt, Human
ccuugacuuugcuccucaca

SEQ ID NO: 3526729 - RNA, 13 nt, Human
ccuugacuuuuua

SEQ ID NO: 3526730 - RNA, 18 nt, Human
ccuugagaagauucuucc

SEQ ID NO: 3526731 - RNA, 11 nt, Human
ccuugagacca

SEQ ID NO: 3526732 - RNA, 16 nt, Human
ccuugagaccucagcc

SEQ ID NO: 3526733 - RNA, 16 nt, Human
ccuugagagaccaggc

SEQ ID NO: 3526734 - RNA, 21 nt, Human
ccuugagagaccaggcaaagc

SEQ ID NO: 3526735 - RNA, 13 nt, Human
ccuugagcccugg

SEQ ID NO: 3526736 - RNA, 14 nt, Human
ccuugagcccuggc

SEQ ID NO: 3526737 - RNA, 17 nt, Human
ccuugagcccuggcugu

SEQ ID NO: 3526738 - RNA, 12 nt, Human
ccuugagcugag

SEQ ID NO: 3526739 - RNA, 16 nt, Human
ccuugaggggagccag

SEQ ID NO: 3526740 - RNA, 18 nt, Human
ccuugaggggagccagga

SEQ ID NO: 3526741 - RNA, 21 nt, Human
ccuugagggugcuuguucccu

SEQ ID NO: 3526742 - RNA, 17 nt, Human
ccuugaggucucagccc

SEQ ID NO: 3526743 - RNA, 20 nt, Human
ccuugaguugauucagcucu

SEQ ID NO: 3526744 - RNA, 15 nt, Human
ccuugauauuuguau

SEQ ID NO: 3526745 - RNA, 11 nt, Human
ccuugaucauu

SEQ ID NO: 3526746 - RNA, 14 nt, Human
ccuugaucuguaua

SEQ ID NO: 3526747 - RNA, 15 nt, Human
ccuugaugcacagag

SEQ ID NO: 3526748 - RNA, 19 nt, Human
ccuugauggagauauuuac

SEQ ID NO: 3526749 - RNA, 19 nt, Human
ccuugauucccuuguuauu

SEQ ID NO: 3526750 - RNA, 14 nt, Human
ccuugauugggacu

SEQ ID NO: 3526751 - RNA, 21 nt, Human
ccuugauuuaucacacaaagc

SEQ ID NO: 3526752 - RNA, 23 nt, Human
ccuugcaaagaccauaaagucca

SEQ ID NO: 3526753 - RNA, 17 nt, Human
ccuugcaacacacagac

SEQ ID NO: 3526754 - RNA, 17 nt, Human
ccuugcaacuucauguc

SEQ ID NO: 3526755 - RNA, 17 nt, Human
ccuugcaccccucacuc

SEQ ID NO: 3526756 - RNA, 16 nt, Human
ccuugcaccugcaucc

SEQ ID NO: 3526757 - RNA, 17 nt, Human
ccuugcagaacugccau

SEQ ID NO: 3526758 - RNA, 17 nt, Human
ccuugcaguucagcacc

SEQ ID NO: 3526759 - RNA, 22 nt, Human
ccuugcaguucagcaccacccu

SEQ ID NO: 3526760 - RNA, 24 nt, Human
ccuugccaccccacccucccugga

SEQ ID NO: 3526761 - RNA, 19 nt, Human
ccuugccacuuugcacgac

SEQ ID NO: 3526762 - RNA, 20 nt, Human
ccuugccagcugcugagccg

SEQ ID NO: 3526763 - RNA, 23 nt, Human
ccuugccagcugcugagccgcag

SEQ ID NO: 3526764 - RNA, 18 nt, Human
ccuugcccacuccugcuc

SEQ ID NO: 3526765 - RNA, 21 nt, Human
ccuugcccacuccugcucugc

SEQ ID NO: 3526766 - RNA, 13 nt, Human
ccuugcccagggc

SEQ ID NO: 3526767 - RNA, 21 nt, Human
ccuugcccagggcucagccug

SEQ ID NO: 3526768 - RNA, 18 nt, Human
ccuugcccggauucuggg

SEQ ID NO: 3526769 - RNA, 19 nt, Human
ccuugcccggauucuggga

SEQ ID NO: 3526770 - RNA, 16 nt, Human
ccuugcccugaccucc

SEQ ID NO: 3526771 - RNA, 15 nt, Human
ccuugcccuugcccu

SEQ ID NO: 3526772 - RNA, 16 nt, Human
ccuugcccuugcccug

SEQ ID NO: 3526773 - RNA, 23 nt, Human
ccuugccuaaauuuaaugcugcc

SEQ ID NO: 3526774 - RNA, 16 nt, Human
ccuugccuccugugua

SEQ ID NO: 3526775 - RNA, 11 nt, Human
ccuugccuggu

SEQ ID NO: 3526776 - RNA, 14 nt, Human
ccuugccugugcca

SEQ ID NO: 3526777 - RNA, 15 nt, Human
ccuugcggcuccuca

SEQ ID NO: 3526778 - RNA, 16 nt, Human
ccuugcggcuccucag

SEQ ID NO: 3526779 - RNA, 14 nt, Human
ccuugcuaauuuuc

SEQ ID NO: 3526780 - RNA, 18 nt, Human
ccuugcuaccacggccuc

SEQ ID NO: 3526781 - RNA, 11 nt, Human
ccuugcuaccu

SEQ ID NO: 3526782 - RNA, 17 nt, Human
ccuugcuaccucaaggg

SEQ ID NO: 3526783 - RNA, 21 nt, Human
ccuugcuccuccuucugcugc

SEQ ID NO: 3526784 - RNA, 21 nt, Human
ccuugcuccuggccuugcuga

SEQ ID NO: 3526785 - RNA, 20 nt, Human
ccuugcucuccccugcccug

SEQ ID NO: 3526786 - RNA, 14 nt, Human
ccuugcucucccuc

SEQ ID NO: 3526787 - RNA, 15 nt, Human
ccuugcucucccucu

SEQ ID NO: 3526788 - RNA, 13 nt, Human
cuuagcugggaga

SEQ ID NO: 3526789 - RNA, 15 nt, Human
cuuagcuuagaccuc

SEQ ID NO: 3526790 - RNA, 17 nt, Human
cuuagcuuagaccucag

SEQ ID NO: 3526791 - RNA, 18 nt, Human
cuuagcuuagaccucagc

SEQ ID NO: 3526792 - RNA, 21 nt, Human
cuuagcuuagaccucagccug

SEQ ID NO: 3526793 - RNA, 16 nt, Human
cuuagcuuaucaauuu

SEQ ID NO: 3526794 - RNA, 11 nt, Human
cuuagcuucag

SEQ ID NO: 3526795 - RNA, 23 nt, Human
cuuagcuucuauuauagccacau

SEQ ID NO: 3526796 - RNA, 18 nt, Human
cuuagcuuugcucugcca

SEQ ID NO: 3526797 - RNA, 22 nt, Human
cuuaggaagagaaaccagggag

SEQ ID NO: 3526798 - RNA, 18 nt, Human
cuuaggagcagagcucug

SEQ ID NO: 3526799 - RNA, 17 nt, Human
cuuaggcaugcacagcu

SEQ ID NO: 3526800 - RNA, 22 nt, Human
cuuaggcauguaggacccugca

SEQ ID NO: 3526801 - RNA, 21 nt, Human
cuuaggcccggagcugccccu

SEQ ID NO: 3526802 - RNA, 20 nt, Human
cuuagggaagcuggccugag

SEQ ID NO: 3526803 - RNA, 23 nt, Human
cuuagggacaggaccccagcucu

SEQ ID NO: 3526804 - RNA, 23 nt, Human
cuuagggacuacccauagacaug

SEQ ID NO: 3526805 - RNA, 15 nt, Human
cuuagggcaccaggg

SEQ ID NO: 3526806 - RNA, 15 nt, Human
cuuagggcccuggag

SEQ ID NO: 3526807 - RNA, 17 nt, Human
cuuagggucucagggug

SEQ ID NO: 3526808 - RNA, 16 nt, Human
cuuaggguuuggagcu

SEQ ID NO: 3526809 - RNA, 18 nt, Human
cuuagguacuuauuccag

SEQ ID NO: 3526810 - RNA, 20 nt, Human
cuuaggugauccacucgccu

SEQ ID NO: 3526811 - RNA, 21 nt, Human
cuuagguggcaagcugugacu

SEQ ID NO: 3526812 - RNA, 17 nt, Human
cuuagguuggcaaaaag

SEQ ID NO: 3526813 - RNA, 21 nt, Human
cuuagguuggcaaaaaggcag

SEQ ID NO: 3526814 - RNA, 23 nt, Human
cuuagguuggcaaaaaggcagga

SEQ ID NO: 3526815 - RNA, 19 nt, Human
cuuaguaaaauuuauuuca

SEQ ID NO: 3526816 - RNA, 22 nt, Human
cuuaguaucucaucaacaaaga

SEQ ID NO: 3526817 - RNA, 16 nt, Human
cuuagucacugagaca

SEQ ID NO: 3526818 - RNA, 18 nt, Human
cuuagucacugagacagc

SEQ ID NO: 3526819 - RNA, 23 nt, Human
cuuagucccccaacucugagccc

SEQ ID NO: 3526820 - RNA, 17 nt, Human
cuuagugaaauuacuuc

SEQ ID NO: 3526821 - RNA, 15 nt, Human
cuuagugauguaauu

SEQ ID NO: 3526822 - RNA, 19 nt, Human
cuuagugcggacaaguuuu

SEQ ID NO: 3526823 - RNA, 13 nt, Human
cuuagugggccag

SEQ ID NO: 3526824 - RNA, 17 nt, Human
cuuagugguuccccacc

SEQ ID NO: 3526825 - RNA, 18 nt, Human
cuuaguguuucugugcau

SEQ ID NO: 3526826 - RNA, 16 nt, Human
cuuaguuaucagcuuu

SEQ ID NO: 3526827 - RNA, 23 nt, Human
cuuaguucaaguccugccucuua

SEQ ID NO: 3526828 - RNA, 21 nt, Human
cuuauaaaacagaguaaucuu

SEQ ID NO: 3526829 - RNA, 24 nt, Human
cuuauaaaguggaaguauguauau

SEQ ID NO: 3526830 - RNA, 13 nt, Human
cuuauaaauauga

SEQ ID NO: 3526831 - RNA, 17 nt, Human
cuuauaaauaugaagcu

SEQ ID NO: 3526832 - RNA, 21 nt, Human
cuuauaaaucauauugaugaa

SEQ ID NO: 3526833 - RNA, 23 nt, Human
cuuauaagguguuuucuguguaa

SEQ ID NO: 3526834 - RNA, 14 nt, Human
cuuauaauaaagga

SEQ ID NO: 3526835 - RNA, 16 nt, Human
cuuauaauaaaggacu

SEQ ID NO: 3526836 - RNA, 17 nt, Human
cuuauaauaaaggacug

SEQ ID NO: 3526837 - RNA, 13 nt, Human
cuuauaauacucu

SEQ ID NO: 3526838 - RNA, 15 nt, Human
cuuauaaugggcucu

SEQ ID NO: 3526839 - RNA, 22 nt, Human
cuuauaauucuuucaauacaga

SEQ ID NO: 3526840 - RNA, 21 nt, Human
cuuauaauuguucucagaauc

SEQ ID NO: 3526841 - RNA, 18 nt, Human
cuuauacuguacaauaaa

SEQ ID NO: 3526842 - RNA, 19 nt, Human
cuuauacuguacaauaaaa

SEQ ID NO: 3526843 - RNA, 16 nt, Human
cuuauagaauauuuau

SEQ ID NO: 3526844 - RNA, 15 nt, Human
cuuauagcacuuuga

SEQ ID NO: 3526845 - RNA, 22 nt, Human
cuuauagcacuuugaaauaccu

SEQ ID NO: 3526846 - RNA, 13 nt, Human
cuuauagguggcc

SEQ ID NO: 3526847 - RNA, 13 nt, Human
cuuauaguacaug

SEQ ID NO: 3526848 - RNA, 15 nt, Human
cuuauaguuacugug

SEQ ID NO: 3526849 - RNA, 20 nt, Human
cuuauauaguuuacuauuuu

SEQ ID NO: 3526850 - RNA, 21 nt, Human
cuuauaucuggccucugcuuu

SEQ ID NO: 3526851 - RNA, 17 nt, Human
cuuauaugggaaaccau

SEQ ID NO: 3526852 - RNA, 18 nt, Human
cuuauauguguauugcua

SEQ ID NO: 3526853 - RNA, 19 nt, Human
cuuauauucaaccauggac

SEQ ID NO: 3526854 - RNA, 21 nt, Human
cuuauauucaaccauggacuu

SEQ ID NO: 3526855 - RNA, 16 nt, Human
cuuauauugaagacaa

SEQ ID NO: 3526856 - RNA, 14 nt, Human
cuuauauuguaaga

SEQ ID NO: 3526857 - RNA, 14 nt, Human
cuuauauuguucac

SEQ ID NO: 3526858 - RNA, 15 nt, Human
cuuauauuuucguau

SEQ ID NO: 3526859 - RNA, 22 nt, Human
cuuauauuuucguaugaaaaug

SEQ ID NO: 3526860 - RNA, 19 nt, Human
cuuauauuuuuaauaaaag

SEQ ID NO: 3526861 - RNA, 19 nt, Human
cuuaucaagaguugugaca

SEQ ID NO: 3526862 - RNA, 15 nt, Human
cuuaucaagugucuu

SEQ ID NO: 3526863 - RNA, 17 nt, Human
cuuaucaagugucuucc

SEQ ID NO: 3526864 - RNA, 16 nt, Human
cuuaucaauuugucau

SEQ ID NO: 3526865 - RNA, 22 nt, Human
cuuaucaccacaguaaguuccu

SEQ ID NO: 3526866 - RNA, 13 nt, Human
cuuaucaccagcu

SEQ ID NO: 3526867 - RNA, 12 nt, Human
cuuaucagagcu

SEQ ID NO: 3526868 - RNA, 17 nt, Human
cuuaucaguuugcuaau

SEQ ID NO: 3526869 - RNA, 15 nt, Human
cuuaucauccacauu

SEQ ID NO: 3526870 - RNA, 15 nt, Human
cuuaucauucauucu

SEQ ID NO: 3526871 - RNA, 20 nt, Human
cuuauccacgagagcgcagc

SEQ ID NO: 3526872 - RNA, 21 nt, Human
cuuccaugagaacagcagggu

SEQ ID NO: 3526873 - RNA, 14 nt, Human
cuuccaugauucua

SEQ ID NO: 3526874 - RNA, 13 nt, Human
cuuccaugccuua

SEQ ID NO: 3526875 - RNA, 19 nt, Human
cuuccaugucgccucugca

SEQ ID NO: 3526876 - RNA, 20 nt, Human
cuuccaugucgccucugcau

SEQ ID NO: 3526877 - RNA, 22 nt, Human
cuuccaugucggccucuaaccc

SEQ ID NO: 3526878 - RNA, 14 nt, Human
cuuccauguggaga

SEQ ID NO: 3526879 - RNA, 18 nt, Human
cuuccauguggagaaagg

SEQ ID NO: 3526880 - RNA, 12 nt, Human
cuuccauuccac

SEQ ID NO: 3526881 - RNA, 17 nt, Human
cuuccauuccacacaga

SEQ ID NO: 3526882 - RNA, 12 nt, Human
cuuccauuuaua

SEQ ID NO: 3526883 - RNA, 16 nt, Human
cuuccauuugugugug

SEQ ID NO: 3526884 - RNA, 16 nt, Human
cuuccauuuuaauuuu

SEQ ID NO: 3526885 - RNA, 19 nt, Human
cuuccauuuucccccacua

SEQ ID NO: 3526886 - RNA, 18 nt, Human
cuucccaaaggacuccac

SEQ ID NO: 3526887 - RNA, 15 nt, Human
cuucccaacugcaag

SEQ ID NO: 3526888 - RNA, 16 nt, Human
cuucccaacugcaagu

SEQ ID NO: 3526889 - RNA, 17 nt, Human
cuucccaaguaagaggc

SEQ ID NO: 3526890 - RNA, 17 nt, Human
cuucccaaucagcacug

SEQ ID NO: 3526891 - RNA, 18 nt, Human
cuucccaaucagcacuga

SEQ ID NO: 3526892 - RNA, 19 nt, Human
cuucccaaucagcacugaa

SEQ ID NO: 3526893 - RNA, 11 nt, Human
cuucccaccuc

SEQ ID NO: 3526894 - RNA, 19 nt, Human
cuucccacucuagggcagu

SEQ ID NO: 3526895 - RNA, 13 nt, Human
cuucccacucugu

SEQ ID NO: 3526896 - RNA, 14 nt, Human
cuucccacucuucu

SEQ ID NO: 3526897 - RNA, 16 nt, Human
cuucccacucuucuca

SEQ ID NO: 3526898 - RNA, 21 nt, Human
cuucccagcagggccacuccc

SEQ ID NO: 3526899 - RNA, 18 nt, Human
cuucccagcucucccucu

SEQ ID NO: 3526900 - RNA, 21 nt, Human
cuucccagcucucccucuggc

SEQ ID NO: 3526901 - RNA, 12 nt, Human
cuucccagcugc

SEQ ID NO: 3526902 - RNA, 11 nt, Human
cuucccagggu

SEQ ID NO: 3526903 - RNA, 19 nt, Human
cuucccaggguagcccgcc

SEQ ID NO: 3526904 - RNA, 21 nt, Human
cuucccaggguagcccgccug

SEQ ID NO: 3526905 - RNA, 18 nt, Human
cuucccagguucaagcga

SEQ ID NO: 3526906 - RNA, 17 nt, Human
cuucccaguggcugcug

SEQ ID NO: 3526907 - RNA, 19 nt, Human
cuucccaguggcugcugcc

SEQ ID NO: 3526908 - RNA, 16 nt, Human
cuucccaucacuggag

SEQ ID NO: 3526909 - RNA, 17 nt, Human
cuucccaugacccaggc

SEQ ID NO: 3526910 - RNA, 19 nt, Human
cuucccaugacccaggcug

SEQ ID NO: 3526911 - RNA, 17 nt, Human
cuucccaugucuuucuc

SEQ ID NO: 3526912 - RNA, 20 nt, Human
cuuccccacccaccaacccu

SEQ ID NO: 3526913 - RNA, 23 nt, Human
cuuccccacccaccaacccucag

SEQ ID NO: 3526914 - RNA, 19 nt, Human
cuuccccagaaaggagacu

SEQ ID NO: 3526915 - RNA, 21 nt, Human
cuuccccauggcccugagcga

SEQ ID NO: 3526916 - RNA, 12 nt, Human
cuuccccauggg

SEQ ID NO: 3526917 - RNA, 13 nt, Human
cuuccccauggga

SEQ ID NO: 3526918 - RNA, 14 nt, Human
cuuccccaugggaa

SEQ ID NO: 3526919 - RNA, 16 nt, Human
cuucccccagcccauc

SEQ ID NO: 3526920 - RNA, 20 nt, Human
cuuccccccaaaacccggga

SEQ ID NO: 3526921 - RNA, 20 nt, Human
cuucccccgcaaugugcccc

SEQ ID NO: 3526922 - RNA, 16 nt, Human
cuucccccucucccag

SEQ ID NO: 3526923 - RNA, 23 nt, Human
cuuccccgagggaugaugccaca

SEQ ID NO: 3526924 - RNA, 18 nt, Human
cuuccccgcauuccaggc

SEQ ID NO: 3526925 - RNA, 16 nt, Human
cuuccccucccuggcu

SEQ ID NO: 3526926 - RNA, 17 nt, Human
cuuccccuggcacuggc

SEQ ID NO: 3526927 - RNA, 12 nt, Human
cuuccccuugcc

SEQ ID NO: 3526928 - RNA, 22 nt, Human
cuuccccuugcccuugcccuga

SEQ ID NO: 3526929 - RNA, 23 nt, Human
cuucccgccgcccagcccacccc

SEQ ID NO: 3526930 - RNA, 16 nt, Human
cuucccgcucagcccu

SEQ ID NO: 3526931 - RNA, 18 nt, Human
cuucccgcucagcccucc

SEQ ID NO: 3526932 - RNA, 19 nt, Human
cuucccgcucagcccuccc

SEQ ID NO: 3526933 - RNA, 14 nt, Human
cuucccgucccaua

SEQ ID NO: 3526934 - RNA, 15 nt, Human
cuucccgucccauau

SEQ ID NO: 3526935 - RNA, 16 nt, Human
cuucccuaaaaucagg

SEQ ID NO: 3526936 - RNA, 13 nt, Human
cuucccuaccuca

SEQ ID NO: 3526937 - RNA, 15 nt, Human
cuucccuaccucagg

SEQ ID NO: 3526938 - RNA, 16 nt, Human
cuucccuaccucaggc

SEQ ID NO: 3526939 - RNA, 20 nt, Human
cuucccuaccucaggcagga

SEQ ID NO: 3526940 - RNA, 17 nt, Human
cuucccuagggcugggu

SEQ ID NO: 3526941 - RNA, 17 nt, Human
cuucccuaucuuugcca

SEQ ID NO: 3526942 - RNA, 23 nt, Human
cuucccucaaagcuuccauucca

SEQ ID NO: 3526943 - RNA, 24 nt, Human
cuucccucaaagcuuccauuccac

SEQ ID NO: 3526944 - RNA, 16 nt, Human
cuucccucaucucucc

SEQ ID NO: 3526945 - RNA, 17 nt, Human
cuucccucaucucuccu

SEQ ID NO: 3526946 - RNA, 11 nt, Human
cuucccuccuc

SEQ ID NO: 3526947 - RNA, 12 nt, Human
cuucccuccucc

SEQ ID NO: 3526948 - RNA, 16 nt, Human
cuucccuccugcuuug

SEQ ID NO: 3526949 - RNA, 15 nt, Human
cuucccucugccugu

SEQ ID NO: 3526950 - RNA, 16 nt, Human
cuucccucugccuguc

SEQ ID NO: 3526951 - RNA, 16 nt, Human
cuucccucuguuucuc

SEQ ID NO: 3526952 - RNA, 15 nt, Human
cuucccucuucccuc

SEQ ID NO: 3526953 - RNA, 17 nt, Human
cuucccugaagcuccca

SEQ ID NO: 3526954 - RNA, 20 nt, Human
cuucccugacucauucugaa

SEQ ID NO: 3526955 - RNA, 14 nt, Human
cuucccugcugccu

SEQ ID NO: 3526956 - RNA, 19 nt, Human
cuucccugcugugaaagaa

SEQ ID NO: 3526957 - RNA, 22 nt, Human
cuucccuggaaaccuuccaccc

SEQ ID NO: 3526958 - RNA, 10 nt, Human
cuucccuggc

SEQ ID NO: 3526959 - RNA, 12 nt, Human
cuucccuggcuu

SEQ ID NO: 3526960 - RNA, 18 nt, Human
cuucccugggcugugcua

SEQ ID NO: 3526961 - RNA, 23 nt, Human
cuucccuggguuagacugccagc

SEQ ID NO: 3526962 - RNA, 20 nt, Human
cuucccugguucaagcgauu

SEQ ID NO: 3526963 - RNA, 12 nt, Human
cuucccuguccc

SEQ ID NO: 3526964 - RNA, 20 nt, Human
cuucccuuccacugccucug

SEQ ID NO: 3526965 - RNA, 15 nt, Human
cuucccuugagcccu

SEQ ID NO: 3526966 - RNA, 20 nt, Human
cuucccuuuccugaguccca

SEQ ID NO: 3526967 - RNA, 22 nt, Human
cuuccgaaaaauccucuuccuc

SEQ ID NO: 3526968 - RNA, 18 nt, Human
cuuccgacccucugggaa

SEQ ID NO: 3526969 - RNA, 23 nt, Human
cuuccgacccucugggaaccucc

SEQ ID NO: 3526970 - RNA, 14 nt, Human
cuuccgcagugugg

SEQ ID NO: 3526971 - RNA, 15 nt, Human
cuuccgcauccuagu

SEQ ID NO: 3526972 - RNA, 18 nt, Human
cuuccgcauccuagucuc

SEQ ID NO: 3526973 - RNA, 17 nt, Human
cuuccgccacuggggcu

SEQ ID NO: 3526974 - RNA, 18 nt, Human
cuuccgccccugccugcc

SEQ ID NO: 3526975 - RNA, 22 nt, Human
cuuccgccccugccugccaugu

SEQ ID NO: 3526976 - RNA, 15 nt, Human
cuuccgccccuuccc

SEQ ID NO: 3526977 - RNA, 15 nt, Human
cuuccggcuccugug

SEQ ID NO: 3526978 - RNA, 18 nt, Human
cuuccggcuccugugcuu

SEQ ID NO: 3526979 - RNA, 22 nt, Human
cuuccggggaaggauuuugcag

SEQ ID NO: 3526980 - RNA, 19 nt, Human
cuuccgguagggaggcagc

SEQ ID NO: 3526981 - RNA, 22 nt, Human
cuuccuaaauauuaugagaugc

SEQ ID NO: 3526982 - RNA, 19 nt, Human
cuuccuaaauuuuccuguc

SEQ ID NO: 3526983 - RNA, 21 nt, Human
cuuccuaaauuuuccuguccu

SEQ ID NO: 3526984 - RNA, 20 nt, Human
cuuccuaagccuguggcugu

SEQ ID NO: 3526985 - RNA, 18 nt, Human
cuuccuaauuccacagcu

SEQ ID NO: 3526986 - RNA, 18 nt, Human
cuuccuacaagagcagcc

SEQ ID NO: 3526987 - RNA, 19 nt, Human
cuuccuacccacaccucug

SEQ ID NO: 3526988 - RNA, 19 nt, Human
cuucugaugaaucuugcgu

SEQ ID NO: 3526989 - RNA, 22 nt, Human
cuucugcacauaaacucuuuua

SEQ ID NO: 3526990 - RNA, 12 nt, Human
cuucugcacccu

SEQ ID NO: 3526991 - RNA, 21 nt, Human
cuucugcacccuccacccugu

SEQ ID NO: 3526992 - RNA, 15 nt, Human
cuucugccauauucu

SEQ ID NO: 3526993 - RNA, 15 nt, Human
cuucugccugcaccc

SEQ ID NO: 3526994 - RNA, 15 nt, Human
cuucugccuggagac

SEQ ID NO: 3526995 - RNA, 18 nt, Human
cuucugccuguggaacug

SEQ ID NO: 3526996 - RNA, 14 nt, Human
cuucugccuguuau

SEQ ID NO: 3526997 - RNA, 21 nt, Human
cuucugccuuagucucaguuu

SEQ ID NO: 3526998 - RNA, 11 nt, Human
cuucugcuacu

SEQ ID NO: 3526999 - RNA, 13 nt, Human
cuucugcuacugg

SEQ ID NO: 3527000 - RNA, 18 nt, Human
cuucugcucagcucuggg

SEQ ID NO: 3527001 - RNA, 19 nt, Human
cuucugcuggauaaaauga

SEQ ID NO: 3527002 - RNA, 14 nt, Human
cuucugcugggcug

SEQ ID NO: 3527003 - RNA, 15 nt, Human
cuucugcugggcugg

SEQ ID NO: 3527004 - RNA, 16 nt, Human
cuucugcugggcuggg

SEQ ID NO: 3527005 - RNA, 19 nt, Human
cuucugcuggggccuggga

SEQ ID NO: 3527006 - RNA, 17 nt, Human
cuucugcuucagccucc

SEQ ID NO: 3527007 - RNA, 17 nt, Human
cuucugcuuuucugccc

SEQ ID NO: 3527008 - RNA, 18 nt, Human
cuucuggaaacugugaag

SEQ ID NO: 3527009 - RNA, 15 nt, Human
cuucuggacugguuu

SEQ ID NO: 3527010 - RNA, 16 nt, Human
cuucuggagucuccag

SEQ ID NO: 3527011 - RNA, 15 nt, Human
cuucuggauucuugg

SEQ ID NO: 3527012 - RNA, 16 nt, Human
cuucuggauucuuggc

SEQ ID NO: 3527013 - RNA, 17 nt, Human
cuucuggauucuuggcc

SEQ ID NO: 3527014 - RNA, 19 nt, Human
cuucuggcacuuggagacu

SEQ ID NO: 3527015 - RNA, 16 nt, Human
cuucuggccucccaca

SEQ ID NO: 3527016 - RNA, 22 nt, Human
cuucuggcucccucuucuuuca

SEQ ID NO: 3527017 - RNA, 18 nt, Human
cgcaggcccccaggugcc

SEQ ID NO: 3527018 - RNA, 16 nt, Human
cgcaggccucccugcc

SEQ ID NO: 3527019 - RNA, 14 nt, Human
cgcaggcuggcccu

SEQ ID NO: 3527020 - RNA, 15 nt, Human
cgcaggcuggcccug

SEQ ID NO: 3527021 - RNA, 21 nt, Human
cgcaggcuggcccugcccugg

SEQ ID NO: 3527022 - RNA, 13 nt, Human
cgcaggggaaacg

SEQ ID NO: 3527023 - RNA, 14 nt, Human
cgcaggugggcugg

SEQ ID NO: 3527024 - RNA, 18 nt, Human
cgcaggugggcuggacuu

SEQ ID NO: 3527025 - RNA, 20 nt, Human
cgcaguccacuucugacagc

SEQ ID NO: 3527026 - RNA, 15 nt, Human
cgcagucgucgcaca

SEQ ID NO: 3527027 - RNA, 21 nt, Human
cgcagucgucgcacagucucu

SEQ ID NO: 3527028 - RNA, 22 nt, Human
cgcagugggagcaaacugcaug

SEQ ID NO: 3527029 - RNA, 23 nt, Human
cgcagugugcacuaaggggcccg

SEQ ID NO: 3527030 - RNA, 19 nt, Human
cgcaucaaaagacaauucu

SEQ ID NO: 3527031 - RNA, 16 nt, Human
cgcaucagcugcucag

SEQ ID NO: 3527032 - RNA, 12 nt, Human
cgcaucauaugc

SEQ ID NO: 3527033 - RNA, 12 nt, Human
cgcauccagcaa

SEQ ID NO: 3527034 - RNA, 13 nt, Human
cgcauccccugcc

SEQ ID NO: 3527035 - RNA, 15 nt, Human
cgcauccccugccuc

SEQ ID NO: 3527036 - RNA, 18 nt, Human
cgcauccccugccuccau

SEQ ID NO: 3527037 - RNA, 13 nt, Human
cgcaucucacagc

SEQ ID NO: 3527038 - RNA, 13 nt, Human
cgcaugcagcagc

SEQ ID NO: 3527039 - RNA, 14 nt, Human
cgcaugcccccucg

SEQ ID NO: 3527040 - RNA, 16 nt, Human
cgcaugcccccucgug

SEQ ID NO: 3527041 - RNA, 18 nt, Human
cgcaugcccccucgugcc

SEQ ID NO: 3527042 - RNA, 21 nt, Human
cgcaugcccccucgugccagu

SEQ ID NO: 3527043 - RNA, 22 nt, Human
cgcaugcccccucgugccaguc

SEQ ID NO: 3527044 - RNA, 12 nt, Human
cgcauucccuga

SEQ ID NO: 3527045 - RNA, 19 nt, Human
cgcauucuaaccuggaggu

SEQ ID NO: 3527046 - RNA, 14 nt, Human
cgcauucucaugga

SEQ ID NO: 3527047 - RNA, 17 nt, Human
cgccaaauaaugucucu

SEQ ID NO: 3527048 - RNA, 12 nt, Human
cgccaaggcugg

SEQ ID NO: 3527049 - RNA, 16 nt, Human
cgccaaggcuggggga

SEQ ID NO: 3527050 - RNA, 22 nt, Human
cgccaagguagccaucccauga

SEQ ID NO: 3527051 - RNA, 16 nt, Human
cgccaagugcgugccg

SEQ ID NO: 3527052 - RNA, 21 nt, Human
cgccacacagaccaccaucca

SEQ ID NO: 3527053 - RNA, 14 nt, Human
cgccacagcccagc

SEQ ID NO: 3527054 - RNA, 14 nt, Human
cgccacagcccuuu

SEQ ID NO: 3527055 - RNA, 19 nt, Human
cgccacagcccuuuugucu

SEQ ID NO: 3527056 - RNA, 12 nt, Human
cgccacaggacc

SEQ ID NO: 3527057 - RNA, 16 nt, Human
cgccacauggcuuccu

SEQ ID NO: 3527058 - RNA, 22 nt, Human
cgccacauggcuuccuccugcg

SEQ ID NO: 3527059 - RNA, 16 nt, Human
cgccaccauuccugga

SEQ ID NO: 3527060 - RNA, 23 nt, Human
cgccaccgcgggugugggaaagc

SEQ ID NO: 3527061 - RNA, 21 nt, Human
cgccacuacacuccagccuga

SEQ ID NO: 3527062 - RNA, 12 nt, Human
cgccacucauuu

SEQ ID NO: 3527063 - RNA, 16 nt, Human
cgccacucauuucauc

SEQ ID NO: 3527064 - RNA, 21 nt, Human
cgccacucauuucaucucauu

SEQ ID NO: 3527065 - RNA, 15 nt, Human
cgccacucgcuuccc

SEQ ID NO: 3527066 - RNA, 22 nt, Human
cgccacugcacuccagccuggg

SEQ ID NO: 3527067 - RNA, 13 nt, Human
cgccacuggggcu

SEQ ID NO: 3527068 - RNA, 18 nt, Human
cgccacuggggcucagag

SEQ ID NO: 3527069 - RNA, 17 nt, Human
cgccagaggugcuucac

SEQ ID NO: 3527070 - RNA, 17 nt, Human
cgccagauucuuuccug

SEQ ID NO: 3527071 - RNA, 20 nt, Human
cgccagauucuuuccugagg

SEQ ID NO: 3527072 - RNA, 13 nt, Human
cgccagccuccuc

SEQ ID NO: 3527073 - RNA, 14 nt, Human
cgccagccuccucu

SEQ ID NO: 3527074 - RNA, 21 nt, Human
cgccagccuccucuggacggc

SEQ ID NO: 3527075 - RNA, 23 nt, Human
cgccagccuccucuggacggcag

SEQ ID NO: 3527076 - RNA, 15 nt, Human
cgccagcgaacuuga

SEQ ID NO: 3527077 - RNA, 14 nt, Human
cgccagcucuguuc

SEQ ID NO: 3527078 - RNA, 16 nt, Human
cgccagcugaugacuc

SEQ ID NO: 3527079 - RNA, 20 nt, Human
cgccaggaccgccaaagaau

SEQ ID NO: 3527080 - RNA, 16 nt, Human
cgccaggauggcgcag

SEQ ID NO: 3527081 - RNA, 19 nt, Human
cgccaggauggcgcaggaa

SEQ ID NO: 3527082 - RNA, 17 nt, Human
cgccagggaccccagaa

SEQ ID NO: 3527083 - RNA, 16 nt, Human
cgccagggagaccugg

SEQ ID NO: 3527084 - RNA, 22 nt, Human
cgccaggggaaaaucagccugc

SEQ ID NO: 3527085 - RNA, 14 nt, Human
cgccaucagcccaa

SEQ ID NO: 3527086 - RNA, 15 nt, Human
cgccaugcuccuggc

SEQ ID NO: 3527087 - RNA, 17 nt, Human
cgccaugcuccuggccc

SEQ ID NO: 3527088 - RNA, 18 nt, Human
cgccauucucaagcccug

SEQ ID NO: 3527089 - RNA, 15 nt, Human
cgccauugcacucca

SEQ ID NO: 3527090 - RNA, 19 nt, Human
cgccauugcacuccagccu

SEQ ID NO: 3527091 - RNA, 17 nt, Human
cgccauugccaccagga

SEQ ID NO: 3527092 - RNA, 13 nt, Human
cgccauuuaaaag

SEQ ID NO: 3527093 - RNA, 13 nt, Human
cgcccaccgcaug

SEQ ID NO: 3527094 - RNA, 14 nt, Human
cgcccaccucccca

SEQ ID NO: 3527095 - RNA, 18 nt, Human
cgcccacuguccugggcg

SEQ ID NO: 3527096 - RNA, 21 nt, Human
cgcccagauuaugagacacag

SEQ ID NO: 3527097 - RNA, 15 nt, Human
cgcccagcuccugac

SEQ ID NO: 3527098 - RNA, 18 nt, Human
cgcccagcugcaccugcc

SEQ ID NO: 3527099 - RNA, 23 nt, Human
cgcccagcugcaccugccagccu

SEQ ID NO: 3527100 - RNA, 11 nt, Human
cgcccaggaga

SEQ ID NO: 3527101 - RNA, 15 nt, Human
cgcccaguccuucca

SEQ ID NO: 3527102 - RNA, 19 nt, Human
cgcccagucuggaaugcag

SEQ ID NO: 3527103 - RNA, 21 nt, Human
cgccccaacccguggaggcug

SEQ ID NO: 3527104 - RNA, 21 nt, Human
cgccccagaucaccagcccgg

SEQ ID NO: 3527105 - RNA, 12 nt, Human
cgcccccaccuc

SEQ ID NO: 3527106 - RNA, 14 nt, Human
cgcccccaccucca

SEQ ID NO: 3527107 - RNA, 11 nt, Human
cgcccccagcc

SEQ ID NO: 3527108 - RNA, 13 nt, Human
cgcccccagccua

SEQ ID NO: 3527109 - RNA, 12 nt, Human
cgcccccagugu

SEQ ID NO: 3527110 - RNA, 18 nt, Human
cgccccccacacuucccu

SEQ ID NO: 3527111 - RNA, 19 nt, Human
cgcccccugcccuccccuc

SEQ ID NO: 3527112 - RNA, 13 nt, Human
cgcccccugucuc

SEQ ID NO: 3527113 - RNA, 13 nt, Human
cgcccccuuggcu

SEQ ID NO: 3527114 - RNA, 18 nt, Human
cgccccgaaaggucaccu

SEQ ID NO: 3527115 - RNA, 13 nt, Human
cgccccugagccc

SEQ ID NO: 3527116 - RNA, 14 nt, Human
cgccccugagccca

SEQ ID NO: 3527117 - RNA, 15 nt, Human
cgccccugagcccac

SEQ ID NO: 3527118 - RNA, 18 nt, Human
cgccccugagcccacugu

SEQ ID NO: 3527119 - RNA, 12 nt, Human
cgccccugcagc

SEQ ID NO: 3527120 - RNA, 13 nt, Human
cgccccugccugc

SEQ ID NO: 3527121 - RNA, 13 nt, Human
cgccccuuccccc

SEQ ID NO: 3527122 - RNA, 17 nt, Human
cgcccgagguggcugcc

SEQ ID NO: 3527123 - RNA, 21 nt, Human
cgcccgcccacuguccugggc

SEQ ID NO: 3527124 - RNA, 17 nt, Human
cgcccgccccugcagca

SEQ ID NO: 3527125 - RNA, 16 nt, Human
cgcccgcugggcugag

SEQ ID NO: 3527126 - RNA, 23 nt, Human
cgcccgcugggcugagccccuac

SEQ ID NO: 3527127 - RNA, 16 nt, Human
cgcccgggcccagagg

SEQ ID NO: 3527128 - RNA, 15 nt, Human
cgcccuaggccuggc

SEQ ID NO: 3527129 - RNA, 16 nt, Human
cgcccuaggccuggca

SEQ ID NO: 3527130 - RNA, 20 nt, Human
cgcccucauuacggcuccuc

SEQ ID NO: 3527131 - RNA, 22 nt, Human
cgcccucauuacggcuccucuc

SEQ ID NO: 3527132 - RNA, 12 nt, Human
cgcccucccagg

SEQ ID NO: 3527133 - RNA, 18 nt, Human
cgcccuccccuccccugc

SEQ ID NO: 3527134 - RNA, 22 nt, Human
cgcccuccccuccccugcugca

SEQ ID NO: 3527135 - RNA, 11 nt, Human
cgcccucuccu

SEQ ID NO: 3527136 - RNA, 16 nt, Human
cgcccucuguccugac

SEQ ID NO: 3527137 - RNA, 19 nt, Human
cgcccucuuccccucuaau

SEQ ID NO: 3527138 - RNA, 13 nt, Human
cgcccucuuccug

SEQ ID NO: 3527139 - RNA, 13 nt, Human
cgcccuggaagcc

SEQ ID NO: 3527140 - RNA, 22 nt, Human
cgcccuggaagccggcggccca

SEQ ID NO: 3527141 - RNA, 15 nt, Human
cgcccuggcccccac

SEQ ID NO: 3527142 - RNA, 12 nt, Human
cgcccugggcuc

SEQ ID NO: 3527143 - RNA, 17 nt, Human
cgcccuuuccuccucag

SEQ ID NO: 3527144 - RNA, 19 nt, Human
cgcccuuuccuccucaggc

SEQ ID NO: 3527145 - RNA, 19 nt, Human
cgccgagucugucucuguc

SEQ ID NO: 3527146 - RNA, 20 nt, Human
cgccgauagagggacggcca

SEQ ID NO: 3527147 - RNA, 15 nt, Human
cgccgcccagcccac

SEQ ID NO: 3527148 - RNA, 12 nt, Human
cgccgccucuuu

SEQ ID NO: 3527149 - RNA, 18 nt, Human
cgccggaguccacuccca

SEQ ID NO: 3527150 - RNA, 23 nt, Human
cgccggaguccacucccagugcu

SEQ ID NO: 3527151 - RNA, 22 nt, Human
cgccggcaauaaaagcccagga

SEQ ID NO: 3527152 - RNA, 16 nt, Human
cgccggggacagaggc

SEQ ID NO: 3527153 - RNA, 22 nt, Human
cgccggggacagaggccugccc

SEQ ID NO: 3527154 - RNA, 18 nt, Human
cgccgugaguucucaggg

SEQ ID NO: 3527155 - RNA, 21 nt, Human
cgccgugaguucucagggcuc

SEQ ID NO: 3527156 - RNA, 22 nt, Human
cgccgugaguucucagggcucc

SEQ ID NO: 3527157 - RNA, 23 nt, Human
cgccgugaguucucagggcuccu

SEQ ID NO: 3527158 - RNA, 19 nt, Human
cgccgugcugggcagcccg

SEQ ID NO: 3527159 - RNA, 15 nt, Human
cgccuagcugcuguc

SEQ ID NO: 3527160 - RNA, 21 nt, Human
cgccuaguggggucucccucu

SEQ ID NO: 3527161 - RNA, 17 nt, Human
cgccucaaugugguugc

SEQ ID NO: 3527162 - RNA, 21 nt, Human
cgccucacugcaaccuucacc

SEQ ID NO: 3527163 - RNA, 19 nt, Human
cuuggccuaaaccucaguu

SEQ ID NO: 3527164 - RNA, 18 nt, Human
cuuggccuagcccacccu

SEQ ID NO: 3527165 - RNA, 21 nt, Human
cuuggccuagcccacccugcu

SEQ ID NO: 3527166 - RNA, 20 nt, Human
cuuggccucacccucuggcu

SEQ ID NO: 3527167 - RNA, 17 nt, Human
cuuggccugaucagacc

SEQ ID NO: 3527168 - RNA, 15 nt, Human
cuuggccugcuguga

SEQ ID NO: 3527169 - RNA, 14 nt, Human
cuuggccugggccg

SEQ ID NO: 3527170 - RNA, 22 nt, Human
cuuggccugucucauccccagg

SEQ ID NO: 3527171 - RNA, 14 nt, Human
cuuggccuugggcu

SEQ ID NO: 3527172 - RNA, 15 nt, Human
cuuggcgaugccagc

SEQ ID NO: 3527173 - RNA, 17 nt, Human
cuuggcgaugccagcca

SEQ ID NO: 3527174 - RNA, 14 nt, Human
cuuggcgcugcccc

SEQ ID NO: 3527175 - RNA, 22 nt, Human
cuuggcgcugccccuggcagcc

SEQ ID NO: 3527176 - RNA, 18 nt, Human
cuuggcggcagcagccau

SEQ ID NO: 3527177 - RNA, 21 nt, Human
cuuggcucaauccucuaagcu

SEQ ID NO: 3527178 - RNA, 23 nt, Human
cuuggcucacacucgacaugaaa

SEQ ID NO: 3527179 - RNA, 12 nt, Human
cuuggcucagac

SEQ ID NO: 3527180 - RNA, 16 nt, Human
cuuggcuccaugcucc

SEQ ID NO: 3527181 - RNA, 16 nt, Human
cuuggcugcagggagu

SEQ ID NO: 3527182 - RNA, 17 nt, Human
cuuggcugcagggaguc

SEQ ID NO: 3527183 - RNA, 17 nt, Human
cuuggcugcuuggccuu

SEQ ID NO: 3527184 - RNA, 15 nt, Human
cuuggcuggacccag

SEQ ID NO: 3527185 - RNA, 16 nt, Human
cuuggcuggacccagc

SEQ ID NO: 3527186 - RNA, 17 nt, Human
cuuggcuggacccagcc

SEQ ID NO: 3527187 - RNA, 18 nt, Human
cuuggcuggacccagcca

SEQ ID NO: 3527188 - RNA, 12 nt, Human
cuuggcuggugu

SEQ ID NO: 3527189 - RNA, 21 nt, Human
cuuggcuggugugguacagag

SEQ ID NO: 3527190 - RNA, 23 nt, Human
cuuggcuggugugguacagagaa

SEQ ID NO: 3527191 - RNA, 21 nt, Human
cuuggcugugaggccccugga

SEQ ID NO: 3527192 - RNA, 14 nt, Human
cuuggcuuaaucau

SEQ ID NO: 3527193 - RNA, 15 nt, Human
cuuggcuuaccugac

SEQ ID NO: 3527194 - RNA, 17 nt, Human
cuuggcuuaccugaccu

SEQ ID NO: 3527195 - RNA, 19 nt, Human
cuuggcuuaccugaccucu

SEQ ID NO: 3527196 - RNA, 16 nt, Human
cuuggcuucucauacg

SEQ ID NO: 3527197 - RNA, 13 nt, Human
cuuggcuucugug

SEQ ID NO: 3527198 - RNA, 14 nt, Human
cuuggcuugcccac

SEQ ID NO: 3527199 - RNA, 14 nt, Human
cuuggcuuucaugu

SEQ ID NO: 3527200 - RNA, 13 nt, Human
cuuggcuuuguuu

SEQ ID NO: 3527201 - RNA, 16 nt, Human
cuuggcuuuucuagcc

SEQ ID NO: 3527202 - RNA, 15 nt, Human
cuugggacauccugu

SEQ ID NO: 3527203 - RNA, 23 nt, Human
cuugggaccgccagauggggccu

SEQ ID NO: 3527204 - RNA, 15 nt, Human
cuugggacuggguuu

SEQ ID NO: 3527205 - RNA, 17 nt, Human
cuugggacuggguuugg

SEQ ID NO: 3527206 - RNA, 14 nt, Human
cuugggaggcugag

SEQ ID NO: 3527207 - RNA, 23 nt, Human
cuugggaggcugaggcaggagaa

SEQ ID NO: 3527208 - RNA, 13 nt, Human
cuugggcaauauu

SEQ ID NO: 3527209 - RNA, 21 nt, Human
cuugggcaauauucucuguac

SEQ ID NO: 3527210 - RNA, 20 nt, Human
cuugggcacccccagccugg

SEQ ID NO: 3527211 - RNA, 22 nt, Human
cuugggcacccccagccugggc

SEQ ID NO: 3527212 - RNA, 22 nt, Human
cuugggcacuuuuuaauucacc

SEQ ID NO: 3527213 - RNA, 18 nt, Human
cuugggcagagcuggcuc

SEQ ID NO: 3527214 - RNA, 22 nt, Human
cuugggcagagcuggcucugag

SEQ ID NO: 3527215 - RNA, 19 nt, Human
cuugggcagaucucccaca

SEQ ID NO: 3527216 - RNA, 23 nt, Human
cuugggcagaucucccacaugcc

SEQ ID NO: 3527217 - RNA, 17 nt, Human
cuugggccaccccuccu

SEQ ID NO: 3527218 - RNA, 15 nt, Human
cuugggccagaagua

SEQ ID NO: 3527219 - RNA, 17 nt, Human
cuugggccauagcuccu

SEQ ID NO: 3527220 - RNA, 16 nt, Human
cuugggcccacaccuc

SEQ ID NO: 3527221 - RNA, 18 nt, Human
cuugggcccacaccuccu

SEQ ID NO: 3527222 - RNA, 13 nt, Human
cggcagcagccau

SEQ ID NO: 3527223 - RNA, 15 nt, Human
cggcagccccagccu

SEQ ID NO: 3527224 - RNA, 17 nt, Human
cggcagcuucugccccc

SEQ ID NO: 3527225 - RNA, 11 nt, Human
cggcaggcccu

SEQ ID NO: 3527226 - RNA, 15 nt, Human
cggcaggcccugcag

SEQ ID NO: 3527227 - RNA, 16 nt, Human
cggcaggcccugcagu

SEQ ID NO: 3527228 - RNA, 18 nt, Human
cggcaggcucacugccag

SEQ ID NO: 3527229 - RNA, 22 nt, Human
cggcagggcgggcagagggcug

SEQ ID NO: 3527230 - RNA, 14 nt, Human
cggcaggggccugg

SEQ ID NO: 3527231 - RNA, 18 nt, Human
cggcaugagacucagugc

SEQ ID NO: 3527232 - RNA, 20 nt, Human
cggcaugagacucagugcag

SEQ ID NO: 3527233 - RNA, 21 nt, Human
cggcaugagacucagugcaga

SEQ ID NO: 3527234 - RNA, 15 nt, Human
cggcauuaaagccau

SEQ ID NO: 3527235 - RNA, 14 nt, Human
cggcauuucaaaug

SEQ ID NO: 3527236 - RNA, 14 nt, Human
cggccaagaaugua

SEQ ID NO: 3527237 - RNA, 18 nt, Human
cggccaagauaggaccuu

SEQ ID NO: 3527238 - RNA, 23 nt, Human
cggccaagauaggaccuugggcc

SEQ ID NO: 3527239 - RNA, 12 nt, Human
cggccaauggaa

SEQ ID NO: 3527240 - RNA, 11 nt, Human
cggccaccucu

SEQ ID NO: 3527241 - RNA, 12 nt, Human
cggccaccucug

SEQ ID NO: 3527242 - RNA, 15 nt, Human
cggccaccugcggug

SEQ ID NO: 3527243 - RNA, 17 nt, Human
cggccaccugcggugcu

SEQ ID NO: 3527244 - RNA, 14 nt, Human
cggccagccagcca

SEQ ID NO: 3527245 - RNA, 15 nt, Human
cggccagccaugucu

SEQ ID NO: 3527246 - RNA, 20 nt, Human
cggccagccccggcccuggg

SEQ ID NO: 3527247 - RNA, 16 nt, Human
cggccagggagaagcu

SEQ ID NO: 3527248 - RNA, 16 nt, Human
cggccaggugccuccu

SEQ ID NO: 3527249 - RNA, 17 nt, Human
cggccaggugccuccug

SEQ ID NO: 3527250 - RNA, 18 nt, Human
cggccaggugccuccuga

SEQ ID NO: 3527251 - RNA, 22 nt, Human
cggccaguggccuuccccagca

SEQ ID NO: 3527252 - RNA, 15 nt, Human
cggcccaauccaagg

SEQ ID NO: 3527253 - RNA, 19 nt, Human
cggcccacagcucccaccc

SEQ ID NO: 3527254 - RNA, 15 nt, Human
cggccccaccagugc

SEQ ID NO: 3527255 - RNA, 16 nt, Human
cggccccaccagugcc

SEQ ID NO: 3527256 - RNA, 17 nt, Human
cggcccccuccaucggg

SEQ ID NO: 3527257 - RNA, 12 nt, Human
cggcccccugcc

SEQ ID NO: 3527258 - RNA, 14 nt, Human
cggccccggcccca

SEQ ID NO: 3527259 - RNA, 19 nt, Human
cggccccggccccagccag

SEQ ID NO: 3527260 - RNA, 17 nt, Human
cggccccgucuguggcu

SEQ ID NO: 3527261 - RNA, 18 nt, Human
cggccccugcugguucag

SEQ ID NO: 3527262 - RNA, 16 nt, Human
cggcccgcgccacagg

SEQ ID NO: 3527263 - RNA, 21 nt, Human
cggcccucaguagucccugca

SEQ ID NO: 3527264 - RNA, 12 nt, Human
cggcccugcaau

SEQ ID NO: 3527265 - RNA, 13 nt, Human
cggcccugggcuc

SEQ ID NO: 3527266 - RNA, 16 nt, Human
cggccgcauucccuga

SEQ ID NO: 3527267 - RNA, 20 nt, Human
cggccgccccuccucgugaa

SEQ ID NO: 3527268 - RNA, 12 nt, Human
cggccgcuccag

SEQ ID NO: 3527269 - RNA, 17 nt, Human
cggccuaugacuugggc

SEQ ID NO: 3527270 - RNA, 22 nt, Human
cggccuccguccaggagccugg

SEQ ID NO: 3527271 - RNA, 20 nt, Human
cggccuccuaaagugcuggg

SEQ ID NO: 3527272 - RNA, 21 nt, Human
cggccucuaaccccaggcccc

SEQ ID NO: 3527273 - RNA, 22 nt, Human
cggccucuaaccccaggccccg

SEQ ID NO: 3527274 - RNA, 13 nt, Human
cggccucucuggc

SEQ ID NO: 3527275 - RNA, 18 nt, Human
cggccucucuggccuccc

SEQ ID NO: 3527276 - RNA, 19 nt, Human
cggccugaugcucccuccc

SEQ ID NO: 3527277 - RNA, 23 nt, Human
cggccugaugcucccuccccugc

SEQ ID NO: 3527278 - RNA, 13 nt, Human
cggccugcuccca

SEQ ID NO: 3527279 - RNA, 14 nt, Human
cggccugcucccag

SEQ ID NO: 3527280 - RNA, 18 nt, Human
cggccuggcgcuccgacu

SEQ ID NO: 3527281 - RNA, 15 nt, Human
cggccuguccuccaa

SEQ ID NO: 3527282 - RNA, 19 nt, Human
cggccuucaacugaaaaga

SEQ ID NO: 3527283 - RNA, 15 nt, Human
cggccuuucuagccu

SEQ ID NO: 3527284 - RNA, 15 nt, Human
cggccuuuggcuuca

SEQ ID NO: 3527285 - RNA, 15 nt, Human
cggcgccaccauccu

SEQ ID NO: 3527286 - RNA, 17 nt, Human
cggcgccaccauccugc

SEQ ID NO: 3527287 - RNA, 18 nt, Human
cggcgccccugccaccuc

SEQ ID NO: 3527288 - RNA, 18 nt, Human
cggcgcccucuguccuga

SEQ ID NO: 3527289 - RNA, 18 nt, Human
cggcgccuggccuccagg

SEQ ID NO: 3527290 - RNA, 20 nt, Human
cggcgcuugccacuagggcu

SEQ ID NO: 3527291 - RNA, 17 nt, Human
cggcggccccuagcgcu

SEQ ID NO: 3527292 - RNA, 16 nt, Human
cggcggucccagcucc

SEQ ID NO: 3527293 - RNA, 14 nt, Human
cggcgucagccucc

SEQ ID NO: 3527294 - RNA, 18 nt, Human
cggcgucagccuccagcc

SEQ ID NO: 3527295 - RNA, 16 nt, Human
cggcguggcccaaggc

SEQ ID NO: 3527296 - RNA, 17 nt, Human
cggcguggcccaaggcu

SEQ ID NO: 3527297 - RNA, 13 nt, Human
cggcuaagcaggc

SEQ ID NO: 3527298 - RNA, 19 nt, Human
cggcuaauuuuuauauuuu

SEQ ID NO: 3527299 - RNA, 18 nt, Human
cggcuaauuuuuguauuu

SEQ ID NO: 3527300 - RNA, 18 nt, Human
cggcuacucagcagcccu

SEQ ID NO: 3527301 - RNA, 16 nt, Human
cggcucaagcccagga

SEQ ID NO: 3527302 - RNA, 17 nt, Human
cggcucaagcccaggag

SEQ ID NO: 3527303 - RNA, 17 nt, Human
cggcucacugcauccuc

SEQ ID NO: 3527304 - RNA, 20 nt, Human
cggcucagugcaaccucugc

SEQ ID NO: 3527305 - RNA, 21 nt, Human
cggcucagugcaaccucugcu

SEQ ID NO: 3527306 - RNA, 20 nt, Human
cggcuccaguccccagaacu

SEQ ID NO: 3527307 - RNA, 14 nt, Human
cggcucccagccuc

SEQ ID NO: 3527308 - RNA, 17 nt, Human
cuuuuaggacccuuccc

SEQ ID NO: 3527309 - RNA, 16 nt, Human
cuuuuaggccaaaaaa

SEQ ID NO: 3527310 - RNA, 21 nt, Human
cuuuuaguuguaucucuuuug

SEQ ID NO: 3527311 - RNA, 13 nt, Human
cuuuuauaaaaaa

SEQ ID NO: 3527312 - RNA, 22 nt, Human
cuuuuauaaaccucuaauuuau

SEQ ID NO: 3527313 - RNA, 13 nt, Human
cuuuuauaaacuu

SEQ ID NO: 3527314 - RNA, 16 nt, Human
cuuuuauaaacuuuac

SEQ ID NO: 3527315 - RNA, 13 nt, Human
cuuuuauaaagca

SEQ ID NO: 3527316 - RNA, 14 nt, Human
cuuuuauaaagcau

SEQ ID NO: 3527317 - RNA, 13 nt, Human
cuuuuauaaauua

SEQ ID NO: 3527318 - RNA, 20 nt, Human
cuuuuauaaauuaaauauau

SEQ ID NO: 3527319 - RNA, 22 nt, Human
cuuuuauaacuaguccuuuacu

SEQ ID NO: 3527320 - RNA, 21 nt, Human
cuuuuauaauaaaaggaaaag

SEQ ID NO: 3527321 - RNA, 12 nt, Human
cuuuuauaauuc

SEQ ID NO: 3527322 - RNA, 12 nt, Human
cuuuuauagcua

SEQ ID NO: 3527323 - RNA, 14 nt, Human
cuuuuauagcuauu

SEQ ID NO: 3527324 - RNA, 18 nt, Human
cuuuuauagcuauuacug

SEQ ID NO: 3527325 - RNA, 21 nt, Human
cuuuuauaggauuuauuuaaa

SEQ ID NO: 3527326 - RNA, 19 nt, Human
cuuuuauaggugagaaaaa

SEQ ID NO: 3527327 - RNA, 20 nt, Human
cuuuuauaggugagaaaaaa

SEQ ID NO: 3527328 - RNA, 15 nt, Human
cuuuuauaucuguau

SEQ ID NO: 3527329 - RNA, 15 nt, Human
cuuuuauauuuguau

SEQ ID NO: 3527330 - RNA, 13 nt, Human
cuuuuaucaaaca

SEQ ID NO: 3527331 - RNA, 17 nt, Human
cuuuuauccacuuaccu

SEQ ID NO: 3527332 - RNA, 22 nt, Human
cuuuuaucccaaaguuguugua

SEQ ID NO: 3527333 - RNA, 22 nt, Human
cuuuuaugagcucauguagcaa

SEQ ID NO: 3527334 - RNA, 23 nt, Human
cuuuuauguaguaauugacaugu

SEQ ID NO: 3527335 - RNA, 18 nt, Human
cuuuuaugugaaacaugu

SEQ ID NO: 3527336 - RNA, 14 nt, Human
cuuuuauguuugaa

SEQ ID NO: 3527337 - RNA, 17 nt, Human
cuuuuauguuugaauau

SEQ ID NO: 3527338 - RNA, 23 nt, Human
cuuuuauguuugaauauggacaa

SEQ ID NO: 3527339 - RNA, 14 nt, Human
cuuuuauuaaugca

SEQ ID NO: 3527340 - RNA, 16 nt, Human
cuuuuauuaaugcacu

SEQ ID NO: 3527341 - RNA, 17 nt, Human
cuuuuauucauuugagu

SEQ ID NO: 3527342 - RNA, 13 nt, Human
cuuuuauuguaua

SEQ ID NO: 3527343 - RNA, 17 nt, Human
cuuuuauuucuuaaaca

SEQ ID NO: 3527344 - RNA, 12 nt, Human
cuuuucaaaauc

SEQ ID NO: 3527345 - RNA, 12 nt, Human
cuuuucacaaau

SEQ ID NO: 3527346 - RNA, 15 nt, Human
cuuuucacaaauaaa

SEQ ID NO: 3527347 - RNA, 18 nt, Human
cuuuucacccuucuacuc

SEQ ID NO: 3527348 - RNA, 19 nt, Human
cuuuucacucccuccauca

SEQ ID NO: 3527349 - RNA, 20 nt, Human
cuuuucacugcugcaaggcc

SEQ ID NO: 3527350 - RNA, 16 nt, Human
cuuuucagcuucugcu

SEQ ID NO: 3527351 - RNA, 18 nt, Human
cuuuucagcuucugcugg

SEQ ID NO: 3527352 - RNA, 18 nt, Human
cuuuucauacauuuucua

SEQ ID NO: 3527353 - RNA, 18 nt, Human
cuuuucauaggucugaaa

SEQ ID NO: 3527354 - RNA, 20 nt, Human
cuuuucauaggucugaaauu

SEQ ID NO: 3527355 - RNA, 15 nt, Human
cuuuucaugcaaacu

SEQ ID NO: 3527356 - RNA, 17 nt, Human
cuuuucaugcaaacucu

SEQ ID NO: 3527357 - RNA, 18 nt, Human
cuuuucaugcgugugugu

SEQ ID NO: 3527358 - RNA, 17 nt, Human
cuuuuccaauaugugau

SEQ ID NO: 3527359 - RNA, 19 nt, Human
cuuuuccaauaugugauuu

SEQ ID NO: 3527360 - RNA, 14 nt, Human
cuuuuccaguauuu

SEQ ID NO: 3527361 - RNA, 22 nt, Human
cuuuucccacuccaagcccagc

SEQ ID NO: 3527362 - RNA, 19 nt, Human
cuuuucccccaaagugguu

SEQ ID NO: 3527363 - RNA, 14 nt, Human
cuuuuccccggucc

SEQ ID NO: 3527364 - RNA, 14 nt, Human
cuuuuccccugucc

SEQ ID NO: 3527365 - RNA, 18 nt, Human
cuuuuccccuuuccuguc

SEQ ID NO: 3527366 - RNA, 19 nt, Human
cuuuucccucuuuucuuac

SEQ ID NO: 3527367 - RNA, 14 nt, Human
cuuuucccugcuuc

SEQ ID NO: 3527368 - RNA, 14 nt, Human
cuuuucccuucuuu

SEQ ID NO: 3527369 - RNA, 13 nt, Human
cuuuuccucccuu

SEQ ID NO: 3527370 - RNA, 15 nt, Human
cuuuuccucccuugg

SEQ ID NO: 3527371 - RNA, 18 nt, Human
cuuuuccucgcuucuuuc

SEQ ID NO: 3527372 - RNA, 22 nt, Human
cuuuuccugauaaagcacagcu

SEQ ID NO: 3527373 - RNA, 13 nt, Human
cuuuuccuucccu

SEQ ID NO: 3527374 - RNA, 20 nt, Human
cuuuuccuuggggcaggcag

SEQ ID NO: 3527375 - RNA, 15 nt, Human
cuuuucguuaacauu

SEQ ID NO: 3527376 - RNA, 20 nt, Human
cuuuucuaaccaagaggcug

SEQ ID NO: 3527377 - RNA, 18 nt, Human
cuuuucuacagcaaauuu

SEQ ID NO: 3527378 - RNA, 23 nt, Human
cuuuucuacagcaaauuuauaau

SEQ ID NO: 3527379 - RNA, 17 nt, Human
cuuuucuacccuagcca

SEQ ID NO: 3527380 - RNA, 18 nt, Human
cuuuucuaggcuacaauu

SEQ ID NO: 3527381 - RNA, 12 nt, Human
cuuuucuaguuu

SEQ ID NO: 3527382 - RNA, 20 nt, Human
cuuuucucaacuggguccag

SEQ ID NO: 3527383 - RNA, 17 nt, Human
cuuuucucaguguuggu

SEQ ID NO: 3527384 - RNA, 14 nt, Human
cuuuucucccauau

SEQ ID NO: 3527385 - RNA, 18 nt, Human
cuuuucuccuaucuucau

SEQ ID NO: 3527386 - RNA, 13 nt, Human
cuuuucucuuucu

SEQ ID NO: 3527387 - RNA, 15 nt, Human
cuuuucugauccagu

SEQ ID NO: 3527388 - RNA, 14 nt, Human
cuuuucugcccugg

SEQ ID NO: 3527389 - RNA, 17 nt, Human
cuuuucugcccuggcug

SEQ ID NO: 3527390 - RNA, 19 nt, Human
cuuuucugcccuggcugcu

SEQ ID NO: 3527391 - RNA, 11 nt, Human
cuuuucugcug

SEQ ID NO: 3527392 - RNA, 19 nt, Human
cuuuucuggaauguaauca

SEQ ID NO: 3527393 - RNA, 13 nt, Human
cuuuucuguaauu

SEQ ID NO: 3527394 - RNA, 14 nt, Human
cuuuucuguaauuc

SEQ ID NO: 3527395 - RNA, 13 nt, Human
cuuuucuguacuu

SEQ ID NO: 3527396 - RNA, 21 nt, Human
cuuuucugucucugccucccu

SEQ ID NO: 3527397 - RNA, 16 nt, Human
cuuuucuuaaaccuuc

SEQ ID NO: 3527398 - RNA, 18 nt, Human
cuuuucuuacuccuccuc

SEQ ID NO: 3527399 - RNA, 23 nt, Human
cuuuucuucuauugccucugaga

SEQ ID NO: 3527400 - RNA, 11 nt, Human
cuuuucuugga

SEQ ID NO: 3527401 - RNA, 14 nt, Human
cuuuucuuuaaaga

SEQ ID NO: 3527402 - RNA, 17 nt, Human
cuuuucuuuaaagaagu

SEQ ID NO: 3527403 - RNA, 21 nt, Human
cuuuucuuuagagaacugaaa

SEQ ID NO: 3527404 - RNA, 16 nt, Human
cuuuucuuucuaccaa

SEQ ID NO: 3527405 - RNA, 21 nt, Human
cuuuucuuugccaucucugcu

SEQ ID NO: 3527406 - RNA, 12 nt, Human
cuuuucuuugua

SEQ ID NO: 3527407 - RNA, 14 nt, Human
cuuuucuuuguauc

SEQ ID NO: 3527408 - RNA, 20 nt, Human
cuuuucuuuucuacccuagc

SEQ ID NO: 3527409 - RNA, 17 nt, Human
cuuuucuuuuguuacug

SEQ ID NO: 3527410 - RNA, 22 nt, Human
cuuuucuuuuguuacuguucuu

SEQ ID NO: 3527411 - RNA, 16 nt, Human
cuuuugaaacaauacu

SEQ ID NO: 3527412 - RNA, 14 nt, Human
cuuuugaaaucugu

SEQ ID NO: 3527413 - RNA, 22 nt, Human
cuuuugaaguaguuuguauaac

SEQ ID NO: 3527414 - RNA, 21 nt, Human
cuuuugaauaaaaacuuugcu

SEQ ID NO: 3527415 - RNA, 19 nt, Human
cuuuugaauccaugcuugg

SEQ ID NO: 3527416 - RNA, 20 nt, Human
cuuuugaauccaugcuuggg

SEQ ID NO: 3527417 - RNA, 14 nt, Human
cuuuugaauuguuu

SEQ ID NO: 3527418 - RNA, 17 nt, Human
cuuuugacaaaggcaag

SEQ ID NO: 3527419 - RNA, 14 nt, Human
cuuuugacaacaaa

SEQ ID NO: 3527420 - RNA, 18 nt, Human
cuuuugacacugcucuaa

SEQ ID NO: 3527421 - RNA, 13 nt, Human
cuuuugacaugug

SEQ ID NO: 3527422 - RNA, 16 nt, Human
cuuuugagcauuuaga

SEQ ID NO: 3527423 - RNA, 17 nt, Human
cuuuugaggcuucuguu

SEQ ID NO: 3527424 - RNA, 21 nt, Human
cuuuugagugccuuacacaau

SEQ ID NO: 3527425 - RNA, 16 nt, Human
cuuuugauauuaaauu

SEQ ID NO: 3527426 - RNA, 15 nt, Human
cuuuugauguggugu

SEQ ID NO: 3527427 - RNA, 14 nt, Human
cuuuugcaaacuuu

SEQ ID NO: 3527428 - RNA, 21 nt, Human
cuuuugcaaagaaagaaaaaa

SEQ ID NO: 3527429 - RNA, 15 nt, Human
cuuuugcaaccagga

SEQ ID NO: 3527430 - RNA, 17 nt, Human
cuuuugcaaccaggaac

SEQ ID NO: 3527431 - RNA, 19 nt, Human
cuuuugcaagguuccacag

SEQ ID NO: 3527432 - RNA, 12 nt, Human
cuuuugcacccc

SEQ ID NO: 3527433 - RNA, 14 nt, Human
cuuuugcagaagag

SEQ ID NO: 3527434 - RNA, 23 nt, Human
cuuuugcagaagaggguguguuu

SEQ ID NO: 3527435 - RNA, 15 nt, Human
cuuuugcauauugca

SEQ ID NO: 3527436 - RNA, 23 nt, Human
cuuuugcauauugcauacuauua

SEQ ID NO: 3527437 - RNA, 13 nt, Human
cuuuugcauucuc

SEQ ID NO: 3527438 - RNA, 14 nt, Human
cuuuugcauucucc

SEQ ID NO: 3527439 - RNA, 16 nt, Human
cuuuugcccauuuuga

SEQ ID NO: 3527440 - RNA, 16 nt, Human
cuuuugccguuauuaa

SEQ ID NO: 3527441 - RNA, 18 nt, Human
cuuuugccguuauuaaaa

SEQ ID NO: 3527442 - RNA, 12 nt, Human
cguucucugccu

SEQ ID NO: 3527443 - RNA, 20 nt, Human
cguucuguacuguuacuggg

SEQ ID NO: 3527444 - RNA, 23 nt, Human
cguucuguacuguuacugggccc

SEQ ID NO: 3527445 - RNA, 20 nt, Human
cguucuguuuacaucaguuu

SEQ ID NO: 3527446 - RNA, 14 nt, Human
cguucuuguaauuu

SEQ ID NO: 3527447 - RNA, 13 nt, Human
cguugaaauugua

SEQ ID NO: 3527448 - RNA, 18 nt, Human
cguugaaauuguaauuau

SEQ ID NO: 3527449 - RNA, 17 nt, Human
cguugauguuggcuggg

SEQ ID NO: 3527450 - RNA, 12 nt, Human
cguugcccccau

SEQ ID NO: 3527451 - RNA, 16 nt, Human
cguugcccccauuucu

SEQ ID NO: 3527452 - RNA, 23 nt, Human
cguugcugugggaacgagagggg

SEQ ID NO: 3527453 - RNA, 20 nt, Human
cguuggaauuaaaacaaugu

SEQ ID NO: 3527454 - RNA, 19 nt, Human
cuaagaugugauauucuaa

SEQ ID NO: 3527455 - RNA, 22 nt, Human
cuaagaugugauauucuaagac

SEQ ID NO: 3527456 - RNA, 22 nt, Human
cuaagaugugcagcauuucacu

SEQ ID NO: 3527457 - RNA, 20 nt, Human
cuaagauguguucuuauuuu

SEQ ID NO: 3527458 - RNA, 19 nt, Human
cuaagauuacaaaucagaa

SEQ ID NO: 3527459 - RNA, 11 nt, Human
cuaagauucua

SEQ ID NO: 3527460 - RNA, 12 nt, Human
cuaagauucuaa

SEQ ID NO: 3527461 - RNA, 12 nt, Human
cuaagauucuga

SEQ ID NO: 3527462 - RNA, 21 nt, Human
cuuuuuuuuuuuugagacaga

SEQ ID NO: 3527463 - RNA, 22 nt, Human
gaaaaaaaaaaaagaggaaaac

SEQ ID NO: 3527464 - RNA, 17 nt, Human
gaaaaaaaaaaagaaag

SEQ ID NO: 3527465 - RNA, 20 nt, Human
gaaaaaaaaaaugcugaaca

SEQ ID NO: 3527466 - RNA, 15 nt, Human
gaaaaaaaaacagcu

SEQ ID NO: 3527467 - RNA, 12 nt, Human
gaaaaaaaaaga

SEQ ID NO: 3527468 - RNA, 15 nt, Human
gaaaaaaaaagaaaa

SEQ ID NO: 3527469 - RNA, 16 nt, Human
gaaaaaaaaagaaaaa

SEQ ID NO: 3527470 - RNA, 14 nt, Human
gaaaaaaaaaugcc

SEQ ID NO: 3527471 - RNA, 19 nt, Human
gaaaaaaaaguuucagaga

SEQ ID NO: 3527472 - RNA, 20 nt, Human
gaaaaaaaauaacacagaga

SEQ ID NO: 3527473 - RNA, 13 nt, Human
gaaaaaaaauuau

SEQ ID NO: 3527474 - RNA, 17 nt, Human
gaaaaaaacuuuuauaa

SEQ ID NO: 3527475 - RNA, 12 nt, Human
gaaaaaaagacu

SEQ ID NO: 3527476 - RNA, 20 nt, Human
gaaaaaaaguuugccagaag

SEQ ID NO: 3527477 - RNA, 15 nt, Human
gaaaaaaaucaucua

SEQ ID NO: 3527478 - RNA, 22 nt, Human
gaaaaaaaucuucuccagauuu

SEQ ID NO: 3527479 - RNA, 13 nt, Human
gaaaaaaauguau

SEQ ID NO: 3527480 - RNA, 19 nt, Human
gaaaaaaauguauuuuaug

SEQ ID NO: 3527481 - RNA, 15 nt, Human
gaaaaaaauugaaau

SEQ ID NO: 3527482 - RNA, 18 nt, Human
gaaaaaaauugaaaugua

SEQ ID NO: 3527483 - RNA, 10 nt, Human
gaaaaaagag

SEQ ID NO: 3527484 - RNA, 17 nt, Human
gaaaaaagagaaaagaa

SEQ ID NO: 3527485 - RNA, 18 nt, Human
gaaaaaagagaaaagaaa

SEQ ID NO: 3527486 - RNA, 10 nt, Human
gaaaaaauac

SEQ ID NO: 3527487 - RNA, 17 nt, Human
gaaaaaauacauuuuau

SEQ ID NO: 3527488 - RNA, 21 nt, Human
gaaaaaauguuggauuuauaa

SEQ ID NO: 3527489 - RNA, 14 nt, Human
gaaaaaauuuaaaa

SEQ ID NO: 3527490 - RNA, 23 nt, Human
gaaaaacaaacucguuuuuuaca

SEQ ID NO: 3527491 - RNA, 19 nt, Human
gaaaaacaaauucaucaaa

SEQ ID NO: 3527492 - RNA, 15 nt, Human
gaaaaacacaagcaa

SEQ ID NO: 3527493 - RNA, 23 nt, Human
gaaaaacacauggggaaaaaaau

SEQ ID NO: 3527494 - RNA, 23 nt, Human
gaaaaacaccgcuucugccuuuu

SEQ ID NO: 3527495 - RNA, 18 nt, Human
gaaaaacguguugccuug

SEQ ID NO: 3527496 - RNA, 20 nt, Human
gaaaaacucaaccaaauggu

SEQ ID NO: 3527497 - RNA, 16 nt, Human
gaaaaagaaaaaauau

SEQ ID NO: 3527498 - RNA, 22 nt, Human
gaaaaagaaaugcaaaaaucuc

SEQ ID NO: 3527499 - RNA, 12 nt, Human
gaaaaagaagca

SEQ ID NO: 3527500 - RNA, 16 nt, Human
gaaaaagcaaaaggca

SEQ ID NO: 3527501 - RNA, 15 nt, Human
gaaaaagcauguaca

SEQ ID NO: 3527502 - RNA, 17 nt, Human
gaaaaagcauguacagu

SEQ ID NO: 3527503 - RNA, 20 nt, Human
gaaaaagcauguacaguguu

SEQ ID NO: 3527504 - RNA, 11 nt, Human
gaaaaagcucc

SEQ ID NO: 3527505 - RNA, 21 nt, Human
gaaaaagcuccuguccuccca

SEQ ID NO: 3527506 - RNA, 18 nt, Human
gaaaaaggagcuuaccuc

SEQ ID NO: 3527507 - RNA, 15 nt, Human
gaaaaaggaggaaga

SEQ ID NO: 3527508 - RNA, 19 nt, Human
gaaaaagucauccaaucua

SEQ ID NO: 3527509 - RNA, 12 nt, Human
gaaaaagugaug

SEQ ID NO: 3527510 - RNA, 20 nt, Human
gaaaaaguuaaugcuuaaga

SEQ ID NO: 3527511 - RNA, 18 nt, Human
gaaaaaguucugcagaua

SEQ ID NO: 3527512 - RNA, 19 nt, Human
gaaaaauaacuucaagcaa

SEQ ID NO: 3527513 - RNA, 12 nt, Human
gaaaaauauaaa

SEQ ID NO: 3527514 - RNA, 16 nt, Human
gaaaaauaucuuggcc

SEQ ID NO: 3527515 - RNA, 10 nt, Human
gaaaaauaug

SEQ ID NO: 3527516 - RNA, 12 nt, Human
gaaaaauaugug

SEQ ID NO: 3527517 - RNA, 13 nt, Human
gaaaaauauguga

SEQ ID NO: 3527518 - RNA, 14 nt, Human
gaaaaauaugugaa

SEQ ID NO: 3527519 - RNA, 21 nt, Human
gaaaaaucaaguauuauaaac

SEQ ID NO: 3527520 - RNA, 15 nt, Human
gaaaaaucacuugau

SEQ ID NO: 3527521 - RNA, 17 nt, Human
gaaaaauccagaaagaa

SEQ ID NO: 3527522 - RNA, 18 nt, Human
gaaaaauccagaaagaaa

SEQ ID NO: 3527523 - RNA, 20 nt, Human
gaaaaauccucuuccucuga

SEQ ID NO: 3527524 - RNA, 20 nt, Human
gaaaaaucuaagugauauaa

SEQ ID NO: 3527525 - RNA, 21 nt, Human
gaaaaaucuugugcuagaaua

SEQ ID NO: 3527526 - RNA, 19 nt, Human
gaaaaaugaaagaugauuu

SEQ ID NO: 3527527 - RNA, 11 nt, Human
gaaaaauggag

SEQ ID NO: 3527528 - RNA, 12 nt, Human
gaaaaauguagg

SEQ ID NO: 3527529 - RNA, 14 nt, Human
gaaaaauguuuguc

SEQ ID NO: 3527530 - RNA, 11 nt, Human
gaaaaauuccu

SEQ ID NO: 3527531 - RNA, 15 nt, Human
gaaaaauuccuauug

SEQ ID NO: 3527532 - RNA, 21 nt, Human
gaaaaauugcugacuguagcu

SEQ ID NO: 3527533 - RNA, 18 nt, Human
gaaaaauuuaagcauugu

SEQ ID NO: 3527534 - RNA, 18 nt, Human
gaaaaauuugaaaaugau

SEQ ID NO: 3527535 - RNA, 13 nt, Human
gaaaacaaaacug

SEQ ID NO: 3527536 - RNA, 14 nt, Human
gaaaacaaggaagu

SEQ ID NO: 3527537 - RNA, 15 nt, Human
gaaaacaagugcugg

SEQ ID NO: 3527538 - RNA, 20 nt, Human
gaaaacaauggaguauucuc

SEQ ID NO: 3527539 - RNA, 14 nt, Human
gaaaacagaaaaaa

SEQ ID NO: 3527540 - RNA, 13 nt, Human
gaaaacagaaauu

SEQ ID NO: 3527541 - RNA, 15 nt, Human
gaaaacagaaauugg

SEQ ID NO: 3527542 - RNA, 20 nt, Human
gaaaacagaaauugguaccu

SEQ ID NO: 3527543 - RNA, 13 nt, Human
gaaaacagaccua

SEQ ID NO: 3527544 - RNA, 21 nt, Human
gaaaacagaccuaaugcuccu

SEQ ID NO: 3527545 - RNA, 23 nt, Human
gaaaacaggaaaaaaacuuuuau

SEQ ID NO: 3527546 - RNA, 20 nt, Human
gaaaacaggacuuaaaauga

SEQ ID NO: 3527547 - RNA, 12 nt, Human
gaaaacaggcac

SEQ ID NO: 3527548 - RNA, 22 nt, Human
gaaaacauaaaaaguuaaaaaa

SEQ ID NO: 3527549 - RNA, 14 nt, Human
gaaaacaucuccuu

SEQ ID NO: 3527550 - RNA, 15 nt, Human
gaaaacaucuccuua

SEQ ID NO: 3527551 - RNA, 12 nt, Human
gaaaacaugcua

SEQ ID NO: 3527552 - RNA, 15 nt, Human
gaaaacaugcuacac

SEQ ID NO: 3527553 - RNA, 15 nt, Human
gaaaacauguaauaa

SEQ ID NO: 3527554 - RNA, 11 nt, Human
gaaaaccaaaa

SEQ ID NO: 3527555 - RNA, 19 nt, Human
gaaaaccaagccguggcuu

SEQ ID NO: 3527556 - RNA, 18 nt, Human
gaaaaccaccccuuagau

SEQ ID NO: 3527557 - RNA, 16 nt, Human
gaaaaccaucuggccu

SEQ ID NO: 3527558 - RNA, 11 nt, Human
gaaaacccacc

SEQ ID NO: 3527559 - RNA, 12 nt, Human
gaaaacccagag

SEQ ID NO: 3527560 - RNA, 22 nt, Human
gaaaacccagagaggaaucaga

SEQ ID NO: 3527561 - RNA, 15 nt, Human
gaaaaccccuuccca

SEQ ID NO: 3527562 - RNA, 20 nt, Human
gaaaacccuugggccagaag

SEQ ID NO: 3527563 - RNA, 21 nt, Human
gaaaacccuugggccagaagu

SEQ ID NO: 3527564 - RNA, 21 nt, Human
gaaaaccuaaguccuuuaugu

SEQ ID NO: 3527565 - RNA, 14 nt, Human
gaaaacggagcuga

SEQ ID NO: 3527566 - RNA, 20 nt, Human
gaaaacguggcugcuucaag

SEQ ID NO: 3527567 - RNA, 16 nt, Human
gaaaacuacauuuuaa

SEQ ID NO: 3527568 - RNA, 17 nt, Human
gaaaacuacauuuuaac

SEQ ID NO: 3527569 - RNA, 18 nt, Human
gaaaacuacauuuuaaca

SEQ ID NO: 3527570 - RNA, 19 nt, Human
gaaaacuacauuuuaacau

SEQ ID NO: 3527571 - RNA, 21 nt, Human
gaaaacuacauuuuaacaugg

SEQ ID NO: 3527572 - RNA, 18 nt, Human
gaaaacuccaccuuccca

SEQ ID NO: 3527573 - RNA, 18 nt, Human
gaaaacucccauuuacgu

SEQ ID NO: 3527574 - RNA, 16 nt, Human
gaaaacugacagagga

SEQ ID NO: 3527575 - RNA, 17 nt, Human
gaaaacuggaauaagaa

SEQ ID NO: 3527576 - RNA, 11 nt, Human
gaaaacuguua

SEQ ID NO: 3527577 - RNA, 13 nt, Human
gaaaacuuaguuu

SEQ ID NO: 3527578 - RNA, 14 nt, Human
gaaaacuuauuuga

SEQ ID NO: 3527579 - RNA, 16 nt, Human
gaaaacuucagaagca

SEQ ID NO: 3527580 - RNA, 19 nt, Human
gaaaacuuguauuaugugu

SEQ ID NO: 3527581 - RNA, 22 nt, Human
gaaaacuuguauuauguguguu

SEQ ID NO: 3527582 - RNA, 16 nt, Human
gaaaacuuuaaagcgu

SEQ ID NO: 3527583 - RNA, 16 nt, Human
gaaaacuuuucucaga

SEQ ID NO: 3527584 - RNA, 18 nt, Human
gaaaagaaaaaaaaaaga

SEQ ID NO: 3527585 - RNA, 22 nt, Human
gaaaagaaaaaaaaaagaagaa

SEQ ID NO: 3527586 - RNA, 17 nt, Human
gaaaagaaaaaaaaaga

SEQ ID NO: 3527587 - RNA, 12 nt, Human
gaaaagaaaaag

SEQ ID NO: 3527588 - RNA, 23 nt, Human
gaaaagaaaaaugagccuggcaa

SEQ ID NO: 3527589 - RNA, 21 nt, Human
gaaaagaaaauuuuuguagua

SEQ ID NO: 3527590 - RNA, 22 nt, Human
gaaaagaaacucuauggucuua

SEQ ID NO: 3527591 - RNA, 21 nt, Human
gaaaagaaagaaguuauuuuc

SEQ ID NO: 3527592 - RNA, 11 nt, Human
gaaaagaaaua

SEQ ID NO: 3527593 - RNA, 22 nt, Human
gaaaagaaaucuauagaaagug

SEQ ID NO: 3527594 - RNA, 22 nt, Human
gaaaagaaaucuaugauuccag

SEQ ID NO: 3527595 - RNA, 16 nt, Human
gaaaagaauacagaaa

SEQ ID NO: 3527596 - RNA, 14 nt, Human
gaaaagaauagaag

SEQ ID NO: 3527597 - RNA, 22 nt, Human
gaaaagaauuguuggggguuuu

SEQ ID NO: 3527598 - RNA, 11 nt, Human
gaaaagaauuu

SEQ ID NO: 3527599 - RNA, 16 nt, Human
gaaaagacaagaaaau

SEQ ID NO: 3527600 - RNA, 13 nt, Human
cuacccuggacuu

SEQ ID NO: 3527601 - RNA, 14 nt, Human
cuacccuguguaua

SEQ ID NO: 3527602 - RNA, 19 nt, Human
cuacccuuaauuacuuaaa

SEQ ID NO: 3527603 - RNA, 17 nt, Human
cuaccgaaugugucuuu

SEQ ID NO: 3527604 - RNA, 19 nt, Human
cuaccgagucucuucucca

SEQ ID NO: 3527605 - RNA, 23 nt, Human
cuaccgccccaaaguaaaagaaa

SEQ ID NO: 3527606 - RNA, 16 nt, Human
cuaccgucuuuuccug

SEQ ID NO: 3527607 - RNA, 18 nt, Human
cuaccucaaccuguaaau

SEQ ID NO: 3527608 - RNA, 21 nt, Human
cuaccucaaccuguaaauuau

SEQ ID NO: 3527609 - RNA, 20 nt, Human
cuaccucaggcaggaagggc

SEQ ID NO: 3527610 - RNA, 15 nt, Human
cuaccucagguugcu

SEQ ID NO: 3527611 - RNA, 22 nt, Human
cuaccucagguugcugguugcu

SEQ ID NO: 3527612 - RNA, 12 nt, Human
cuaccucccucc

SEQ ID NO: 3527613 - RNA, 16 nt, Human
cuaccucccuugccuu

SEQ ID NO: 3527614 - RNA, 16 nt, Human
cuaccuccucuccuga

SEQ ID NO: 3527615 - RNA, 17 nt, Human
cuaccugaacacuuauu

SEQ ID NO: 3527616 - RNA, 22 nt, Human
cuaccugaacacuuauugcuuu

SEQ ID NO: 3527617 - RNA, 23 nt, Human
cuaccugaacacuuauugcuuug

SEQ ID NO: 3527618 - RNA, 11 nt, Human
cuaccugaggg

SEQ ID NO: 3527619 - RNA, 14 nt, Human
cuaccugaggggcc

SEQ ID NO: 3527620 - RNA, 15 nt, Human
cuaccugaggggccu

SEQ ID NO: 3527621 - RNA, 16 nt, Human
cuaccugccacucaca

SEQ ID NO: 3527622 - RNA, 22 nt, Human
cuaccugccacucacacagcca

SEQ ID NO: 3527623 - RNA, 16 nt, Human
cuaccugcccucaagg

SEQ ID NO: 3527624 - RNA, 17 nt, Human
cuaccugcccuggaaca

SEQ ID NO: 3527625 - RNA, 23 nt, Human
cuaccuggagggaagaguggagg

SEQ ID NO: 3527626 - RNA, 23 nt, Human
cuaccuguauuuaaaaauagaaa

SEQ ID NO: 3527627 - RNA, 17 nt, Human
cuaccuguguggacagg

SEQ ID NO: 3527628 - RNA, 16 nt, Human
cuaccuguucaguguc

SEQ ID NO: 3527629 - RNA, 22 nt, Human
cuaccuguugagcaucacagaa

SEQ ID NO: 3527630 - RNA, 22 nt, Human
cuaccuuaucacugcauuauuc

SEQ ID NO: 3527631 - RNA, 16 nt, Human
cuaccuucaaagcuga

SEQ ID NO: 3527632 - RNA, 18 nt, Human
cuaccuucauuucaggag

SEQ ID NO: 3527633 - RNA, 16 nt, Human
cuaccuucuccccagc

SEQ ID NO: 3527634 - RNA, 14 nt, Human
cuaccuugaaaaua

SEQ ID NO: 3527635 - RNA, 21 nt, Human
cuaccuugccccaacccuucu

SEQ ID NO: 3527636 - RNA, 13 nt, Human
cuaccuugcuuuu

SEQ ID NO: 3527637 - RNA, 21 nt, Human
cuaccuugguucccccacuga

SEQ ID NO: 3527638 - RNA, 16 nt, Human
cuaccuuucaaagcuu

SEQ ID NO: 3527639 - RNA, 17 nt, Human
cuaccuuuguauucucu

SEQ ID NO: 3527640 - RNA, 13 nt, Human
cuacgaaucuucc

SEQ ID NO: 3527641 - RNA, 22 nt, Human
cuacgcugaagauggcauccug

SEQ ID NO: 3527642 - RNA, 16 nt, Human
cuacgcuguccagaaa

SEQ ID NO: 3527643 - RNA, 12 nt, Human
cuacguuucuuu

SEQ ID NO: 3527644 - RNA, 14 nt, Human
cuacguuucuuuaa

SEQ ID NO: 3527645 - RNA, 15 nt, Human
cuacuaaaaauacaa

SEQ ID NO: 3527646 - RNA, 15 nt, Human
cuacuaaaaaugcaa

SEQ ID NO: 3527647 - RNA, 20 nt, Human
cuacuaaaaaugcaaaaaaa

SEQ ID NO: 3527648 - RNA, 16 nt, Human
cuacuaagaaaauaga

SEQ ID NO: 3527649 - RNA, 12 nt, Human
cuacuaauucca

SEQ ID NO: 3527650 - RNA, 17 nt, Human
cuacuaauuccacaccu

SEQ ID NO: 3527651 - RNA, 21 nt, Human
cuacuacaucgcccuccacau

SEQ ID NO: 3527652 - RNA, 22 nt, Human
cuacuagagucugaacagcugu

SEQ ID NO: 3527653 - RNA, 15 nt, Human
cuacuagaugucuuu

SEQ ID NO: 3527654 - RNA, 19 nt, Human
cuacuagcaaaauaaaaca

SEQ ID NO: 3527655 - RNA, 20 nt, Human
cuacuagggaaaugccuuug

SEQ ID NO: 3527656 - RNA, 18 nt, Human
cuacuagggaccugggga

SEQ ID NO: 3527657 - RNA, 20 nt, Human
cuacuagggaccuggggaag

SEQ ID NO: 3527658 - RNA, 21 nt, Human
cuacuagggaccuggggaagc

SEQ ID NO: 3527659 - RNA, 17 nt, Human
cuacuauaaagagaaga

SEQ ID NO: 3527660 - RNA, 14 nt, Human
cuacuauauaugug

SEQ ID NO: 3527661 - RNA, 18 nt, Human
cuacuauggcugaguucu

SEQ ID NO: 3527662 - RNA, 13 nt, Human
cuacucaaagcau

SEQ ID NO: 3527663 - RNA, 16 nt, Human
cuacucaagaggcuga

SEQ ID NO: 3527664 - RNA, 17 nt, Human
cuacucaagcggguggc

SEQ ID NO: 3527665 - RNA, 20 nt, Human
cuacucaagcggguggcucu

SEQ ID NO: 3527666 - RNA, 17 nt, Human
cuacucaaguagcauuu

SEQ ID NO: 3527667 - RNA, 15 nt, Human
cuacucacagucucu

SEQ ID NO: 3527668 - RNA, 15 nt, Human
cuacucacucaaguu

SEQ ID NO: 3527669 - RNA, 17 nt, Human
gaaaagguaaggugaag

SEQ ID NO: 3527670 - RNA, 23 nt, Human
gaaaagguagaggagucacguua

SEQ ID NO: 3527671 - RNA, 23 nt, Human
gaaaagguagcuuaccugacaca

SEQ ID NO: 3527672 - RNA, 20 nt, Human
gaaaagguucuuacugcuug

SEQ ID NO: 3527673 - RNA, 23 nt, Human
gaaaagguucuucaucccuuucc

SEQ ID NO: 3527674 - RNA, 13 nt, Human
gaaaagguugaau

SEQ ID NO: 3527675 - RNA, 23 nt, Human
gaaaagguuuaugaaaaagaaga

SEQ ID NO: 3527676 - RNA, 21 nt, Human
gaaaaguaaggugcaguuccc

SEQ ID NO: 3527677 - RNA, 14 nt, Human
gaaaaguaauauuu

SEQ ID NO: 3527678 - RNA, 17 nt, Human
gaaaaguaauauuuauu

SEQ ID NO: 3527679 - RNA, 20 nt, Human
gaaaaguaauauuuauuaaa

SEQ ID NO: 3527680 - RNA, 13 nt, Human
gaaaaguauguuc

SEQ ID NO: 3527681 - RNA, 19 nt, Human
gaaaaguauuuugaaguuu

SEQ ID NO: 3527682 - RNA, 12 nt, Human
gaaaaguucaua

SEQ ID NO: 3527683 - RNA, 23 nt, Human
gaaaaguuuagccccugaaagcc

SEQ ID NO: 3527684 - RNA, 17 nt, Human
gaaaauaaaaaaaagaa

SEQ ID NO: 3527685 - RNA, 16 nt, Human
gaaaauaaaaaguuaa

SEQ ID NO: 3527686 - RNA, 17 nt, Human
gaaaauaaaauuaagaa

SEQ ID NO: 3527687 - RNA, 20 nt, Human
gaaaauaaaauuaagaaugu

SEQ ID NO: 3527688 - RNA, 13 nt, Human
gaaaauaaagcua

SEQ ID NO: 3527689 - RNA, 18 nt, Human
gaaaauaacugaauuugg

SEQ ID NO: 3527690 - RNA, 17 nt, Human
gaaaauaagagcucagg

SEQ ID NO: 3527691 - RNA, 18 nt, Human
gaaaauaaucauucuuau

SEQ ID NO: 3527692 - RNA, 11 nt, Human
gaaaauaauug

SEQ ID NO: 3527693 - RNA, 20 nt, Human
gaaaauaauugacaggcgaa

SEQ ID NO: 3527694 - RNA, 19 nt, Human
gaaaauacaacuuaaauaa

SEQ ID NO: 3527695 - RNA, 17 nt, Human
gaaaauacuuaaauguu

SEQ ID NO: 3527696 - RNA, 18 nt, Human
gaaaauagagaugagcuu

SEQ ID NO: 3527697 - RNA, 19 nt, Human
gaaaauagcucuuucaggg

SEQ ID NO: 3527698 - RNA, 20 nt, Human
gaaaauaguaaaugcuuugu

SEQ ID NO: 3527699 - RNA, 16 nt, Human
gaaaauaguuauucag

SEQ ID NO: 3527700 - RNA, 14 nt, Human
gaaaauaguuuauu

SEQ ID NO: 3527701 - RNA, 15 nt, Human
gaaaauaguuuauuu

SEQ ID NO: 3527702 - RNA, 16 nt, Human
gaaaauauaugauggc

SEQ ID NO: 3527703 - RNA, 17 nt, Human
gaaaauaugucccagaa

SEQ ID NO: 3527704 - RNA, 17 nt, Human
gaaaauauuauguguuu

SEQ ID NO: 3527705 - RNA, 21 nt, Human
gaaaauauuauguguuuccau

SEQ ID NO: 3527706 - RNA, 20 nt, Human
gaaaauauucucuauuugaa

SEQ ID NO: 3527707 - RNA, 18 nt, Human
gaaaauauuuguaucaca

SEQ ID NO: 3527708 - RNA, 17 nt, Human
gaaaauauuuugaucuu

SEQ ID NO: 3527709 - RNA, 19 nt, Human
gaaaauauuuugucuaaaa

SEQ ID NO: 3527710 - RNA, 14 nt, Human
gaaaaucagccugc

SEQ ID NO: 3527711 - RNA, 16 nt, Human
gaaaaucagccugcuc

SEQ ID NO: 3527712 - RNA, 20 nt, Human
gaaaaucagccugcuccagc

SEQ ID NO: 3527713 - RNA, 11 nt, Human
gaaaaucauau

SEQ ID NO: 3527714 - RNA, 23 nt, Human
gaaaaucaucaagaagggcugca

SEQ ID NO: 3527715 - RNA, 22 nt, Human
gaaaaucuacacuccagugaga

SEQ ID NO: 3527716 - RNA, 18 nt, Human
gaaaaucugaauuggaau

SEQ ID NO: 3527717 - RNA, 15 nt, Human
gaaaaugaaccauuc

SEQ ID NO: 3527718 - RNA, 12 nt, Human
gaaaaugaauaa

SEQ ID NO: 3527719 - RNA, 13 nt, Human
gaaaaugaauaau

SEQ ID NO: 3527720 - RNA, 17 nt, Human
gaaaaugauacagcaga

SEQ ID NO: 3527721 - RNA, 20 nt, Human
gaaaaugauacgcaacauaa

SEQ ID NO: 3527722 - RNA, 14 nt, Human
gaaaaugaucugag

SEQ ID NO: 3527723 - RNA, 18 nt, Human
gaaaaugcaacaacaugu

SEQ ID NO: 3527724 - RNA, 20 nt, Human
gaaaaugcaacaacauguau

SEQ ID NO: 3527725 - RNA, 14 nt, Human
gaaaaugcagcagg

SEQ ID NO: 3527726 - RNA, 23 nt, Human
gaaaaugcagcagggaugcccug

SEQ ID NO: 3527727 - RNA, 23 nt, Human
gaaaaugcuguauuagucacaga

SEQ ID NO: 3527728 - RNA, 21 nt, Human
gaaaauggaagacagcucuua

SEQ ID NO: 3527729 - RNA, 19 nt, Human
gaaaauggacguguuauga

SEQ ID NO: 3527730 - RNA, 14 nt, Human
gaaaaugguauuuu

SEQ ID NO: 3527731 - RNA, 22 nt, Human
gaaaaugguccaauuaguuucc

SEQ ID NO: 3527732 - RNA, 18 nt, Human
gaaaaugguccaggagaa

SEQ ID NO: 3527733 - RNA, 20 nt, Human
gaaaaugguuuauuuuguau

SEQ ID NO: 3527734 - RNA, 23 nt, Human
gaaaaugguuuauuuuguauugu

SEQ ID NO: 3527735 - RNA, 16 nt, Human
gaaaauguaaguaaau

SEQ ID NO: 3527736 - RNA, 23 nt, Human
gaaaaugucagaaaccaguuaug

SEQ ID NO: 3527737 - RNA, 23 nt, Human
gaaaaugucuauucaaaauauca

SEQ ID NO: 3527738 - RNA, 21 nt, Human
gaaaaugucuuuauuaaaugu

SEQ ID NO: 3527739 - RNA, 14 nt, Human
gaaaauguguguuu

SEQ ID NO: 3527740 - RNA, 21 nt, Human
gaaaauguucuguuugcugug

SEQ ID NO: 3527741 - RNA, 21 nt, Human
gaaaauguugagaaucccaaa

SEQ ID NO: 3527742 - RNA, 14 nt, Human
gaaaauuaacauga

SEQ ID NO: 3527743 - RNA, 14 nt, Human
gaaaauuacaaaaa

SEQ ID NO: 3527744 - RNA, 21 nt, Human
gaacccuuggcuugcccacgu

SEQ ID NO: 3527745 - RNA, 18 nt, Human
gaacccuuuuggcccccg

SEQ ID NO: 3527746 - RNA, 23 nt, Human
gaacccuuuuggcccccgagcug

SEQ ID NO: 3527747 - RNA, 15 nt, Human
gaaccgaggcaggga

SEQ ID NO: 3527748 - RNA, 20 nt, Human
gaaccgagggggcugcuccc

SEQ ID NO: 3527749 - RNA, 21 nt, Human
gaaccgagggggcugcuccca

SEQ ID NO: 3527750 - RNA, 13 nt, Human
gaaccgcacagcu

SEQ ID NO: 3527751 - RNA, 14 nt, Human
gaaccgcacagcuc

SEQ ID NO: 3527752 - RNA, 16 nt, Human
gaaccgcacagcucag

SEQ ID NO: 3527753 - RNA, 17 nt, Human
gaaccgcacagcucagg

SEQ ID NO: 3527754 - RNA, 20 nt, Human
gaaccgcucaccuagagcca

SEQ ID NO: 3527755 - RNA, 12 nt, Human
gaaccguugcca

SEQ ID NO: 3527756 - RNA, 17 nt, Human
gaaccuaacuguaucuu

SEQ ID NO: 3527757 - RNA, 17 nt, Human
gaaccuagaagggcuag

SEQ ID NO: 3527758 - RNA, 21 nt, Human
gaaccuauuucucuuucuuua

SEQ ID NO: 3527759 - RNA, 22 nt, Human
gaaccucaccccgaggcccugc

SEQ ID NO: 3527760 - RNA, 23 nt, Human
gaaccucaccccgaggcccugca

SEQ ID NO: 3527761 - RNA, 19 nt, Human
gaaccucacgcaccuccca

SEQ ID NO: 3527762 - RNA, 13 nt, Human
gaaccucagccug

SEQ ID NO: 3527763 - RNA, 17 nt, Human
gaaccucagccuggcca

SEQ ID NO: 3527764 - RNA, 15 nt, Human
gaaccucauccagcu

SEQ ID NO: 3527765 - RNA, 21 nt, Human
gaaccucccagagguccagcc

SEQ ID NO: 3527766 - RNA, 22 nt, Human
gaaccuccccagccugcgccug

SEQ ID NO: 3527767 - RNA, 13 nt, Human
gaaccuccucugu

SEQ ID NO: 3527768 - RNA, 16 nt, Human
gaaccuccucugugaa

SEQ ID NO: 3527769 - RNA, 20 nt, Human
gaaccucgaguacugugggc

SEQ ID NO: 3527770 - RNA, 14 nt, Human
gaaccucugucuca

SEQ ID NO: 3527771 - RNA, 22 nt, Human
gaaccucugucucauccuccug

SEQ ID NO: 3527772 - RNA, 16 nt, Human
gaaccugcaaaaaaua

SEQ ID NO: 3527773 - RNA, 12 nt, Human
gaaccuggacca

SEQ ID NO: 3527774 - RNA, 16 nt, Human
gaaccuggaccaaagc

SEQ ID NO: 3527775 - RNA, 12 nt, Human
gaaccuggagag

SEQ ID NO: 3527776 - RNA, 21 nt, Human
gaaccuggagggcuggaaucu

SEQ ID NO: 3527777 - RNA, 17 nt, Human
gaaccuggaggggcuag

SEQ ID NO: 3527778 - RNA, 16 nt, Human
gaaccuggccuucagu

SEQ ID NO: 3527779 - RNA, 22 nt, Human
gaaccugggaaagagauuuaaa

SEQ ID NO: 3527780 - RNA, 21 nt, Human
gaaccuggguugcagacagga

SEQ ID NO: 3527781 - RNA, 16 nt, Human
gaaccuguccuaagga

SEQ ID NO: 3527782 - RNA, 20 nt, Human
gaaccuguccuugcacacuc

SEQ ID NO: 3527783 - RNA, 17 nt, Human
gaaccugugagcugcac

SEQ ID NO: 3527784 - RNA, 15 nt, Human
gaaccuugcuguccu

SEQ ID NO: 3527785 - RNA, 16 nt, Human
gaaccuugcuguccug

SEQ ID NO: 3527786 - RNA, 16 nt, Human
gaaccuuggccugggc

SEQ ID NO: 3527787 - RNA, 19 nt, Human
gaaccuugugccuggcuca

SEQ ID NO: 3527788 - RNA, 17 nt, Human
gaaccuuugugcccuau

SEQ ID NO: 3527789 - RNA, 22 nt, Human
gaaccuuuugagugccuuacac

SEQ ID NO: 3527790 - RNA, 14 nt, Human
gaacgagaggggaa

SEQ ID NO: 3527791 - RNA, 21 nt, Human
gaacgauauguagcagaaagg

SEQ ID NO: 3527792 - RNA, 20 nt, Human
gaacgcagcccuagagccug

SEQ ID NO: 3527793 - RNA, 21 nt, Human
gaacgcagcccuagagccugc

SEQ ID NO: 3527794 - RNA, 23 nt, Human
gaacgcagcccuagagccugccu

SEQ ID NO: 3527795 - RNA, 15 nt, Human
gaacgcguugaaauu

SEQ ID NO: 3527796 - RNA, 22 nt, Human
gaacggggcucuucucauuuca

SEQ ID NO: 3527797 - RNA, 16 nt, Human
gaacgggguccuucaa

SEQ ID NO: 3527798 - RNA, 18 nt, Human
gaacggugaaggugacag

SEQ ID NO: 3527799 - RNA, 13 nt, Human
gaacguaaagaac

SEQ ID NO: 3527800 - RNA, 15 nt, Human
gaacgucuuaucuaa

SEQ ID NO: 3527801 - RNA, 22 nt, Human
gaacgugacugccccaacuccu

SEQ ID NO: 3527802 - RNA, 20 nt, Human
gaacguuuagcugacaaaau

SEQ ID NO: 3527803 - RNA, 18 nt, Human
gaacguuugguucaaaug

SEQ ID NO: 3527804 - RNA, 14 nt, Human
gaacguuuucuaau

SEQ ID NO: 3527805 - RNA, 12 nt, Human
gaacguuuuucc

SEQ ID NO: 3527806 - RNA, 23 nt, Human
gaacuaaacuaguuuuuccuauc

SEQ ID NO: 3527807 - RNA, 17 nt, Human
gaacuaaacucauuuau

SEQ ID NO: 3527808 - RNA, 14 nt, Human
gaacuaaacuuuca

SEQ ID NO: 3527809 - RNA, 16 nt, Human
gaacuaaacuuucaca

SEQ ID NO: 3527810 - RNA, 14 nt, Human
gaacuaaauguucu

SEQ ID NO: 3527811 - RNA, 16 nt, Human
gaacuaaauguucuau

SEQ ID NO: 3527812 - RNA, 19 nt, Human
gaacuaccuugguuccccc

SEQ ID NO: 3527813 - RNA, 19 nt, Human
gaacuagaauuugauuauu

SEQ ID NO: 3527814 - RNA, 19 nt, Human
gaacuagacugccuggguu

SEQ ID NO: 3527815 - RNA, 22 nt, Human
gaacuagaguuuagcuggaaaa

SEQ ID NO: 3527816 - RNA, 22 nt, Human
gaacuagccaccaacucuugca

SEQ ID NO: 3527817 - RNA, 19 nt, Human
gaacuauauuaguauguau

SEQ ID NO: 3527818 - RNA, 13 nt, Human
gaacuaucuucau

SEQ ID NO: 3527819 - RNA, 14 nt, Human
gaacuaucuucauc

SEQ ID NO: 3527820 - RNA, 21 nt, Human
gaacuauggacggugcuccag

SEQ ID NO: 3527821 - RNA, 18 nt, Human
gaacuauuccccagcagg

SEQ ID NO: 3527822 - RNA, 20 nt, Human
gaacuauugugcucagagac

SEQ ID NO: 3527823 - RNA, 16 nt, Human
gaacucaaauggggcc

SEQ ID NO: 3527824 - RNA, 13 nt, Human
gaacucacucugg

SEQ ID NO: 3527825 - RNA, 16 nt, Human
gaacucacucugggcu

SEQ ID NO: 3527826 - RNA, 16 nt, Human
gaacucacuggggccu

SEQ ID NO: 3527827 - RNA, 18 nt, Human
gaacucagccaagcacag

SEQ ID NO: 3527828 - RNA, 20 nt, Human
gaacucagccaagcacagug

SEQ ID NO: 3527829 - RNA, 24 nt, Human
gaacucagccaagcacaguggugg

SEQ ID NO: 3527830 - RNA, 20 nt, Human
gaacucagcugucuguggcu

SEQ ID NO: 3527831 - RNA, 14 nt, Human
gaacucaucacugu

SEQ ID NO: 3527832 - RNA, 18 nt, Human
gaacucaucccuaaugcu

SEQ ID NO: 3527833 - RNA, 22 nt, Human
gaacucaucccuaaugcugcag

SEQ ID NO: 3527834 - RNA, 16 nt, Human
gaacucaugugauuua

SEQ ID NO: 3527835 - RNA, 14 nt, Human
gaacucauuccugc

SEQ ID NO: 3527836 - RNA, 17 nt, Human
gaaagcgccuccaaccc

SEQ ID NO: 3527837 - RNA, 18 nt, Human
gaaagcuccuagcagaga

SEQ ID NO: 3527838 - RNA, 20 nt, Human
gaaagcuccuagcagagaga

SEQ ID NO: 3527839 - RNA, 12 nt, Human
gaaagcugauua

SEQ ID NO: 3527840 - RNA, 21 nt, Human
gaaagcugguaaacuauuugu

SEQ ID NO: 3527841 - RNA, 18 nt, Human
gaaagcuucagugcugcc

SEQ ID NO: 3527842 - RNA, 20 nt, Human
gaaaggaaaaccugaagacu

SEQ ID NO: 3527843 - RNA, 13 nt, Human
gaaaggaaaccuu

SEQ ID NO: 3527844 - RNA, 16 nt, Human
gaaaggaagcugugcg

SEQ ID NO: 3527845 - RNA, 23 nt, Human
gaaaggacucugggguuuuuacu

SEQ ID NO: 3527846 - RNA, 15 nt, Human
gaaaggagaguacuu

SEQ ID NO: 3527847 - RNA, 19 nt, Human
gaaaggaggcaugccucug

SEQ ID NO: 3527848 - RNA, 21 nt, Human
gaaaggaggcaugccucugau

SEQ ID NO: 3527849 - RNA, 22 nt, Human
gaaaggaguuucuuuagcugac

SEQ ID NO: 3527850 - RNA, 17 nt, Human
gaaaggauauuuaagaa

SEQ ID NO: 3527851 - RNA, 21 nt, Human
gaaaggauauuuaagaaaaua

SEQ ID NO: 3527852 - RNA, 22 nt, Human
gaaaggauauuuaagaaaauac

SEQ ID NO: 3527853 - RNA, 14 nt, Human
gaaaggauucaugu

SEQ ID NO: 3527854 - RNA, 20 nt, Human
gaaaggcaggccuauuucau

SEQ ID NO: 3527855 - RNA, 16 nt, Human
gaaaggcauucucuga

SEQ ID NO: 3527856 - RNA, 21 nt, Human
gaaaggccagcuggcagcaga

SEQ ID NO: 3527857 - RNA, 22 nt, Human
gaaaggccagcuggcagcagag

SEQ ID NO: 3527858 - RNA, 15 nt, Human
gaaaggccugcacac

SEQ ID NO: 3527859 - RNA, 16 nt, Human
gaaaggccugcacaca

SEQ ID NO: 3527860 - RNA, 14 nt, Human
gaaaggccuuuaaa

SEQ ID NO: 3527861 - RNA, 18 nt, Human
gaaaggccuuuaaaauuu

SEQ ID NO: 3527862 - RNA, 18 nt, Human
gaaaggcucagucucagg

SEQ ID NO: 3527863 - RNA, 19 nt, Human
gaaaggcucagucucagga

SEQ ID NO: 3527864 - RNA, 21 nt, Human
gaaaggcucagucucaggagc

SEQ ID NO: 3527865 - RNA, 22 nt, Human
gaaaggcucagucucaggagca

SEQ ID NO: 3527866 - RNA, 14 nt, Human
gaaaggcuccagga

SEQ ID NO: 3527867 - RNA, 20 nt, Human
gaaaggcuccaggagcagcc

SEQ ID NO: 3527868 - RNA, 22 nt, Human
gaaaggcuccaggagcagccac

SEQ ID NO: 3527869 - RNA, 17 nt, Human
gaaaggcucugaaagcc

SEQ ID NO: 3527870 - RNA, 19 nt, Human
gaaaggcugcuguacugaa

SEQ ID NO: 3527871 - RNA, 16 nt, Human
gaaagggacaaugaua

SEQ ID NO: 3527872 - RNA, 22 nt, Human
gaaagggacuuggaagcuccgc

SEQ ID NO: 3527873 - RNA, 14 nt, Human
gaaagggaucauca

SEQ ID NO: 3527874 - RNA, 21 nt, Human
gaaagggcccugggccugccu

SEQ ID NO: 3527875 - RNA, 15 nt, Human
gaaaggggagagccu

SEQ ID NO: 3527876 - RNA, 21 nt, Human
gaaaggggagagccugcuggc

SEQ ID NO: 3527877 - RNA, 15 nt, Human
gaaaggggagcccac

SEQ ID NO: 3527878 - RNA, 17 nt, Human
gaaaggggauuacaguu

SEQ ID NO: 3527879 - RNA, 20 nt, Human
gaaaggggcaguuuaaagca

SEQ ID NO: 3527880 - RNA, 18 nt, Human
gaaagggggucccagugg

SEQ ID NO: 3527881 - RNA, 23 nt, Human
gaaagggggucccagugggaggg

SEQ ID NO: 3527882 - RNA, 17 nt, Human
gaaaggggucggcugac

SEQ ID NO: 3527883 - RNA, 14 nt, Human
gaaagggguugggg

SEQ ID NO: 3527884 - RNA, 16 nt, Human
gaaagggugcugcuuc

SEQ ID NO: 3527885 - RNA, 23 nt, Human
gaaaggguguuuuucuguuuuau

SEQ ID NO: 3527886 - RNA, 21 nt, Human
gaaagguacuauauuugcuag

SEQ ID NO: 3527887 - RNA, 18 nt, Human
cuauauuuuaaccugcau

SEQ ID NO: 3527888 - RNA, 17 nt, Human
cuauauuuuacauaaau

SEQ ID NO: 3527889 - RNA, 19 nt, Human
cuauauuuucauucuccua

SEQ ID NO: 3527890 - RNA, 13 nt, Human
cuauauuuuccug

SEQ ID NO: 3527891 - RNA, 16 nt, Human
cuauauuuugucauau

SEQ ID NO: 3527892 - RNA, 17 nt, Human
gaaggcaggcagggcuc

SEQ ID NO: 3527893 - RNA, 22 nt, Human
gaaggcaggcagggcucuccug

SEQ ID NO: 3527894 - RNA, 13 nt, Human
gaaggcagggagg

SEQ ID NO: 3527895 - RNA, 23 nt, Human
gaaggcagggagggccugggccc

SEQ ID NO: 3527896 - RNA, 14 nt, Human
gaaggccacagcaa

SEQ ID NO: 3527897 - RNA, 17 nt, Human
gaaggccaccugcaggu

SEQ ID NO: 3527898 - RNA, 23 nt, Human
gaaggcccagcaccacccuccuu

SEQ ID NO: 3527899 - RNA, 14 nt, Human
gaaggccccgccca

SEQ ID NO: 3527900 - RNA, 16 nt, Human
gaaggccccgcccagg

SEQ ID NO: 3527901 - RNA, 17 nt, Human
gaaggccccgcccaggc

SEQ ID NO: 3527902 - RNA, 17 nt, Human
gaaggccgagaagcaag

SEQ ID NO: 3527903 - RNA, 22 nt, Human
gaaggccgagaagcaagaaaga

SEQ ID NO: 3527904 - RNA, 14 nt, Human
gaaggccucgcagg

SEQ ID NO: 3527905 - RNA, 20 nt, Human
gaaggccugacuucugcugg

SEQ ID NO: 3527906 - RNA, 19 nt, Human
gaaggcuacuucggggcug

SEQ ID NO: 3527907 - RNA, 15 nt, Human
gaaggcuauggggau

SEQ ID NO: 3527908 - RNA, 16 nt, Human
gaaggcucgagcaugc

SEQ ID NO: 3527909 - RNA, 21 nt, Human
gaaggcucuucuccccagagu

SEQ ID NO: 3527910 - RNA, 23 nt, Human
gaaggcucuucuccccagaguuc

SEQ ID NO: 3527911 - RNA, 13 nt, Human
gaaggcugccaac

SEQ ID NO: 3527912 - RNA, 16 nt, Human
gaaggcuggcugggca

SEQ ID NO: 3527913 - RNA, 18 nt, Human
gaaggcuggggcuauuua

SEQ ID NO: 3527914 - RNA, 19 nt, Human
gaaggcuggguucugaucc

SEQ ID NO: 3527915 - RNA, 12 nt, Human
gaaggcuguacg

SEQ ID NO: 3527916 - RNA, 16 nt, Human
gaaggcuugggauuug

SEQ ID NO: 3527917 - RNA, 17 nt, Human
gaaggcuuucagggccu

SEQ ID NO: 3527918 - RNA, 19 nt, Human
gaaggcuuuuggucucccu

SEQ ID NO: 3527919 - RNA, 14 nt, Human
gaagggaaaguuuu

SEQ ID NO: 3527920 - RNA, 20 nt, Human
gaagggaauccuccuccagg

SEQ ID NO: 3527921 - RNA, 21 nt, Human
gaagggaccaaggcaaggcag

SEQ ID NO: 3527922 - RNA, 12 nt, Human
gaagggagaagg

SEQ ID NO: 3527923 - RNA, 16 nt, Human
gaagggagagccagcu

SEQ ID NO: 3527924 - RNA, 16 nt, Human
gaagggagcagcacac

SEQ ID NO: 3527925 - RNA, 12 nt, Human
gaagggagccaa

SEQ ID NO: 3527926 - RNA, 13 nt, Human
gaagggagccaag

SEQ ID NO: 3527927 - RNA, 13 nt, Human
gaagggaggcugg

SEQ ID NO: 3527928 - RNA, 14 nt, Human
gaagggaggugggg

SEQ ID NO: 3527929 - RNA, 18 nt, Human
gaagggauaugugaaaca

SEQ ID NO: 3527930 - RNA, 20 nt, Human
gaagggauuuuagucacacg

SEQ ID NO: 3527931 - RNA, 21 nt, Human
gaagggcauaaaacagcuuug

SEQ ID NO: 3527932 - RNA, 16 nt, Human
gaagggcauucuuucc

SEQ ID NO: 3527933 - RNA, 14 nt, Human
gaagggccagagcc

SEQ ID NO: 3527934 - RNA, 17 nt, Human
gaagggccagagccagg

SEQ ID NO: 3527935 - RNA, 18 nt, Human
gaagggccaguccugccu

SEQ ID NO: 3527936 - RNA, 14 nt, Human
gaagggccagucug

SEQ ID NO: 3527937 - RNA, 22 nt, Human
gaagggccugcccaguugcacu

SEQ ID NO: 3527938 - RNA, 20 nt, Human
gaagggcuagaaccuggagg

SEQ ID NO: 3527939 - RNA, 15 nt, Human
gaaggggacccuccg

SEQ ID NO: 3527940 - RNA, 15 nt, Human
gaaggggacugccac

SEQ ID NO: 3527941 - RNA, 15 nt, Human
gaaggggaggagggc

SEQ ID NO: 3527942 - RNA, 20 nt, Human
gaaggggcuggacuggcugu

SEQ ID NO: 3527943 - RNA, 13 nt, Human
gaagggggauaug

SEQ ID NO: 3527944 - RNA, 13 nt, Human
gaagggggcuggg

SEQ ID NO: 3527945 - RNA, 19 nt, Human
gaagggggcugggacaugg

SEQ ID NO: 3527946 - RNA, 20 nt, Human
gaagggggucaaagcaagga

SEQ ID NO: 3527947 - RNA, 19 nt, Human
gaaggggguggugucucca

SEQ ID NO: 3527948 - RNA, 14 nt, Human
gaaggguaaacaau

SEQ ID NO: 3527949 - RNA, 13 nt, Human
gaaggguaaagaa

SEQ ID NO: 3527950 - RNA, 13 nt, Human
gaaggguuucucu

SEQ ID NO: 3527951 - RNA, 15 nt, Human
gaaggguuuguggcu

SEQ ID NO: 3527952 - RNA, 13 nt, Human
gaagguaaaaagu

SEQ ID NO: 3527953 - RNA, 18 nt, Human
gaagguauuaagauuaua

SEQ ID NO: 3527954 - RNA, 21 nt, Human
gaaggucacucuuccugcaag

SEQ ID NO: 3527955 - RNA, 23 nt, Human
gaaggucacucuuccugcaagga

SEQ ID NO: 3527956 - RNA, 15 nt, Human
gaaggucauuuccau

SEQ ID NO: 3527957 - RNA, 20 nt, Human
gaaggugaaacauuuucucc

SEQ ID NO: 3527958 - RNA, 12 nt, Human
gaaggugaauag

SEQ ID NO: 3527959 - RNA, 22 nt, Human
gaaggugaauagccauauuugu

SEQ ID NO: 3527960 - RNA, 15 nt, Human
gaaggugacagcagu

SEQ ID NO: 3527961 - RNA, 23 nt, Human
gaaggugauaagggaaaagauaa

SEQ ID NO: 3527962 - RNA, 21 nt, Human
gaaggugauuuaagggcccag

SEQ ID NO: 3527963 - RNA, 23 nt, Human
gaaggugccucuggaugcuguga

SEQ ID NO: 3527964 - RNA, 19 nt, Human
gaaggugcugacggccagg

SEQ ID NO: 3527965 - RNA, 14 nt, Human
gaaggugcuggagg

SEQ ID NO: 3527966 - RNA, 16 nt, Human
gaaggugcuggaggug

SEQ ID NO: 3527967 - RNA, 18 nt, Human
gaaggugcuggagguggg

SEQ ID NO: 3527968 - RNA, 23 nt, Human
gaaggugcuggaggugggagcag

SEQ ID NO: 3527969 - RNA, 18 nt, Human
gaagguggccucugugga

SEQ ID NO: 3527970 - RNA, 22 nt, Human
gaagguggccuuccugcuguua

SEQ ID NO: 3527971 - RNA, 23 nt, Human
gaagguggugggggugcagauga

SEQ ID NO: 3527972 - RNA, 19 nt, Human
gaagguucauguagagaaa

SEQ ID NO: 3527973 - RNA, 12 nt, Human
gaagguuguaag

SEQ ID NO: 3527974 - RNA, 15 nt, Human
gaagguugugaugaa

SEQ ID NO: 3527975 - RNA, 14 nt, Human
gaagguuuauuguu

SEQ ID NO: 3527976 - RNA, 22 nt, Human
gaagguuuauuguuaauacaag

SEQ ID NO: 3527977 - RNA, 15 nt, Human
gaagguuuguauauu

SEQ ID NO: 3527978 - RNA, 16 nt, Human
gaagguuuguguuuuu

SEQ ID NO: 3527979 - RNA, 16 nt, Human
gaaguaaacuuuuugu

SEQ ID NO: 3527980 - RNA, 20 nt, Human
gaaguaaacuuuuuguucug

SEQ ID NO: 3527981 - RNA, 12 nt, Human
gaaguaaagccu

SEQ ID NO: 3527982 - RNA, 20 nt, Human
gaaguaacuugucuuaaaua

SEQ ID NO: 3527983 - RNA, 17 nt, Human
gaaguaagugggguugc

SEQ ID NO: 3527984 - RNA, 21 nt, Human
gaaguaauaugcacacauuuu

SEQ ID NO: 3527985 - RNA, 13 nt, Human
gaaguaaugaauu

SEQ ID NO: 3527986 - RNA, 15 nt, Human
gaaguaaugaauuuu

SEQ ID NO: 3527987 - RNA, 14 nt, Human
gaaguaccagacua

SEQ ID NO: 3527988 - RNA, 23 nt, Human
gaaguacuugccagaaguugugg

SEQ ID NO: 3527989 - RNA, 13 nt, Human
gaaguagcacagg

SEQ ID NO: 3527990 - RNA, 15 nt, Human
gaaguagcacaggcu

SEQ ID NO: 3527991 - RNA, 23 nt, Human
gaaguaguggagccccugcucug

SEQ ID NO: 3527992 - RNA, 14 nt, Human
gaaguaguuaucau

SEQ ID NO: 3527993 - RNA, 15 nt, Human
gaaguaguuaucaug

SEQ ID NO: 3527994 - RNA, 17 nt, Human
gaaguaguuaucauguu

SEQ ID NO: 3527995 - RNA, 21 nt, Human
gaaguaguuaucauguuagua

SEQ ID NO: 3527996 - RNA, 16 nt, Human
gaaguauccuucagcc

SEQ ID NO: 3527997 - RNA, 16 nt, Human
gaaguaugagggaaaa

SEQ ID NO: 3527998 - RNA, 15 nt, Human
gaaguauuauaaauu

SEQ ID NO: 3527999 - RNA, 16 nt, Human
gaaguauuauaaauua

SEQ ID NO: 3528000 - RNA, 19 nt, Human
gaaguauuauaaauuaugu

SEQ ID NO: 3528001 - RNA, 15 nt, Human
gaagucaaagcaagg

SEQ ID NO: 3528002 - RNA, 16 nt, Human
gaagucaauaugugga

SEQ ID NO: 3528003 - RNA, 19 nt, Human
gaagucaauuacucuauaa

SEQ ID NO: 3528004 - RNA, 16 nt, Human
gaagucacauuccuga

SEQ ID NO: 3528005 - RNA, 20 nt, Human
gaagucacauuccugaacag

SEQ ID NO: 3528006 - RNA, 14 nt, Human
gaagucagaucugc

SEQ ID NO: 3528007 - RNA, 15 nt, Human
gaagucauuaaacug

SEQ ID NO: 3528008 - RNA, 12 nt, Human
gaaguccaagca

SEQ ID NO: 3528009 - RNA, 16 nt, Human
gaaguccccaggcccc

SEQ ID NO: 3528010 - RNA, 22 nt, Human
gaaguccccuuccaucccagag

SEQ ID NO: 3528011 - RNA, 18 nt, Human
gaagucccuugccauccu

SEQ ID NO: 3528012 - RNA, 15 nt, Human
gaaguccggccccag

SEQ ID NO: 3528013 - RNA, 22 nt, Human
gaaguccuauggaaacccgagg

SEQ ID NO: 3528014 - RNA, 14 nt, Human
gaaguccuuauguu

SEQ ID NO: 3528015 - RNA, 15 nt, Human
gaagucuaggagcug

SEQ ID NO: 3528016 - RNA, 16 nt, Human
gaagucuaggagcugg

SEQ ID NO: 3528017 - RNA, 22 nt, Human
gaagucuaggagcugggaggaa

SEQ ID NO: 3528018 - RNA, 19 nt, Human
gaagucuuacuacagaaau

SEQ ID NO: 3528019 - RNA, 15 nt, Human
gaagucuuagaugua

SEQ ID NO: 3528020 - RNA, 18 nt, Human
gaagucuuagauguauau

SEQ ID NO: 3528021 - RNA, 18 nt, Human
gaagucuucaugaaaugc

SEQ ID NO: 3528022 - RNA, 9 nt, Human
gaagucuug

SEQ ID NO: 3528023 - RNA, 14 nt, Human
gaagucuuguauaa

SEQ ID NO: 3528024 - RNA, 18 nt, Human
gaagucuuucaagaauga

SEQ ID NO: 3528025 - RNA, 14 nt, Human
gaagucuuuguaca

SEQ ID NO: 3528026 - RNA, 18 nt, Human
gaagucuuuguacagaca

SEQ ID NO: 3528027 - RNA, 15 nt, Human
gaagugaagaaugca

SEQ ID NO: 3528028 - RNA, 17 nt, Human
gaagugaaugcugggac

SEQ ID NO: 3528029 - RNA, 13 nt, Human
gaagugacaggga

SEQ ID NO: 3528030 - RNA, 16 nt, Human
gaagugacgguuccua

SEQ ID NO: 3528031 - RNA, 16 nt, Human
gaagugagaaaaugaa

SEQ ID NO: 3528032 - RNA, 18 nt, Human
gaagugagcuuugcugcu

SEQ ID NO: 3528033 - RNA, 23 nt, Human
cuaugggacucaaugcacugaca

SEQ ID NO: 3528034 - RNA, 22 nt, Human
cuaugggagagugucaaccaga

SEQ ID NO: 3528035 - RNA, 13 nt, Human
cuaugggagcccc

SEQ ID NO: 3528036 - RNA, 13 nt, Human
cuaugggccugcc

SEQ ID NO: 3528037 - RNA, 19 nt, Human
cuaugggccugccgggcug

SEQ ID NO: 3528038 - RNA, 22 nt, Human
cuauggggagaggaacuccuug

SEQ ID NO: 3528039 - RNA, 21 nt, Human
cuauggguuuaguuacuuuag

SEQ ID NO: 3528040 - RNA, 16 nt, Human
cuaugguaaagauauu

SEQ ID NO: 3528041 - RNA, 16 nt, Human
cuauggucaucuuuuu

SEQ ID NO: 3528042 - RNA, 21 nt, Human
cuauggucgggagacagcauc

SEQ ID NO: 3528043 - RNA, 17 nt, Human
cuauggugcucugucua

SEQ ID NO: 3528044 - RNA, 22 nt, Human
cuaugguguaaucaugaaggag

SEQ ID NO: 3528045 - RNA, 15 nt, Human
cuaugguuaugaaag

SEQ ID NO: 3528046 - RNA, 16 nt, Human
cuaugguuaugaaaga

SEQ ID NO: 3528047 - RNA, 22 nt, Human
cuauguaacauguaggaaguag

SEQ ID NO: 3528048 - RNA, 21 nt, Human
cuauguaagaauucagaagac

SEQ ID NO: 3528049 - RNA, 21 nt, Human
cuauguacaauauuuuaagca

SEQ ID NO: 3528050 - RNA, 13 nt, Human
cuauguauaaaau

SEQ ID NO: 3528051 - RNA, 14 nt, Human
cuauguauauacau

SEQ ID NO: 3528052 - RNA, 16 nt, Human
cuauguaucaaugagu

SEQ ID NO: 3528053 - RNA, 16 nt, Human
cuaugucauuucaugu

SEQ ID NO: 3528054 - RNA, 14 nt, Human
cuauguccuaagga

SEQ ID NO: 3528055 - RNA, 20 nt, Human
cuauguccuaaggacacacu

SEQ ID NO: 3528056 - RNA, 11 nt, Human
cuaugugauuu

SEQ ID NO: 3528057 - RNA, 17 nt, Human
gaagccuucaagcucug

SEQ ID NO: 3528058 - RNA, 16 nt, Human
gaagccuucagcucca

SEQ ID NO: 3528059 - RNA, 22 nt, Human
gaagccuugccuaaauuuaaug

SEQ ID NO: 3528060 - RNA, 13 nt, Human
gaagccuuuggga

SEQ ID NO: 3528061 - RNA, 13 nt, Human
gaagcguauguuu

SEQ ID NO: 3528062 - RNA, 16 nt, Human
gaagcuaacagggaag

SEQ ID NO: 3528063 - RNA, 19 nt, Human
gaagcuaacagggaaggca

SEQ ID NO: 3528064 - RNA, 22 nt, Human
gaagcuaacagggaaggcaggc

SEQ ID NO: 3528065 - RNA, 13 nt, Human
gaagcuaauuauu

SEQ ID NO: 3528066 - RNA, 18 nt, Human
gaagcuaauuauuuuaau

SEQ ID NO: 3528067 - RNA, 16 nt, Human
gaagcuaauuugcauu

SEQ ID NO: 3528068 - RNA, 21 nt, Human
gaagcuacagguuacaacaga

SEQ ID NO: 3528069 - RNA, 15 nt, Human
gaagcuagcuccccu

SEQ ID NO: 3528070 - RNA, 20 nt, Human
gaagcucaccuguugcuuac

SEQ ID NO: 3528071 - RNA, 15 nt, Human
gaagcucagcccacc

SEQ ID NO: 3528072 - RNA, 17 nt, Human
gaagcucagcccacccc

SEQ ID NO: 3528073 - RNA, 14 nt, Human
gaagcucagggccu

SEQ ID NO: 3528074 - RNA, 15 nt, Human
gaagcucagggccug

SEQ ID NO: 3528075 - RNA, 14 nt, Human
gaagcuccacuguc

SEQ ID NO: 3528076 - RNA, 11 nt, Human
gaagcuccagu

SEQ ID NO: 3528077 - RNA, 20 nt, Human
gaagcucccccagcaaagcc

SEQ ID NO: 3528078 - RNA, 21 nt, Human
gaagcucccccagcaaagccc

SEQ ID NO: 3528079 - RNA, 22 nt, Human
gaagcuccgcuuucuacccagc

SEQ ID NO: 3528080 - RNA, 22 nt, Human
gaagcuccucuccccagcccag

SEQ ID NO: 3528081 - RNA, 19 nt, Human
gaagcugacgaacuuccau

SEQ ID NO: 3528082 - RNA, 14 nt, Human
gaagcugagcacca

SEQ ID NO: 3528083 - RNA, 22 nt, Human
gaagcugaggcaggugaauugu

SEQ ID NO: 3528084 - RNA, 18 nt, Human
gaagcugaggcgggagaa

SEQ ID NO: 3528085 - RNA, 21 nt, Human
gaagcugaugcuuugcuucaa

SEQ ID NO: 3528086 - RNA, 18 nt, Human
gaagcugcagcuugggag

SEQ ID NO: 3528087 - RNA, 15 nt, Human
gaagcugcaggcuuu

SEQ ID NO: 3528088 - RNA, 20 nt, Human
gaagcugcucaacuugcaaa

SEQ ID NO: 3528089 - RNA, 18 nt, Human
gaagcugcuccaggccug

SEQ ID NO: 3528090 - RNA, 13 nt, Human
gaagcugcugacc

SEQ ID NO: 3528091 - RNA, 14 nt, Human
gaagcuggccugag

SEQ ID NO: 3528092 - RNA, 22 nt, Human
gaagcuggccugagaggggaag

SEQ ID NO: 3528093 - RNA, 17 nt, Human
gaagcugggguucauga

SEQ ID NO: 3528094 - RNA, 22 nt, Human
gaagcuguguccuugcaccugc

SEQ ID NO: 3528095 - RNA, 16 nt, Human
gaagcuguuguacauu

SEQ ID NO: 3528096 - RNA, 22 nt, Human
gaagcuguuguacauuuaugau

SEQ ID NO: 3528097 - RNA, 23 nt, Human
gaagcuuauuaaugcuaagggca

SEQ ID NO: 3528098 - RNA, 11 nt, Human
gaagcuucuaa

SEQ ID NO: 3528099 - RNA, 19 nt, Human
gaagcuucuaauaaauuau

SEQ ID NO: 3528100 - RNA, 15 nt, Human
gaagcuucugucucc

SEQ ID NO: 3528101 - RNA, 18 nt, Human
gaagcuuggggaagaccc

SEQ ID NO: 3528102 - RNA, 19 nt, Human
gaagcuuggggaagaccca

SEQ ID NO: 3528103 - RNA, 15 nt, Human
gaagcuuugaaggcc

SEQ ID NO: 3528104 - RNA, 14 nt, Human
gaagcuuuggugag

SEQ ID NO: 3528105 - RNA, 20 nt, Human
gaagcuuuguccccugcuuc

SEQ ID NO: 3528106 - RNA, 15 nt, Human
gaaggaaaaaugugu

SEQ ID NO: 3528107 - RNA, 15 nt, Human
gaaggaaaaauucaa

SEQ ID NO: 3528108 - RNA, 18 nt, Human
gaaggaaacccagcucug

SEQ ID NO: 3528109 - RNA, 19 nt, Human
gaaggaaacccagcucugg

SEQ ID NO: 3528110 - RNA, 22 nt, Human
gaaggaaacccagcucuggucc

SEQ ID NO: 3528111 - RNA, 23 nt, Human
gaaggaaauaaaaaagucucuau

SEQ ID NO: 3528112 - RNA, 15 nt, Human
gaaggaacucuggcu

SEQ ID NO: 3528113 - RNA, 23 nt, Human
gaaggaacuugucucuucaucua

SEQ ID NO: 3528114 - RNA, 22 nt, Human
gaaggaagccaaauuuaucaaa

SEQ ID NO: 3528115 - RNA, 19 nt, Human
gaaggaaggcagggaggag

SEQ ID NO: 3528116 - RNA, 16 nt, Human
gaaggaagugaagagg

SEQ ID NO: 3528117 - RNA, 22 nt, Human
gaaggaauaaauugcuccuuga

SEQ ID NO: 3528118 - RNA, 17 nt, Human
gaaggacacuuccugcc

SEQ ID NO: 3528119 - RNA, 14 nt, Human
gaaggacaggagga

SEQ ID NO: 3528120 - RNA, 13 nt, Human
gaaggacauagag

SEQ ID NO: 3528121 - RNA, 19 nt, Human
gaaggacauugcggacagc

SEQ ID NO: 3528122 - RNA, 15 nt, Human
gaaggaccuccugag

SEQ ID NO: 3528123 - RNA, 24 nt, Human
gaaggaccuucacucuaagauguu

SEQ ID NO: 3528124 - RNA, 21 nt, Human
gaaggacuaugaaaagcuaga

SEQ ID NO: 3528125 - RNA, 17 nt, Human
gaaggagaaggaaggag

SEQ ID NO: 3528126 - RNA, 15 nt, Human
gaaggagacagagcu

SEQ ID NO: 3528127 - RNA, 18 nt, Human
gaaggagacaggcagagc

SEQ ID NO: 3528128 - RNA, 15 nt, Human
gaaggagacucaccu

SEQ ID NO: 3528129 - RNA, 20 nt, Human
gaaggagacucaccucugcc

SEQ ID NO: 3528130 - RNA, 15 nt, Human
gaaggagagaagggg

SEQ ID NO: 3528131 - RNA, 15 nt, Human
gaaggagagccugcu

SEQ ID NO: 3528132 - RNA, 23 nt, Human
gaaggagauaauuacugccuuga

SEQ ID NO: 3528133 - RNA, 21 nt, Human
gaaggagccccauuccuggga

SEQ ID NO: 3528134 - RNA, 22 nt, Human
gaaggagccccauuccugggaa

SEQ ID NO: 3528135 - RNA, 14 nt, Human
gaaggagcugccug

SEQ ID NO: 3528136 - RNA, 19 nt, Human
gaaggagcugccuggaccc

SEQ ID NO: 3528137 - RNA, 15 nt, Human
gaaggaggacccagg

SEQ ID NO: 3528138 - RNA, 17 nt, Human
gaaggaggacccaggac

SEQ ID NO: 3528139 - RNA, 18 nt, Human
gaaggaggacccaggaca

SEQ ID NO: 3528140 - RNA, 19 nt, Human
gaaggaggacccaggacag

SEQ ID NO: 3528141 - RNA, 15 nt, Human
gaaggaggagccugu

SEQ ID NO: 3528142 - RNA, 22 nt, Human
gaaggaggagccuguccugccu

SEQ ID NO: 3528143 - RNA, 15 nt, Human
gaaggaggaggagga

SEQ ID NO: 3528144 - RNA, 18 nt, Human
gaaggaggaggaggaggu

SEQ ID NO: 3528145 - RNA, 15 nt, Human
gaaggaggccaccuc

SEQ ID NO: 3528146 - RNA, 16 nt, Human
gaaggaggccaccucc

SEQ ID NO: 3528147 - RNA, 14 nt, Human
gaaggaggcuggcu

SEQ ID NO: 3528148 - RNA, 18 nt, Human
gaaggaggggaagcugca

SEQ ID NO: 3528149 - RNA, 23 nt, Human
gaaggagggggugaccuccggcc

SEQ ID NO: 3528150 - RNA, 19 nt, Human
gaaggaggguuagggaggg

SEQ ID NO: 3528151 - RNA, 22 nt, Human
gaaggaucuguuuuuaaaaauc

SEQ ID NO: 3528152 - RNA, 16 nt, Human
gaaggaugagcauuua

SEQ ID NO: 3528153 - RNA, 16 nt, Human
gaaggaugccaagaag

SEQ ID NO: 3528154 - RNA, 16 nt, Human
gaaggauguacauuuc

SEQ ID NO: 3528155 - RNA, 17 nt, Human
gaaggauuauggaaaaa

SEQ ID NO: 3528156 - RNA, 15 nt, Human
gaaggcaaagcacga

SEQ ID NO: 3528157 - RNA, 15 nt, Human
gaaggcaaaugacuu

SEQ ID NO: 3528158 - RNA, 16 nt, Human
gaaggcaagccaggcu

SEQ ID NO: 3528159 - RNA, 13 nt, Human
gaaggcaaugcca

SEQ ID NO: 3528160 - RNA, 15 nt, Human
gaaggcagagaaagg

SEQ ID NO: 3528161 - RNA, 19 nt, Human
gaaggcaggcagggcucuc

SEQ ID NO: 3528162 - RNA, 23 nt, Human
gaaggcaggcagggcucuccugg

SEQ ID NO: 3528163 - RNA, 14 nt, Human
gaaggcagggaggg

SEQ ID NO: 3528164 - RNA, 21 nt, Human
gaaggcagggggaaggugggg

SEQ ID NO: 3528165 - RNA, 21 nt, Human
gaaggcauaucagucucugag

SEQ ID NO: 3528166 - RNA, 17 nt, Human
gaaggcaucagucccua

SEQ ID NO: 3528167 - RNA, 18 nt, Human
gaaggcaugccuggacaa

SEQ ID NO: 3528168 - RNA, 20 nt, Human
gaaggcauggacuucuggau

SEQ ID NO: 3528169 - RNA, 13 nt, Human
gaaggccaccugc

SEQ ID NO: 3528170 - RNA, 14 nt, Human
gaaggccaccugca

SEQ ID NO: 3528171 - RNA, 14 nt, Human
gaaggcccagcacc

SEQ ID NO: 3528172 - RNA, 18 nt, Human
gaaggccgagaagcaaga

SEQ ID NO: 3528173 - RNA, 20 nt, Human
gaaggccucccuagccagca

SEQ ID NO: 3528174 - RNA, 18 nt, Human
gaaggccucgcaggaaga

SEQ ID NO: 3528175 - RNA, 16 nt, Human
gaaggcuaaaaagcaa

SEQ ID NO: 3528176 - RNA, 19 nt, Human
gaaggcucgagcaugccug

SEQ ID NO: 3528177 - RNA, 20 nt, Human
aacagggccacauagaugcu

SEQ ID NO: 3528178 - RNA, 15 nt, Human
aacaggggcuggugg

SEQ ID NO: 3528179 - RNA, 22 nt, Human
aacaggguguugucagcaucuu

SEQ ID NO: 3528180 - RNA, 18 nt, Human
aacagguaauauaaaaag

SEQ ID NO: 3528181 - RNA, 18 nt, Human
aacagguauauacuuuga

SEQ ID NO: 3528182 - RNA, 21 nt, Human
aacagguauuuuguuucuuuu

SEQ ID NO: 3528183 - RNA, 18 nt, Human
aacagguguuggugacaa

SEQ ID NO: 3528184 - RNA, 16 nt, Human
aacagguuauuuuagu

SEQ ID NO: 3528185 - RNA, 17 nt, Human
aacaguaaaccacugaa

SEQ ID NO: 3528186 - RNA, 18 nt, Human
aacaguaaaccacugaaa

SEQ ID NO: 3528187 - RNA, 23 nt, Human
aacaguaaaccacugaaaaaaua

SEQ ID NO: 3528188 - RNA, 21 nt, Human
aacaguaugugggauauugaa

SEQ ID NO: 3528189 - RNA, 19 nt, Human
aacaguauuuauuuuguaa

SEQ ID NO: 3528190 - RNA, 13 nt, Human
aacagucauuuaa

SEQ ID NO: 3528191 - RNA, 12 nt, Human
aacagucugauc

SEQ ID NO: 3528192 - RNA, 23 nt, Human
aacagucugaucgugacgcugaa

SEQ ID NO: 3528193 - RNA, 18 nt, Human
aacagucuuacugcaggc

SEQ ID NO: 3528194 - RNA, 16 nt, Human
aacagugaagacagaa

SEQ ID NO: 3528195 - RNA, 17 nt, Human
aacagugaagacagaag

SEQ ID NO: 3528196 - RNA, 21 nt, Human
aacagugaaguuuuacugucu

SEQ ID NO: 3528197 - RNA, 15 nt, Human
aacagugauuaccag

SEQ ID NO: 3528198 - RNA, 15 nt, Human
aacagugcauauucc

SEQ ID NO: 3528199 - RNA, 22 nt, Human
aacagugcauauuccuuucuau

SEQ ID NO: 3528200 - RNA, 16 nt, Human
aacagugcuaaaaaug

SEQ ID NO: 3528201 - RNA, 12 nt, Human
aacaguggggaa

SEQ ID NO: 3528202 - RNA, 22 nt, Human
aacagugugaaguuagaauucc

SEQ ID NO: 3528203 - RNA, 16 nt, Human
aacagugugcaaggca

SEQ ID NO: 3528204 - RNA, 20 nt, Human
aacaguguggccucuucuga

SEQ ID NO: 3528205 - RNA, 22 nt, Human
aacagugugguaguuaauaaaa

SEQ ID NO: 3528206 - RNA, 21 nt, Human
aacaguguguaaacaaaauga

SEQ ID NO: 3528207 - RNA, 23 nt, Human
aacaguguuaggccuggcacagu

SEQ ID NO: 3528208 - RNA, 23 nt, Human
aacaguguuucccauaauuuucu

SEQ ID NO: 3528209 - RNA, 18 nt, Human
aacaguuaacuuucagaa

SEQ ID NO: 3528210 - RNA, 19 nt, Human
aacaguuaagcagccgcca

SEQ ID NO: 3528211 - RNA, 23 nt, Human
aacaguucauguuugcuucauaa

SEQ ID NO: 3528212 - RNA, 15 nt, Human
aacaguugcacagca

SEQ ID NO: 3528213 - RNA, 20 nt, Human
aacaguugcauguaguaaca

SEQ ID NO: 3528214 - RNA, 21 nt, Human
aacaguugcauguaguaacac

SEQ ID NO: 3528215 - RNA, 17 nt, Human
aacaguuggcaugcauc

SEQ ID NO: 3528216 - RNA, 22 nt, Human
aacaguugugaaccaagaucua

SEQ ID NO: 3528217 - RNA, 18 nt, Human
aacaguuuaaugaagauc

SEQ ID NO: 3528218 - RNA, 21 nt, Human
aacaguuuaaugaagaucuaa

SEQ ID NO: 3528219 - RNA, 23 nt, Human
aacaguuuaugcagugcugcuuu

SEQ ID NO: 3528220 - RNA, 16 nt, Human
aacaguuuggaaaagu

SEQ ID NO: 3528221 - RNA, 14 nt, Human
aacaguuuuccaug

SEQ ID NO: 3528222 - RNA, 12 nt, Human
aacaguuuuccu

SEQ ID NO: 3528223 - RNA, 18 nt, Human
aacaguuuuccuaugcuu

SEQ ID NO: 3528224 - RNA, 15 nt, Human
aacauaaaaaggaca

SEQ ID NO: 3528225 - RNA, 12 nt, Human
aacauaaaacaa

SEQ ID NO: 3528226 - RNA, 21 nt, Human
aacauaaauuuuuugaagucu

SEQ ID NO: 3528227 - RNA, 21 nt, Human
aacauaacccacuugucacug

SEQ ID NO: 3528228 - RNA, 20 nt, Human
aacauaagcuauuuuucuaa

SEQ ID NO: 3528229 - RNA, 14 nt, Human
aacauaaucuaguu

SEQ ID NO: 3528230 - RNA, 17 nt, Human
aacauaauucuuguaua

SEQ ID NO: 3528231 - RNA, 22 nt, Human
aacauacaaaugcaucuuugau

SEQ ID NO: 3528232 - RNA, 15 nt, Human
aacauacucccaucu

SEQ ID NO: 3528233 - RNA, 19 nt, Human
aacauagacagaagaaaca

SEQ ID NO: 3528234 - RNA, 20 nt, Human
aacauagacuagagaaaccg

SEQ ID NO: 3528235 - RNA, 12 nt, Human
aacauagauaaa

SEQ ID NO: 3528236 - RNA, 21 nt, Human
aacauagcagaucuguuuugu

SEQ ID NO: 3528237 - RNA, 20 nt, Human
aacauaguaaguucagcacu

SEQ ID NO: 3528238 - RNA, 21 nt, Human
aacauaguaaguucagcacuu

SEQ ID NO: 3528239 - RNA, 21 nt, Human
aacauagugagaccccugucu

SEQ ID NO: 3528240 - RNA, 17 nt, Human
aacauauaauauauguu

SEQ ID NO: 3528241 - RNA, 16 nt, Human
aacauauauaacaaug

SEQ ID NO: 3528242 - RNA, 14 nt, Human
aacauauccaaguu

SEQ ID NO: 3528243 - RNA, 19 nt, Human
aacauauccaaguuugaau

SEQ ID NO: 3528244 - RNA, 20 nt, Human
aacauauccaaguuugaauu

SEQ ID NO: 3528245 - RNA, 12 nt, Human
aacauaugauuu

SEQ ID NO: 3528246 - RNA, 17 nt, Human
aacauaugcaaacauaa

SEQ ID NO: 3528247 - RNA, 19 nt, Human
aacauauucuguaugaacu

SEQ ID NO: 3528248 - RNA, 20 nt, Human
aacauauuuguuaaauauuu

SEQ ID NO: 3528249 - RNA, 14 nt, Human
aacaucaacaucuu

SEQ ID NO: 3528250 - RNA, 12 nt, Human
aacaucaauguu

SEQ ID NO: 3528251 - RNA, 16 nt, Human
aacaucacaccugccc

SEQ ID NO: 3528252 - RNA, 21 nt, Human
aacaucauagaaacugucuag

SEQ ID NO: 3528253 - RNA, 19 nt, Human
aacaucauuacuauaagaa

SEQ ID NO: 3528254 - RNA, 15 nt, Human
aacaucauuagaaca

SEQ ID NO: 3528255 - RNA, 13 nt, Human
aacaucauuccuu

SEQ ID NO: 3528256 - RNA, 17 nt, Human
aacaucauuccuuuuua

SEQ ID NO: 3528257 - RNA, 20 nt, Human
aacaucauuccuuuuuauuu

SEQ ID NO: 3528258 - RNA, 22 nt, Human
aacaucauuccuuuuuauuuau

SEQ ID NO: 3528259 - RNA, 16 nt, Human
aacauccaaccuuccc

SEQ ID NO: 3528260 - RNA, 22 nt, Human
aacauccaaggagaaacagaga

SEQ ID NO: 3528261 - RNA, 17 nt, Human
aacauccaaguggccuc

SEQ ID NO: 3528262 - RNA, 16 nt, Human
gaauguuacugccuua

SEQ ID NO: 3528263 - RNA, 22 nt, Human
gaauguuccugccuccuugaua

SEQ ID NO: 3528264 - RNA, 14 nt, Human
gaauguucucagau

SEQ ID NO: 3528265 - RNA, 11 nt, Human
gaauguucuga

SEQ ID NO: 3528266 - RNA, 16 nt, Human
gaauguucugacauua

SEQ ID NO: 3528267 - RNA, 20 nt, Human
gaauguugauuacagugcag

SEQ ID NO: 3528268 - RNA, 15 nt, Human
gaauguuucuuaacu

SEQ ID NO: 3528269 - RNA, 16 nt, Human
gaauguuugccucugc

SEQ ID NO: 3528270 - RNA, 18 nt, Human
gaauguuugccucugccu

SEQ ID NO: 3528271 - RNA, 19 nt, Human
gaauguuugccucugccuc

SEQ ID NO: 3528272 - RNA, 15 nt, Human
gaauguuuuaaauuc

SEQ ID NO: 3528273 - RNA, 21 nt, Human
gaauuaaaaggauaguauuuu

SEQ ID NO: 3528274 - RNA, 13 nt, Human
gaauuaaacuuuu

SEQ ID NO: 3528275 - RNA, 20 nt, Human
gaauuaaacuuuuaauucau

SEQ ID NO: 3528276 - RNA, 18 nt, Human
gaauuaaccuggugcugg

SEQ ID NO: 3528277 - RNA, 15 nt, Human
gaauuaaguuaucuu

SEQ ID NO: 3528278 - RNA, 20 nt, Human
gaauuaaguuaucuuuaaaa

SEQ ID NO: 3528279 - RNA, 21 nt, Human
gaauuaaucaucuauaaagaa

SEQ ID NO: 3528280 - RNA, 18 nt, Human
gaauuaauuaauuuggag

SEQ ID NO: 3528281 - RNA, 13 nt, Human
gaauuacauuugu

SEQ ID NO: 3528282 - RNA, 20 nt, Human
gaauuacauuuguauaaaau

SEQ ID NO: 3528283 - RNA, 19 nt, Human
gaauuaccaagaauauccu

SEQ ID NO: 3528284 - RNA, 18 nt, Human
gaauuaccauuuguuaau

SEQ ID NO: 3528285 - RNA, 15 nt, Human
gaauuacuaacuucu

SEQ ID NO: 3528286 - RNA, 23 nt, Human
gaauuacuaacuucuaaaacugu

SEQ ID NO: 3528287 - RNA, 16 nt, Human
gaauuaggcuguaacu

SEQ ID NO: 3528288 - RNA, 16 nt, Human
gaauuaguccuugcuu

SEQ ID NO: 3528289 - RNA, 18 nt, Human
gaauuaguccuugcuugg

SEQ ID NO: 3528290 - RNA, 17 nt, Human
gaauuaguuuuaaaaug

SEQ ID NO: 3528291 - RNA, 19 nt, Human
gaauuauaacuggaaagaa

SEQ ID NO: 3528292 - RNA, 20 nt, Human
gaauuauaacuggaaagaag

SEQ ID NO: 3528293 - RNA, 14 nt, Human
gaauuauaacugua

SEQ ID NO: 3528294 - RNA, 18 nt, Human
gaauuaucagcaaagaaa

SEQ ID NO: 3528295 - RNA, 20 nt, Human
gaauuaucagcaaagaaaaa

SEQ ID NO: 3528296 - RNA, 22 nt, Human
gaauuauccuauuucaguacuu

SEQ ID NO: 3528297 - RNA, 22 nt, Human
gaauuaucuauacauaucuuua

SEQ ID NO: 3528298 - RNA, 20 nt, Human
gaauuauucaauuuauuuga

SEQ ID NO: 3528299 - RNA, 16 nt, Human
gaauuauuuuaaaaga

SEQ ID NO: 3528300 - RNA, 15 nt, Human
gaauuauuuuucacu

SEQ ID NO: 3528301 - RNA, 16 nt, Human
gaauucaaauuuuauc

SEQ ID NO: 3528302 - RNA, 18 nt, Human
gaauucaccacagacuuu

SEQ ID NO: 3528303 - RNA, 12 nt, Human
gaauucauucau

SEQ ID NO: 3528304 - RNA, 22 nt, Human
gaauucauucuggucucucuau

SEQ ID NO: 3528305 - RNA, 14 nt, Human
gaauucauuucacu

SEQ ID NO: 3528306 - RNA, 13 nt, Human
gaauucccucacu

SEQ ID NO: 3528307 - RNA, 16 nt, Human
gaauuccuaaaauuau

SEQ ID NO: 3528308 - RNA, 20 nt, Human
gaauuccuaaaauuauggaa

SEQ ID NO: 3528309 - RNA, 17 nt, Human
gaauuccuagaauuaaa

SEQ ID NO: 3528310 - RNA, 16 nt, Human
gaauuccuucagggug

SEQ ID NO: 3528311 - RNA, 17 nt, Human
gaauucucagaaucuca

SEQ ID NO: 3528312 - RNA, 18 nt, Human
gaauucucagugccaacu

SEQ ID NO: 3528313 - RNA, 18 nt, Human
gaauucugcuaccucacu

SEQ ID NO: 3528314 - RNA, 11 nt, Human
gaauucuguau

SEQ ID NO: 3528315 - RNA, 13 nt, Human
gaauucuguauag

SEQ ID NO: 3528316 - RNA, 14 nt, Human
gaauucuuuugcca

SEQ ID NO: 3528317 - RNA, 16 nt, Human
gaauucuuuuggggaa

SEQ ID NO: 3528318 - RNA, 18 nt, Human
gaauugaacccaggaggu

SEQ ID NO: 3528319 - RNA, 16 nt, Human
gaauugacauugaaau

SEQ ID NO: 3528320 - RNA, 17 nt, Human
gaauugaccaucugcuu

SEQ ID NO: 3528321 - RNA, 13 nt, Human
gacagucucacuu

SEQ ID NO: 3528322 - RNA, 12 nt, Human
gacagucugcuc

SEQ ID NO: 3528323 - RNA, 15 nt, Human
gacagucuugugcuu

SEQ ID NO: 3528324 - RNA, 15 nt, Human
gacagugaauuuggg

SEQ ID NO: 3528325 - RNA, 21 nt, Human
gacagugagacucugucucag

SEQ ID NO: 3528326 - RNA, 15 nt, Human
gacagugagguccug

SEQ ID NO: 3528327 - RNA, 20 nt, Human
gacagugagguccugggggc

SEQ ID NO: 3528328 - RNA, 15 nt, Human
gacagugaucuccau

SEQ ID NO: 3528329 - RNA, 13 nt, Human
gacagugcacaug

SEQ ID NO: 3528330 - RNA, 16 nt, Human
gacagugcuucagccu

SEQ ID NO: 3528331 - RNA, 17 nt, Human
gacagugcuucagccug

SEQ ID NO: 3528332 - RNA, 18 nt, Human
gacaguggcaggacagga

SEQ ID NO: 3528333 - RNA, 20 nt, Human
gacaguguauguagaagcau

SEQ ID NO: 3528334 - RNA, 14 nt, Human
gacaguucaagaaa

SEQ ID NO: 3528335 - RNA, 18 nt, Human
gacaguucacacccugca

SEQ ID NO: 3528336 - RNA, 14 nt, Human
gacaguucugaaga

SEQ ID NO: 3528337 - RNA, 18 nt, Human
gacaguuuaucaugaagc

SEQ ID NO: 3528338 - RNA, 23 nt, Human
gacaguuucuuagcuuuuuaauu

SEQ ID NO: 3528339 - RNA, 15 nt, Human
gacaguuuguaaaug

SEQ ID NO: 3528340 - RNA, 17 nt, Human
gacaguuuguaaauguu

SEQ ID NO: 3528341 - RNA, 18 nt, Human
gacaguuuguaaauguua

SEQ ID NO: 3528342 - RNA, 22 nt, Human
gacaguuuuccuucucaucugu

SEQ ID NO: 3528343 - RNA, 18 nt, Human
gacauaaagccauguuuc

SEQ ID NO: 3528344 - RNA, 15 nt, Human
gacauaaaggaaaag

SEQ ID NO: 3528345 - RNA, 19 nt, Human
gacauaaaguugauaaaga

SEQ ID NO: 3528346 - RNA, 16 nt, Human
gacauaacguuuuucc

SEQ ID NO: 3528347 - RNA, 21 nt, Human
gacauaacguuuuuccuuuaa

SEQ ID NO: 3528348 - RNA, 22 nt, Human
gacauaacguuuuuccuuuaaa

SEQ ID NO: 3528349 - RNA, 22 nt, Human
gacauaaugggguccuggccau

SEQ ID NO: 3528350 - RNA, 16 nt, Human
gacauaauuucacuga

SEQ ID NO: 3528351 - RNA, 21 nt, Human
gacauacgcuuuuaaugaaaa

SEQ ID NO: 3528352 - RNA, 16 nt, Human
gacauacuaaccagca

SEQ ID NO: 3528353 - RNA, 22 nt, Human
gacauacuccuuccaucaaaua

SEQ ID NO: 3528354 - RNA, 23 nt, Human
gacauacuugaagggccagagcc

SEQ ID NO: 3528355 - RNA, 21 nt, Human
gacauagagagggagaagaag

SEQ ID NO: 3528356 - RNA, 21 nt, Human
gacauagcaucuuguggcuuu

SEQ ID NO: 3528357 - RNA, 16 nt, Human
gacauagucuggcugu

SEQ ID NO: 3528358 - RNA, 15 nt, Human
gacauauuuaacugg

SEQ ID NO: 3528359 - RNA, 17 nt, Human
gacauauuuaauguuuu

SEQ ID NO: 3528360 - RNA, 18 nt, Human
gacauauuuaauguuuua

SEQ ID NO: 3528361 - RNA, 22 nt, Human
gacauauuuaauguuuuaaaug

SEQ ID NO: 3528362 - RNA, 23 nt, Human
gacauauuuaauguuuuaaaugu

SEQ ID NO: 3528363 - RNA, 14 nt, Human
gacaucacagcagc

SEQ ID NO: 3528364 - RNA, 15 nt, Human
gacaucacagggugg

SEQ ID NO: 3528365 - RNA, 15 nt, Human
gacaucacuuguaca

SEQ ID NO: 3528366 - RNA, 20 nt, Human
gacaucagagguucuuugag

SEQ ID NO: 3528367 - RNA, 14 nt, Human
gacaucagcaaaca

SEQ ID NO: 3528368 - RNA, 14 nt, Human
gacaucagccagcu

SEQ ID NO: 3528369 - RNA, 16 nt, Human
gacaucagccagcugc

SEQ ID NO: 3528370 - RNA, 17 nt, Human
gacaucagccagcugcc

SEQ ID NO: 3528371 - RNA, 16 nt, Human
gacaucagguuuuucc

SEQ ID NO: 3528372 - RNA, 13 nt, Human
gacaucaguggca

SEQ ID NO: 3528373 - RNA, 20 nt, Human
gacaucaguggcauggcucc

SEQ ID NO: 3528374 - RNA, 21 nt, Human
gacaucaguuccuuugugugu

SEQ ID NO: 3528375 - RNA, 18 nt, Human
gacaucaugaauuuuaca

SEQ ID NO: 3528376 - RNA, 22 nt, Human
gacauccagcagauuuccagcc

SEQ ID NO: 3528377 - RNA, 20 nt, Human
gacauccauaaagaagcaau

SEQ ID NO: 3528378 - RNA, 23 nt, Human
gacauccauguuuguaaaacuac

SEQ ID NO: 3528379 - RNA, 16 nt, Human
gacauccguugugcuu

SEQ ID NO: 3528380 - RNA, 16 nt, Human
gacauccucuucugcu

SEQ ID NO: 3528381 - RNA, 19 nt, Human
gacauccuguauaagcacu

SEQ ID NO: 3528382 - RNA, 23 nt, Human
gacauccugucaucugagaauga

SEQ ID NO: 3528383 - RNA, 16 nt, Human
gacaucucaggggcca

SEQ ID NO: 3528384 - RNA, 22 nt, Human
gacaucucaggggccagaggaa

SEQ ID NO: 3528385 - RNA, 15 nt, Human
gacaucucugcaccc

SEQ ID NO: 3528386 - RNA, 16 nt, Human
gacaucucuuugaugu

SEQ ID NO: 3528387 - RNA, 20 nt, Human
gacaucuggaaucuggagac

SEQ ID NO: 3528388 - RNA, 22 nt, Human
gacaucuggaaucuggagacca

SEQ ID NO: 3528389 - RNA, 21 nt, Human
gacaucuguuucuaaauguuu

SEQ ID NO: 3528390 - RNA, 15 nt, Human
gacaucuugaauccu

SEQ ID NO: 3528391 - RNA, 17 nt, Human
gacaucuugucauuuuu

SEQ ID NO: 3528392 - RNA, 20 nt, Human
gacaugaagauucuuuccca

SEQ ID NO: 3528393 - RNA, 17 nt, Human
gacaugauuuccuugaa

SEQ ID NO: 3528394 - RNA, 24 nt, Human
gacaugauuuccuugaauguggcu

SEQ ID NO: 3528395 - RNA, 20 nt, Human
gacaugcaauaaaauuuaaa

SEQ ID NO: 3528396 - RNA, 14 nt, Human
gacaugcacucagc

SEQ ID NO: 3528397 - RNA, 13 nt, Human
gacaugcacugac

SEQ ID NO: 3528398 - RNA, 14 nt, Human
gacaugcacugacc

SEQ ID NO: 3528399 - RNA, 20 nt, Human
gacaugcgggcugggcagcu

SEQ ID NO: 3528400 - RNA, 22 nt, Human
gacaugcgggcugggcagcugu

SEQ ID NO: 3528401 - RNA, 16 nt, Human
gacaugcgguagccag

SEQ ID NO: 3528402 - RNA, 14 nt, Human
gacaugcugacuuu

SEQ ID NO: 3528403 - RNA, 14 nt, Human
gacauggaaaugaa

SEQ ID NO: 3528404 - RNA, 17 nt, Human
gacauggacccggagcu

SEQ ID NO: 3528405 - RNA, 16 nt, Human
gacaugggacauuugc

SEQ ID NO: 3528406 - RNA, 21 nt, Human
gacauggugccugagaggcag

SEQ ID NO: 3528407 - RNA, 22 nt, Human
gacauggugccugagaggcagg

SEQ ID NO: 3528408 - RNA, 11 nt, Human
gacauguacag

SEQ ID NO: 3528409 - RNA, 17 nt, Human
gacaugucuuuucuugc

SEQ ID NO: 3528410 - RNA, 23 nt, Human
gacaugugaaaccuuuuuuaaga

SEQ ID NO: 3528411 - RNA, 18 nt, Human
gacauguggaaagugaau

SEQ ID NO: 3528412 - RNA, 23 nt, Human
gacauguggaaagugaauuugaa

SEQ ID NO: 3528413 - RNA, 17 nt, Human
gacauguggggccaggu

SEQ ID NO: 3528414 - RNA, 14 nt, Human
gacaugugguggga

SEQ ID NO: 3528415 - RNA, 22 nt, Human
gacauguggugggacagggacc

SEQ ID NO: 3528416 - RNA, 23 nt, Human
gacauguuuuagacaaauacuca

SEQ ID NO: 3528417 - RNA, 18 nt, Human
gacauuaacaguuuucca

SEQ ID NO: 3528418 - RNA, 22 nt, Human
gacauuaacaguuuuccaugaa

SEQ ID NO: 3528419 - RNA, 19 nt, Human
gacauuaagaauguugguu

SEQ ID NO: 3528420 - RNA, 22 nt, Human
gacauuaagcaucacaaaugau

SEQ ID NO: 3528421 - RNA, 17 nt, Human
gacauuaugugguuuua

SEQ ID NO: 3528422 - RNA, 14 nt, Human
gacauucaccugcc

SEQ ID NO: 3528423 - RNA, 16 nt, Human
gacauucaccugcccc

SEQ ID NO: 3528424 - RNA, 13 nt, Human
gacauucaugccu

SEQ ID NO: 3528425 - RNA, 16 nt, Human
gacaaaaaguuuccau

SEQ ID NO: 3528426 - RNA, 21 nt, Human
gacaaaaauucaacucagacu

SEQ ID NO: 3528427 - RNA, 17 nt, Human
gacaaaaccuaacuugc

SEQ ID NO: 3528428 - RNA, 13 nt, Human
gacaaaacuucuu

SEQ ID NO: 3528429 - RNA, 19 nt, Human
gacaaaacuucuugucaga

SEQ ID NO: 3528430 - RNA, 22 nt, Human
gacaaaacuucuugucagacau

SEQ ID NO: 3528431 - RNA, 22 nt, Human
gacaaaauacuugucuguuuua

SEQ ID NO: 3528432 - RNA, 13 nt, Human
gacaaaauguuau

SEQ ID NO: 3528433 - RNA, 17 nt, Human
gacaaacaccucccagg

SEQ ID NO: 3528434 - RNA, 22 nt, Human
gacaaacaccucccaggagaca

SEQ ID NO: 3528435 - RNA, 12 nt, Human
gacaaacccuuc

SEQ ID NO: 3528436 - RNA, 17 nt, Human
gacaaacugccaguuuu

SEQ ID NO: 3528437 - RNA, 14 nt, Human
gacaaacuguaaaa

SEQ ID NO: 3528438 - RNA, 15 nt, Human
gacaaacuuugcauc

SEQ ID NO: 3528439 - RNA, 23 nt, Human
gacaaagaugauuuaaaagggaa

SEQ ID NO: 3528440 - RNA, 17 nt, Human
gacaaagauggcucaga

SEQ ID NO: 3528441 - RNA, 16 nt, Human
gacaaagcugcuaaau

SEQ ID NO: 3528442 - RNA, 19 nt, Human
gacaaagcugcuaaaucuc

SEQ ID NO: 3528443 - RNA, 13 nt, Human
gacaaaggagccu

SEQ ID NO: 3528444 - RNA, 17 nt, Human
gacaaaggagccuguga

SEQ ID NO: 3528445 - RNA, 18 nt, Human
gacaaagguuuuccucuu

SEQ ID NO: 3528446 - RNA, 15 nt, Human
gacaaagucaagcca

SEQ ID NO: 3528447 - RNA, 17 nt, Human
gacaaauagaaaauggu

SEQ ID NO: 3528448 - RNA, 11 nt, Human
gacaaauauuc

SEQ ID NO: 3528449 - RNA, 13 nt, Human
gacaaaucaacag

SEQ ID NO: 3528450 - RNA, 17 nt, Human
gacaaaucaacagaagc

SEQ ID NO: 3528451 - RNA, 18 nt, Human
gacaaaucaacagaagca

SEQ ID NO: 3528452 - RNA, 13 nt, Human
gacaaaucaaguu

SEQ ID NO: 3528453 - RNA, 14 nt, Human
gacaaaucaaguuu

SEQ ID NO: 3528454 - RNA, 15 nt, Human
gacaaaucaaguuuc

SEQ ID NO: 3528455 - RNA, 18 nt, Human
gacaaaucaaguuuccaa

SEQ ID NO: 3528456 - RNA, 19 nt, Human
gacaaaucaaguuuccaag

SEQ ID NO: 3528457 - RNA, 23 nt, Human
gacaaaucaaguuuccaagcaaa

SEQ ID NO: 3528458 - RNA, 20 nt, Human
gacaaaucuguguauauuau

SEQ ID NO: 3528459 - RNA, 16 nt, Human
gacaaauucuguuucu

SEQ ID NO: 3528460 - RNA, 19 nt, Human
gacaaauugagacagugca

SEQ ID NO: 3528461 - RNA, 23 nt, Human
gacaacaaauuagguuuuguaca

SEQ ID NO: 3528462 - RNA, 16 nt, Human
gacaacacccauuuuu

SEQ ID NO: 3528463 - RNA, 12 nt, Human
gacaacagaagu

SEQ ID NO: 3528464 - RNA, 14 nt, Human
gacaacagaaguca

SEQ ID NO: 3528465 - RNA, 17 nt, Human
cuccaagaaugcugaaa

SEQ ID NO: 3528466 - RNA, 20 nt, Human
cuccaagaaugcugaaacca

SEQ ID NO: 3528467 - RNA, 12 nt, Human
cuccaagauucu

SEQ ID NO: 3528468 - RNA, 16 nt, Human
cuccaagcagcuuaga

SEQ ID NO: 3528469 - RNA, 22 nt, Human
cuccaagcaggacauggacaag

SEQ ID NO: 3528470 - RNA, 13 nt, Human
cuccaagccagca

SEQ ID NO: 3528471 - RNA, 17 nt, Human
cuccaagcccagcccau

SEQ ID NO: 3528472 - RNA, 15 nt, Human
cuccaagccccaucu

SEQ ID NO: 3528473 - RNA, 17 nt, Human
cuccaagccccaucuuc

SEQ ID NO: 3528474 - RNA, 14 nt, Human
cuccaagcuccauc

SEQ ID NO: 3528475 - RNA, 14 nt, Human
cuccaaggaccagg

SEQ ID NO: 3528476 - RNA, 22 nt, Human
cuccaaggaggggcuguaaaau

SEQ ID NO: 3528477 - RNA, 20 nt, Human
gacccaaaaggcagaagcaa

SEQ ID NO: 3528478 - RNA, 11 nt, Human
gacccaaagac

SEQ ID NO: 3528479 - RNA, 12 nt, Human
gacccaaagacc

SEQ ID NO: 3528480 - RNA, 19 nt, Human
gacccaauguaggagcugc

SEQ ID NO: 3528481 - RNA, 16 nt, Human
gacccaccccaccugc

SEQ ID NO: 3528482 - RNA, 17 nt, Human
gacccaccccaccugca

SEQ ID NO: 3528483 - RNA, 18 nt, Human
gacccaccccaccugcag

SEQ ID NO: 3528484 - RNA, 16 nt, Human
gacccaccccugugcu

SEQ ID NO: 3528485 - RNA, 17 nt, Human
gacccaccccugugcuc

SEQ ID NO: 3528486 - RNA, 22 nt, Human
gacccaccugguggccucugcc

SEQ ID NO: 3528487 - RNA, 22 nt, Human
gacccacgaaacugcccuggcu

SEQ ID NO: 3528488 - RNA, 18 nt, Human
gacccacguggcugcgug

SEQ ID NO: 3528489 - RNA, 18 nt, Human
gacccacuggacucaccu

SEQ ID NO: 3528490 - RNA, 20 nt, Human
gacccacugguuccuucuuc

SEQ ID NO: 3528491 - RNA, 10 nt, Human
gacccagacc

SEQ ID NO: 3528492 - RNA, 16 nt, Human
gacccagauccucaca

SEQ ID NO: 3528493 - RNA, 13 nt, Human
gacccagcacugc

SEQ ID NO: 3528494 - RNA, 20 nt, Human
gacccagcauggguuagugc

SEQ ID NO: 3528495 - RNA, 23 nt, Human
gacccagccccuugagaaaccuu

SEQ ID NO: 3528496 - RNA, 16 nt, Human
gacccagcccucaucc

SEQ ID NO: 3528497 - RNA, 15 nt, Human
gacccaggaaaggca

SEQ ID NO: 3528498 - RNA, 21 nt, Human
gacccaggaaaggcaggauug

SEQ ID NO: 3528499 - RNA, 20 nt, Human
gacccaggacuccuccccac

SEQ ID NO: 3528500 - RNA, 16 nt, Human
gacccaggcaccugca

SEQ ID NO: 3528501 - RNA, 16 nt, Human
gacccaggcugccuga

SEQ ID NO: 3528502 - RNA, 22 nt, Human
gacccagggaacagccacuccc

SEQ ID NO: 3528503 - RNA, 15 nt, Human
gacccagucccuggg

SEQ ID NO: 3528504 - RNA, 12 nt, Human
gacccagugaga

SEQ ID NO: 3528505 - RNA, 23 nt, Human
gacccagugagauuacagaggaa

SEQ ID NO: 3528506 - RNA, 16 nt, Human
gacccagugcccccac

SEQ ID NO: 3528507 - RNA, 20 nt, Human
gacccagugcccccacugac

SEQ ID NO: 3528508 - RNA, 17 nt, Human
gacccaguggcagggca

SEQ ID NO: 3528509 - RNA, 19 nt, Human
gacccaguggcagggcaca

SEQ ID NO: 3528510 - RNA, 14 nt, Human
gacccaguggggag

SEQ ID NO: 3528511 - RNA, 18 nt, Human
gacccauagaucuucuga

SEQ ID NO: 3528512 - RNA, 17 nt, Human
gacccaucacgccugug

SEQ ID NO: 3528513 - RNA, 17 nt, Human
gacccaugcugcccugu

SEQ ID NO: 3528514 - RNA, 20 nt, Human
gacccaugcugcccugugag

SEQ ID NO: 3528515 - RNA, 17 nt, Human
gacccaugggcaggaga

SEQ ID NO: 3528516 - RNA, 14 nt, Human
gacccauugcuguu

SEQ ID NO: 3528517 - RNA, 15 nt, Human
gacccauugcuguug

SEQ ID NO: 3528518 - RNA, 23 nt, Human
gaccccaaagagccuggagaagc

SEQ ID NO: 3528519 - RNA, 12 nt, Human
gaccccacccaa

SEQ ID NO: 3528520 - RNA, 14 nt, Human
gaccccacccaagc

SEQ ID NO: 3528521 - RNA, 22 nt, Human
gaccccacccaagcuuggcagc

SEQ ID NO: 3528522 - RNA, 15 nt, Human
gaccccacuccggcc

SEQ ID NO: 3528523 - RNA, 17 nt, Human
gaccccacuccggcccu

SEQ ID NO: 3528524 - RNA, 19 nt, Human
gaccccagcaagugguccu

SEQ ID NO: 3528525 - RNA, 14 nt, Human
gaccccagccucaa

SEQ ID NO: 3528526 - RNA, 18 nt, Human
gaccccagcggcugaguc

SEQ ID NO: 3528527 - RNA, 14 nt, Human
gaccccagcucugc

SEQ ID NO: 3528528 - RNA, 21 nt, Human
gaccccagcugggaggcaaga

SEQ ID NO: 3528529 - RNA, 21 nt, Human
gaccccagcugugagccuugg

SEQ ID NO: 3528530 - RNA, 22 nt, Human
gaccccagcugugagccuuggc

SEQ ID NO: 3528531 - RNA, 13 nt, Human
gaccccaggccca

SEQ ID NO: 3528532 - RNA, 17 nt, Human
gaccccagggcacagga

SEQ ID NO: 3528533 - RNA, 18 nt, Human
gaccccagggcacaggag

SEQ ID NO: 3528534 - RNA, 16 nt, Human
gaccccaucugcccag

SEQ ID NO: 3528535 - RNA, 17 nt, Human
gaccccaucugcccagg

SEQ ID NO: 3528536 - RNA, 21 nt, Human
gacccccaaccaaguggcucc

SEQ ID NO: 3528537 - RNA, 15 nt, Human
gacccccacaccuca

SEQ ID NO: 3528538 - RNA, 12 nt, Human
gacccccacccc

SEQ ID NO: 3528539 - RNA, 17 nt, Human
gacccccaccccuuccc

SEQ ID NO: 3528540 - RNA, 23 nt, Human
gacccccacucucauuccccagg

SEQ ID NO: 3528541 - RNA, 13 nt, Human
gacccccagcucc

SEQ ID NO: 3528542 - RNA, 13 nt, Human
gacccccaggaca

SEQ ID NO: 3528543 - RNA, 16 nt, Human
gaccccccucaggacc

SEQ ID NO: 3528544 - RNA, 22 nt, Human
gaccccccuuucacaggcagcc

SEQ ID NO: 3528545 - RNA, 16 nt, Human
gacccccgcccccugc

SEQ ID NO: 3528546 - RNA, 18 nt, Human
gacccccgcccccugccc

SEQ ID NO: 3528547 - RNA, 15 nt, Human
gacccccguggggca

SEQ ID NO: 3528548 - RNA, 18 nt, Human
gaccccgacgccacagcc

SEQ ID NO: 3528549 - RNA, 21 nt, Human
gaccccgacgccacagcccag

SEQ ID NO: 3528550 - RNA, 19 nt, Human
gaccccggcuuccuuuccc

SEQ ID NO: 3528551 - RNA, 17 nt, Human
gaccccuaguucccucu

SEQ ID NO: 3528552 - RNA, 22 nt, Human
gaccccuaguucccucugcuca

SEQ ID NO: 3528553 - RNA, 12 nt, Human
gaccccucaccu

SEQ ID NO: 3528554 - RNA, 22 nt, Human
gaccccucauagcccucacccu

SEQ ID NO: 3528555 - RNA, 23 nt, Human
gaccccucauagcccucacccug

SEQ ID NO: 3528556 - RNA, 13 nt, Human
gaccccuccaugu

SEQ ID NO: 3528557 - RNA, 19 nt, Human
gaccccuccccuaaugccu

SEQ ID NO: 3528558 - RNA, 13 nt, Human
gaccccuccucac

SEQ ID NO: 3528559 - RNA, 14 nt, Human
gaccccuccucacu

SEQ ID NO: 3528560 - RNA, 12 nt, Human
gaccccuccucc

SEQ ID NO: 3528561 - RNA, 11 nt, Human
gaccccuccug

SEQ ID NO: 3528562 - RNA, 16 nt, Human
gaccccuccuggggcc

SEQ ID NO: 3528563 - RNA, 23 nt, Human
gaccccuccuggggccaggccgg

SEQ ID NO: 3528564 - RNA, 16 nt, Human
gaccccucuggccagg

SEQ ID NO: 3528565 - RNA, 18 nt, Human
gaccccucuggccaggau

SEQ ID NO: 3528566 - RNA, 20 nt, Human
gaccccucuggccaggaugg

SEQ ID NO: 3528567 - RNA, 12 nt, Human
gaccccugccca

SEQ ID NO: 3528568 - RNA, 13 nt, Human
gaccccuggccuc

SEQ ID NO: 3528569 - RNA, 14 nt, Human
gaccccuggccucc

SEQ ID NO: 3528570 - RNA, 16 nt, Human
gaccccuggccuccgg

SEQ ID NO: 3528571 - RNA, 17 nt, Human
gaccccuuuucagcuuc

SEQ ID NO: 3528572 - RNA, 15 nt, Human
gacccgaccuggccg

SEQ ID NO: 3528573 - RNA, 16 nt, Human
gacccgaccuggccgc

SEQ ID NO: 3528574 - RNA, 23 nt, Human
gacccggagcuaacacuggcccc

SEQ ID NO: 3528575 - RNA, 20 nt, Human
gacccggaggggccuggcag

SEQ ID NO: 3528576 - RNA, 17 nt, Human
gacccggcacccccugc

SEQ ID NO: 3528577 - RNA, 12 nt, Human
gacccggcugcg

SEQ ID NO: 3528578 - RNA, 22 nt, Human
gacccguucaacuuuuccuuug

SEQ ID NO: 3528579 - RNA, 15 nt, Human
gacccuacaggagag

SEQ ID NO: 3528580 - RNA, 11 nt, Human
gacccuacccc

SEQ ID NO: 3528581 - RNA, 16 nt, Human
gacccuaccccaccac

SEQ ID NO: 3528582 - RNA, 18 nt, Human
gacccuaugggucuagga

SEQ ID NO: 3528583 - RNA, 19 nt, Human
gacccucaucuuucuucca

SEQ ID NO: 3528584 - RNA, 20 nt, Human
gacccucaucuuucuuccaa

SEQ ID NO: 3528585 - RNA, 16 nt, Human
gacccucaugcugcca

SEQ ID NO: 3528586 - RNA, 21 nt, Human
gacccucaugcugccaauauc

SEQ ID NO: 3528587 - RNA, 11 nt, Human
gacccuccaag

SEQ ID NO: 3528588 - RNA, 19 nt, Human
gacccuccaccgcagaagg

SEQ ID NO: 3528589 - RNA, 18 nt, Human
gacccuccccaaaggcuu

SEQ ID NO: 3528590 - RNA, 15 nt, Human
gacccuccccgcacc

SEQ ID NO: 3528591 - RNA, 17 nt, Human
gacccuccccgcacccc

SEQ ID NO: 3528592 - RNA, 11 nt, Human
gacccucccuu

SEQ ID NO: 3528593 - RNA, 22 nt, Human
gacccuccuccucccccagagg

SEQ ID NO: 3528594 - RNA, 14 nt, Human
gacccucgcuggcc

SEQ ID NO: 3528595 - RNA, 16 nt, Human
gacccucgcuggcccc

SEQ ID NO: 3528596 - RNA, 18 nt, Human
gacccucgcuggccccca

SEQ ID NO: 3528597 - RNA, 19 nt, Human
gacccucgcuggcccccac

SEQ ID NO: 3528598 - RNA, 21 nt, Human
gacccucgcuggcccccacug

SEQ ID NO: 3528599 - RNA, 15 nt, Human
gacccucuccacccc

SEQ ID NO: 3528600 - RNA, 17 nt, Human
gacccucuccaccccau

SEQ ID NO: 3528601 - RNA, 15 nt, Human
gacccucugaauggu

SEQ ID NO: 3528602 - RNA, 20 nt, Human
gacccucugggaaccuccca

SEQ ID NO: 3528603 - RNA, 22 nt, Human
gacccucugggaaccucccaga

SEQ ID NO: 3528604 - RNA, 13 nt, Human
gacccucuugccc

SEQ ID NO: 3528605 - RNA, 14 nt, Human
gacccucuugccca

SEQ ID NO: 3528606 - RNA, 20 nt, Human
gacccucuugcccauccuga

SEQ ID NO: 3528607 - RNA, 21 nt, Human
gacccugaaaagaaggacggg

SEQ ID NO: 3528608 - RNA, 15 nt, Human
gacccugaaaugugu

SEQ ID NO: 3528609 - RNA, 16 nt, Human
gacccugaaaugugug

SEQ ID NO: 3528610 - RNA, 16 nt, Human
gacccugagcugacca

SEQ ID NO: 3528611 - RNA, 20 nt, Human
cuccagccagccagcucauu

SEQ ID NO: 3528612 - RNA, 17 nt, Human
cuccagccagcgccucc

SEQ ID NO: 3528613 - RNA, 19 nt, Human
cuccagccagcgccucccu

SEQ ID NO: 3528614 - RNA, 22 nt, Human
cuccagccagcgccucccucca

SEQ ID NO: 3528615 - RNA, 16 nt, Human
cuccagccccgcgacc

SEQ ID NO: 3528616 - RNA, 22 nt, Human
cuccagccccucuuggagaagu

SEQ ID NO: 3528617 - RNA, 20 nt, Human
cuccagccccuggaugcagc

SEQ ID NO: 3528618 - RNA, 14 nt, Human
cuccagccccuguc

SEQ ID NO: 3528619 - RNA, 19 nt, Human
cuccagccccuuuccaaaa

SEQ ID NO: 3528620 - RNA, 16 nt, Human
cuccagcccgggagcc

SEQ ID NO: 3528621 - RNA, 23 nt, Human
cuccagcccgggagccuaggacc

SEQ ID NO: 3528622 - RNA, 16 nt, Human
cuccagccucagcccc

SEQ ID NO: 3528623 - RNA, 15 nt, Human
cuccagccucagccu

SEQ ID NO: 3528624 - RNA, 13 nt, Human
cuccagccucugu

SEQ ID NO: 3528625 - RNA, 20 nt, Human
cuccagccugacaucaaaaa

SEQ ID NO: 3528626 - RNA, 19 nt, Human
cuccagccuggacccccag

SEQ ID NO: 3528627 - RNA, 14 nt, Human
cuccagccuggcuc

SEQ ID NO: 3528628 - RNA, 20 nt, Human
cuccagccugggaggcacag

SEQ ID NO: 3528629 - RNA, 13 nt, Human
cuccagccugggg

SEQ ID NO: 3528630 - RNA, 16 nt, Human
cuccagccugggggac

SEQ ID NO: 3528631 - RNA, 19 nt, Human
cuccagcggcccugucauc

SEQ ID NO: 3528632 - RNA, 22 nt, Human
cuccagcggcccugucauccag

SEQ ID NO: 3528633 - RNA, 14 nt, Human
cuccagcuccaaga

SEQ ID NO: 3528634 - RNA, 17 nt, Human
cuccagcucccugugcc

SEQ ID NO: 3528635 - RNA, 16 nt, Human
cuccagcuccuuuggg

SEQ ID NO: 3528636 - RNA, 15 nt, Human
cuccagcucuuuccu

SEQ ID NO: 3528637 - RNA, 14 nt, Human
cuccagcugcugag

SEQ ID NO: 3528638 - RNA, 15 nt, Human
cuccagcugggcucu

SEQ ID NO: 3528639 - RNA, 19 nt, Human
cuccagcuguucagcuggu

SEQ ID NO: 3528640 - RNA, 19 nt, Human
cuccagcuuguggagcccc

SEQ ID NO: 3528641 - RNA, 20 nt, Human
cuccagcuuguggagcccca

SEQ ID NO: 3528642 - RNA, 16 nt, Human
gacuccaggcagcaga

SEQ ID NO: 3528643 - RNA, 20 nt, Human
gacuccaggcagcagacaca

SEQ ID NO: 3528644 - RNA, 12 nt, Human
gacuccaggccc

SEQ ID NO: 3528645 - RNA, 23 nt, Human
gacuccaugagaagccgugggug

SEQ ID NO: 3528646 - RNA, 16 nt, Human
gacucccaaagagcug

SEQ ID NO: 3528647 - RNA, 17 nt, Human
gacucccaaguuuccau

SEQ ID NO: 3528648 - RNA, 14 nt, Human
gacucccaugaagc

SEQ ID NO: 3528649 - RNA, 16 nt, Human
gacucccaugaagccu

SEQ ID NO: 3528650 - RNA, 18 nt, Human
gacucccaugaagccuuu

SEQ ID NO: 3528651 - RNA, 22 nt, Human
gacucccauuccugaagaacca

SEQ ID NO: 3528652 - RNA, 15 nt, Human
gacuccccaggccag

SEQ ID NO: 3528653 - RNA, 15 nt, Human
gacuccggcccuccu

SEQ ID NO: 3528654 - RNA, 17 nt, Human
gacuccguuggccacuc

SEQ ID NO: 3528655 - RNA, 18 nt, Human
gacuccuaccugcccugg

SEQ ID NO: 3528656 - RNA, 19 nt, Human
gacuccuaccugcccugga

SEQ ID NO: 3528657 - RNA, 19 nt, Human
gacuccuagcuguccuuuu

SEQ ID NO: 3528658 - RNA, 15 nt, Human
gacuccuaugaucuc

SEQ ID NO: 3528659 - RNA, 19 nt, Human
gacuccuccccacccuccu

SEQ ID NO: 3528660 - RNA, 16 nt, Human
gacuccuccuuucucc

SEQ ID NO: 3528661 - RNA, 16 nt, Human
gacuccuccuuuuucc

SEQ ID NO: 3528662 - RNA, 15 nt, Human
gacuccucggccugg

SEQ ID NO: 3528663 - RNA, 18 nt, Human
gacuccucggccuggcuc

SEQ ID NO: 3528664 - RNA, 11 nt, Human
gacuccugcag

SEQ ID NO: 3528665 - RNA, 16 nt, Human
gacuccugcaggcagc

SEQ ID NO: 3528666 - RNA, 17 nt, Human
gacuccugcaggcagcc

SEQ ID NO: 3528667 - RNA, 20 nt, Human
gacuccugcaggcagccagg

SEQ ID NO: 3528668 - RNA, 14 nt, Human
gacuccugcccugu

SEQ ID NO: 3528669 - RNA, 14 nt, Human
gacuccuguggaga

SEQ ID NO: 3528670 - RNA, 17 nt, Human
gacucgacucugugccu

SEQ ID NO: 3528671 - RNA, 18 nt, Human
gacucgcgacaaugcaaa

SEQ ID NO: 3528672 - RNA, 14 nt, Human
gacucgcuuguaaa

SEQ ID NO: 3528673 - RNA, 15 nt, Human
gacucgcuuguaaau

SEQ ID NO: 3528674 - RNA, 19 nt, Human
gacucgcuuguaaauacca

SEQ ID NO: 3528675 - RNA, 15 nt, Human
gacucgggcuccugu

SEQ ID NO: 3528676 - RNA, 16 nt, Human
gacucgggcuccugug

SEQ ID NO: 3528677 - RNA, 18 nt, Human
gacucgggcuccugugcc

SEQ ID NO: 3528678 - RNA, 18 nt, Human
gacucggggugcuuccuu

SEQ ID NO: 3528679 - RNA, 20 nt, Human
gacucgucugacugugugug

SEQ ID NO: 3528680 - RNA, 19 nt, Human
gacucuaaagaccaaacuu

SEQ ID NO: 3528681 - RNA, 16 nt, Human
gacucuaagaaagaac

SEQ ID NO: 3528682 - RNA, 15 nt, Human
gacucuacagaggcc

SEQ ID NO: 3528683 - RNA, 14 nt, Human
gacucuaccagacu

SEQ ID NO: 3528684 - RNA, 19 nt, Human
gacucuaccucauaucagu

SEQ ID NO: 3528685 - RNA, 17 nt, Human
gacucuaggugcccuug

SEQ ID NO: 3528686 - RNA, 15 nt, Human
gacucuauucuuuaa

SEQ ID NO: 3528687 - RNA, 15 nt, Human
gacucucagcccaga

SEQ ID NO: 3528688 - RNA, 17 nt, Human
gacucucagcccagaag

SEQ ID NO: 3528689 - RNA, 16 nt, Human
gacucucagucucuga

SEQ ID NO: 3528690 - RNA, 22 nt, Human
gacucuccccucuuauguaccu

SEQ ID NO: 3528691 - RNA, 19 nt, Human
gacucugaagccucuggga

SEQ ID NO: 3528692 - RNA, 17 nt, Human
gacucugaccucuuggc

SEQ ID NO: 3528693 - RNA, 21 nt, Human
gacucugagcgggaggcagag

SEQ ID NO: 3528694 - RNA, 15 nt, Human
gacucugcacauguc

SEQ ID NO: 3528695 - RNA, 20 nt, Human
gacucugcaucccagcaccu

SEQ ID NO: 3528696 - RNA, 10 nt, Human
gacucugccc

SEQ ID NO: 3528697 - RNA, 14 nt, Human
gacucugcccccug

SEQ ID NO: 3528698 - RNA, 17 nt, Human
gacucugcccccugcug

SEQ ID NO: 3528699 - RNA, 16 nt, Human
gacucuggcccuggcc

SEQ ID NO: 3528700 - RNA, 13 nt, Human
gacucuggccucc

SEQ ID NO: 3528701 - RNA, 18 nt, Human
gacucugggcuauggaca

SEQ ID NO: 3528702 - RNA, 19 nt, Human
gacucugggcuauggacac

SEQ ID NO: 3528703 - RNA, 18 nt, Human
gacucuggguccuuccug

SEQ ID NO: 3528704 - RNA, 16 nt, Human
gacucugucucaaaaa

SEQ ID NO: 3528705 - RNA, 16 nt, Human
gacucugugcuggcca

SEQ ID NO: 3528706 - RNA, 21 nt, Human
gacucugugcuggccagcgag

SEQ ID NO: 3528707 - RNA, 16 nt, Human
gacucuuaagaagacu

SEQ ID NO: 3528708 - RNA, 21 nt, Human
gacucuuaagaagacugcauu

SEQ ID NO: 3528709 - RNA, 17 nt, Human
gacucuucaaaaacugu

SEQ ID NO: 3528710 - RNA, 13 nt, Human
gacucuucccuca

SEQ ID NO: 3528711 - RNA, 11 nt, Human
gacucuugccu

SEQ ID NO: 3528712 - RNA, 21 nt, Human
gacucuugccuguuucccagg

SEQ ID NO: 3528713 - RNA, 15 nt, Human
gacucuugcucuuuc

SEQ ID NO: 3528714 - RNA, 19 nt, Human
gacucuuguuuucaguuuc

SEQ ID NO: 3528715 - RNA, 21 nt, Human
gacucuuuauugucuguaaau

SEQ ID NO: 3528716 - RNA, 23 nt, Human
gacucuuuauugucuguaaaucu

SEQ ID NO: 3528717 - RNA, 19 nt, Human
gacucuuucugagugccuu

SEQ ID NO: 3528718 - RNA, 21 nt, Human
gacucuuucugagugccuucu

SEQ ID NO: 3528719 - RNA, 17 nt, Human
gacucuuuugccauuaa

SEQ ID NO: 3528720 - RNA, 22 nt, Human
gacucuuuuuagggccaggcag

SEQ ID NO: 3528721 - RNA, 17 nt, Human
gacugaaaaccucuccu

SEQ ID NO: 3528722 - RNA, 15 nt, Human
gacugaaaauauugu

SEQ ID NO: 3528723 - RNA, 19 nt, Human
gacugaaauuacggguacc

SEQ ID NO: 3528724 - RNA, 21 nt, Human
gacugaaugggaucaugaaag

SEQ ID NO: 3528725 - RNA, 14 nt, Human
gacugaauuaugaa

SEQ ID NO: 3528726 - RNA, 13 nt, Human
gacugaauuccaa

SEQ ID NO: 3528727 - RNA, 14 nt, Human
gacugacagcaugu

SEQ ID NO: 3528728 - RNA, 21 nt, Human
gacugaccaauauuguacagu

SEQ ID NO: 3528729 - RNA, 15 nt, Human
gacugacugaggcag

SEQ ID NO: 3528730 - RNA, 16 nt, Human
gacugacugaggcagu

SEQ ID NO: 3528731 - RNA, 18 nt, Human
gacugagcaagacccugu

SEQ ID NO: 3528732 - RNA, 17 nt, Human
gacugagcacccucugg

SEQ ID NO: 3528733 - RNA, 14 nt, Human
gacugagcaccugc

SEQ ID NO: 3528734 - RNA, 16 nt, Human
gacugagcaccugcuu

SEQ ID NO: 3528735 - RNA, 14 nt, Human
gacugagcagacug

SEQ ID NO: 3528736 - RNA, 15 nt, Human
gacugagcagacugg

SEQ ID NO: 3528737 - RNA, 15 nt, Human
gacugaggacaaagu

SEQ ID NO: 3528738 - RNA, 17 nt, Human
gacugagggggccugga

SEQ ID NO: 3528739 - RNA, 22 nt, Human
gacugaguacguugugcauuug

SEQ ID NO: 3528740 - RNA, 14 nt, Human
gacugagugggaag

SEQ ID NO: 3528741 - RNA, 16 nt, Human
gacugagugggaagcc

SEQ ID NO: 3528742 - RNA, 15 nt, Human
gacugaucaggaccu

SEQ ID NO: 3528743 - RNA, 14 nt, Human
gacugaugcuuuca

SEQ ID NO: 3528744 - RNA, 17 nt, Human
gacugaugucuccuaag

SEQ ID NO: 3528745 - RNA, 22 nt, Human
gacugaugucuccuaagcaccu

SEQ ID NO: 3528746 - RNA, 20 nt, Human
gacugauguuaggcugggcc

SEQ ID NO: 3528747 - RNA, 21 nt, Human
gacugauguugagggaacaga

SEQ ID NO: 3528748 - RNA, 16 nt, Human
gacugauucugggaug

SEQ ID NO: 3528749 - RNA, 16 nt, Human
gacugauucuucagca

SEQ ID NO: 3528750 - RNA, 18 nt, Human
gacugcaagaggcuccug

SEQ ID NO: 3528751 - RNA, 21 nt, Human
gacugcaagugagcaaaccug

SEQ ID NO: 3528752 - RNA, 15 nt, Human
gacugcacagcggcc

SEQ ID NO: 3528753 - RNA, 21 nt, Human
gacugcacagcguccugucca

SEQ ID NO: 3528754 - RNA, 15 nt, Human
gacugcacccaggag

SEQ ID NO: 3528755 - RNA, 22 nt, Human
gacugcagggacacgggcagcc

SEQ ID NO: 3528756 - RNA, 13 nt, Human
gagacagugaauu

SEQ ID NO: 3528757 - RNA, 16 nt, Human
gagacagugggaaaua

SEQ ID NO: 3528758 - RNA, 17 nt, Human
gagacaguuauuuauag

SEQ ID NO: 3528759 - RNA, 18 nt, Human
gagacaguucaagaaagc

SEQ ID NO: 3528760 - RNA, 23 nt, Human
gagacaguugggugagaacaacc

SEQ ID NO: 3528761 - RNA, 16 nt, Human
gagacaguuucuuagc

SEQ ID NO: 3528762 - RNA, 22 nt, Human
gagacaguuucuuagcuuuuua

SEQ ID NO: 3528763 - RNA, 13 nt, Human
gagacaucagccc

SEQ ID NO: 3528764 - RNA, 11 nt, Human
gagacauccag

SEQ ID NO: 3528765 - RNA, 20 nt, Human
gagacauggcuuucagaaaa

SEQ ID NO: 3528766 - RNA, 21 nt, Human
gagacauggcuuucagaaaac

SEQ ID NO: 3528767 - RNA, 14 nt, Human
gagacaugugacau

SEQ ID NO: 3528768 - RNA, 14 nt, Human
gagaccaaccugac

SEQ ID NO: 3528769 - RNA, 17 nt, Human
gagaccaaccugaccaa

SEQ ID NO: 3528770 - RNA, 12 nt, Human
gagaccaccagg

SEQ ID NO: 3528771 - RNA, 12 nt, Human
gagaccaccucu

SEQ ID NO: 3528772 - RNA, 13 nt, Human
gagaccagccugg

SEQ ID NO: 3528773 - RNA, 18 nt, Human
gagaccaggcaaagcaag

SEQ ID NO: 3528774 - RNA, 14 nt, Human
gagaccaggcccug

SEQ ID NO: 3528775 - RNA, 17 nt, Human
gagaccaggcugugucc

SEQ ID NO: 3528776 - RNA, 22 nt, Human
gagaccaguugggagcacugga

SEQ ID NO: 3528777 - RNA, 21 nt, Human
gagaccaucccugaaggcccc

SEQ ID NO: 3528778 - RNA, 18 nt, Human
gagaccaugcagagcgcc

SEQ ID NO: 3528779 - RNA, 17 nt, Human
gagacccaccccaccug

SEQ ID NO: 3528780 - RNA, 18 nt, Human
gagacccagcggacacac

SEQ ID NO: 3528781 - RNA, 12 nt, Human
gagacccaggac

SEQ ID NO: 3528782 - RNA, 18 nt, Human
gagaccccaccagccuca

SEQ ID NO: 3528783 - RNA, 15 nt, Human
gagacccccacaccu

SEQ ID NO: 3528784 - RNA, 20 nt, Human
gagaccccgggagccgggga

SEQ ID NO: 3528785 - RNA, 13 nt, Human
gagaccccuggcc

SEQ ID NO: 3528786 - RNA, 17 nt, Human
gagaccccuggccuccg

SEQ ID NO: 3528787 - RNA, 13 nt, Human
gagaccccugucu

SEQ ID NO: 3528788 - RNA, 17 nt, Human
gagacccuacaggagag

SEQ ID NO: 3528789 - RNA, 21 nt, Human
gagacccucugccaccagaga

SEQ ID NO: 3528790 - RNA, 15 nt, Human
gagaccggccugcca

SEQ ID NO: 3528791 - RNA, 18 nt, Human
gagaccggccugccagga

SEQ ID NO: 3528792 - RNA, 20 nt, Human
gagaccggccugccaggagg

SEQ ID NO: 3528793 - RNA, 18 nt, Human
gagaccgggcccuggguu

SEQ ID NO: 3528794 - RNA, 20 nt, Human
gagaccgggcccuggguucc

SEQ ID NO: 3528795 - RNA, 15 nt, Human
gagaccguccucacc

SEQ ID NO: 3528796 - RNA, 16 nt, Human
gagaccguccucaccc

SEQ ID NO: 3528797 - RNA, 20 nt, Human
gagaccgucgggggcugagg

SEQ ID NO: 3528798 - RNA, 18 nt, Human
gagaccucagaaguaaag

SEQ ID NO: 3528799 - RNA, 20 nt, Human
gagaccucaucaggaugaac

SEQ ID NO: 3528800 - RNA, 21 nt, Human
gagaccucaucaggaugaacc

SEQ ID NO: 3528801 - RNA, 15 nt, Human
gagaccugaagugug

SEQ ID NO: 3528802 - RNA, 19 nt, Human
gagaccugacaagcacugc

SEQ ID NO: 3528803 - RNA, 13 nt, Human
gagaccugccccu

SEQ ID NO: 3528804 - RNA, 13 nt, Human
gagaccuuacccc

SEQ ID NO: 3528805 - RNA, 18 nt, Human
gagaccuuaccccuggcu

SEQ ID NO: 3528806 - RNA, 22 nt, Human
gagaccuuaccccuggcuguuu

SEQ ID NO: 3528807 - RNA, 16 nt, Human
gagacgggaccgggcc

SEQ ID NO: 3528808 - RNA, 18 nt, Human
gagacgggugggcggcug

SEQ ID NO: 3528809 - RNA, 23 nt, Human
gagacgguuuccagggaggggcc

SEQ ID NO: 3528810 - RNA, 18 nt, Human
gagacguggaaccucugu

SEQ ID NO: 3528811 - RNA, 22 nt, Human
gagacguggaaccucugucuca

SEQ ID NO: 3528812 - RNA, 20 nt, Human
gagacguuuauaaacagaaa

SEQ ID NO: 3528813 - RNA, 23 nt, Human
gagacguuuauaaacagaaaugg

SEQ ID NO: 3528814 - RNA, 22 nt, Human
gagacuaagcccugucgagaca

SEQ ID NO: 3528815 - RNA, 20 nt, Human
gagacucaccucugccucaa

SEQ ID NO: 3528816 - RNA, 13 nt, Human
gagacucagacag

SEQ ID NO: 3528817 - RNA, 15 nt, Human
gagacucagagggag

SEQ ID NO: 3528818 - RNA, 12 nt, Human
gagacucagccu

SEQ ID NO: 3528819 - RNA, 15 nt, Human
gagacucagccugca

SEQ ID NO: 3528820 - RNA, 17 nt, Human
gagacucagccugcagu

SEQ ID NO: 3528821 - RNA, 21 nt, Human
gagacucagggccccagcacu

SEQ ID NO: 3528822 - RNA, 16 nt, Human
gagacucagugcagau

SEQ ID NO: 3528823 - RNA, 23 nt, Human
gagacucagugcagauggagaga

SEQ ID NO: 3528824 - RNA, 16 nt, Human
gagacuccaugagaag

SEQ ID NO: 3528825 - RNA, 20 nt, Human
gagacuccucaguucuugcc

SEQ ID NO: 3528826 - RNA, 18 nt, Human
gagacuccugcaggcagc

SEQ ID NO: 3528827 - RNA, 18 nt, Human
gagacucgacucugugcc

SEQ ID NO: 3528828 - RNA, 20 nt, Human
gagacucgagaacuuucauu

SEQ ID NO: 3528829 - RNA, 14 nt, Human
gagacucuggccuc

SEQ ID NO: 3528830 - RNA, 12 nt, Human
gagacucugugg

SEQ ID NO: 3528831 - RNA, 23 nt, Human
gagacucuguggggccuugguuc

SEQ ID NO: 3528832 - RNA, 23 nt, Human
gagacugcgggaugguccugggg

SEQ ID NO: 3528833 - RNA, 17 nt, Human
gagacugcuucccaucc

SEQ ID NO: 3528834 - RNA, 22 nt, Human
gagacugcuucccauccuaccc

SEQ ID NO: 3528835 - RNA, 12 nt, Human
gagacuggagca

SEQ ID NO: 3528836 - RNA, 20 nt, Human
gagacuggagcaucugacuc

SEQ ID NO: 3528837 - RNA, 22 nt, Human
gagacuggcgugaacccaggag

SEQ ID NO: 3528838 - RNA, 13 nt, Human
gagacugggcuga

SEQ ID NO: 3528839 - RNA, 21 nt, Human
gagacugggcugagggagccu

SEQ ID NO: 3528840 - RNA, 20 nt, Human
gagaagggaauccuccucca

SEQ ID NO: 3528841 - RNA, 15 nt, Human
gagaagggauggagg

SEQ ID NO: 3528842 - RNA, 17 nt, Human
gagaagggcauaaaaca

SEQ ID NO: 3528843 - RNA, 23 nt, Human
gagaaggggcgggaauauuguuu

SEQ ID NO: 3528844 - RNA, 22 nt, Human
gagaagggggucaaagcaagga

SEQ ID NO: 3528845 - RNA, 23 nt, Human
gagaagguggguuuucaucaaga

SEQ ID NO: 3528846 - RNA, 15 nt, Human
gagaagguuuauugu

SEQ ID NO: 3528847 - RNA, 16 nt, Human
gagaaguauacauaag

SEQ ID NO: 3528848 - RNA, 18 nt, Human
gagaagucacagggcagu

SEQ ID NO: 3528849 - RNA, 23 nt, Human
gagaagucuuagacuugaaauac

SEQ ID NO: 3528850 - RNA, 20 nt, Human
gagaagucuucuauuuauuu

SEQ ID NO: 3528851 - RNA, 17 nt, Human
gagaagugaaugcuggg

SEQ ID NO: 3528852 - RNA, 17 nt, Human
gagaagugacagggaag

SEQ ID NO: 3528853 - RNA, 21 nt, Human
gagaagugacagggaagcuac

SEQ ID NO: 3528854 - RNA, 23 nt, Human
gagaagugacagggaagcuacag

SEQ ID NO: 3528855 - RNA, 24 nt, Human
gagaagugacagggaagcuacagg

SEQ ID NO: 3528856 - RNA, 17 nt, Human
gagaagugccccugcug

SEQ ID NO: 3528857 - RNA, 22 nt, Human
gagaagugccccugcugccucc

SEQ ID NO: 3528858 - RNA, 23 nt, Human
gagaagugccccugcugccuccc

SEQ ID NO: 3528859 - RNA, 17 nt, Human
gagaaguuucuggcccu

SEQ ID NO: 3528860 - RNA, 19 nt, Human
gagaaguuuuguacagaga

SEQ ID NO: 3528861 - RNA, 20 nt, Human
gagaauaaauugauuuuuau

SEQ ID NO: 3528862 - RNA, 22 nt, Human
gagaauaagagaaagaaaauga

SEQ ID NO: 3528863 - RNA, 16 nt, Human
gagaauaauucuuuga

SEQ ID NO: 3528864 - RNA, 14 nt, Human
gagaauagaaggaa

SEQ ID NO: 3528865 - RNA, 23 nt, Human
gagaauauuagcuuuacuguuug

SEQ ID NO: 3528866 - RNA, 14 nt, Human
gagaaucagacuga

SEQ ID NO: 3528867 - RNA, 20 nt, Human
gagaaucagaucauuucaaa

SEQ ID NO: 3528868 - RNA, 16 nt, Human
gagaaucauguuucuu

SEQ ID NO: 3528869 - RNA, 20 nt, Human
gagaaucccacuuucuauag

SEQ ID NO: 3528870 - RNA, 13 nt, Human
gagaaucuuuauu

SEQ ID NO: 3528871 - RNA, 19 nt, Human
gagaaugaaagggcccaga

SEQ ID NO: 3528872 - RNA, 11 nt, Human
gagaaugaaca

SEQ ID NO: 3528873 - RNA, 17 nt, Human
gagaaugagagacacac

SEQ ID NO: 3528874 - RNA, 13 nt, Human
gagaaugagccuc

SEQ ID NO: 3528875 - RNA, 12 nt, Human
gagaaugcacag

SEQ ID NO: 3528876 - RNA, 17 nt, Human
gagaaugcacagauaua

SEQ ID NO: 3528877 - RNA, 15 nt, Human
gagaauggaaaacag

SEQ ID NO: 3528878 - RNA, 18 nt, Human
gagaauugcuugaaccca

SEQ ID NO: 3528879 - RNA, 13 nt, Human
gagaauuggcuca

SEQ ID NO: 3528880 - RNA, 12 nt, Human
gagaauuucuaa

SEQ ID NO: 3528881 - RNA, 21 nt, Human
gagaauuucuaccauuucaga

SEQ ID NO: 3528882 - RNA, 16 nt, Human
gagaauuuuaaauuau

SEQ ID NO: 3528883 - RNA, 15 nt, Human
gagacaaaaauuauc

SEQ ID NO: 3528884 - RNA, 16 nt, Human
gagacaaaauuuuagu

SEQ ID NO: 3528885 - RNA, 20 nt, Human
gagacaaacaccucccagga

SEQ ID NO: 3528886 - RNA, 18 nt, Human
gagacacaggaugaagca

SEQ ID NO: 3528887 - RNA, 17 nt, Human
gagacaccugcaccucc

SEQ ID NO: 3528888 - RNA, 17 nt, Human
gagacacuggccccuca

SEQ ID NO: 3528889 - RNA, 17 nt, Human
gagacacugguggggau

SEQ ID NO: 3528890 - RNA, 20 nt, Human
gagacacugugcuauaaauc

SEQ ID NO: 3528891 - RNA, 20 nt, Human
gagacacuguugauaaaaac

SEQ ID NO: 3528892 - RNA, 20 nt, Human
gagacagacagagaaggcag

SEQ ID NO: 3528893 - RNA, 19 nt, Human
gagacagaguuuucacucu

SEQ ID NO: 3528894 - RNA, 16 nt, Human
gagacagccaacuaug

SEQ ID NO: 3528895 - RNA, 13 nt, Human
gagacagcccagg

SEQ ID NO: 3528896 - RNA, 12 nt, Human
gagacagcccgg

SEQ ID NO: 3528897 - RNA, 18 nt, Human
gagacagcccgggcucug

SEQ ID NO: 3528898 - RNA, 19 nt, Human
gagacagcccgggcucugc

SEQ ID NO: 3528899 - RNA, 21 nt, Human
gagacagcccgggcucugccu

SEQ ID NO: 3528900 - RNA, 15 nt, Human
cuccucccuuccuuu

SEQ ID NO: 3528901 - RNA, 21 nt, Human
cuccucccuuccuuuucccug

SEQ ID NO: 3528902 - RNA, 22 nt, Human
cuccucccuuccuuuucccugc

SEQ ID NO: 3528903 - RNA, 20 nt, Human
cuccuccgugcuuccucagu

SEQ ID NO: 3528904 - RNA, 12 nt, Human
cuccuccuagcc

SEQ ID NO: 3528905 - RNA, 14 nt, Human
cuccuccuccccca

SEQ ID NO: 3528906 - RNA, 15 nt, Human
cuccuccucccccag

SEQ ID NO: 3528907 - RNA, 14 nt, Human
cuccuccucccugc

SEQ ID NO: 3528908 - RNA, 12 nt, Human
cuccuccucuuu

SEQ ID NO: 3528909 - RNA, 14 nt, Human
cuccuccucuuucu

SEQ ID NO: 3528910 - RNA, 15 nt, Human
cuccuccucuuucuc

SEQ ID NO: 3528911 - RNA, 19 nt, Human
cuccuccucuuucucuccc

SEQ ID NO: 3528912 - RNA, 19 nt, Human
cuccuccuggacuccugca

SEQ ID NO: 3528913 - RNA, 12 nt, Human
cuccuccuuccc

SEQ ID NO: 3528914 - RNA, 15 nt, Human
cuccuccuuccuagu

SEQ ID NO: 3528915 - RNA, 15 nt, Human
cuccuccuuuuuccu

SEQ ID NO: 3528916 - RNA, 16 nt, Human
cuccucgacaucacug

SEQ ID NO: 3528917 - RNA, 17 nt, Human
cuccucgagggcaggga

SEQ ID NO: 3528918 - RNA, 22 nt, Human
cuccucggaaccgcucaccuag

SEQ ID NO: 3528919 - RNA, 17 nt, Human
cuccucgguucaagguc

SEQ ID NO: 3528920 - RNA, 13 nt, Human
cuccucguuccuu

SEQ ID NO: 3528921 - RNA, 21 nt, Human
cuccucuaacaggggcuggug

SEQ ID NO: 3528922 - RNA, 17 nt, Human
cuccucuagcugugggg

SEQ ID NO: 3528923 - RNA, 19 nt, Human
cuccucuagcugugggggu

SEQ ID NO: 3528924 - RNA, 18 nt, Human
cuccucucacuccccagc

SEQ ID NO: 3528925 - RNA, 13 nt, Human
cuccucucaguac

SEQ ID NO: 3528926 - RNA, 13 nt, Human
cuccucucccauc

SEQ ID NO: 3528927 - RNA, 21 nt, Human
cuccucucccaucccccugcc

SEQ ID NO: 3528928 - RNA, 14 nt, Human
cuccucuccccagc

SEQ ID NO: 3528929 - RNA, 17 nt, Human
cuccucuccccagccca

SEQ ID NO: 3528930 - RNA, 18 nt, Human
cuccucuccccagcccag

SEQ ID NO: 3528931 - RNA, 20 nt, Human
cuccucuccccagcccagag

SEQ ID NO: 3528932 - RNA, 12 nt, Human
cuccucuccccu

SEQ ID NO: 3528933 - RNA, 14 nt, Human
cuccucuccccuac

SEQ ID NO: 3528934 - RNA, 17 nt, Human
cuccucuccccuaccac

SEQ ID NO: 3528935 - RNA, 14 nt, Human
cuccucuccuggag

SEQ ID NO: 3528936 - RNA, 12 nt, Human
cuccucucugcc

SEQ ID NO: 3528937 - RNA, 14 nt, Human
cuccucucugcccu

SEQ ID NO: 3528938 - RNA, 15 nt, Human
cuccucucugcccua

SEQ ID NO: 3528939 - RNA, 19 nt, Human
cuccucugaaacagcugcc

SEQ ID NO: 3528940 - RNA, 21 nt, Human
cuccucugaaacagcugccuu

SEQ ID NO: 3528941 - RNA, 23 nt, Human
cuccucugaaacagcugccuuag

SEQ ID NO: 3528942 - RNA, 19 nt, Human
cuccucugacucagggcuc

SEQ ID NO: 3528943 - RNA, 20 nt, Human
cuccucugacucagggcucc

SEQ ID NO: 3528944 - RNA, 13 nt, Human
cuccucugcacuc

SEQ ID NO: 3528945 - RNA, 18 nt, Human
cuccucugcagugccuug

SEQ ID NO: 3528946 - RNA, 16 nt, Human
cuccucugcugcuggc

SEQ ID NO: 3528947 - RNA, 18 nt, Human
cuccucugcugcuggcug

SEQ ID NO: 3528948 - RNA, 15 nt, Human
cuccucugggcagga

SEQ ID NO: 3528949 - RNA, 12 nt, Human
cuccucugucca

SEQ ID NO: 3528950 - RNA, 15 nt, Human
cuccucuguccaggg

SEQ ID NO: 3528951 - RNA, 17 nt, Human
cuccucuguccagggcc

SEQ ID NO: 3528952 - RNA, 16 nt, Human
cuccucuguccugcuu

SEQ ID NO: 3528953 - RNA, 12 nt, Human
cuccucugugaa

SEQ ID NO: 3528954 - RNA, 18 nt, Human
cuccucugugaagcauuc

SEQ ID NO: 3528955 - RNA, 22 nt, Human
cuccucugugaccaaugucuug

SEQ ID NO: 3528956 - RNA, 23 nt, Human
cuccucuuaaaaaauaaaaacug

SEQ ID NO: 3528957 - RNA, 18 nt, Human
cuccucuucaacugacca

SEQ ID NO: 3528958 - RNA, 21 nt, Human
cuccucuucaacugaccagcc

SEQ ID NO: 3528959 - RNA, 19 nt, Human
cuccucuucaccccggcag

SEQ ID NO: 3528960 - RNA, 11 nt, Human
cuccucuucca

SEQ ID NO: 3528961 - RNA, 20 nt, Human
cuccucuuccaugcugugcg

SEQ ID NO: 3528962 - RNA, 14 nt, Human
cuccucuuccccag

SEQ ID NO: 3528963 - RNA, 23 nt, Human
cuccucuucuacucacuuuuccc

SEQ ID NO: 3528964 - RNA, 15 nt, Human
cuccucuugccacug

SEQ ID NO: 3528965 - RNA, 18 nt, Human
cuccucuugccacugccu

SEQ ID NO: 3528966 - RNA, 12 nt, Human
cuccucuuguaa

SEQ ID NO: 3528967 - RNA, 13 nt, Human
cuccucuuguaaa

SEQ ID NO: 3528968 - RNA, 15 nt, Human
cuccucuuuaaaaca

SEQ ID NO: 3528969 - RNA, 16 nt, Human
cuccucuuuaaaacaa

SEQ ID NO: 3528970 - RNA, 17 nt, Human
cuccucuuuccucucuu

SEQ ID NO: 3528971 - RNA, 22 nt, Human
cuccucuuuccucucuuuguuc

SEQ ID NO: 3528972 - RNA, 23 nt, Human
cuccugaaaaaaaaccugagauu

SEQ ID NO: 3528973 - RNA, 19 nt, Human
cuccugaaccgcacagcuc

SEQ ID NO: 3528974 - RNA, 21 nt, Human
cuccugaaccgcacagcucag

SEQ ID NO: 3528975 - RNA, 20 nt, Human
cuccugacacaccugcagcc

SEQ ID NO: 3528976 - RNA, 17 nt, Human
cuccugacacugcugga

SEQ ID NO: 3528977 - RNA, 18 nt, Human
cuccugacacugcuggag

SEQ ID NO: 3528978 - RNA, 14 nt, Human
cuccugacagaagg

SEQ ID NO: 3528979 - RNA, 16 nt, Human
cuccugacagaaggug

SEQ ID NO: 3528980 - RNA, 15 nt, Human
cuccugaccucaagu

SEQ ID NO: 3528981 - RNA, 15 nt, Human
cuccugaccucaggc

SEQ ID NO: 3528982 - RNA, 16 nt, Human
cuccugaccugaggcu

SEQ ID NO: 3528983 - RNA, 20 nt, Human
cuccugacgucugaagcuug

SEQ ID NO: 3528984 - RNA, 16 nt, Human
cuccugacuggugcug

SEQ ID NO: 3528985 - RNA, 15 nt, Human
cuccugagaccccug

SEQ ID NO: 3528986 - RNA, 17 nt, Human
cuccugagaccccuggc

SEQ ID NO: 3528987 - RNA, 20 nt, Human
cuccugagaccccuggccuc

SEQ ID NO: 3528988 - RNA, 20 nt, Human
cuccugagcccccagcuucc

SEQ ID NO: 3528989 - RNA, 21 nt, Human
cuccugagcccccagcuucca

SEQ ID NO: 3528990 - RNA, 22 nt, Human
cuccugagcccccagcuuccag

SEQ ID NO: 3528991 - RNA, 14 nt, Human
cuccugaggacagc

SEQ ID NO: 3528992 - RNA, 16 nt, Human
cuccugaggacagcug

SEQ ID NO: 3528993 - RNA, 21 nt, Human
cuccugaggacagcuguccuc

SEQ ID NO: 3528994 - RNA, 19 nt, Human
cuccugaggaucagaaagu

SEQ ID NO: 3528995 - RNA, 16 nt, Human
cuccugaggggcaucu

SEQ ID NO: 3528996 - RNA, 19 nt, Human
cuccugagugcuugcuuuu

SEQ ID NO: 3528997 - RNA, 22 nt, Human
cuccugaguugaagucaugcuc

SEQ ID NO: 3528998 - RNA, 23 nt, Human
cuccugauaaaacaacagcucga

SEQ ID NO: 3528999 - RNA, 13 nt, Human
cuccugauauaga

SEQ ID NO: 3529000 - RNA, 14 nt, Human
cuccugcacuguuu

SEQ ID NO: 3529001 - RNA, 15 nt, Human
cuccugcacuuacuu

SEQ ID NO: 3529002 - RNA, 22 nt, Human
cuccugcacuuacuugcuuauu

SEQ ID NO: 3529003 - RNA, 14 nt, Human
cuccugcagcaugg

SEQ ID NO: 3529004 - RNA, 13 nt, Human
cuccugcaggcag

SEQ ID NO: 3529005 - RNA, 20 nt, Human
cuccugcaggcagccaggcc

SEQ ID NO: 3529006 - RNA, 22 nt, Human
cuccugcaggcagccaggccac

SEQ ID NO: 3529007 - RNA, 12 nt, Human
cuccugcaugca

SEQ ID NO: 3529008 - RNA, 21 nt, Human
cuccugccacauuagaacuuc

SEQ ID NO: 3529009 - RNA, 17 nt, Human
cuccugcccacggaguc

SEQ ID NO: 3529010 - RNA, 20 nt, Human
cuccugcccaggagagccag

SEQ ID NO: 3529011 - RNA, 14 nt, Human
cuccugcccagucc

SEQ ID NO: 3529012 - RNA, 15 nt, Human
gagauacugguggaa

SEQ ID NO: 3529013 - RNA, 12 nt, Human
gagauagcauug

SEQ ID NO: 3529014 - RNA, 16 nt, Human
gagauagccaaggcca

SEQ ID NO: 3529015 - RNA, 16 nt, Human
gagauagccuguggcc

SEQ ID NO: 3529016 - RNA, 20 nt, Human
gagauagccuguggcccugu

SEQ ID NO: 3529017 - RNA, 21 nt, Human
gagauaggaaggucauuucca

SEQ ID NO: 3529018 - RNA, 16 nt, Human
gagauaguuuucaucc

SEQ ID NO: 3529019 - RNA, 18 nt, Human
gagauauaucugaaaacu

SEQ ID NO: 3529020 - RNA, 12 nt, Human
gagauauauuuu

SEQ ID NO: 3529021 - RNA, 18 nt, Human
gagauaucugagggagga

SEQ ID NO: 3529022 - RNA, 16 nt, Human
gagauaugcagaagga

SEQ ID NO: 3529023 - RNA, 19 nt, Human
gagauauuaaugcccagac

SEQ ID NO: 3529024 - RNA, 11 nt, Human
gagauauuuac

SEQ ID NO: 3529025 - RNA, 17 nt, Human
gagauauuuuguaaaau

SEQ ID NO: 3529026 - RNA, 14 nt, Human
gagaucaaagauga

SEQ ID NO: 3529027 - RNA, 17 nt, Human
gagaucaaauggaaagg

SEQ ID NO: 3529028 - RNA, 23 nt, Human
gagaucaaauggaaaggagagga

SEQ ID NO: 3529029 - RNA, 20 nt, Human
gagaucaaccccuucgcucc

SEQ ID NO: 3529030 - RNA, 23 nt, Human
gagaucaaccccuucgcuccugu

SEQ ID NO: 3529031 - RNA, 19 nt, Human
gagaucacgccacugcacu

SEQ ID NO: 3529032 - RNA, 21 nt, Human
gagaucacgccacugcacucc

SEQ ID NO: 3529033 - RNA, 13 nt, Human
gagaucagccugg

SEQ ID NO: 3529034 - RNA, 14 nt, Human
gagaucagccuggg

SEQ ID NO: 3529035 - RNA, 12 nt, Human
gagaucaugaga

SEQ ID NO: 3529036 - RNA, 19 nt, Human
gagaucccaacacugccag

SEQ ID NO: 3529037 - RNA, 19 nt, Human
gagaucccauccccuuguc

SEQ ID NO: 3529038 - RNA, 12 nt, Human
gagauccuccug

SEQ ID NO: 3529039 - RNA, 13 nt, Human
gagauccuggacu

SEQ ID NO: 3529040 - RNA, 16 nt, Human
gagaucggggccagag

SEQ ID NO: 3529041 - RNA, 18 nt, Human
gagaucggggccagaggc

SEQ ID NO: 3529042 - RNA, 18 nt, Human
gagaucgugccauugcac

SEQ ID NO: 3529043 - RNA, 22 nt, Human
gagaucgugccguuacucucca

SEQ ID NO: 3529044 - RNA, 21 nt, Human
gagaucuaagccuuuccauaa

SEQ ID NO: 3529045 - RNA, 16 nt, Human
gagaucugguuuugcu

SEQ ID NO: 3529046 - RNA, 22 nt, Human
cucuauauuguucagcaugcaa

SEQ ID NO: 3529047 - RNA, 11 nt, Human
cucuauauuua

SEQ ID NO: 3529048 - RNA, 22 nt, Human
cucuauauuuagauuguuaaaa

SEQ ID NO: 3529049 - RNA, 13 nt, Human
cucuaucauuaaa

SEQ ID NO: 3529050 - RNA, 23 nt, Human
cucuaucauuuaauaauauacuu

SEQ ID NO: 3529051 - RNA, 15 nt, Human
cucuauccugggcuu

SEQ ID NO: 3529052 - RNA, 14 nt, Human
cucuaucucucaaa

SEQ ID NO: 3529053 - RNA, 16 nt, Human
cucuaucugggccugg

SEQ ID NO: 3529054 - RNA, 17 nt, Human
cucuaugagucuagaug

SEQ ID NO: 3529055 - RNA, 21 nt, Human
cucuaugccagcucaguccca

SEQ ID NO: 3529056 - RNA, 22 nt, Human
cucuaugggcagaucuaccccu

SEQ ID NO: 3529057 - RNA, 20 nt, Human
cucuauggguaucaaacagc

SEQ ID NO: 3529058 - RNA, 19 nt, Human
cucuaugguaaagauauua

SEQ ID NO: 3529059 - RNA, 20 nt, Human
cucuaugguaaagauauuau

SEQ ID NO: 3529060 - RNA, 22 nt, Human
cucuauggucuuauauuuacaa

SEQ ID NO: 3529061 - RNA, 15 nt, Human
cucuauguuuacaaa

SEQ ID NO: 3529062 - RNA, 22 nt, Human
cucuauuaccacugaagauaga

SEQ ID NO: 3529063 - RNA, 23 nt, Human
cucuauuagacuuuagaaauaaa

SEQ ID NO: 3529064 - RNA, 21 nt, Human
gagcuccuccuugucuuggca

SEQ ID NO: 3529065 - RNA, 15 nt, Human
gagcuccucuccugg

SEQ ID NO: 3529066 - RNA, 17 nt, Human
gagcuccucuccuggag

SEQ ID NO: 3529067 - RNA, 22 nt, Human
gagcuccucuguccugcuucug

SEQ ID NO: 3529068 - RNA, 19 nt, Human
gagcuccucuuccaugcug

SEQ ID NO: 3529069 - RNA, 23 nt, Human
gagcucgcggcgaggacgacuuc

SEQ ID NO: 3529070 - RNA, 20 nt, Human
gagcucuacccagggccugc

SEQ ID NO: 3529071 - RNA, 19 nt, Human
gagcucuauuaugaaugug

SEQ ID NO: 3529072 - RNA, 13 nt, Human
gagcucuccagcu

SEQ ID NO: 3529073 - RNA, 14 nt, Human
gagcucugagaggc

SEQ ID NO: 3529074 - RNA, 18 nt, Human
gagcucugagaggcccug

SEQ ID NO: 3529075 - RNA, 21 nt, Human
gagcucugagaggcccuggau

SEQ ID NO: 3529076 - RNA, 20 nt, Human
gagcucuggagccaccuguc

SEQ ID NO: 3529077 - RNA, 16 nt, Human
gagcucuucaggccuc

SEQ ID NO: 3529078 - RNA, 22 nt, Human
gagcucuucaggccucccucuc

SEQ ID NO: 3529079 - RNA, 17 nt, Human
gagcugaaaugcugcau

SEQ ID NO: 3529080 - RNA, 19 nt, Human
gagcugaacccauuuugag

SEQ ID NO: 3529081 - RNA, 23 nt, Human
gagcugaacccauuuugagugac

SEQ ID NO: 3529082 - RNA, 16 nt, Human
gagcugacaaaauuuu

SEQ ID NO: 3529083 - RNA, 18 nt, Human
gagcugacacaaaccugc

SEQ ID NO: 3529084 - RNA, 23 nt, Human
gagcugacacaaaccugccuggg

SEQ ID NO: 3529085 - RNA, 14 nt, Human
gagcugaccagccg

SEQ ID NO: 3529086 - RNA, 19 nt, Human
gagcugagaauagaaggaa

SEQ ID NO: 3529087 - RNA, 20 nt, Human
gagcugagaucgcgccacug

SEQ ID NO: 3529088 - RNA, 13 nt, Human
gagcugagaucgu

SEQ ID NO: 3529089 - RNA, 22 nt, Human
gagcugagaucgugccacugca

SEQ ID NO: 3529090 - RNA, 16 nt, Human
gagcugagcagggaga

SEQ ID NO: 3529091 - RNA, 12 nt, Human
gagcugagccag

SEQ ID NO: 3529092 - RNA, 15 nt, Human
gagcugagccaggcu

SEQ ID NO: 3529093 - RNA, 17 nt, Human
gagcugagccucucacc

SEQ ID NO: 3529094 - RNA, 16 nt, Human
gagcugauauaaauuc

SEQ ID NO: 3529095 - RNA, 17 nt, Human
gagcugauauaaauucu

SEQ ID NO: 3529096 - RNA, 13 nt, Human
gagcugauccaga

SEQ ID NO: 3529097 - RNA, 16 nt, Human
gagcugauccagagca

SEQ ID NO: 3529098 - RNA, 20 nt, Human
gagcugauccagagcacaga

SEQ ID NO: 3529099 - RNA, 21 nt, Human
gagcugaugaaacucacaaau

SEQ ID NO: 3529100 - RNA, 15 nt, Human
gagcugauggagaag

SEQ ID NO: 3529101 - RNA, 21 nt, Human
gagcugccaguggggccugag

SEQ ID NO: 3529102 - RNA, 18 nt, Human
gagcugccccucucuggg

SEQ ID NO: 3529103 - RNA, 11 nt, Human
gagcugcccuc

SEQ ID NO: 3529104 - RNA, 15 nt, Human
gagcugcccuccuug

SEQ ID NO: 3529105 - RNA, 21 nt, Human
gagcugcccuccuuguccacc

SEQ ID NO: 3529106 - RNA, 14 nt, Human
gagcugcccucucc

SEQ ID NO: 3529107 - RNA, 16 nt, Human
gagcugcccucuccug

SEQ ID NO: 3529108 - RNA, 17 nt, Human
gagcugccuaagaggca

SEQ ID NO: 3529109 - RNA, 12 nt, Human
gagcugccugga

SEQ ID NO: 3529110 - RNA, 16 nt, Human
gagcugccuggacccg

SEQ ID NO: 3529111 - RNA, 15 nt, Human
gagcugccuguucag

SEQ ID NO: 3529112 - RNA, 19 nt, Human
gagcugccuguucagcucc

SEQ ID NO: 3529113 - RNA, 20 nt, Human
gagcugccuguucagcucca

SEQ ID NO: 3529114 - RNA, 23 nt, Human
gagcugccuucccuagcuuuaga

SEQ ID NO: 3529115 - RNA, 18 nt, Human
gagcugccuuggcucaga

SEQ ID NO: 3529116 - RNA, 21 nt, Human
gagcugccuuggcucagacau

SEQ ID NO: 3529117 - RNA, 20 nt, Human
gagcugcuauagccuggggu

SEQ ID NO: 3529118 - RNA, 24 nt, Human
gagcugcucugaauuaguccuugc

SEQ ID NO: 3529119 - RNA, 12 nt, Human
gagcugcuggcu

SEQ ID NO: 3529120 - RNA, 21 nt, Human
gagcugcuggcuugcagugcg

SEQ ID NO: 3529121 - RNA, 15 nt, Human
gagcuggaccagugg

SEQ ID NO: 3529122 - RNA, 16 nt, Human
gagcuggacucccuca

SEQ ID NO: 3529123 - RNA, 14 nt, Human
gagcuggagccugg

SEQ ID NO: 3529124 - RNA, 20 nt, Human
gagcuggagccuggugcccu

SEQ ID NO: 3529125 - RNA, 14 nt, Human
gagcuggccccgcc

SEQ ID NO: 3529126 - RNA, 16 nt, Human
gagcuggccccgccgc

SEQ ID NO: 3529127 - RNA, 22 nt, Human
gagcuggcccucuccuggggau

SEQ ID NO: 3529128 - RNA, 16 nt, Human
gagcuggccucucuag

SEQ ID NO: 3529129 - RNA, 13 nt, Human
gagcuggcucuga

SEQ ID NO: 3529130 - RNA, 17 nt, Human
gagcuggcucugagcgc

SEQ ID NO: 3529131 - RNA, 22 nt, Human
gagcugggagccgggccgcaga

SEQ ID NO: 3529132 - RNA, 14 nt, Human
gagcugggaggaaa

SEQ ID NO: 3529133 - RNA, 16 nt, Human
gagcugggaggaaaag

SEQ ID NO: 3529134 - RNA, 16 nt, Human
gagcugggauccuaag

SEQ ID NO: 3529135 - RNA, 19 nt, Human
gagcugggcagaaggccaa

SEQ ID NO: 3529136 - RNA, 16 nt, Human
gagcugggcccgacau

SEQ ID NO: 3529137 - RNA, 23 nt, Human
gagcugggcccgacauggcuccg

SEQ ID NO: 3529138 - RNA, 12 nt, Human
gagcugggccug

SEQ ID NO: 3529139 - RNA, 17 nt, Human
gagcugggccuggucuc

SEQ ID NO: 3529140 - RNA, 19 nt, Human
gagcuggggaccugguacc

SEQ ID NO: 3529141 - RNA, 21 nt, Human
gagcugguaguuaguagcaug

SEQ ID NO: 3529142 - RNA, 11 nt, Human
gagcuggugca

SEQ ID NO: 3529143 - RNA, 16 nt, Human
gagcuggugcauuaca

SEQ ID NO: 3529144 - RNA, 17 nt, Human
gagcuggugcauuacag

SEQ ID NO: 3529145 - RNA, 16 nt, Human
gagcugguggacccag

SEQ ID NO: 3529146 - RNA, 23 nt, Human
gagcugguggacccagggaacag

SEQ ID NO: 3529147 - RNA, 14 nt, Human
gagcuggugucuga

SEQ ID NO: 3529148 - RNA, 20 nt, Human
gagcugugaguucucccugu

SEQ ID NO: 3529149 - RNA, 18 nt, Human
gagcugugcaggugggga

SEQ ID NO: 3529150 - RNA, 20 nt, Human
gagcugugcaucagcuagaa

SEQ ID NO: 3529151 - RNA, 19 nt, Human
gagcuguggaggauugcua

SEQ ID NO: 3529152 - RNA, 22 nt, Human
gagcuguggaggauugcuaucu

SEQ ID NO: 3529153 - RNA, 15 nt, Human
gagcuuaaaauacaa

SEQ ID NO: 3529154 - RNA, 17 nt, Human
gagcuuagggucucagg

SEQ ID NO: 3529155 - RNA, 20 nt, Human
gagcuuccaauuuuccuuca

SEQ ID NO: 3529156 - RNA, 19 nt, Human
gagcuuccuguccucccag

SEQ ID NO: 3529157 - RNA, 21 nt, Human
gagcuucucuuuaacucagga

SEQ ID NO: 3529158 - RNA, 23 nt, Human
gagcuucugggguccccagggcu

SEQ ID NO: 3529159 - RNA, 21 nt, Human
gagcuucuguugcugccucau

SEQ ID NO: 3529160 - RNA, 20 nt, Human
gagcuugcucauuaauuuug

SEQ ID NO: 3529161 - RNA, 13 nt, Human
gagcuugcuuuga

SEQ ID NO: 3529162 - RNA, 13 nt, Human
gagcuugggaaug

SEQ ID NO: 3529163 - RNA, 16 nt, Human
gagcuuuacaaaaaga

SEQ ID NO: 3529164 - RNA, 23 nt, Human
gagcuuuaugguccuaaaagcaa

SEQ ID NO: 3529165 - RNA, 19 nt, Human
gagcuuuccauguugcugc

SEQ ID NO: 3529166 - RNA, 17 nt, Human
gagcuuucugaacagcu

SEQ ID NO: 3529167 - RNA, 22 nt, Human
gagcuuucugcuaucaaagagg

SEQ ID NO: 3529168 - RNA, 21 nt, Human
gagcuuucuguccuuuuggca

SEQ ID NO: 3529169 - RNA, 15 nt, Human
gagcuuugacucagg

SEQ ID NO: 3529170 - RNA, 18 nt, Human
gagcuuugacucaggagc

SEQ ID NO: 3529171 - RNA, 12 nt, Human
gagcuuugcugc

SEQ ID NO: 3529172 - RNA, 14 nt, Human
gagcuuuggacaca

SEQ ID NO: 3529173 - RNA, 21 nt, Human
gagcuuuggacacacacagcu

SEQ ID NO: 3529174 - RNA, 22 nt, Human
gaggaaaaaaaucguccaggga

SEQ ID NO: 3529175 - RNA, 13 nt, Human
gaggaaaaauaug

SEQ ID NO: 3529176 - RNA, 20 nt, Human
gaggaaaaccaagccguggc

SEQ ID NO: 3529177 - RNA, 21 nt, Human
gaggaaaaccaagccguggcu

SEQ ID NO: 3529178 - RNA, 21 nt, Human
gaggaaaauaauguaauugua

SEQ ID NO: 3529179 - RNA, 22 nt, Human
gaggaaacuacugccuuuagaa

SEQ ID NO: 3529180 - RNA, 23 nt, Human
gaggaaacucaccugcuggcccc

SEQ ID NO: 3529181 - RNA, 14 nt, Human
gaggaaacucagag

SEQ ID NO: 3529182 - RNA, 22 nt, Human
gaggaaagacaacacaaccaac

SEQ ID NO: 3529183 - RNA, 16 nt, Human
gaggaaagagagcagg

SEQ ID NO: 3529184 - RNA, 19 nt, Human
gaggaaaggccagcuggca

SEQ ID NO: 3529185 - RNA, 19 nt, Human
gaggaaagguuugagaagc

SEQ ID NO: 3529186 - RNA, 21 nt, Human
gaggaaauaaaguuaaguuug

SEQ ID NO: 3529187 - RNA, 20 nt, Human
gaggaaaucccuucauacuu

SEQ ID NO: 3529188 - RNA, 16 nt, Human
gaggaaauccuaccuu

SEQ ID NO: 3529189 - RNA, 13 nt, Human
gaggccuggacuu

SEQ ID NO: 3529190 - RNA, 19 nt, Human
gaggccuggacuuuccugc

SEQ ID NO: 3529191 - RNA, 20 nt, Human
gaggccuggacuuuccugca

SEQ ID NO: 3529192 - RNA, 13 nt, Human
gaggccuggccag

SEQ ID NO: 3529193 - RNA, 15 nt, Human
gaggccuggccaggc

SEQ ID NO: 3529194 - RNA, 15 nt, Human
gaggccugucuguga

SEQ ID NO: 3529195 - RNA, 20 nt, Human
gaggccuuccagcugcuguc

SEQ ID NO: 3529196 - RNA, 16 nt, Human
gaggccuucucugaag

SEQ ID NO: 3529197 - RNA, 18 nt, Human
gaggccuucucugaagga

SEQ ID NO: 3529198 - RNA, 20 nt, Human
gaggccuugggcucugcuga

SEQ ID NO: 3529199 - RNA, 19 nt, Human
gaggccuuucccuaagcca

SEQ ID NO: 3529200 - RNA, 22 nt, Human
gaggccuuucccuaagccagcu

SEQ ID NO: 3529201 - RNA, 21 nt, Human
gaggcgcaugaauuugugaag

SEQ ID NO: 3529202 - RNA, 14 nt, Human
gaggcgcgggggcc

SEQ ID NO: 3529203 - RNA, 19 nt, Human
gaggcggacguuccagccg

SEQ ID NO: 3529204 - RNA, 20 nt, Human
gaggcggagcuugcagugag

SEQ ID NO: 3529205 - RNA, 19 nt, Human
gaggcggaucuuuggacag

SEQ ID NO: 3529206 - RNA, 14 nt, Human
gaggcgggccagcc

SEQ ID NO: 3529207 - RNA, 20 nt, Human
gaggcgggccagccaggcgg

SEQ ID NO: 3529208 - RNA, 15 nt, Human
gaggcucaacaauaa

SEQ ID NO: 3529209 - RNA, 17 nt, Human
gaggcuccacuuggucu

SEQ ID NO: 3529210 - RNA, 12 nt, Human
gaggcucugccc

SEQ ID NO: 3529211 - RNA, 13 nt, Human
gaggcucugcccu

SEQ ID NO: 3529212 - RNA, 17 nt, Human
gaggcucugcccuuggu

SEQ ID NO: 3529213 - RNA, 14 nt, Human
gaggcucuggagcc

SEQ ID NO: 3529214 - RNA, 17 nt, Human
gaggcucuggagcccac

SEQ ID NO: 3529215 - RNA, 16 nt, Human
gaggcucuuucugggc

SEQ ID NO: 3529216 - RNA, 19 nt, Human
gaggcugacgugugaggga

SEQ ID NO: 3529217 - RNA, 16 nt, Human
gaggcugacuccuggu

SEQ ID NO: 3529218 - RNA, 22 nt, Human
gaggcugagccuacagaugaac

SEQ ID NO: 3529219 - RNA, 20 nt, Human
gaggcugaggcuggcacagg

SEQ ID NO: 3529220 - RNA, 14 nt, Human
gaggcugcagucag

SEQ ID NO: 3529221 - RNA, 21 nt, Human
gaggcugcccccggcccccug

SEQ ID NO: 3529222 - RNA, 18 nt, Human
gaggcugcucggggugca

SEQ ID NO: 3529223 - RNA, 23 nt, Human
gaggcuggacuccagaucugcac

SEQ ID NO: 3529224 - RNA, 12 nt, Human
gaggcuggcugg

SEQ ID NO: 3529225 - RNA, 13 nt, Human
gaggcuggcuggg

SEQ ID NO: 3529226 - RNA, 19 nt, Human
gaggcugggacgcucugcu

SEQ ID NO: 3529227 - RNA, 20 nt, Human
gaggcugggacgcucugcug

SEQ ID NO: 3529228 - RNA, 14 nt, Human
gaggcugggcuccc

SEQ ID NO: 3529229 - RNA, 15 nt, Human
gaggcugggcucccu

SEQ ID NO: 3529230 - RNA, 16 nt, Human
gaggcugggcucccuu

SEQ ID NO: 3529231 - RNA, 20 nt, Human
gaggcuggugcuguggccag

SEQ ID NO: 3529232 - RNA, 18 nt, Human
gaggcuguggcuggugag

SEQ ID NO: 3529233 - RNA, 13 nt, Human
gaggcauggcccu

SEQ ID NO: 3529234 - RNA, 14 nt, Human
gaggcauggcccug

SEQ ID NO: 3529235 - RNA, 18 nt, Human
gaggcauggcccuggggu

SEQ ID NO: 3529236 - RNA, 17 nt, Human
gaggccaaacaggcccu

SEQ ID NO: 3529237 - RNA, 19 nt, Human
gaggccaaaggcugguggc

SEQ ID NO: 3529238 - RNA, 21 nt, Human
gaggccaagaguggccccacc

SEQ ID NO: 3529239 - RNA, 17 nt, Human
gaggccaagugcaggcu

SEQ ID NO: 3529240 - RNA, 18 nt, Human
gaggccacacucagcaca

SEQ ID NO: 3529241 - RNA, 23 nt, Human
gaggccacaugagucccaguggg

SEQ ID NO: 3529242 - RNA, 10 nt, Human
gaggccaccu

SEQ ID NO: 3529243 - RNA, 15 nt, Human
gaggccaccucucca

SEQ ID NO: 3529244 - RNA, 21 nt, Human
gaggccagaggcccccagccc

SEQ ID NO: 3529245 - RNA, 21 nt, Human
gaggccagccccacccaggag

SEQ ID NO: 3529246 - RNA, 15 nt, Human
gaggccagccuggcc

SEQ ID NO: 3529247 - RNA, 17 nt, Human
gaggccagccuggccuc

SEQ ID NO: 3529248 - RNA, 17 nt, Human
gaggccaguaccuuucc

SEQ ID NO: 3529249 - RNA, 15 nt, Human
gaggccagugagcca

SEQ ID NO: 3529250 - RNA, 16 nt, Human
gaggccauaaaauaag

SEQ ID NO: 3529251 - RNA, 19 nt, Human
gaggccauggacucugucc

SEQ ID NO: 3529252 - RNA, 14 nt, Human
gaggccaugggccu

SEQ ID NO: 3529253 - RNA, 17 nt, Human
gaggccaugggccuccu

SEQ ID NO: 3529254 - RNA, 18 nt, Human
gaggccaugggccuccug

SEQ ID NO: 3529255 - RNA, 21 nt, Human
gaggccaugugcauaguuucu

SEQ ID NO: 3529256 - RNA, 20 nt, Human
gaggcccacauuggaagagc

SEQ ID NO: 3529257 - RNA, 16 nt, Human
gaggcccaggcugccg

SEQ ID NO: 3529258 - RNA, 17 nt, Human
gaggcccaggcugccgu

SEQ ID NO: 3529259 - RNA, 15 nt, Human
gaggcccaggcuggg

SEQ ID NO: 3529260 - RNA, 16 nt, Human
gaggcccaggcuggga

SEQ ID NO: 3529261 - RNA, 13 nt, Human
gaggccccaaagg

SEQ ID NO: 3529262 - RNA, 18 nt, Human
gaggccccacugaugcug

SEQ ID NO: 3529263 - RNA, 19 nt, Human
gaggccccagccucccuga

SEQ ID NO: 3529264 - RNA, 23 nt, Human
gaggccccagccucccugaagcc

SEQ ID NO: 3529265 - RNA, 14 nt, Human
gaggccccaggggg

SEQ ID NO: 3529266 - RNA, 14 nt, Human
gaggcccccagccc

SEQ ID NO: 3529267 - RNA, 20 nt, Human
gaggcccccagcccagggcu

SEQ ID NO: 3529268 - RNA, 19 nt, Human
gaggcccccaucuccuuaa

SEQ ID NO: 3529269 - RNA, 17 nt, Human
gaggccccuggagccag

SEQ ID NO: 3529270 - RNA, 18 nt, Human
gaggccccuggagccaga

SEQ ID NO: 3529271 - RNA, 20 nt, Human
gaggccccugucucagggug

SEQ ID NO: 3529272 - RNA, 19 nt, Human
gaggccccuucuagguggc

SEQ ID NO: 3529273 - RNA, 20 nt, Human
gaggcccguggggccggggc

SEQ ID NO: 3529274 - RNA, 18 nt, Human
gaggcccuccacaccugc

SEQ ID NO: 3529275 - RNA, 14 nt, Human
gaggcccuccugug

SEQ ID NO: 3529276 - RNA, 16 nt, Human
gaggcccuccugugcu

SEQ ID NO: 3529277 - RNA, 21 nt, Human
gaggcccuccugugcuggggg

SEQ ID NO: 3529278 - RNA, 12 nt, Human
gaggcccugcau

SEQ ID NO: 3529279 - RNA, 21 nt, Human
gaggccguggcugcuguggga

SEQ ID NO: 3529280 - RNA, 21 nt, Human
gaggccguugcugacuuagaa

SEQ ID NO: 3529281 - RNA, 19 nt, Human
gaggccuaaaaguaaacau

SEQ ID NO: 3529282 - RNA, 18 nt, Human
gaggccuacucuuccauc

SEQ ID NO: 3529283 - RNA, 12 nt, Human
gaggccucaggu

SEQ ID NO: 3529284 - RNA, 16 nt, Human
gaggccucaguggacu

SEQ ID NO: 3529285 - RNA, 18 nt, Human
gaggccucuggaaagcaa

SEQ ID NO: 3529286 - RNA, 18 nt, Human
gaggccucuuggaccucu

SEQ ID NO: 3529287 - RNA, 22 nt, Human
gaggccucuuggaccucugcuc

SEQ ID NO: 3529288 - RNA, 18 nt, Human
gaggccugaaauccuggu

SEQ ID NO: 3529289 - RNA, 20 nt, Human
gaggccugaagccagcugcc

SEQ ID NO: 3529290 - RNA, 14 nt, Human
gaggccugagaccc

SEQ ID NO: 3529291 - RNA, 13 nt, Human
gaggccugaggau

SEQ ID NO: 3529292 - RNA, 13 nt, Human
gaggccugcccgg

SEQ ID NO: 3529293 - RNA, 16 nt, Human
gaggccuggccaggca

SEQ ID NO: 3529294 - RNA, 17 nt, Human
gaggccuggccaggcac

SEQ ID NO: 3529295 - RNA, 22 nt, Human
gaggccugggccgcugccacgu

SEQ ID NO: 3529296 - RNA, 12 nt, Human
gaggccugucug

SEQ ID NO: 3529297 - RNA, 19 nt, Human
gaggccuguuuggccucuc

SEQ ID NO: 3529298 - RNA, 11 nt, Human
gaggccuucca

SEQ ID NO: 3529299 - RNA, 14 nt, Human
gaggccuuccagcu

SEQ ID NO: 3529300 - RNA, 15 nt, Human
gaggccuuccagcug

SEQ ID NO: 3529301 - RNA, 17 nt, Human
gaggccuuccagcugcu

SEQ ID NO: 3529302 - RNA, 19 nt, Human
gaggccuuccagcugcugu

SEQ ID NO: 3529303 - RNA, 14 nt, Human
gaggccuucucuga

SEQ ID NO: 3529304 - RNA, 15 nt, Human
gaggccuugagaggc

SEQ ID NO: 3529305 - RNA, 20 nt, Human
gaggcgaagcguuguccuca

SEQ ID NO: 3529306 - RNA, 20 nt, Human
gaggcgccccaacccgugga

SEQ ID NO: 3529307 - RNA, 18 nt, Human
gaggcggacguuccagcc

SEQ ID NO: 3529308 - RNA, 20 nt, Human
gaggcgggagaaucauguga

SEQ ID NO: 3529309 - RNA, 15 nt, Human
gaggcgggccagcca

SEQ ID NO: 3529310 - RNA, 19 nt, Human
gaggcgggccagccaggcg

SEQ ID NO: 3529311 - RNA, 19 nt, Human
gaggcggguggaucacuug

SEQ ID NO: 3529312 - RNA, 20 nt, Human
gaggcguauguggcaaaaug

SEQ ID NO: 3529313 - RNA, 13 nt, Human
gaggcuaaaaugu

SEQ ID NO: 3529314 - RNA, 18 nt, Human
gaggcuaaaauguuuuca

SEQ ID NO: 3529315 - RNA, 21 nt, Human
gaggcuagaaccaagaagggc

SEQ ID NO: 3529316 - RNA, 22 nt, Human
gaggcuagguggguugaaagcc

SEQ ID NO: 3529317 - RNA, 16 nt, Human
gaggcucaaauuuuga

SEQ ID NO: 3529318 - RNA, 18 nt, Human
gaggcuccacuuggucug

SEQ ID NO: 3529319 - RNA, 19 nt, Human
gaggcuccacuuggucugu

SEQ ID NO: 3529320 - RNA, 14 nt, Human
gaggcuccagaggg

SEQ ID NO: 3529321 - RNA, 17 nt, Human
gaggcuccagagggcac

SEQ ID NO: 3529322 - RNA, 13 nt, Human
gaggcuccaggca

SEQ ID NO: 3529323 - RNA, 15 nt, Human
gaggcuccaggcagc

SEQ ID NO: 3529324 - RNA, 21 nt, Human
gaggcuccuguuagcuccuca

SEQ ID NO: 3529325 - RNA, 20 nt, Human
gaggcucuaaccacacagcc

SEQ ID NO: 3529326 - RNA, 15 nt, Human
gaggcucugcccuug

SEQ ID NO: 3529327 - RNA, 12 nt, Human
gaggcugaggca

SEQ ID NO: 3529328 - RNA, 13 nt, Human
gaggcugaggcag

SEQ ID NO: 3529329 - RNA, 14 nt, Human
gaggcugaggcaga

SEQ ID NO: 3529330 - RNA, 18 nt, Human
gaggcugaggcagaagaa

SEQ ID NO: 3529331 - RNA, 19 nt, Human
gaggcugaggccuggacuu

SEQ ID NO: 3529332 - RNA, 16 nt, Human
gaggcugaggcuggca

SEQ ID NO: 3529333 - RNA, 19 nt, Human
gaggcugcagccaggccac

SEQ ID NO: 3529334 - RNA, 14 nt, Human
cucuguucauuucc

SEQ ID NO: 3529335 - RNA, 16 nt, Human
cucuguuccuucacau

SEQ ID NO: 3529336 - RNA, 22 nt, Human
cucuguuccuucccugugccuc

SEQ ID NO: 3529337 - RNA, 18 nt, Human
cucuguucuuccucagcc

SEQ ID NO: 3529338 - RNA, 17 nt, Human
cucuguugacuggcugu

SEQ ID NO: 3529339 - RNA, 14 nt, Human
cucuguuguaagaa

SEQ ID NO: 3529340 - RNA, 17 nt, Human
cucuguuguccuccccu

SEQ ID NO: 3529341 - RNA, 21 nt, Human
cucuguuguccuccccuuggg

SEQ ID NO: 3529342 - RNA, 13 nt, Human
cucuuaaaaccca

SEQ ID NO: 3529343 - RNA, 17 nt, Human
cucuuaaacuugugaau

SEQ ID NO: 3529344 - RNA, 18 nt, Human
cucuuaaguuucucagcu

SEQ ID NO: 3529345 - RNA, 19 nt, Human
cucuuaaguuucucagcuc

SEQ ID NO: 3529346 - RNA, 23 nt, Human
cucuuaauugccaccucuaacag

SEQ ID NO: 3529347 - RNA, 15 nt, Human
cucuuacccuucugu

SEQ ID NO: 3529348 - RNA, 16 nt, Human
cucuuacccuucugug

SEQ ID NO: 3529349 - RNA, 20 nt, Human
cucuuacccuucugugccca

SEQ ID NO: 3529350 - RNA, 22 nt, Human
cucuuacgcccaacccuucccc

SEQ ID NO: 3529351 - RNA, 14 nt, Human
cucuuacucuuucc

SEQ ID NO: 3529352 - RNA, 14 nt, Human
cucuuacugcaaau

SEQ ID NO: 3529353 - RNA, 19 nt, Human
cucuuacugcaaaugucau

SEQ ID NO: 3529354 - RNA, 23 nt, Human
cucuuagaggaaggagauaggga

SEQ ID NO: 3529355 - RNA, 15 nt, Human
cucuuagaugcaguu

SEQ ID NO: 3529356 - RNA, 18 nt, Human
cucuuagcagcuuccaga

SEQ ID NO: 3529357 - RNA, 16 nt, Human
cucuuagcccaugcug

SEQ ID NO: 3529358 - RNA, 15 nt, Human
cucuuagcuccccuc

SEQ ID NO: 3529359 - RNA, 19 nt, Human
cucuuagcuccccuccaac

SEQ ID NO: 3529360 - RNA, 12 nt, Human
cucuuagcugag

SEQ ID NO: 3529361 - RNA, 13 nt, Human
cucuuagcugucu

SEQ ID NO: 3529362 - RNA, 19 nt, Human
cucuuaggaagagaaacca

SEQ ID NO: 3529363 - RNA, 22 nt, Human
cucuuagggacagucaaaacca

SEQ ID NO: 3529364 - RNA, 20 nt, Human
cucuuauagaauauuuauua

SEQ ID NO: 3529365 - RNA, 18 nt, Human
cucuuauaucuauauuuu

SEQ ID NO: 3529366 - RNA, 21 nt, Human
cucuuaucucagucaugcaua

SEQ ID NO: 3529367 - RNA, 23 nt, Human
cucuuaucucagucaugcauaaa

SEQ ID NO: 3529368 - RNA, 19 nt, Human
cucuuauggauguccccag

SEQ ID NO: 3529369 - RNA, 19 nt, Human
cucuuauguaccucuuuua

SEQ ID NO: 3529370 - RNA, 20 nt, Human
cucuuauguaccucuuuuag

SEQ ID NO: 3529371 - RNA, 14 nt, Human
cucuuauugcccac

SEQ ID NO: 3529372 - RNA, 15 nt, Human
cucuuauugcccacg

SEQ ID NO: 3529373 - RNA, 13 nt, Human
cucuuauuucauc

SEQ ID NO: 3529374 - RNA, 16 nt, Human
cucuucaaaaacuguu

SEQ ID NO: 3529375 - RNA, 14 nt, Human
cucuucaaucucuu

SEQ ID NO: 3529376 - RNA, 17 nt, Human
cucuucaccccccacuc

SEQ ID NO: 3529377 - RNA, 15 nt, Human
cucuucagacucuca

SEQ ID NO: 3529378 - RNA, 20 nt, Human
cucuucagacucucagccca

SEQ ID NO: 3529379 - RNA, 23 nt, Human
cucuucaggaagaaaggagucug

SEQ ID NO: 3529380 - RNA, 13 nt, Human
cucuucaggccuc

SEQ ID NO: 3529381 - RNA, 20 nt, Human
cucuucaggccucccucucu

SEQ ID NO: 3529382 - RNA, 14 nt, Human
cucuucagguucuu

SEQ ID NO: 3529383 - RNA, 15 nt, Human
cucuucagguucuua

SEQ ID NO: 3529384 - RNA, 19 nt, Human
cucuucagguuguaaaaaa

SEQ ID NO: 3529385 - RNA, 18 nt, Human
cucuuccagaaucccaag

SEQ ID NO: 3529386 - RNA, 13 nt, Human
cucuuccaggcag

SEQ ID NO: 3529387 - RNA, 14 nt, Human
cucuuccaggcugg

SEQ ID NO: 3529388 - RNA, 15 nt, Human
cucuuccaggcuggg

SEQ ID NO: 3529389 - RNA, 21 nt, Human
cucuuccaggcugggagagcc

SEQ ID NO: 3529390 - RNA, 21 nt, Human
cucuuccccagaaaggagacu

SEQ ID NO: 3529391 - RNA, 21 nt, Human
cucuuccccagacgccuggcu

SEQ ID NO: 3529392 - RNA, 22 nt, Human
cucuuccccagacgccuggcug

SEQ ID NO: 3529393 - RNA, 13 nt, Human
cucuuccccccaa

SEQ ID NO: 3529394 - RNA, 14 nt, Human
cucuuccccccaaa

SEQ ID NO: 3529395 - RNA, 15 nt, Human
cucuucccccucucc

SEQ ID NO: 3529396 - RNA, 16 nt, Human
cucuucccccucuccc

SEQ ID NO: 3529397 - RNA, 20 nt, Human
cucuucccccucucccaguu

SEQ ID NO: 3529398 - RNA, 15 nt, Human
cucuucccccuucca

SEQ ID NO: 3529399 - RNA, 24 nt, Human
cucuuccccucuaaugcucacgcu

SEQ ID NO: 3529400 - RNA, 14 nt, Human
cucuuccccucuca

SEQ ID NO: 3529401 - RNA, 16 nt, Human
cucuuccccucucaga

SEQ ID NO: 3529402 - RNA, 16 nt, Human
cucuuccccuugcccu

SEQ ID NO: 3529403 - RNA, 18 nt, Human
cucuuccccuugcccuug

SEQ ID NO: 3529404 - RNA, 23 nt, Human
cucuuccccuugcccuugcccug

SEQ ID NO: 3529405 - RNA, 21 nt, Human
cucuucccgccgcccagccca

SEQ ID NO: 3529406 - RNA, 17 nt, Human
cucuucccucaguccca

SEQ ID NO: 3529407 - RNA, 20 nt, Human
cucuuccgaaaaauccucuu

SEQ ID NO: 3529408 - RNA, 22 nt, Human
cucuuccggagauguagcaaaa

SEQ ID NO: 3529409 - RNA, 15 nt, Human
cucuuccuacccaac

SEQ ID NO: 3529410 - RNA, 18 nt, Human
cucuuccuacccugccuc

SEQ ID NO: 3529411 - RNA, 14 nt, Human
cucuuccuagcugg

SEQ ID NO: 3529412 - RNA, 16 nt, Human
cucuuccuaucccauc

SEQ ID NO: 3529413 - RNA, 18 nt, Human
cucuuccuaucccauccc

SEQ ID NO: 3529414 - RNA, 11 nt, Human
cucuuccucca

SEQ ID NO: 3529415 - RNA, 14 nt, Human
cucuuccuccugac

SEQ ID NO: 3529416 - RNA, 16 nt, Human
cucuuccucugaggcu

SEQ ID NO: 3529417 - RNA, 16 nt, Human
cucuuccucuugaccc

SEQ ID NO: 3529418 - RNA, 17 nt, Human
cucuuccugccccucuu

SEQ ID NO: 3529419 - RNA, 22 nt, Human
cucuuccugccccucuuucucu

SEQ ID NO: 3529420 - RNA, 22 nt, Human
cucuucuacucacuuuucccac

SEQ ID NO: 3529421 - RNA, 19 nt, Human
cucuucuauuuuguaaacu

SEQ ID NO: 3529422 - RNA, 14 nt, Human
cucuucucaagugc

SEQ ID NO: 3529423 - RNA, 14 nt, Human
cucuucucagccac

SEQ ID NO: 3529424 - RNA, 11 nt, Human
cucuucucauu

SEQ ID NO: 3529425 - RNA, 15 nt, Human
cucuucucauuucac

SEQ ID NO: 3529426 - RNA, 12 nt, Human
cucuucuccacu

SEQ ID NO: 3529427 - RNA, 13 nt, Human
cucuucuccacug

SEQ ID NO: 3529428 - RNA, 15 nt, Human
cucuucuccacugga

SEQ ID NO: 3529429 - RNA, 17 nt, Human
cucuucuccacuggaug

SEQ ID NO: 3529430 - RNA, 15 nt, Human
cucuucuccaggcug

SEQ ID NO: 3529431 - RNA, 16 nt, Human
cucuucuccaggcugu

SEQ ID NO: 3529432 - RNA, 13 nt, Human
cucuucucccaga

SEQ ID NO: 3529433 - RNA, 15 nt, Human
cucuucuccuuucac

SEQ ID NO: 3529434 - RNA, 23 nt, Human
cucuucucucagaccgucuuccu

SEQ ID NO: 3529435 - RNA, 15 nt, Human
cucuucucuccagcu

SEQ ID NO: 3529436 - RNA, 14 nt, Human
cucuucucuuccug

SEQ ID NO: 3529437 - RNA, 19 nt, Human
cucuucugaauaaagcaau

SEQ ID NO: 3529438 - RNA, 20 nt, Human
cucuucugacgugccuuuug

SEQ ID NO: 3529439 - RNA, 12 nt, Human
cucuucugagcu

SEQ ID NO: 3529440 - RNA, 12 nt, Human
gaguuagacugu

SEQ ID NO: 3529441 - RNA, 14 nt, Human
gaguuagaggccag

SEQ ID NO: 3529442 - RNA, 17 nt, Human
gaguuaggcuauucaca

SEQ ID NO: 3529443 - RNA, 21 nt, Human
gaguuagggacugaccagcag

SEQ ID NO: 3529444 - RNA, 18 nt, Human
gaguuaggggccuuaggg

SEQ ID NO: 3529445 - RNA, 18 nt, Human
gaguuauugaagcagagu

SEQ ID NO: 3529446 - RNA, 19 nt, Human
gaguuauugaagcagagug

SEQ ID NO: 3529447 - RNA, 23 nt, Human
gaguuauuuuaauuaucuuuucu

SEQ ID NO: 3529448 - RNA, 20 nt, Human
gaguucaagaccagccuggc

SEQ ID NO: 3529449 - RNA, 11 nt, Human
gaguucaauga

SEQ ID NO: 3529450 - RNA, 12 nt, Human
gaguucaaugau

SEQ ID NO: 3529451 - RNA, 14 nt, Human
gaguucaaugaucu

SEQ ID NO: 3529452 - RNA, 15 nt, Human
gaguucaaugaucua

SEQ ID NO: 3529453 - RNA, 21 nt, Human
gaguucagaguccuuaaaaug

SEQ ID NO: 3529454 - RNA, 22 nt, Human
gaguucagguagcugccccugg

SEQ ID NO: 3529455 - RNA, 15 nt, Human
gaguucauucauauu

SEQ ID NO: 3529456 - RNA, 15 nt, Human
gaguuccagaaagua

SEQ ID NO: 3529457 - RNA, 12 nt, Human
gaguuccaguca

SEQ ID NO: 3529458 - RNA, 19 nt, Human
gaguuccaguuccucuuug

SEQ ID NO: 3529459 - RNA, 17 nt, Human
gaguuccaugaagacca

SEQ ID NO: 3529460 - RNA, 15 nt, Human
gaguucccaagaaag

SEQ ID NO: 3529461 - RNA, 17 nt, Human
gaguuccuaccauggag

SEQ ID NO: 3529462 - RNA, 13 nt, Human
gaguuccuagcca

SEQ ID NO: 3529463 - RNA, 12 nt, Human
gaguuccugcau

SEQ ID NO: 3529464 - RNA, 11 nt, Human
gaguucuacau

SEQ ID NO: 3529465 - RNA, 20 nt, Human
gaguucucagggcuccugcc

SEQ ID NO: 3529466 - RNA, 21 nt, Human
gaguucucagggcuccugccu

SEQ ID NO: 3529467 - RNA, 13 nt, Human
gaguucuggaaaa

SEQ ID NO: 3529468 - RNA, 15 nt, Human
gaguugaagacagag

SEQ ID NO: 3529469 - RNA, 21 nt, Human
gaguugaagacagagcuacac

SEQ ID NO: 3529470 - RNA, 16 nt, Human
gaguugaggaacugua

SEQ ID NO: 3529471 - RNA, 22 nt, Human
gaguugauacuacaguuuguua

SEQ ID NO: 3529472 - RNA, 16 nt, Human
gaguugaucuggaacc

SEQ ID NO: 3529473 - RNA, 18 nt, Human
gaguugauucagcucugc

SEQ ID NO: 3529474 - RNA, 16 nt, Human
gaguugccaagacaaa

SEQ ID NO: 3529475 - RNA, 20 nt, Human
gaguugccaagacaaaucaa

SEQ ID NO: 3529476 - RNA, 15 nt, Human
gaguuggaaucacug

SEQ ID NO: 3529477 - RNA, 11 nt, Human
gaguugggggu

SEQ ID NO: 3529478 - RNA, 14 nt, Human
gaguuguaaauaua

SEQ ID NO: 3529479 - RNA, 15 nt, Human
gaguuguaaauauau

SEQ ID NO: 3529480 - RNA, 20 nt, Human
gauacccauagcuuccauga

SEQ ID NO: 3529481 - RNA, 21 nt, Human
gauaccuaaaacauaagauca

SEQ ID NO: 3529482 - RNA, 20 nt, Human
gauaccuccaacccugccgu

SEQ ID NO: 3529483 - RNA, 19 nt, Human
gauaccuuaaaauuugaaa

SEQ ID NO: 3529484 - RNA, 18 nt, Human
gauaccuucuuauuuaau

SEQ ID NO: 3529485 - RNA, 17 nt, Human
gauacgacaacuugcac

SEQ ID NO: 3529486 - RNA, 13 nt, Human
gauacuaaggacg

SEQ ID NO: 3529487 - RNA, 16 nt, Human
gauacuacugaccaga

SEQ ID NO: 3529488 - RNA, 20 nt, Human
gauacucuuucuaaugcuga

SEQ ID NO: 3529489 - RNA, 20 nt, Human
gauacugcgacuuucugccu

SEQ ID NO: 3529490 - RNA, 21 nt, Human
gauacugcgacuuucugccug

SEQ ID NO: 3529491 - RNA, 23 nt, Human
gauacugcgacuuucugccugga

SEQ ID NO: 3529492 - RNA, 20 nt, Human
gauacuggaaguuuugcauu

SEQ ID NO: 3529493 - RNA, 20 nt, Human
gauacuggauuguacuuugu

SEQ ID NO: 3529494 - RNA, 17 nt, Human
gauacugucucuuucau

SEQ ID NO: 3529495 - RNA, 13 nt, Human
gauacuguugcac

SEQ ID NO: 3529496 - RNA, 16 nt, Human
gauacuguugcacgug

SEQ ID NO: 3529497 - RNA, 20 nt, Human
gauacuucgacacuguucuu

SEQ ID NO: 3529498 - RNA, 17 nt, Human
gauacuugaaaauuaac

SEQ ID NO: 3529499 - RNA, 13 nt, Human
gauacuuggauuu

SEQ ID NO: 3529500 - RNA, 20 nt, Human
gauacuuggauuuaguuuca

SEQ ID NO: 3529501 - RNA, 19 nt, Human
gauacuuuguauuguccua

SEQ ID NO: 3529502 - RNA, 23 nt, Human
gauacuuuguauuguccuauuag

SEQ ID NO: 3529503 - RNA, 20 nt, Human
gauacuuuuucuuuuguaag

SEQ ID NO: 3529504 - RNA, 21 nt, Human
gauacuuuuucuuuuguaagu

SEQ ID NO: 3529505 - RNA, 13 nt, Human
gauagaaaugcca

SEQ ID NO: 3529506 - RNA, 14 nt, Human
gauagaagaacugc

SEQ ID NO: 3529507 - RNA, 16 nt, Human
gauagaagauguuugc

SEQ ID NO: 3529508 - RNA, 14 nt, Human
gauagaaugacagu

SEQ ID NO: 3529509 - RNA, 14 nt, Human
gauagacugcuaca

SEQ ID NO: 3529510 - RNA, 23 nt, Human
gauagagacuggaacacuagaca

SEQ ID NO: 3529511 - RNA, 21 nt, Human
gauagaggaagccugauuaaa

SEQ ID NO: 3529512 - RNA, 15 nt, Human
gauagaguaaaaaga

SEQ ID NO: 3529513 - RNA, 17 nt, Human
gauagauaacucuuugg

SEQ ID NO: 3529514 - RNA, 21 nt, Human
gauagaugcuggcccagggcc

SEQ ID NO: 3529515 - RNA, 13 nt, Human
gauagaugugugg

SEQ ID NO: 3529516 - RNA, 14 nt, Human
gauagaugugugga

SEQ ID NO: 3529517 - RNA, 22 nt, Human
gauagauguguggacacauugg

SEQ ID NO: 3529518 - RNA, 16 nt, Human
gauagauuuggaauag

SEQ ID NO: 3529519 - RNA, 22 nt, Human
gauagauuuucugcuacuuugc

SEQ ID NO: 3529520 - RNA, 16 nt, Human
gauagcacagacccug

SEQ ID NO: 3529521 - RNA, 15 nt, Human
gauagcagccuggcu

SEQ ID NO: 3529522 - RNA, 14 nt, Human
gauagcaugucuuu

SEQ ID NO: 3529523 - RNA, 17 nt, Human
gauagcauugugaacug

SEQ ID NO: 3529524 - RNA, 12 nt, Human
gauagccaaggc

SEQ ID NO: 3529525 - RNA, 22 nt, Human
gauagccaaggccaaaggaagc

SEQ ID NO: 3529526 - RNA, 16 nt, Human
gauagcccuguccugg

SEQ ID NO: 3529527 - RNA, 16 nt, Human
gauagccuguggcccu

SEQ ID NO: 3529528 - RNA, 16 nt, Human
gauagcuaacauuuua

SEQ ID NO: 3529529 - RNA, 16 nt, Human
gauagcuaacuguaaa

SEQ ID NO: 3529530 - RNA, 23 nt, Human
gauaggaaggucauuuccaugua

SEQ ID NO: 3529531 - RNA, 18 nt, Human
gauaggaccuugggccaa

SEQ ID NO: 3529532 - RNA, 13 nt, Human
gauaggccagccg

SEQ ID NO: 3529533 - RNA, 17 nt, Human
gauaggcucugcacaga

SEQ ID NO: 3529534 - RNA, 21 nt, Human
gauagggauacaugcucuuag

SEQ ID NO: 3529535 - RNA, 21 nt, Human
gauagggcugggcaaggaaaa

SEQ ID NO: 3529536 - RNA, 14 nt, Human
gauaguaagcauag

SEQ ID NO: 3529537 - RNA, 16 nt, Human
gauagucaccuuuuaa

SEQ ID NO: 3529538 - RNA, 22 nt, Human
gauagucuuucaguuaaggaga

SEQ ID NO: 3529539 - RNA, 23 nt, Human
gauagucuuuugcuuuuggcaaa

SEQ ID NO: 3529540 - RNA, 14 nt, Human
gauaguuacuguug

SEQ ID NO: 3529541 - RNA, 20 nt, Human
gauaguuacuguugugaccu

SEQ ID NO: 3529542 - RNA, 15 nt, Human
gauaguucacccccu

SEQ ID NO: 3529543 - RNA, 21 nt, Human
gauaguugaauguugcaaugu

SEQ ID NO: 3529544 - RNA, 15 nt, Human
gauauaaaaugugca

SEQ ID NO: 3529545 - RNA, 13 nt, Human
gauauaaauaaaa

SEQ ID NO: 3529546 - RNA, 13 nt, Human
gauauaaauauau

SEQ ID NO: 3529547 - RNA, 17 nt, Human
gauauaaauauauauaa

SEQ ID NO: 3529548 - RNA, 14 nt, Human
gauauaaauuuuua

SEQ ID NO: 3529549 - RNA, 19 nt, Human
gauauaacuauugcccagg

SEQ ID NO: 3529550 - RNA, 16 nt, Human
gauauaagugcuguau

SEQ ID NO: 3529551 - RNA, 22 nt, Human
gauauaagugcuguauaaaauc

SEQ ID NO: 3529552 - RNA, 14 nt, Human
gauauaaugaacaa

SEQ ID NO: 3529553 - RNA, 18 nt, Human
gauauaaugaacaaaauu

SEQ ID NO: 3529554 - RNA, 14 nt, Human
gauauacagaugaa

SEQ ID NO: 3529555 - RNA, 16 nt, Human
gauauacagaugaaaa

SEQ ID NO: 3529556 - RNA, 17 nt, Human
gauauacaugaaaauuu

SEQ ID NO: 3529557 - RNA, 17 nt, Human
gauauacucuagaugaa

SEQ ID NO: 3529558 - RNA, 15 nt, Human
gauauacugugugcu

SEQ ID NO: 3529559 - RNA, 13 nt, Human
gauauacuuguuu

SEQ ID NO: 3529560 - RNA, 17 nt, Human
gauauacuuguuuuugu

SEQ ID NO: 3529561 - RNA, 20 nt, Human
gauauagacaguccuuaaaa

SEQ ID NO: 3529562 - RNA, 18 nt, Human
gauauagaucacauaaca

SEQ ID NO: 3529563 - RNA, 13 nt, Human
gauauauaucaua

SEQ ID NO: 3529564 - RNA, 23 nt, Human
gauauauauuauaaauauauaua

SEQ ID NO: 3529565 - RNA, 21 nt, Human
gauauaucaugagugaauaaa

SEQ ID NO: 3529566 - RNA, 12 nt, Human
gauauaucugaa

SEQ ID NO: 3529567 - RNA, 16 nt, Human
gauauaucugaaaacu

SEQ ID NO: 3529568 - RNA, 18 nt, Human
gauauaucugaaaacugg

SEQ ID NO: 3529569 - RNA, 22 nt, Human
gauauauguauuaauaaauaga

SEQ ID NO: 3529570 - RNA, 20 nt, Human
gauauauguguuuuucacau

SEQ ID NO: 3529571 - RNA, 17 nt, Human
gauauauuaaaaauaua

SEQ ID NO: 3529572 - RNA, 22 nt, Human
gauauauuaaaaauauaaaacu

SEQ ID NO: 3529573 - RNA, 15 nt, Human
gauauauuuaaaaau

SEQ ID NO: 3529574 - RNA, 18 nt, Human
gauaucacagucuaauuu

SEQ ID NO: 3529575 - RNA, 16 nt, Human
gauaucaugcaaauuu

SEQ ID NO: 3529576 - RNA, 15 nt, Human
gauauccauucuuuc

SEQ ID NO: 3529577 - RNA, 16 nt, Human
gauauccauucuuucu

SEQ ID NO: 3529578 - RNA, 17 nt, Human
gauaucccuaugcugcc

SEQ ID NO: 3529579 - RNA, 21 nt, Human
gauaucuagcuaguaauauau

SEQ ID NO: 3529580 - RNA, 15 nt, Human
gauaucugagggagg

SEQ ID NO: 3529581 - RNA, 17 nt, Human
gauaucuugaaaugaaa

SEQ ID NO: 3529582 - RNA, 15 nt, Human
gauaugaaagcugau

SEQ ID NO: 3529583 - RNA, 23 nt, Human
gauaugaauauauggcauuugca

SEQ ID NO: 3529584 - RNA, 23 nt, Human
gauaugauuguuucucaaaucuu

SEQ ID NO: 3529585 - RNA, 14 nt, Human
gauaugcaaaagcu

SEQ ID NO: 3529586 - RNA, 15 nt, Human
gauaugcaaaagcug

SEQ ID NO: 3529587 - RNA, 18 nt, Human
gauaugccugcucuuugg

SEQ ID NO: 3529588 - RNA, 14 nt, Human
gauaugcguauuau

SEQ ID NO: 3529589 - RNA, 12 nt, Human
gauaugcuugua

SEQ ID NO: 3529590 - RNA, 21 nt, Human
gauauggagcccuguaauuuu

SEQ ID NO: 3529591 - RNA, 18 nt, Human
gauauggguaguauuuuu

SEQ ID NO: 3529592 - RNA, 18 nt, Human
gauauguaaaacauuuau

SEQ ID NO: 3529593 - RNA, 19 nt, Human
gauauguaaaacauuuauu

SEQ ID NO: 3529594 - RNA, 14 nt, Human
gauaugugaacagu

SEQ ID NO: 3529595 - RNA, 16 nt, Human
gauauuaaaggaguua

SEQ ID NO: 3529596 - RNA, 19 nt, Human
gauauuaaauuuuuuaaaa

SEQ ID NO: 3529597 - RNA, 13 nt, Human
gauauuaauguau

SEQ ID NO: 3529598 - RNA, 15 nt, Human
gauauuauucuugua

SEQ ID NO: 3529599 - RNA, 17 nt, Human
gauauucagauguaugu

SEQ ID NO: 3529600 - RNA, 21 nt, Human
gauauuccauaguauauuaaa

SEQ ID NO: 3529601 - RNA, 16 nt, Human
gauauuccaugaaugu

SEQ ID NO: 3529602 - RNA, 18 nt, Human
gauauuccaugaauguau

SEQ ID NO: 3529603 - RNA, 21 nt, Human
gauauuccaugaauguaucag

SEQ ID NO: 3529604 - RNA, 20 nt, Human
gauauuccccccacuuaaga

SEQ ID NO: 3529605 - RNA, 23 nt, Human
gauauucuaagaaauaucuguga

SEQ ID NO: 3529606 - RNA, 21 nt, Human
gauauauuaaaaauauaaaac

SEQ ID NO: 3529607 - RNA, 14 nt, Human
gauauauuuuacaa

SEQ ID NO: 3529608 - RNA, 16 nt, Human
gauauauuuucuuucu

SEQ ID NO: 3529609 - RNA, 16 nt, Human
gauauauuuuuaagau

SEQ ID NO: 3529610 - RNA, 17 nt, Human
gauauauuuuucacagu

SEQ ID NO: 3529611 - RNA, 18 nt, Human
gauauccuuaucagagcu

SEQ ID NO: 3529612 - RNA, 20 nt, Human
gauaucuagcuaguaauaua

SEQ ID NO: 3529613 - RNA, 15 nt, Human
gauaucuauaaaaua

SEQ ID NO: 3529614 - RNA, 17 nt, Human
gauaucuauaaaauaga

SEQ ID NO: 3529615 - RNA, 20 nt, Human
gauaucugagggaggaggcc

SEQ ID NO: 3529616 - RNA, 21 nt, Human
gauaucugagggaggaggcca

SEQ ID NO: 3529617 - RNA, 23 nt, Human
gauaucugagggaggaggccacc

SEQ ID NO: 3529618 - RNA, 21 nt, Human
gauaucuggccuaaaaucuug

SEQ ID NO: 3529619 - RNA, 20 nt, Human
gauaucuuggacaaaucaca

SEQ ID NO: 3529620 - RNA, 14 nt, Human
gauaucuuuucuuu

SEQ ID NO: 3529621 - RNA, 22 nt, Human
gauaucuuuuuauugaugugca

SEQ ID NO: 3529622 - RNA, 15 nt, Human
gauaugaaaaauaug

SEQ ID NO: 3529623 - RNA, 21 nt, Human
gauaugaagagcaacugggac

SEQ ID NO: 3529624 - RNA, 18 nt, Human
cugagcacugccaggagg

SEQ ID NO: 3529625 - RNA, 20 nt, Human
cugagcacuguuuauacacu

SEQ ID NO: 3529626 - RNA, 23 nt, Human
cugagcacuguuuucuaguguau

SEQ ID NO: 3529627 - RNA, 17 nt, Human
cugagcagcgagccugc

SEQ ID NO: 3529628 - RNA, 12 nt, Human
cugagcaggcca

SEQ ID NO: 3529629 - RNA, 23 nt, Human
cugagcaggccacacuucaaacu

SEQ ID NO: 3529630 - RNA, 12 nt, Human
cugagcagggcc

SEQ ID NO: 3529631 - RNA, 18 nt, Human
cugagcaguccuuggccu

SEQ ID NO: 3529632 - RNA, 17 nt, Human
cugagcagugauauucu

SEQ ID NO: 3529633 - RNA, 22 nt, Human
cugagcagugauauucuuuguu

SEQ ID NO: 3529634 - RNA, 22 nt, Human
cugagccaagcuagaauucccu

SEQ ID NO: 3529635 - RNA, 14 nt, Human
cugagccacagcag

SEQ ID NO: 3529636 - RNA, 14 nt, Human
cugagccaccugcc

SEQ ID NO: 3529637 - RNA, 17 nt, Human
cugagccaccugcccuu

SEQ ID NO: 3529638 - RNA, 17 nt, Human
cugagccagauuucacu

SEQ ID NO: 3529639 - RNA, 18 nt, Human
cugagccagggucuccag

SEQ ID NO: 3529640 - RNA, 16 nt, Human
cugagccagugucagg

SEQ ID NO: 3529641 - RNA, 23 nt, Human
cugagccaguucaguaccuggag

SEQ ID NO: 3529642 - RNA, 13 nt, Human
cugagcccaggga

SEQ ID NO: 3529643 - RNA, 23 nt, Human
cugagcccauguucugcccccag

SEQ ID NO: 3529644 - RNA, 12 nt, Human
cugagccccagg

SEQ ID NO: 3529645 - RNA, 15 nt, Human
cugagccccagggag

SEQ ID NO: 3529646 - RNA, 18 nt, Human
cugagccccagggagagg

SEQ ID NO: 3529647 - RNA, 22 nt, Human
cugagccccagggugcccagaa

SEQ ID NO: 3529648 - RNA, 18 nt, Human
cugagcccccagcuucca

SEQ ID NO: 3529649 - RNA, 23 nt, Human
cugagcccccagcuuccagcagg

SEQ ID NO: 3529650 - RNA, 17 nt, Human
cugagccccgcagaccu

SEQ ID NO: 3529651 - RNA, 15 nt, Human
cugagccccuacccc

SEQ ID NO: 3529652 - RNA, 17 nt, Human
cugagccccuaccccac

SEQ ID NO: 3529653 - RNA, 22 nt, Human
cugagccccugggacugcugcu

SEQ ID NO: 3529654 - RNA, 12 nt, Human
cugagccccugu

SEQ ID NO: 3529655 - RNA, 13 nt, Human
cugagccccuguc

SEQ ID NO: 3529656 - RNA, 16 nt, Human
cugagccccugucuag

SEQ ID NO: 3529657 - RNA, 16 nt, Human
cugagccccuuccuug

SEQ ID NO: 3529658 - RNA, 20 nt, Human
cugagccccuuccuugcucu

SEQ ID NO: 3529659 - RNA, 14 nt, Human
cugagcccgggcug

SEQ ID NO: 3529660 - RNA, 15 nt, Human
cugagcccgggcugc

SEQ ID NO: 3529661 - RNA, 17 nt, Human
cugagcccgggcugccu

SEQ ID NO: 3529662 - RNA, 19 nt, Human
cugagcccgggcugccugg

SEQ ID NO: 3529663 - RNA, 21 nt, Human
cugagcccgggcugccugggc

SEQ ID NO: 3529664 - RNA, 20 nt, Human
cugagcccuacucccugcag

SEQ ID NO: 3529665 - RNA, 23 nt, Human
cugagcccuacucccugcagaug

SEQ ID NO: 3529666 - RNA, 18 nt, Human
cugagccuacagaugaac

SEQ ID NO: 3529667 - RNA, 17 nt, Human
cugagccucacagcagu

SEQ ID NO: 3529668 - RNA, 13 nt, Human
cugagccucucac

SEQ ID NO: 3529669 - RNA, 22 nt, Human
cugagccucucaccuguacucu

SEQ ID NO: 3529670 - RNA, 12 nt, Human
cugagccucugc

SEQ ID NO: 3529671 - RNA, 14 nt, Human
cugagccucugcuc

SEQ ID NO: 3529672 - RNA, 14 nt, Human
gauuauucauuuaa

SEQ ID NO: 3529673 - RNA, 19 nt, Human
gauuauucauuuaaaauga

SEQ ID NO: 3529674 - RNA, 20 nt, Human
gauuauucauuuaaaaugau

SEQ ID NO: 3529675 - RNA, 12 nt, Human
gauuauuggaaa

SEQ ID NO: 3529676 - RNA, 13 nt, Human
gauuauuuacaag

SEQ ID NO: 3529677 - RNA, 18 nt, Human
gauuauuuacaagaagaa

SEQ ID NO: 3529678 - RNA, 13 nt, Human
gauuauuugcaug

SEQ ID NO: 3529679 - RNA, 17 nt, Human
gauuauuugcauguuau

SEQ ID NO: 3529680 - RNA, 21 nt, Human
gauuauuugggagggaaaagg

SEQ ID NO: 3529681 - RNA, 14 nt, Human
gauuauuuucauua

SEQ ID NO: 3529682 - RNA, 14 nt, Human
gauuauuuuuucag

SEQ ID NO: 3529683 - RNA, 15 nt, Human
gauuauuuuuucaga

SEQ ID NO: 3529684 - RNA, 21 nt, Human
gauuauuuuuucagaccgaaa

SEQ ID NO: 3529685 - RNA, 23 nt, Human
gauucaaaauauuuaaaaauguc

SEQ ID NO: 3529686 - RNA, 21 nt, Human
gauucaaaauugacauugcuu

SEQ ID NO: 3529687 - RNA, 13 nt, Human
gauucaaagguuc

SEQ ID NO: 3529688 - RNA, 19 nt, Human
gauucaaagguucuagguu

SEQ ID NO: 3529689 - RNA, 18 nt, Human
gauucaaucgacuggguu

SEQ ID NO: 3529690 - RNA, 21 nt, Human
gauucaaucuguaaacugugu

SEQ ID NO: 3529691 - RNA, 22 nt, Human
gauucaaucuguaaacugugua

SEQ ID NO: 3529692 - RNA, 20 nt, Human
gauucaaugccccugaauuu

SEQ ID NO: 3529693 - RNA, 17 nt, Human
gauucacaccccaccug

SEQ ID NO: 3529694 - RNA, 15 nt, Human
gauucacaucucauu

SEQ ID NO: 3529695 - RNA, 16 nt, Human
gauucacauguuuuca

SEQ ID NO: 3529696 - RNA, 17 nt, Human
gauucacauguuuucaa

SEQ ID NO: 3529697 - RNA, 19 nt, Human
gauucacauguuuucaaau

SEQ ID NO: 3529698 - RNA, 21 nt, Human
gauucacccuguccaaacugc

SEQ ID NO: 3529699 - RNA, 14 nt, Human
gauucaccuguaaa

SEQ ID NO: 3529700 - RNA, 16 nt, Human
gauucacuucacgcuu

SEQ ID NO: 3529701 - RNA, 21 nt, Human
gauucagaaaauguucuguuu

SEQ ID NO: 3529702 - RNA, 18 nt, Human
gauucagaaaugaggcca

SEQ ID NO: 3529703 - RNA, 21 nt, Human
gauucagagaaaggcaaggga

SEQ ID NO: 3529704 - RNA, 18 nt, Human
gauucagauuguuaucua

SEQ ID NO: 3529705 - RNA, 19 nt, Human
gauucaggaaaaggccugg

SEQ ID NO: 3529706 - RNA, 20 nt, Human
gauucaggcauuuucccccu

SEQ ID NO: 3529707 - RNA, 16 nt, Human
gauucaggcugcuugg

SEQ ID NO: 3529708 - RNA, 17 nt, Human
gauucagguauguugcc

SEQ ID NO: 3529709 - RNA, 15 nt, Human
gauucagucuugccu

SEQ ID NO: 3529710 - RNA, 18 nt, Human
gauucagucuugccuuac

SEQ ID NO: 3529711 - RNA, 19 nt, Human
gauucaguuucuaaaauug

SEQ ID NO: 3529712 - RNA, 22 nt, Human
gauucaguuuucauuugguuca

SEQ ID NO: 3529713 - RNA, 19 nt, Human
gauucauauuuacuucuua

SEQ ID NO: 3529714 - RNA, 23 nt, Human
gauucaucucucagaagggaggc

SEQ ID NO: 3529715 - RNA, 21 nt, Human
gauucaugccaauuagcaauu

SEQ ID NO: 3529716 - RNA, 15 nt, Human
gauucauucucauaa

SEQ ID NO: 3529717 - RNA, 17 nt, Human
gauucauuuauaagaag

SEQ ID NO: 3529718 - RNA, 19 nt, Human
gauucauuuuuaaucauga

SEQ ID NO: 3529719 - RNA, 18 nt, Human
gauucauuuuugaaacug

SEQ ID NO: 3529720 - RNA, 18 nt, Human
gauuccaaagaguagaau

SEQ ID NO: 3529721 - RNA, 19 nt, Human
gauuccaaagaguagaauu

SEQ ID NO: 3529722 - RNA, 17 nt, Human
gauuccacuacaccugg

SEQ ID NO: 3529723 - RNA, 20 nt, Human
gauuccacuacaccuggcug

SEQ ID NO: 3529724 - RNA, 19 nt, Human
gauuccagagaguggcucc

SEQ ID NO: 3529725 - RNA, 20 nt, Human
gauuccagagaguggcuccu

SEQ ID NO: 3529726 - RNA, 15 nt, Human
gauuccagcacaacc

SEQ ID NO: 3529727 - RNA, 14 nt, Human
gauuccaugcuaag

SEQ ID NO: 3529728 - RNA, 18 nt, Human
gauuccauugguccaaga

SEQ ID NO: 3529729 - RNA, 16 nt, Human
gauucccaagcucugc

SEQ ID NO: 3529730 - RNA, 16 nt, Human
gauucccacauuuguc

SEQ ID NO: 3529731 - RNA, 14 nt, Human
gauucccagagaca

SEQ ID NO: 3529732 - RNA, 19 nt, Human
gauucccagagacaggaaa

SEQ ID NO: 3529733 - RNA, 19 nt, Human
gauucccaggaguucugcu

SEQ ID NO: 3529734 - RNA, 17 nt, Human
gauuccccaucucaggc

SEQ ID NO: 3529735 - RNA, 20 nt, Human
gauuccccaucucaggccag

SEQ ID NO: 3529736 - RNA, 17 nt, Human
gauuccccauugccucc

SEQ ID NO: 3529737 - RNA, 15 nt, Human
gauuccccuguguca

SEQ ID NO: 3529738 - RNA, 15 nt, Human
gauucccugauuuaa

SEQ ID NO: 3529739 - RNA, 13 nt, Human
gauucccuuguua

SEQ ID NO: 3529740 - RNA, 16 nt, Human
gauucccuuguuauuc

SEQ ID NO: 3529741 - RNA, 19 nt, Human
gauucccuuguuauucaac

SEQ ID NO: 3529742 - RNA, 23 nt, Human
gauuccucuguauugugcugauu

SEQ ID NO: 3529743 - RNA, 18 nt, Human
gauuccugacccaggccg

SEQ ID NO: 3529744 - RNA, 15 nt, Human
gauuccugagccagu

SEQ ID NO: 3529745 - RNA, 15 nt, Human
gauuccuucucugaa

SEQ ID NO: 3529746 - RNA, 13 nt, Human
gauuccuuucccu

SEQ ID NO: 3529747 - RNA, 23 nt, Human
gauucguggucuuuuccucgcuu

SEQ ID NO: 3529748 - RNA, 22 nt, Human
gauucuaaaaugugauguucua

SEQ ID NO: 3529749 - RNA, 11 nt, Human
gauucuaaaga

SEQ ID NO: 3529750 - RNA, 17 nt, Human
gauucuaaagauucuau

SEQ ID NO: 3529751 - RNA, 15 nt, Human
gauucuaaugaugau

SEQ ID NO: 3529752 - RNA, 14 nt, Human
gauucuacuuuaag

SEQ ID NO: 3529753 - RNA, 18 nt, Human
gauucuacuuuaagcacu

SEQ ID NO: 3529754 - RNA, 20 nt, Human
gauucuauguuaauauuuua

SEQ ID NO: 3529755 - RNA, 20 nt, Human
gauucuauuuauauguacau

SEQ ID NO: 3529756 - RNA, 19 nt, Human
gauucucagggucucugcu

SEQ ID NO: 3529757 - RNA, 21 nt, Human
gauucucagggucucugcugc

SEQ ID NO: 3529758 - RNA, 13 nt, Human
gauucucauaacu

SEQ ID NO: 3529759 - RNA, 17 nt, Human
gauucuccugccucagc

SEQ ID NO: 3529760 - RNA, 18 nt, Human
gauucucugugucuaaga

SEQ ID NO: 3529761 - RNA, 20 nt, Human
gauucugaccuuaaaugcaa

SEQ ID NO: 3529762 - RNA, 19 nt, Human
gauucugcaguaaaucuuu

SEQ ID NO: 3529763 - RNA, 15 nt, Human
gauucugccuuugcc

SEQ ID NO: 3529764 - RNA, 17 nt, Human
gauucugcuggccucug

SEQ ID NO: 3529765 - RNA, 22 nt, Human
gauucugcuggccucugcgagu

SEQ ID NO: 3529766 - RNA, 21 nt, Human
gauucuggacagucagcucuu

SEQ ID NO: 3529767 - RNA, 17 nt, Human
gauucuggauaaagcca

SEQ ID NO: 3529768 - RNA, 11 nt, Human
gauuuuuucca

SEQ ID NO: 3529769 - RNA, 21 nt, Human
gauuuuuuucccaauugagaa

SEQ ID NO: 3529770 - RNA, 18 nt, Human
gauuuuuuuguuguuugu

SEQ ID NO: 3529771 - RNA, 21 nt, Human
gauuuuuuuuuagaacagaaa

SEQ ID NO: 3529772 - RNA, 16 nt, Human
gauuuuuuuuuccuuc

SEQ ID NO: 3529773 - RNA, 21 nt, Human
gauuuuuuuuuuuucucucaa

SEQ ID NO: 3529774 - RNA, 20 nt, Human
gauuuuuuuuuuuuuuuccu

SEQ ID NO: 3529775 - RNA, 18 nt, Human
gcaaaaaaaaaaaaaagc

SEQ ID NO: 3529776 - RNA, 12 nt, Human
gcaaaaaaaguu

SEQ ID NO: 3529777 - RNA, 21 nt, Human
gcaaaaaaauuaaaauggaug

SEQ ID NO: 3529778 - RNA, 20 nt, Human
gcaaaaaacucgaggacugu

SEQ ID NO: 3529779 - RNA, 16 nt, Human
gcaaaaaaguccaauu

SEQ ID NO: 3529780 - RNA, 18 nt, Human
gcaaaaaauacuuuuucu

SEQ ID NO: 3529781 - RNA, 20 nt, Human
gcaaaaaauacuuuuucuaa

SEQ ID NO: 3529782 - RNA, 15 nt, Human
gcaaaaacaaaaaga

SEQ ID NO: 3529783 - RNA, 11 nt, Human
gcaaaaauaua

SEQ ID NO: 3529784 - RNA, 16 nt, Human
gcaaaaauauaaaaua

SEQ ID NO: 3529785 - RNA, 23 nt, Human
gcaaaaauauuuauaaaacuucu

SEQ ID NO: 3529786 - RNA, 17 nt, Human
gcaaaaauauuuuauga

SEQ ID NO: 3529787 - RNA, 23 nt, Human
gcaaaaauauuuuaugauccagc

SEQ ID NO: 3529788 - RNA, 14 nt, Human
gcaaaaaugcuaau

SEQ ID NO: 3529789 - RNA, 19 nt, Human
gcaaaacacaaaacaaauc

SEQ ID NO: 3529790 - RNA, 15 nt, Human
gcaaaaccauugcuu

SEQ ID NO: 3529791 - RNA, 16 nt, Human
gcaaaacccacagaag

SEQ ID NO: 3529792 - RNA, 15 nt, Human
gcaaaaccuuuuacu

SEQ ID NO: 3529793 - RNA, 16 nt, Human
gcaaaaccuuuuacug

SEQ ID NO: 3529794 - RNA, 12 nt, Human
gcaaaagaaaaa

SEQ ID NO: 3529795 - RNA, 14 nt, Human
gcaaaagaaguaac

SEQ ID NO: 3529796 - RNA, 12 nt, Human
gcaaaagagugu

SEQ ID NO: 3529797 - RNA, 16 nt, Human
gcaaaagaugcuucuc

SEQ ID NO: 3529798 - RNA, 20 nt, Human
gcaaaaggaucuuuguggcc

SEQ ID NO: 3529799 - RNA, 21 nt, Human
gcaaaaggcaguggggcuggg

SEQ ID NO: 3529800 - RNA, 13 nt, Human
gcaaaaggccucu

SEQ ID NO: 3529801 - RNA, 16 nt, Human
gcaaaaggccucuugu

SEQ ID NO: 3529802 - RNA, 17 nt, Human
gcaaaagggugucugag

SEQ ID NO: 3529803 - RNA, 20 nt, Human
gcaaaagguucacuaaagca

SEQ ID NO: 3529804 - RNA, 23 nt, Human
gcaaaagugcugcagggcuuuaa

SEQ ID NO: 3529805 - RNA, 19 nt, Human
gcaaaaguucugacuugac

SEQ ID NO: 3529806 - RNA, 13 nt, Human
gcaaaauaaaaca

SEQ ID NO: 3529807 - RNA, 15 nt, Human
gcaaaauaaaacaua

SEQ ID NO: 3529808 - RNA, 17 nt, Human
gcaaaauacaugaagcu

SEQ ID NO: 3529809 - RNA, 21 nt, Human
gcaaaauacaugaugauuuca

SEQ ID NO: 3529810 - RNA, 13 nt, Human
gcaaaauauguuu

SEQ ID NO: 3529811 - RNA, 20 nt, Human
gcaaaauauucacugggcca

SEQ ID NO: 3529812 - RNA, 13 nt, Human
gcaaaaucaugga

SEQ ID NO: 3529813 - RNA, 23 nt, Human
gcaaaauuauagaaguuuagauu

SEQ ID NO: 3529814 - RNA, 17 nt, Human
gcaaacacuccacccuc

SEQ ID NO: 3529815 - RNA, 15 nt, Human
gcaaacagaacaggg

SEQ ID NO: 3529816 - RNA, 16 nt, Human
gcaaacagaacagggu

SEQ ID NO: 3529817 - RNA, 21 nt, Human
gcaaacauuuucucuuagaaa

SEQ ID NO: 3529818 - RNA, 22 nt, Human
gcaaaccaagagauugcuaauu

SEQ ID NO: 3529819 - RNA, 15 nt, Human
gcaaaccacacugga

SEQ ID NO: 3529820 - RNA, 20 nt, Human
gcaaaccacacuggacuccg

SEQ ID NO: 3529821 - RNA, 15 nt, Human
gcaaaccaucauuga

SEQ ID NO: 3529822 - RNA, 16 nt, Human
gcaaacccauuaaggg

SEQ ID NO: 3529823 - RNA, 19 nt, Human
gcaaacccugucaaacauu

SEQ ID NO: 3529824 - RNA, 19 nt, Human
gcaaaccugaccccugcuc

SEQ ID NO: 3529825 - RNA, 21 nt, Human
gcaaaccugaccccugcucag

SEQ ID NO: 3529826 - RNA, 13 nt, Human
gcaaaccugcccc

SEQ ID NO: 3529827 - RNA, 22 nt, Human
gcaaaccuuucuauaauuuuac

SEQ ID NO: 3529828 - RNA, 17 nt, Human
gcaaacgcugccugccg

SEQ ID NO: 3529829 - RNA, 19 nt, Human
gcaaacuaagcccccgcug

SEQ ID NO: 3529830 - RNA, 13 nt, Human
gcaaacucugcug

SEQ ID NO: 3529831 - RNA, 20 nt, Human
gcaaacucuuuggucguuuu

SEQ ID NO: 3529832 - RNA, 23 nt, Human
gcaaacucuuuggucguuuuuuu

SEQ ID NO: 3529833 - RNA, 14 nt, Human
gcaaacugcaugcc

SEQ ID NO: 3529834 - RNA, 18 nt, Human
gcaaacuuaauguucuua

SEQ ID NO: 3529835 - RNA, 23 nt, Human
gcaaacuuggaauuuguaaccuc

SEQ ID NO: 3529836 - RNA, 14 nt, Human
gcaaagaacucuua

SEQ ID NO: 3529837 - RNA, 15 nt, Human
gcaaagacagaagcc

SEQ ID NO: 3529838 - RNA, 16 nt, Human
gcaaagacagaagccu

SEQ ID NO: 3529839 - RNA, 23 nt, Human
gcaaagaggacucgcuuguaaau

SEQ ID NO: 3529840 - RNA, 12 nt, Human
gcaaagaucaaa

SEQ ID NO: 3529841 - RNA, 14 nt, Human
gcaaagaucaaaau

SEQ ID NO: 3529842 - RNA, 15 nt, Human
gcaaagaucaaaaua

SEQ ID NO: 3529843 - RNA, 16 nt, Human
gcaaagauuuaaucug

SEQ ID NO: 3529844 - RNA, 14 nt, Human
gcaaagcacagaga

SEQ ID NO: 3529845 - RNA, 23 nt, Human
gcaaagcaccagcuucuccaggc

SEQ ID NO: 3529846 - RNA, 21 nt, Human
gcaaagcacccauuucaaugu

SEQ ID NO: 3529847 - RNA, 21 nt, Human
gcaaagcaugccaauuucucu

SEQ ID NO: 3529848 - RNA, 21 nt, Human
gcaaagccccaugcuggagcc

SEQ ID NO: 3529849 - RNA, 22 nt, Human
gcaaagccccaugcuggagccu

SEQ ID NO: 3529850 - RNA, 13 nt, Human
gcaaagcccccag

SEQ ID NO: 3529851 - RNA, 15 nt, Human
gcaaagcccccagag

SEQ ID NO: 3529852 - RNA, 11 nt, Human
gcaaagccugu

SEQ ID NO: 3529853 - RNA, 16 nt, Human
gcaaagcucuguggcc

SEQ ID NO: 3529854 - RNA, 20 nt, Human
gcaaaggacuguuuuuuccu

SEQ ID NO: 3529855 - RNA, 14 nt, Human
gcaaagggcugaaa

SEQ ID NO: 3529856 - RNA, 22 nt, Human
gcaaagggcugaaagccauuug

SEQ ID NO: 3529857 - RNA, 20 nt, Human
gcaaaggggcugaaagaaca

SEQ ID NO: 3529858 - RNA, 23 nt, Human
gcaaagggggaggagaagaaaau

SEQ ID NO: 3529859 - RNA, 23 nt, Human
gcaaaggggucccauagagguga

SEQ ID NO: 3529860 - RNA, 18 nt, Human
gcaaagguggcucuccag

SEQ ID NO: 3529861 - RNA, 19 nt, Human
gcaaaguacagguacuuug

SEQ ID NO: 3529862 - RNA, 11 nt, Human
gcaaaguacug

SEQ ID NO: 3529863 - RNA, 14 nt, Human
gcaaaguaguacuu

SEQ ID NO: 3529864 - RNA, 16 nt, Human
gcaaaguaucccuacu

SEQ ID NO: 3529865 - RNA, 17 nt, Human
gcaaaguauuguaaauu

SEQ ID NO: 3529866 - RNA, 18 nt, Human
gcaaaguauuguaaauua

SEQ ID NO: 3529867 - RNA, 16 nt, Human
gcaaagucaugcaaag

SEQ ID NO: 3529868 - RNA, 22 nt, Human
gcaaagucaugcaaaggcuggg

SEQ ID NO: 3529869 - RNA, 23 nt, Human
gcaaagucaugcaaaggcuggga

SEQ ID NO: 3529870 - RNA, 21 nt, Human
gcaaagucuaaaguuuacagu

SEQ ID NO: 3529871 - RNA, 20 nt, Human
gcaaagugaagacacuggcu

SEQ ID NO: 3529872 - RNA, 22 nt, Human
gcaaagugaaguugcuucuucu

SEQ ID NO: 3529873 - RNA, 23 nt, Human
gcaaaguucccuacuuccuguga

SEQ ID NO: 3529874 - RNA, 12 nt, Human
gcaaauaaaagu

SEQ ID NO: 3529875 - RNA, 17 nt, Human
gcaaauaacaaaugcca

SEQ ID NO: 3529876 - RNA, 22 nt, Human
gcacagccaacacgcaccugcc

SEQ ID NO: 3529877 - RNA, 21 nt, Human
gcacagccauacggcacugaa

SEQ ID NO: 3529878 - RNA, 12 nt, Human
gcacagcccucc

SEQ ID NO: 3529879 - RNA, 11 nt, Human
gcacagcccuu

SEQ ID NO: 3529880 - RNA, 14 nt, Human
gcacagccuucucc

SEQ ID NO: 3529881 - RNA, 15 nt, Human
gcacagcuaauucua

SEQ ID NO: 3529882 - RNA, 19 nt, Human
gcacagcugaaaguucuug

SEQ ID NO: 3529883 - RNA, 15 nt, Human
gcacagcuuagauuu

SEQ ID NO: 3529884 - RNA, 21 nt, Human
gcacagcuucauuuccugugu

SEQ ID NO: 3529885 - RNA, 20 nt, Human
gcacagcuugaccugaggcu

SEQ ID NO: 3529886 - RNA, 16 nt, Human
gcacaggacugauucu

SEQ ID NO: 3529887 - RNA, 16 nt, Human
gcacaggagcuaccug

SEQ ID NO: 3529888 - RNA, 16 nt, Human
gcacaggaggcaggca

SEQ ID NO: 3529889 - RNA, 20 nt, Human
gcacaggaggcaggcauggc

SEQ ID NO: 3529890 - RNA, 21 nt, Human
gcacaggaggcaggcauggcc

SEQ ID NO: 3529891 - RNA, 22 nt, Human
gcacaggaggcaggcauggccc

SEQ ID NO: 3529892 - RNA, 12 nt, Human
gcacaggagggg

SEQ ID NO: 3529893 - RNA, 21 nt, Human
gcacaggagggggucguggag

SEQ ID NO: 3529894 - RNA, 11 nt, Human
gcacaggcaga

SEQ ID NO: 3529895 - RNA, 16 nt, Human
gcacaggcagggcagg

SEQ ID NO: 3529896 - RNA, 15 nt, Human
gcacaggcuaauuuu

SEQ ID NO: 3529897 - RNA, 18 nt, Human
gcacaggcugagugcagg

SEQ ID NO: 3529898 - RNA, 17 nt, Human
gcacagggagugcacau

SEQ ID NO: 3529899 - RNA, 15 nt, Human
gcacagggcagcugg

SEQ ID NO: 3529900 - RNA, 20 nt, Human
gcacagggcagcugggccca

SEQ ID NO: 3529901 - RNA, 11 nt, Human
gcacagggccu

SEQ ID NO: 3529902 - RNA, 17 nt, Human
gcacagggccuggccca

SEQ ID NO: 3529903 - RNA, 18 nt, Human
gcacagggccuggcccau

SEQ ID NO: 3529904 - RNA, 23 nt, Human
gcacagggucugcucuuucucug

SEQ ID NO: 3529905 - RNA, 13 nt, Human
gcacaggucaggc

SEQ ID NO: 3529906 - RNA, 14 nt, Human
gcacaggucccacc

SEQ ID NO: 3529907 - RNA, 22 nt, Human
gcacaggucccaccuccagccc

SEQ ID NO: 3529908 - RNA, 16 nt, Human
gcacagucacugcucu

SEQ ID NO: 3529909 - RNA, 13 nt, Human
gcacagugcaucu

SEQ ID NO: 3529910 - RNA, 18 nt, Human
gcacagugcaucucagcc

SEQ ID NO: 3529911 - RNA, 19 nt, Human
gcacagugcaucucagccc

SEQ ID NO: 3529912 - RNA, 15 nt, Human
cugcagcuuccuguc

SEQ ID NO: 3529913 - RNA, 13 nt, Human
cugcagcuuggga

SEQ ID NO: 3529914 - RNA, 17 nt, Human
cugcagcuuguagccag

SEQ ID NO: 3529915 - RNA, 18 nt, Human
cugcagcuuguagccagc

SEQ ID NO: 3529916 - RNA, 21 nt, Human
cugcagcuuuacaugcaauuu

SEQ ID NO: 3529917 - RNA, 17 nt, Human
cugcaggaaauggcugu

SEQ ID NO: 3529918 - RNA, 13 nt, Human
cugcaggaaggag

SEQ ID NO: 3529919 - RNA, 18 nt, Human
cugcaggaaggagcugcc

SEQ ID NO: 3529920 - RNA, 20 nt, Human
cugcaggaaggagcugccug

SEQ ID NO: 3529921 - RNA, 22 nt, Human
cugcaggaaggagcugccugga

SEQ ID NO: 3529922 - RNA, 15 nt, Human
cugcaggaccugccu

SEQ ID NO: 3529923 - RNA, 22 nt, Human
cugcaggaccugccuguagccc

SEQ ID NO: 3529924 - RNA, 21 nt, Human
cugcaggaucucaccaggcag

SEQ ID NO: 3529925 - RNA, 19 nt, Human
cugcaggaugauuguacag

SEQ ID NO: 3529926 - RNA, 13 nt, Human
cugcaggcagaca

SEQ ID NO: 3529927 - RNA, 14 nt, Human
cugcaggcagccag

SEQ ID NO: 3529928 - RNA, 14 nt, Human
cugcaggcaggaac

SEQ ID NO: 3529929 - RNA, 17 nt, Human
cugcaggcaucacagcu

SEQ ID NO: 3529930 - RNA, 19 nt, Human
cugcaggccaagagcagag

SEQ ID NO: 3529931 - RNA, 23 nt, Human
cugcaggccaagagcagaggcag

SEQ ID NO: 3529932 - RNA, 17 nt, Human
cugcaggccaggccagc

SEQ ID NO: 3529933 - RNA, 18 nt, Human
cugcaggccaggccagcu

SEQ ID NO: 3529934 - RNA, 20 nt, Human
cugcaggccccgcuugucca

SEQ ID NO: 3529935 - RNA, 16 nt, Human
cugcaggcugagugca

SEQ ID NO: 3529936 - RNA, 15 nt, Human
cugcaggcuuaauaa

SEQ ID NO: 3529937 - RNA, 17 nt, Human
cugcagggacagagcau

SEQ ID NO: 3529938 - RNA, 17 nt, Human
cugcagggacugccagu

SEQ ID NO: 3529939 - RNA, 21 nt, Human
cugcagggccaggacugagcc

SEQ ID NO: 3529940 - RNA, 22 nt, Human
cugcagggcccucccuuuuccc

SEQ ID NO: 3529941 - RNA, 19 nt, Human
cugcagggcuuuaaaauuc

SEQ ID NO: 3529942 - RNA, 16 nt, Human
cugcaggggcauggga

SEQ ID NO: 3529943 - RNA, 11 nt, Human
cugcaggggcu

SEQ ID NO: 3529944 - RNA, 17 nt, Human
cugcaggggcucuggag

SEQ ID NO: 3529945 - RNA, 19 nt, Human
cugcaggggcucuggagag

SEQ ID NO: 3529946 - RNA, 20 nt, Human
cugcaggggguggacaaacu

SEQ ID NO: 3529947 - RNA, 18 nt, Human
cugcaggguggugcuggg

SEQ ID NO: 3529948 - RNA, 19 nt, Human
cugcaggguggugcuggga

SEQ ID NO: 3529949 - RNA, 19 nt, Human
cugcaggucccuaauaaag

SEQ ID NO: 3529950 - RNA, 21 nt, Human
cugcaggucccuaauaaagcu

SEQ ID NO: 3529951 - RNA, 14 nt, Human
cugcaggugcugcu

SEQ ID NO: 3529952 - RNA, 17 nt, Human
cugcaggugcugcugcg

SEQ ID NO: 3529953 - RNA, 23 nt, Human
cugcagguucucucucacugcca

SEQ ID NO: 3529954 - RNA, 20 nt, Human
cugcagguugggccauacug

SEQ ID NO: 3529955 - RNA, 15 nt, Human
cugcaguagucucug

SEQ ID NO: 3529956 - RNA, 16 nt, Human
cugcaguagucucugu

SEQ ID NO: 3529957 - RNA, 23 nt, Human
cugcaguagucucugugcuuuga

SEQ ID NO: 3529958 - RNA, 17 nt, Human
cugcagucucuauacca

SEQ ID NO: 3529959 - RNA, 21 nt, Human
cugcagucucuauaccaauaa

SEQ ID NO: 3529960 - RNA, 9 nt, Human
cugcaguga

SEQ ID NO: 3529961 - RNA, 22 nt, Human
cugcagugaaagacaagcugca

SEQ ID NO: 3529962 - RNA, 15 nt, Human
cugcagugugccccc

SEQ ID NO: 3529963 - RNA, 17 nt, Human
cugcaguguucgcuugg

SEQ ID NO: 3529964 - RNA, 18 nt, Human
cugcaguguucgcuuggc

SEQ ID NO: 3529965 - RNA, 23 nt, Human
cugcaguucuacucaggcuggug

SEQ ID NO: 3529966 - RNA, 13 nt, Human
cugcaguugccag

SEQ ID NO: 3529967 - RNA, 19 nt, Human
cugcaguuugagacaggag

SEQ ID NO: 3529968 - RNA, 15 nt, Human
cugcaguuuuucagg

SEQ ID NO: 3529969 - RNA, 24 nt, Human
cugcaguuuuucaggagcgcaaga

SEQ ID NO: 3529970 - RNA, 22 nt, Human
cugcaguuuuuuuccuucaaga

SEQ ID NO: 3529971 - RNA, 14 nt, Human
cugcauacaaucug

SEQ ID NO: 3529972 - RNA, 14 nt, Human
cugcauacuuuuua

SEQ ID NO: 3529973 - RNA, 14 nt, Human
cugcauagaaggag

SEQ ID NO: 3529974 - RNA, 15 nt, Human
cugcauaugaaagga

SEQ ID NO: 3529975 - RNA, 12 nt, Human
cugcaucaguuc

SEQ ID NO: 3529976 - RNA, 23 nt, Human
cugcaucccagcaccugccuccu

SEQ ID NO: 3529977 - RNA, 22 nt, Human
cugcaucccaggaugcugggug

SEQ ID NO: 3529978 - RNA, 23 nt, Human
cugcaucccaggaugcugggugg

SEQ ID NO: 3529979 - RNA, 17 nt, Human
cugcauccuccaagaau

SEQ ID NO: 3529980 - RNA, 23 nt, Human
cugcauccuccaagaaucuaucu

SEQ ID NO: 3529981 - RNA, 19 nt, Human
cugcauccuccgccucccg

SEQ ID NO: 3529982 - RNA, 15 nt, Human
cugcauccucuggag

SEQ ID NO: 3529983 - RNA, 22 nt, Human
cugcauccucuggagccagccg

SEQ ID NO: 3529984 - RNA, 18 nt, Human
cugcaucuaagcccaugg

SEQ ID NO: 3529985 - RNA, 16 nt, Human
cugcaucugaccagca

SEQ ID NO: 3529986 - RNA, 17 nt, Human
cugcaucugaccagcag

SEQ ID NO: 3529987 - RNA, 21 nt, Human
cugcaucugaccagcagcgcc

SEQ ID NO: 3529988 - RNA, 21 nt, Human
cugcaucuuauagcacuuuga

SEQ ID NO: 3529989 - RNA, 22 nt, Human
cugcaucuuauagcacuuugaa

SEQ ID NO: 3529990 - RNA, 16 nt, Human
cugcaucuuggggaca

SEQ ID NO: 3529991 - RNA, 21 nt, Human
cugcaucuuggggacaucucu

SEQ ID NO: 3529992 - RNA, 18 nt, Human
cugcaucuuuagugcuuu

SEQ ID NO: 3529993 - RNA, 15 nt, Human
cugcaugaauaucau

SEQ ID NO: 3529994 - RNA, 16 nt, Human
cugcaugaauaucaua

SEQ ID NO: 3529995 - RNA, 20 nt, Human
cugcaugauguuugcccaaa

SEQ ID NO: 3529996 - RNA, 15 nt, Human
cugcaugcagaaagg

SEQ ID NO: 3529997 - RNA, 14 nt, Human
cugcaugcccagag

SEQ ID NO: 3529998 - RNA, 19 nt, Human
cugcaugcccagagaccca

SEQ ID NO: 3529999 - RNA, 20 nt, Human
cugcaugcccagagacccag

SEQ ID NO: 3530000 - RNA, 22 nt, Human
cugcaugcccagagacccagcg

SEQ ID NO: 3530001 - RNA, 20 nt, Human
cugcaugccuggucuuuccu

SEQ ID NO: 3530002 - RNA, 22 nt, Human
cugcaugccuggucuuuccucu

SEQ ID NO: 3530003 - RNA, 23 nt, Human
cugcaugccuggucuuuccucug

SEQ ID NO: 3530004 - RNA, 14 nt, Human
cugcaugcggccca

SEQ ID NO: 3530005 - RNA, 20 nt, Human
cugcaugcggcccagcccgg

SEQ ID NO: 3530006 - RNA, 12 nt, Human
cugcaugcugcu

SEQ ID NO: 3530007 - RNA, 13 nt, Human
cugcaugcugcug

SEQ ID NO: 3530008 - RNA, 16 nt, Human
cugcauggaccuaaca

SEQ ID NO: 3530009 - RNA, 17 nt, Human
cugcauggaccuaacau

SEQ ID NO: 3530010 - RNA, 18 nt, Human
cugcauggagacgcauuu

SEQ ID NO: 3530011 - RNA, 17 nt, Human
cugcauggcagggggcu

SEQ ID NO: 3530012 - RNA, 20 nt, Human
cugcauggcagggggcugcu

SEQ ID NO: 3530013 - RNA, 18 nt, Human
cugcauggcauccuccag

SEQ ID NO: 3530014 - RNA, 19 nt, Human
cugcauggcauccuccagc

SEQ ID NO: 3530015 - RNA, 15 nt, Human
cugcaugguaauuua

SEQ ID NO: 3530016 - RNA, 20 nt, Human
cugcaugguaauuuauaguu

SEQ ID NO: 3530017 - RNA, 21 nt, Human
cugcauguggcuuuuuuaaaa

SEQ ID NO: 3530018 - RNA, 20 nt, Human
cugcauuaccgcguuguaaa

SEQ ID NO: 3530019 - RNA, 23 nt, Human
cugcauuaccgcguuguaaaaua

SEQ ID NO: 3530020 - RNA, 13 nt, Human
cugcauuagaaaa

SEQ ID NO: 3530021 - RNA, 15 nt, Human
cugcauuagaaaaag

SEQ ID NO: 3530022 - RNA, 17 nt, Human
cugcauuauuugagaag

SEQ ID NO: 3530023 - RNA, 20 nt, Human
cugcauucaggaucaaaccc

SEQ ID NO: 3530024 - RNA, 23 nt, Human
cugcauucauuuuuauagcaaca

SEQ ID NO: 3530025 - RNA, 12 nt, Human
cugcauuccgca

SEQ ID NO: 3530026 - RNA, 13 nt, Human
cugcauuccgcag

SEQ ID NO: 3530027 - RNA, 21 nt, Human
cugcauucugccucucuagga

SEQ ID NO: 3530028 - RNA, 17 nt, Human
cugcauugaaaagagcu

SEQ ID NO: 3530029 - RNA, 18 nt, Human
cugcauugaaaagagcug

SEQ ID NO: 3530030 - RNA, 19 nt, Human
cugcauugaaaagagcuga

SEQ ID NO: 3530031 - RNA, 17 nt, Human
cugcauugcccagucuu

SEQ ID NO: 3530032 - RNA, 21 nt, Human
cugcauugcuagauaaaagcu

SEQ ID NO: 3530033 - RNA, 13 nt, Human
cugcauuggcuuu

SEQ ID NO: 3530034 - RNA, 18 nt, Human
cugcauugggugaucauu

SEQ ID NO: 3530035 - RNA, 15 nt, Human
cugcauuuaaaaaaa

SEQ ID NO: 3530036 - RNA, 17 nt, Human
cugcauuuaaaagauac

SEQ ID NO: 3530037 - RNA, 14 nt, Human
cugcauuuagcaca

SEQ ID NO: 3530038 - RNA, 23 nt, Human
cugcauuuagcacaaaaaaaauu

SEQ ID NO: 3530039 - RNA, 13 nt, Human
cugcauuuaggga

SEQ ID NO: 3530040 - RNA, 16 nt, Human
cugcauuuguauauuu

SEQ ID NO: 3530041 - RNA, 14 nt, Human
cugcauuugugaaa

SEQ ID NO: 3530042 - RNA, 15 nt, Human
cugcauuugugaaau

SEQ ID NO: 3530043 - RNA, 22 nt, Human
cugcauuugugaaaugauggug

SEQ ID NO: 3530044 - RNA, 20 nt, Human
cugcauuuuauucuggaugg

SEQ ID NO: 3530045 - RNA, 18 nt, Human
cugcauuuucaccccacc

SEQ ID NO: 3530046 - RNA, 17 nt, Human
cugcauuuucuggguuc

SEQ ID NO: 3530047 - RNA, 15 nt, Human
gcaaggcccugcugc

SEQ ID NO: 3530048 - RNA, 21 nt, Human
gcaaggccgcuguucacccac

SEQ ID NO: 3530049 - RNA, 15 nt, Human
gcaaggcuaugugau

SEQ ID NO: 3530050 - RNA, 14 nt, Human
gcaagggaggccca

SEQ ID NO: 3530051 - RNA, 17 nt, Human
gcaagggaggcccagcg

SEQ ID NO: 3530052 - RNA, 22 nt, Human
gcaagggcacaaguccuggaug

SEQ ID NO: 3530053 - RNA, 15 nt, Human
gcaagggccaugcug

SEQ ID NO: 3530054 - RNA, 15 nt, Human
gcaaggggaaaaucu

SEQ ID NO: 3530055 - RNA, 16 nt, Human
gcaaggggaaaaucuc

SEQ ID NO: 3530056 - RNA, 21 nt, Human
gcagccucgccccuggcagag

SEQ ID NO: 3530057 - RNA, 12 nt, Human
gcagccucuccc

SEQ ID NO: 3530058 - RNA, 13 nt, Human
gcagccucugggc

SEQ ID NO: 3530059 - RNA, 14 nt, Human
gcagccucuggggg

SEQ ID NO: 3530060 - RNA, 22 nt, Human
gcagccucugggggguggccag

SEQ ID NO: 3530061 - RNA, 16 nt, Human
gcagccugccuggagu

SEQ ID NO: 3530062 - RNA, 15 nt, Human
gcagccugcguggcu

SEQ ID NO: 3530063 - RNA, 15 nt, Human
gcagccuggagcccu

SEQ ID NO: 3530064 - RNA, 12 nt, Human
gcagccuggagg

SEQ ID NO: 3530065 - RNA, 20 nt, Human
gcagccuggcucccaggaca

SEQ ID NO: 3530066 - RNA, 21 nt, Human
gcagccuggcucccaggacac

SEQ ID NO: 3530067 - RNA, 15 nt, Human
gcagccuggcucccc

SEQ ID NO: 3530068 - RNA, 20 nt, Human
gcagccuggcuccccugggg

SEQ ID NO: 3530069 - RNA, 10 nt, Human
gcagccuggg

SEQ ID NO: 3530070 - RNA, 20 nt, Human
gcagccuugaacucugggcu

SEQ ID NO: 3530071 - RNA, 15 nt, Human
gcagccuuggcaaac

SEQ ID NO: 3530072 - RNA, 12 nt, Human
gcagccuuguga

SEQ ID NO: 3530073 - RNA, 15 nt, Human
gcagccuuuaaugca

SEQ ID NO: 3530074 - RNA, 14 nt, Human
gcagcgaccgcccc

SEQ ID NO: 3530075 - RNA, 12 nt, Human
gcagcgagccug

SEQ ID NO: 3530076 - RNA, 20 nt, Human
gcagcgccaagcaaccuggg

SEQ ID NO: 3530077 - RNA, 15 nt, Human
gcagcgccuuuccca

SEQ ID NO: 3530078 - RNA, 20 nt, Human
gcagcuaguccuagugaacc

SEQ ID NO: 3530079 - RNA, 23 nt, Human
gcagcucaagcagcgaccgcccc

SEQ ID NO: 3530080 - RNA, 20 nt, Human
gcagcucagaaccacagcaa

SEQ ID NO: 3530081 - RNA, 14 nt, Human
gcagcucagagagg

SEQ ID NO: 3530082 - RNA, 21 nt, Human
gcagcucaucucugucccacu

SEQ ID NO: 3530083 - RNA, 13 nt, Human
gcagcucccuggc

SEQ ID NO: 3530084 - RNA, 13 nt, Human
gcagcuccucugu

SEQ ID NO: 3530085 - RNA, 16 nt, Human
gcagcuccucugucuc

SEQ ID NO: 3530086 - RNA, 13 nt, Human
gcagcucuuccug

SEQ ID NO: 3530087 - RNA, 13 nt, Human
gcagcucuugcua

SEQ ID NO: 3530088 - RNA, 23 nt, Human
gcagcucuugcuaaucagugucu

SEQ ID NO: 3530089 - RNA, 16 nt, Human
gcagcugagcagggcc

SEQ ID NO: 3530090 - RNA, 17 nt, Human
gcagcugagcagggccg

SEQ ID NO: 3530091 - RNA, 20 nt, Human
gcagcugagcagggccgggg

SEQ ID NO: 3530092 - RNA, 21 nt, Human
gcagcugagcagggccgggga

SEQ ID NO: 3530093 - RNA, 16 nt, Human
gcagcugauacaaauu

SEQ ID NO: 3530094 - RNA, 15 nt, Human
gcagcugauuuuaac

SEQ ID NO: 3530095 - RNA, 17 nt, Human
gcagcugccaggagcac

SEQ ID NO: 3530096 - RNA, 11 nt, Human
gcagcugccuc

SEQ ID NO: 3530097 - RNA, 15 nt, Human
gcagcugccuccccu

SEQ ID NO: 3530098 - RNA, 13 nt, Human
gcagcugcuuuug

SEQ ID NO: 3530099 - RNA, 20 nt, Human
gcagcugcuuuugucuaugg

SEQ ID NO: 3530100 - RNA, 23 nt, Human
gcagcuggaaaagggucuuggga

SEQ ID NO: 3530101 - RNA, 16 nt, Human
gcagcuggacuaccca

SEQ ID NO: 3530102 - RNA, 22 nt, Human
gcagcuggacucugcaucccag

SEQ ID NO: 3530103 - RNA, 16 nt, Human
gcagcugggcccaacc

SEQ ID NO: 3530104 - RNA, 18 nt, Human
gcagaaaagcaccugccg

SEQ ID NO: 3530105 - RNA, 18 nt, Human
gcagaaaauaaaggaagc

SEQ ID NO: 3530106 - RNA, 22 nt, Human
gcagaaaaucuuuuacuagugu

SEQ ID NO: 3530107 - RNA, 17 nt, Human
gcagaaaauucugugcc

SEQ ID NO: 3530108 - RNA, 18 nt, Human
gcagaaacccugagcaga

SEQ ID NO: 3530109 - RNA, 20 nt, Human
gcagaaagcaucccucaccc

SEQ ID NO: 3530110 - RNA, 13 nt, Human
gcagaaagugccu

SEQ ID NO: 3530111 - RNA, 16 nt, Human
gcagaaauacagucuu

SEQ ID NO: 3530112 - RNA, 16 nt, Human
gcagaaauagacaaaa

SEQ ID NO: 3530113 - RNA, 14 nt, Human
gcagaaaucuagaa

SEQ ID NO: 3530114 - RNA, 12 nt, Human
gcagaaauucug

SEQ ID NO: 3530115 - RNA, 17 nt, Human
gcagaaauucuguuuuu

SEQ ID NO: 3530116 - RNA, 18 nt, Human
gcagaacacauuucaaau

SEQ ID NO: 3530117 - RNA, 17 nt, Human
gcagaacacuaaccuga

SEQ ID NO: 3530118 - RNA, 21 nt, Human
gcagaacagccgcuccugucu

SEQ ID NO: 3530119 - RNA, 13 nt, Human
gcagaacagugau

SEQ ID NO: 3530120 - RNA, 19 nt, Human
gcagaaccggagagccagc

SEQ ID NO: 3530121 - RNA, 20 nt, Human
gcagaaccggagagccagcu

SEQ ID NO: 3530122 - RNA, 21 nt, Human
gcagaacgaaccuuggccugg

SEQ ID NO: 3530123 - RNA, 21 nt, Human
gcagaacguauugguccagcu

SEQ ID NO: 3530124 - RNA, 21 nt, Human
gcagaacuaaacucauuuaua

SEQ ID NO: 3530125 - RNA, 18 nt, Human
gcagaacugagcuccucu

SEQ ID NO: 3530126 - RNA, 19 nt, Human
gcagaacugccauuauuuu

SEQ ID NO: 3530127 - RNA, 19 nt, Human
gcagaacuugaagccugcu

SEQ ID NO: 3530128 - RNA, 13 nt, Human
gcagaagaaagga

SEQ ID NO: 3530129 - RNA, 23 nt, Human
gcagaagaauugaacccaggagg

SEQ ID NO: 3530130 - RNA, 14 nt, Human
gcagaagacaguau

SEQ ID NO: 3530131 - RNA, 16 nt, Human
gcagaagcagcaacuu

SEQ ID NO: 3530132 - RNA, 12 nt, Human
gcagaaggaaga

SEQ ID NO: 3530133 - RNA, 14 nt, Human
gcagaaggaagacu

SEQ ID NO: 3530134 - RNA, 16 nt, Human
gcagaaggaaggcagg

SEQ ID NO: 3530135 - RNA, 19 nt, Human
gcagaaggauuuuuuaaag

SEQ ID NO: 3530136 - RNA, 14 nt, Human
gcagaaggccaaga

SEQ ID NO: 3530137 - RNA, 15 nt, Human
gcagaagggagaagg

SEQ ID NO: 3530138 - RNA, 22 nt, Human
gcagaagggagcuggcuccagc

SEQ ID NO: 3530139 - RNA, 22 nt, Human
gcagaaggggguggugucucca

SEQ ID NO: 3530140 - RNA, 17 nt, Human
gcagaaguaagccucau

SEQ ID NO: 3530141 - RNA, 16 nt, Human
gcagaaguguuuuuua

SEQ ID NO: 3530142 - RNA, 17 nt, Human
gcagaauaaagcaauuu

SEQ ID NO: 3530143 - RNA, 19 nt, Human
gcagaauaaagcaauuuuc

SEQ ID NO: 3530144 - RNA, 17 nt, Human
gcagaauacuuuucucu

SEQ ID NO: 3530145 - RNA, 21 nt, Human
gcagaauucauucauacuuaa

SEQ ID NO: 3530146 - RNA, 13 nt, Human
gcagaauuggaaa

SEQ ID NO: 3530147 - RNA, 21 nt, Human
gcagaauuguuuagauuuugu

SEQ ID NO: 3530148 - RNA, 23 nt, Human
gcagaauuguuuagauuuugugu

SEQ ID NO: 3530149 - RNA, 14 nt, Human
gcagacaauaaacc

SEQ ID NO: 3530150 - RNA, 17 nt, Human
gcagacaauaaacccuc

SEQ ID NO: 3530151 - RNA, 18 nt, Human
gcagacacagggacuuga

SEQ ID NO: 3530152 - RNA, 21 nt, Human
gcagacacagggacuugaagu

SEQ ID NO: 3530153 - RNA, 22 nt, Human
gcagacacagggacuugaaguu

SEQ ID NO: 3530154 - RNA, 20 nt, Human
gcagacagaagucuccucaa

SEQ ID NO: 3530155 - RNA, 15 nt, Human
gcagacagagccagg

SEQ ID NO: 3530156 - RNA, 16 nt, Human
gcagacagagccagga

SEQ ID NO: 3530157 - RNA, 18 nt, Human
gcagacagagccaggaga

SEQ ID NO: 3530158 - RNA, 23 nt, Human
gcagacagagccaggagaagcuc

SEQ ID NO: 3530159 - RNA, 18 nt, Human
gcagacagcagcucaggc

SEQ ID NO: 3530160 - RNA, 15 nt, Human
gcagacagcuccacc

SEQ ID NO: 3530161 - RNA, 23 nt, Human
gcagacaggcaagcaccuccugc

SEQ ID NO: 3530162 - RNA, 20 nt, Human
gcagacagggggccagaaca

SEQ ID NO: 3530163 - RNA, 12 nt, Human
gcagacauuguc

SEQ ID NO: 3530164 - RNA, 20 nt, Human
gcagaccacgcccguccugc

SEQ ID NO: 3530165 - RNA, 20 nt, Human
gcagaccauuggggcuccca

SEQ ID NO: 3530166 - RNA, 23 nt, Human
gcagaccauuggggcucccagcc

SEQ ID NO: 3530167 - RNA, 15 nt, Human
gcagaccuccccagc

SEQ ID NO: 3530168 - RNA, 17 nt, Human
gcagaccuccccagccc

SEQ ID NO: 3530169 - RNA, 19 nt, Human
gcagaccuccccagccccu

SEQ ID NO: 3530170 - RNA, 12 nt, Human
gcagaccucugg

SEQ ID NO: 3530171 - RNA, 20 nt, Human
gcagaccuguccuccuggug

SEQ ID NO: 3530172 - RNA, 14 nt, Human
gcagacgccgggga

SEQ ID NO: 3530173 - RNA, 15 nt, Human
gcagacuaugcaaac

SEQ ID NO: 3530174 - RNA, 18 nt, Human
gcagacucaguuugucag

SEQ ID NO: 3530175 - RNA, 15 nt, Human
gcagacucuacagag

SEQ ID NO: 3530176 - RNA, 19 nt, Human
gcagacucuacagaggcca

SEQ ID NO: 3530177 - RNA, 20 nt, Human
gcagacucuuuaugcuugca

SEQ ID NO: 3530178 - RNA, 18 nt, Human
gcagacugaucaggaccu

SEQ ID NO: 3530179 - RNA, 15 nt, Human
gcagacuggagggga

SEQ ID NO: 3530180 - RNA, 15 nt, Human
gcagacuucccagcu

SEQ ID NO: 3530181 - RNA, 23 nt, Human
gcagagaaagaagagacaggagg

SEQ ID NO: 3530182 - RNA, 21 nt, Human
gcagagaccaucccugaaggc

SEQ ID NO: 3530183 - RNA, 22 nt, Human
gcagagaccaucccugaaggcc

SEQ ID NO: 3530184 - RNA, 13 nt, Human
gcagagagaagcc

SEQ ID NO: 3530185 - RNA, 16 nt, Human
gcagagagaagccugu

SEQ ID NO: 3530186 - RNA, 10 nt, Human
gcagagagag

SEQ ID NO: 3530187 - RNA, 15 nt, Human
gcagagaggccaggu

SEQ ID NO: 3530188 - RNA, 22 nt, Human
gcagagagguuugcagucccaa

SEQ ID NO: 3530189 - RNA, 17 nt, Human
gcagagaugccucccug

SEQ ID NO: 3530190 - RNA, 23 nt, Human
gcagagauuggaaugggcagcuc

SEQ ID NO: 3530191 - RNA, 23 nt, Human
gcagagauuucucauugacuuuu

SEQ ID NO: 3530192 - RNA, 19 nt, Human
gcagagauuuucaacauuu

SEQ ID NO: 3530193 - RNA, 16 nt, Human
gcagagcaagucugca

SEQ ID NO: 3530194 - RNA, 19 nt, Human
gcagagcaccuuagacagu

SEQ ID NO: 3530195 - RNA, 21 nt, Human
gcagagcaccuuugcacagga

SEQ ID NO: 3530196 - RNA, 15 nt, Human
gcagagcagagacca

SEQ ID NO: 3530197 - RNA, 21 nt, Human
gcagagcagugggccuggcca

SEQ ID NO: 3530198 - RNA, 15 nt, Human
gcagagcccccagga

SEQ ID NO: 3530199 - RNA, 11 nt, Human
gcagagcccug

SEQ ID NO: 3530200 - RNA, 22 nt, Human
gcagagcgccgugaguucucag

SEQ ID NO: 3530201 - RNA, 16 nt, Human
gcagccacccugagga

SEQ ID NO: 3530202 - RNA, 17 nt, Human
gcagccacccugaggag

SEQ ID NO: 3530203 - RNA, 14 nt, Human
gcagccacuauugu

SEQ ID NO: 3530204 - RNA, 14 nt, Human
gcagccagaggcac

SEQ ID NO: 3530205 - RNA, 17 nt, Human
gcagccagcaucugggc

SEQ ID NO: 3530206 - RNA, 19 nt, Human
gcagccagcaucugggccu

SEQ ID NO: 3530207 - RNA, 13 nt, Human
gcagccagcccag

SEQ ID NO: 3530208 - RNA, 13 nt, Human
gcagccagcccug

SEQ ID NO: 3530209 - RNA, 17 nt, Human
gcagccagcccugccug

SEQ ID NO: 3530210 - RNA, 18 nt, Human
gcagccagcccugccugg

SEQ ID NO: 3530211 - RNA, 19 nt, Human
gcagccagcccugccugga

SEQ ID NO: 3530212 - RNA, 16 nt, Human
gcagccagcucucagc

SEQ ID NO: 3530213 - RNA, 19 nt, Human
gcagccaggacaccgggca

SEQ ID NO: 3530214 - RNA, 20 nt, Human
gcagccaggccacuggcccc

SEQ ID NO: 3530215 - RNA, 12 nt, Human
gcagccagggag

SEQ ID NO: 3530216 - RNA, 20 nt, Human
gcagccagggagagcccagg

SEQ ID NO: 3530217 - RNA, 18 nt, Human
gcagccagugcccugagc

SEQ ID NO: 3530218 - RNA, 15 nt, Human
gcagcccaagcuucc

SEQ ID NO: 3530219 - RNA, 21 nt, Human
gcagcccaagcuucccuccau

SEQ ID NO: 3530220 - RNA, 18 nt, Human
gcagcccaccccucaaca

SEQ ID NO: 3530221 - RNA, 14 nt, Human
gcagcccagagacu

SEQ ID NO: 3530222 - RNA, 12 nt, Human
gcagcccagcca

SEQ ID NO: 3530223 - RNA, 16 nt, Human
gcagcccaggaagucu

SEQ ID NO: 3530224 - RNA, 18 nt, Human
gcagcccauuucuccaga

SEQ ID NO: 3530225 - RNA, 22 nt, Human
gcagcccauuucuccagaaccc

SEQ ID NO: 3530226 - RNA, 17 nt, Human
gcagccccagccugcua

SEQ ID NO: 3530227 - RNA, 12 nt, Human
gcagccccaggc

SEQ ID NO: 3530228 - RNA, 19 nt, Human
gcagccccauucugccugc

SEQ ID NO: 3530229 - RNA, 14 nt, Human
gcagcccccagcuc

SEQ ID NO: 3530230 - RNA, 23 nt, Human
gcagcccccagcucccaccuccc

SEQ ID NO: 3530231 - RNA, 23 nt, Human
gcagccccgggagggcggcacag

SEQ ID NO: 3530232 - RNA, 22 nt, Human
gcagcccgcaucagcugcucag

SEQ ID NO: 3530233 - RNA, 23 nt, Human
gcagcccuaaggaucucucagga

SEQ ID NO: 3530234 - RNA, 19 nt, Human
gcagcccuagagccugccu

SEQ ID NO: 3530235 - RNA, 15 nt, Human
gcagcccuccucacc

SEQ ID NO: 3530236 - RNA, 18 nt, Human
gcagcccuccucaccccg

SEQ ID NO: 3530237 - RNA, 20 nt, Human
gcagcccugcugcugccugc

SEQ ID NO: 3530238 - RNA, 13 nt, Human
gcagcccugcuuu

SEQ ID NO: 3530239 - RNA, 18 nt, Human
gcagcccuggcccaucau

SEQ ID NO: 3530240 - RNA, 14 nt, Human
gcagcccuuccaaa

SEQ ID NO: 3530241 - RNA, 14 nt, Human
gcagccgagcucgu

SEQ ID NO: 3530242 - RNA, 14 nt, Human
gcagccgccuucac

SEQ ID NO: 3530243 - RNA, 18 nt, Human
gcagccgccuuccuugac

SEQ ID NO: 3530244 - RNA, 19 nt, Human
gcagccggcacagggucug

SEQ ID NO: 3530245 - RNA, 18 nt, Human
gcagccgugccuucagcu

SEQ ID NO: 3530246 - RNA, 18 nt, Human
gcagccguuugagaagaa

SEQ ID NO: 3530247 - RNA, 16 nt, Human
gcagccuacuagggac

SEQ ID NO: 3530248 - RNA, 23 nt, Human
gcagccuacuagggaccugggga

SEQ ID NO: 3530249 - RNA, 20 nt, Human
gcagccucaaccuccugggc

SEQ ID NO: 3530250 - RNA, 17 nt, Human
gcagccuccaacacaag

SEQ ID NO: 3530251 - RNA, 20 nt, Human
gcagccucccauccagggcc

SEQ ID NO: 3530252 - RNA, 14 nt, Human
gcagccucccuccg

SEQ ID NO: 3530253 - RNA, 17 nt, Human
gcagccuccgcuucccu

SEQ ID NO: 3530254 - RNA, 18 nt, Human
gcagccucgaacuccugg

SEQ ID NO: 3530255 - RNA, 20 nt, Human
gcagccucucagugcccucc

SEQ ID NO: 3530256 - RNA, 23 nt, Human
gcagccucugggggguggccagg

SEQ ID NO: 3530257 - RNA, 13 nt, Human
gcagccugagucc

SEQ ID NO: 3530258 - RNA, 13 nt, Human
gcagccugcagga

SEQ ID NO: 3530259 - RNA, 13 nt, Human
gcagccugccugg

SEQ ID NO: 3530260 - RNA, 21 nt, Human
gcagccugcucuagugggaca

SEQ ID NO: 3530261 - RNA, 12 nt, Human
gcagccuggagc

SEQ ID NO: 3530262 - RNA, 13 nt, Human
gcagccuggagcc

SEQ ID NO: 3530263 - RNA, 13 nt, Human
gcagccuggaggc

SEQ ID NO: 3530264 - RNA, 14 nt, Human
gcagccuggggcug

SEQ ID NO: 3530265 - RNA, 19 nt, Human
gcagccuugaacucugggc

SEQ ID NO: 3530266 - RNA, 15 nt, Human
gcagcgaccaccccu

SEQ ID NO: 3530267 - RNA, 16 nt, Human
gcagcgaccaccccug

SEQ ID NO: 3530268 - RNA, 16 nt, Human
gcagcgaccgcccccu

SEQ ID NO: 3530269 - RNA, 13 nt, Human
gcagggccauggc

SEQ ID NO: 3530270 - RNA, 18 nt, Human
gcagggccauggcucagg

SEQ ID NO: 3530271 - RNA, 23 nt, Human
gcagggccgccagggagaccugg

SEQ ID NO: 3530272 - RNA, 13 nt, Human
gcagggccgggga

SEQ ID NO: 3530273 - RNA, 20 nt, Human
gcagggccggggaacuggcc

SEQ ID NO: 3530274 - RNA, 22 nt, Human
gcagggccggggaacuggccaa

SEQ ID NO: 3530275 - RNA, 17 nt, Human
gcagggccuagcugcua

SEQ ID NO: 3530276 - RNA, 21 nt, Human
gcagggccuagcugcuacaaa

SEQ ID NO: 3530277 - RNA, 17 nt, Human
gcagggcgggcagaggg

SEQ ID NO: 3530278 - RNA, 18 nt, Human
gcagggcgggcagagggc

SEQ ID NO: 3530279 - RNA, 22 nt, Human
gcagggcgggcagagggcugga

SEQ ID NO: 3530280 - RNA, 12 nt, Human
gcagggcucagc

SEQ ID NO: 3530281 - RNA, 21 nt, Human
gcagggcucagcggggacagc

SEQ ID NO: 3530282 - RNA, 22 nt, Human
gcagggcucagcggggacagcu

SEQ ID NO: 3530283 - RNA, 17 nt, Human
gcagggcucccacagag

SEQ ID NO: 3530284 - RNA, 14 nt, Human
gcagggcucuccug

SEQ ID NO: 3530285 - RNA, 16 nt, Human
gcagggcucuccuggc

SEQ ID NO: 3530286 - RNA, 19 nt, Human
gcagggcucugccccagag

SEQ ID NO: 3530287 - RNA, 21 nt, Human
gcagggcuggccccagggcac

SEQ ID NO: 3530288 - RNA, 17 nt, Human
gcaggggaggccaucug

SEQ ID NO: 3530289 - RNA, 18 nt, Human
gcaggggaggccaucugg

SEQ ID NO: 3530290 - RNA, 12 nt, Human
gcaggggagggg

SEQ ID NO: 3530291 - RNA, 22 nt, Human
gcaggggaggguagagcggaga

SEQ ID NO: 3530292 - RNA, 24 nt, Human
gcaggggauggcguggucaagcac

SEQ ID NO: 3530293 - RNA, 20 nt, Human
gcaggggcccugcagcucuc

SEQ ID NO: 3530294 - RNA, 19 nt, Human
gcaggggcuacaagaggga

SEQ ID NO: 3530295 - RNA, 14 nt, Human
gcaggggcucugga

SEQ ID NO: 3530296 - RNA, 18 nt, Human
gcaggggcucuggagaga

SEQ ID NO: 3530297 - RNA, 14 nt, Human
gcaggggcuuccug

SEQ ID NO: 3530298 - RNA, 20 nt, Human
gcaggggcuuguugcaggcu

SEQ ID NO: 3530299 - RNA, 16 nt, Human
gcagggggacugcuug

SEQ ID NO: 3530300 - RNA, 14 nt, Human
gcagggggcugcug

SEQ ID NO: 3530301 - RNA, 21 nt, Human
gcaggggguggacaaacugga

SEQ ID NO: 3530302 - RNA, 23 nt, Human
gcagggguggaggagagccuggu

SEQ ID NO: 3530303 - RNA, 19 nt, Human
gcaggguccuagaaauucc

SEQ ID NO: 3530304 - RNA, 21 nt, Human
gcaggguccucuucugggccu

SEQ ID NO: 3530305 - RNA, 17 nt, Human
gcagggucugggcagga

SEQ ID NO: 3530306 - RNA, 16 nt, Human
gcagggucuuuucauc

SEQ ID NO: 3530307 - RNA, 21 nt, Human
gcagggucuuuucaucuggga

SEQ ID NO: 3530308 - RNA, 14 nt, Human
gcaggguguuggga

SEQ ID NO: 3530309 - RNA, 14 nt, Human
gcaggguuucuuuu

SEQ ID NO: 3530310 - RNA, 16 nt, Human
gcagguaaacuccugu

SEQ ID NO: 3530311 - RNA, 19 nt, Human
gcagguagaccugucuccu

SEQ ID NO: 3530312 - RNA, 21 nt, Human
gcagguagccagggggacuag

SEQ ID NO: 3530313 - RNA, 13 nt, Human
gcagguccccaga

SEQ ID NO: 3530314 - RNA, 23 nt, Human
gcagguccccagacuccaccaag

SEQ ID NO: 3530315 - RNA, 10 nt, Human
gcaggucccu

SEQ ID NO: 3530316 - RNA, 14 nt, Human
gcaggucccuaaua

SEQ ID NO: 3530317 - RNA, 17 nt, Human
gcaggucccuaauaaag

SEQ ID NO: 3530318 - RNA, 15 nt, Human
gcaggugaauuguuu

SEQ ID NO: 3530319 - RNA, 17 nt, Human
gcaggugaccuucuggg

SEQ ID NO: 3530320 - RNA, 23 nt, Human
gcaggugaucugcugcagagcag

SEQ ID NO: 3530321 - RNA, 22 nt, Human
gcaggugauuggaccaggccau

SEQ ID NO: 3530322 - RNA, 14 nt, Human
gcaggugccuccag

SEQ ID NO: 3530323 - RNA, 21 nt, Human
gcaggugccuccaggugugca

SEQ ID NO: 3530324 - RNA, 13 nt, Human
gcagguggaucua

SEQ ID NO: 3530325 - RNA, 21 nt, Human
gcagguggaucuauuucaugu

SEQ ID NO: 3530326 - RNA, 17 nt, Human
gcagguggcaucucuaa

SEQ ID NO: 3530327 - RNA, 13 nt, Human
gcagguggggagg

SEQ ID NO: 3530328 - RNA, 21 nt, Human
gcaggugguccugagaccuga

SEQ ID NO: 3530329 - RNA, 14 nt, Human
gcagguuaaauguu

SEQ ID NO: 3530330 - RNA, 23 nt, Human
gcagguuaaauguuuuguaaacu

SEQ ID NO: 3530331 - RNA, 13 nt, Human
gcagguucaguuu

SEQ ID NO: 3530332 - RNA, 15 nt, Human
gcagguucccaagcu

SEQ ID NO: 3530333 - RNA, 19 nt, Human
gcagguucccaagcucaga

SEQ ID NO: 3530334 - RNA, 17 nt, Human
gcagguucuuguuggug

SEQ ID NO: 3530335 - RNA, 22 nt, Human
gcagguucuuguuggugcacag

SEQ ID NO: 3530336 - RNA, 17 nt, Human
gcagguugauaaaucau

SEQ ID NO: 3530337 - RNA, 14 nt, Human
gcagguuggacccc

SEQ ID NO: 3530338 - RNA, 19 nt, Human
gcagguuggaccccagaga

SEQ ID NO: 3530339 - RNA, 23 nt, Human
gcagguugggaaugaggcuugcu

SEQ ID NO: 3530340 - RNA, 23 nt, Human
gcagguugggccauacuggccuc

SEQ ID NO: 3530341 - RNA, 14 nt, Human
gcaguaaaaacugu

SEQ ID NO: 3530342 - RNA, 16 nt, Human
gcaguacaauaaaagu

SEQ ID NO: 3530343 - RNA, 17 nt, Human
gcaguacaauaaaagua

SEQ ID NO: 3530344 - RNA, 15 nt, Human
gcaguaccugagggu

SEQ ID NO: 3530345 - RNA, 19 nt, Human
gcaguaccugggcaagcug

SEQ ID NO: 3530346 - RNA, 15 nt, Human
cugcugccuccccaa

SEQ ID NO: 3530347 - RNA, 11 nt, Human
cugcugccugg

SEQ ID NO: 3530348 - RNA, 14 nt, Human
cugcugccuggcca

SEQ ID NO: 3530349 - RNA, 16 nt, Human
cugcugccuggccacu

SEQ ID NO: 3530350 - RNA, 19 nt, Human
cugcugccuggccacugcu

SEQ ID NO: 3530351 - RNA, 21 nt, Human
cugcugccuggccacugcucc

SEQ ID NO: 3530352 - RNA, 18 nt, Human
cugcugcgcccugggcuc

SEQ ID NO: 3530353 - RNA, 15 nt, Human
cugcugcuccuagga

SEQ ID NO: 3530354 - RNA, 18 nt, Human
cugcugcuccuaggaccc

SEQ ID NO: 3530355 - RNA, 23 nt, Human
cugcugcucuuggcuggacccag

SEQ ID NO: 3530356 - RNA, 11 nt, Human
cugcugcugag

SEQ ID NO: 3530357 - RNA, 14 nt, Human
cugcugcugagaac

SEQ ID NO: 3530358 - RNA, 17 nt, Human
cugcugcugagaaccug

SEQ ID NO: 3530359 - RNA, 21 nt, Human
cugcugcugagaaccuggccu

SEQ ID NO: 3530360 - RNA, 23 nt, Human
cugcugcugagaaccuggccuuc

SEQ ID NO: 3530361 - RNA, 14 nt, Human
cugcugcugccugc

SEQ ID NO: 3530362 - RNA, 15 nt, Human
cugcugcugccuggc

SEQ ID NO: 3530363 - RNA, 20 nt, Human
cugcugcugcgcccuuaccu

SEQ ID NO: 3530364 - RNA, 16 nt, Human
cugcugcugcugcgcc

SEQ ID NO: 3530365 - RNA, 15 nt, Human
cugcugcuggaucac

SEQ ID NO: 3530366 - RNA, 14 nt, Human
cugcugcugggcuc

SEQ ID NO: 3530367 - RNA, 15 nt, Human
cugcugcugggcuca

SEQ ID NO: 3530368 - RNA, 13 nt, Human
cugcugcuguguu

SEQ ID NO: 3530369 - RNA, 22 nt, Human
cugcugcuuuuugagguggcac

SEQ ID NO: 3530370 - RNA, 15 nt, Human
cugcuggaagcccag

SEQ ID NO: 3530371 - RNA, 16 nt, Human
cugcuggaagcccagc

SEQ ID NO: 3530372 - RNA, 15 nt, Human
cugcuggagaggccc

SEQ ID NO: 3530373 - RNA, 21 nt, Human
cugcuggagaggccccagccg

SEQ ID NO: 3530374 - RNA, 18 nt, Human
cugcuggaggccucaggu

SEQ ID NO: 3530375 - RNA, 20 nt, Human
cugcuggaguuucauguaca

SEQ ID NO: 3530376 - RNA, 14 nt, Human
cugcuggcacccac

SEQ ID NO: 3530377 - RNA, 17 nt, Human
cugcuggcacccaccgu

SEQ ID NO: 3530378 - RNA, 20 nt, Human
cugcuggccaaauagcaaag

SEQ ID NO: 3530379 - RNA, 16 nt, Human
cugcuggcccagccaa

SEQ ID NO: 3530380 - RNA, 23 nt, Human
cugcuggccccucaccugggcac

SEQ ID NO: 3530381 - RNA, 15 nt, Human
cugcuggccgccuca

SEQ ID NO: 3530382 - RNA, 16 nt, Human
cugcuggccgggcaca

SEQ ID NO: 3530383 - RNA, 17 nt, Human
cugcuggccgggcacag

SEQ ID NO: 3530384 - RNA, 19 nt, Human
cugcuggccgggcacagcu

SEQ ID NO: 3530385 - RNA, 15 nt, Human
cugcuggccuggauc

SEQ ID NO: 3530386 - RNA, 14 nt, Human
cugcuggcgccucu

SEQ ID NO: 3530387 - RNA, 17 nt, Human
cugcuggcgccucugca

SEQ ID NO: 3530388 - RNA, 14 nt, Human
cugcuggcugccuu

SEQ ID NO: 3530389 - RNA, 14 nt, Human
cugcuggcuugcag

SEQ ID NO: 3530390 - RNA, 14 nt, Human
cugcugggcucagu

SEQ ID NO: 3530391 - RNA, 14 nt, Human
cugcugggcucucc

SEQ ID NO: 3530392 - RNA, 22 nt, Human
cugcugggcucuccaccucagc

SEQ ID NO: 3530393 - RNA, 23 nt, Human
cugcugggcucuccaccucagcc

SEQ ID NO: 3530394 - RNA, 13 nt, Human
cugcugggcuggg

SEQ ID NO: 3530395 - RNA, 17 nt, Human
cugcugggcuggggccu

SEQ ID NO: 3530396 - RNA, 18 nt, Human
cugcugggcuggggccug

SEQ ID NO: 3530397 - RNA, 11 nt, Human
cugcugggcuu

SEQ ID NO: 3530398 - RNA, 18 nt, Human
cugcuggggaagacagug

SEQ ID NO: 3530399 - RNA, 19 nt, Human
cugcuggggaagacagugg

SEQ ID NO: 3530400 - RNA, 21 nt, Human
cugcuggggaagacaguggcc

SEQ ID NO: 3530401 - RNA, 22 nt, Human
cugcuggggauccccgccuggc

SEQ ID NO: 3530402 - RNA, 17 nt, Human
cugcuggggccucagac

SEQ ID NO: 3530403 - RNA, 13 nt, Human
cugcuggggccug

SEQ ID NO: 3530404 - RNA, 17 nt, Human
cugcuggggccugggac

SEQ ID NO: 3530405 - RNA, 11 nt, Human
cugcugggugg

SEQ ID NO: 3530406 - RNA, 16 nt, Human
cugcugguccguggga

SEQ ID NO: 3530407 - RNA, 17 nt, Human
cugcuggucuucaauua

SEQ ID NO: 3530408 - RNA, 18 nt, Human
cugcuggugcagagcuga

SEQ ID NO: 3530409 - RNA, 22 nt, Human
cugcuggugcagagcugaagau

SEQ ID NO: 3530410 - RNA, 23 nt, Human
cugcugguucaggguuggccccu

SEQ ID NO: 3530411 - RNA, 19 nt, Human
cugcuguaaauuuggcuuc

SEQ ID NO: 3530412 - RNA, 13 nt, Human
cugcuguacugaa

SEQ ID NO: 3530413 - RNA, 15 nt, Human
cugcugucaccucuc

SEQ ID NO: 3530414 - RNA, 19 nt, Human
cugcugucaccucucccac

SEQ ID NO: 3530415 - RNA, 18 nt, Human
cugcugucauugcuucuu

SEQ ID NO: 3530416 - RNA, 11 nt, Human
cugcuguccag

SEQ ID NO: 3530417 - RNA, 14 nt, Human
cugcuguccagaca

SEQ ID NO: 3530418 - RNA, 15 nt, Human
cugcuguccagacag

SEQ ID NO: 3530419 - RNA, 17 nt, Human
cugcuguccagacagcc

SEQ ID NO: 3530420 - RNA, 13 nt, Human
cugcuguccccuc

SEQ ID NO: 3530421 - RNA, 19 nt, Human
cugcuguccccucuugccc

SEQ ID NO: 3530422 - RNA, 22 nt, Human
cugcuguccccucuugccccaa

SEQ ID NO: 3530423 - RNA, 18 nt, Human
cugcuguccccuuggcag

SEQ ID NO: 3530424 - RNA, 17 nt, Human
cugcugucccucccccu

SEQ ID NO: 3530425 - RNA, 20 nt, Human
cugcugucccucccccuugu

SEQ ID NO: 3530426 - RNA, 18 nt, Human
cugcugucgcucucaguu

SEQ ID NO: 3530427 - RNA, 13 nt, Human
cugcugucugggu

SEQ ID NO: 3530428 - RNA, 21 nt, Human
cugcugugauacgaugcuuca

SEQ ID NO: 3530429 - RNA, 14 nt, Human
cugcugugcaacgg

SEQ ID NO: 3530430 - RNA, 14 nt, Human
cugcuguggccagg

SEQ ID NO: 3530431 - RNA, 16 nt, Human
cugcuguggccaggag

SEQ ID NO: 3530432 - RNA, 19 nt, Human
cugcugugggcacagguca

SEQ ID NO: 3530433 - RNA, 14 nt, Human
cugcugugugccuu

SEQ ID NO: 3530434 - RNA, 22 nt, Human
cugcugugugcuuuuuuugugu

SEQ ID NO: 3530435 - RNA, 15 nt, Human
cugcuguuccagugg

SEQ ID NO: 3530436 - RNA, 21 nt, Human
cugcuguuugacaccucuuuu

SEQ ID NO: 3530437 - RNA, 17 nt, Human
cugcuuaacuucacaua

SEQ ID NO: 3530438 - RNA, 18 nt, Human
cugcuuacaauucccugc

SEQ ID NO: 3530439 - RNA, 14 nt, Human
cugcuucaaggauc

SEQ ID NO: 3530440 - RNA, 19 nt, Human
cugcuucaaggauccugag

SEQ ID NO: 3530441 - RNA, 22 nt, Human
cugcuucaaggauccugagcca

SEQ ID NO: 3530442 - RNA, 20 nt, Human
cugcuucagauguggagcca

SEQ ID NO: 3530443 - RNA, 14 nt, Human
cugcuucagccucc

SEQ ID NO: 3530444 - RNA, 16 nt, Human
cugcuucagccuccca

SEQ ID NO: 3530445 - RNA, 21 nt, Human
cugcuucaguguauggaaaua

SEQ ID NO: 3530446 - RNA, 24 nt, Human
cugcuuccaauuuucuggaauaca

SEQ ID NO: 3530447 - RNA, 16 nt, Human
cugcuuccaccucacc

SEQ ID NO: 3530448 - RNA, 17 nt, Human
cugcuuccaccucaccc

SEQ ID NO: 3530449 - RNA, 19 nt, Human
cugcuuccaccucacccca

SEQ ID NO: 3530450 - RNA, 20 nt, Human
cugcuuccaccucaccccac

SEQ ID NO: 3530451 - RNA, 14 nt, Human
cugcuuccagugag

SEQ ID NO: 3530452 - RNA, 19 nt, Human
cugcuuccagugaggcucu

SEQ ID NO: 3530453 - RNA, 12 nt, Human
cugcuucccagg

SEQ ID NO: 3530454 - RNA, 18 nt, Human
cugcuucccucugccugu

SEQ ID NO: 3530455 - RNA, 20 nt, Human
cugcuucccucugccugucc

SEQ ID NO: 3530456 - RNA, 22 nt, Human
cugcuucccucugccugucccu

SEQ ID NO: 3530457 - RNA, 15 nt, Human
cugcuucccugaagc

SEQ ID NO: 3530458 - RNA, 16 nt, Human
cugcuuccuauaauuu

SEQ ID NO: 3530459 - RNA, 20 nt, Human
cugcuuccuauaauuuugau

SEQ ID NO: 3530460 - RNA, 13 nt, Human
cugcuuccuccug

SEQ ID NO: 3530461 - RNA, 15 nt, Human
cugcuuccuccugga

SEQ ID NO: 3530462 - RNA, 16 nt, Human
cugcuuccuccuggaa

SEQ ID NO: 3530463 - RNA, 12 nt, Human
cugcuuccugcu

SEQ ID NO: 3530464 - RNA, 19 nt, Human
cugcuuccugucuuuggga

SEQ ID NO: 3530465 - RNA, 17 nt, Human
cugcuuccuuucuugau

SEQ ID NO: 3530466 - RNA, 18 nt, Human
cugcuucuaccaacugga

SEQ ID NO: 3530467 - RNA, 20 nt, Human
cugcuucuaccaacuggaag

SEQ ID NO: 3530468 - RNA, 13 nt, Human
cugcuucuccaag

SEQ ID NO: 3530469 - RNA, 21 nt, Human
cugcuucucccacuuggccaa

SEQ ID NO: 3530470 - RNA, 17 nt, Human
cugcuucucccaggcaa

SEQ ID NO: 3530471 - RNA, 18 nt, Human
cugcuucucccaggcaag

SEQ ID NO: 3530472 - RNA, 19 nt, Human
cugcuucucccaggcaagg

SEQ ID NO: 3530473 - RNA, 22 nt, Human
cugcuucucccaggcaaggcug

SEQ ID NO: 3530474 - RNA, 18 nt, Human
gcaugauugcagaauugu

SEQ ID NO: 3530475 - RNA, 18 nt, Human
gcaugcaaaugagcucug

SEQ ID NO: 3530476 - RNA, 14 nt, Human
gcaugcaccugcaa

SEQ ID NO: 3530477 - RNA, 22 nt, Human
gcaugcacuguucccccugugc

SEQ ID NO: 3530478 - RNA, 14 nt, Human
gcaugcagcuuugc

SEQ ID NO: 3530479 - RNA, 21 nt, Human
gcaugcauuuugcagcaguga

SEQ ID NO: 3530480 - RNA, 23 nt, Human
gcaugccaacaagaaugcauuga

SEQ ID NO: 3530481 - RNA, 18 nt, Human
gcaugcccagagacccag

SEQ ID NO: 3530482 - RNA, 18 nt, Human
gcaugcccccucgugcca

SEQ ID NO: 3530483 - RNA, 16 nt, Human
gcaugccccggccacc

SEQ ID NO: 3530484 - RNA, 18 nt, Human
gcaugccccggccaccuc

SEQ ID NO: 3530485 - RNA, 19 nt, Human
gcaugccccggccaccucu

SEQ ID NO: 3530486 - RNA, 21 nt, Human
gcaugccccggccaccucugc

SEQ ID NO: 3530487 - RNA, 15 nt, Human
gcaugcccucucagg

SEQ ID NO: 3530488 - RNA, 16 nt, Human
gcaugcccucucaggc

SEQ ID NO: 3530489 - RNA, 14 nt, Human
gcaugccuggacaa

SEQ ID NO: 3530490 - RNA, 14 nt, Human
gcaugccuggaugg

SEQ ID NO: 3530491 - RNA, 14 nt, Human
cugcuugaggaaaa

SEQ ID NO: 3530492 - RNA, 13 nt, Human
cugcuugaggcaa

SEQ ID NO: 3530493 - RNA, 20 nt, Human
cugcuugaggcaacucaucu

SEQ ID NO: 3530494 - RNA, 20 nt, Human
cugcuugaguucccagaugg

SEQ ID NO: 3530495 - RNA, 23 nt, Human
cugcuugaugggauucuggacag

SEQ ID NO: 3530496 - RNA, 16 nt, Human
cugcuugccaucccuc

SEQ ID NO: 3530497 - RNA, 19 nt, Human
cugcuugcccuaagcagaa

SEQ ID NO: 3530498 - RNA, 18 nt, Human
cugcuugccgaaacugga

SEQ ID NO: 3530499 - RNA, 19 nt, Human
cugcuugccgaaacuggaa

SEQ ID NO: 3530500 - RNA, 22 nt, Human
cugcuuggaccucgugcuuuaa

SEQ ID NO: 3530501 - RNA, 17 nt, Human
cugcuuggagcugagca

SEQ ID NO: 3530502 - RNA, 15 nt, Human
cugcuuggcccaggg

SEQ ID NO: 3530503 - RNA, 16 nt, Human
cugcuuggcccagggg

SEQ ID NO: 3530504 - RNA, 21 nt, Human
cugcuuggggggugaugaggg

SEQ ID NO: 3530505 - RNA, 20 nt, Human
cugcuuggguggagaagcca

SEQ ID NO: 3530506 - RNA, 23 nt, Human
cugcuuuaaaaaaaauccuucua

SEQ ID NO: 3530507 - RNA, 19 nt, Human
cugcuuuaaaaaugucuua

SEQ ID NO: 3530508 - RNA, 17 nt, Human
cugcuuuaaccacccca

SEQ ID NO: 3530509 - RNA, 21 nt, Human
cugcuuuaauugugaauugau

SEQ ID NO: 3530510 - RNA, 20 nt, Human
cugcuuuagacuugaaaaga

SEQ ID NO: 3530511 - RNA, 15 nt, Human
cugcuuucagauacu

SEQ ID NO: 3530512 - RNA, 15 nt, Human
cugcuuuccaaagcc

SEQ ID NO: 3530513 - RNA, 18 nt, Human
cugcuuuccccugugggg

SEQ ID NO: 3530514 - RNA, 20 nt, Human
cugcuuuccccuguggggau

SEQ ID NO: 3530515 - RNA, 21 nt, Human
cugcuuuccccuguggggauc

SEQ ID NO: 3530516 - RNA, 16 nt, Human
cugcuuucuccauugu

SEQ ID NO: 3530517 - RNA, 22 nt, Human
cugcuuucuccauuguaaacca

SEQ ID NO: 3530518 - RNA, 14 nt, Human
cugcuuucuccuuu

SEQ ID NO: 3530519 - RNA, 13 nt, Human
cugcuuucuguuc

SEQ ID NO: 3530520 - RNA, 15 nt, Human
cugcuuucuguucca

SEQ ID NO: 3530521 - RNA, 17 nt, Human
cugcuuucuguuccaaa

SEQ ID NO: 3530522 - RNA, 18 nt, Human
cugcuuucuguuccaaau

SEQ ID NO: 3530523 - RNA, 13 nt, Human
cugcuuugaauaa

SEQ ID NO: 3530524 - RNA, 21 nt, Human
cugcuuugacugagcagacug

SEQ ID NO: 3530525 - RNA, 23 nt, Human
cugcuuugacugagcagacuggu

SEQ ID NO: 3530526 - RNA, 16 nt, Human
cugcuuuggcagugcc

SEQ ID NO: 3530527 - RNA, 16 nt, Human
cugcuuugggcugccc

SEQ ID NO: 3530528 - RNA, 19 nt, Human
cugcuuugggcugcccugg

SEQ ID NO: 3530529 - RNA, 13 nt, Human
cugcuuuguuacc

SEQ ID NO: 3530530 - RNA, 14 nt, Human
cugcuuuuaccaug

SEQ ID NO: 3530531 - RNA, 17 nt, Human
cugcuuuuaccaugccc

SEQ ID NO: 3530532 - RNA, 13 nt, Human
cugcuuuuauauc

SEQ ID NO: 3530533 - RNA, 22 nt, Human
cugcuuuuauuaaauuuguuga

SEQ ID NO: 3530534 - RNA, 15 nt, Human
cugcuuuucaaugug

SEQ ID NO: 3530535 - RNA, 18 nt, Human
cugcuuuucacugcugca

SEQ ID NO: 3530536 - RNA, 19 nt, Human
cugcuuuucccuuugugag

SEQ ID NO: 3530537 - RNA, 14 nt, Human
cugcuuuuggccug

SEQ ID NO: 3530538 - RNA, 19 nt, Human
cugcuuuuuaaagaaugcu

SEQ ID NO: 3530539 - RNA, 16 nt, Human
cugcuuuuuggaaagu

SEQ ID NO: 3530540 - RNA, 20 nt, Human
cugcuuuuuggaaagucaga

SEQ ID NO: 3530541 - RNA, 18 nt, Human
cugcuuuuuuuuuuccag

SEQ ID NO: 3530542 - RNA, 19 nt, Human
cugcuuuuuuuuuuccagc

SEQ ID NO: 3530543 - RNA, 22 nt, Human
cugcuuuuuuuuuuccagcaag

SEQ ID NO: 3530544 - RNA, 23 nt, Human
cugcuuuuuuuuuuccagcaagu

SEQ ID NO: 3530545 - RNA, 16 nt, Human
cuggaaaacagaacac

SEQ ID NO: 3530546 - RNA, 17 nt, Human
cuggaaaacagaacacu

SEQ ID NO: 3530547 - RNA, 18 nt, Human
cuggaaaacagaacacuu

SEQ ID NO: 3530548 - RNA, 22 nt, Human
cuggaaaagggucuugggaaau

SEQ ID NO: 3530549 - RNA, 23 nt, Human
cuggaaaaguauguuagugcaaa

SEQ ID NO: 3530550 - RNA, 19 nt, Human
cuggaaaauaaaaggucua

SEQ ID NO: 3530551 - RNA, 23 nt, Human
cuggaaaauaauacugcugagau

SEQ ID NO: 3530552 - RNA, 20 nt, Human
cuggaaaauuccuauugauu

SEQ ID NO: 3530553 - RNA, 16 nt, Human
cuggaaaccugucuga

SEQ ID NO: 3530554 - RNA, 19 nt, Human
cuggaaagcccccccuuau

SEQ ID NO: 3530555 - RNA, 13 nt, Human
cuggaaaggcuca

SEQ ID NO: 3530556 - RNA, 20 nt, Human
cuggaaaggcucagucucag

SEQ ID NO: 3530557 - RNA, 21 nt, Human
cuggaaaggggagagccugcu

SEQ ID NO: 3530558 - RNA, 23 nt, Human
cuggaaauaucaguuacucagcc

SEQ ID NO: 3530559 - RNA, 14 nt, Human
cuggaacccagacu

SEQ ID NO: 3530560 - RNA, 20 nt, Human
cuggaacccuuuuaaaguug

SEQ ID NO: 3530561 - RNA, 15 nt, Human
cuggaaccucagccu

SEQ ID NO: 3530562 - RNA, 16 nt, Human
cuggaaccucagccug

SEQ ID NO: 3530563 - RNA, 18 nt, Human
cuggaaccucagccuggc

SEQ ID NO: 3530564 - RNA, 20 nt, Human
cuggaaccuugcuguccuga

SEQ ID NO: 3530565 - RNA, 22 nt, Human
cuggaacggugaaggugacagc

SEQ ID NO: 3530566 - RNA, 21 nt, Human
cuggaacucagugugacuccu

SEQ ID NO: 3530567 - RNA, 17 nt, Human
cuggaacucuugacagc

SEQ ID NO: 3530568 - RNA, 18 nt, Human
cuggaacugucucucaug

SEQ ID NO: 3530569 - RNA, 19 nt, Human
cuggaacugucucucauga

SEQ ID NO: 3530570 - RNA, 19 nt, Human
cuggaacuugaacugauuc

SEQ ID NO: 3530571 - RNA, 20 nt, Human
cuggaacuugaacugauuca

SEQ ID NO: 3530572 - RNA, 15 nt, Human
cuggaagaacaggcc

SEQ ID NO: 3530573 - RNA, 21 nt, Human
cuggaagaacaggccucucca

SEQ ID NO: 3530574 - RNA, 21 nt, Human
cuggaagacgcaagggccuga

SEQ ID NO: 3530575 - RNA, 19 nt, Human
cuggaagagcuaggcaggg

SEQ ID NO: 3530576 - RNA, 13 nt, Human
cuggaagaugggg

SEQ ID NO: 3530577 - RNA, 18 nt, Human
cuggaagcacagcuucau

SEQ ID NO: 3530578 - RNA, 20 nt, Human
cuggaagcagugcccaggug

SEQ ID NO: 3530579 - RNA, 22 nt, Human
cuggaagccaaaauguaggcuu

SEQ ID NO: 3530580 - RNA, 14 nt, Human
cuggaagcccagcc

SEQ ID NO: 3530581 - RNA, 21 nt, Human
cuggaagcccagccccuacug

SEQ ID NO: 3530582 - RNA, 17 nt, Human
cuggaagccccugggcc

SEQ ID NO: 3530583 - RNA, 16 nt, Human
cuggaagcccuggaga

SEQ ID NO: 3530584 - RNA, 18 nt, Human
cuggaagccggcggccca

SEQ ID NO: 3530585 - RNA, 22 nt, Human
cuggaagccggcggcccaagcc

SEQ ID NO: 3530586 - RNA, 18 nt, Human
cuggaagcuaauuugcau

SEQ ID NO: 3530587 - RNA, 19 nt, Human
cuggaagcuaauuugcauu

SEQ ID NO: 3530588 - RNA, 15 nt, Human
cuggaagcugggagg

SEQ ID NO: 3530589 - RNA, 16 nt, Human
cuggaagcuguguccu

SEQ ID NO: 3530590 - RNA, 22 nt, Human
cuggaagcuguguccuugcacc

SEQ ID NO: 3530591 - RNA, 18 nt, Human
cuggaagcuuuguccccu

SEQ ID NO: 3530592 - RNA, 20 nt, Human
cuggaagcuuuguccccugc

SEQ ID NO: 3530593 - RNA, 13 nt, Human
cuggaaggaggaa

SEQ ID NO: 3530594 - RNA, 14 nt, Human
cuggaaggaggaag

SEQ ID NO: 3530595 - RNA, 17 nt, Human
cuggaaggagugagagg

SEQ ID NO: 3530596 - RNA, 15 nt, Human
cuggaagggaggugg

SEQ ID NO: 3530597 - RNA, 15 nt, Human
cuggaagggcuagaa

SEQ ID NO: 3530598 - RNA, 22 nt, Human
cuggaagggcuagaaccuguag

SEQ ID NO: 3530599 - RNA, 21 nt, Human
cuggaagugcuaauuuugaaa

SEQ ID NO: 3530600 - RNA, 18 nt, Human
cuggaaguuaaagugagg

SEQ ID NO: 3530601 - RNA, 19 nt, Human
cuggaaguuaaagugaggc

SEQ ID NO: 3530602 - RNA, 19 nt, Human
cuggaauaagaagcaaaua

SEQ ID NO: 3530603 - RNA, 24 nt, Human
cuggaaucuggagaccagggagcc

SEQ ID NO: 3530604 - RNA, 14 nt, Human
cuggaaugcagugg

SEQ ID NO: 3530605 - RNA, 15 nt, Human
cuggaaugcaguggu

SEQ ID NO: 3530606 - RNA, 22 nt, Human
cuggaaugguacaugucuucca

SEQ ID NO: 3530607 - RNA, 20 nt, Human
cuggaauguaaucaauguuu

SEQ ID NO: 3530608 - RNA, 21 nt, Human
cuggaauguaaucaauguuuc

SEQ ID NO: 3530609 - RNA, 20 nt, Human
cuggaauuagcuuggggcca

SEQ ID NO: 3530610 - RNA, 15 nt, Human
cuggaauuguggcua

SEQ ID NO: 3530611 - RNA, 22 nt, Human
cuggaauuguggcuauccugau

SEQ ID NO: 3530612 - RNA, 13 nt, Human
cuggaauuugaaa

SEQ ID NO: 3530613 - RNA, 14 nt, Human
cuggacaaagaauu

SEQ ID NO: 3530614 - RNA, 18 nt, Human
cuggacaagcagaggugg

SEQ ID NO: 3530615 - RNA, 21 nt, Human
cuggacaauugcuucaagcau

SEQ ID NO: 3530616 - RNA, 13 nt, Human
cuggacacaggcc

SEQ ID NO: 3530617 - RNA, 16 nt, Human
cuggacacucagaccu

SEQ ID NO: 3530618 - RNA, 17 nt, Human
cuggacacucagaccug

SEQ ID NO: 3530619 - RNA, 18 nt, Human
cuggacacucagaccuga

SEQ ID NO: 3530620 - RNA, 20 nt, Human
cuggacagaggggacucugg

SEQ ID NO: 3530621 - RNA, 15 nt, Human
cuggacagccccacc

SEQ ID NO: 3530622 - RNA, 14 nt, Human
cuggacagcuugug

SEQ ID NO: 3530623 - RNA, 20 nt, Human
cuggacaggcucugcuucuc

SEQ ID NO: 3530624 - RNA, 15 nt, Human
cuggacaggucuggg

SEQ ID NO: 3530625 - RNA, 20 nt, Human
cuggacaguaucccacaucc

SEQ ID NO: 3530626 - RNA, 16 nt, Human
cuggacagucagcucu

SEQ ID NO: 3530627 - RNA, 17 nt, Human
cuggacauagagaggga

SEQ ID NO: 3530628 - RNA, 18 nt, Human
cuggacauagagagggag

SEQ ID NO: 3530629 - RNA, 23 nt, Human
cuggacauagagagggagaagaa

SEQ ID NO: 3530630 - RNA, 14 nt, Human
cuggaccaaagcug

SEQ ID NO: 3530631 - RNA, 22 nt, Human
cuggaccaaagcugacgaggcu

SEQ ID NO: 3530632 - RNA, 13 nt, Human
gcauucuaguacu

SEQ ID NO: 3530633 - RNA, 15 nt, Human
gcauucuauugccuu

SEQ ID NO: 3530634 - RNA, 16 nt, Human
gccagcaacugaauaa

SEQ ID NO: 3530635 - RNA, 13 nt, Human
gccagcaaugaca

SEQ ID NO: 3530636 - RNA, 20 nt, Human
gccagcaaugacaucucagg

SEQ ID NO: 3530637 - RNA, 21 nt, Human
gccagcaaugauguccagaag

SEQ ID NO: 3530638 - RNA, 22 nt, Human
gccagcaaugauguccagaaga

SEQ ID NO: 3530639 - RNA, 13 nt, Human
gccagcacacagg

SEQ ID NO: 3530640 - RNA, 16 nt, Human
gccagcacacagggca

SEQ ID NO: 3530641 - RNA, 20 nt, Human
gccagcacuuguccagcuga

SEQ ID NO: 3530642 - RNA, 21 nt, Human
cuggaccaacccuguuuccug

SEQ ID NO: 3530643 - RNA, 14 nt, Human
cuggaccagaugcu

SEQ ID NO: 3530644 - RNA, 21 nt, Human
cuggaccaguggucucacaug

SEQ ID NO: 3530645 - RNA, 11 nt, Human
cuggacccagc

SEQ ID NO: 3530646 - RNA, 13 nt, Human
cuggacccagcca

SEQ ID NO: 3530647 - RNA, 13 nt, Human
cuggaccccagcc

SEQ ID NO: 3530648 - RNA, 23 nt, Human
cuggaccccugcauuggaacugg

SEQ ID NO: 3530649 - RNA, 20 nt, Human
cuggacccguucauggggga

SEQ ID NO: 3530650 - RNA, 13 nt, Human
cuggacccugacc

SEQ ID NO: 3530651 - RNA, 20 nt, Human
cuggacccugaccagcuccc

SEQ ID NO: 3530652 - RNA, 21 nt, Human
cuggacccugaccagcucccc

SEQ ID NO: 3530653 - RNA, 16 nt, Human
cuggacccuuauaaaa

SEQ ID NO: 3530654 - RNA, 18 nt, Human
cuggacccuuauaaaauc

SEQ ID NO: 3530655 - RNA, 18 nt, Human
cuggaccucugacagcag

SEQ ID NO: 3530656 - RNA, 14 nt, Human
cuggaccucugggu

SEQ ID NO: 3530657 - RNA, 21 nt, Human
cuggaccugccuccugccugc

SEQ ID NO: 3530658 - RNA, 15 nt, Human
cuggaccuguauauu

SEQ ID NO: 3530659 - RNA, 16 nt, Human
cuggaccuugaacugg

SEQ ID NO: 3530660 - RNA, 14 nt, Human
cuggacggaagugg

SEQ ID NO: 3530661 - RNA, 14 nt, Human
cuggacggcaggcu

SEQ ID NO: 3530662 - RNA, 21 nt, Human
cuggacggcaggcucacugcc

SEQ ID NO: 3530663 - RNA, 22 nt, Human
cuggacggcaggcucacugcca

SEQ ID NO: 3530664 - RNA, 18 nt, Human
cuggacggggacugggga

SEQ ID NO: 3530665 - RNA, 23 nt, Human
cuggacggggacuggggaugugg

SEQ ID NO: 3530666 - RNA, 20 nt, Human
cuggacuagagggaccucuc

SEQ ID NO: 3530667 - RNA, 16 nt, Human
cuggacucaccucccc

SEQ ID NO: 3530668 - RNA, 19 nt, Human
cuggacuccagaucugcac

SEQ ID NO: 3530669 - RNA, 14 nt, Human
cuggacuccucugu

SEQ ID NO: 3530670 - RNA, 20 nt, Human
cuggacuccucuguccaggc

SEQ ID NO: 3530671 - RNA, 18 nt, Human
cuggacucucagucucug

SEQ ID NO: 3530672 - RNA, 15 nt, Human
cuggacucugcaucc

SEQ ID NO: 3530673 - RNA, 23 nt, Human
cuggacucugcaucccagcaccu

SEQ ID NO: 3530674 - RNA, 14 nt, Human
cuggacucuggacu

SEQ ID NO: 3530675 - RNA, 23 nt, Human
cuggacucuucaaaaacuguuuu

SEQ ID NO: 3530676 - RNA, 23 nt, Human
cuggacugaagccugcaggaguu

SEQ ID NO: 3530677 - RNA, 13 nt, Human
cuggacugacagc

SEQ ID NO: 3530678 - RNA, 15 nt, Human
cuggacugacagcau

SEQ ID NO: 3530679 - RNA, 18 nt, Human
cuggacugaggccugagc

SEQ ID NO: 3530680 - RNA, 22 nt, Human
cuggacugagggggccuggaug

SEQ ID NO: 3530681 - RNA, 20 nt, Human
cuggacugccuugaauaucc

SEQ ID NO: 3530682 - RNA, 15 nt, Human
cuggacuggcuagag

SEQ ID NO: 3530683 - RNA, 13 nt, Human
cuggacuggcugu

SEQ ID NO: 3530684 - RNA, 17 nt, Human
cuggacugggagguaga

SEQ ID NO: 3530685 - RNA, 20 nt, Human
cuggacugucauagaaauua

SEQ ID NO: 3530686 - RNA, 16 nt, Human
cuggacugugugcuca

SEQ ID NO: 3530687 - RNA, 22 nt, Human
cuggacuuaagcaucuggcucu

SEQ ID NO: 3530688 - RNA, 15 nt, Human
cuggacuucuaccug

SEQ ID NO: 3530689 - RNA, 15 nt, Human
cuggacuugagcuug

SEQ ID NO: 3530690 - RNA, 17 nt, Human
cuggacuuggccccugc

SEQ ID NO: 3530691 - RNA, 14 nt, Human
cuggacuuuccugc

SEQ ID NO: 3530692 - RNA, 15 nt, Human
cuggacuuuccugca

SEQ ID NO: 3530693 - RNA, 18 nt, Human
cuggacuuuccugcaacu

SEQ ID NO: 3530694 - RNA, 14 nt, Human
cuggagaaaaauau

SEQ ID NO: 3530695 - RNA, 19 nt, Human
cuggagaacuagaaccugg

SEQ ID NO: 3530696 - RNA, 22 nt, Human
cuggagaacuagaaccuggagg

SEQ ID NO: 3530697 - RNA, 18 nt, Human
cuggagaagagaggagag

SEQ ID NO: 3530698 - RNA, 19 nt, Human
cuggagaagagaggagagg

SEQ ID NO: 3530699 - RNA, 21 nt, Human
cuggagaagcagugagccgca

SEQ ID NO: 3530700 - RNA, 19 nt, Human
cuggagaagcucacccaau

SEQ ID NO: 3530701 - RNA, 15 nt, Human
cuggagaagcuccca

SEQ ID NO: 3530702 - RNA, 19 nt, Human
cuggagaagcucccaggaa

SEQ ID NO: 3530703 - RNA, 17 nt, Human
cuggagaagcugaugcu

SEQ ID NO: 3530704 - RNA, 20 nt, Human
cuggagacaaugcagaugcc

SEQ ID NO: 3530705 - RNA, 14 nt, Human
cuggagacagcccc

SEQ ID NO: 3530706 - RNA, 15 nt, Human
cuggagaccaccagg

SEQ ID NO: 3530707 - RNA, 17 nt, Human
cuggagacccaccccac

SEQ ID NO: 3530708 - RNA, 19 nt, Human
cuggagacccaccccaccu

SEQ ID NO: 3530709 - RNA, 20 nt, Human
cuggagaccccaccagccuc

SEQ ID NO: 3530710 - RNA, 21 nt, Human
cuggagaccccaccagccuca

SEQ ID NO: 3530711 - RNA, 17 nt, Human
cuggagacuaaccccac

SEQ ID NO: 3530712 - RNA, 16 nt, Human
cuggagagaacagguu

SEQ ID NO: 3530713 - RNA, 12 nt, Human
cuggagagaagu

SEQ ID NO: 3530714 - RNA, 17 nt, Human
cuggagagaaguuucug

SEQ ID NO: 3530715 - RNA, 22 nt, Human
cuggagagccagaaccuggagg

SEQ ID NO: 3530716 - RNA, 23 nt, Human
cuggagagccagaaccuggaggg

SEQ ID NO: 3530717 - RNA, 22 nt, Human
cuggagagcuagaaccuggaga

SEQ ID NO: 3530718 - RNA, 16 nt, Human
cuggagauccuccugc

SEQ ID NO: 3530719 - RNA, 16 nt, Human
cuggagaugaggccag

SEQ ID NO: 3530720 - RNA, 17 nt, Human
cuggagaugaggccaga

SEQ ID NO: 3530721 - RNA, 18 nt, Human
cuggagaugaggccagac

SEQ ID NO: 3530722 - RNA, 18 nt, Human
cuggagauggggagaaac

SEQ ID NO: 3530723 - RNA, 18 nt, Human
cuggagauguuuuagagu

SEQ ID NO: 3530724 - RNA, 16 nt, Human
cuggagcagaagcagc

SEQ ID NO: 3530725 - RNA, 17 nt, Human
cuggagcagaagcagca

SEQ ID NO: 3530726 - RNA, 21 nt, Human
cuggagcaggccuugcgcugu

SEQ ID NO: 3530727 - RNA, 17 nt, Human
cuggagccaacugcugc

SEQ ID NO: 3530728 - RNA, 18 nt, Human
cuggagccaacugcugcu

SEQ ID NO: 3530729 - RNA, 20 nt, Human
cuggagccaacugcugcuuu

SEQ ID NO: 3530730 - RNA, 16 nt, Human
cuggagccaaguccag

SEQ ID NO: 3530731 - RNA, 13 nt, Human
cuggagccaccug

SEQ ID NO: 3530732 - RNA, 18 nt, Human
cuggagccaccuguccca

SEQ ID NO: 3530733 - RNA, 18 nt, Human
cuggagccacuaacuaga

SEQ ID NO: 3530734 - RNA, 16 nt, Human
cuggagccagacucug

SEQ ID NO: 3530735 - RNA, 12 nt, Human
cuggagccagcc

SEQ ID NO: 3530736 - RNA, 15 nt, Human
cuggagcccacugua

SEQ ID NO: 3530737 - RNA, 23 nt, Human
cuggagcccagaggagggcagca

SEQ ID NO: 3530738 - RNA, 15 nt, Human
cuggagcccaggagu

SEQ ID NO: 3530739 - RNA, 13 nt, Human
cuggagccccauc

SEQ ID NO: 3530740 - RNA, 18 nt, Human
cuggagccugagucaggg

SEQ ID NO: 3530741 - RNA, 16 nt, Human
cuggagccuggugccc

SEQ ID NO: 3530742 - RNA, 15 nt, Human
cuggagccuguguaa

SEQ ID NO: 3530743 - RNA, 17 nt, Human
cuggagccuguguaaca

SEQ ID NO: 3530744 - RNA, 18 nt, Human
cuggagccuguguaacag

SEQ ID NO: 3530745 - RNA, 17 nt, Human
cuggagcuagaauuuga

SEQ ID NO: 3530746 - RNA, 20 nt, Human
cuggagcucaucugcaaaag

SEQ ID NO: 3530747 - RNA, 16 nt, Human
cuggagcuccugggaa

SEQ ID NO: 3530748 - RNA, 12 nt, Human
cuggagcucugc

SEQ ID NO: 3530749 - RNA, 11 nt, Human
cuggagcuggc

SEQ ID NO: 3530750 - RNA, 18 nt, Human
cuggaggaacacuugaug

SEQ ID NO: 3530751 - RNA, 14 nt, Human
cuggaggaccugag

SEQ ID NO: 3530752 - RNA, 19 nt, Human
cuggaggaccugagccugc

SEQ ID NO: 3530753 - RNA, 20 nt, Human
cuggaggaccugcccggugg

SEQ ID NO: 3530754 - RNA, 19 nt, Human
cuggaggacuagaaccugg

SEQ ID NO: 3530755 - RNA, 12 nt, Human
cuggaggagccc

SEQ ID NO: 3530756 - RNA, 13 nt, Human
cuggaggagccca

SEQ ID NO: 3530757 - RNA, 18 nt, Human
cuggaggaugugggcagc

SEQ ID NO: 3530758 - RNA, 19 nt, Human
cuggaggaugugggcagcu

SEQ ID NO: 3530759 - RNA, 15 nt, Human
cuggaggcagggaac

SEQ ID NO: 3530760 - RNA, 14 nt, Human
cuggaggcagggcc

SEQ ID NO: 3530761 - RNA, 21 nt, Human
cuggaggcaggggcuuccugg

SEQ ID NO: 3530762 - RNA, 12 nt, Human
cuggaggcccag

SEQ ID NO: 3530763 - RNA, 13 nt, Human
cuggaggcccagg

SEQ ID NO: 3530764 - RNA, 15 nt, Human
cuggaggcccaggcu

SEQ ID NO: 3530765 - RNA, 21 nt, Human
cuggaggcccaguucacccug

SEQ ID NO: 3530766 - RNA, 14 nt, Human
cuggaggccccaac

SEQ ID NO: 3530767 - RNA, 13 nt, Human
cuggaggccccug

SEQ ID NO: 3530768 - RNA, 19 nt, Human
cuggaggccccuggagcca

SEQ ID NO: 3530769 - RNA, 21 nt, Human
cuggaggccgggugcucaggg

SEQ ID NO: 3530770 - RNA, 15 nt, Human
cuggaggccucaggu

SEQ ID NO: 3530771 - RNA, 12 nt, Human
cuggaggccucu

SEQ ID NO: 3530772 - RNA, 14 nt, Human
cuggaggccucugg

SEQ ID NO: 3530773 - RNA, 18 nt, Human
cuggaggccuuccagcug

SEQ ID NO: 3530774 - RNA, 20 nt, Human
cuggaggccuuccagcugcu

SEQ ID NO: 3530775 - RNA, 16 nt, Human
cuggaggcggugcggc

SEQ ID NO: 3530776 - RNA, 17 nt, Human
cuggaggcggugcggca

SEQ ID NO: 3530777 - RNA, 21 nt, Human
cuggaggcugccucccaacag

SEQ ID NO: 3530778 - RNA, 23 nt, Human
cuggagggaaugaaccuggaggg

SEQ ID NO: 3530779 - RNA, 22 nt, Human
cuggcuagaggccagccccacc

SEQ ID NO: 3530780 - RNA, 23 nt, Human
cuggcuagaggccagccccaccc

SEQ ID NO: 3530781 - RNA, 18 nt, Human
cuggcuagaguccucacu

SEQ ID NO: 3530782 - RNA, 22 nt, Human
cuggcuagaguccucacuccca

SEQ ID NO: 3530783 - RNA, 19 nt, Human
cuggcuauagaugucuuuu

SEQ ID NO: 3530784 - RNA, 13 nt, Human
cuggcuaugcauu

SEQ ID NO: 3530785 - RNA, 15 nt, Human
cuggcuaugcauuug

SEQ ID NO: 3530786 - RNA, 18 nt, Human
cuggcucacagacuggag

SEQ ID NO: 3530787 - RNA, 15 nt, Human
cuggcucacaguaca

SEQ ID NO: 3530788 - RNA, 17 nt, Human
cuggcucacaguacagc

SEQ ID NO: 3530789 - RNA, 24 nt, Human
cuggcucacaguacagcaugugcc

SEQ ID NO: 3530790 - RNA, 20 nt, Human
cuggcuccaaacccucgagg

SEQ ID NO: 3530791 - RNA, 14 nt, Human
cuggcuccagaugc

SEQ ID NO: 3530792 - RNA, 20 nt, Human
cuggcuccagaugcagggca

SEQ ID NO: 3530793 - RNA, 14 nt, Human
cuggcuccagccug

SEQ ID NO: 3530794 - RNA, 15 nt, Human
cuggcuccagccugg

SEQ ID NO: 3530795 - RNA, 16 nt, Human
cuggcuccagccugga

SEQ ID NO: 3530796 - RNA, 16 nt, Human
cuggcuccaggccagg

SEQ ID NO: 3530797 - RNA, 17 nt, Human
cuggcucccacaggcag

SEQ ID NO: 3530798 - RNA, 18 nt, Human
cuggcucccacaggcccu

SEQ ID NO: 3530799 - RNA, 15 nt, Human
cuggcuccccaaagg

SEQ ID NO: 3530800 - RNA, 16 nt, Human
cuggcuccccugcagc

SEQ ID NO: 3530801 - RNA, 13 nt, Human
cuggcuccccugg

SEQ ID NO: 3530802 - RNA, 14 nt, Human
cuggcuccccuggg

SEQ ID NO: 3530803 - RNA, 13 nt, Human
cuggcucccucac

SEQ ID NO: 3530804 - RNA, 14 nt, Human
cuggcucccucacu

SEQ ID NO: 3530805 - RNA, 17 nt, Human
cuggcucccuccuccag

SEQ ID NO: 3530806 - RNA, 22 nt, Human
cuggcucccuccuccaggccug

SEQ ID NO: 3530807 - RNA, 20 nt, Human
cuggcuccguccaggagccu

SEQ ID NO: 3530808 - RNA, 18 nt, Human
cuggcuccuugugccaga

SEQ ID NO: 3530809 - RNA, 21 nt, Human
cuggcuccuugugccagagaa

SEQ ID NO: 3530810 - RNA, 15 nt, Human
cuggcuccuuuacaa

SEQ ID NO: 3530811 - RNA, 19 nt, Human
cuggcucuaauucacagug

SEQ ID NO: 3530812 - RNA, 20 nt, Human
cuggcucuaauucacagugc

SEQ ID NO: 3530813 - RNA, 23 nt, Human
cuggcucuaauucacagugcucu

SEQ ID NO: 3530814 - RNA, 13 nt, Human
cuggcucucaccu

SEQ ID NO: 3530815 - RNA, 16 nt, Human
cuggcucucaccucua

SEQ ID NO: 3530816 - RNA, 22 nt, Human
cuggcucucaccucuagguccc

SEQ ID NO: 3530817 - RNA, 19 nt, Human
cuggcucuccaagugccag

SEQ ID NO: 3530818 - RNA, 20 nt, Human
cuggcucucccauuuccuga

SEQ ID NO: 3530819 - RNA, 13 nt, Human
cuggcucucucca

SEQ ID NO: 3530820 - RNA, 14 nt, Human
cuggcucucuccag

SEQ ID NO: 3530821 - RNA, 21 nt, Human
cuggcucugagcgccuccauc

SEQ ID NO: 3530822 - RNA, 14 nt, Human
cuggcucugcuguc

SEQ ID NO: 3530823 - RNA, 15 nt, Human
cuggcucugcugucc

SEQ ID NO: 3530824 - RNA, 12 nt, Human
cuggcucugugg

SEQ ID NO: 3530825 - RNA, 13 nt, Human
cuggcucuuccag

SEQ ID NO: 3530826 - RNA, 15 nt, Human
cuggcucuuccaggc

SEQ ID NO: 3530827 - RNA, 17 nt, Human
cuggcucuuccaggcug

SEQ ID NO: 3530828 - RNA, 18 nt, Human
cuggcucuuccaggcugg

SEQ ID NO: 3530829 - RNA, 19 nt, Human
cuggcucuuccaggcuggg

SEQ ID NO: 3530830 - RNA, 24 nt, Human
cuggcucuuccaggcugggagagc

SEQ ID NO: 3530831 - RNA, 17 nt, Human
cuggcucuugugcugga

SEQ ID NO: 3530832 - RNA, 22 nt, Human
cuggcucuuuggagaucaagga

SEQ ID NO: 3530833 - RNA, 19 nt, Human
cuggcugaacccugugcug

SEQ ID NO: 3530834 - RNA, 23 nt, Human
cuggcugaacccugugcuggugu

SEQ ID NO: 3530835 - RNA, 22 nt, Human
cuggcugaccccaaagagccug

SEQ ID NO: 3530836 - RNA, 22 nt, Human
cuggcugaggauuucaagccug

SEQ ID NO: 3530837 - RNA, 12 nt, Human
cuggcugagggc

SEQ ID NO: 3530838 - RNA, 20 nt, Human
cuggcugagguuccucugcc

SEQ ID NO: 3530839 - RNA, 21 nt, Human
cuggcugagguuccucugccu

SEQ ID NO: 3530840 - RNA, 14 nt, Human
cuggcugcccuggc

SEQ ID NO: 3530841 - RNA, 15 nt, Human
cuggcugcccuggcc

SEQ ID NO: 3530842 - RNA, 16 nt, Human
cuggcugcccuggccc

SEQ ID NO: 3530843 - RNA, 16 nt, Human
cuggcugccuccacuc

SEQ ID NO: 3530844 - RNA, 14 nt, Human
cuggcugccuuaga

SEQ ID NO: 3530845 - RNA, 12 nt, Human
cuggcugcgggg

SEQ ID NO: 3530846 - RNA, 12 nt, Human
cuggcugcugcc

SEQ ID NO: 3530847 - RNA, 13 nt, Human
cuggcugcugccc

SEQ ID NO: 3530848 - RNA, 14 nt, Human
cuggcugcugcccc

SEQ ID NO: 3530849 - RNA, 16 nt, Human
gcccaguccuggccug

SEQ ID NO: 3530850 - RNA, 17 nt, Human
gcccaguccuggccugg

SEQ ID NO: 3530851 - RNA, 21 nt, Human
gcccaguccuggccuggcuuc

SEQ ID NO: 3530852 - RNA, 14 nt, Human
gcccaguccuucca

SEQ ID NO: 3530853 - RNA, 15 nt, Human
gcccaguccuuccac

SEQ ID NO: 3530854 - RNA, 19 nt, Human
gcccaguccuuccaccucg

SEQ ID NO: 3530855 - RNA, 14 nt, Human
gcccagucuguuga

SEQ ID NO: 3530856 - RNA, 15 nt, Human
gcccagucuguugag

SEQ ID NO: 3530857 - RNA, 19 nt, Human
gcccagugcacuugcugga

SEQ ID NO: 3530858 - RNA, 21 nt, Human
gcccagugcaugguggccaga

SEQ ID NO: 3530859 - RNA, 17 nt, Human
gcccaguguuguuugua

SEQ ID NO: 3530860 - RNA, 23 nt, Human
gcccaguguuguuuguaaauaag

SEQ ID NO: 3530861 - RNA, 21 nt, Human
gcccaguuggagacugucugg

SEQ ID NO: 3530862 - RNA, 17 nt, Human
gcccaguuucugccucu

SEQ ID NO: 3530863 - RNA, 20 nt, Human
gcccauacucagccugcugc

SEQ ID NO: 3530864 - RNA, 16 nt, Human
gcccauacugguuggc

SEQ ID NO: 3530865 - RNA, 21 nt, Human
gcccauagaaacaugacacug

SEQ ID NO: 3530866 - RNA, 20 nt, Human
gcccauauuuuacuuggaaa

SEQ ID NO: 3530867 - RNA, 13 nt, Human
gcccaucacaggg

SEQ ID NO: 3530868 - RNA, 21 nt, Human
gcccaucacaggguugggccc

SEQ ID NO: 3530869 - RNA, 12 nt, Human
gcccaucagggu

SEQ ID NO: 3530870 - RNA, 20 nt, Human
gcccaucaguguacccccgc

SEQ ID NO: 3530871 - RNA, 20 nt, Human
gcccauccauaguaacugac

SEQ ID NO: 3530872 - RNA, 18 nt, Human
gcccauccccaggcaccu

SEQ ID NO: 3530873 - RNA, 19 nt, Human
gcccaucccugccugguca

SEQ ID NO: 3530874 - RNA, 18 nt, Human
gcccauccugaccagcug

SEQ ID NO: 3530875 - RNA, 20 nt, Human
gcccaucgugaagaagccug

SEQ ID NO: 3530876 - RNA, 14 nt, Human
gcccaucucaggac

SEQ ID NO: 3530877 - RNA, 13 nt, Human
gcccaucucggag

SEQ ID NO: 3530878 - RNA, 18 nt, Human
gcccaucucggagcaucc

SEQ ID NO: 3530879 - RNA, 18 nt, Human
gcccaucugggaaaauac

SEQ ID NO: 3530880 - RNA, 20 nt, Human
gcccaucuugccuccauggu

SEQ ID NO: 3530881 - RNA, 17 nt, Human
gcccaugagagcgcagc

SEQ ID NO: 3530882 - RNA, 15 nt, Human
gcccaugcccaccug

SEQ ID NO: 3530883 - RNA, 21 nt, Human
gcccauggacaggcuggcucc

SEQ ID NO: 3530884 - RNA, 14 nt, Human
gcccauggcccugu

SEQ ID NO: 3530885 - RNA, 16 nt, Human
gcccaugggagggagc

SEQ ID NO: 3530886 - RNA, 15 nt, Human
gcccaugggcacugc

SEQ ID NO: 3530887 - RNA, 18 nt, Human
gcccaugggcacugcugg

SEQ ID NO: 3530888 - RNA, 23 nt, Human
gcccaugggcacugcuggguggc

SEQ ID NO: 3530889 - RNA, 16 nt, Human
gcccauguauggccag

SEQ ID NO: 3530890 - RNA, 18 nt, Human
gcccauguauggccagga

SEQ ID NO: 3530891 - RNA, 13 nt, Human
gcccaugugugag

SEQ ID NO: 3530892 - RNA, 14 nt, Human
gcccaugugugagu

SEQ ID NO: 3530893 - RNA, 20 nt, Human
gcccaugugugagugugugc

SEQ ID NO: 3530894 - RNA, 20 nt, Human
gcccauguucugcccccagc

SEQ ID NO: 3530895 - RNA, 22 nt, Human
gcccauguucugcccccagccc

SEQ ID NO: 3530896 - RNA, 16 nt, Human
gcccauucauuccauu

SEQ ID NO: 3530897 - RNA, 13 nt, Human
gcccauucuacuu

SEQ ID NO: 3530898 - RNA, 14 nt, Human
gcccauucucucuc

SEQ ID NO: 3530899 - RNA, 19 nt, Human
gcccauuucaauucucaaa

SEQ ID NO: 3530900 - RNA, 22 nt, Human
gcccauuucacaccugaaaaug

SEQ ID NO: 3530901 - RNA, 18 nt, Human
gcccauuucauauucuuu

SEQ ID NO: 3530902 - RNA, 14 nt, Human
gcccauuucuccag

SEQ ID NO: 3530903 - RNA, 16 nt, Human
gcccauuucuccagaa

SEQ ID NO: 3530904 - RNA, 16 nt, Human
gcccauuuggagggcc

SEQ ID NO: 3530905 - RNA, 18 nt, Human
gcccauuugggcagagag

SEQ ID NO: 3530906 - RNA, 20 nt, Human
gcccauuugggcagagaggc

SEQ ID NO: 3530907 - RNA, 16 nt, Human
gccccaaaaccacagc

SEQ ID NO: 3530908 - RNA, 20 nt, Human
gccccaaaaccacagcccug

SEQ ID NO: 3530909 - RNA, 20 nt, Human
gccccaaaacucuccucugc

SEQ ID NO: 3530910 - RNA, 19 nt, Human
gccccaaacaaauaugcaa

SEQ ID NO: 3530911 - RNA, 20 nt, Human
gccccaaacgggcugcccug

SEQ ID NO: 3530912 - RNA, 22 nt, Human
gccccaaauaacuucaguccug

SEQ ID NO: 3530913 - RNA, 22 nt, Human
gccccaaauugucaccugcuuc

SEQ ID NO: 3530914 - RNA, 19 nt, Human
gccccaacccaaaccugga

SEQ ID NO: 3530915 - RNA, 20 nt, Human
gccccaacccaaaccuggag

SEQ ID NO: 3530916 - RNA, 15 nt, Human
gccccaacccgugga

SEQ ID NO: 3530917 - RNA, 19 nt, Human
gccccaacccguggaggcu

SEQ ID NO: 3530918 - RNA, 23 nt, Human
gccccaacccguggaggcugcuc

SEQ ID NO: 3530919 - RNA, 17 nt, Human
gccccaacuccuuccag

SEQ ID NO: 3530920 - RNA, 18 nt, Human
gccccaacuccuuccagc

SEQ ID NO: 3530921 - RNA, 20 nt, Human
gccccaacucgggcucccgg

SEQ ID NO: 3530922 - RNA, 21 nt, Human
gccccaaguccugaagaggcg

SEQ ID NO: 3530923 - RNA, 17 nt, Human
cugggaacucaucuggu

SEQ ID NO: 3530924 - RNA, 20 nt, Human
cugggaagauaggcucugca

SEQ ID NO: 3530925 - RNA, 20 nt, Human
cugggaagcugagggcaaau

SEQ ID NO: 3530926 - RNA, 22 nt, Human
cugggaaggcuacucaccuuga

SEQ ID NO: 3530927 - RNA, 23 nt, Human
cugggaaggcuacuucggggcug

SEQ ID NO: 3530928 - RNA, 18 nt, Human
cugggaauaagugccagg

SEQ ID NO: 3530929 - RNA, 13 nt, Human
cugggaauggagg

SEQ ID NO: 3530930 - RNA, 14 nt, Human
cugggaauguauag

SEQ ID NO: 3530931 - RNA, 20 nt, Human
cugggaauguauaguauuug

SEQ ID NO: 3530932 - RNA, 18 nt, Human
cugggaauguauuauucu

SEQ ID NO: 3530933 - RNA, 23 nt, Human
cugggaauguauuauucugcagc

SEQ ID NO: 3530934 - RNA, 11 nt, Human
cugggacacag

SEQ ID NO: 3530935 - RNA, 13 nt, Human
cugggacacaguu

SEQ ID NO: 3530936 - RNA, 22 nt, Human
cugggacaccauuaccaaaaua

SEQ ID NO: 3530937 - RNA, 19 nt, Human
cugggacacuuaacagaug

SEQ ID NO: 3530938 - RNA, 19 nt, Human
cugggacccuuuccuuccu

SEQ ID NO: 3530939 - RNA, 20 nt, Human
cugggaccgcuacaccacuc

SEQ ID NO: 3530940 - RNA, 15 nt, Human
cugggaccuccccug

SEQ ID NO: 3530941 - RNA, 16 nt, Human
cugggacgcucugcug

SEQ ID NO: 3530942 - RNA, 15 nt, Human
cugggacguggcuca

SEQ ID NO: 3530943 - RNA, 16 nt, Human
cugggacguggcucag

SEQ ID NO: 3530944 - RNA, 20 nt, Human
cugggacguggcucagccag

SEQ ID NO: 3530945 - RNA, 16 nt, Human
cugggacuacaggcac

SEQ ID NO: 3530946 - RNA, 23 nt, Human
cugggacuauaggcaugcgccac

SEQ ID NO: 3530947 - RNA, 13 nt, Human
cugggacucagcc

SEQ ID NO: 3530948 - RNA, 21 nt, Human
cugggacucagccuucagaca

SEQ ID NO: 3530949 - RNA, 13 nt, Human
cugggacugggaa

SEQ ID NO: 3530950 - RNA, 17 nt, Human
cugggacuuccaugccu

SEQ ID NO: 3530951 - RNA, 17 nt, Human
cugggacuuccuugcuc

SEQ ID NO: 3530952 - RNA, 17 nt, Human
cugggagaaaaucauca

SEQ ID NO: 3530953 - RNA, 21 nt, Human
cugggagaaaaucaucaagaa

SEQ ID NO: 3530954 - RNA, 21 nt, Human
cugggagaaaucuggcuucug

SEQ ID NO: 3530955 - RNA, 22 nt, Human
cugggagaaccaaaaagaggcu

SEQ ID NO: 3530956 - RNA, 17 nt, Human
cugggagaaccucaggc

SEQ ID NO: 3530957 - RNA, 12 nt, Human
cugggagacaga

SEQ ID NO: 3530958 - RNA, 19 nt, Human
cugggagagccuuccaggg

SEQ ID NO: 3530959 - RNA, 14 nt, Human
cugggagaggcagc

SEQ ID NO: 3530960 - RNA, 15 nt, Human
cugggagaggcagcc

SEQ ID NO: 3530961 - RNA, 19 nt, Human
cugggagaggcagcccagg

SEQ ID NO: 3530962 - RNA, 18 nt, Human
cugggagaggugccagca

SEQ ID NO: 3530963 - RNA, 20 nt, Human
cugggagaggugccagcaac

SEQ ID NO: 3530964 - RNA, 23 nt, Human
cugggagcuccacucugcuucuc

SEQ ID NO: 3530965 - RNA, 13 nt, Human
cugggaggaagca

SEQ ID NO: 3530966 - RNA, 15 nt, Human
cugggaggaagcagg

SEQ ID NO: 3530967 - RNA, 21 nt, Human
cugggaggaagcagguugagg

SEQ ID NO: 3530968 - RNA, 22 nt, Human
cugggaggaaggacuucccugu

SEQ ID NO: 3530969 - RNA, 19 nt, Human
cugggaggaauggacagac

SEQ ID NO: 3530970 - RNA, 19 nt, Human
cugggaggagggagaggga

SEQ ID NO: 3530971 - RNA, 15 nt, Human
cugggaggcagaggu

SEQ ID NO: 3530972 - RNA, 14 nt, Human
cugggaggcaguga

SEQ ID NO: 3530973 - RNA, 19 nt, Human
cugggaggcauggcccugg

SEQ ID NO: 3530974 - RNA, 16 nt, Human
cugggaggcuccccuu

SEQ ID NO: 3530975 - RNA, 17 nt, Human
cugggaggcuccccuuc

SEQ ID NO: 3530976 - RNA, 17 nt, Human
cugggaggcucuggagc

SEQ ID NO: 3530977 - RNA, 21 nt, Human
cugggaggcucuggagcccac

SEQ ID NO: 3530978 - RNA, 22 nt, Human
cugggaggcucuggagcccacu

SEQ ID NO: 3530979 - RNA, 22 nt, Human
cugggagggacaugcuuagcag

SEQ ID NO: 3530980 - RNA, 23 nt, Human
cugggagggauagaggggggcug

SEQ ID NO: 3530981 - RNA, 11 nt, Human
cugggagggca

SEQ ID NO: 3530982 - RNA, 17 nt, Human
cugggagggcagcaggg

SEQ ID NO: 3530983 - RNA, 23 nt, Human
cugggaguaguugucuuuccugg

SEQ ID NO: 3530984 - RNA, 14 nt, Human
cugggagucacaca

SEQ ID NO: 3530985 - RNA, 17 nt, Human
cugggagucacacagug

SEQ ID NO: 3530986 - RNA, 14 nt, Human
cugggaguccccuu

SEQ ID NO: 3530987 - RNA, 16 nt, Human
cugggagugagcuggu

SEQ ID NO: 3530988 - RNA, 19 nt, Human
cugggaguggguggaggca

SEQ ID NO: 3530989 - RNA, 15 nt, Human
cugggaucacaggug

SEQ ID NO: 3530990 - RNA, 22 nt, Human
cugggaucacaggugucagcca

SEQ ID NO: 3530991 - RNA, 20 nt, Human
cugggaucacauguggacuu

SEQ ID NO: 3530992 - RNA, 13 nt, Human
cugggauccuaag

SEQ ID NO: 3530993 - RNA, 16 nt, Human
cugggaucuggugguc

SEQ ID NO: 3530994 - RNA, 21 nt, Human
cugggaugagccgcugugagc

SEQ ID NO: 3530995 - RNA, 18 nt, Human
cugggaugauuggagggg

SEQ ID NO: 3530996 - RNA, 20 nt, Human
cugggaugggaggagaggac

SEQ ID NO: 3530997 - RNA, 15 nt, Human
cugggaugggccugc

SEQ ID NO: 3530998 - RNA, 17 nt, Human
cugggauggugggcuuc

SEQ ID NO: 3530999 - RNA, 19 nt, Human
cugggauggugggcuucag

SEQ ID NO: 3531000 - RNA, 22 nt, Human
cugggauggugggcuucagggc

SEQ ID NO: 3531001 - RNA, 22 nt, Human
cugggauuacaggcaugugcca

SEQ ID NO: 3531002 - RNA, 21 nt, Human
cugggauuacaggcuccugcc

SEQ ID NO: 3531003 - RNA, 20 nt, Human
cugggauuacaggugugaac

SEQ ID NO: 3531004 - RNA, 23 nt, Human
cugggauuacaggugugagccac

SEQ ID NO: 3531005 - RNA, 23 nt, Human
cugggauucaggaaaaggccugg

SEQ ID NO: 3531006 - RNA, 20 nt, Human
cugggauucccaccaagguc

SEQ ID NO: 3531007 - RNA, 14 nt, Human
cugggauuggcugu

SEQ ID NO: 3531008 - RNA, 17 nt, Human
cugggauuuacacuuga

SEQ ID NO: 3531009 - RNA, 15 nt, Human
cugggcaaagccuag

SEQ ID NO: 3531010 - RNA, 19 nt, Human
cugggcaacagagcaagac

SEQ ID NO: 3531011 - RNA, 19 nt, Human
cugggcaaggaaaaagaaa

SEQ ID NO: 3531012 - RNA, 15 nt, Human
gccauuugcuuuuuc

SEQ ID NO: 3531013 - RNA, 13 nt, Human
gccauuuguccca

SEQ ID NO: 3531014 - RNA, 18 nt, Human
gccauuugucccaagugc

SEQ ID NO: 3531015 - RNA, 16 nt, Human
gccauuuguguuuaua

SEQ ID NO: 3531016 - RNA, 19 nt, Human
gccauuuugugaauggauu

SEQ ID NO: 3531017 - RNA, 13 nt, Human
gcccaaaauuuau

SEQ ID NO: 3531018 - RNA, 23 nt, Human
gcccaaaauuuauuuuauaagaa

SEQ ID NO: 3531019 - RNA, 16 nt, Human
gcccaaaccuuucccc

SEQ ID NO: 3531020 - RNA, 19 nt, Human
gcccaaaccuuucccccau

SEQ ID NO: 3531021 - RNA, 21 nt, Human
gcccaaagagcacaaacauuu

SEQ ID NO: 3531022 - RNA, 16 nt, Human
gcccaaagaugcagcc

SEQ ID NO: 3531023 - RNA, 21 nt, Human
gcccaaaggacgcacugagca

SEQ ID NO: 3531024 - RNA, 19 nt, Human
gcccaaaggggacaggccu

SEQ ID NO: 3531025 - RNA, 14 nt, Human
gcccaaaucugccu

SEQ ID NO: 3531026 - RNA, 17 nt, Human
gcccaaauuaucaagcu

SEQ ID NO: 3531027 - RNA, 21 nt, Human
gcccaaauuaucaagcuaaua

SEQ ID NO: 3531028 - RNA, 10 nt, Human
gcccaaccuc

SEQ ID NO: 3531029 - RNA, 14 nt, Human
gcccaaccuccuga

SEQ ID NO: 3531030 - RNA, 19 nt, Human
gcccaagacagaugcccca

SEQ ID NO: 3531031 - RNA, 15 nt, Human
gcccaagccagaggc

SEQ ID NO: 3531032 - RNA, 18 nt, Human
gcccaagccagaggcugg

SEQ ID NO: 3531033 - RNA, 21 nt, Human
gcccaagccagaggcuggguu

SEQ ID NO: 3531034 - RNA, 23 nt, Human
gcccaagccagaggcuggguuca

SEQ ID NO: 3531035 - RNA, 14 nt, Human
gcccaagcccaggc

SEQ ID NO: 3531036 - RNA, 12 nt, Human
gcccaagcucuu

SEQ ID NO: 3531037 - RNA, 15 nt, Human
gcccaagcuucccuc

SEQ ID NO: 3531038 - RNA, 16 nt, Human
gcccaaggccuucccc

SEQ ID NO: 3531039 - RNA, 15 nt, Human
gcccaaggcggcccc

SEQ ID NO: 3531040 - RNA, 23 nt, Human
gcccaagggaaagaaaaggaagg

SEQ ID NO: 3531041 - RNA, 19 nt, Human
gcccaagggaucugguccu

SEQ ID NO: 3531042 - RNA, 20 nt, Human
gcccaagguuaaaaaguuca

SEQ ID NO: 3531043 - RNA, 15 nt, Human
gcccaaguccaaaug

SEQ ID NO: 3531044 - RNA, 19 nt, Human
gcccaaguucaugcagcug

SEQ ID NO: 3531045 - RNA, 18 nt, Human
gcccaaguuguggugcug

SEQ ID NO: 3531046 - RNA, 21 nt, Human
gcccaaguuguggugcugaca

SEQ ID NO: 3531047 - RNA, 19 nt, Human
gcccaauaugcaguucugc

SEQ ID NO: 3531048 - RNA, 22 nt, Human
gcccaauccagguacgcacaga

SEQ ID NO: 3531049 - RNA, 14 nt, Human
gcccaaugaauaau

SEQ ID NO: 3531050 - RNA, 14 nt, Human
gcccaaugaauuau

SEQ ID NO: 3531051 - RNA, 22 nt, Human
gcccaauucuuacaaacaugug

SEQ ID NO: 3531052 - RNA, 14 nt, Human
gcccaauuggagga

SEQ ID NO: 3531053 - RNA, 15 nt, Human
gcccaauuggaggaa

SEQ ID NO: 3531054 - RNA, 12 nt, Human
gcccacacacag

SEQ ID NO: 3531055 - RNA, 15 nt, Human
gcccacaccuccugg

SEQ ID NO: 3531056 - RNA, 22 nt, Human
gcccacagcacagcucccugcc

SEQ ID NO: 3531057 - RNA, 16 nt, Human
gcccacagcaggugcu

SEQ ID NO: 3531058 - RNA, 22 nt, Human
gcccacagcccgcaugcagcag

SEQ ID NO: 3531059 - RNA, 13 nt, Human
gcccacagcuccc

SEQ ID NO: 3531060 - RNA, 17 nt, Human
gcccacagcucccaccc

SEQ ID NO: 3531061 - RNA, 22 nt, Human
gcccacaggaggcaagcaagcu

SEQ ID NO: 3531062 - RNA, 19 nt, Human
gcccacagggaacccugcu

SEQ ID NO: 3531063 - RNA, 16 nt, Human
gcccacagugucaggc

SEQ ID NO: 3531064 - RNA, 15 nt, Human
gcccacaucccaggc

SEQ ID NO: 3531065 - RNA, 21 nt, Human
gcccacauccggggccagcuc

SEQ ID NO: 3531066 - RNA, 14 nt, Human
gcccccagcuggcc

SEQ ID NO: 3531067 - RNA, 12 nt, Human
gcccccaggacu

SEQ ID NO: 3531068 - RNA, 15 nt, Human
gcccccaggacuggg

SEQ ID NO: 3531069 - RNA, 17 nt, Human
gcccccaggacugggcc

SEQ ID NO: 3531070 - RNA, 18 nt, Human
gcccccaggacugggcca

SEQ ID NO: 3531071 - RNA, 17 nt, Human
gcccccaggcugcugga

SEQ ID NO: 3531072 - RNA, 22 nt, Human
gcccccagggcacuucacagag

SEQ ID NO: 3531073 - RNA, 19 nt, Human
gcccccaggguccugggag

SEQ ID NO: 3531074 - RNA, 15 nt, Human
gcccccaguccccac

SEQ ID NO: 3531075 - RNA, 17 nt, Human
gcccccaguccccaccc

SEQ ID NO: 3531076 - RNA, 17 nt, Human
gcccccaucauccucug

SEQ ID NO: 3531077 - RNA, 18 nt, Human
gcccccaucauccucugg

SEQ ID NO: 3531078 - RNA, 13 nt, Human
gcccccaucucau

SEQ ID NO: 3531079 - RNA, 18 nt, Human
gccccccacacuucccug

SEQ ID NO: 3531080 - RNA, 19 nt, Human
gccccccagccccgguggc

SEQ ID NO: 3531081 - RNA, 16 nt, Human
gccccccagccucugg

SEQ ID NO: 3531082 - RNA, 13 nt, Human
gccccccagcuca

SEQ ID NO: 3531083 - RNA, 18 nt, Human
gccccccauccuggccca

SEQ ID NO: 3531084 - RNA, 20 nt, Human
gccccccauccuggcccauc

SEQ ID NO: 3531085 - RNA, 19 nt, Human
gcccccccaacacugugcc

SEQ ID NO: 3531086 - RNA, 16 nt, Human
gcccccccccaccccu

SEQ ID NO: 3531087 - RNA, 17 nt, Human
gcccccccccaccccug

SEQ ID NO: 3531088 - RNA, 17 nt, Human
gccccccccuccccaug

SEQ ID NO: 3531089 - RNA, 11 nt, Human
gccccccucaa

SEQ ID NO: 3531090 - RNA, 16 nt, Human
gccccccucaaaccuc

SEQ ID NO: 3531091 - RNA, 13 nt, Human
gccccccucccag

SEQ ID NO: 3531092 - RNA, 20 nt, Human
gccccccuccuugcucugca

SEQ ID NO: 3531093 - RNA, 15 nt, Human
gccccccugcccugu

SEQ ID NO: 3531094 - RNA, 12 nt, Human
gccccccuggcc

SEQ ID NO: 3531095 - RNA, 18 nt, Human
gccccccugguccccucc

SEQ ID NO: 3531096 - RNA, 13 nt, Human
gcccccgagcugg

SEQ ID NO: 3531097 - RNA, 22 nt, Human
gcccccgagcugggggccauga

SEQ ID NO: 3531098 - RNA, 11 nt, Human
gcccccgcccc

SEQ ID NO: 3531099 - RNA, 17 nt, Human
gcccccgccuuggccug

SEQ ID NO: 3531100 - RNA, 13 nt, Human
gcccccggcggcg

SEQ ID NO: 3531101 - RNA, 15 nt, Human
gcccccggcggcgcc

SEQ ID NO: 3531102 - RNA, 18 nt, Human
gcccccgggccgacggag

SEQ ID NO: 3531103 - RNA, 19 nt, Human
gcccccgucacgugcgcug

SEQ ID NO: 3531104 - RNA, 23 nt, Human
gcccccucacaguauugcucacc

SEQ ID NO: 3531105 - RNA, 14 nt, Human
gcccccucccugga

SEQ ID NO: 3531106 - RNA, 15 nt, Human
gcccccucccuggau

SEQ ID NO: 3531107 - RNA, 16 nt, Human
gcccccuccucuagcu

SEQ ID NO: 3531108 - RNA, 15 nt, Human
gcccccuccucuccc

SEQ ID NO: 3531109 - RNA, 19 nt, Human
gcccccuccucucccaucc

SEQ ID NO: 3531110 - RNA, 15 nt, Human
gcccccuccugaacc

SEQ ID NO: 3531111 - RNA, 17 nt, Human
gcccccucgugccaguc

SEQ ID NO: 3531112 - RNA, 16 nt, Human
gcccccucugcccugc

SEQ ID NO: 3531113 - RNA, 17 nt, Human
gcccccugaccacucag

SEQ ID NO: 3531114 - RNA, 19 nt, Human
gcccccugaccacucagag

SEQ ID NO: 3531115 - RNA, 11 nt, Human
gcccccugcag

SEQ ID NO: 3531116 - RNA, 15 nt, Human
gcccccugcaggaag

SEQ ID NO: 3531117 - RNA, 18 nt, Human
gcccccugccccccagcc

SEQ ID NO: 3531118 - RNA, 12 nt, Human
gcccccugcccu

SEQ ID NO: 3531119 - RNA, 19 nt, Human
gcccccugcccuccccucu

SEQ ID NO: 3531120 - RNA, 16 nt, Human
gcccccugccugcccu

SEQ ID NO: 3531121 - RNA, 15 nt, Human
gcccccugcugccau

SEQ ID NO: 3531122 - RNA, 15 nt, Human
gcccccuggccucug

SEQ ID NO: 3531123 - RNA, 16 nt, Human
gcccccuggccucugu

SEQ ID NO: 3531124 - RNA, 17 nt, Human
gcccccuggucucuggu

SEQ ID NO: 3531125 - RNA, 23 nt, Human
gcccccugguggacaguccuggg

SEQ ID NO: 3531126 - RNA, 17 nt, Human
gcccccugucucucagg

SEQ ID NO: 3531127 - RNA, 13 nt, Human
gcccccuguggau

SEQ ID NO: 3531128 - RNA, 15 nt, Human
gcccccuucucccac

SEQ ID NO: 3531129 - RNA, 18 nt, Human
gcccccuuucagaugucu

SEQ ID NO: 3531130 - RNA, 23 nt, Human
gcccccuuucagaugucuucugc

SEQ ID NO: 3531131 - RNA, 16 nt, Human
gcccccuuucccgggc

SEQ ID NO: 3531132 - RNA, 20 nt, Human
gcccccuuucccgggcuguc

SEQ ID NO: 3531133 - RNA, 22 nt, Human
gccccgaaaggucaccucacuc

SEQ ID NO: 3531134 - RNA, 17 nt, Human
gccccgacuccagccag

SEQ ID NO: 3531135 - RNA, 20 nt, Human
gccccgacuccagccagcgc

SEQ ID NO: 3531136 - RNA, 22 nt, Human
gccccgaggacccagacccagu

SEQ ID NO: 3531137 - RNA, 20 nt, Human
gccccgcaaaacccacugac

SEQ ID NO: 3531138 - RNA, 15 nt, Human
gccccgcaccuguac

SEQ ID NO: 3531139 - RNA, 22 nt, Human
gccccgcccucuuccugacgaa

SEQ ID NO: 3531140 - RNA, 13 nt, Human
gccccgccgccug

SEQ ID NO: 3531141 - RNA, 18 nt, Human
gccccgcuuggcuucuuc

SEQ ID NO: 3531142 - RNA, 18 nt, Human
gccccggaucagagcagg

SEQ ID NO: 3531143 - RNA, 13 nt, Human
gccccggccaccu

SEQ ID NO: 3531144 - RNA, 15 nt, Human
gccccggccaccucu

SEQ ID NO: 3531145 - RNA, 16 nt, Human
gccccggccaccucug

SEQ ID NO: 3531146 - RNA, 15 nt, Human
gccccggcccugggc

SEQ ID NO: 3531147 - RNA, 17 nt, Human
gccccgggacuuggagg

SEQ ID NO: 3531148 - RNA, 17 nt, Human
gccccgguggcugggca

SEQ ID NO: 3531149 - RNA, 19 nt, Human
gccccgguggcugggcaga

SEQ ID NO: 3531150 - RNA, 17 nt, Human
gccccgucaccaucuca

SEQ ID NO: 3531151 - RNA, 21 nt, Human
gccccgucaccaucucaggcc

SEQ ID NO: 3531152 - RNA, 21 nt, Human
gccccgucccccucuggcucc

SEQ ID NO: 3531153 - RNA, 18 nt, Human
gccccgucuacagcuccc

SEQ ID NO: 3531154 - RNA, 17 nt, Human
gccccgugggguuccuc

SEQ ID NO: 3531155 - RNA, 17 nt, Human
gccccuaaucucuguag

SEQ ID NO: 3531156 - RNA, 15 nt, Human
gccccuacugcugug

SEQ ID NO: 3531157 - RNA, 21 nt, Human
gccccuagaaacccaagcucc

SEQ ID NO: 3531158 - RNA, 17 nt, Human
gccccuagaagggaagg

SEQ ID NO: 3531159 - RNA, 17 nt, Human
gccccuagaaucagccu

SEQ ID NO: 3531160 - RNA, 20 nt, Human
gccccuagaaucagccuagg

SEQ ID NO: 3531161 - RNA, 14 nt, Human
gccccuagcccagg

SEQ ID NO: 3531162 - RNA, 18 nt, Human
gccccuagccgguuccug

SEQ ID NO: 3531163 - RNA, 15 nt, Human
gccccucagagacug

SEQ ID NO: 3531164 - RNA, 16 nt, Human
gccccucagggucccu

SEQ ID NO: 3531165 - RNA, 21 nt, Human
gccccucaucugcucagcagc

SEQ ID NO: 3531166 - RNA, 18 nt, Human
gccccuccagcuugugga

SEQ ID NO: 3531167 - RNA, 18 nt, Human
gccccucccaagcuggcu

SEQ ID NO: 3531168 - RNA, 19 nt, Human
gccccucccaagcuggcug

SEQ ID NO: 3531169 - RNA, 15 nt, Human
gccccucccaccaca

SEQ ID NO: 3531170 - RNA, 21 nt, Human
gccccucccccaacccccacc

SEQ ID NO: 3531171 - RNA, 13 nt, Human
gccccucccccag

SEQ ID NO: 3531172 - RNA, 14 nt, Human
gccccucccccauc

SEQ ID NO: 3531173 - RNA, 16 nt, Human
gccccucccccaucuc

SEQ ID NO: 3531174 - RNA, 13 nt, Human
gccccucccgccc

SEQ ID NO: 3531175 - RNA, 18 nt, Human
gccccucccucccagagc

SEQ ID NO: 3531176 - RNA, 15 nt, Human
gccccucccucucca

SEQ ID NO: 3531177 - RNA, 14 nt, Human
gccccucccuucaa

SEQ ID NO: 3531178 - RNA, 15 nt, Human
gccccuccuccagcc

SEQ ID NO: 3531179 - RNA, 21 nt, Human
gccccuccuccagccccuguc

SEQ ID NO: 3531180 - RNA, 19 nt, Human
gccccuccucucugcccua

SEQ ID NO: 3531181 - RNA, 18 nt, Human
gccccuccucugccaccu

SEQ ID NO: 3531182 - RNA, 13 nt, Human
gccccucucagcc

SEQ ID NO: 3531183 - RNA, 14 nt, Human
gccccucucagccc

SEQ ID NO: 3531184 - RNA, 20 nt, Human
gccccucucagcccucacac

SEQ ID NO: 3531185 - RNA, 21 nt, Human
gccccucucccgccagacugu

SEQ ID NO: 3531186 - RNA, 14 nt, Human
gccccucucuccau

SEQ ID NO: 3531187 - RNA, 12 nt, Human
gccccucucugg

SEQ ID NO: 3531188 - RNA, 15 nt, Human
gccccucugcccagc

SEQ ID NO: 3531189 - RNA, 18 nt, Human
gccccucugcccagcuug

SEQ ID NO: 3531190 - RNA, 21 nt, Human
gccccucugcccagcuugggc

SEQ ID NO: 3531191 - RNA, 14 nt, Human
gccccucuggucgc

SEQ ID NO: 3531192 - RNA, 13 nt, Human
gccccucuugccc

SEQ ID NO: 3531193 - RNA, 16 nt, Human
gccccucuugcccccc

SEQ ID NO: 3531194 - RNA, 15 nt, Human
gccccucuuucucuu

SEQ ID NO: 3531195 - RNA, 17 nt, Human
gccccucuuucucuuuc

SEQ ID NO: 3531196 - RNA, 22 nt, Human
gccccugagcaaugucugugcu

SEQ ID NO: 3531197 - RNA, 23 nt, Human
gccccugagcaaugucugugcua

SEQ ID NO: 3531198 - RNA, 11 nt, Human
gccccugagcc

SEQ ID NO: 3531199 - RNA, 14 nt, Human
gccccugagcccac

SEQ ID NO: 3531200 - RNA, 14 nt, Human
gccccugcacagca

SEQ ID NO: 3531201 - RNA, 17 nt, Human
gccccugcacagcaggc

SEQ ID NO: 3531202 - RNA, 23 nt, Human
gccccugcacagcaggcugccag

SEQ ID NO: 3531203 - RNA, 15 nt, Human
gccccugcacuccag

SEQ ID NO: 3531204 - RNA, 19 nt, Human
gccccugcacuccagccug

SEQ ID NO: 3531205 - RNA, 16 nt, Human
gccccugccacccugg

SEQ ID NO: 3531206 - RNA, 18 nt, Human
gccccugccaccucccug

SEQ ID NO: 3531207 - RNA, 16 nt, Human
gccccugccagacccc

SEQ ID NO: 3531208 - RNA, 14 nt, Human
gccccugccccguc

SEQ ID NO: 3531209 - RNA, 15 nt, Human
gccccugccccguca

SEQ ID NO: 3531210 - RNA, 23 nt, Human
cugguaggaauagcaugucacua

SEQ ID NO: 3531211 - RNA, 15 nt, Human
cugguaggaccaagc

SEQ ID NO: 3531212 - RNA, 17 nt, Human
gcccuacucccugcaga

SEQ ID NO: 3531213 - RNA, 20 nt, Human
gcccuacucccugcagaugc

SEQ ID NO: 3531214 - RNA, 21 nt, Human
gcccuacuucuuugcuuugcc

SEQ ID NO: 3531215 - RNA, 13 nt, Human
gcccuagagccug

SEQ ID NO: 3531216 - RNA, 17 nt, Human
gcccuagagccugccug

SEQ ID NO: 3531217 - RNA, 21 nt, Human
gcccuagcccagcgcucugcc

SEQ ID NO: 3531218 - RNA, 13 nt, Human
gcccuagcuccac

SEQ ID NO: 3531219 - RNA, 11 nt, Human
gcccuaucugu

SEQ ID NO: 3531220 - RNA, 13 nt, Human
gcccuauggaugu

SEQ ID NO: 3531221 - RNA, 15 nt, Human
gcccuaugggccugc

SEQ ID NO: 3531222 - RNA, 16 nt, Human
gcccuaugggccugcc

SEQ ID NO: 3531223 - RNA, 19 nt, Human
gcccuaugggccugccggg

SEQ ID NO: 3531224 - RNA, 21 nt, Human
gcccuauuuagaugauaaaga

SEQ ID NO: 3531225 - RNA, 20 nt, Human
cugguucaggguuggccccu

SEQ ID NO: 3531226 - RNA, 16 nt, Human
cugguuccaggguccc

SEQ ID NO: 3531227 - RNA, 16 nt, Human
cugguuccuaggggaa

SEQ ID NO: 3531228 - RNA, 20 nt, Human
cugguuccuaggggaaugag

SEQ ID NO: 3531229 - RNA, 21 nt, Human
cugguucggauuuggggugga

SEQ ID NO: 3531230 - RNA, 16 nt, Human
cugguucuauuuaaug

SEQ ID NO: 3531231 - RNA, 15 nt, Human
cugguucucaaugaa

SEQ ID NO: 3531232 - RNA, 16 nt, Human
cugguucucaaugaaa

SEQ ID NO: 3531233 - RNA, 14 nt, Human
cugguucucaucuu

SEQ ID NO: 3531234 - RNA, 16 nt, Human
cugguucucaucuuuc

SEQ ID NO: 3531235 - RNA, 19 nt, Human
cugguugaagaagaugauc

SEQ ID NO: 3531236 - RNA, 17 nt, Human
cugguugaugccuguga

SEQ ID NO: 3531237 - RNA, 12 nt, Human
cugguugcaugg

SEQ ID NO: 3531238 - RNA, 13 nt, Human
cugguugcugugu

SEQ ID NO: 3531239 - RNA, 13 nt, Human
cugguugguuuug

SEQ ID NO: 3531240 - RNA, 16 nt, Human
cugguuguuaugugau

SEQ ID NO: 3531241 - RNA, 16 nt, Human
cugguuuacaggcccu

SEQ ID NO: 3531242 - RNA, 13 nt, Human
cugguuuccugcc

SEQ ID NO: 3531243 - RNA, 14 nt, Human
cugguuuccugccc

SEQ ID NO: 3531244 - RNA, 15 nt, Human
cugguuucucauucu

SEQ ID NO: 3531245 - RNA, 17 nt, Human
cugguuuggaaugcuuc

SEQ ID NO: 3531246 - RNA, 22 nt, Human
cugguuuuaaauauuuugacuu

SEQ ID NO: 3531247 - RNA, 17 nt, Human
cugguuuucacauuaga

SEQ ID NO: 3531248 - RNA, 13 nt, Human
cugguuuuguaag

SEQ ID NO: 3531249 - RNA, 19 nt, Human
cugguuuuguaagaugcug

SEQ ID NO: 3531250 - RNA, 20 nt, Human
cugguuuuguaagaugcugg

SEQ ID NO: 3531251 - RNA, 21 nt, Human
cugguuuuguaagaugcuggg

SEQ ID NO: 3531252 - RNA, 15 nt, Human
cugguuuuucaguuu

SEQ ID NO: 3531253 - RNA, 15 nt, Human
cugguuuuuguagcc

SEQ ID NO: 3531254 - RNA, 15 nt, Human
cuguaaaaacugugg

SEQ ID NO: 3531255 - RNA, 21 nt, Human
cuguaaaaagagagaaaacuu

SEQ ID NO: 3531256 - RNA, 15 nt, Human
cuguaaaacagguua

SEQ ID NO: 3531257 - RNA, 14 nt, Human
cuguaaaagaaaaa

SEQ ID NO: 3531258 - RNA, 19 nt, Human
cuguaaaagagccuaguuu

SEQ ID NO: 3531259 - RNA, 23 nt, Human
cuguaaaauauacuuaaauggaa

SEQ ID NO: 3531260 - RNA, 18 nt, Human
cuguaaaaugcaaaaaau

SEQ ID NO: 3531261 - RNA, 15 nt, Human
cuguaaacacucagc

SEQ ID NO: 3531262 - RNA, 19 nt, Human
cuguaaacacucagcuguu

SEQ ID NO: 3531263 - RNA, 22 nt, Human
cuguaaacucaaaacuuaacau

SEQ ID NO: 3531264 - RNA, 13 nt, Human
cuguaaagaaaga

SEQ ID NO: 3531265 - RNA, 14 nt, Human
cuguaaagaaagag

SEQ ID NO: 3531266 - RNA, 22 nt, Human
cuguaaagagaccuaccucagg

SEQ ID NO: 3531267 - RNA, 16 nt, Human
cuguaaagauguuuau

SEQ ID NO: 3531268 - RNA, 18 nt, Human
cuguaaagcuaaaauaaa

SEQ ID NO: 3531269 - RNA, 11 nt, Human
cuguaaaucau

SEQ ID NO: 3531270 - RNA, 14 nt, Human
cuguaaaucuacac

SEQ ID NO: 3531271 - RNA, 17 nt, Human
cuguaaauuauuuuaaa

SEQ ID NO: 3531272 - RNA, 17 nt, Human
cuguaaauuuggcuucu

SEQ ID NO: 3531273 - RNA, 16 nt, Human
cuguaacaagccagau

SEQ ID NO: 3531274 - RNA, 18 nt, Human
cuguaacacaagccacag

SEQ ID NO: 3531275 - RNA, 15 nt, Human
cuguaacacagcuga

SEQ ID NO: 3531276 - RNA, 21 nt, Human
cuguaacacagcugagagacu

SEQ ID NO: 3531277 - RNA, 14 nt, Human
cuguaacaguucuu

SEQ ID NO: 3531278 - RNA, 22 nt, Human
cuguaacaucacuauccaugca

SEQ ID NO: 3531279 - RNA, 15 nt, Human
cuguaacauucagga

SEQ ID NO: 3531280 - RNA, 19 nt, Human
cuguaacuuccaaauaaau

SEQ ID NO: 3531281 - RNA, 23 nt, Human
cuguaacuugauccauuucuaau

SEQ ID NO: 3531282 - RNA, 19 nt, Human
cuguaagaauaauuuauag

SEQ ID NO: 3531283 - RNA, 20 nt, Human
cuguaagaauaauuuauagu

SEQ ID NO: 3531284 - RNA, 15 nt, Human
cuguaagaugucugu

SEQ ID NO: 3531285 - RNA, 14 nt, Human
cuguaagccaaaga

SEQ ID NO: 3531286 - RNA, 21 nt, Human
cuguaagccaaagaaaugaac

SEQ ID NO: 3531287 - RNA, 16 nt, Human
cuguaagccugcaagc

SEQ ID NO: 3531288 - RNA, 13 nt, Human
cuguaaggcucua

SEQ ID NO: 3531289 - RNA, 14 nt, Human
cuguaaggcucuag

SEQ ID NO: 3531290 - RNA, 22 nt, Human
cuguaauaaacucauuucuagc

SEQ ID NO: 3531291 - RNA, 12 nt, Human
cuguaauaaaua

SEQ ID NO: 3531292 - RNA, 15 nt, Human
cuguaauaaauauga

SEQ ID NO: 3531293 - RNA, 17 nt, Human
cuguaauaaauaugagu

SEQ ID NO: 3531294 - RNA, 21 nt, Human
cuguaauaacuagaacaaaua

SEQ ID NO: 3531295 - RNA, 15 nt, Human
cuguaauauuuacaa

SEQ ID NO: 3531296 - RNA, 21 nt, Human
cuguaauauuuacaauguauu

SEQ ID NO: 3531297 - RNA, 22 nt, Human
cuguaauauuuacaauguauua

SEQ ID NO: 3531298 - RNA, 19 nt, Human
cuguaaucauauaauaaau

SEQ ID NO: 3531299 - RNA, 18 nt, Human
cuguaaucccagcaauuu

SEQ ID NO: 3531300 - RNA, 16 nt, Human
cuguaaucccagcacu

SEQ ID NO: 3531301 - RNA, 15 nt, Human
cuguaaucccagcag

SEQ ID NO: 3531302 - RNA, 23 nt, Human
cuguaaucccagcuauuugggag

SEQ ID NO: 3531303 - RNA, 14 nt, Human
cuguaaucuaugaa

SEQ ID NO: 3531304 - RNA, 21 nt, Human
cuguaaugaaccgcugaauau

SEQ ID NO: 3531305 - RNA, 19 nt, Human
cuguaauguuaauauugau

SEQ ID NO: 3531306 - RNA, 16 nt, Human
cuguaauuccuaccuc

SEQ ID NO: 3531307 - RNA, 14 nt, Human
cuguaauugcaaaa

SEQ ID NO: 3531308 - RNA, 16 nt, Human
cuguaauuguguguga

SEQ ID NO: 3531309 - RNA, 18 nt, Human
cuguaauuugugauacaa

SEQ ID NO: 3531310 - RNA, 22 nt, Human
cuguaauuugugauacaaugcu

SEQ ID NO: 3531311 - RNA, 23 nt, Human
cuguacaaaaaaaucuuccaauu

SEQ ID NO: 3531312 - RNA, 11 nt, Human
cuguacaauaa

SEQ ID NO: 3531313 - RNA, 14 nt, Human
cuguacaauauuua

SEQ ID NO: 3531314 - RNA, 17 nt, Human
cuguacaauauuuaaaa

SEQ ID NO: 3531315 - RNA, 15 nt, Human
cuguacaaugacuuu

SEQ ID NO: 3531316 - RNA, 16 nt, Human
cuguacacguguccug

SEQ ID NO: 3531317 - RNA, 17 nt, Human
cuguacacguguccugu

SEQ ID NO: 3531318 - RNA, 17 nt, Human
cuguacacugacuugag

SEQ ID NO: 3531319 - RNA, 21 nt, Human
cuguacacugacuugagacca

SEQ ID NO: 3531320 - RNA, 18 nt, Human
cuguacagagcccacgcc

SEQ ID NO: 3531321 - RNA, 18 nt, Human
cuguacagcuggcucuac

SEQ ID NO: 3531322 - RNA, 14 nt, Human
cuguacagucuguc

SEQ ID NO: 3531323 - RNA, 15 nt, Human
cuguacagucugucu

SEQ ID NO: 3531324 - RNA, 17 nt, Human
cuguacagucugucuuc

SEQ ID NO: 3531325 - RNA, 23 nt, Human
cuguacagucugucuucuguaua

SEQ ID NO: 3531326 - RNA, 14 nt, Human
cuguacagugucuu

SEQ ID NO: 3531327 - RNA, 15 nt, Human
cuguacauauguaaa

SEQ ID NO: 3531328 - RNA, 20 nt, Human
cuguacauauuugagacuag

SEQ ID NO: 3531329 - RNA, 14 nt, Human
cuguacaucuauuu

SEQ ID NO: 3531330 - RNA, 20 nt, Human
cuguacaugaaaacacauuu

SEQ ID NO: 3531331 - RNA, 21 nt, Human
cuguacaugaaaacacauuuu

SEQ ID NO: 3531332 - RNA, 16 nt, Human
cuguaccaguuaauuu

SEQ ID NO: 3531333 - RNA, 17 nt, Human
cuguaccaguuaauuuu

SEQ ID NO: 3531334 - RNA, 23 nt, Human
cuguaccaugugcuacaggggcc

SEQ ID NO: 3531335 - RNA, 15 nt, Human
cuguaccucauccca

SEQ ID NO: 3531336 - RNA, 22 nt, Human
cuguaccucuugagccuugaac

SEQ ID NO: 3531337 - RNA, 14 nt, Human
cuguaccugagagg

SEQ ID NO: 3531338 - RNA, 20 nt, Human
cuguaccuuuugaggagccc

SEQ ID NO: 3531339 - RNA, 16 nt, Human
cuguacgucugacagg

SEQ ID NO: 3531340 - RNA, 18 nt, Human
cuguacgucugacaggca

SEQ ID NO: 3531341 - RNA, 17 nt, Human
cuguacuaauucuuaca

SEQ ID NO: 3531342 - RNA, 13 nt, Human
cuguacuagagau

SEQ ID NO: 3531343 - RNA, 22 nt, Human
cuguacuagucugugugggacu

SEQ ID NO: 3531344 - RNA, 15 nt, Human
cuguacucuuagaug

SEQ ID NO: 3531345 - RNA, 19 nt, Human
cuguacugaaguaaaacaa

SEQ ID NO: 3531346 - RNA, 12 nt, Human
cuguacugccug

SEQ ID NO: 3531347 - RNA, 18 nt, Human
cuguacugccugcuuggg

SEQ ID NO: 3531348 - RNA, 16 nt, Human
cuguacugcucaggcu

SEQ ID NO: 3531349 - RNA, 21 nt, Human
cuguacugcucaggcugcagc

SEQ ID NO: 3531350 - RNA, 16 nt, Human
cuguacugggccaugu

SEQ ID NO: 3531351 - RNA, 17 nt, Human
cuguacuguucuguguc

SEQ ID NO: 3531352 - RNA, 15 nt, Human
cuguacuucaaguua

SEQ ID NO: 3531353 - RNA, 22 nt, Human
cuguacuugaagucuaaaagca

SEQ ID NO: 3531354 - RNA, 17 nt, Human
cuguacuugaugacaga

SEQ ID NO: 3531355 - RNA, 16 nt, Human
cuguacuugcucuuga

SEQ ID NO: 3531356 - RNA, 14 nt, Human
cuguacuuggucca

SEQ ID NO: 3531357 - RNA, 11 nt, Human
gccuguacagu

SEQ ID NO: 3531358 - RNA, 15 nt, Human
gccuguacagucugu

SEQ ID NO: 3531359 - RNA, 20 nt, Human
gccuguacagucugucuucu

SEQ ID NO: 3531360 - RNA, 19 nt, Human
gccuguacucgcuugugca

SEQ ID NO: 3531361 - RNA, 20 nt, Human
gccuguacucgcuugugcag

SEQ ID NO: 3531362 - RNA, 13 nt, Human
gccuguacugccu

SEQ ID NO: 3531363 - RNA, 15 nt, Human
gccuguacugccugc

SEQ ID NO: 3531364 - RNA, 19 nt, Human
gccuguacugccugcuugg

SEQ ID NO: 3531365 - RNA, 20 nt, Human
gccuguacugccugcuuggg

SEQ ID NO: 3531366 - RNA, 13 nt, Human
gccuguagaguug

SEQ ID NO: 3531367 - RNA, 16 nt, Human
gccuguagaguugcug

SEQ ID NO: 3531368 - RNA, 19 nt, Human
gccuguagaguugcugaga

SEQ ID NO: 3531369 - RNA, 19 nt, Human
gccuguagcccacucugcu

SEQ ID NO: 3531370 - RNA, 22 nt, Human
gccuguagcccacucugcucgc

SEQ ID NO: 3531371 - RNA, 18 nt, Human
gccuguaguuaggaaaua

SEQ ID NO: 3531372 - RNA, 19 nt, Human
gccuguaguuaggaaauaa

SEQ ID NO: 3531373 - RNA, 23 nt, Human
gccuguaguuaggaaauaaaacc

SEQ ID NO: 3531374 - RNA, 19 nt, Human
gccugucagauccaggagc

SEQ ID NO: 3531375 - RNA, 22 nt, Human
gccugucagauccaggagcucc

SEQ ID NO: 3531376 - RNA, 20 nt, Human
gccuguccacaggcuucuga

SEQ ID NO: 3531377 - RNA, 18 nt, Human
gccugucccucucaggca

SEQ ID NO: 3531378 - RNA, 20 nt, Human
gccuguccugaccugucuca

SEQ ID NO: 3531379 - RNA, 15 nt, Human
gccuguccugccugu

SEQ ID NO: 3531380 - RNA, 12 nt, Human
gccugucucaag

SEQ ID NO: 3531381 - RNA, 22 nt, Human
gccugucucauccccagggguc

SEQ ID NO: 3531382 - RNA, 21 nt, Human
gccugucuccuuugcaggcuc

SEQ ID NO: 3531383 - RNA, 20 nt, Human
gccugucucggaaccuguga

SEQ ID NO: 3531384 - RNA, 14 nt, Human
gccugucucuucca

SEQ ID NO: 3531385 - RNA, 15 nt, Human
gccugucugagacuc

SEQ ID NO: 3531386 - RNA, 13 nt, Human
gccugucugcccc

SEQ ID NO: 3531387 - RNA, 15 nt, Human
gccugucugugaccu

SEQ ID NO: 3531388 - RNA, 15 nt, Human
gccugugagccaguc

SEQ ID NO: 3531389 - RNA, 18 nt, Human
gccugugaggcaggggcg

SEQ ID NO: 3531390 - RNA, 17 nt, Human
gccugugaggugcagag

SEQ ID NO: 3531391 - RNA, 23 nt, Human
gccugugcacacacacacacaug

SEQ ID NO: 3531392 - RNA, 17 nt, Human
gccuguggagcucagcc

SEQ ID NO: 3531393 - RNA, 19 nt, Human
gccuguggagcucagcccc

SEQ ID NO: 3531394 - RNA, 15 nt, Human
gccuguggcccuguc

SEQ ID NO: 3531395 - RNA, 18 nt, Human
gccuguggccuguguccc

SEQ ID NO: 3531396 - RNA, 21 nt, Human
gccuguggcgccgucuccagg

SEQ ID NO: 3531397 - RNA, 18 nt, Human
gccuguggcggugccugg

SEQ ID NO: 3531398 - RNA, 12 nt, Human
gccuguggcugc

SEQ ID NO: 3531399 - RNA, 15 nt, Human
gccuguggcugucgg

SEQ ID NO: 3531400 - RNA, 17 nt, Human
gccuguggcuguggaga

SEQ ID NO: 3531401 - RNA, 12 nt, Human
gccugugguucu

SEQ ID NO: 3531402 - RNA, 14 nt, Human
gccuguguaacagc

SEQ ID NO: 3531403 - RNA, 18 nt, Human
gccuguguaacagcuccu

SEQ ID NO: 3531404 - RNA, 23 nt, Human
gccuguguaacagcuccuuggga

SEQ ID NO: 3531405 - RNA, 21 nt, Human
gccuguguccaugcgcucagg

SEQ ID NO: 3531406 - RNA, 23 nt, Human
gccuguguccaugcgcucagggc

SEQ ID NO: 3531407 - RNA, 15 nt, Human
gccugugucccauga

SEQ ID NO: 3531408 - RNA, 20 nt, Human
gccugugucccaugacccac

SEQ ID NO: 3531409 - RNA, 21 nt, Human
gccugugugacaucaguggca

SEQ ID NO: 3531410 - RNA, 19 nt, Human
gccuguuauaacucugcac

SEQ ID NO: 3531411 - RNA, 15 nt, Human
gccuguucagcucca

SEQ ID NO: 3531412 - RNA, 16 nt, Human
gccuguucagcuccag

SEQ ID NO: 3531413 - RNA, 20 nt, Human
gccuguucagcuccagcuca

SEQ ID NO: 3531414 - RNA, 13 nt, Human
gccuguucaguua

SEQ ID NO: 3531415 - RNA, 20 nt, Human
gccuguucaguuacagaaag

SEQ ID NO: 3531416 - RNA, 21 nt, Human
gccuguucaguuacagaaagu

SEQ ID NO: 3531417 - RNA, 16 nt, Human
gccuguucauggcaga

SEQ ID NO: 3531418 - RNA, 22 nt, Human
gccuguuccccucacuggauga

SEQ ID NO: 3531419 - RNA, 19 nt, Human
gccuguuggacccgcucug

SEQ ID NO: 3531420 - RNA, 14 nt, Human
gccuguugggccag

SEQ ID NO: 3531421 - RNA, 14 nt, Human
gccuguuuggccuc

SEQ ID NO: 3531422 - RNA, 16 nt, Human
gccuguuuggccucuc

SEQ ID NO: 3531423 - RNA, 16 nt, Human
gccuuaaaacaucauu

SEQ ID NO: 3531424 - RNA, 19 nt, Human
gccuuaaaacaucauuccu

SEQ ID NO: 3531425 - RNA, 19 nt, Human
gccuuaaaagccaucaugu

SEQ ID NO: 3531426 - RNA, 16 nt, Human
gccuuaaagaaagucg

SEQ ID NO: 3531427 - RNA, 14 nt, Human
gccuuaagcugcag

SEQ ID NO: 3531428 - RNA, 20 nt, Human
gccuuaagugaggaaaucaa

SEQ ID NO: 3531429 - RNA, 15 nt, Human
gccuuaauacuuuuu

SEQ ID NO: 3531430 - RNA, 15 nt, Human
gccuuacacaauggu

SEQ ID NO: 3531431 - RNA, 22 nt, Human
gccuagcauacguacacauuuu

SEQ ID NO: 3531432 - RNA, 18 nt, Human
gccuagcccacccugcug

SEQ ID NO: 3531433 - RNA, 15 nt, Human
gccuagccgaccuca

SEQ ID NO: 3531434 - RNA, 20 nt, Human
gccuagccgaccucagccuu

SEQ ID NO: 3531435 - RNA, 17 nt, Human
gccuagcgaucucuccu

SEQ ID NO: 3531436 - RNA, 21 nt, Human
gccuagcgaucucuccuggcc

SEQ ID NO: 3531437 - RNA, 22 nt, Human
gccuagcgaucucuccuggccu

SEQ ID NO: 3531438 - RNA, 18 nt, Human
gccuaggaccacucagcc

SEQ ID NO: 3531439 - RNA, 19 nt, Human
gccuaggaccacucagccc

SEQ ID NO: 3531440 - RNA, 20 nt, Human
gccuaggaccacucagcccc

SEQ ID NO: 3531441 - RNA, 21 nt, Human
gccuaggaccacucagccccu

SEQ ID NO: 3531442 - RNA, 20 nt, Human
gccuaggagauaucugaggg

SEQ ID NO: 3531443 - RNA, 15 nt, Human
gccuaggaggguccu

SEQ ID NO: 3531444 - RNA, 13 nt, Human
gccuaggauucua

SEQ ID NO: 3531445 - RNA, 16 nt, Human
gccuaggccaggugca

SEQ ID NO: 3531446 - RNA, 17 nt, Human
gccuaggccucagccag

SEQ ID NO: 3531447 - RNA, 19 nt, Human
gccuaggccugggcagugg

SEQ ID NO: 3531448 - RNA, 12 nt, Human
gccuaggcugca

SEQ ID NO: 3531449 - RNA, 16 nt, Human
gccuaguauugacaaa

SEQ ID NO: 3531450 - RNA, 23 nt, Human
gccuagugaaggcuucucucugu

SEQ ID NO: 3531451 - RNA, 18 nt, Human
gccuaguggggucucccu

SEQ ID NO: 3531452 - RNA, 15 nt, Human
gccuaguuuuuagua

SEQ ID NO: 3531453 - RNA, 19 nt, Human
gccuauaagccaaaauuaa

SEQ ID NO: 3531454 - RNA, 22 nt, Human
gccuauauuuuuuguuaaauga

SEQ ID NO: 3531455 - RNA, 18 nt, Human
gccuaucagugugccccc

SEQ ID NO: 3531456 - RNA, 16 nt, Human
gccuauccuaagagcu

SEQ ID NO: 3531457 - RNA, 21 nt, Human
gccuaugagcauccugagccc

SEQ ID NO: 3531458 - RNA, 15 nt, Human
gccuaugaucccagc

SEQ ID NO: 3531459 - RNA, 14 nt, Human
gccuaugcacauau

SEQ ID NO: 3531460 - RNA, 23 nt, Human
gccuaugcacauauggacucugc

SEQ ID NO: 3531461 - RNA, 14 nt, Human
gccuauggagagcc

SEQ ID NO: 3531462 - RNA, 20 nt, Human
gccuauggagagcccuggga

SEQ ID NO: 3531463 - RNA, 16 nt, Human
gccuauggcagaaaaa

SEQ ID NO: 3531464 - RNA, 18 nt, Human
gccuauguggucuaaggu

SEQ ID NO: 3531465 - RNA, 15 nt, Human
gccuauucccacacc

SEQ ID NO: 3531466 - RNA, 18 nt, Human
gccuauugcuagagcucc

SEQ ID NO: 3531467 - RNA, 19 nt, Human
gccuauugcuagagcuccu

SEQ ID NO: 3531468 - RNA, 13 nt, Human
gccuauuguaaua

SEQ ID NO: 3531469 - RNA, 17 nt, Human
gccuauuuaccugcagg

SEQ ID NO: 3531470 - RNA, 20 nt, Human
gccuauuuaccugcaggcug

SEQ ID NO: 3531471 - RNA, 12 nt, Human
gccucaaaaugu

SEQ ID NO: 3531472 - RNA, 14 nt, Human
gccucaaaaugugu

SEQ ID NO: 3531473 - RNA, 22 nt, Human
gccucaaagcaagcauucagaa

SEQ ID NO: 3531474 - RNA, 15 nt, Human
gccucaaauccagga

SEQ ID NO: 3531475 - RNA, 16 nt, Human
gccucaaauccaggac

SEQ ID NO: 3531476 - RNA, 22 nt, Human
gccucaaauccaggacccugcc

SEQ ID NO: 3531477 - RNA, 13 nt, Human
gccucaaaugcag

SEQ ID NO: 3531478 - RNA, 14 nt, Human
gccucaacccuccc

SEQ ID NO: 3531479 - RNA, 18 nt, Human
gccucaacccucccucag

SEQ ID NO: 3531480 - RNA, 16 nt, Human
gccucaaccuccuggg

SEQ ID NO: 3531481 - RNA, 20 nt, Human
gccucaagguuuuagguucu

SEQ ID NO: 3531482 - RNA, 16 nt, Human
gccucaagucacuccc

SEQ ID NO: 3531483 - RNA, 19 nt, Human
gccucaagugauucuccug

SEQ ID NO: 3531484 - RNA, 20 nt, Human
gccucaagugauucuccugc

SEQ ID NO: 3531485 - RNA, 21 nt, Human
gccucaaugugguugcaaggc

SEQ ID NO: 3531486 - RNA, 22 nt, Human
gccucaauuucugaacaccaua

SEQ ID NO: 3531487 - RNA, 19 nt, Human
gccucacagcagugagacu

SEQ ID NO: 3531488 - RNA, 18 nt, Human
gccucacaguccuuacca

SEQ ID NO: 3531489 - RNA, 19 nt, Human
gccucacauuuuuuucuac

SEQ ID NO: 3531490 - RNA, 21 nt, Human
gccucaccaugugagcucuuc

SEQ ID NO: 3531491 - RNA, 17 nt, Human
gccucacccaccccugc

SEQ ID NO: 3531492 - RNA, 18 nt, Human
gccucacccaccccugca

SEQ ID NO: 3531493 - RNA, 20 nt, Human
gccucacccaccccugcaca

SEQ ID NO: 3531494 - RNA, 16 nt, Human
gccucacccccucggg

SEQ ID NO: 3531495 - RNA, 22 nt, Human
gccucacccccucgggucuccu

SEQ ID NO: 3531496 - RNA, 14 nt, Human
gccucacccuugcg

SEQ ID NO: 3531497 - RNA, 22 nt, Human
gccucaccuuggggcuugacuu

SEQ ID NO: 3531498 - RNA, 19 nt, Human
gccucacuaauuuuuguau

SEQ ID NO: 3531499 - RNA, 20 nt, Human
gccucacugaaacauggcug

SEQ ID NO: 3531500 - RNA, 13 nt, Human
gccucacuggggc

SEQ ID NO: 3531501 - RNA, 19 nt, Human
cuguggagacaaugucugc

SEQ ID NO: 3531502 - RNA, 23 nt, Human
cuguggagacugcuccugagccc

SEQ ID NO: 3531503 - RNA, 14 nt, Human
cuguggagacuggg

SEQ ID NO: 3531504 - RNA, 15 nt, Human
cuguggagcccgcac

SEQ ID NO: 3531505 - RNA, 23 nt, Human
cuguggagcccgcacccccaccc

SEQ ID NO: 3531506 - RNA, 16 nt, Human
cuguggagcucagccc

SEQ ID NO: 3531507 - RNA, 14 nt, Human
cuguggaggaagga

SEQ ID NO: 3531508 - RNA, 22 nt, Human
cuguggaggaaggauuguaaaa

SEQ ID NO: 3531509 - RNA, 22 nt, Human
cuguggagguacacucuuauag

SEQ ID NO: 3531510 - RNA, 16 nt, Human
cuguggaugccagggc

SEQ ID NO: 3531511 - RNA, 21 nt, Human
cuguggaugcugcugccccug

SEQ ID NO: 3531512 - RNA, 22 nt, Human
cuguggaugcugcugccccugc

SEQ ID NO: 3531513 - RNA, 20 nt, Human
cuguggcacuugccuggguc

SEQ ID NO: 3531514 - RNA, 21 nt, Human
cuguggcacuugccuggguca

SEQ ID NO: 3531515 - RNA, 18 nt, Human
cuguggcagaguuacagu

SEQ ID NO: 3531516 - RNA, 21 nt, Human
cuguggcaggcagcgccaagc

SEQ ID NO: 3531517 - RNA, 19 nt, Human
cuguggcaggccagcugug

SEQ ID NO: 3531518 - RNA, 21 nt, Human
cuguggcaguaaagagaaacu

SEQ ID NO: 3531519 - RNA, 17 nt, Human
cuguggcaucuuugccu

SEQ ID NO: 3531520 - RNA, 18 nt, Human
cuguggcaugggugaaga

SEQ ID NO: 3531521 - RNA, 23 nt, Human
cuguggccagcuuguuauuuaua

SEQ ID NO: 3531522 - RNA, 12 nt, Human
cuguggccagga

SEQ ID NO: 3531523 - RNA, 13 nt, Human
cuguggccaggag

SEQ ID NO: 3531524 - RNA, 20 nt, Human
cuguggccaugacccugccu

SEQ ID NO: 3531525 - RNA, 23 nt, Human
cuguggccaugguccccaagacc

SEQ ID NO: 3531526 - RNA, 16 nt, Human
cuguggcccuggcucu

SEQ ID NO: 3531527 - RNA, 13 nt, Human
cuguggcccuguc

SEQ ID NO: 3531528 - RNA, 11 nt, Human
cuguggccugg

SEQ ID NO: 3531529 - RNA, 14 nt, Human
cuguggccugggca

SEQ ID NO: 3531530 - RNA, 16 nt, Human
cuguggccugggcaag

SEQ ID NO: 3531531 - RNA, 14 nt, Human
cuguggccuguguc

SEQ ID NO: 3531532 - RNA, 17 nt, Human
cuguggcgccgucucca

SEQ ID NO: 3531533 - RNA, 24 nt, Human
cuguggcgccgucuccaggggcug

SEQ ID NO: 3531534 - RNA, 18 nt, Human
cuguggcuccaggccaaa

SEQ ID NO: 3531535 - RNA, 22 nt, Human
cuguggcuucuuaaucuuuuca

SEQ ID NO: 3531536 - RNA, 24 nt, Human
cugugggaaaugguacuguacagc

SEQ ID NO: 3531537 - RNA, 23 nt, Human
cugugggaacgagaggggaagag

SEQ ID NO: 3531538 - RNA, 15 nt, Human
cugugggaaggccag

SEQ ID NO: 3531539 - RNA, 18 nt, Human
cugugggaaggccagcug

SEQ ID NO: 3531540 - RNA, 14 nt, Human
cugugggaccccag

SEQ ID NO: 3531541 - RNA, 19 nt, Human
cugugggaccccaggccca

SEQ ID NO: 3531542 - RNA, 13 nt, Human
cugugggagccuc

SEQ ID NO: 3531543 - RNA, 16 nt, Human
cugugggagccucgca

SEQ ID NO: 3531544 - RNA, 20 nt, Human
cugugggcaggugggagcuu

SEQ ID NO: 3531545 - RNA, 14 nt, Human
cugugggcccccaa

SEQ ID NO: 3531546 - RNA, 14 nt, Human
cugugggccucaag

SEQ ID NO: 3531547 - RNA, 20 nt, Human
cugugggccucaaggacuug

SEQ ID NO: 3531548 - RNA, 16 nt, Human
cugugggcgggcccag

SEQ ID NO: 3531549 - RNA, 18 nt, Human
cugugggcgggcccagca

SEQ ID NO: 3531550 - RNA, 13 nt, Human
cuguggggacucc

SEQ ID NO: 3531551 - RNA, 19 nt, Human
cuguggggacuccggcugu

SEQ ID NO: 3531552 - RNA, 16 nt, Human
cuguggggaucucagg

SEQ ID NO: 3531553 - RNA, 18 nt, Human
cuguggggauuucuccca

SEQ ID NO: 3531554 - RNA, 16 nt, Human
cuguggggcccccaca

SEQ ID NO: 3531555 - RNA, 14 nt, Human
cuguggggcuggua

SEQ ID NO: 3531556 - RNA, 21 nt, Human
cuguggggcugguagcucagg

SEQ ID NO: 3531557 - RNA, 23 nt, Human
cugugggggaagagcacagcccu

SEQ ID NO: 3531558 - RNA, 24 nt, Human
cugugggggugagggucccaugug

SEQ ID NO: 3531559 - RNA, 20 nt, Human
cugugggggugugcccccuu

SEQ ID NO: 3531560 - RNA, 22 nt, Human
cuguggggucaacccuucugga

SEQ ID NO: 3531561 - RNA, 19 nt, Human
cuguggguccgauaauauc

SEQ ID NO: 3531562 - RNA, 22 nt, Human
cugugggugaagacagagggaa

SEQ ID NO: 3531563 - RNA, 16 nt, Human
cugugggugaugggga

SEQ ID NO: 3531564 - RNA, 21 nt, Human
cuguggguuucuaaagcugcc

SEQ ID NO: 3531565 - RNA, 22 nt, Human
cuguggguuuguggggggaggc

SEQ ID NO: 3531566 - RNA, 17 nt, Human
cugugguaaaugccaca

SEQ ID NO: 3531567 - RNA, 16 nt, Human
cuguggucacagcgga

SEQ ID NO: 3531568 - RNA, 22 nt, Human
cuguggucuucaaauugucuuu

SEQ ID NO: 3531569 - RNA, 14 nt, Human
cuguggugacuuug

SEQ ID NO: 3531570 - RNA, 18 nt, Human
cuguggugacuuuggaua

SEQ ID NO: 3531571 - RNA, 23 nt, Human
cuguggugcaaaagcagaaaaua

SEQ ID NO: 3531572 - RNA, 13 nt, Human
cuguggugucugc

SEQ ID NO: 3531573 - RNA, 14 nt, Human
cugugguguguccc

SEQ ID NO: 3531574 - RNA, 21 nt, Human
cugugguuguuuuagcuccuu

SEQ ID NO: 3531575 - RNA, 16 nt, Human
cugugguuucauguua

SEQ ID NO: 3531576 - RNA, 17 nt, Human
cugugguuucauguuag

SEQ ID NO: 3531577 - RNA, 16 nt, Human
cugugguuuuccccuc

SEQ ID NO: 3531578 - RNA, 19 nt, Human
cugugguuuuccccucccu

SEQ ID NO: 3531579 - RNA, 22 nt, Human
cugugguuuucuuuugccauga

SEQ ID NO: 3531580 - RNA, 19 nt, Human
cuguguaaaauguaaugca

SEQ ID NO: 3531581 - RNA, 12 nt, Human
cuguguaaaguu

SEQ ID NO: 3531582 - RNA, 15 nt, Human
cuguguaaaguuagu

SEQ ID NO: 3531583 - RNA, 15 nt, Human
cuguguaacacuguu

SEQ ID NO: 3531584 - RNA, 15 nt, Human
cuguguaacagcucc

SEQ ID NO: 3531585 - RNA, 16 nt, Human
cuguguaaccauuuua

SEQ ID NO: 3531586 - RNA, 11 nt, Human
cuguguaacug

SEQ ID NO: 3531587 - RNA, 18 nt, Human
cuguguaagauuuguuuu

SEQ ID NO: 3531588 - RNA, 15 nt, Human
cuguguacaaagaaa

SEQ ID NO: 3531589 - RNA, 20 nt, Human
gccuuacacaaugguuuucu

SEQ ID NO: 3531590 - RNA, 14 nt, Human
gccuuaccccugcc

SEQ ID NO: 3531591 - RNA, 18 nt, Human
gccuuacccucauguucu

SEQ ID NO: 3531592 - RNA, 19 nt, Human
gccuuacccucauguucuu

SEQ ID NO: 3531593 - RNA, 16 nt, Human
gccuuaccuccugccc

SEQ ID NO: 3531594 - RNA, 17 nt, Human
gccuuaccuccugccca

SEQ ID NO: 3531595 - RNA, 18 nt, Human
gccuuaccuccugcccag

SEQ ID NO: 3531596 - RNA, 20 nt, Human
gccuuacuuuguaugauauu

SEQ ID NO: 3531597 - RNA, 20 nt, Human
gccuuagaaauguaaacugc

SEQ ID NO: 3531598 - RNA, 23 nt, Human
gccuuagaaauguaaacugccau

SEQ ID NO: 3531599 - RNA, 18 nt, Human
gccuuagaagucacacag

SEQ ID NO: 3531600 - RNA, 17 nt, Human
gccuuagagccaggcac

SEQ ID NO: 3531601 - RNA, 14 nt, Human
gccuuagcauguuu

SEQ ID NO: 3531602 - RNA, 18 nt, Human
gccuuagcauguuugcug

SEQ ID NO: 3531603 - RNA, 20 nt, Human
gccuuagcauguuugcugaa

SEQ ID NO: 3531604 - RNA, 21 nt, Human
gccuuagccgcccaugcacug

SEQ ID NO: 3531605 - RNA, 12 nt, Human
gccuuagcuuca

SEQ ID NO: 3531606 - RNA, 15 nt, Human
gccuuaggccuaccu

SEQ ID NO: 3531607 - RNA, 15 nt, Human
gccuuagucucaguu

SEQ ID NO: 3531608 - RNA, 19 nt, Human
gccuuagugggccagggcu

SEQ ID NO: 3531609 - RNA, 19 nt, Human
gccuuaucaagugucuucc

SEQ ID NO: 3531610 - RNA, 10 nt, Human
gccuuaugga

SEQ ID NO: 3531611 - RNA, 22 nt, Human
gccuuauggaacacucugagac

SEQ ID NO: 3531612 - RNA, 16 nt, Human
gccuuauguugaaaaa

SEQ ID NO: 3531613 - RNA, 17 nt, Human
gccuuauguugaaaaaa

SEQ ID NO: 3531614 - RNA, 16 nt, Human
gccuuauucagggaag

SEQ ID NO: 3531615 - RNA, 22 nt, Human
gccuuauuggaaagcagucccc

SEQ ID NO: 3531616 - RNA, 13 nt, Human
gccuucaaaucaa

SEQ ID NO: 3531617 - RNA, 14 nt, Human
gccuucaagcucug

SEQ ID NO: 3531618 - RNA, 16 nt, Human
gccuucaagcucugag

SEQ ID NO: 3531619 - RNA, 19 nt, Human
gccuucaagcucugaggga

SEQ ID NO: 3531620 - RNA, 20 nt, Human
gccuucacuccggugugccu

SEQ ID NO: 3531621 - RNA, 23 nt, Human
gccuucagacagagaggacugua

SEQ ID NO: 3531622 - RNA, 16 nt, Human
gccuucagcucuacag

SEQ ID NO: 3531623 - RNA, 13 nt, Human
gccuucagggagu

SEQ ID NO: 3531624 - RNA, 12 nt, Human
gccuuccaccca

SEQ ID NO: 3531625 - RNA, 23 nt, Human
gccuuccacgcugucuccagacc

SEQ ID NO: 3531626 - RNA, 12 nt, Human
gccuuccagauc

SEQ ID NO: 3531627 - RNA, 16 nt, Human
gccuuccagauccucu

SEQ ID NO: 3531628 - RNA, 20 nt, Human
gccuuccagauccucucugg

SEQ ID NO: 3531629 - RNA, 18 nt, Human
gccuuccagcugcugucu

SEQ ID NO: 3531630 - RNA, 17 nt, Human
gccuuccaugucggccu

SEQ ID NO: 3531631 - RNA, 19 nt, Human
gccuuccaugucggccucu

SEQ ID NO: 3531632 - RNA, 20 nt, Human
gccuuccaugucggccucua

SEQ ID NO: 3531633 - RNA, 18 nt, Human
gccuuccauuuccccucu

SEQ ID NO: 3531634 - RNA, 15 nt, Human
gccuuccccagccuc

SEQ ID NO: 3531635 - RNA, 18 nt, Human
gccuucccccucccaggg

SEQ ID NO: 3531636 - RNA, 23 nt, Human
gccuucccccucccagggccagg

SEQ ID NO: 3531637 - RNA, 18 nt, Human
gccuuccccucagccaca

SEQ ID NO: 3531638 - RNA, 20 nt, Human
gccuuccccuggcacuggca

SEQ ID NO: 3531639 - RNA, 24 nt, Human
gccuucccuagcuuuagacccugg

SEQ ID NO: 3531640 - RNA, 20 nt, Human
gccuuccgccccuucccuuc

SEQ ID NO: 3531641 - RNA, 20 nt, Human
gccuuccguaacccaacucu

SEQ ID NO: 3531642 - RNA, 17 nt, Human
gccuuccuaagccugug

SEQ ID NO: 3531643 - RNA, 18 nt, Human
gccuuccuaagccugugg

SEQ ID NO: 3531644 - RNA, 12 nt, Human
cuuaagcuuccg

SEQ ID NO: 3531645 - RNA, 23 nt, Human
cuuaagcuuuggacccaaggaaa

SEQ ID NO: 3531646 - RNA, 16 nt, Human
cuuaagggaguuuaau

SEQ ID NO: 3531647 - RNA, 12 nt, Human
cuuaaggggcag

SEQ ID NO: 3531648 - RNA, 20 nt, Human
gcuaucaaagaauaagaaaa

SEQ ID NO: 3531649 - RNA, 13 nt, Human
gcuaucaagaggc

SEQ ID NO: 3531650 - RNA, 12 nt, Human
gcuauccaccaa

SEQ ID NO: 3531651 - RNA, 17 nt, Human
gcuauccauuucucaug

SEQ ID NO: 3531652 - RNA, 22 nt, Human
gcuauccccaucucccugccug

SEQ ID NO: 3531653 - RNA, 12 nt, Human
gcuauccugauu

SEQ ID NO: 3531654 - RNA, 19 nt, Human
gcuaucggggaagccagac

SEQ ID NO: 3531655 - RNA, 15 nt, Human
gcuaucguaaaauua

SEQ ID NO: 3531656 - RNA, 13 nt, Human
gcuaucuccccca

SEQ ID NO: 3531657 - RNA, 20 nt, Human
gcuaucucccccagccccau

SEQ ID NO: 3531658 - RNA, 12 nt, Human
gcuaucucccug

SEQ ID NO: 3531659 - RNA, 17 nt, Human
gcuaucuggucaaccuc

SEQ ID NO: 3531660 - RNA, 14 nt, Human
gcuaucuuaauuuu

SEQ ID NO: 3531661 - RNA, 13 nt, Human
gcuaucuucaugu

SEQ ID NO: 3531662 - RNA, 15 nt, Human
gcuaucuucauguaa

SEQ ID NO: 3531663 - RNA, 21 nt, Human
gcuaugaagagcuagagaaau

SEQ ID NO: 3531664 - RNA, 14 nt, Human
gcuaugagggccuu

SEQ ID NO: 3531665 - RNA, 18 nt, Human
gcuaugauguuaguuuuc

SEQ ID NO: 3531666 - RNA, 12 nt, Human
gcuaugcauuug

SEQ ID NO: 3531667 - RNA, 13 nt, Human
gcuaugcauuuga

SEQ ID NO: 3531668 - RNA, 13 nt, Human
gcuauggacacag

SEQ ID NO: 3531669 - RNA, 18 nt, Human
gcuauggacacaggguga

SEQ ID NO: 3531670 - RNA, 14 nt, Human
gcuaugggagcccc

SEQ ID NO: 3531671 - RNA, 19 nt, Human
gcuaugggagccccagggu

SEQ ID NO: 3531672 - RNA, 14 nt, Human
gcuauggugagaug

SEQ ID NO: 3531673 - RNA, 18 nt, Human
gcuauggugcucugucua

SEQ ID NO: 3531674 - RNA, 13 nt, Human
gcuaugguuuucu

SEQ ID NO: 3531675 - RNA, 15 nt, Human
gcuauguauaaaaua

SEQ ID NO: 3531676 - RNA, 16 nt, Human
gcuaugucauuucaug

SEQ ID NO: 3531677 - RNA, 16 nt, Human
gcuauguuacuauuuu

SEQ ID NO: 3531678 - RNA, 15 nt, Human
gcuauuaaaacucag

SEQ ID NO: 3531679 - RNA, 19 nt, Human
gcuauuaacaauuaauugu

SEQ ID NO: 3531680 - RNA, 12 nt, Human
gcuauuaauauu

SEQ ID NO: 3531681 - RNA, 15 nt, Human
gcuauuacugucugg

SEQ ID NO: 3531682 - RNA, 19 nt, Human
gcuauuagccaggaucaug

SEQ ID NO: 3531683 - RNA, 21 nt, Human
gcuauuagccaggaucauggu

SEQ ID NO: 3531684 - RNA, 21 nt, Human
gcuauuauuuucacuguagaa

SEQ ID NO: 3531685 - RNA, 18 nt, Human
gcuauucaguaauaacuc

SEQ ID NO: 3531686 - RNA, 20 nt, Human
gcuauucaguaauaacucua

SEQ ID NO: 3531687 - RNA, 17 nt, Human
gcuauuccuuucccuuc

SEQ ID NO: 3531688 - RNA, 15 nt, Human
gcuauugacaauaaa

SEQ ID NO: 3531689 - RNA, 13 nt, Human
gcuauuguaaaua

SEQ ID NO: 3531690 - RNA, 16 nt, Human
gcuauuuaugggcccc

SEQ ID NO: 3531691 - RNA, 18 nt, Human
gcuauuuaugggccccug

SEQ ID NO: 3531692 - RNA, 22 nt, Human
gcuauuuauuuuccuaaagaga

SEQ ID NO: 3531693 - RNA, 15 nt, Human
gcuauuucaucuauu

SEQ ID NO: 3531694 - RNA, 18 nt, Human
gcuauuuccauuccagaa

SEQ ID NO: 3531695 - RNA, 13 nt, Human
gcuauuucuauau

SEQ ID NO: 3531696 - RNA, 20 nt, Human
gcuauuucuauauuuucauu

SEQ ID NO: 3531697 - RNA, 17 nt, Human
gcuauuugauguaauac

SEQ ID NO: 3531698 - RNA, 19 nt, Human
gcuauuugcaauuccugcu

SEQ ID NO: 3531699 - RNA, 19 nt, Human
gcuauuuguaaaucugcca

SEQ ID NO: 3531700 - RNA, 21 nt, Human
gcuauuuuaaaccaauugcag

SEQ ID NO: 3531701 - RNA, 24 nt, Human
gcuauuuuccaggcuucugcuggg

SEQ ID NO: 3531702 - RNA, 13 nt, Human
gcuauuuuuguaa

SEQ ID NO: 3531703 - RNA, 15 nt, Human
gcuauuuuuguaaag

SEQ ID NO: 3531704 - RNA, 15 nt, Human
gcucaaaaaaugagc

SEQ ID NO: 3531705 - RNA, 15 nt, Human
gcucaaaaucuuucc

SEQ ID NO: 3531706 - RNA, 20 nt, Human
gcucaaacaaugacaaagca

SEQ ID NO: 3531707 - RNA, 21 nt, Human
gcucaaacaaugacaaagcag

SEQ ID NO: 3531708 - RNA, 14 nt, Human
gcucaaagaaaucu

SEQ ID NO: 3531709 - RNA, 12 nt, Human
gcucaaaggcac

SEQ ID NO: 3531710 - RNA, 16 nt, Human
gcucaaaggcacagug

SEQ ID NO: 3531711 - RNA, 20 nt, Human
gcucaaaucuauucagacaa

SEQ ID NO: 3531712 - RNA, 23 nt, Human
gcucaacucucuuauugccucac

SEQ ID NO: 3531713 - RNA, 15 nt, Human
gcucaacuugcaaaa

SEQ ID NO: 3531714 - RNA, 21 nt, Human
gcucaagcaauccucucaccu

SEQ ID NO: 3531715 - RNA, 17 nt, Human
gcucaagcccaggaggg

SEQ ID NO: 3531716 - RNA, 17 nt, Human
gcucaaggaaaggccug

SEQ ID NO: 3531717 - RNA, 17 nt, Human
gcucaaggcgugaggau

SEQ ID NO: 3531718 - RNA, 19 nt, Human
gcucaagggacaaggacac

SEQ ID NO: 3531719 - RNA, 18 nt, Human
gcucaaguccucuuuucu

SEQ ID NO: 3531720 - RNA, 21 nt, Human
gcucaaguguucacaaccugg

SEQ ID NO: 3531721 - RNA, 15 nt, Human
gcucaauaggaccag

SEQ ID NO: 3531722 - RNA, 20 nt, Human
gcucaauccauguucuauuu

SEQ ID NO: 3531723 - RNA, 20 nt, Human
gcucaaucccugaggacuga

SEQ ID NO: 3531724 - RNA, 13 nt, Human
gcucaaugagcau

SEQ ID NO: 3531725 - RNA, 15 nt, Human
gcucacaaggcagca

SEQ ID NO: 3531726 - RNA, 14 nt, Human
gcucacacaugaga

SEQ ID NO: 3531727 - RNA, 14 nt, Human
gcucacaccccauu

SEQ ID NO: 3531728 - RNA, 12 nt, Human
gcucacagacug

SEQ ID NO: 3531729 - RNA, 22 nt, Human
gcucacaguacagcaugugccu

SEQ ID NO: 3531730 - RNA, 19 nt, Human
gcucacaguuccucgcccu

SEQ ID NO: 3531731 - RNA, 21 nt, Human
gcucacaguuccucgcccugg

SEQ ID NO: 3531732 - RNA, 23 nt, Human
gcucacaguuccucgcccugggu

SEQ ID NO: 3531733 - RNA, 15 nt, Human
gcucacccaguccug

SEQ ID NO: 3531734 - RNA, 20 nt, Human
gcucaccccccacacucacu

SEQ ID NO: 3531735 - RNA, 14 nt, Human
gcucaccuagagcc

SEQ ID NO: 3531736 - RNA, 22 nt, Human
gcucaccuguugcuuacaauuu

SEQ ID NO: 3531737 - RNA, 18 nt, Human
gcucaccuugugcugggg

SEQ ID NO: 3531738 - RNA, 18 nt, Human
gcucacuaccuccucagg

SEQ ID NO: 3531739 - RNA, 21 nt, Human
gcucacuaccuccucagggau

SEQ ID NO: 3531740 - RNA, 16 nt, Human
gcucacuaugaaucua

SEQ ID NO: 3531741 - RNA, 17 nt, Human
gcucacuaugaaucuau

SEQ ID NO: 3531742 - RNA, 19 nt, Human
gcucacugaccugccugua

SEQ ID NO: 3531743 - RNA, 20 nt, Human
gcucacugcaaccucugccu

SEQ ID NO: 3531744 - RNA, 15 nt, Human
gcucacugcagccuc

SEQ ID NO: 3531745 - RNA, 14 nt, Human
gcucacugccaggc

SEQ ID NO: 3531746 - RNA, 15 nt, Human
gcucacugccaggcc

SEQ ID NO: 3531747 - RNA, 17 nt, Human
gcucacugccaggccag

SEQ ID NO: 3531748 - RNA, 19 nt, Human
gcucacugccaggccagcc

SEQ ID NO: 3531749 - RNA, 20 nt, Human
gcucacugccaggccagccu

SEQ ID NO: 3531750 - RNA, 21 nt, Human
gcucacugcuaagaauauuug

SEQ ID NO: 3531751 - RNA, 17 nt, Human
gcucacuguggugucug

SEQ ID NO: 3531752 - RNA, 19 nt, Human
gcucacuguggugucugug

SEQ ID NO: 3531753 - RNA, 15 nt, Human
gcucagaacccaggg

SEQ ID NO: 3531754 - RNA, 18 nt, Human
gcucagaacccagggcuc

SEQ ID NO: 3531755 - RNA, 20 nt, Human
gcucagaauaaggcaggcau

SEQ ID NO: 3531756 - RNA, 18 nt, Human
gcucagaauccaagugaa

SEQ ID NO: 3531757 - RNA, 21 nt, Human
gcucagacauguuuuccguga

SEQ ID NO: 3531758 - RNA, 13 nt, Human
gcucagagagggc

SEQ ID NO: 3531759 - RNA, 18 nt, Human
gcucagagagggcaggca

SEQ ID NO: 3531760 - RNA, 19 nt, Human
gcucagagagggcaggcau

SEQ ID NO: 3531761 - RNA, 19 nt, Human
gcucagaggcgcacuguga

SEQ ID NO: 3531762 - RNA, 21 nt, Human
gcucagaucccacuuuugcca

SEQ ID NO: 3531763 - RNA, 20 nt, Human
gcucagcaaaagaugcuucu

SEQ ID NO: 3531764 - RNA, 22 nt, Human
gcucagcaaaagaugcuucuca

SEQ ID NO: 3531765 - RNA, 16 nt, Human
gcucagcaaggccacc

SEQ ID NO: 3531766 - RNA, 17 nt, Human
gcucagcaaggccaccu

SEQ ID NO: 3531767 - RNA, 19 nt, Human
gcucagcaaggggcucugc

SEQ ID NO: 3531768 - RNA, 19 nt, Human
gcucagcacugccugcucc

SEQ ID NO: 3531769 - RNA, 20 nt, Human
gcucagcacugccugcuccc

SEQ ID NO: 3531770 - RNA, 13 nt, Human
gcucagccagcac

SEQ ID NO: 3531771 - RNA, 21 nt, Human
gcucagccaucccgucuucuc

SEQ ID NO: 3531772 - RNA, 15 nt, Human
gcucagcccaccccc

SEQ ID NO: 3531773 - RNA, 12 nt, Human
gcucagccccag

SEQ ID NO: 3531774 - RNA, 19 nt, Human
gcucagccccgagcugucc

SEQ ID NO: 3531775 - RNA, 17 nt, Human
gcucagcccucccugcc

SEQ ID NO: 3531776 - RNA, 21 nt, Human
gcucagcccucccugccccuc

SEQ ID NO: 3531777 - RNA, 16 nt, Human
gcucagcccugacugg

SEQ ID NO: 3531778 - RNA, 20 nt, Human
gcucagcccugacuggugcu

SEQ ID NO: 3531779 - RNA, 16 nt, Human
gcucagcccugcacca

SEQ ID NO: 3531780 - RNA, 12 nt, Human
gcucagcccugg

SEQ ID NO: 3531781 - RNA, 14 nt, Human
gcucagcccuggag

SEQ ID NO: 3531782 - RNA, 11 nt, Human
gcucagccugg

SEQ ID NO: 3531783 - RNA, 14 nt, Human
gcucagccuggugg

SEQ ID NO: 3531784 - RNA, 20 nt, Human
gcucagccuggugggccucc

SEQ ID NO: 3531785 - RNA, 16 nt, Human
gcucagcggggacagc

SEQ ID NO: 3531786 - RNA, 18 nt, Human
gcucagcucauccaugcc

SEQ ID NO: 3531787 - RNA, 12 nt, Human
gcucagcucugg

SEQ ID NO: 3531788 - RNA, 13 nt, Human
gcucagcucuggc

SEQ ID NO: 3531789 - RNA, 14 nt, Human
gcucagcucuggcu

SEQ ID NO: 3531790 - RNA, 19 nt, Human
gcucccgccuccaaccccu

SEQ ID NO: 3531791 - RNA, 16 nt, Human
gcucccgcuccugcgg

SEQ ID NO: 3531792 - RNA, 20 nt, Human
gcucccgggacucacuggca

SEQ ID NO: 3531793 - RNA, 24 nt, Human
gcucccgggacucacuggcagccc

SEQ ID NO: 3531794 - RNA, 17 nt, Human
gcucccggggcagggca

SEQ ID NO: 3531795 - RNA, 14 nt, Human
gcucccguggccug

SEQ ID NO: 3531796 - RNA, 15 nt, Human
gcucccguggccugu

SEQ ID NO: 3531797 - RNA, 23 nt, Human
gcucccuaagccagccuggucca

SEQ ID NO: 3531798 - RNA, 15 nt, Human
gcucccuaccaccuc

SEQ ID NO: 3531799 - RNA, 20 nt, Human
gcucccuaccaccuccccag

SEQ ID NO: 3531800 - RNA, 19 nt, Human
gcucccucaaagaggcagu

SEQ ID NO: 3531801 - RNA, 16 nt, Human
gcucccucacucucag

SEQ ID NO: 3531802 - RNA, 17 nt, Human
gcucccucacucucagg

SEQ ID NO: 3531803 - RNA, 13 nt, Human
gcucccucccccu

SEQ ID NO: 3531804 - RNA, 22 nt, Human
gcucccucccccugccccuucu

SEQ ID NO: 3531805 - RNA, 19 nt, Human
gcucccuccccugcccugg

SEQ ID NO: 3531806 - RNA, 18 nt, Human
gcucccuccgcccccagg

SEQ ID NO: 3531807 - RNA, 19 nt, Human
gcucccuccuccaggccug

SEQ ID NO: 3531808 - RNA, 22 nt, Human
gcucccuccuccaggccugccu

SEQ ID NO: 3531809 - RNA, 18 nt, Human
cuuaaggugaggccuguc

SEQ ID NO: 3531810 - RNA, 20 nt, Human
cuuaaggugaggccugucug

SEQ ID NO: 3531811 - RNA, 22 nt, Human
cuuaaguaagcaacagcauaac

SEQ ID NO: 3531812 - RNA, 15 nt, Human
cuuaaguaucagaaa

SEQ ID NO: 3531813 - RNA, 19 nt, Human
cuuaaguuaguuccacuga

SEQ ID NO: 3531814 - RNA, 16 nt, Human
cuuaaguuucucagcu

SEQ ID NO: 3531815 - RNA, 18 nt, Human
cuuaauaaaaaugacaga

SEQ ID NO: 3531816 - RNA, 13 nt, Human
cuuaauaaucaag

SEQ ID NO: 3531817 - RNA, 13 nt, Human
cuuaauacuaagg

SEQ ID NO: 3531818 - RNA, 22 nt, Human
cuuaauacucaaaugaguaaca

SEQ ID NO: 3531819 - RNA, 17 nt, Human
cuuaauacuguuauucu

SEQ ID NO: 3531820 - RNA, 21 nt, Human
cuuaauacuguuauucuuugc

SEQ ID NO: 3531821 - RNA, 20 nt, Human
cuuaauagaaacauugaaga

SEQ ID NO: 3531822 - RNA, 21 nt, Human
cuuaauaugcugcaacaaaau

SEQ ID NO: 3531823 - RNA, 11 nt, Human
cuuaauauuuc

SEQ ID NO: 3531824 - RNA, 20 nt, Human
cuuaauauuucuucaaauau

SEQ ID NO: 3531825 - RNA, 20 nt, Human
cuuaaucagguccucagaga

SEQ ID NO: 3531826 - RNA, 18 nt, Human
cuuaaucauuuuuuauau

SEQ ID NO: 3531827 - RNA, 22 nt, Human
cuuaaucauuuuuuauauauau

SEQ ID NO: 3531828 - RNA, 23 nt, Human
cuuaaucauuuuuuauauauaug

SEQ ID NO: 3531829 - RNA, 23 nt, Human
cuuaauccguaguuauuuugcac

SEQ ID NO: 3531830 - RNA, 21 nt, Human
cuuaaucuguuuauuuacaag

SEQ ID NO: 3531831 - RNA, 21 nt, Human
cuuaaucuuuucacaaauaaa

SEQ ID NO: 3531832 - RNA, 15 nt, Human
cuuaaugaaaacaau

SEQ ID NO: 3531833 - RNA, 12 nt, Human
cuuaaugaaaua

SEQ ID NO: 3531834 - RNA, 14 nt, Human
cuuaaugaaguuug

SEQ ID NO: 3531835 - RNA, 15 nt, Human
cuuaaugaaguuuga

SEQ ID NO: 3531836 - RNA, 18 nt, Human
cuuaaugaaguuugaaug

SEQ ID NO: 3531837 - RNA, 19 nt, Human
cuuaaugaaguuugaaugu

SEQ ID NO: 3531838 - RNA, 12 nt, Human
cuuaaugagaua

SEQ ID NO: 3531839 - RNA, 17 nt, Human
cuuaauggaguucuugu

SEQ ID NO: 3531840 - RNA, 18 nt, Human
cuuaauggaguucuugug

SEQ ID NO: 3531841 - RNA, 14 nt, Human
cuuaauggaugaaa

SEQ ID NO: 3531842 - RNA, 13 nt, Human
cuuaauguacaua

SEQ ID NO: 3531843 - RNA, 15 nt, Human
cuuaauguacauagu

SEQ ID NO: 3531844 - RNA, 14 nt, Human
cuuaauguaucaaa

SEQ ID NO: 3531845 - RNA, 23 nt, Human
cuuaauguaucaaacuguauaac

SEQ ID NO: 3531846 - RNA, 14 nt, Human
cuuaauguauguua

SEQ ID NO: 3531847 - RNA, 17 nt, Human
cuuaauguauguuacca

SEQ ID NO: 3531848 - RNA, 14 nt, Human
cuuaauguuuauuc

SEQ ID NO: 3531849 - RNA, 23 nt, Human
cuuaauguuuauuccugauaaua

SEQ ID NO: 3531850 - RNA, 17 nt, Human
cuuaauuaaaagaauau

SEQ ID NO: 3531851 - RNA, 19 nt, Human
cuuaauuaaaagaauauuu

SEQ ID NO: 3531852 - RNA, 15 nt, Human
cuuaauuaaguaaac

SEQ ID NO: 3531853 - RNA, 13 nt, Human
cuuaauuaauuug

SEQ ID NO: 3531854 - RNA, 15 nt, Human
cuuaauuaauuugau

SEQ ID NO: 3531855 - RNA, 16 nt, Human
cuuaauuacuuaaaaa

SEQ ID NO: 3531856 - RNA, 21 nt, Human
cuuaauuauuauaaaaauauu

SEQ ID NO: 3531857 - RNA, 15 nt, Human
cuuaauuauuauuug

SEQ ID NO: 3531858 - RNA, 17 nt, Human
cuuaauuccuuucucau

SEQ ID NO: 3531859 - RNA, 19 nt, Human
cuuaauuccuuucucaucc

SEQ ID NO: 3531860 - RNA, 20 nt, Human
cuuaauucuuagcucauucu

SEQ ID NO: 3531861 - RNA, 15 nt, Human
cuuaauugcacucua

SEQ ID NO: 3531862 - RNA, 19 nt, Human
cuuaauuguucauuuugag

SEQ ID NO: 3531863 - RNA, 15 nt, Human
cuuaauuuauuauua

SEQ ID NO: 3531864 - RNA, 23 nt, Human
cuuaauuuccuuuuugacacuga

SEQ ID NO: 3531865 - RNA, 12 nt, Human
cuuaauuucuaa

SEQ ID NO: 3531866 - RNA, 15 nt, Human
cuuaauuuggaaacu

SEQ ID NO: 3531867 - RNA, 16 nt, Human
cuuaauuuggaaacua

SEQ ID NO: 3531868 - RNA, 11 nt, Human
cuuaauuuugg

SEQ ID NO: 3531869 - RNA, 19 nt, Human
cuuaauuuuuuuuucauag

SEQ ID NO: 3531870 - RNA, 15 nt, Human
cuuacaaaaacacuu

SEQ ID NO: 3531871 - RNA, 18 nt, Human
cuuacaaaugauugcuuu

SEQ ID NO: 3531872 - RNA, 16 nt, Human
cuuacaagccagcugg

SEQ ID NO: 3531873 - RNA, 20 nt, Human
cuuacaauauugauugggaa

SEQ ID NO: 3531874 - RNA, 21 nt, Human
cuuacaaucgcaaaucaaaac

SEQ ID NO: 3531875 - RNA, 20 nt, Human
cuuacaauucccugcugucg

SEQ ID NO: 3531876 - RNA, 23 nt, Human
cuuacaauuuuuuuaauuuugua

SEQ ID NO: 3531877 - RNA, 16 nt, Human
cuuacacaaaggggau

SEQ ID NO: 3531878 - RNA, 13 nt, Human
cuuacacauacag

SEQ ID NO: 3531879 - RNA, 20 nt, Human
cuuacacauacaguuuuaug

SEQ ID NO: 3531880 - RNA, 11 nt, Human
cuuacacccac

SEQ ID NO: 3531881 - RNA, 20 nt, Human
cuuacacccacaguggaaag

SEQ ID NO: 3531882 - RNA, 23 nt, Human
cuuacaccucguuagggaagaga

SEQ ID NO: 3531883 - RNA, 12 nt, Human
cuuacacugccu

SEQ ID NO: 3531884 - RNA, 19 nt, Human
cuuacacugccuguauacu

SEQ ID NO: 3531885 - RNA, 12 nt, Human
cuuacagcaggc

SEQ ID NO: 3531886 - RNA, 13 nt, Human
cuuacagcaggca

SEQ ID NO: 3531887 - RNA, 16 nt, Human
cuuacagccucugacu

SEQ ID NO: 3531888 - RNA, 14 nt, Human
cuuacaggugauua

SEQ ID NO: 3531889 - RNA, 18 nt, Human
cuuacaguuuuaaauucu

SEQ ID NO: 3531890 - RNA, 19 nt, Human
cuuacauaaacaucagguu

SEQ ID NO: 3531891 - RNA, 17 nt, Human
cuuacaugagaacagac

SEQ ID NO: 3531892 - RNA, 14 nt, Human
cuuacauguuuucu

SEQ ID NO: 3531893 - RNA, 21 nt, Human
cuuacauguuuucuuugcuuu

SEQ ID NO: 3531894 - RNA, 16 nt, Human
cuuacauucucuaaua

SEQ ID NO: 3531895 - RNA, 22 nt, Human
cuuacauucucuaauaagaaaa

SEQ ID NO: 3531896 - RNA, 15 nt, Human
cuuacauugugaaac

SEQ ID NO: 3531897 - RNA, 20 nt, Human
cuuacauuguucaauuagaa

SEQ ID NO: 3531898 - RNA, 18 nt, Human
cuuacauuugugagauuc

SEQ ID NO: 3531899 - RNA, 20 nt, Human
cuuacauuuuacuuuuuccu

SEQ ID NO: 3531900 - RNA, 22 nt, Human
cuuacauuuuuacaauaaauaa

SEQ ID NO: 3531901 - RNA, 14 nt, Human
cuuaccaacuuucu

SEQ ID NO: 3531902 - RNA, 21 nt, Human
cuuacccaggugggucccggc

SEQ ID NO: 3531903 - RNA, 13 nt, Human
cuuaccccugccu

SEQ ID NO: 3531904 - RNA, 20 nt, Human
cuuacccuucugugcccagc

SEQ ID NO: 3531905 - RNA, 22 nt, Human
cuuaccgcguaaugcgccaaua

SEQ ID NO: 3531906 - RNA, 15 nt, Human
cuuaccuaacaucug

SEQ ID NO: 3531907 - RNA, 21 nt, Human
cuuaccuaagugacauuugua

SEQ ID NO: 3531908 - RNA, 18 nt, Human
cuuaccuaccacaugcca

SEQ ID NO: 3531909 - RNA, 18 nt, Human
cuuaccuacuuucuucag

SEQ ID NO: 3531910 - RNA, 21 nt, Human
cuuaccuagugaaacuuuucu

SEQ ID NO: 3531911 - RNA, 13 nt, Human
cuuaccuccugcc

SEQ ID NO: 3531912 - RNA, 20 nt, Human
cuuaccuccugcccaggaga

SEQ ID NO: 3531913 - RNA, 15 nt, Human
cuuaccucuuccgga

SEQ ID NO: 3531914 - RNA, 11 nt, Human
cuuaccugaca

SEQ ID NO: 3531915 - RNA, 19 nt, Human
cuuaccugacacaagagga

SEQ ID NO: 3531916 - RNA, 19 nt, Human
cuuaccugaccucuugcug

SEQ ID NO: 3531917 - RNA, 17 nt, Human
cuuaccugaguugaaga

SEQ ID NO: 3531918 - RNA, 12 nt, Human
cuuaccuggccc

SEQ ID NO: 3531919 - RNA, 16 nt, Human
cuuaccuuuaccccau

SEQ ID NO: 3531920 - RNA, 13 nt, Human
cuuaccuuuuuau

SEQ ID NO: 3531921 - RNA, 22 nt, Human
cuuacgaaaaaaugguagcauu

SEQ ID NO: 3531922 - RNA, 20 nt, Human
cuuacgaauauuuucaguaa

SEQ ID NO: 3531923 - RNA, 15 nt, Human
cuuacgaucaggcac

SEQ ID NO: 3531924 - RNA, 17 nt, Human
cuuacgaucaggcacag

SEQ ID NO: 3531925 - RNA, 21 nt, Human
cuuacgaucaggcacagguca

SEQ ID NO: 3531926 - RNA, 18 nt, Human
cuuacgauggcacccagu

SEQ ID NO: 3531927 - RNA, 17 nt, Human
cuuacuaaaaaguauaa

SEQ ID NO: 3531928 - RNA, 18 nt, Human
cuuacuaaaaaguauaaa

SEQ ID NO: 3531929 - RNA, 14 nt, Human
cuuacuaaaauaua

SEQ ID NO: 3531930 - RNA, 22 nt, Human
cuuacuaaaauauauauagaaa

SEQ ID NO: 3531931 - RNA, 18 nt, Human
cuuacuacaugugggagc

SEQ ID NO: 3531932 - RNA, 12 nt, Human
cuuacuaggaag

SEQ ID NO: 3531933 - RNA, 19 nt, Human
cuuacuauuaagcaguaaa

SEQ ID NO: 3531934 - RNA, 21 nt, Human
gcgugacacucuccuugcagu

SEQ ID NO: 3531935 - RNA, 14 nt, Human
gcgugacucaccca

SEQ ID NO: 3531936 - RNA, 16 nt, Human
gcgugagaccugcccc

SEQ ID NO: 3531937 - RNA, 23 nt, Human
gcgugagcuuaaaauacaagacu

SEQ ID NO: 3531938 - RNA, 12 nt, Human
gcgugaucucag

SEQ ID NO: 3531939 - RNA, 17 nt, Human
gcgugccgugugagugu

SEQ ID NO: 3531940 - RNA, 19 nt, Human
gcgugcuccagccuggcuc

SEQ ID NO: 3531941 - RNA, 21 nt, Human
gcguggaacucgugucuggca

SEQ ID NO: 3531942 - RNA, 14 nt, Human
gcguggacaggugu

SEQ ID NO: 3531943 - RNA, 14 nt, Human
gcguggagggaggc

SEQ ID NO: 3531944 - RNA, 17 nt, Human
gcguggagggaggcccc

SEQ ID NO: 3531945 - RNA, 21 nt, Human
gcguggagggaggccccaggg

SEQ ID NO: 3531946 - RNA, 19 nt, Human
gcguggagggcguggaggg

SEQ ID NO: 3531947 - RNA, 14 nt, Human
gcguggauuaaacu

SEQ ID NO: 3531948 - RNA, 17 nt, Human
gcguggcaaauauaaaa

SEQ ID NO: 3531949 - RNA, 14 nt, Human
gcguggcccaaggc

SEQ ID NO: 3531950 - RNA, 13 nt, Human
gcgugguggacau

SEQ ID NO: 3531951 - RNA, 20 nt, Human
gcgugguggacaugcacagc

SEQ ID NO: 3531952 - RNA, 18 nt, Human
gcgugguggucccugggu

SEQ ID NO: 3531953 - RNA, 17 nt, Human
gcguguccccggggccc

SEQ ID NO: 3531954 - RNA, 17 nt, Human
gcgugugccugugugcg

SEQ ID NO: 3531955 - RNA, 11 nt, Human
gcguguggcuc

SEQ ID NO: 3531956 - RNA, 13 nt, Human
gcguguggcucac

SEQ ID NO: 3531957 - RNA, 18 nt, Human
gcguguguacacgggacu

SEQ ID NO: 3531958 - RNA, 12 nt, Human
gcguguguagag

SEQ ID NO: 3531959 - RNA, 21 nt, Human
gcguguguagaguuaagaagc

SEQ ID NO: 3531960 - RNA, 17 nt, Human
gcguguguccaugugug

SEQ ID NO: 3531961 - RNA, 21 nt, Human
gcguuaacaguuccuuucaaa

SEQ ID NO: 3531962 - RNA, 16 nt, Human
gcguuacuaauuggcc

SEQ ID NO: 3531963 - RNA, 17 nt, Human
gcguucaccagugaccu

SEQ ID NO: 3531964 - RNA, 14 nt, Human
gcguucuuguaauu

SEQ ID NO: 3531965 - RNA, 12 nt, Human
gcguugaaauug

SEQ ID NO: 3531966 - RNA, 16 nt, Human
gcguugccugucgcuu

SEQ ID NO: 3531967 - RNA, 19 nt, Human
gcguuggaauuaaaacaau

SEQ ID NO: 3531968 - RNA, 20 nt, Human
gcguuguaaaauauagcugu

SEQ ID NO: 3531969 - RNA, 23 nt, Human
gcguuguugcauguuugaaauga

SEQ ID NO: 3531970 - RNA, 19 nt, Human
gcguuuaagacuguaauga

SEQ ID NO: 3531971 - RNA, 14 nt, Human
gcuaaaaagcaaca

SEQ ID NO: 3531972 - RNA, 11 nt, Human
gcuaaaaaugg

SEQ ID NO: 3531973 - RNA, 20 nt, Human
gcuaaaaaugggacuucuuu

SEQ ID NO: 3531974 - RNA, 19 nt, Human
gcuaaaaccaucauaguac

SEQ ID NO: 3531975 - RNA, 12 nt, Human
gcuaaaagaaac

SEQ ID NO: 3531976 - RNA, 22 nt, Human
cuuagaaaaggugauaaaauca

SEQ ID NO: 3531977 - RNA, 23 nt, Human
cuuagaaaaggugauaaaaucau

SEQ ID NO: 3531978 - RNA, 13 nt, Human
cuuagaaaaugug

SEQ ID NO: 3531979 - RNA, 14 nt, Human
cuuagaaagcaggg

SEQ ID NO: 3531980 - RNA, 16 nt, Human
cuuagaaagcaggggc

SEQ ID NO: 3531981 - RNA, 17 nt, Human
cuuagaaagcaggggcu

SEQ ID NO: 3531982 - RNA, 21 nt, Human
cuuagaaauaacagaagaaaa

SEQ ID NO: 3531983 - RNA, 23 nt, Human
cuuagaaauaacagaagaaaaua

SEQ ID NO: 3531984 - RNA, 21 nt, Human
cuuagaaauguaaacugccau

SEQ ID NO: 3531985 - RNA, 17 nt, Human
cuuagaaauugcauuuc

SEQ ID NO: 3531986 - RNA, 15 nt, Human
cuuagaacauuuuaa

SEQ ID NO: 3531987 - RNA, 15 nt, Human
cuuagaagucacaca

SEQ ID NO: 3531988 - RNA, 17 nt, Human
cuuagaagucacacagu

SEQ ID NO: 3531989 - RNA, 22 nt, Human
cuuagaaguggaccaggacagg

SEQ ID NO: 3531990 - RNA, 16 nt, Human
cuuagaauaaaauugu

SEQ ID NO: 3531991 - RNA, 19 nt, Human
cuuagacagaggcccucaa

SEQ ID NO: 3531992 - RNA, 15 nt, Human
cuuagaccaccaagc

SEQ ID NO: 3531993 - RNA, 19 nt, Human
cuuagaccaccaagccuug

SEQ ID NO: 3531994 - RNA, 14 nt, Human
cuuagaccucagcc

SEQ ID NO: 3531995 - RNA, 15 nt, Human
cuuagaccucagccu

SEQ ID NO: 3531996 - RNA, 16 nt, Human
cuuagaccucagccug

SEQ ID NO: 3531997 - RNA, 16 nt, Human
cuuagacuucugcuuu

SEQ ID NO: 3531998 - RNA, 17 nt, Human
cuuagacuugaaauacu

SEQ ID NO: 3531999 - RNA, 19 nt, Human
cuuagagcaguuucugucc

SEQ ID NO: 3532000 - RNA, 14 nt, Human
cuuagagccaggca

SEQ ID NO: 3532001 - RNA, 23 nt, Human
cuuagagccucccucaauucccc

SEQ ID NO: 3532002 - RNA, 21 nt, Human
cuuagagggauuucuuugcug

SEQ ID NO: 3532003 - RNA, 17 nt, Human
cuuagaguuggccauau

SEQ ID NO: 3532004 - RNA, 14 nt, Human
cuuagaguuucugu

SEQ ID NO: 3532005 - RNA, 15 nt, Human
cuuagaucuggcaug

SEQ ID NO: 3532006 - RNA, 19 nt, Human
cuuagauguauauauuucc

SEQ ID NO: 3532007 - RNA, 18 nt, Human
cuuagauguucuaagucu

SEQ ID NO: 3532008 - RNA, 16 nt, Human
cuuagauguuucacac

SEQ ID NO: 3532009 - RNA, 17 nt, Human
cuuagauuagcucugga

SEQ ID NO: 3532010 - RNA, 18 nt, Human
cuuagauuagcucuggac

SEQ ID NO: 3532011 - RNA, 20 nt, Human
cuuagauuagcucuggacca

SEQ ID NO: 3532012 - RNA, 24 nt, Human
cuuagauucucugugucuaagauu

SEQ ID NO: 3532013 - RNA, 21 nt, Human
cuuagauuucauaguucagaa

SEQ ID NO: 3532014 - RNA, 21 nt, Human
cuuagcacuaccacuccugcc

SEQ ID NO: 3532015 - RNA, 18 nt, Human
cuuagcauccuaagaaau

SEQ ID NO: 3532016 - RNA, 19 nt, Human
cuuagcauccuaagaaaua

SEQ ID NO: 3532017 - RNA, 22 nt, Human
cuuagcauccuaagaaauaugu

SEQ ID NO: 3532018 - RNA, 14 nt, Human
cuuagcaugcacaa

SEQ ID NO: 3532019 - RNA, 18 nt, Human
cuuagcauguuugcugaa

SEQ ID NO: 3532020 - RNA, 20 nt, Human
cuuagcccccacccacuucc

SEQ ID NO: 3532021 - RNA, 14 nt, Human
cuuagccucccuga

SEQ ID NO: 3532022 - RNA, 18 nt, Human
cuuagccuggaccucuga

SEQ ID NO: 3532023 - RNA, 14 nt, Human
cuuagccuggagca

SEQ ID NO: 3532024 - RNA, 22 nt, Human
cuuagccuggagcaccuuuccu

SEQ ID NO: 3532025 - RNA, 14 nt, Human
cuuagcuaucagaa

SEQ ID NO: 3532026 - RNA, 20 nt, Human
cuuagcucaaugagcauguu

SEQ ID NO: 3532027 - RNA, 22 nt, Human
cuuagcucauucuccuuguguu

SEQ ID NO: 3532028 - RNA, 11 nt, Human
cuuagcucccu

SEQ ID NO: 3532029 - RNA, 17 nt, Human
cuuagcucccucccgca

SEQ ID NO: 3532030 - RNA, 19 nt, Human
cuuagcucucccaacucuu

SEQ ID NO: 3532031 - RNA, 14 nt, Human
cuuagcugucugcu

SEQ ID NO: 3532032 - RNA, 13 nt, Human
cuuagcuucagga

SEQ ID NO: 3532033 - RNA, 15 nt, Human
cuuagcuucaggaac

SEQ ID NO: 3532034 - RNA, 17 nt, Human
cuuagcuuuuuaauugu

SEQ ID NO: 3532035 - RNA, 15 nt, Human
cuuaggaagaauuuu

SEQ ID NO: 3532036 - RNA, 20 nt, Human
cuuaggaagagccuuccacc

SEQ ID NO: 3532037 - RNA, 23 nt, Human
cuuaggaagagccuuccacccag

SEQ ID NO: 3532038 - RNA, 20 nt, Human
cuuaggacagggucccugcu

SEQ ID NO: 3532039 - RNA, 22 nt, Human
cuuaggaugugugcaugugugu

SEQ ID NO: 3532040 - RNA, 14 nt, Human
cuuaggcagggaag

SEQ ID NO: 3532041 - RNA, 19 nt, Human
cuuaggcaugacuguagaa

SEQ ID NO: 3532042 - RNA, 15 nt, Human
cuuaggccuuccucu

SEQ ID NO: 3532043 - RNA, 17 nt, Human
cuuaggccuuccucucu

SEQ ID NO: 3532044 - RNA, 13 nt, Human
cuuagggaagcug

SEQ ID NO: 3532045 - RNA, 17 nt, Human
cuuagggaagcuggccu

SEQ ID NO: 3532046 - RNA, 19 nt, Human
cuuagggaaggauacaaaa

SEQ ID NO: 3532047 - RNA, 18 nt, Human
cuuagggacaggacccca

SEQ ID NO: 3532048 - RNA, 21 nt, Human
cuuagggacaggaccccagcu

SEQ ID NO: 3532049 - RNA, 22 nt, Human
cuuagggacaggaccccagcuc

SEQ ID NO: 3532050 - RNA, 18 nt, Human
cuuagggcacugggcugu

SEQ ID NO: 3532051 - RNA, 14 nt, Human
cuuagggcccugga

SEQ ID NO: 3532052 - RNA, 16 nt, Human
cuuagggcccuggagg

SEQ ID NO: 3532053 - RNA, 18 nt, Human
cuuagggcccuggaggcg

SEQ ID NO: 3532054 - RNA, 11 nt, Human
cuuagggucuc

SEQ ID NO: 3532055 - RNA, 13 nt, Human
cuuagggucucag

SEQ ID NO: 3532056 - RNA, 16 nt, Human
cuuagggucucagggu

SEQ ID NO: 3532057 - RNA, 22 nt, Human
cuuagggugaaccacuucauuc

SEQ ID NO: 3532058 - RNA, 22 nt, Human
cuuaggugugauuauaaaauca

SEQ ID NO: 3532059 - RNA, 15 nt, Human
cuuaguaaaauuuau

SEQ ID NO: 3532060 - RNA, 20 nt, Human
cuuaguaaugcuacguguga

SEQ ID NO: 3532061 - RNA, 16 nt, Human
cuuaguagauuaaaaa

SEQ ID NO: 3532062 - RNA, 13 nt, Human
cuuaguaucucau

SEQ ID NO: 3532063 - RNA, 19 nt, Human
cuuaguaucucaucaacaa

SEQ ID NO: 3532064 - RNA, 14 nt, Human
cuuagucacugaga

SEQ ID NO: 3532065 - RNA, 20 nt, Human
cuuagucacugagacagccc

SEQ ID NO: 3532066 - RNA, 22 nt, Human
cuuagucacugagacagcccgg

SEQ ID NO: 3532067 - RNA, 23 nt, Human
cuuagucacugccugcagagguc

SEQ ID NO: 3532068 - RNA, 12 nt, Human
cuuaguccccca

SEQ ID NO: 3532069 - RNA, 15 nt, Human
cuuagucuagguccu

SEQ ID NO: 3532070 - RNA, 21 nt, Human
cuuagucuagguccuuguugu

SEQ ID NO: 3532071 - RNA, 20 nt, Human
cuuagucuucucauagcauu

SEQ ID NO: 3532072 - RNA, 19 nt, Human
cuuagugcaguuauuugcu

SEQ ID NO: 3532073 - RNA, 22 nt, Human
cuuagugcggacaaguuuuaau

SEQ ID NO: 3532074 - RNA, 12 nt, Human
cuuaguggacag

SEQ ID NO: 3532075 - RNA, 18 nt, Human
cuuagugggguuuuauau

SEQ ID NO: 3532076 - RNA, 15 nt, Human
cuuaguguaugauua

SEQ ID NO: 3532077 - RNA, 17 nt, Human
cuuaguguuucugugca

SEQ ID NO: 3532078 - RNA, 14 nt, Human
cuuaguucucacug

SEQ ID NO: 3532079 - RNA, 15 nt, Human
gcuggacccagccag

SEQ ID NO: 3532080 - RNA, 21 nt, Human
gcuggacccugaccagcuccc

SEQ ID NO: 3532081 - RNA, 22 nt, Human
gcuggacccugaccagcucccc

SEQ ID NO: 3532082 - RNA, 15 nt, Human
gcuggaccuugaacu

SEQ ID NO: 3532083 - RNA, 16 nt, Human
gcuggaccuugaacug

SEQ ID NO: 3532084 - RNA, 21 nt, Human
gcuggaccuugaacuggguac

SEQ ID NO: 3532085 - RNA, 22 nt, Human
gcuggaccuugaacuggguacu

SEQ ID NO: 3532086 - RNA, 19 nt, Human
gcuggacggguuagacagc

SEQ ID NO: 3532087 - RNA, 16 nt, Human
gcuggacgucuuucuu

SEQ ID NO: 3532088 - RNA, 20 nt, Human
gcuggacgucuuucuuuuuu

SEQ ID NO: 3532089 - RNA, 20 nt, Human
gcuggacuccagaucugcac

SEQ ID NO: 3532090 - RNA, 23 nt, Human
gcuggacuccagaucugcaccgc

SEQ ID NO: 3532091 - RNA, 16 nt, Human
gcuggacucccucaag

SEQ ID NO: 3532092 - RNA, 21 nt, Human
gcuggacucucagucucugag

SEQ ID NO: 3532093 - RNA, 18 nt, Human
gcuggacugaggccugag

SEQ ID NO: 3532094 - RNA, 20 nt, Human
gcuggacuggaggccccugg

SEQ ID NO: 3532095 - RNA, 13 nt, Human
gcuggacuggcug

SEQ ID NO: 3532096 - RNA, 20 nt, Human
gcuggacuucuaccugcccu

SEQ ID NO: 3532097 - RNA, 22 nt, Human
gcuggacuucuaccugcccuca

SEQ ID NO: 3532098 - RNA, 23 nt, Human
gcuggacuucuaccugcccucaa

SEQ ID NO: 3532099 - RNA, 13 nt, Human
gcuggacuuggag

SEQ ID NO: 3532100 - RNA, 14 nt, Human
gcuggagaagagag

SEQ ID NO: 3532101 - RNA, 18 nt, Human
gcuggagaagagaggaga

SEQ ID NO: 3532102 - RNA, 18 nt, Human
gcuggagacuccuaggca

SEQ ID NO: 3532103 - RNA, 20 nt, Human
gcuggagagcauagggucug

SEQ ID NO: 3532104 - RNA, 15 nt, Human
gcuggagaggagccc

SEQ ID NO: 3532105 - RNA, 20 nt, Human
gcuggagaugaggccagacc

SEQ ID NO: 3532106 - RNA, 16 nt, Human
gcuggagccacuaacu

SEQ ID NO: 3532107 - RNA, 22 nt, Human
gcuggagcccagggagcggaaa

SEQ ID NO: 3532108 - RNA, 10 nt, Human
gcuggagccu

SEQ ID NO: 3532109 - RNA, 23 nt, Human
gcuggagccuguguaacagcucc

SEQ ID NO: 3532110 - RNA, 12 nt, Human
gcuggagcggcu

SEQ ID NO: 3532111 - RNA, 17 nt, Human
gcuggagcucugcccau

SEQ ID NO: 3532112 - RNA, 14 nt, Human
gcuggaggagccca

SEQ ID NO: 3532113 - RNA, 20 nt, Human
gcuggaggagcccaggccag

SEQ ID NO: 3532114 - RNA, 13 nt, Human
gcuggaggcccag

SEQ ID NO: 3532115 - RNA, 16 nt, Human
gcuggagguggggcga

SEQ ID NO: 3532116 - RNA, 22 nt, Human
gcuggagguggggcgaggcagg

SEQ ID NO: 3532117 - RNA, 22 nt, Human
gcuggagugcagugagccgaga

SEQ ID NO: 3532118 - RNA, 19 nt, Human
gcuggagugcaguggugcg

SEQ ID NO: 3532119 - RNA, 21 nt, Human
gcuggagugugaggguccugc

SEQ ID NO: 3532120 - RNA, 21 nt, Human
gcuggaguuagggacugacca

SEQ ID NO: 3532121 - RNA, 20 nt, Human
gcuggaguucagugguguga

SEQ ID NO: 3532122 - RNA, 17 nt, Human
gcuggaguuggggcaga

SEQ ID NO: 3532123 - RNA, 20 nt, Human
gcuggaguuggggcagagga

SEQ ID NO: 3532124 - RNA, 14 nt, Human
gcuggauaaaauga

SEQ ID NO: 3532125 - RNA, 15 nt, Human
gcuggauaaaaugag

SEQ ID NO: 3532126 - RNA, 23 nt, Human
gcuggaucacagcugcuuucugu

SEQ ID NO: 3532127 - RNA, 13 nt, Human
gcuggaugagcuc

SEQ ID NO: 3532128 - RNA, 16 nt, Human
gcuggauggagcccag

SEQ ID NO: 3532129 - RNA, 20 nt, Human
gcuggcacccaccguggagg

SEQ ID NO: 3532130 - RNA, 13 nt, Human
gcuggcagcagag

SEQ ID NO: 3532131 - RNA, 15 nt, Human
gcuggcagcagagug

SEQ ID NO: 3532132 - RNA, 17 nt, Human
gcuggcaguccuggaag

SEQ ID NO: 3532133 - RNA, 16 nt, Human
gcuggcauuugcaccu

SEQ ID NO: 3532134 - RNA, 19 nt, Human
gcuggccaaauagcaaaga

SEQ ID NO: 3532135 - RNA, 13 nt, Human
gcuggccacugca

SEQ ID NO: 3532136 - RNA, 19 nt, Human
gcuggccacugcacagagc

SEQ ID NO: 3532137 - RNA, 21 nt, Human
gcuggccacugcacagagcuc

SEQ ID NO: 3532138 - RNA, 13 nt, Human
gcuggccagcccc

SEQ ID NO: 3532139 - RNA, 16 nt, Human
gcuggccagccccaca

SEQ ID NO: 3532140 - RNA, 13 nt, Human
gcuggccagccgc

SEQ ID NO: 3532141 - RNA, 13 nt, Human
gcuggccagccug

SEQ ID NO: 3532142 - RNA, 15 nt, Human
gcuggccagccuggg

SEQ ID NO: 3532143 - RNA, 15 nt, Human
gcuggccauggagaa

SEQ ID NO: 3532144 - RNA, 19 nt, Human
gcuggccauggagaaagcu

SEQ ID NO: 3532145 - RNA, 12 nt, Human
gcuggcccagcc

SEQ ID NO: 3532146 - RNA, 13 nt, Human
gcuggcccagccc

SEQ ID NO: 3532147 - RNA, 15 nt, Human
gcuggcccagcccug

SEQ ID NO: 3532148 - RNA, 17 nt, Human
gcuggcccagcccugcu

SEQ ID NO: 3532149 - RNA, 20 nt, Human
gcuggcccagggcccagagc

SEQ ID NO: 3532150 - RNA, 12 nt, Human
gcuggccccagc

SEQ ID NO: 3532151 - RNA, 17 nt, Human
gcuggccccagcccugc

SEQ ID NO: 3532152 - RNA, 21 nt, Human
gcuggccccagcccugcuggg

SEQ ID NO: 3532153 - RNA, 16 nt, Human
gcuggccccagggcac

SEQ ID NO: 3532154 - RNA, 12 nt, Human
gcuggcccccac

SEQ ID NO: 3532155 - RNA, 14 nt, Human
gcuggcccccacug

SEQ ID NO: 3532156 - RNA, 19 nt, Human
gcuggcccccacuggcugu

SEQ ID NO: 3532157 - RNA, 21 nt, Human
gcuggcccccacuggcugugg

SEQ ID NO: 3532158 - RNA, 22 nt, Human
gcuggcccccacuggcuguggg

SEQ ID NO: 3532159 - RNA, 12 nt, Human
gcuggccccuca

SEQ ID NO: 3532160 - RNA, 21 nt, Human
gcuggccccuuugggcccugc

SEQ ID NO: 3532161 - RNA, 23 nt, Human
gcuggccccuuugggcccugcau

SEQ ID NO: 3532162 - RNA, 17 nt, Human
gcuggcccgugacagac

SEQ ID NO: 3532163 - RNA, 16 nt, Human
gcuggcccugcccugg

SEQ ID NO: 3532164 - RNA, 19 nt, Human
gcuggccgaggguccuggc

SEQ ID NO: 3532165 - RNA, 18 nt, Human
gcuggccgcccccagccc

SEQ ID NO: 3532166 - RNA, 15 nt, Human
gcuggccgggcacag

SEQ ID NO: 3532167 - RNA, 18 nt, Human
gcuggccgggcacagcug

SEQ ID NO: 3532168 - RNA, 21 nt, Human
gcuggccucacccaccccugc

SEQ ID NO: 3532169 - RNA, 12 nt, Human
gcuggccucaga

SEQ ID NO: 3532170 - RNA, 19 nt, Human
gcuggccucucuagcacaa

SEQ ID NO: 3532171 - RNA, 12 nt, Human
gcuggccucugc

SEQ ID NO: 3532172 - RNA, 15 nt, Human
gcuggccuggaucuc

SEQ ID NO: 3532173 - RNA, 15 nt, Human
gcuggccuggccccu

SEQ ID NO: 3532174 - RNA, 18 nt, Human
gcuggccuggccccucag

SEQ ID NO: 3532175 - RNA, 20 nt, Human
gcuggccuggccccucaggg

SEQ ID NO: 3532176 - RNA, 21 nt, Human
gcuggccuugugguccaaaua

SEQ ID NO: 3532177 - RNA, 21 nt, Human
gcuggccuuuguaagugcagg

SEQ ID NO: 3532178 - RNA, 17 nt, Human
gcuggcgagagucuggc

SEQ ID NO: 3532179 - RNA, 12 nt, Human
gcuggcgccucu

SEQ ID NO: 3532180 - RNA, 13 nt, Human
gcuggcgccucug

SEQ ID NO: 3532181 - RNA, 14 nt, Human
gcuggcgccucugc

SEQ ID NO: 3532182 - RNA, 16 nt, Human
gcuggcggcuacucag

SEQ ID NO: 3532183 - RNA, 16 nt, Human
gcuggcucacaguaca

SEQ ID NO: 3532184 - RNA, 17 nt, Human
gcuggcucccagggcca

SEQ ID NO: 3532185 - RNA, 13 nt, Human
gcuggcuccccaa

SEQ ID NO: 3532186 - RNA, 21 nt, Human
gcuggcuccccaaagggugug

SEQ ID NO: 3532187 - RNA, 14 nt, Human
gcuggcuccccugc

SEQ ID NO: 3532188 - RNA, 20 nt, Human
gcuggcuccccugcagcccu

SEQ ID NO: 3532189 - RNA, 22 nt, Human
gcuggcuccccugcagcccugg

SEQ ID NO: 3532190 - RNA, 13 nt, Human
gcuggcucuucug

SEQ ID NO: 3532191 - RNA, 14 nt, Human
gcuggcugccuuag

SEQ ID NO: 3532192 - RNA, 11 nt, Human
gcuggcugggg

SEQ ID NO: 3532193 - RNA, 14 nt, Human
gcuggcuggggccu

SEQ ID NO: 3532194 - RNA, 15 nt, Human
gcuggcuguuggcug

SEQ ID NO: 3532195 - RNA, 23 nt, Human
gcuggcuguuggcugggggccuc

SEQ ID NO: 3532196 - RNA, 18 nt, Human
gcuggcuuuucuguuucc

SEQ ID NO: 3532197 - RNA, 14 nt, Human
gcugggaaagcaua

SEQ ID NO: 3532198 - RNA, 22 nt, Human
gcugggaacagugugcaaggca

SEQ ID NO: 3532199 - RNA, 16 nt, Human
gcugggaacucaccug

SEQ ID NO: 3532200 - RNA, 17 nt, Human
gcugggacgcucugcug

SEQ ID NO: 3532201 - RNA, 19 nt, Human
gcugggacguggcucagcc

SEQ ID NO: 3532202 - RNA, 13 nt, Human
gcugggacuacag

SEQ ID NO: 3532203 - RNA, 19 nt, Human
gcugggacuacaggcaccc

SEQ ID NO: 3532204 - RNA, 19 nt, Human
gcugggacuacagguguga

SEQ ID NO: 3532205 - RNA, 19 nt, Human
gcugggacucagccuucag

SEQ ID NO: 3532206 - RNA, 15 nt, Human
gcugggacuggccag

SEQ ID NO: 3532207 - RNA, 13 nt, Human
gcugggagagccu

SEQ ID NO: 3532208 - RNA, 19 nt, Human
gcugggagagccuuccagg

SEQ ID NO: 3532209 - RNA, 14 nt, Human
gcugggagaggcag

SEQ ID NO: 3532210 - RNA, 15 nt, Human
gcugggagaggcagc

SEQ ID NO: 3532211 - RNA, 14 nt, Human
gcugggagcuccac

SEQ ID NO: 3532212 - RNA, 21 nt, Human
gcugggagcuccacucugcuu

SEQ ID NO: 3532213 - RNA, 22 nt, Human
gcugggaggaaggacuucccug

SEQ ID NO: 3532214 - RNA, 17 nt, Human
gcugggaggagggagag

SEQ ID NO: 3532215 - RNA, 17 nt, Human
gcugggaggagggcagg

SEQ ID NO: 3532216 - RNA, 19 nt, Human
gcugggaggagggcaggca

SEQ ID NO: 3532217 - RNA, 21 nt, Human
gcugggaggagggcaggcauc

SEQ ID NO: 3532218 - RNA, 12 nt, Human
gcugggaggcaa

SEQ ID NO: 3532219 - RNA, 21 nt, Human
gcugggaggcaagaggggugg

SEQ ID NO: 3532220 - RNA, 15 nt, Human
gcugggaggcauggc

SEQ ID NO: 3532221 - RNA, 20 nt, Human
gcugggaggcauggcccugg

SEQ ID NO: 3532222 - RNA, 21 nt, Human
gcugggaugauuggagggggg

SEQ ID NO: 3532223 - RNA, 16 nt, Human
gcugggauuacaggug

SEQ ID NO: 3532224 - RNA, 20 nt, Human
gcuguaaaaugcaugauuuu

SEQ ID NO: 3532225 - RNA, 17 nt, Human
gcuguaaauuuggcuuc

SEQ ID NO: 3532226 - RNA, 18 nt, Human
gcuguaacguggcacugg

SEQ ID NO: 3532227 - RNA, 15 nt, Human
gcuguaacugccagg

SEQ ID NO: 3532228 - RNA, 14 nt, Human
gcuguaagcuccuu

SEQ ID NO: 3532229 - RNA, 23 nt, Human
gcuguaaggauccggaaagaaga

SEQ ID NO: 3532230 - RNA, 22 nt, Human
gcuguaaucuaugaauucuaag

SEQ ID NO: 3532231 - RNA, 21 nt, Human
gcuguacaaauauaagaauaa

SEQ ID NO: 3532232 - RNA, 16 nt, Human
gcuguacaucuauuuu

SEQ ID NO: 3532233 - RNA, 20 nt, Human
gcuguacaucuauuuuggau

SEQ ID NO: 3532234 - RNA, 23 nt, Human
gcuguacaucuauuuuggauugu

SEQ ID NO: 3532235 - RNA, 16 nt, Human
gcuguacccaguuucu

SEQ ID NO: 3532236 - RNA, 19 nt, Human
gcuguacugaaguaaaaca

SEQ ID NO: 3532237 - RNA, 17 nt, Human
gcuguacuucuugaaua

SEQ ID NO: 3532238 - RNA, 13 nt, Human
gcuguagaaaaaa

SEQ ID NO: 3532239 - RNA, 20 nt, Human
gcuguaggacucgcagucag

SEQ ID NO: 3532240 - RNA, 13 nt, Human
gcuguaggugugc

SEQ ID NO: 3532241 - RNA, 22 nt, Human
gcuguauaaaaucagccaauua

SEQ ID NO: 3532242 - RNA, 14 nt, Human
gcuguauaaguuau

SEQ ID NO: 3532243 - RNA, 14 nt, Human
gcuguaucugugcu

SEQ ID NO: 3532244 - RNA, 16 nt, Human
gcuguaucuuguuuuu

SEQ ID NO: 3532245 - RNA, 18 nt, Human
gcuguaucuuguuuuucc

SEQ ID NO: 3532246 - RNA, 14 nt, Human
gcuguauugucuga

SEQ ID NO: 3532247 - RNA, 15 nt, Human
gcuguauugucugaa

SEQ ID NO: 3532248 - RNA, 13 nt, Human
gcuguauuuuaaa

SEQ ID NO: 3532249 - RNA, 22 nt, Human
gcuguauuuuaaaagaaugauu

SEQ ID NO: 3532250 - RNA, 19 nt, Human
gcugucaauuacaggaagu

SEQ ID NO: 3532251 - RNA, 17 nt, Human
gcugucacaaccaagaa

SEQ ID NO: 3532252 - RNA, 15 nt, Human
gcugucaccucuccc

SEQ ID NO: 3532253 - RNA, 23 nt, Human
gcugucaggauugcgagagaugu

SEQ ID NO: 3532254 - RNA, 24 nt, Human
gcugucaggauugcgagagaugug

SEQ ID NO: 3532255 - RNA, 18 nt, Human
gcugucauaagaaugaau

SEQ ID NO: 3532256 - RNA, 11 nt, Human
gcugucaucug

SEQ ID NO: 3532257 - RNA, 16 nt, Human
gcugucaucugugcac

SEQ ID NO: 3532258 - RNA, 18 nt, Human
gcugucauugcuucuucu

SEQ ID NO: 3532259 - RNA, 14 nt, Human
gcuguccacccgcc

SEQ ID NO: 3532260 - RNA, 12 nt, Human
gcuguccagaca

SEQ ID NO: 3532261 - RNA, 16 nt, Human
gcuguccagacagccu

SEQ ID NO: 3532262 - RNA, 16 nt, Human
gcuguccagagaaaag

SEQ ID NO: 3532263 - RNA, 12 nt, Human
gcuguccagugc

SEQ ID NO: 3532264 - RNA, 23 nt, Human
gcugucccauagucccugccacg

SEQ ID NO: 3532265 - RNA, 22 nt, Human
gcugucccaucuccacuguuau

SEQ ID NO: 3532266 - RNA, 21 nt, Human
gcuguccccccacucccucac

SEQ ID NO: 3532267 - RNA, 23 nt, Human
gcuguccccucuugccccaaccc

SEQ ID NO: 3532268 - RNA, 13 nt, Human
gcugucccucacu

SEQ ID NO: 3532269 - RNA, 15 nt, Human
gcugucccucccccu

SEQ ID NO: 3532270 - RNA, 16 nt, Human
gcugucccucccccuu

SEQ ID NO: 3532271 - RNA, 14 nt, Human
gcugucccugucac

SEQ ID NO: 3532272 - RNA, 22 nt, Human
gcugucccuuacgugaguccug

SEQ ID NO: 3532273 - RNA, 22 nt, Human
gcugucccuugcuugccugcag

SEQ ID NO: 3532274 - RNA, 16 nt, Human
gcuguccuaggccaca

SEQ ID NO: 3532275 - RNA, 17 nt, Human
gcuguccuuacccaucu

SEQ ID NO: 3532276 - RNA, 22 nt, Human
gcuguccuuacccaucugcacc

SEQ ID NO: 3532277 - RNA, 14 nt, Human
gcuguccuuucuag

SEQ ID NO: 3532278 - RNA, 13 nt, Human
gcugucuccagac

SEQ ID NO: 3532279 - RNA, 17 nt, Human
gcugucuccauguuuga

SEQ ID NO: 3532280 - RNA, 17 nt, Human
gcugucugaucugugcu

SEQ ID NO: 3532281 - RNA, 18 nt, Human
gcugucugaucugugcuu

SEQ ID NO: 3532282 - RNA, 19 nt, Human
gcugucugaucugugcuuu

SEQ ID NO: 3532283 - RNA, 22 nt, Human
gcugucugaucugugcuuucca

SEQ ID NO: 3532284 - RNA, 15 nt, Human
gcugucugcagccuu

SEQ ID NO: 3532285 - RNA, 19 nt, Human
gcugucuggcacagccugc

SEQ ID NO: 3532286 - RNA, 23 nt, Human
gcugucugggugcuacuggggaa

SEQ ID NO: 3532287 - RNA, 14 nt, Human
gcugucuguggcuu

SEQ ID NO: 3532288 - RNA, 15 nt, Human
gcugucuguggcuuc

SEQ ID NO: 3532289 - RNA, 24 nt, Human
gcugucuucuggacaggcucugcu

SEQ ID NO: 3532290 - RNA, 19 nt, Human
gcugucuuucuugcucccu

SEQ ID NO: 3532291 - RNA, 18 nt, Human
gcugucuuuucuuugcca

SEQ ID NO: 3532292 - RNA, 18 nt, Human
gcugugaacauggacucu

SEQ ID NO: 3532293 - RNA, 13 nt, Human
gcugugaacccug

SEQ ID NO: 3532294 - RNA, 13 nt, Human
gcugugaccugcu

SEQ ID NO: 3532295 - RNA, 14 nt, Human
gcugugaccugcug

SEQ ID NO: 3532296 - RNA, 18 nt, Human
gcugugaccugcugagcu

SEQ ID NO: 3532297 - RNA, 23 nt, Human
gcugugaccugcugagcucugag

SEQ ID NO: 3532298 - RNA, 20 nt, Human
gcugugagccccugguccug

SEQ ID NO: 3532299 - RNA, 17 nt, Human
gcugugagccuuggcug

SEQ ID NO: 3532300 - RNA, 12 nt, Human
gcugugaggcug

SEQ ID NO: 3532301 - RNA, 14 nt, Human
gcugugaggcuguc

SEQ ID NO: 3532302 - RNA, 23 nt, Human
gcugugagggaggggaaaagcau

SEQ ID NO: 3532303 - RNA, 22 nt, Human
gcugugaguguaagugugagua

SEQ ID NO: 3532304 - RNA, 13 nt, Human
gcugugcaacgcc

SEQ ID NO: 3532305 - RNA, 14 nt, Human
gcugugccacccug

SEQ ID NO: 3532306 - RNA, 19 nt, Human
gcugugccacccugggcuc

SEQ ID NO: 3532307 - RNA, 15 nt, Human
gcugugccucgcucc

SEQ ID NO: 3532308 - RNA, 18 nt, Human
gcugugccucgcucccca

SEQ ID NO: 3532309 - RNA, 15 nt, Human
gcugugcuaugaauu

SEQ ID NO: 3532310 - RNA, 16 nt, Human
gcugugcuauggugcu

SEQ ID NO: 3532311 - RNA, 17 nt, Human
gcugugcuauggugcuc

SEQ ID NO: 3532312 - RNA, 12 nt, Human
gcugugcucaga

SEQ ID NO: 3532313 - RNA, 19 nt, Human
gcugugcucucaccagcug

SEQ ID NO: 3532314 - RNA, 21 nt, Human
gcugugcucuggacaggcaug

SEQ ID NO: 3532315 - RNA, 19 nt, Human
gcugugcugcccugaagaa

SEQ ID NO: 3532316 - RNA, 17 nt, Human
gcugugcugcccugccc

SEQ ID NO: 3532317 - RNA, 17 nt, Human
gcugugcuuaugguacc

SEQ ID NO: 3532318 - RNA, 20 nt, Human
gcugugcuugaaggcccugc

SEQ ID NO: 3532319 - RNA, 23 nt, Human
gcugugcuugaaggcccugcuga

SEQ ID NO: 3532320 - RNA, 15 nt, Human
gcuguggaagcaaca

SEQ ID NO: 3532321 - RNA, 14 nt, Human
gcuguggcaggcca

SEQ ID NO: 3532322 - RNA, 12 nt, Human
gcuguggccagg

SEQ ID NO: 3532323 - RNA, 13 nt, Human
gcuguggccagga

SEQ ID NO: 3532324 - RNA, 16 nt, Human
gcuguggccaggaggu

SEQ ID NO: 3532325 - RNA, 16 nt, Human
gcuguggccaggguga

SEQ ID NO: 3532326 - RNA, 14 nt, Human
gcuguggccugggc

SEQ ID NO: 3532327 - RNA, 15 nt, Human
gcugugggcucccuu

SEQ ID NO: 3532328 - RNA, 15 nt, Human
gcugugguuccuggg

SEQ ID NO: 3532329 - RNA, 13 nt, Human
gcugugguuuucu

SEQ ID NO: 3532330 - RNA, 15 nt, Human
gcugugguuuucuuu

SEQ ID NO: 3532331 - RNA, 13 nt, Human
gcuguguaaaguu

SEQ ID NO: 3532332 - RNA, 15 nt, Human
gcuguguaaaguuag

SEQ ID NO: 3532333 - RNA, 17 nt, Human
gcuguguaaaguuaguc

SEQ ID NO: 3532334 - RNA, 18 nt, Human
gcuguguaaaguuagucu

SEQ ID NO: 3532335 - RNA, 16 nt, Human
gcuguguaagauuugu

SEQ ID NO: 3532336 - RNA, 22 nt, Human
gcuguguacacugacaccuuug

SEQ ID NO: 3532337 - RNA, 21 nt, Human
gcuguguauaugguauauaua

SEQ ID NO: 3532338 - RNA, 22 nt, Human
gcuguguccaaaaccgccagcu

SEQ ID NO: 3532339 - RNA, 21 nt, Human
gcugugucugcccaaugaaua

SEQ ID NO: 3532340 - RNA, 20 nt, Human
gcugugugaauaccugcuca

SEQ ID NO: 3532341 - RNA, 15 nt, Human
gcugugugccugggg

SEQ ID NO: 3532342 - RNA, 13 nt, Human
gcugugugguuug

SEQ ID NO: 3532343 - RNA, 22 nt, Human
gcugugugguuugguguguucc

SEQ ID NO: 3532344 - RNA, 14 nt, Human
gcugugugucccag

SEQ ID NO: 3532345 - RNA, 22 nt, Human
gcuguguuguugcuucuuguga

SEQ ID NO: 3532346 - RNA, 16 nt, Human
gcuguguuuaauuuga

SEQ ID NO: 3532347 - RNA, 23 nt, Human
gcuguuaaauacaggaaacaguu

SEQ ID NO: 3532348 - RNA, 23 nt, Human
gcuguuagggguuauugguguaa

SEQ ID NO: 3532349 - RNA, 18 nt, Human
gcuguucaacaucacuga

SEQ ID NO: 3532350 - RNA, 15 nt, Human
gcuguucacagccag

SEQ ID NO: 3532351 - RNA, 20 nt, Human
gcuguucacccacagggcua

SEQ ID NO: 3532352 - RNA, 19 nt, Human
gcuguucagauuggacaua

SEQ ID NO: 3532353 - RNA, 13 nt, Human
gcuguucagcugg

SEQ ID NO: 3532354 - RNA, 21 nt, Human
gcuguucaugaaagauucaau

SEQ ID NO: 3532355 - RNA, 16 nt, Human
gcuguucugcacugaa

SEQ ID NO: 3532356 - RNA, 17 nt, Human
gcuguucugcacugaaa

SEQ ID NO: 3532357 - RNA, 12 nt, Human
gcuguucugugg

SEQ ID NO: 3532358 - RNA, 12 nt, Human
gcuguucuuccu

SEQ ID NO: 3532359 - RNA, 20 nt, Human
gcuguucuucuguucugcag

SEQ ID NO: 3532360 - RNA, 14 nt, Human
gcuguugacauauu

SEQ ID NO: 3532361 - RNA, 13 nt, Human
gcuguugaccagg

SEQ ID NO: 3532362 - RNA, 12 nt, Human
gcuguugagcug

SEQ ID NO: 3532363 - RNA, 21 nt, Human
gcuguugaugaggccucuugg

SEQ ID NO: 3532364 - RNA, 18 nt, Human
gcuguugauuucuuucca

SEQ ID NO: 3532365 - RNA, 13 nt, Human
gcuguugccucau

SEQ ID NO: 3532366 - RNA, 21 nt, Human
gcuguugcguaacuggcugug

SEQ ID NO: 3532367 - RNA, 23 nt, Human
gcuguugcguaacuggcuguguu

SEQ ID NO: 3532368 - RNA, 16 nt, Human
gcuguugcugaauagg

SEQ ID NO: 3532369 - RNA, 18 nt, Human
ggaacaaggagucagaca

SEQ ID NO: 3532370 - RNA, 15 nt, Human
ggaacaaggcaaggc

SEQ ID NO: 3532371 - RNA, 17 nt, Human
ggaacaaggcaaggcug

SEQ ID NO: 3532372 - RNA, 13 nt, Human
ggaacaaucuaaa

SEQ ID NO: 3532373 - RNA, 20 nt, Human
ggaacacuagacaagccaga

SEQ ID NO: 3532374 - RNA, 15 nt, Human
ggaacacuccuucac

SEQ ID NO: 3532375 - RNA, 19 nt, Human
ggaacacuccuucacagau

SEQ ID NO: 3532376 - RNA, 14 nt, Human
ggaacacucugaga

SEQ ID NO: 3532377 - RNA, 13 nt, Human
ggaacagaaauug

SEQ ID NO: 3532378 - RNA, 23 nt, Human
ggaacagaagaggaaagagagac

SEQ ID NO: 3532379 - RNA, 19 nt, Human
ggaacagaauguuuuacug

SEQ ID NO: 3532380 - RNA, 15 nt, Human
ggaacagacaggaga

SEQ ID NO: 3532381 - RNA, 17 nt, Human
ggaacagacuggaagca

SEQ ID NO: 3532382 - RNA, 17 nt, Human
ggaacagcacuggggag

SEQ ID NO: 3532383 - RNA, 21 nt, Human
ggaacagcacuggggagucuu

SEQ ID NO: 3532384 - RNA, 20 nt, Human
ggaacagcuaugggagcccc

SEQ ID NO: 3532385 - RNA, 18 nt, Human
ggaacagugugcaaggca

SEQ ID NO: 3532386 - RNA, 18 nt, Human
ggaacauaaaaaggacau

SEQ ID NO: 3532387 - RNA, 15 nt, Human
ggaacaucaucaagg

SEQ ID NO: 3532388 - RNA, 23 nt, Human
ggaacauccuuugcagggcagcc

SEQ ID NO: 3532389 - RNA, 14 nt, Human
ggaacaugcccccu

SEQ ID NO: 3532390 - RNA, 13 nt, Human
ggaacauggggag

SEQ ID NO: 3532391 - RNA, 14 nt, Human
ggaacauggggagg

SEQ ID NO: 3532392 - RNA, 17 nt, Human
ggaacauggggaggagg

SEQ ID NO: 3532393 - RNA, 21 nt, Human
ggaacauuuauuuuaugagaa

SEQ ID NO: 3532394 - RNA, 23 nt, Human
ggaacauuuauuuuaugagaaau

SEQ ID NO: 3532395 - RNA, 21 nt, Human
ggaacauuucuguaaauacca

SEQ ID NO: 3532396 - RNA, 12 nt, Human
ggaaccagacuc

SEQ ID NO: 3532397 - RNA, 13 nt, Human
ggaaccagggaga

SEQ ID NO: 3532398 - RNA, 11 nt, Human
ggaacccagac

SEQ ID NO: 3532399 - RNA, 13 nt, Human
ggaacccagacuc

SEQ ID NO: 3532400 - RNA, 17 nt, Human
ggaaccccccucccacc

SEQ ID NO: 3532401 - RNA, 23 nt, Human
ggaacccugcccacucccaggac

SEQ ID NO: 3532402 - RNA, 15 nt, Human
ggaaccgaggcaggg

SEQ ID NO: 3532403 - RNA, 16 nt, Human
ggaaccgaggcaggga

SEQ ID NO: 3532404 - RNA, 18 nt, Human
ggaaccguugccaaccga

SEQ ID NO: 3532405 - RNA, 17 nt, Human
cuugaacguuuucuaau

SEQ ID NO: 3532406 - RNA, 16 nt, Human
cuugaacuccugaccu

SEQ ID NO: 3532407 - RNA, 18 nt, Human
cuugaacucugggcucaa

SEQ ID NO: 3532408 - RNA, 19 nt, Human
cuugaacugagcuuggaag

SEQ ID NO: 3532409 - RNA, 14 nt, Human
cuugaacugauuca

SEQ ID NO: 3532410 - RNA, 24 nt, Human
cuugaacuucaccugcaaagcucu

SEQ ID NO: 3532411 - RNA, 18 nt, Human
cuugaacuugccucuuuu

SEQ ID NO: 3532412 - RNA, 21 nt, Human
cuugaacuuugaccucugcag

SEQ ID NO: 3532413 - RNA, 12 nt, Human
cuugaagaacug

SEQ ID NO: 3532414 - RNA, 20 nt, Human
cuugaagaacugcaggcccu

SEQ ID NO: 3532415 - RNA, 16 nt, Human
cuugaagacuuuucuu

SEQ ID NO: 3532416 - RNA, 12 nt, Human
cuugaagcagua

SEQ ID NO: 3532417 - RNA, 12 nt, Human
cuugaagccaaa

SEQ ID NO: 3532418 - RNA, 16 nt, Human
cuugaagccaaagaaa

SEQ ID NO: 3532419 - RNA, 13 nt, Human
cuugaagccaagu

SEQ ID NO: 3532420 - RNA, 13 nt, Human
cuugaagccacug

SEQ ID NO: 3532421 - RNA, 16 nt, Human
cuugaagccugcuccu

SEQ ID NO: 3532422 - RNA, 11 nt, Human
cuugaagcugu

SEQ ID NO: 3532423 - RNA, 14 nt, Human
cuugaaggaaaaau

SEQ ID NO: 3532424 - RNA, 18 nt, Human
cuugaaggaaaaauucaa

SEQ ID NO: 3532425 - RNA, 13 nt, Human
cuugaaggagaau

SEQ ID NO: 3532426 - RNA, 15 nt, Human
cuugaaggcccugcu

SEQ ID NO: 3532427 - RNA, 18 nt, Human
cuugaaggcccugcugag

SEQ ID NO: 3532428 - RNA, 13 nt, Human
cuugaagggccag

SEQ ID NO: 3532429 - RNA, 14 nt, Human
cuugaagggccaga

SEQ ID NO: 3532430 - RNA, 15 nt, Human
cuugaagggccagag

SEQ ID NO: 3532431 - RNA, 21 nt, Human
cuugaagggccagagccaggg

SEQ ID NO: 3532432 - RNA, 16 nt, Human
cuugaagggcccagga

SEQ ID NO: 3532433 - RNA, 16 nt, Human
cuugaaggguaaagaa

SEQ ID NO: 3532434 - RNA, 23 nt, Human
cuugaagguauaucuagguuuau

SEQ ID NO: 3532435 - RNA, 17 nt, Human
cuugaagucacccggcc

SEQ ID NO: 3532436 - RNA, 18 nt, Human
cuugaaguccuggcuuca

SEQ ID NO: 3532437 - RNA, 19 nt, Human
cuugaagucuaaaagcaga

SEQ ID NO: 3532438 - RNA, 20 nt, Human
cuugaagucuaaaagcagaa

SEQ ID NO: 3532439 - RNA, 20 nt, Human
cuugaauauaaaaaaucaug

SEQ ID NO: 3532440 - RNA, 22 nt, Human
cuugaauauccccucccaguca

SEQ ID NO: 3532441 - RNA, 15 nt, Human
cuugaauccuuccau

SEQ ID NO: 3532442 - RNA, 13 nt, Human
cuugaaugcugcc

SEQ ID NO: 3532443 - RNA, 16 nt, Human
cuugaauguagcagcc

SEQ ID NO: 3532444 - RNA, 19 nt, Human
cuugaauguggucucagga

SEQ ID NO: 3532445 - RNA, 15 nt, Human
cuugaauuaagaaga

SEQ ID NO: 3532446 - RNA, 14 nt, Human
cuugaauucauaga

SEQ ID NO: 3532447 - RNA, 19 nt, Human
cuugaauuguaaggaauga

SEQ ID NO: 3532448 - RNA, 19 nt, Human
cuugacaaaaccuaacuug

SEQ ID NO: 3532449 - RNA, 19 nt, Human
cuugacaaacuucuuucac

SEQ ID NO: 3532450 - RNA, 14 nt, Human
cuugacaacaucug

SEQ ID NO: 3532451 - RNA, 22 nt, Human
cuugacaaguugcgacggagag

SEQ ID NO: 3532452 - RNA, 20 nt, Human
cuugacacauaguuuuucag

SEQ ID NO: 3532453 - RNA, 16 nt, Human
cuugacagagccugcc

SEQ ID NO: 3532454 - RNA, 19 nt, Human
cuugacagagccugcccca

SEQ ID NO: 3532455 - RNA, 12 nt, Human
cuugacagggca

SEQ ID NO: 3532456 - RNA, 19 nt, Human
cuugaccaagcaggaagcu

SEQ ID NO: 3532457 - RNA, 20 nt, Human
cuugaccaagcaggaagcuc

SEQ ID NO: 3532458 - RNA, 11 nt, Human
cuugaccagca

SEQ ID NO: 3532459 - RNA, 20 nt, Human
cuugaccauucuccaccugc

SEQ ID NO: 3532460 - RNA, 13 nt, Human
cuugacccugagc

SEQ ID NO: 3532461 - RNA, 14 nt, Human
cuugacccugagcu

SEQ ID NO: 3532462 - RNA, 18 nt, Human
cuugacccugcacccucc

SEQ ID NO: 3532463 - RNA, 18 nt, Human
cuugaccucacucagaag

SEQ ID NO: 3532464 - RNA, 23 nt, Human
cuugaccugaggcuguggucaca

SEQ ID NO: 3532465 - RNA, 18 nt, Human
cuugaccugcauuguaaa

SEQ ID NO: 3532466 - RNA, 16 nt, Human
cuugaccuuuguacag

SEQ ID NO: 3532467 - RNA, 21 nt, Human
cuugaccuuuguacagcccag

SEQ ID NO: 3532468 - RNA, 19 nt, Human
cuugacguauuauuguccu

SEQ ID NO: 3532469 - RNA, 20 nt, Human
cuugacuaaaaaaaaaagaa

SEQ ID NO: 3532470 - RNA, 21 nt, Human
cuugacucccaaguuuccaua

SEQ ID NO: 3532471 - RNA, 20 nt, Human
cuugacucuuguuuucaguu

SEQ ID NO: 3532472 - RNA, 11 nt, Human
cuugagaaacc

SEQ ID NO: 3532473 - RNA, 12 nt, Human
cuugagaaaccu

SEQ ID NO: 3532474 - RNA, 23 nt, Human
cuugagaagaccucaccuagaaa

SEQ ID NO: 3532475 - RNA, 22 nt, Human
cuugagacacggagcccagccc

SEQ ID NO: 3532476 - RNA, 16 nt, Human
cuugagaccucagcca

SEQ ID NO: 3532477 - RNA, 18 nt, Human
cuugagaccucagccaug

SEQ ID NO: 3532478 - RNA, 19 nt, Human
cuugagcaaguuccuucug

SEQ ID NO: 3532479 - RNA, 20 nt, Human
cuugagcaaguuccuucugg

SEQ ID NO: 3532480 - RNA, 16 nt, Human
cuugagcaguggcugg

SEQ ID NO: 3532481 - RNA, 21 nt, Human
cuugagcaguggcugguccag

SEQ ID NO: 3532482 - RNA, 18 nt, Human
cuugagccaggaggccug

SEQ ID NO: 3532483 - RNA, 13 nt, Human
cuugagcccagga

SEQ ID NO: 3532484 - RNA, 15 nt, Human
cuugagcccaggagu

SEQ ID NO: 3532485 - RNA, 17 nt, Human
cuugagccgggccccug

SEQ ID NO: 3532486 - RNA, 17 nt, Human
cuugagccuugaacuuu

SEQ ID NO: 3532487 - RNA, 14 nt, Human
cuugagcucuauua

SEQ ID NO: 3532488 - RNA, 15 nt, Human
cuugagcucuauuau

SEQ ID NO: 3532489 - RNA, 16 nt, Human
cuugagcucuauuaug

SEQ ID NO: 3532490 - RNA, 18 nt, Human
cuugagcucuauuaugaa

SEQ ID NO: 3532491 - RNA, 12 nt, Human
cuugagcuggcc

SEQ ID NO: 3532492 - RNA, 14 nt, Human
cuugagcuggccuc

SEQ ID NO: 3532493 - RNA, 23 nt, Human
cuugagcuggccucucuagcaca

SEQ ID NO: 3532494 - RNA, 20 nt, Human
cuugagcuuggcagcugaac

SEQ ID NO: 3532495 - RNA, 21 nt, Human
cuugagcuuggcagcugaacu

SEQ ID NO: 3532496 - RNA, 13 nt, Human
cuugaggaaacaa

SEQ ID NO: 3532497 - RNA, 20 nt, Human
cuugaggaaacaacagcuuu

SEQ ID NO: 3532498 - RNA, 15 nt, Human
cuugaggacacaugu

SEQ ID NO: 3532499 - RNA, 17 nt, Human
cuugaggacacaugucc

SEQ ID NO: 3532500 - RNA, 14 nt, Human
cuugaggccaggag

SEQ ID NO: 3532501 - RNA, 14 nt, Human
cuugagggcccaga

SEQ ID NO: 3532502 - RNA, 16 nt, Human
cuugagggcccagagc

SEQ ID NO: 3532503 - RNA, 12 nt, Human
cuugagggcugc

SEQ ID NO: 3532504 - RNA, 13 nt, Human
cuugagggcugca

SEQ ID NO: 3532505 - RNA, 21 nt, Human
cuugaggggaagcuagucuuu

SEQ ID NO: 3532506 - RNA, 15 nt, Human
cuugaggggaccagg

SEQ ID NO: 3532507 - RNA, 17 nt, Human
cuugaggggaccaggag

SEQ ID NO: 3532508 - RNA, 18 nt, Human
cuugaggggaccaggagu

SEQ ID NO: 3532509 - RNA, 15 nt, Human
cuugaggguugggcu

SEQ ID NO: 3532510 - RNA, 19 nt, Human
cuugaggguugggcuggug

SEQ ID NO: 3532511 - RNA, 21 nt, Human
cuugaggguugggcugguguc

SEQ ID NO: 3532512 - RNA, 14 nt, Human
cuugaggucucagc

SEQ ID NO: 3532513 - RNA, 17 nt, Human
cuugaggucuuuugaca

SEQ ID NO: 3532514 - RNA, 18 nt, Human
cuugaggucuuuugacau

SEQ ID NO: 3532515 - RNA, 14 nt, Human
gcugcuccuccagg

SEQ ID NO: 3532516 - RNA, 18 nt, Human
gcugcucggggugcacag

SEQ ID NO: 3532517 - RNA, 23 nt, Human
gcugcucuauuguagcauuucuu

SEQ ID NO: 3532518 - RNA, 20 nt, Human
gcugcucucaaaccccugac

SEQ ID NO: 3532519 - RNA, 14 nt, Human
gcugcucugcccag

SEQ ID NO: 3532520 - RNA, 15 nt, Human
gcugcucugcccaga

SEQ ID NO: 3532521 - RNA, 17 nt, Human
gcugcucugcccagagc

SEQ ID NO: 3532522 - RNA, 20 nt, Human
gcugcucugcccagagcugg

SEQ ID NO: 3532523 - RNA, 12 nt, Human
gcugcucuggaa

SEQ ID NO: 3532524 - RNA, 18 nt, Human
gcugcucuggaauuugca

SEQ ID NO: 3532525 - RNA, 20 nt, Human
gcugcucugugaccagggac

SEQ ID NO: 3532526 - RNA, 22 nt, Human
gcugcucuuaugccauuuguuu

SEQ ID NO: 3532527 - RNA, 10 nt, Human
gcugcucuuc

SEQ ID NO: 3532528 - RNA, 21 nt, Human
gcugcucuuggcuggacccag

SEQ ID NO: 3532529 - RNA, 18 nt, Human
gcugcugaaacaacaaau

SEQ ID NO: 3532530 - RNA, 14 nt, Human
gcugcugaaggcuc

SEQ ID NO: 3532531 - RNA, 23 nt, Human
gcugcugaccaauugugcugcca

SEQ ID NO: 3532532 - RNA, 18 nt, Human
gcugcugagauccuggac

SEQ ID NO: 3532533 - RNA, 20 nt, Human
gcugcugagccgcagagaag

SEQ ID NO: 3532534 - RNA, 15 nt, Human
gcugcugcccaggcc

SEQ ID NO: 3532535 - RNA, 17 nt, Human
gcugcugcccccacccc

SEQ ID NO: 3532536 - RNA, 13 nt, Human
gcugcugccucuu

SEQ ID NO: 3532537 - RNA, 16 nt, Human
gcugcugccugccugg

SEQ ID NO: 3532538 - RNA, 13 nt, Human
gcugcugccuggc

SEQ ID NO: 3532539 - RNA, 21 nt, Human
gcugcugcguggcauagccca

SEQ ID NO: 3532540 - RNA, 22 nt, Human
gcugcugcucuuggcuggaccc

SEQ ID NO: 3532541 - RNA, 15 nt, Human
gcugcugcugggcuc

SEQ ID NO: 3532542 - RNA, 16 nt, Human
gcugcugcugggcuca

SEQ ID NO: 3532543 - RNA, 21 nt, Human
gcugcuggacaguaucacugu

SEQ ID NO: 3532544 - RNA, 22 nt, Human
gcugcuggccaaauagcaaaga

SEQ ID NO: 3532545 - RNA, 20 nt, Human
gcugcugggauggugggcuu

SEQ ID NO: 3532546 - RNA, 13 nt, Human
gcugcugggcuca

SEQ ID NO: 3532547 - RNA, 16 nt, Human
gcugcugggcucagug

SEQ ID NO: 3532548 - RNA, 19 nt, Human
gcugcugggcucagugaag

SEQ ID NO: 3532549 - RNA, 20 nt, Human
gcugcuggggccucagacga

SEQ ID NO: 3532550 - RNA, 17 nt, Human
gcugcuggugcacagcc

SEQ ID NO: 3532551 - RNA, 16 nt, Human
gcugcugucaccucuc

SEQ ID NO: 3532552 - RNA, 18 nt, Human
gcugcugucccucccccu

SEQ ID NO: 3532553 - RNA, 22 nt, Human
gcugcugucugggugcuacugg

SEQ ID NO: 3532554 - RNA, 20 nt, Human
gcugcuguguguggcuucug

SEQ ID NO: 3532555 - RNA, 20 nt, Human
gcugcuguuacuguuaacca

SEQ ID NO: 3532556 - RNA, 21 nt, Human
gcugcuucaaggauccugagc

SEQ ID NO: 3532557 - RNA, 13 nt, Human
gcugcuuccagug

SEQ ID NO: 3532558 - RNA, 15 nt, Human
gcugcuucccucugc

SEQ ID NO: 3532559 - RNA, 21 nt, Human
gcugcuucccucugccugucc

SEQ ID NO: 3532560 - RNA, 13 nt, Human
gcugcuuccuccu

SEQ ID NO: 3532561 - RNA, 15 nt, Human
gcugcuuccuccugg

SEQ ID NO: 3532562 - RNA, 21 nt, Human
gcugcuucucccacuuggcca

SEQ ID NO: 3532563 - RNA, 22 nt, Human
gcugcuucucccaggcaaggcu

SEQ ID NO: 3532564 - RNA, 12 nt, Human
gcugcuugcccc

SEQ ID NO: 3532565 - RNA, 13 nt, Human
gcugcuuggccuu

SEQ ID NO: 3532566 - RNA, 17 nt, Human
gcugcuuuccccugugg

SEQ ID NO: 3532567 - RNA, 20 nt, Human
gcugcuuuccccugugggga

SEQ ID NO: 3532568 - RNA, 21 nt, Human
gcugcuuuccccuguggggau

SEQ ID NO: 3532569 - RNA, 19 nt, Human
gcugcuuucuguugucauu

SEQ ID NO: 3532570 - RNA, 17 nt, Human
cuugauucccuuguuau

SEQ ID NO: 3532571 - RNA, 17 nt, Human
cuugauucugcaguaaa

SEQ ID NO: 3532572 - RNA, 20 nt, Human
cuugauucugcaguaaaucu

SEQ ID NO: 3532573 - RNA, 23 nt, Human
cuugauuggggaauuaaaaguca

SEQ ID NO: 3532574 - RNA, 19 nt, Human
cuugauugguguugccagu

SEQ ID NO: 3532575 - RNA, 23 nt, Human
cuugauuuuccaucuaaaaauau

SEQ ID NO: 3532576 - RNA, 16 nt, Human
cuugcaaaaaggguca

SEQ ID NO: 3532577 - RNA, 15 nt, Human
cuugcaaaaucaguu

SEQ ID NO: 3532578 - RNA, 12 nt, Human
cuugcaaaguau

SEQ ID NO: 3532579 - RNA, 22 nt, Human
cuugcaaaguaucccuacugua

SEQ ID NO: 3532580 - RNA, 14 nt, Human
cuugcaacacacag

SEQ ID NO: 3532581 - RNA, 17 nt, Human
cuugcaagcaugcuugu

SEQ ID NO: 3532582 - RNA, 22 nt, Human
cuugcaagggcggccuuuccca

SEQ ID NO: 3532583 - RNA, 18 nt, Human
cuugcaauggcagccuug

SEQ ID NO: 3532584 - RNA, 20 nt, Human
cuugcacacaucaucuguaa

SEQ ID NO: 3532585 - RNA, 18 nt, Human
cuugcaccccucacucug

SEQ ID NO: 3532586 - RNA, 20 nt, Human
cuugcaccccucacucuggc

SEQ ID NO: 3532587 - RNA, 15 nt, Human
cuugcacccgccucu

SEQ ID NO: 3532588 - RNA, 13 nt, Human
cuugcaccugcau

SEQ ID NO: 3532589 - RNA, 14 nt, Human
cuugcaccugcauc

SEQ ID NO: 3532590 - RNA, 21 nt, Human
cuugcacgcgcccuuucuacc

SEQ ID NO: 3532591 - RNA, 15 nt, Human
cuugcagaacugcca

SEQ ID NO: 3532592 - RNA, 12 nt, Human
cuugcagaacuu

SEQ ID NO: 3532593 - RNA, 18 nt, Human
cuugcagagaagccuugg

SEQ ID NO: 3532594 - RNA, 13 nt, Human
cuugcagagcuug

SEQ ID NO: 3532595 - RNA, 13 nt, Human
cuugcagcaggau

SEQ ID NO: 3532596 - RNA, 23 nt, Human
cuugcagcaggaucuagaggggg

SEQ ID NO: 3532597 - RNA, 18 nt, Human
cuugcaguaucggcacug

SEQ ID NO: 3532598 - RNA, 20 nt, Human
cuugcaguaucggcacugua

SEQ ID NO: 3532599 - RNA, 20 nt, Human
cuugcaguggaagauacuug

SEQ ID NO: 3532600 - RNA, 18 nt, Human
cuugcaguucagcaccac

SEQ ID NO: 3532601 - RNA, 20 nt, Human
cuugcauaauaagcuaaaga

SEQ ID NO: 3532602 - RNA, 15 nt, Human
cuugcauacaaacaa

SEQ ID NO: 3532603 - RNA, 13 nt, Human
cuugcaucaaggg

SEQ ID NO: 3532604 - RNA, 14 nt, Human
cuugcaucaagggg

SEQ ID NO: 3532605 - RNA, 17 nt, Human
cuugcaucaagggguca

SEQ ID NO: 3532606 - RNA, 14 nt, Human
cuugcauccuuccu

SEQ ID NO: 3532607 - RNA, 17 nt, Human
cuugcaucguggagaca

SEQ ID NO: 3532608 - RNA, 20 nt, Human
cuugcaugaagagaagcaau

SEQ ID NO: 3532609 - RNA, 20 nt, Human
cuugcaugguuuggagcuga

SEQ ID NO: 3532610 - RNA, 14 nt, Human
cuugcauucccagu

SEQ ID NO: 3532611 - RNA, 13 nt, Human
cuugcauuuuugc

SEQ ID NO: 3532612 - RNA, 20 nt, Human
cuugcauuuuugcaggagca

SEQ ID NO: 3532613 - RNA, 21 nt, Human
cuugccaaaguacagaauuug

SEQ ID NO: 3532614 - RNA, 17 nt, Human
cuugccaaggcagaggc

SEQ ID NO: 3532615 - RNA, 20 nt, Human
cuugccaaggcagaggccug

SEQ ID NO: 3532616 - RNA, 23 nt, Human
cuugccaaugaggucugaaaugg

SEQ ID NO: 3532617 - RNA, 23 nt, Human
cuugccacaccccccaccccuag

SEQ ID NO: 3532618 - RNA, 14 nt, Human
cuugccacagcucu

SEQ ID NO: 3532619 - RNA, 20 nt, Human
cuugccaccccacccucccu

SEQ ID NO: 3532620 - RNA, 21 nt, Human
cuugccaccccacccucccug

SEQ ID NO: 3532621 - RNA, 14 nt, Human
cuugccacugccuc

SEQ ID NO: 3532622 - RNA, 16 nt, Human
cuugccagcugcugag

SEQ ID NO: 3532623 - RNA, 18 nt, Human
cuugccagcugcugagcc

SEQ ID NO: 3532624 - RNA, 23 nt, Human
cuugccaggguuucgagaagcug

SEQ ID NO: 3532625 - RNA, 17 nt, Human
cuugccaucagugaaaa

SEQ ID NO: 3532626 - RNA, 14 nt, Human
cuugccaucccucc

SEQ ID NO: 3532627 - RNA, 15 nt, Human
cuugccaucccuccc

SEQ ID NO: 3532628 - RNA, 22 nt, Human
cuugccaucccucccuccaccu

SEQ ID NO: 3532629 - RNA, 17 nt, Human
cuugccauuccaaaaua

SEQ ID NO: 3532630 - RNA, 14 nt, Human
cuugcccaccccac

SEQ ID NO: 3532631 - RNA, 15 nt, Human
cuugcccaccccacc

SEQ ID NO: 3532632 - RNA, 16 nt, Human
cuugcccacuccugcu

SEQ ID NO: 3532633 - RNA, 16 nt, Human
cuugcccagccuggau

SEQ ID NO: 3532634 - RNA, 15 nt, Human
cuugcccagggcuca

SEQ ID NO: 3532635 - RNA, 19 nt, Human
cuugcccagggcucagccu

SEQ ID NO: 3532636 - RNA, 21 nt, Human
cuugcccagggcucagccugg

SEQ ID NO: 3532637 - RNA, 12 nt, Human
cuugcccauccu

SEQ ID NO: 3532638 - RNA, 16 nt, Human
cuugcccauccugacu

SEQ ID NO: 3532639 - RNA, 14 nt, Human
cuugccccaacccc

SEQ ID NO: 3532640 - RNA, 17 nt, Human
cuugccccaacccuucu

SEQ ID NO: 3532641 - RNA, 17 nt, Human
cuugcccggauucuggg

SEQ ID NO: 3532642 - RNA, 15 nt, Human
cuugcccuaagcaga

SEQ ID NO: 3532643 - RNA, 18 nt, Human
cuugcccuaagcagaaag

SEQ ID NO: 3532644 - RNA, 19 nt, Human
cuugcccuagauaguuuau

SEQ ID NO: 3532645 - RNA, 14 nt, Human
cuugcccugaccuc

SEQ ID NO: 3532646 - RNA, 18 nt, Human
cuugcccugaccucccag

SEQ ID NO: 3532647 - RNA, 13 nt, Human
cuugcccugcucc

SEQ ID NO: 3532648 - RNA, 19 nt, Human
cuugcccuucccugucccu

SEQ ID NO: 3532649 - RNA, 16 nt, Human
cuugcccuugcccuga

SEQ ID NO: 3532650 - RNA, 15 nt, Human
cuugccgaaacugga

SEQ ID NO: 3532651 - RNA, 13 nt, Human
cuugccgaggagc

SEQ ID NO: 3532652 - RNA, 19 nt, Human
cuugccgucuaccugaggg

SEQ ID NO: 3532653 - RNA, 20 nt, Human
cuugccgucuaccugagggg

SEQ ID NO: 3532654 - RNA, 14 nt, Human
cuugccuagggccu

SEQ ID NO: 3532655 - RNA, 16 nt, Human
cuugccuagggccugg

SEQ ID NO: 3532656 - RNA, 18 nt, Human
cuugccuagggccugguc

SEQ ID NO: 3532657 - RNA, 17 nt, Human
cuugccucaaccuccca

SEQ ID NO: 3532658 - RNA, 18 nt, Human
cuugccucaaccucccaa

SEQ ID NO: 3532659 - RNA, 17 nt, Human
cuugccucaaugccagu

SEQ ID NO: 3532660 - RNA, 22 nt, Human
gcuuccauuuuccuacaggcag

SEQ ID NO: 3532661 - RNA, 22 nt, Human
gcuucccaccucccugcccagg

SEQ ID NO: 3532662 - RNA, 18 nt, Human
gcuucccaguggcugcug

SEQ ID NO: 3532663 - RNA, 19 nt, Human
gcuucccaguggcugcugc

SEQ ID NO: 3532664 - RNA, 20 nt, Human
gcuucccaguggcugcugcc

SEQ ID NO: 3532665 - RNA, 18 nt, Human
gcuucccauccccagcga

SEQ ID NO: 3532666 - RNA, 16 nt, Human
gcuuccccucucuccu

SEQ ID NO: 3532667 - RNA, 18 nt, Human
gcuucccgcucagcccuc

SEQ ID NO: 3532668 - RNA, 13 nt, Human
gcuucccucugcc

SEQ ID NO: 3532669 - RNA, 19 nt, Human
gcuucccucugccuguccc

SEQ ID NO: 3532670 - RNA, 20 nt, Human
gcuucccucugccugucccu

SEQ ID NO: 3532671 - RNA, 17 nt, Human
gcuucccugaaagacug

SEQ ID NO: 3532672 - RNA, 15 nt, Human
gcuucccugaagcuc

SEQ ID NO: 3532673 - RNA, 15 nt, Human
gcuucccuuacuuug

SEQ ID NO: 3532674 - RNA, 23 nt, Human
gcuuccuacccacaccucugcca

SEQ ID NO: 3532675 - RNA, 18 nt, Human
gcuuccuagaaguuacug

SEQ ID NO: 3532676 - RNA, 23 nt, Human
gcuuccuagaaguuacugaaugc

SEQ ID NO: 3532677 - RNA, 21 nt, Human
gcuuccuccuccccaacugug

SEQ ID NO: 3532678 - RNA, 12 nt, Human
gcuuccuccugg

SEQ ID NO: 3532679 - RNA, 13 nt, Human
gcuuccuccugga

SEQ ID NO: 3532680 - RNA, 16 nt, Human
gcuuccuccuggaaau

SEQ ID NO: 3532681 - RNA, 17 nt, Human
gcuuccucuagaagcca

SEQ ID NO: 3532682 - RNA, 23 nt, Human
gcuuccucuagaagccaagggaa

SEQ ID NO: 3532683 - RNA, 23 nt, Human
gcuuccugaggggagacagagca

SEQ ID NO: 3532684 - RNA, 21 nt, Human
gcuuccugcuugccaaggcag

SEQ ID NO: 3532685 - RNA, 12 nt, Human
gcuuccuggagc

SEQ ID NO: 3532686 - RNA, 22 nt, Human
gcuuccuggagcagaagcagca

SEQ ID NO: 3532687 - RNA, 20 nt, Human
gcuuccuguccccaucuguc

SEQ ID NO: 3532688 - RNA, 13 nt, Human
gcuuccuucagag

SEQ ID NO: 3532689 - RNA, 16 nt, Human
gcuuccuucagagagc

SEQ ID NO: 3532690 - RNA, 17 nt, Human
gcuuccuucagagagca

SEQ ID NO: 3532691 - RNA, 19 nt, Human
gcuuccuucagagagcagu

SEQ ID NO: 3532692 - RNA, 13 nt, Human
gcuuccuucauuu

SEQ ID NO: 3532693 - RNA, 14 nt, Human
gcuuccuugccuga

SEQ ID NO: 3532694 - RNA, 22 nt, Human
gcuuccuuggcaucacagggca

SEQ ID NO: 3532695 - RNA, 23 nt, Human
gcuuccuuuguuuuuuuuuccug

SEQ ID NO: 3532696 - RNA, 16 nt, Human
gcuucgacuuuucuua

SEQ ID NO: 3532697 - RNA, 16 nt, Human
gcuucuaaguaaauac

SEQ ID NO: 3532698 - RNA, 22 nt, Human
gcuucuaaguaaauacaauuuu

SEQ ID NO: 3532699 - RNA, 21 nt, Human
gcuucuaauauuuauugcuuu

SEQ ID NO: 3532700 - RNA, 16 nt, Human
gcuucuagcugacuug

SEQ ID NO: 3532701 - RNA, 15 nt, Human
gcuucuagggaccag

SEQ ID NO: 3532702 - RNA, 17 nt, Human
gcuucucacugccaugc

SEQ ID NO: 3532703 - RNA, 22 nt, Human
gcuucucagauuucugaggaaa

SEQ ID NO: 3532704 - RNA, 17 nt, Human
gcuucucauccugcagg

SEQ ID NO: 3532705 - RNA, 18 nt, Human
gcuucucauccugcaggc

SEQ ID NO: 3532706 - RNA, 16 nt, Human
gcuucucaucuuguga

SEQ ID NO: 3532707 - RNA, 20 nt, Human
gcuucuccaaaaaucugccu

SEQ ID NO: 3532708 - RNA, 17 nt, Human
gcuucucccaggcaagg

SEQ ID NO: 3532709 - RNA, 15 nt, Human
gcuucuccccagaau

SEQ ID NO: 3532710 - RNA, 22 nt, Human
gcuucucccccacccccuaggg

SEQ ID NO: 3532711 - RNA, 17 nt, Human
gcuucuccgccagccuc

SEQ ID NO: 3532712 - RNA, 20 nt, Human
gcuucuccgccagccuccuc

SEQ ID NO: 3532713 - RNA, 13 nt, Human
gcuucuccucucc

SEQ ID NO: 3532714 - RNA, 18 nt, Human
gcuucucuagcucucuag

SEQ ID NO: 3532715 - RNA, 19 nt, Human
gcuucucuagcucucuagg

SEQ ID NO: 3532716 - RNA, 21 nt, Human
gcuucucuagcucucuaggcc

SEQ ID NO: 3532717 - RNA, 22 nt, Human
gcuucucuagcucucuaggccu

SEQ ID NO: 3532718 - RNA, 13 nt, Human
gcuucucucucac

SEQ ID NO: 3532719 - RNA, 16 nt, Human
gcuucucucucaccag

SEQ ID NO: 3532720 - RNA, 14 nt, Human
gcuucucugacuuc

SEQ ID NO: 3532721 - RNA, 22 nt, Human
gcuucucugacuucugccugga

SEQ ID NO: 3532722 - RNA, 17 nt, Human
gcuucucuuuaacucag

SEQ ID NO: 3532723 - RNA, 19 nt, Human
gcuucucuuuaacucagga

SEQ ID NO: 3532724 - RNA, 21 nt, Human
gcuucucuuuaacucaggacu

SEQ ID NO: 3532725 - RNA, 23 nt, Human
gcuucucuuuaacucaggacucc

SEQ ID NO: 3532726 - RNA, 19 nt, Human
gcuucugaaugcugcuacu

SEQ ID NO: 3532727 - RNA, 15 nt, Human
gcuucugaccucagc

SEQ ID NO: 3532728 - RNA, 17 nt, Human
gcuucugaugaaucuug

SEQ ID NO: 3532729 - RNA, 14 nt, Human
gcuucugcacccuc

SEQ ID NO: 3532730 - RNA, 14 nt, Human
gcuucugcaccuua

SEQ ID NO: 3532731 - RNA, 19 nt, Human
gcuucugcccccugcagaa

SEQ ID NO: 3532732 - RNA, 13 nt, Human
gcuucugccugca

SEQ ID NO: 3532733 - RNA, 15 nt, Human
gcuucugcuggggcc

SEQ ID NO: 3532734 - RNA, 18 nt, Human
gcuucugcuggggccugg

SEQ ID NO: 3532735 - RNA, 13 nt, Human
gcuucugcuuuuc

SEQ ID NO: 3532736 - RNA, 19 nt, Human
gcuucugcuuuucugcccu

SEQ ID NO: 3532737 - RNA, 12 nt, Human
gcuucuggagcc

SEQ ID NO: 3532738 - RNA, 16 nt, Human
gcuucuggccaggaag

SEQ ID NO: 3532739 - RNA, 18 nt, Human
gcuucuggccaggaagcu

SEQ ID NO: 3532740 - RNA, 12 nt, Human
gcuucugggaag

SEQ ID NO: 3532741 - RNA, 18 nt, Human
gcuucugggguccccagg

SEQ ID NO: 3532742 - RNA, 19 nt, Human
gcuucugggguccccaggg

SEQ ID NO: 3532743 - RNA, 20 nt, Human
gcuucugggguccccagggc

SEQ ID NO: 3532744 - RNA, 15 nt, Human
gcuucugguacucuc

SEQ ID NO: 3532745 - RNA, 15 nt, Human
gcuucugucuccagc

SEQ ID NO: 3532746 - RNA, 20 nt, Human
gcuucugugaugagcugauc

SEQ ID NO: 3532747 - RNA, 15 nt, Human
gcuucugugcccaga

SEQ ID NO: 3532748 - RNA, 16 nt, Human
gcuucuguugcugccu

SEQ ID NO: 3532749 - RNA, 17 nt, Human
gcuucuguugcugccuc

SEQ ID NO: 3532750 - RNA, 19 nt, Human
gcuucuguuuuauaauuuu

SEQ ID NO: 3532751 - RNA, 19 nt, Human
gcuucuuaauauaacugcc

SEQ ID NO: 3532752 - RNA, 22 nt, Human
gcuucuuaauauaacugccuua

SEQ ID NO: 3532753 - RNA, 23 nt, Human
gcuucuuaaucuuuucacaaaua

SEQ ID NO: 3532754 - RNA, 20 nt, Human
gcuucuuacuauuaagcagu

SEQ ID NO: 3532755 - RNA, 16 nt, Human
gcuucuucagagacuc

SEQ ID NO: 3532756 - RNA, 23 nt, Human
gcuucuucagagacuccugcagg

SEQ ID NO: 3532757 - RNA, 19 nt, Human
gcuucuucagaucagugcu

SEQ ID NO: 3532758 - RNA, 19 nt, Human
gcuucuucuccuaugugua

SEQ ID NO: 3532759 - RNA, 13 nt, Human
gcuucuugccucu

SEQ ID NO: 3532760 - RNA, 20 nt, Human
gcuucuugccucugugcugu

SEQ ID NO: 3532761 - RNA, 12 nt, Human
gcuucuugugaa

SEQ ID NO: 3532762 - RNA, 23 nt, Human
gcuucuuucaagggcuuuccugu

SEQ ID NO: 3532763 - RNA, 23 nt, Human
gcuucuuucuuugggaauauuug

SEQ ID NO: 3532764 - RNA, 13 nt, Human
gcuucuuugccaa

SEQ ID NO: 3532765 - RNA, 17 nt, Human
gcuucuuuucuuuguau

SEQ ID NO: 3532766 - RNA, 17 nt, Human
gcuugaaaaaugugcaa

SEQ ID NO: 3532767 - RNA, 13 nt, Human
gcuugaaagaaaa

SEQ ID NO: 3532768 - RNA, 18 nt, Human
gcuugaaggcccugcuga

SEQ ID NO: 3532769 - RNA, 17 nt, Human
gcuugaccgugaggcca

SEQ ID NO: 3532770 - RNA, 19 nt, Human
gcuugaccgugaggccaga

SEQ ID NO: 3532771 - RNA, 23 nt, Human
gcuugaccgugaggccagagaca

SEQ ID NO: 3532772 - RNA, 22 nt, Human
gcuugaccuuuaagagaaauga

SEQ ID NO: 3532773 - RNA, 16 nt, Human
gcuugacucaggauuu

SEQ ID NO: 3532774 - RNA, 15 nt, Human
gcuugacuuuuguau

SEQ ID NO: 3532775 - RNA, 23 nt, Human
ggacugugugcucaggagcccug

SEQ ID NO: 3532776 - RNA, 23 nt, Human
ggacuguuuuuuccugagcuugg

SEQ ID NO: 3532777 - RNA, 17 nt, Human
ggacuuaacggcuccag

SEQ ID NO: 3532778 - RNA, 19 nt, Human
ggacuuaacggcuccagga

SEQ ID NO: 3532779 - RNA, 17 nt, Human
ggacuuagaaagcaggg

SEQ ID NO: 3532780 - RNA, 20 nt, Human
ggacuuagaaagcaggggcu

SEQ ID NO: 3532781 - RNA, 19 nt, Human
ggacuuccccggagggcug

SEQ ID NO: 3532782 - RNA, 20 nt, Human
ggacuuccccggagggcugc

SEQ ID NO: 3532783 - RNA, 19 nt, Human
ggacuuccuguccagcucc

SEQ ID NO: 3532784 - RNA, 23 nt, Human
ggacuucuaccugcccucaaggg

SEQ ID NO: 3532785 - RNA, 13 nt, Human
ggacuugaaguug

SEQ ID NO: 3532786 - RNA, 16 nt, Human
ggacuuggagguagcu

SEQ ID NO: 3532787 - RNA, 15 nt, Human
ggacuuggcgcgccc

SEQ ID NO: 3532788 - RNA, 11 nt, Human
ggacuugggug

SEQ ID NO: 3532789 - RNA, 12 nt, Human
ggacuuguuaga

SEQ ID NO: 3532790 - RNA, 16 nt, Human
ggacuuuccacccccu

SEQ ID NO: 3532791 - RNA, 22 nt, Human
ggacuuucucuaauaauaaaua

SEQ ID NO: 3532792 - RNA, 21 nt, Human
ggacuuucuuuucgccguggc

SEQ ID NO: 3532793 - RNA, 23 nt, Human
ggacuuugcacacuuuggcccag

SEQ ID NO: 3532794 - RNA, 17 nt, Human
ggacuuugcagccggca

SEQ ID NO: 3532795 - RNA, 13 nt, Human
ggacuuuguuaca

SEQ ID NO: 3532796 - RNA, 15 nt, Human
ggacuuuuauuuugg

SEQ ID NO: 3532797 - RNA, 18 nt, Human
ggacuuuucguuaacauu

SEQ ID NO: 3532798 - RNA, 16 nt, Human
ggagaaacagagacag

SEQ ID NO: 3532799 - RNA, 13 nt, Human
ggagaaacuggaa

SEQ ID NO: 3532800 - RNA, 17 nt, Human
ggagaaagcacugaccu

SEQ ID NO: 3532801 - RNA, 14 nt, Human
ggagaaagcugacu

SEQ ID NO: 3532802 - RNA, 22 nt, Human
ggagaaagcugacuuggcuggu

SEQ ID NO: 3532803 - RNA, 13 nt, Human
ggagaaaggaccc

SEQ ID NO: 3532804 - RNA, 16 nt, Human
cuuuaauauaaaugca

SEQ ID NO: 3532805 - RNA, 19 nt, Human
cuuuaauauaaaugcaaau

SEQ ID NO: 3532806 - RNA, 21 nt, Human
cuuuaauaucaucaguauuga

SEQ ID NO: 3532807 - RNA, 14 nt, Human
cuuuaauaugaaau

SEQ ID NO: 3532808 - RNA, 15 nt, Human
cuuuaauauguauuu

SEQ ID NO: 3532809 - RNA, 21 nt, Human
cuuuaaugauaugcuuguaac

SEQ ID NO: 3532810 - RNA, 14 nt, Human
cuuuaaugcaucua

SEQ ID NO: 3532811 - RNA, 12 nt, Human
cuuuaaugcuuu

SEQ ID NO: 3532812 - RNA, 19 nt, Human
cuuuaauggacuuauuucu

SEQ ID NO: 3532813 - RNA, 17 nt, Human
cuuuaaugucacaggca

SEQ ID NO: 3532814 - RNA, 22 nt, Human
cuuuaauuaaaaccugggauua

SEQ ID NO: 3532815 - RNA, 16 nt, Human
cuuuaauuccaugaau

SEQ ID NO: 3532816 - RNA, 19 nt, Human
cuuuaauucucuuucaaag

SEQ ID NO: 3532817 - RNA, 15 nt, Human
cuuuaauuuauguaa

SEQ ID NO: 3532818 - RNA, 23 nt, Human
cuuuacaaaacaaacucauucau

SEQ ID NO: 3532819 - RNA, 13 nt, Human
cuuuacaaauauu

SEQ ID NO: 3532820 - RNA, 22 nt, Human
cuuuacaagauggguccaggau

SEQ ID NO: 3532821 - RNA, 15 nt, Human
cuuuacacucaggcu

SEQ ID NO: 3532822 - RNA, 21 nt, Human
cuuuacagguauuuauaauau

SEQ ID NO: 3532823 - RNA, 17 nt, Human
cuuuacauaugcuuuaa

SEQ ID NO: 3532824 - RNA, 14 nt, Human
cuuuaccaaacagc

SEQ ID NO: 3532825 - RNA, 20 nt, Human
cuuuaccaaacagcaaacca

SEQ ID NO: 3532826 - RNA, 23 nt, Human
cuuuaccaaacagcaaaccaaga

SEQ ID NO: 3532827 - RNA, 14 nt, Human
cuuuaccaccccca

SEQ ID NO: 3532828 - RNA, 16 nt, Human
cuuuaccacccccaca

SEQ ID NO: 3532829 - RNA, 18 nt, Human
cuuuacccaccuagaaca

SEQ ID NO: 3532830 - RNA, 20 nt, Human
cuuuacccucaucugucugg

SEQ ID NO: 3532831 - RNA, 14 nt, Human
cuuuacccucuuug

SEQ ID NO: 3532832 - RNA, 16 nt, Human
cuuuacccuugagccc

SEQ ID NO: 3532833 - RNA, 14 nt, Human
cuuuaccuguauac

SEQ ID NO: 3532834 - RNA, 17 nt, Human
cuuuaccuuuucagggc

SEQ ID NO: 3532835 - RNA, 20 nt, Human
cuuuaccuuuucagggcugg

SEQ ID NO: 3532836 - RNA, 16 nt, Human
cuuuaccuuuuuucuu

SEQ ID NO: 3532837 - RNA, 22 nt, Human
cuuuacgcccaucucaggacac

SEQ ID NO: 3532838 - RNA, 22 nt, Human
cuuuacguguuuaaaaaaaagc

SEQ ID NO: 3532839 - RNA, 18 nt, Human
cuuuacuaagaugacauu

SEQ ID NO: 3532840 - RNA, 13 nt, Human
cuuuacucccaag

SEQ ID NO: 3532841 - RNA, 17 nt, Human
cuuuacuccucacacuu

SEQ ID NO: 3532842 - RNA, 15 nt, Human
cuuuacuguuuguua

SEQ ID NO: 3532843 - RNA, 20 nt, Human
cuuuacuugucuuucugggg

SEQ ID NO: 3532844 - RNA, 22 nt, Human
cuuuacuuucccuugcuuuucc

SEQ ID NO: 3532845 - RNA, 23 nt, Human
cuuuacuuucccuugcuuuuccc

SEQ ID NO: 3532846 - RNA, 14 nt, Human
cuuuacuuuuaaac

SEQ ID NO: 3532847 - RNA, 18 nt, Human
cuuuagaaucccagcccc

SEQ ID NO: 3532848 - RNA, 22 nt, Human
cuuuagaaugagagugugaaau

SEQ ID NO: 3532849 - RNA, 16 nt, Human
cuuuagacccugggug

SEQ ID NO: 3532850 - RNA, 15 nt, Human
cuuuagagaacugaa

SEQ ID NO: 3532851 - RNA, 16 nt, Human
cuuuagagaacugaaa

SEQ ID NO: 3532852 - RNA, 17 nt, Human
cuuuagagaacugaaaa

SEQ ID NO: 3532853 - RNA, 20 nt, Human
cuuuagagaacugaaaagag

SEQ ID NO: 3532854 - RNA, 19 nt, Human
cuuuagagaaguauacaua

SEQ ID NO: 3532855 - RNA, 14 nt, Human
cuuuagaguuagac

SEQ ID NO: 3532856 - RNA, 17 nt, Human
cuuuagaguuagacugu

SEQ ID NO: 3532857 - RNA, 20 nt, Human
cuuuagaguuagacuguugg

SEQ ID NO: 3532858 - RNA, 19 nt, Human
cuuuagauagcccuguccu

SEQ ID NO: 3532859 - RNA, 20 nt, Human
cuuuagauagcccuguccug

SEQ ID NO: 3532860 - RNA, 15 nt, Human
cuuuagaucucugaa

SEQ ID NO: 3532861 - RNA, 14 nt, Human
cuuuagaugcugau

SEQ ID NO: 3532862 - RNA, 13 nt, Human
cuuuagcacguuu

SEQ ID NO: 3532863 - RNA, 17 nt, Human
cuuuagcacguuuaaag

SEQ ID NO: 3532864 - RNA, 20 nt, Human
cuuuagcacguuuaaaguuc

SEQ ID NO: 3532865 - RNA, 21 nt, Human
cuuuagcacguuuaaaguucu

SEQ ID NO: 3532866 - RNA, 18 nt, Human
cuuuagcuuauuuuuaca

SEQ ID NO: 3532867 - RNA, 15 nt, Human
cuuuaggagcagugg

SEQ ID NO: 3532868 - RNA, 21 nt, Human
cuuuaggcauaugcuucuuua

SEQ ID NO: 3532869 - RNA, 18 nt, Human
cuuuagggcagcuugccc

SEQ ID NO: 3532870 - RNA, 16 nt, Human
cuuuaggguucugccu

SEQ ID NO: 3532871 - RNA, 18 nt, Human
cuuuaggguucugccucu

SEQ ID NO: 3532872 - RNA, 17 nt, Human
cuuuaggucuuuguaag

SEQ ID NO: 3532873 - RNA, 15 nt, Human
cuuuagucgcugagg

SEQ ID NO: 3532874 - RNA, 20 nt, Human
cuuuagugaacguggacucc

SEQ ID NO: 3532875 - RNA, 20 nt, Human
cuuuagugaucacagcagcu

SEQ ID NO: 3532876 - RNA, 19 nt, Human
cuuuaguuauaaaggaauc

SEQ ID NO: 3532877 - RNA, 23 nt, Human
cuuuaguuuuugguugggaauga

SEQ ID NO: 3532878 - RNA, 13 nt, Human
cuuuauaaaugua

SEQ ID NO: 3532879 - RNA, 13 nt, Human
cuuuauaagaaag

SEQ ID NO: 3532880 - RNA, 13 nt, Human
cuuuauacaacag

SEQ ID NO: 3532881 - RNA, 15 nt, Human
cuuuauacaacagug

SEQ ID NO: 3532882 - RNA, 18 nt, Human
cuuuauacaacagugcua

SEQ ID NO: 3532883 - RNA, 23 nt, Human
cuuuauacagcuguauugucuga

SEQ ID NO: 3532884 - RNA, 12 nt, Human
cuuuauacauua

SEQ ID NO: 3532885 - RNA, 14 nt, Human
cuuuauacauuagu

SEQ ID NO: 3532886 - RNA, 23 nt, Human
cuuuauacauuaguaaaugucuu

SEQ ID NO: 3532887 - RNA, 18 nt, Human
cuuuauacguguagcuau

SEQ ID NO: 3532888 - RNA, 19 nt, Human
cuuuauacguguagcuaua

SEQ ID NO: 3532889 - RNA, 20 nt, Human
cuuuauagugcacaaaauga

SEQ ID NO: 3532890 - RNA, 19 nt, Human
cuuuauauacaauaaugga

SEQ ID NO: 3532891 - RNA, 16 nt, Human
cuuuauauauggacau

SEQ ID NO: 3532892 - RNA, 13 nt, Human
cuuuauaugaaga

SEQ ID NO: 3532893 - RNA, 22 nt, Human
cuuuauaugaagaaaaucacuu

SEQ ID NO: 3532894 - RNA, 20 nt, Human
cuuuauauggccucaagauc

SEQ ID NO: 3532895 - RNA, 15 nt, Human
cuuuauauuuaucca

SEQ ID NO: 3532896 - RNA, 18 nt, Human
cuuuauauuuauccacua

SEQ ID NO: 3532897 - RNA, 21 nt, Human
cuuuaucaaagggugaaaauu

SEQ ID NO: 3532898 - RNA, 23 nt, Human
cuuuaucacaaccaccguuacaa

SEQ ID NO: 3532899 - RNA, 19 nt, Human
cuuuaucaccuggcuuguu

SEQ ID NO: 3532900 - RNA, 20 nt, Human
cuuuaucaccuggcuuguuu

SEQ ID NO: 3532901 - RNA, 22 nt, Human
cuuuaucaccuggcuuguuuau

SEQ ID NO: 3532902 - RNA, 13 nt, Human
cuuuaucacuuuu

SEQ ID NO: 3532903 - RNA, 22 nt, Human
cuuuaucacuuuuugaacuaag

SEQ ID NO: 3532904 - RNA, 22 nt, Human
cuuuaucagggaaacuaagauu

SEQ ID NO: 3532905 - RNA, 19 nt, Human
cuuuaucuaccaacuuuca

SEQ ID NO: 3532906 - RNA, 20 nt, Human
cuuuaucuaccaacuuucaa

SEQ ID NO: 3532907 - RNA, 21 nt, Human
cuuuaucuugaauaauguaag

SEQ ID NO: 3532908 - RNA, 23 nt, Human
cuuuaucuugaauaauguaagac

SEQ ID NO: 3532909 - RNA, 22 nt, Human
cuuuaugaaugaaaaaacaguc

SEQ ID NO: 3532910 - RNA, 16 nt, Human
cuuuaugauuuucaua

SEQ ID NO: 3532911 - RNA, 18 nt, Human
cuuuaugauuuucauaac

SEQ ID NO: 3532912 - RNA, 13 nt, Human
cuuuaugcuugca

SEQ ID NO: 3532913 - RNA, 21 nt, Human
cuuuauguacaggaugcuuug

SEQ ID NO: 3532914 - RNA, 21 nt, Human
cuuuaugucuguggauuuuuu

SEQ ID NO: 3532915 - RNA, 17 nt, Human
cuuuaugugaauuuuua

SEQ ID NO: 3532916 - RNA, 14 nt, Human
cuuuauguguaaau

SEQ ID NO: 3532917 - RNA, 20 nt, Human
cuuuauguucauuuguuugu

SEQ ID NO: 3532918 - RNA, 13 nt, Human
cuuuauuaaaauc

SEQ ID NO: 3532919 - RNA, 15 nt, Human
cuuuauuaaucacua

SEQ ID NO: 3532920 - RNA, 19 nt, Human
cuuuauuaauguuuucaaa

SEQ ID NO: 3532921 - RNA, 14 nt, Human
cuuuauuacccccu

SEQ ID NO: 3532922 - RNA, 12 nt, Human
cuuuauuauuau

SEQ ID NO: 3532923 - RNA, 13 nt, Human
cuuuauuauuuau

SEQ ID NO: 3532924 - RNA, 20 nt, Human
cuuuauuccagaaugcugua

SEQ ID NO: 3532925 - RNA, 16 nt, Human
cuuuauuggcugagau

SEQ ID NO: 3532926 - RNA, 22 nt, Human
cuuuauuuguuaauaguuccug

SEQ ID NO: 3532927 - RNA, 16 nt, Human
cuuuauuuguuuuuuu

SEQ ID NO: 3532928 - RNA, 21 nt, Human
cuuuauuuuccccuaucauuu

SEQ ID NO: 3532929 - RNA, 11 nt, Human
cuuuauuuucu

SEQ ID NO: 3532930 - RNA, 11 nt, Human
cuuuauuuuga

SEQ ID NO: 3532931 - RNA, 16 nt, Human
cuuuauuuuguguaaa

SEQ ID NO: 3532932 - RNA, 17 nt, Human
cuuuauuuuuuugaacu

SEQ ID NO: 3532933 - RNA, 19 nt, Human
cuuucaaaaccuuuugaaa

SEQ ID NO: 3532934 - RNA, 19 nt, Human
cuuucaaaauuaaaucugu

SEQ ID NO: 3532935 - RNA, 19 nt, Human
cuuucaaauuuagaaacua

SEQ ID NO: 3532936 - RNA, 23 nt, Human
cuuucaagugccuuucugcaguu

SEQ ID NO: 3532937 - RNA, 22 nt, Human
cuuucaauaaacuaaagaaaaa

SEQ ID NO: 3532938 - RNA, 17 nt, Human
cuuucaauacagauaua

SEQ ID NO: 3532939 - RNA, 16 nt, Human
ggagcugccuggaccc

SEQ ID NO: 3532940 - RNA, 21 nt, Human
ggagcugccuguucagcucca

SEQ ID NO: 3532941 - RNA, 23 nt, Human
ggagcugcuggcuugcagugcgc

SEQ ID NO: 3532942 - RNA, 21 nt, Human
ggagcuggccgugggccuggg

SEQ ID NO: 3532943 - RNA, 14 nt, Human
ggagcugggaggaa

SEQ ID NO: 3532944 - RNA, 15 nt, Human
ggagcugggaggaaa

SEQ ID NO: 3532945 - RNA, 19 nt, Human
ggagcugggcagaaggcca

SEQ ID NO: 3532946 - RNA, 18 nt, Human
ggagcugguuagaaaugc

SEQ ID NO: 3532947 - RNA, 14 nt, Human
cuuuggaggccccu

SEQ ID NO: 3532948 - RNA, 16 nt, Human
cuuuggaguccccuca

SEQ ID NO: 3532949 - RNA, 17 nt, Human
cuuuggauuugacauug

SEQ ID NO: 3532950 - RNA, 18 nt, Human
cuuuggcacuggggcacu

SEQ ID NO: 3532951 - RNA, 11 nt, Human
cuuuggcagug

SEQ ID NO: 3532952 - RNA, 17 nt, Human
cuuuggccauuccaaca

SEQ ID NO: 3532953 - RNA, 16 nt, Human
cuuuggcccagggugg

SEQ ID NO: 3532954 - RNA, 14 nt, Human
cuuuggccugaguu

SEQ ID NO: 3532955 - RNA, 14 nt, Human
cuuuggcucuggag

SEQ ID NO: 3532956 - RNA, 14 nt, Human
cuuuggcugcaugc

SEQ ID NO: 3532957 - RNA, 18 nt, Human
cuuuggcuuauaauucuu

SEQ ID NO: 3532958 - RNA, 15 nt, Human
cuuugggaaaggaga

SEQ ID NO: 3532959 - RNA, 22 nt, Human
cuuugggaaaggagaaguuaag

SEQ ID NO: 3532960 - RNA, 17 nt, Human
cuuugggaauauuugaa

SEQ ID NO: 3532961 - RNA, 20 nt, Human
cuuugggaauauuugaaucu

SEQ ID NO: 3532962 - RNA, 14 nt, Human
cuuugggaggcuga

SEQ ID NO: 3532963 - RNA, 13 nt, Human
cuuugggccagac

SEQ ID NO: 3532964 - RNA, 16 nt, Human
cuuugggcccagggac

SEQ ID NO: 3532965 - RNA, 15 nt, Human
cuuugggcccugcau

SEQ ID NO: 3532966 - RNA, 17 nt, Human
cuuugggcccugcaugu

SEQ ID NO: 3532967 - RNA, 23 nt, Human
cuuugggggaggagaacaugagu

SEQ ID NO: 3532968 - RNA, 17 nt, Human
cuuuggggucagccagg

SEQ ID NO: 3532969 - RNA, 22 nt, Human
cuuuggguaccuauuuucauug

SEQ ID NO: 3532970 - RNA, 17 nt, Human
cuuuggguuaagcauua

SEQ ID NO: 3532971 - RNA, 14 nt, Human
cuuugguccuucaa

SEQ ID NO: 3532972 - RNA, 13 nt, Human
cuuuggugccuuu

SEQ ID NO: 3532973 - RNA, 14 nt, Human
cuuuggugccuuuc

SEQ ID NO: 3532974 - RNA, 17 nt, Human
cuuugguggcuuugcau

SEQ ID NO: 3532975 - RNA, 22 nt, Human
cuuuggugguuuaaaaauggua

SEQ ID NO: 3532976 - RNA, 13 nt, Human
cuuugguuauuuu

SEQ ID NO: 3532977 - RNA, 14 nt, Human
cuuugguucuaagg

SEQ ID NO: 3532978 - RNA, 15 nt, Human
cuuugguucuaagga

SEQ ID NO: 3532979 - RNA, 18 nt, Human
cuuuguaaccacaacuuu

SEQ ID NO: 3532980 - RNA, 15 nt, Human
cuuuguaagaacuaa

SEQ ID NO: 3532981 - RNA, 17 nt, Human
cuuuguaagaguguaga

SEQ ID NO: 3532982 - RNA, 20 nt, Human
cuuuguaagaguguagaagc

SEQ ID NO: 3532983 - RNA, 23 nt, Human
cuuuguaagaguguagaagcauu

SEQ ID NO: 3532984 - RNA, 21 nt, Human
cuuuguaagugaaaaacauga

SEQ ID NO: 3532985 - RNA, 20 nt, Human
cuuuguacacccaugaaaga

SEQ ID NO: 3532986 - RNA, 15 nt, Human
cuuuguacagagugc

SEQ ID NO: 3532987 - RNA, 16 nt, Human
cuuuguacagcccaga

SEQ ID NO: 3532988 - RNA, 19 nt, Human
cuuuguaccccccaacccc

SEQ ID NO: 3532989 - RNA, 21 nt, Human
cuuuguaccccccaaccccug

SEQ ID NO: 3532990 - RNA, 16 nt, Human
cuuuguauacaaguac

SEQ ID NO: 3532991 - RNA, 16 nt, Human
cuuuguauacuuuaaa

SEQ ID NO: 3532992 - RNA, 20 nt, Human
ggcacugggaugagccgcug

SEQ ID NO: 3532993 - RNA, 14 nt, Human
ggcacuuaaagcuu

SEQ ID NO: 3532994 - RNA, 15 nt, Human
ggcacuuaagcacaa

SEQ ID NO: 3532995 - RNA, 22 nt, Human
ggcacuuauuguaaauuuuaga

SEQ ID NO: 3532996 - RNA, 11 nt, Human
ggcacuucaca

SEQ ID NO: 3532997 - RNA, 14 nt, Human
ggcacuucccugcu

SEQ ID NO: 3532998 - RNA, 14 nt, Human
ggcacuugccuggg

SEQ ID NO: 3532999 - RNA, 18 nt, Human
ggcacuuuaaaacacucu

SEQ ID NO: 3533000 - RNA, 17 nt, Human
ggcagaaaauugcacaa

SEQ ID NO: 3533001 - RNA, 22 nt, Human
ggcagaaagcaaaugugaccug

SEQ ID NO: 3533002 - RNA, 14 nt, Human
ggcagaaaggaaaa

SEQ ID NO: 3533003 - RNA, 14 nt, Human
ggcagaaaguggcc

SEQ ID NO: 3533004 - RNA, 21 nt, Human
ggcagaacacuaaccugaccg

SEQ ID NO: 3533005 - RNA, 18 nt, Human
ggcagaacagccgcuccu

SEQ ID NO: 3533006 - RNA, 15 nt, Human
ggcagaacccuggug

SEQ ID NO: 3533007 - RNA, 14 nt, Human
ggcagaacugagcu

SEQ ID NO: 3533008 - RNA, 22 nt, Human
ggcagaagaauugaacccagga

SEQ ID NO: 3533009 - RNA, 23 nt, Human
ggcagaagaauugaacccaggag

SEQ ID NO: 3533010 - RNA, 17 nt, Human
ggcagaagacaccagag

SEQ ID NO: 3533011 - RNA, 18 nt, Human
ggcagaagacaccagagc

SEQ ID NO: 3533012 - RNA, 15 nt, Human
ggcagaagggagaag

SEQ ID NO: 3533013 - RNA, 20 nt, Human
ggcagaaugcuagcucugag

SEQ ID NO: 3533014 - RNA, 19 nt, Human
ggcagacacggaucugaga

SEQ ID NO: 3533015 - RNA, 17 nt, Human
ggcagacagcagcucag

SEQ ID NO: 3533016 - RNA, 21 nt, Human
ggcagacaugguggggucucc

SEQ ID NO: 3533017 - RNA, 15 nt, Human
ggcagacuacacagg

SEQ ID NO: 3533018 - RNA, 17 nt, Human
ggcagacuacacaggau

SEQ ID NO: 3533019 - RNA, 14 nt, Human
ggcagacuggguuu

SEQ ID NO: 3533020 - RNA, 14 nt, Human
ggcagagaaucaua

SEQ ID NO: 3533021 - RNA, 9 nt, Human
ggcagagag

SEQ ID NO: 3533022 - RNA, 11 nt, Human
ggcagagagag

SEQ ID NO: 3533023 - RNA, 12 nt, Human
ggcagagagaga

SEQ ID NO: 3533024 - RNA, 22 nt, Human
ggcagagcagagaccaucccug

SEQ ID NO: 3533025 - RNA, 12 nt, Human
ggcagagcauuu

SEQ ID NO: 3533026 - RNA, 12 nt, Human
ggcagagccagg

SEQ ID NO: 3533027 - RNA, 14 nt, Human
ggcagagcccugcu

SEQ ID NO: 3533028 - RNA, 16 nt, Human
ggcagagccgggaagc

SEQ ID NO: 3533029 - RNA, 22 nt, Human
ggcagagccuuuggaugaccag

SEQ ID NO: 3533030 - RNA, 16 nt, Human
ggcagagcuggcucug

SEQ ID NO: 3533031 - RNA, 20 nt, Human
ggcagaggaccaggcuguag

SEQ ID NO: 3533032 - RNA, 21 nt, Human
ggcagaggagaacuugcugcc

SEQ ID NO: 3533033 - RNA, 22 nt, Human
ggcagaggagaacuugcugccu

SEQ ID NO: 3533034 - RNA, 17 nt, Human
ggcagaggcccaggcug

SEQ ID NO: 3533035 - RNA, 14 nt, Human
ggcagaggccuggg

SEQ ID NO: 3533036 - RNA, 12 nt, Human
ggcagaggcugg

SEQ ID NO: 3533037 - RNA, 19 nt, Human
ggcagagggcagaggcugg

SEQ ID NO: 3533038 - RNA, 12 nt, Human
ggcagagggcug

SEQ ID NO: 3533039 - RNA, 14 nt, Human
ggcagagggcugga

SEQ ID NO: 3533040 - RNA, 18 nt, Human
ggcagagguucauuucaa

SEQ ID NO: 3533041 - RNA, 21 nt, Human
ggcagagguugcagugagccg

SEQ ID NO: 3533042 - RNA, 20 nt, Human
ggcagagguugcagugagcu

SEQ ID NO: 3533043 - RNA, 15 nt, Human
ggcagagguuguagu

SEQ ID NO: 3533044 - RNA, 20 nt, Human
ggcagagguuguagugagcc

SEQ ID NO: 3533045 - RNA, 18 nt, Human
ggcagagguuguggugag

SEQ ID NO: 3533046 - RNA, 14 nt, Human
ggcagaguuacuug

SEQ ID NO: 3533047 - RNA, 19 nt, Human
ggcagauaaucagccucuu

SEQ ID NO: 3533048 - RNA, 16 nt, Human
ggcagaugacaagaug

SEQ ID NO: 3533049 - RNA, 15 nt, Human
ggcagaugcagcucu

SEQ ID NO: 3533050 - RNA, 17 nt, Human
ggcagauggccuggagg

SEQ ID NO: 3533051 - RNA, 16 nt, Human
ggcagcaaggcccgag

SEQ ID NO: 3533052 - RNA, 22 nt, Human
ggcagcaaggcccgagcagcug

SEQ ID NO: 3533053 - RNA, 14 nt, Human
ggcagcacagagac

SEQ ID NO: 3533054 - RNA, 21 nt, Human
ggcagcaccugucuccuuuca

SEQ ID NO: 3533055 - RNA, 14 nt, Human
ggcagcagaaaacu

SEQ ID NO: 3533056 - RNA, 16 nt, Human
ggcagcagcagcccug

SEQ ID NO: 3533057 - RNA, 11 nt, Human
ggcagcagcca

SEQ ID NO: 3533058 - RNA, 16 nt, Human
ggcagcagccagcccu

SEQ ID NO: 3533059 - RNA, 23 nt, Human
ggcagcagccagcccugccugga

SEQ ID NO: 3533060 - RNA, 13 nt, Human
ggcagcagccauc

SEQ ID NO: 3533061 - RNA, 13 nt, Human
ggcagcagggcua

SEQ ID NO: 3533062 - RNA, 15 nt, Human
ggcagcagggguugg

SEQ ID NO: 3533063 - RNA, 22 nt, Human
ggcagcagggguuggggaaaca

SEQ ID NO: 3533064 - RNA, 15 nt, Human
ggcagcaggugcugc

SEQ ID NO: 3533065 - RNA, 16 nt, Human
ggcagcaggugcugcu

SEQ ID NO: 3533066 - RNA, 19 nt, Human
ggcagcaggugcugcuacc

SEQ ID NO: 3533067 - RNA, 21 nt, Human
ggcagcaggugcugcuacccu

SEQ ID NO: 3533068 - RNA, 14 nt, Human
ggcagcagugugag

SEQ ID NO: 3533069 - RNA, 17 nt, Human
ggcagcauccccuugaa

SEQ ID NO: 3533070 - RNA, 18 nt, Human
ggcagccaaacccaugag

SEQ ID NO: 3533071 - RNA, 23 nt, Human
ggcagccacuucggccaggucac

SEQ ID NO: 3533072 - RNA, 13 nt, Human
ggcagccagacca

SEQ ID NO: 3533073 - RNA, 14 nt, Human
ggcagccaggccac

SEQ ID NO: 3533074 - RNA, 12 nt, Human
ggcagccaggcu

SEQ ID NO: 3533075 - RNA, 13 nt, Human
ggcagccaggcug

SEQ ID NO: 3533076 - RNA, 12 nt, Human
ggcagccaggga

SEQ ID NO: 3533077 - RNA, 13 nt, Human
ggcagccagggag

SEQ ID NO: 3533078 - RNA, 18 nt, Human
ggcagccagggagagccc

SEQ ID NO: 3533079 - RNA, 13 nt, Human
ggcagccagggcu

SEQ ID NO: 3533080 - RNA, 14 nt, Human
ggcagccagugaga

SEQ ID NO: 3533081 - RNA, 17 nt, Human
ggcagccagugcccuga

SEQ ID NO: 3533082 - RNA, 20 nt, Human
ggcagccagugcccugagcc

SEQ ID NO: 3533083 - RNA, 22 nt, Human
ggcagcccagagacuuuguaga

SEQ ID NO: 3533084 - RNA, 16 nt, Human
ggcagccccagccugc

SEQ ID NO: 3533085 - RNA, 17 nt, Human
ggcagccccagccugcu

SEQ ID NO: 3533086 - RNA, 16 nt, Human
ggcagccccauucugc

SEQ ID NO: 3533087 - RNA, 20 nt, Human
ggcagccccauucugccugc

SEQ ID NO: 3533088 - RNA, 22 nt, Human
ggcagccccauucugccugccc

SEQ ID NO: 3533089 - RNA, 23 nt, Human
ggcagccccauucugccugccca

SEQ ID NO: 3533090 - RNA, 11 nt, Human
ggcagccccug

SEQ ID NO: 3533091 - RNA, 17 nt, Human
ggcagcccgcuaggcuc

SEQ ID NO: 3533092 - RNA, 18 nt, Human
ggcagccgugccuucagc

SEQ ID NO: 3533093 - RNA, 23 nt, Human
cuuuuaaagaaaaaaauugaaau

SEQ ID NO: 3533094 - RNA, 15 nt, Human
cuuuuaaagaauuuc

SEQ ID NO: 3533095 - RNA, 12 nt, Human
cuuuuaaagacc

SEQ ID NO: 3533096 - RNA, 23 nt, Human
cuuuuaaaggggcagaaaaacuc

SEQ ID NO: 3533097 - RNA, 19 nt, Human
cuuuuaaaguguuucagcu

SEQ ID NO: 3533098 - RNA, 17 nt, Human
cuuuuaaauccuguuga

SEQ ID NO: 3533099 - RNA, 17 nt, Human
cuuuuaaauuagaaaau

SEQ ID NO: 3533100 - RNA, 19 nt, Human
cuuuuaaauuagaaaauau

SEQ ID NO: 3533101 - RNA, 20 nt, Human
cuuuuaacaccugaugugua

SEQ ID NO: 3533102 - RNA, 13 nt, Human
cuuuuaacauuuu

SEQ ID NO: 3533103 - RNA, 21 nt, Human
cuuuuaaccucuuuaaguauu

SEQ ID NO: 3533104 - RNA, 14 nt, Human
cuuuuaacugugca

SEQ ID NO: 3533105 - RNA, 15 nt, Human
cuuuuaacuucuuuc

SEQ ID NO: 3533106 - RNA, 17 nt, Human
cuuuuaacuucuuucua

SEQ ID NO: 3533107 - RNA, 20 nt, Human
cuuuuaacuuuauaaaucca

SEQ ID NO: 3533108 - RNA, 17 nt, Human
cuuuuaagacuuugguu

SEQ ID NO: 3533109 - RNA, 20 nt, Human
cuuuuaagaugugucuucaa

SEQ ID NO: 3533110 - RNA, 16 nt, Human
cuuuuaauacagggua

SEQ ID NO: 3533111 - RNA, 15 nt, Human
cuuuuaauccuggcu

SEQ ID NO: 3533112 - RNA, 16 nt, Human
cuuuuaaugaaaagga

SEQ ID NO: 3533113 - RNA, 15 nt, Human
cuuuuaaugaacaaa

SEQ ID NO: 3533114 - RNA, 23 nt, Human
cuuuuaaugcuucauucaauauu

SEQ ID NO: 3533115 - RNA, 14 nt, Human
cuuuuaauuaaaug

SEQ ID NO: 3533116 - RNA, 16 nt, Human
cuuuuaauuaaugaaa

SEQ ID NO: 3533117 - RNA, 23 nt, Human
cuuuuaauuaaugaaauaucugu

SEQ ID NO: 3533118 - RNA, 14 nt, Human
cuuuuaauuuuccu

SEQ ID NO: 3533119 - RNA, 23 nt, Human
cuuuuacaaguaacaaaaauaaa

SEQ ID NO: 3533120 - RNA, 13 nt, Human
cuuuuacauacug

SEQ ID NO: 3533121 - RNA, 15 nt, Human
cuuuuaccagcuuuu

SEQ ID NO: 3533122 - RNA, 19 nt, Human
cuuuuacccuggccccucu

SEQ ID NO: 3533123 - RNA, 15 nt, Human
cuuuuacccuuuuuc

SEQ ID NO: 3533124 - RNA, 14 nt, Human
cuuuuaccugcugc

SEQ ID NO: 3533125 - RNA, 15 nt, Human
cuuuuaccugcugcu

SEQ ID NO: 3533126 - RNA, 20 nt, Human
cuuuuaccuuuuuuuuuucu

SEQ ID NO: 3533127 - RNA, 21 nt, Human
cuuuuaccuuuuuuuuuucuu

SEQ ID NO: 3533128 - RNA, 15 nt, Human
cuuuuacgagugcua

SEQ ID NO: 3533129 - RNA, 18 nt, Human
cuuuuacuacagcuauga

SEQ ID NO: 3533130 - RNA, 14 nt, Human
cuuuuacucugccu

SEQ ID NO: 3533131 - RNA, 22 nt, Human
cuuuuacugguugcauggaaau

SEQ ID NO: 3533132 - RNA, 13 nt, Human
cuuuuagccuagu

SEQ ID NO: 3533133 - RNA, 20 nt, Human
cuuuuaggaaaaucacuuug

SEQ ID NO: 3533134 - RNA, 20 nt, Human
cuuuuagggagagucauauu

SEQ ID NO: 3533135 - RNA, 15 nt, Human
cuuuuaguacccacc

SEQ ID NO: 3533136 - RNA, 16 nt, Human
cuuuuaguacccaccu

SEQ ID NO: 3533137 - RNA, 17 nt, Human
cuuuuaguacccaccug

SEQ ID NO: 3533138 - RNA, 21 nt, Human
cuuuuaguacccaccugagcu

SEQ ID NO: 3533139 - RNA, 21 nt, Human
cuuuuaguuccugugcacagc

SEQ ID NO: 3533140 - RNA, 22 nt, Human
cuuuuaguuccugugcacagcc

SEQ ID NO: 3533141 - RNA, 21 nt, Human
cuuuuaguuuuaguugcagaa

SEQ ID NO: 3533142 - RNA, 18 nt, Human
cuuuuaguuuuucugucc

SEQ ID NO: 3533143 - RNA, 20 nt, Human
cuuuuaguuuuucugucccu

SEQ ID NO: 3533144 - RNA, 20 nt, Human
cuuuuauaaaaaaaaugaaa

SEQ ID NO: 3533145 - RNA, 21 nt, Human
cuuuuauaaaaaaaaugaaau

SEQ ID NO: 3533146 - RNA, 14 nt, Human
cuuuuauaaaccuc

SEQ ID NO: 3533147 - RNA, 15 nt, Human
cuuuuauaaacuuua

SEQ ID NO: 3533148 - RNA, 18 nt, Human
cuuuuauaaauuaaauau

SEQ ID NO: 3533149 - RNA, 24 nt, Human
cuuuuauaaauuaaauauauguau

SEQ ID NO: 3533150 - RNA, 21 nt, Human
cuuuuauaauucucauuaaaa

SEQ ID NO: 3533151 - RNA, 12 nt, Human
cuuuuauacucu

SEQ ID NO: 3533152 - RNA, 17 nt, Human
cuuuuauacucuuucug

SEQ ID NO: 3533153 - RNA, 22 nt, Human
cuuuuauaggugagaaaaaaac

SEQ ID NO: 3533154 - RNA, 15 nt, Human
cuuuuauaguggaaa

SEQ ID NO: 3533155 - RNA, 16 nt, Human
cuuuuauauuuguauc

SEQ ID NO: 3533156 - RNA, 17 nt, Human
cuuuuauauuuguaucg

SEQ ID NO: 3533157 - RNA, 16 nt, Human
ggaccccuccucccuu

SEQ ID NO: 3533158 - RNA, 11 nt, Human
ggaccccugca

SEQ ID NO: 3533159 - RNA, 23 nt, Human
ggacccgaccccccgugggcucc

SEQ ID NO: 3533160 - RNA, 14 nt, Human
ggacccgcucugga

SEQ ID NO: 3533161 - RNA, 20 nt, Human
ggacccggaggggccuggca

SEQ ID NO: 3533162 - RNA, 17 nt, Human
ggacccguucauggggg

SEQ ID NO: 3533163 - RNA, 15 nt, Human
ggacccucgcuggcc

SEQ ID NO: 3533164 - RNA, 16 nt, Human
ggacccugaaaugugu

SEQ ID NO: 3533165 - RNA, 13 nt, Human
ggacccugaaggg

SEQ ID NO: 3533166 - RNA, 11 nt, Human
ggacccugacc

SEQ ID NO: 3533167 - RNA, 19 nt, Human
ggacccugaggcccagagg

SEQ ID NO: 3533168 - RNA, 18 nt, Human
ggacccugccaggcacag

SEQ ID NO: 3533169 - RNA, 20 nt, Human
ggacccugccaggcacaggc

SEQ ID NO: 3533170 - RNA, 15 nt, Human
ggacccugugagccg

SEQ ID NO: 3533171 - RNA, 17 nt, Human
ggacccuguugcuaagc

SEQ ID NO: 3533172 - RNA, 16 nt, Human
ggacccuuauaaaauc

SEQ ID NO: 3533173 - RNA, 16 nt, Human
ggacccuuuccuuccu

SEQ ID NO: 3533174 - RNA, 22 nt, Human
ggaccgccagauggggccucug

SEQ ID NO: 3533175 - RNA, 23 nt, Human
ggaccgccagauggggccucugu

SEQ ID NO: 3533176 - RNA, 18 nt, Human
ggaccgcccuuuuccccu

SEQ ID NO: 3533177 - RNA, 21 nt, Human
ggaccgcuacaccacucuggc

SEQ ID NO: 3533178 - RNA, 22 nt, Human
ggaccgcuacaccacucuggca

SEQ ID NO: 3533179 - RNA, 17 nt, Human
ggaccggagaguggggg

SEQ ID NO: 3533180 - RNA, 20 nt, Human
ggaccggguggaagggaugg

SEQ ID NO: 3533181 - RNA, 17 nt, Human
ggaccgguacagaaagg

SEQ ID NO: 3533182 - RNA, 20 nt, Human
ggaccuaggauaucuucucc

SEQ ID NO: 3533183 - RNA, 17 nt, Human
ggaccuauguccuaagg

SEQ ID NO: 3533184 - RNA, 21 nt, Human
ggaccucagaguccaggcccc

SEQ ID NO: 3533185 - RNA, 23 nt, Human
ggaccucaggugagaagcagagg

SEQ ID NO: 3533186 - RNA, 11 nt, Human
ggaccucaucc

SEQ ID NO: 3533187 - RNA, 13 nt, Human
ggaccucccuucc

SEQ ID NO: 3533188 - RNA, 16 nt, Human
ggaccucgugcuuuaa

SEQ ID NO: 3533189 - RNA, 12 nt, Human
ggaccucugaca

SEQ ID NO: 3533190 - RNA, 16 nt, Human
ggaccucugacagcag

SEQ ID NO: 3533191 - RNA, 13 nt, Human
ggaccucugcucu

SEQ ID NO: 3533192 - RNA, 16 nt, Human
ggaccucugcucugag

SEQ ID NO: 3533193 - RNA, 12 nt, Human
ggaccugagccu

SEQ ID NO: 3533194 - RNA, 15 nt, Human
ggaccugagccugcc

SEQ ID NO: 3533195 - RNA, 16 nt, Human
ggaccugagccugccg

SEQ ID NO: 3533196 - RNA, 17 nt, Human
ggaccugagccugccga

SEQ ID NO: 3533197 - RNA, 17 nt, Human
ggaccugagucugcuau

SEQ ID NO: 3533198 - RNA, 16 nt, Human
ggaccugccaggcagg

SEQ ID NO: 3533199 - RNA, 22 nt, Human
ggaccugcccccgcauccccug

SEQ ID NO: 3533200 - RNA, 22 nt, Human
ggaccugccuccugccugcccc

SEQ ID NO: 3533201 - RNA, 14 nt, Human
ggaccugccuguag

SEQ ID NO: 3533202 - RNA, 15 nt, Human
ggaccugccuguagc

SEQ ID NO: 3533203 - RNA, 14 nt, Human
ggaccuggaaggga

SEQ ID NO: 3533204 - RNA, 17 nt, Human
ggaccugguacccuccu

SEQ ID NO: 3533205 - RNA, 20 nt, Human
ggaccuguauuuaagcaaau

SEQ ID NO: 3533206 - RNA, 12 nt, Human
ggaccuguggcu

SEQ ID NO: 3533207 - RNA, 21 nt, Human
ggaccuuaggccuuccucucu

SEQ ID NO: 3533208 - RNA, 17 nt, Human
ggaccuucgggcugugc

SEQ ID NO: 3533209 - RNA, 17 nt, Human
ggaccuuucagcuguga

SEQ ID NO: 3533210 - RNA, 20 nt, Human
ggacgaagaagagccacagu

SEQ ID NO: 3533211 - RNA, 22 nt, Human
ggacgcagcaggaggccaggcc

SEQ ID NO: 3533212 - RNA, 23 nt, Human
ggacgcagcaggaggccaggccg

SEQ ID NO: 3533213 - RNA, 19 nt, Human
ggacgcuacccgggaaggg

SEQ ID NO: 3533214 - RNA, 17 nt, Human
ggacgcucccugcucca

SEQ ID NO: 3533215 - RNA, 19 nt, Human
ggacgcuccgcugccgugc

SEQ ID NO: 3533216 - RNA, 14 nt, Human
ggacgcucucuggc

SEQ ID NO: 3533217 - RNA, 16 nt, Human
ggacgcucucuggccu

SEQ ID NO: 3533218 - RNA, 18 nt, Human
ggacgcucucuggccuuc

SEQ ID NO: 3533219 - RNA, 19 nt, Human
ggacgcucucuggccuucg

SEQ ID NO: 3533220 - RNA, 13 nt, Human
ggacgcuggcucc

SEQ ID NO: 3533221 - RNA, 17 nt, Human
ggacggcauuccugcuu

SEQ ID NO: 3533222 - RNA, 18 nt, Human
ggacggcauuccugcuua

SEQ ID NO: 3533223 - RNA, 21 nt, Human
ggacggccugaugcucccucc

SEQ ID NO: 3533224 - RNA, 13 nt, Human
ggacggggccggc

SEQ ID NO: 3533225 - RNA, 16 nt, Human
ggacggguuagacagc

SEQ ID NO: 3533226 - RNA, 21 nt, Human
ggacggugcccaagccagagg

SEQ ID NO: 3533227 - RNA, 19 nt, Human
ggacguggcucagccagca

SEQ ID NO: 3533228 - RNA, 16 nt, Human
ggacguuccagccggc

SEQ ID NO: 3533229 - RNA, 21 nt, Human
ggacguuccagccggcauggc

SEQ ID NO: 3533230 - RNA, 14 nt, Human
ggacguuguuuugg

SEQ ID NO: 3533231 - RNA, 12 nt, Human
ggacguuucuca

SEQ ID NO: 3533232 - RNA, 18 nt, Human
ggacuaacacucagaagc

SEQ ID NO: 3533233 - RNA, 20 nt, Human
ggacuaacacucagaagccu

SEQ ID NO: 3533234 - RNA, 22 nt, Human
ggacuaacacucagaagccugg

SEQ ID NO: 3533235 - RNA, 24 nt, Human
ggacuaacuugucuuuggacccug

SEQ ID NO: 3533236 - RNA, 16 nt, Human
ggacuaagccuaccug

SEQ ID NO: 3533237 - RNA, 23 nt, Human
ggagugaguugauagcacagacc

SEQ ID NO: 3533238 - RNA, 20 nt, Human
ggagugcaaugacacagucu

SEQ ID NO: 3533239 - RNA, 22 nt, Human
ggagugcuggcucacaguacag

SEQ ID NO: 3533240 - RNA, 21 nt, Human
ggagugcuguuuuguuauaua

SEQ ID NO: 3533241 - RNA, 22 nt, Human
ggagugcuuaucccuucuuuuu

SEQ ID NO: 3533242 - RNA, 20 nt, Human
ggaguggaauaguauccucc

SEQ ID NO: 3533243 - RNA, 16 nt, Human
ggaguggccacagaaa

SEQ ID NO: 3533244 - RNA, 18 nt, Human
ggaguggcucgccaggcc

SEQ ID NO: 3533245 - RNA, 12 nt, Human
ggagugggacag

SEQ ID NO: 3533246 - RNA, 17 nt, Human
ggagugggacagagucu

SEQ ID NO: 3533247 - RNA, 22 nt, Human
ggaguggggaagugaucuuuug

SEQ ID NO: 3533248 - RNA, 15 nt, Human
ggaguggggcaguag

SEQ ID NO: 3533249 - RNA, 16 nt, Human
ggaguggggcaguaga

SEQ ID NO: 3533250 - RNA, 17 nt, Human
ggaguggguggaggcag

SEQ ID NO: 3533251 - RNA, 14 nt, Human
ggagugggugggga

SEQ ID NO: 3533252 - RNA, 15 nt, Human
ggaguggguggggag

SEQ ID NO: 3533253 - RNA, 18 nt, Human
ggaguggugauuugaaaa

SEQ ID NO: 3533254 - RNA, 16 nt, Human
ggaguggugcagacag

SEQ ID NO: 3533255 - RNA, 20 nt, Human
ggaguguaugacugcacaug

SEQ ID NO: 3533256 - RNA, 19 nt, Human
ggagugugagccaccuaag

SEQ ID NO: 3533257 - RNA, 20 nt, Human
ggagugugaggguccugcag

SEQ ID NO: 3533258 - RNA, 13 nt, Human
ggagugugugucu

SEQ ID NO: 3533259 - RNA, 18 nt, Human
ggaguuaagaccuggcag

SEQ ID NO: 3533260 - RNA, 19 nt, Human
ggaguuagaggccagccug

SEQ ID NO: 3533261 - RNA, 21 nt, Human
ggaguuagaggccagccuggc

SEQ ID NO: 3533262 - RNA, 13 nt, Human
ggaguuagggacu

SEQ ID NO: 3533263 - RNA, 12 nt, Human
ggaguuaucuaa

SEQ ID NO: 3533264 - RNA, 19 nt, Human
ggaguuauugaagcagagu

SEQ ID NO: 3533265 - RNA, 21 nt, Human
ggaguucaagaccagccuggc

SEQ ID NO: 3533266 - RNA, 15 nt, Human
ggaguucaaugaucu

SEQ ID NO: 3533267 - RNA, 20 nt, Human
ggaguucaaugaucuagguu

SEQ ID NO: 3533268 - RNA, 20 nt, Human
ggaguucaguggugugaucu

SEQ ID NO: 3533269 - RNA, 19 nt, Human
ggaguucauucauauuaca

SEQ ID NO: 3533270 - RNA, 20 nt, Human
ggaguucauucauauuacaa

SEQ ID NO: 3533271 - RNA, 17 nt, Human
ggaguuccagcaaacaa

SEQ ID NO: 3533272 - RNA, 19 nt, Human
ggaguuccaugaagaccac

SEQ ID NO: 3533273 - RNA, 14 nt, Human
ggaguucugcucau

SEQ ID NO: 3533274 - RNA, 15 nt, Human
ggaguucugguuccu

SEQ ID NO: 3533275 - RNA, 22 nt, Human
ggaguugaucuggaacccagac

SEQ ID NO: 3533276 - RNA, 21 nt, Human
ggaguuggaagugugugaucu

SEQ ID NO: 3533277 - RNA, 22 nt, Human
ggaguugucaagucucugcugg

SEQ ID NO: 3533278 - RNA, 19 nt, Human
ggaguuuaagaccagccug

SEQ ID NO: 3533279 - RNA, 20 nt, Human
ggaguuuaagaccagccugg

SEQ ID NO: 3533280 - RNA, 19 nt, Human
ggaguuuccuaaaaguuca

SEQ ID NO: 3533281 - RNA, 12 nt, Human
ggaguuucuaag

SEQ ID NO: 3533282 - RNA, 14 nt, Human
ggaguuucuaaggu

SEQ ID NO: 3533283 - RNA, 16 nt, Human
ggaguuucuuuccugc

SEQ ID NO: 3533284 - RNA, 14 nt, Human
ggaguuuggccaga

SEQ ID NO: 3533285 - RNA, 15 nt, Human
ggauaaaaagauguu

SEQ ID NO: 3533286 - RNA, 20 nt, Human
ggauaaaaagccagggcugg

SEQ ID NO: 3533287 - RNA, 19 nt, Human
ggauaaaauaaugcugcaa

SEQ ID NO: 3533288 - RNA, 22 nt, Human
ggauaaagaauacuauuuccaa

SEQ ID NO: 3533289 - RNA, 18 nt, Human
ggauaaaucauaaaguca

SEQ ID NO: 3533290 - RNA, 12 nt, Human
ggauaaaugcca

SEQ ID NO: 3533291 - RNA, 20 nt, Human
ggauaagccacucugucccu

SEQ ID NO: 3533292 - RNA, 15 nt, Human
ggauaagccagcugc

SEQ ID NO: 3533293 - RNA, 23 nt, Human
ggauaagcuauccguguugcagg

SEQ ID NO: 3533294 - RNA, 20 nt, Human
ggauaaugcuguugccucau

SEQ ID NO: 3533295 - RNA, 14 nt, Human
ggauaauuagcauc

SEQ ID NO: 3533296 - RNA, 18 nt, Human
ggauacaaaagcauguga

SEQ ID NO: 3533297 - RNA, 18 nt, Human
ggauacaaccucccucuu

SEQ ID NO: 3533298 - RNA, 20 nt, Human
ggauacagcaguagacauuu

SEQ ID NO: 3533299 - RNA, 17 nt, Human
ggauaccuucuuauuua

SEQ ID NO: 3533300 - RNA, 18 nt, Human
ggauacuuauauggaaau

SEQ ID NO: 3533301 - RNA, 21 nt, Human
ggauagaugcuggcccagggc

SEQ ID NO: 3533302 - RNA, 18 nt, Human
ggauagcuaacuguaaau

SEQ ID NO: 3533303 - RNA, 18 nt, Human
ggauaggaaaaaugagua

SEQ ID NO: 3533304 - RNA, 18 nt, Human
ggauagucaccuuuuaaa

SEQ ID NO: 3533305 - RNA, 16 nt, Human
ggauaguugcuauuuu

SEQ ID NO: 3533306 - RNA, 15 nt, Human
ggauauaggagagga

SEQ ID NO: 3533307 - RNA, 19 nt, Human
ggauauauaggcuauuuuc

SEQ ID NO: 3533308 - RNA, 14 nt, Human
ggauaugaguagcc

SEQ ID NO: 3533309 - RNA, 16 nt, Human
ggauauguaaaacauu

SEQ ID NO: 3533310 - RNA, 19 nt, Human
ggauauuuguacuguuuaa

SEQ ID NO: 3533311 - RNA, 23 nt, Human
ggaucaaaguucugcuuucuccc

SEQ ID NO: 3533312 - RNA, 14 nt, Human
ggaucacagagaca

SEQ ID NO: 3533313 - RNA, 17 nt, Human
ggaucacagggccccag

SEQ ID NO: 3533314 - RNA, 18 nt, Human
ggaucacaggugucagcc

SEQ ID NO: 3533315 - RNA, 17 nt, Human
ggaucacuggagcccag

SEQ ID NO: 3533316 - RNA, 16 nt, Human
ggaucagaacagcaga

SEQ ID NO: 3533317 - RNA, 16 nt, Human
ggaucagaacaggagc

SEQ ID NO: 3533318 - RNA, 19 nt, Human
ggaucagagcgcacaggga

SEQ ID NO: 3533319 - RNA, 13 nt, Human
ggaucagcguggc

SEQ ID NO: 3533320 - RNA, 18 nt, Human
ggaucagcguggccuugu

SEQ ID NO: 3533321 - RNA, 21 nt, Human
ggaucagucugauucccaagc

SEQ ID NO: 3533322 - RNA, 18 nt, Human
ggaucaucaugcagcuca

SEQ ID NO: 3533323 - RNA, 21 nt, Human
ggaucaucuaauucucugugg

SEQ ID NO: 3533324 - RNA, 12 nt, Human
ggaucaugaaag

SEQ ID NO: 3533325 - RNA, 16 nt, Human
ggaucaugguguaaua

SEQ ID NO: 3533326 - RNA, 15 nt, Human
ggauccacaccuggu

SEQ ID NO: 3533327 - RNA, 18 nt, Human
ggauccaggccccucccu

SEQ ID NO: 3533328 - RNA, 19 nt, Human
ggauccaggccccucccuc

SEQ ID NO: 3533329 - RNA, 16 nt, Human
ggaucccaagccuccu

SEQ ID NO: 3533330 - RNA, 23 nt, Human
ggaucccaccccauuuucugugg

SEQ ID NO: 3533331 - RNA, 21 nt, Human
ggauccccgccuggccaggag

SEQ ID NO: 3533332 - RNA, 22 nt, Human
ggauccccucugucuacaaaua

SEQ ID NO: 3533333 - RNA, 12 nt, Human
ggauccccuucc

SEQ ID NO: 3533334 - RNA, 14 nt, Human
ggauccccuuccua

SEQ ID NO: 3533335 - RNA, 17 nt, Human
ggaucccucauccucau

SEQ ID NO: 3533336 - RNA, 17 nt, Human
ggaucccucccccccau

SEQ ID NO: 3533337 - RNA, 17 nt, Human
ggauccgacugcuuugg

SEQ ID NO: 3533338 - RNA, 20 nt, Human
ggauccuauucucaccagga

SEQ ID NO: 3533339 - RNA, 23 nt, Human
ggauccuauucucaccaggaagg

SEQ ID NO: 3533340 - RNA, 15 nt, Human
ggauccuccaggugc

SEQ ID NO: 3533341 - RNA, 15 nt, Human
ggauccugagccaga

SEQ ID NO: 3533342 - RNA, 23 nt, Human
ggauccugagccagauuucacuc

SEQ ID NO: 3533343 - RNA, 19 nt, Human
ggaucggaggcuugucaga

SEQ ID NO: 3533344 - RNA, 14 nt, Human
ggaucuauuucaug

SEQ ID NO: 3533345 - RNA, 16 nt, Human
ggaucucucaggagca

SEQ ID NO: 3533346 - RNA, 18 nt, Human
ggaucucuugagccuggg

SEQ ID NO: 3533347 - RNA, 11 nt, Human
ggaucucuuuu

SEQ ID NO: 3533348 - RNA, 15 nt, Human
ggaucugagaaucuu

SEQ ID NO: 3533349 - RNA, 23 nt, Human
ggaucugggacccuuuccuuccu

SEQ ID NO: 3533350 - RNA, 18 nt, Human
ggaucuggggcucuggga

SEQ ID NO: 3533351 - RNA, 15 nt, Human
ggaucuguccaagga

SEQ ID NO: 3533352 - RNA, 16 nt, Human
ggaucuugcauuccca

SEQ ID NO: 3533353 - RNA, 22 nt, Human
ggaucuuucacccacagaaaga

SEQ ID NO: 3533354 - RNA, 21 nt, Human
ggaucuuuggacagaagcagc

SEQ ID NO: 3533355 - RNA, 22 nt, Human
ggaucuuuggacagaagcagcu

SEQ ID NO: 3533356 - RNA, 16 nt, Human
ggaucuuuguggccaa

SEQ ID NO: 3533357 - RNA, 17 nt, Human
ggaucuuuguggccaag

SEQ ID NO: 3533358 - RNA, 18 nt, Human
ggaugaaauaacuccuuc

SEQ ID NO: 3533359 - RNA, 22 nt, Human
ggaugaagggcccgagaacaug

SEQ ID NO: 3533360 - RNA, 13 nt, Human
ggaugaaucuccc

SEQ ID NO: 3533361 - RNA, 14 nt, Human
ggaugaaugagguc

SEQ ID NO: 3533362 - RNA, 16 nt, Human
ggccuggcagcucagc

SEQ ID NO: 3533363 - RNA, 21 nt, Human
ggccuggcagggaggucaggc

SEQ ID NO: 3533364 - RNA, 19 nt, Human
ggccuggcauucuuguaca

SEQ ID NO: 3533365 - RNA, 17 nt, Human
ggccuggccaccucucu

SEQ ID NO: 3533366 - RNA, 17 nt, Human
ggccuggccaggagcuc

SEQ ID NO: 3533367 - RNA, 13 nt, Human
ggccuggccaggc

SEQ ID NO: 3533368 - RNA, 14 nt, Human
ggccuggccaggca

SEQ ID NO: 3533369 - RNA, 16 nt, Human
ggccuggccagugccc

SEQ ID NO: 3533370 - RNA, 19 nt, Human
ggccuggccagugcccuga

SEQ ID NO: 3533371 - RNA, 20 nt, Human
ggccuggccagugcccugau

SEQ ID NO: 3533372 - RNA, 15 nt, Human
ggccuggcccaugua

SEQ ID NO: 3533373 - RNA, 18 nt, Human
ggccuggccccucagggu

SEQ ID NO: 3533374 - RNA, 12 nt, Human
ggccuggcccug

SEQ ID NO: 3533375 - RNA, 10 nt, Human
ggccuggccu

SEQ ID NO: 3533376 - RNA, 19 nt, Human
ggccuggccugagcuggga

SEQ ID NO: 3533377 - RNA, 14 nt, Human
ggccuggccuggcc

SEQ ID NO: 3533378 - RNA, 18 nt, Human
ggccuggccuggcccugc

SEQ ID NO: 3533379 - RNA, 12 nt, Human
ggccuggcuccg

SEQ ID NO: 3533380 - RNA, 13 nt, Human
ggccuggcuccgc

SEQ ID NO: 3533381 - RNA, 23 nt, Human
ggcgugaucucagcucacugcaa

SEQ ID NO: 3533382 - RNA, 19 nt, Human
ggcgugcaguggugcgauc

SEQ ID NO: 3533383 - RNA, 19 nt, Human
ggcguggagccagggagcg

SEQ ID NO: 3533384 - RNA, 12 nt, Human
ggcguggagcug

SEQ ID NO: 3533385 - RNA, 17 nt, Human
ggcguggucacugcugu

SEQ ID NO: 3533386 - RNA, 19 nt, Human
ggcguggucacugcuguca

SEQ ID NO: 3533387 - RNA, 11 nt, Human
ggcguuucuuu

SEQ ID NO: 3533388 - RNA, 21 nt, Human
ggcuaaaaaagcugaaucaga

SEQ ID NO: 3533389 - RNA, 18 nt, Human
ggcuaaaauguuuucagc

SEQ ID NO: 3533390 - RNA, 19 nt, Human
ggcuaagagcuagcgcugc

SEQ ID NO: 3533391 - RNA, 16 nt, Human
ggcuaauguacugcau

SEQ ID NO: 3533392 - RNA, 15 nt, Human
ggcuaauuaaauaaa

SEQ ID NO: 3533393 - RNA, 21 nt, Human
ggcuaauuagcauggccacau

SEQ ID NO: 3533394 - RNA, 12 nt, Human
ggcuaauuuaac

SEQ ID NO: 3533395 - RNA, 23 nt, Human
ggcuacaauuuucucccaggaag

SEQ ID NO: 3533396 - RNA, 23 nt, Human
ggcuacaccuuagccugcccucc

SEQ ID NO: 3533397 - RNA, 12 nt, Human
ggcuacagagaa

SEQ ID NO: 3533398 - RNA, 14 nt, Human
ggcuaccaggaaag

SEQ ID NO: 3533399 - RNA, 13 nt, Human
ggcuaccuuugua

SEQ ID NO: 3533400 - RNA, 14 nt, Human
ggcuaccuuuguau

SEQ ID NO: 3533401 - RNA, 19 nt, Human
ggcuacucuccucggcccc

SEQ ID NO: 3533402 - RNA, 20 nt, Human
ggcuacucugugccagagcc

SEQ ID NO: 3533403 - RNA, 21 nt, Human
ggcuacucugugccagagccu

SEQ ID NO: 3533404 - RNA, 15 nt, Human
ggcuacugcagcuuu

SEQ ID NO: 3533405 - RNA, 16 nt, Human
ggcuagaaccuggagg

SEQ ID NO: 3533406 - RNA, 18 nt, Human
ggcuagaaccuggagggc

SEQ ID NO: 3533407 - RNA, 13 nt, Human
ggcuagaaucugg

SEQ ID NO: 3533408 - RNA, 22 nt, Human
ggcuagaaucuggagagcuaga

SEQ ID NO: 3533409 - RNA, 18 nt, Human
ggcuagaggccagcccca

SEQ ID NO: 3533410 - RNA, 20 nt, Human
ggcuagaggccagccccacc

SEQ ID NO: 3533411 - RNA, 14 nt, Human
ggcuagaguccuca

SEQ ID NO: 3533412 - RNA, 20 nt, Human
ggcuagagugcaguggcaug

SEQ ID NO: 3533413 - RNA, 15 nt, Human
ggcuagaucaugaag

SEQ ID NO: 3533414 - RNA, 15 nt, Human
ggcuagguagaaaaa

SEQ ID NO: 3533415 - RNA, 20 nt, Human
ggcuagguagaaaaaggguc

SEQ ID NO: 3533416 - RNA, 19 nt, Human
ggcuagucaagcuccuccu

SEQ ID NO: 3533417 - RNA, 22 nt, Human
ggcuagucaagcuccuccuccc

SEQ ID NO: 3533418 - RNA, 18 nt, Human
ggcuagucagagagagug

SEQ ID NO: 3533419 - RNA, 20 nt, Human
ggcuagugacuuguguccca

SEQ ID NO: 3533420 - RNA, 17 nt, Human
ggcuauagaugucuuuu

SEQ ID NO: 3533421 - RNA, 19 nt, Human
ggcuauagaugucuuuucc

SEQ ID NO: 3533422 - RNA, 23 nt, Human
ggcuauaggugcuacaaaaacac

SEQ ID NO: 3533423 - RNA, 15 nt, Human
ggcuaugcauuugaa

SEQ ID NO: 3533424 - RNA, 19 nt, Human
ggcuaugggggcacugagg

SEQ ID NO: 3533425 - RNA, 21 nt, Human
ggcuauuuuguuugcuucaug

SEQ ID NO: 3533426 - RNA, 18 nt, Human
ggcucacacugagaaugu

SEQ ID NO: 3533427 - RNA, 23 nt, Human
ggcucacgccuaugaucccagca

SEQ ID NO: 3533428 - RNA, 18 nt, Human
ggcucacgccuguaaucc

SEQ ID NO: 3533429 - RNA, 22 nt, Human
ggcucacgccuguaaucccagc

SEQ ID NO: 3533430 - RNA, 18 nt, Human
ggcucacuauggugccaa

SEQ ID NO: 3533431 - RNA, 19 nt, Human
ggcucacuauggugccaau

SEQ ID NO: 3533432 - RNA, 13 nt, Human
ggcucacugcagc

SEQ ID NO: 3533433 - RNA, 15 nt, Human
ggcucacugcagccu

SEQ ID NO: 3533434 - RNA, 14 nt, Human
ggcucacugccagg

SEQ ID NO: 3533435 - RNA, 15 nt, Human
ggcucacugccaggc

SEQ ID NO: 3533436 - RNA, 18 nt, Human
ggcucacugccaggccag

SEQ ID NO: 3533437 - RNA, 12 nt, Human
ggcucagagggg

SEQ ID NO: 3533438 - RNA, 19 nt, Human
ggcucagcaaaagaugcuu

SEQ ID NO: 3533439 - RNA, 18 nt, Human
ggcucagcaaggccaccu

SEQ ID NO: 3533440 - RNA, 20 nt, Human
ggcucagcaaggccaccucu

SEQ ID NO: 3533441 - RNA, 22 nt, Human
ggcucagccccaccccagggca

SEQ ID NO: 3533442 - RNA, 23 nt, Human
ggcucagccccaccccagggcag

SEQ ID NO: 3533443 - RNA, 18 nt, Human
ggcucagcucuggcucac

SEQ ID NO: 3533444 - RNA, 21 nt, Human
ggcucagcucuggcucacaga

SEQ ID NO: 3533445 - RNA, 16 nt, Human
ggcucagggaccacag

SEQ ID NO: 3533446 - RNA, 17 nt, Human
ggcucagggaccacagc

SEQ ID NO: 3533447 - RNA, 22 nt, Human
ggcucagggagguuaagugacu

SEQ ID NO: 3533448 - RNA, 12 nt, Human
ggcucagggugg

SEQ ID NO: 3533449 - RNA, 17 nt, Human
ggcucagucucaggagc

SEQ ID NO: 3533450 - RNA, 20 nt, Human
ggcucagugaaguugcugcu

SEQ ID NO: 3533451 - RNA, 20 nt, Human
ggcucauauuccugcagccu

SEQ ID NO: 3533452 - RNA, 18 nt, Human
ggcuccaagaccuaggcu

SEQ ID NO: 3533453 - RNA, 14 nt, Human
ggcuccacuugguc

SEQ ID NO: 3533454 - RNA, 9 nt, Human
ggcuccaga

SEQ ID NO: 3533455 - RNA, 14 nt, Human
ggcuccagaaaugu

SEQ ID NO: 3533456 - RNA, 10 nt, Human
ggcuccagac

SEQ ID NO: 3533457 - RNA, 16 nt, Human
ggcuccagaugcaggg

SEQ ID NO: 3533458 - RNA, 15 nt, Human
ggcuccagccaucuc

SEQ ID NO: 3533459 - RNA, 21 nt, Human
ggcuccagccccucuuggaga

SEQ ID NO: 3533460 - RNA, 23 nt, Human
ggcuccagccccucuuggagaag

SEQ ID NO: 3533461 - RNA, 14 nt, Human
ggcuccaggagcag

SEQ ID NO: 3533462 - RNA, 16 nt, Human
ggcuccaggagcagcc

SEQ ID NO: 3533463 - RNA, 19 nt, Human
ggcuccaggagcagccaca

SEQ ID NO: 3533464 - RNA, 13 nt, Human
ggcuccaggcagc

SEQ ID NO: 3533465 - RNA, 11 nt, Human
ggcuccaggcu

SEQ ID NO: 3533466 - RNA, 13 nt, Human
ggcuccaggcucc

SEQ ID NO: 3533467 - RNA, 16 nt, Human
ggcucccacaggcagc

SEQ ID NO: 3533468 - RNA, 17 nt, Human
ggcucccacaggcagcu

SEQ ID NO: 3533469 - RNA, 20 nt, Human
ggcucccacaggcccuuccu

SEQ ID NO: 3533470 - RNA, 14 nt, Human
ggcucccagccagg

SEQ ID NO: 3533471 - RNA, 13 nt, Human
ggcucccagccuc

SEQ ID NO: 3533472 - RNA, 15 nt, Human
ggcucccagccucag

SEQ ID NO: 3533473 - RNA, 14 nt, Human
ggcucccaggacac

SEQ ID NO: 3533474 - RNA, 20 nt, Human
ggcucccaggagccugccca

SEQ ID NO: 3533475 - RNA, 22 nt, Human
ggcucccaggggcucccuccgc

SEQ ID NO: 3533476 - RNA, 22 nt, Human
ggcucccaggggucucccuggc

SEQ ID NO: 3533477 - RNA, 23 nt, Human
ggcucccaggggucucccuggcu

SEQ ID NO: 3533478 - RNA, 17 nt, Human
ggcuccccauguguccu

SEQ ID NO: 3533479 - RNA, 21 nt, Human
ggcuccccauguguccugguu

SEQ ID NO: 3533480 - RNA, 12 nt, Human
ggcuccccucuu

SEQ ID NO: 3533481 - RNA, 12 nt, Human
ggcuccccugag

SEQ ID NO: 3533482 - RNA, 13 nt, Human
ggcuccccugagg

SEQ ID NO: 3533483 - RNA, 15 nt, Human
ggcuccccugcagcc

SEQ ID NO: 3533484 - RNA, 18 nt, Human
ggcuccccugcagcccug

SEQ ID NO: 3533485 - RNA, 12 nt, Human
ggcuccccuggg

SEQ ID NO: 3533486 - RNA, 21 nt, Human
ggcucccgccuccaaccccuc

SEQ ID NO: 3533487 - RNA, 19 nt, Human
ggcucccggggcagggcag

SEQ ID NO: 3533488 - RNA, 15 nt, Human
ggcucccucacucuc

SEQ ID NO: 3533489 - RNA, 18 nt, Human
ggcucccucacucucagg

SEQ ID NO: 3533490 - RNA, 19 nt, Human
ggcucccucacucucagga

SEQ ID NO: 3533491 - RNA, 15 nt, Human
ggcucccuccuccag

SEQ ID NO: 3533492 - RNA, 16 nt, Human
ggcucccucuucuuuc

SEQ ID NO: 3533493 - RNA, 18 nt, Human
ggcucccugacugggagu

SEQ ID NO: 3533494 - RNA, 20 nt, Human
ggcucccuguaaccucuuca

SEQ ID NO: 3533495 - RNA, 21 nt, Human
ggcucccuguaaccucuucag

SEQ ID NO: 3533496 - RNA, 18 nt, Human
ggcucccuucccaccucu

SEQ ID NO: 3533497 - RNA, 20 nt, Human
ggcucccuucccaccucucu

SEQ ID NO: 3533498 - RNA, 22 nt, Human
ggcucccuucccaccucucuca

SEQ ID NO: 3533499 - RNA, 15 nt, Human
ggcuccgaacacccu

SEQ ID NO: 3533500 - RNA, 21 nt, Human
ggcuccgcccuuaguccccca

SEQ ID NO: 3533501 - RNA, 24 nt, Human
ggcuccgucaguaucaggccugcc

SEQ ID NO: 3533502 - RNA, 15 nt, Human
ggcuccgugugggag

SEQ ID NO: 3533503 - RNA, 17 nt, Human
ggcuccuauucaacaca

SEQ ID NO: 3533504 - RNA, 12 nt, Human
ggcuccucccag

SEQ ID NO: 3533505 - RNA, 21 nt, Human
ggcuccucuguggugucugcc

SEQ ID NO: 3533506 - RNA, 18 nt, Human
ggcuccugccuucugucc

SEQ ID NO: 3533507 - RNA, 19 nt, Human
ggcuccugccuucuguccu

SEQ ID NO: 3533508 - RNA, 23 nt, Human
ggcuccugcugcaccaacccagc

SEQ ID NO: 3533509 - RNA, 13 nt, Human
ggcuccuggaaag

SEQ ID NO: 3533510 - RNA, 10 nt, Human
ggcuccuggu

SEQ ID NO: 3533511 - RNA, 12 nt, Human
ggcuccugugcu

SEQ ID NO: 3533512 - RNA, 20 nt, Human
ggcuccugugcuacuuugcc

SEQ ID NO: 3533513 - RNA, 23 nt, Human
ggcuccugugcuacuuugccuuu

SEQ ID NO: 3533514 - RNA, 14 nt, Human
ggcuccuguuuugc

SEQ ID NO: 3533515 - RNA, 22 nt, Human
ggcuccuuaggguuuucucucu

SEQ ID NO: 3533516 - RNA, 17 nt, Human
ggcuccuugguucuuga

SEQ ID NO: 3533517 - RNA, 16 nt, Human
ggcuccuugugccaga

SEQ ID NO: 3533518 - RNA, 15 nt, Human
ggcucgaaucucugu

SEQ ID NO: 3533519 - RNA, 20 nt, Human
ggcucgauuuuguaucugca

SEQ ID NO: 3533520 - RNA, 22 nt, Human
ggcucgauuuuguaucugcagg

SEQ ID NO: 3533521 - RNA, 23 nt, Human
ggcucgccucaggaaugggcugu

SEQ ID NO: 3533522 - RNA, 17 nt, Human
ggcucggaggcugcccc

SEQ ID NO: 3533523 - RNA, 22 nt, Human
ggcucgucggggggacagcucc

SEQ ID NO: 3533524 - RNA, 22 nt, Human
ggcucuaacgccugagcccagg

SEQ ID NO: 3533525 - RNA, 15 nt, Human
ggccagaccugcaga

SEQ ID NO: 3533526 - RNA, 11 nt, Human
ggccagacucg

SEQ ID NO: 3533527 - RNA, 18 nt, Human
ggccagagagccuggugc

SEQ ID NO: 3533528 - RNA, 21 nt, Human
ggccagagagccuggugcugc

SEQ ID NO: 3533529 - RNA, 13 nt, Human
ggccagagcccac

SEQ ID NO: 3533530 - RNA, 15 nt, Human
ggccagagcccacuc

SEQ ID NO: 3533531 - RNA, 21 nt, Human
ggccagaggaacuguccagag

SEQ ID NO: 3533532 - RNA, 22 nt, Human
ggccagaggaacuguccagaga

SEQ ID NO: 3533533 - RNA, 17 nt, Human
ggccagaggcagaaccc

SEQ ID NO: 3533534 - RNA, 18 nt, Human
ggccagaggcccccagcc

SEQ ID NO: 3533535 - RNA, 22 nt, Human
ggccagaggcccccagcccagg

SEQ ID NO: 3533536 - RNA, 11 nt, Human
ggccagaggcu

SEQ ID NO: 3533537 - RNA, 14 nt, Human
ggccagaguggccu

SEQ ID NO: 3533538 - RNA, 19 nt, Human
ggccagaguggccuggcca

SEQ ID NO: 3533539 - RNA, 20 nt, Human
ggccagaguggccuggccag

SEQ ID NO: 3533540 - RNA, 20 nt, Human
ggccagaugcacaucccugg

SEQ ID NO: 3533541 - RNA, 23 nt, Human
ggccagaugcacaucccuggaag

SEQ ID NO: 3533542 - RNA, 17 nt, Human
ggccagcaacgcuugua

SEQ ID NO: 3533543 - RNA, 18 nt, Human
ggccagcaagguggagug

SEQ ID NO: 3533544 - RNA, 18 nt, Human
ggccagcaccaucucuuu

SEQ ID NO: 3533545 - RNA, 12 nt, Human
ggccagcagcuu

SEQ ID NO: 3533546 - RNA, 14 nt, Human
ggccagccaggcgg

SEQ ID NO: 3533547 - RNA, 16 nt, Human
ggccagccaggcgggc

SEQ ID NO: 3533548 - RNA, 15 nt, Human
ggccagccaugucug

SEQ ID NO: 3533549 - RNA, 13 nt, Human
ggccagccccaca

SEQ ID NO: 3533550 - RNA, 20 nt, Human
ggccagccccacccaggagg

SEQ ID NO: 3533551 - RNA, 11 nt, Human
ggccagccccg

SEQ ID NO: 3533552 - RNA, 15 nt, Human
ggccagccccggccc

SEQ ID NO: 3533553 - RNA, 19 nt, Human
ggccagccccggcccuggg

SEQ ID NO: 3533554 - RNA, 20 nt, Human
ggccagccccggcccugggc

SEQ ID NO: 3533555 - RNA, 17 nt, Human
ggccagccccuccaucu

SEQ ID NO: 3533556 - RNA, 20 nt, Human
ggccagccccuuagacagag

SEQ ID NO: 3533557 - RNA, 21 nt, Human
ggccagccccuuagacagagg

SEQ ID NO: 3533558 - RNA, 23 nt, Human
ggccagccccuuagacagaggcc

SEQ ID NO: 3533559 - RNA, 22 nt, Human
ggccagccgcgcaucagacugu

SEQ ID NO: 3533560 - RNA, 15 nt, Human
ggccagccgcucucc

SEQ ID NO: 3533561 - RNA, 18 nt, Human
ggccagccucacccuugc

SEQ ID NO: 3533562 - RNA, 11 nt, Human
ggccagccucu

SEQ ID NO: 3533563 - RNA, 11 nt, Human
ggccagccugg

SEQ ID NO: 3533564 - RNA, 17 nt, Human
ggccagccuggccuccu

SEQ ID NO: 3533565 - RNA, 20 nt, Human
ggccagccuugaccauucuc

SEQ ID NO: 3533566 - RNA, 13 nt, Human
ggccagcguggcu

SEQ ID NO: 3533567 - RNA, 23 nt, Human
ggccagcugcuugggcuucaucc

SEQ ID NO: 3533568 - RNA, 13 nt, Human
ggccagcuggagg

SEQ ID NO: 3533569 - RNA, 18 nt, Human
ggccagcuggaggcaggg

SEQ ID NO: 3533570 - RNA, 23 nt, Human
ggccagcugggaucugacugcac

SEQ ID NO: 3533571 - RNA, 18 nt, Human
ggccaggacucugcagcc

SEQ ID NO: 3533572 - RNA, 14 nt, Human
ggccaggagaugga

SEQ ID NO: 3533573 - RNA, 11 nt, Human
ggccaggagcc

SEQ ID NO: 3533574 - RNA, 16 nt, Human
ggccaggagccuccug

SEQ ID NO: 3533575 - RNA, 13 nt, Human
ggccaggagcucu

SEQ ID NO: 3533576 - RNA, 16 nt, Human
ggccaggauggagggg

SEQ ID NO: 3533577 - RNA, 15 nt, Human
ggccaggcagaucug

SEQ ID NO: 3533578 - RNA, 22 nt, Human
ggccaggcagaucugugcccca

SEQ ID NO: 3533579 - RNA, 11 nt, Human
ggccaggcagg

SEQ ID NO: 3533580 - RNA, 12 nt, Human
ggccaggcaggu

SEQ ID NO: 3533581 - RNA, 16 nt, Human
ggccaggccagaggga

SEQ ID NO: 3533582 - RNA, 13 nt, Human
ggccaggcccucu

SEQ ID NO: 3533583 - RNA, 18 nt, Human
ggccaggcccucugccca

SEQ ID NO: 3533584 - RNA, 23 nt, Human
gggaggaagcagaauaaagcaau

SEQ ID NO: 3533585 - RNA, 16 nt, Human
gggaggacaaaacuuc

SEQ ID NO: 3533586 - RNA, 20 nt, Human
gggaggaccugacccuacuc

SEQ ID NO: 3533587 - RNA, 12 nt, Human
gggaggaccugg

SEQ ID NO: 3533588 - RNA, 17 nt, Human
gggaggaccuggggcac

SEQ ID NO: 3533589 - RNA, 12 nt, Human
gggaggagaaga

SEQ ID NO: 3533590 - RNA, 17 nt, Human
gggaggaucacuggagc

SEQ ID NO: 3533591 - RNA, 19 nt, Human
gggaggaucacuggagccc

SEQ ID NO: 3533592 - RNA, 23 nt, Human
gggaggauugcuugagcucagga

SEQ ID NO: 3533593 - RNA, 11 nt, Human
gggaggcagag

SEQ ID NO: 3533594 - RNA, 16 nt, Human
gggaggcauggcccug

SEQ ID NO: 3533595 - RNA, 22 nt, Human
gggaggccaagaguggccccac

SEQ ID NO: 3533596 - RNA, 17 nt, Human
gggaggccagugagcca

SEQ ID NO: 3533597 - RNA, 11 nt, Human
gggaggcccca

SEQ ID NO: 3533598 - RNA, 14 nt, Human
gggaggccccaggg

SEQ ID NO: 3533599 - RNA, 15 nt, Human
gggaggccgaggcgg

SEQ ID NO: 3533600 - RNA, 20 nt, Human
gggaggcggacguuccagcc

SEQ ID NO: 3533601 - RNA, 18 nt, Human
gggaggcugaggcaggag

SEQ ID NO: 3533602 - RNA, 20 nt, Human
gggaggcuggaagcugggag

SEQ ID NO: 3533603 - RNA, 16 nt, Human
gggagggagggcucca

SEQ ID NO: 3533604 - RNA, 11 nt, Human
gggagggcaga

SEQ ID NO: 3533605 - RNA, 15 nt, Human
gggagggcagagcug

SEQ ID NO: 3533606 - RNA, 20 nt, Human
gggagggcagagcuggugcg

SEQ ID NO: 3533607 - RNA, 13 nt, Human
gggagggcagcag

SEQ ID NO: 3533608 - RNA, 17 nt, Human
gggagggcuccagacac

SEQ ID NO: 3533609 - RNA, 18 nt, Human
gggagggcucugaggcgc

SEQ ID NO: 3533610 - RNA, 19 nt, Human
gggagggcucugaggcgcc

SEQ ID NO: 3533611 - RNA, 16 nt, Human
gggaggggaaaagcau

SEQ ID NO: 3533612 - RNA, 16 nt, Human
gggaggggagacuuug

SEQ ID NO: 3533613 - RNA, 12 nt, Human
gggaggggcagg

SEQ ID NO: 3533614 - RNA, 14 nt, Human
gggaggggccuagg

SEQ ID NO: 3533615 - RNA, 16 nt, Human
gggaggggcgcuggcc

SEQ ID NO: 3533616 - RNA, 23 nt, Human
gggaggggcggcaggagggaggu

SEQ ID NO: 3533617 - RNA, 14 nt, Human
gggagggggagagg

SEQ ID NO: 3533618 - RNA, 13 nt, Human
gggagggggaggg

SEQ ID NO: 3533619 - RNA, 22 nt, Human
gggagggguaaaauuccuuagc

SEQ ID NO: 3533620 - RNA, 16 nt, Human
gggaggucaggcccug

SEQ ID NO: 3533621 - RNA, 22 nt, Human
gggaggucaggcccuggaacuc

SEQ ID NO: 3533622 - RNA, 14 nt, Human
gggaggucauuuug

SEQ ID NO: 3533623 - RNA, 18 nt, Human
gggaggucgaggcaggag

SEQ ID NO: 3533624 - RNA, 19 nt, Human
gggaggucgaggcaggagg

SEQ ID NO: 3533625 - RNA, 14 nt, Human
gggagguggcuggg

SEQ ID NO: 3533626 - RNA, 13 nt, Human
gggagguguucac

SEQ ID NO: 3533627 - RNA, 18 nt, Human
gggagguugaucagaucu

SEQ ID NO: 3533628 - RNA, 21 nt, Human
gggagucaucucaaccauccc

SEQ ID NO: 3533629 - RNA, 19 nt, Human
gggaguccaggcacaggau

SEQ ID NO: 3533630 - RNA, 23 nt, Human
gggagucugaagcagaugcaaag

SEQ ID NO: 3533631 - RNA, 19 nt, Human
gggagugcuggcucacagu

SEQ ID NO: 3533632 - RNA, 21 nt, Human
gggaguggaauaguauccucc

SEQ ID NO: 3533633 - RNA, 21 nt, Human
gggagugggacagagucuggg

SEQ ID NO: 3533634 - RNA, 15 nt, Human
gggaguuaagaccug

SEQ ID NO: 3533635 - RNA, 20 nt, Human
gggaguucgagaccaaccug

SEQ ID NO: 3533636 - RNA, 16 nt, Human
gggaguuuaggguggg

SEQ ID NO: 3533637 - RNA, 22 nt, Human
gggauacaaccucccucuuguu

SEQ ID NO: 3533638 - RNA, 15 nt, Human
gggauacaugcucuu

SEQ ID NO: 3533639 - RNA, 15 nt, Human
gggauaggccagccg

SEQ ID NO: 3533640 - RNA, 15 nt, Human
gggauauuuuuuucu

SEQ ID NO: 3533641 - RNA, 22 nt, Human
gggauccccgccuggccaggag

SEQ ID NO: 3533642 - RNA, 19 nt, Human
gggaucccugucuuuccua

SEQ ID NO: 3533643 - RNA, 15 nt, Human
gggauccuccaggug

SEQ ID NO: 3533644 - RNA, 23 nt, Human
gggauccuggaguucugguuccu

SEQ ID NO: 3533645 - RNA, 20 nt, Human
gggaugaaacuaaagcaaua

SEQ ID NO: 3533646 - RNA, 15 nt, Human
gggaugaaagagaag

SEQ ID NO: 3533647 - RNA, 19 nt, Human
gggaugacuaaaauauuua

SEQ ID NO: 3533648 - RNA, 23 nt, Human
gggaugacuagaggcagggaggg

SEQ ID NO: 3533649 - RNA, 13 nt, Human
gggaugagaaagg

SEQ ID NO: 3533650 - RNA, 20 nt, Human
gggaugagcauggagcuggc

SEQ ID NO: 3533651 - RNA, 20 nt, Human
gggaugagcucaagcaggaa

SEQ ID NO: 3533652 - RNA, 22 nt, Human
gggaugaugccacaccaagcug

SEQ ID NO: 3533653 - RNA, 20 nt, Human
gggaugccacuccucccucc

SEQ ID NO: 3533654 - RNA, 15 nt, Human
gggauggaggagaag

SEQ ID NO: 3533655 - RNA, 12 nt, Human
gggaugggaggu

SEQ ID NO: 3533656 - RNA, 15 nt, Human
gggaugggccaccgc

SEQ ID NO: 3533657 - RNA, 17 nt, Human
gggauggggccacagcc

SEQ ID NO: 3533658 - RNA, 14 nt, Human
gggaugguaguuuu

SEQ ID NO: 3533659 - RNA, 18 nt, Human
gggaugguggagggccac

SEQ ID NO: 3533660 - RNA, 16 nt, Human
gggaugguguucaaaa

SEQ ID NO: 3533661 - RNA, 23 nt, Human
gggauguauccaugggggcaggg

SEQ ID NO: 3533662 - RNA, 11 nt, Human
gggaugucuua

SEQ ID NO: 3533663 - RNA, 20 nt, Human
gggauguggcugcagcagcg

SEQ ID NO: 3533664 - RNA, 14 nt, Human
gggaugugggaggg

SEQ ID NO: 3533665 - RNA, 22 nt, Human
gggaugugugugugcagagcug

SEQ ID NO: 3533666 - RNA, 12 nt, Human
gggauuacaggu

SEQ ID NO: 3533667 - RNA, 15 nt, Human
gggauuacaggugug

SEQ ID NO: 3533668 - RNA, 17 nt, Human
gggauuaugggucacag

SEQ ID NO: 3533669 - RNA, 22 nt, Human
gggauucaggaaaaggccuggg

SEQ ID NO: 3533670 - RNA, 13 nt, Human
gggccaaaaggaa

SEQ ID NO: 3533671 - RNA, 15 nt, Human
gggccaaaaggaaaa

SEQ ID NO: 3533672 - RNA, 18 nt, Human
gggccaaacgcugagcca

SEQ ID NO: 3533673 - RNA, 15 nt, Human
gggccaacaccaggg

SEQ ID NO: 3533674 - RNA, 16 nt, Human
gggccaacaccaggga

SEQ ID NO: 3533675 - RNA, 13 nt, Human
gggccaagcccag

SEQ ID NO: 3533676 - RNA, 13 nt, Human
gggccaaggaccu

SEQ ID NO: 3533677 - RNA, 14 nt, Human
gggccaaggaccug

SEQ ID NO: 3533678 - RNA, 15 nt, Human
gggccaaggaccuga

SEQ ID NO: 3533679 - RNA, 15 nt, Human
gggccacacagaaac

SEQ ID NO: 3533680 - RNA, 16 nt, Human
gggccacagagaaagu

SEQ ID NO: 3533681 - RNA, 23 nt, Human
gggccacagagaaaguacuucuc

SEQ ID NO: 3533682 - RNA, 14 nt, Human
gggccacagccaga

SEQ ID NO: 3533683 - RNA, 16 nt, Human
gggccaccaaagcugc

SEQ ID NO: 3533684 - RNA, 17 nt, Human
gggccaccaaagcugcc

SEQ ID NO: 3533685 - RNA, 14 nt, Human
gggccaccccuccu

SEQ ID NO: 3533686 - RNA, 19 nt, Human
gggccaccuccccaggccg

SEQ ID NO: 3533687 - RNA, 22 nt, Human
gggccaccuccccaggccgugg

SEQ ID NO: 3533688 - RNA, 14 nt, Human
gggccacgugccag

SEQ ID NO: 3533689 - RNA, 18 nt, Human
gggccacgugccaggccc

SEQ ID NO: 3533690 - RNA, 16 nt, Human
gggccacuccuuccug

SEQ ID NO: 3533691 - RNA, 20 nt, Human
gggccacuccuuccugcccc

SEQ ID NO: 3533692 - RNA, 17 nt, Human
gggccacucugccucug

SEQ ID NO: 3533693 - RNA, 22 nt, Human
gggccacuucuggguggggcag

SEQ ID NO: 3533694 - RNA, 11 nt, Human
gggccagagcc

SEQ ID NO: 3533695 - RNA, 12 nt, Human
gggccagagcca

SEQ ID NO: 3533696 - RNA, 22 nt, Human
gggccagaggaacuguccagag

SEQ ID NO: 3533697 - RNA, 14 nt, Human
gggccagauccagc

SEQ ID NO: 3533698 - RNA, 16 nt, Human
gggccagauccagccu

SEQ ID NO: 3533699 - RNA, 18 nt, Human
gggccagauccagccugg

SEQ ID NO: 3533700 - RNA, 14 nt, Human
gggccagccaggcg

SEQ ID NO: 3533701 - RNA, 16 nt, Human
gggccagccaggcggg

SEQ ID NO: 3533702 - RNA, 11 nt, Human
gggccagccuc

SEQ ID NO: 3533703 - RNA, 11 nt, Human
gggccaggagc

SEQ ID NO: 3533704 - RNA, 14 nt, Human
gggccaggagccuc

SEQ ID NO: 3533705 - RNA, 12 nt, Human
gggccaggcagg

SEQ ID NO: 3533706 - RNA, 13 nt, Human
gggccaggcaggu

SEQ ID NO: 3533707 - RNA, 20 nt, Human
gggccaggcaggugccugga

SEQ ID NO: 3533708 - RNA, 14 nt, Human
gggccaggccgggc

SEQ ID NO: 3533709 - RNA, 22 nt, Human
gggccaggccgggccuguacag

SEQ ID NO: 3533710 - RNA, 13 nt, Human
gggccaggcuggg

SEQ ID NO: 3533711 - RNA, 22 nt, Human
gggccaggcugggucgcccugg

SEQ ID NO: 3533712 - RNA, 12 nt, Human
gggccagggcug

SEQ ID NO: 3533713 - RNA, 23 nt, Human
gggccaggggucucccuggagug

SEQ ID NO: 3533714 - RNA, 19 nt, Human
gggccaguccugccuggcc

SEQ ID NO: 3533715 - RNA, 20 nt, Human
gggccaguccugccuggcca

SEQ ID NO: 3533716 - RNA, 21 nt, Human
gggccaguccugccuggccag

SEQ ID NO: 3533717 - RNA, 18 nt, Human
gggccaguggggccugug

SEQ ID NO: 3533718 - RNA, 19 nt, Human
gggccaguggggccugugg

SEQ ID NO: 3533719 - RNA, 22 nt, Human
gggccaguuggucccccuucca

SEQ ID NO: 3533720 - RNA, 14 nt, Human
gggccauacuggcc

SEQ ID NO: 3533721 - RNA, 17 nt, Human
gggccauacuggccucg

SEQ ID NO: 3533722 - RNA, 22 nt, Human
gggccauacuggccucgccugg

SEQ ID NO: 3533723 - RNA, 18 nt, Human
gggccaugaacuuugucc

SEQ ID NO: 3533724 - RNA, 23 nt, Human
gggccaugccuccucaggagccg

SEQ ID NO: 3533725 - RNA, 14 nt, Human
gggccaugcugaag

SEQ ID NO: 3533726 - RNA, 15 nt, Human
gggccaugcugaagg

SEQ ID NO: 3533727 - RNA, 14 nt, Human
gggccaugcugagg

SEQ ID NO: 3533728 - RNA, 15 nt, Human
gggccaugcugaggc

SEQ ID NO: 3533729 - RNA, 17 nt, Human
gggccaugcugaggccu

SEQ ID NO: 3533730 - RNA, 17 nt, Human
gggccaugucagacaca

SEQ ID NO: 3533731 - RNA, 18 nt, Human
gggccauucuccacagca

SEQ ID NO: 3533732 - RNA, 19 nt, Human
gggccauugaacucugaga

SEQ ID NO: 3533733 - RNA, 14 nt, Human
gggcccaacccugu

SEQ ID NO: 3533734 - RNA, 16 nt, Human
gggcccaacccugucu

SEQ ID NO: 3533735 - RNA, 20 nt, Human
gggcccaagucccuguuuuc

SEQ ID NO: 3533736 - RNA, 16 nt, Human
gggcccaccuggccac

SEQ ID NO: 3533737 - RNA, 19 nt, Human
gggcccaccuggccaccug

SEQ ID NO: 3533738 - RNA, 19 nt, Human
gggcccacgugguuggggc

SEQ ID NO: 3533739 - RNA, 14 nt, Human
gggcccagagcagg

SEQ ID NO: 3533740 - RNA, 12 nt, Human
gggcccagagcc

SEQ ID NO: 3533741 - RNA, 19 nt, Human
gggcccagagcccagcucc

SEQ ID NO: 3533742 - RNA, 14 nt, Human
gggcccagaggcug

SEQ ID NO: 3533743 - RNA, 14 nt, Human
gggcccagauucua

SEQ ID NO: 3533744 - RNA, 12 nt, Human
gggcccagcccc

SEQ ID NO: 3533745 - RNA, 12 nt, Human
gggcccagcugg

SEQ ID NO: 3533746 - RNA, 15 nt, Human
gggcccagcugggcu

SEQ ID NO: 3533747 - RNA, 16 nt, Human
gggcccaggaccagcu

SEQ ID NO: 3533748 - RNA, 17 nt, Human
gggcccaggaccagcug

SEQ ID NO: 3533749 - RNA, 13 nt, Human
gggcccaggcagg

SEQ ID NO: 3533750 - RNA, 21 nt, Human
gaaauaucugaaaauguaugu

SEQ ID NO: 3533751 - RNA, 14 nt, Human
gaaauaugaaugcc

SEQ ID NO: 3533752 - RNA, 18 nt, Human
gaaauaugcucuuuuguu

SEQ ID NO: 3533753 - RNA, 13 nt, Human
gaaauauguauaa

SEQ ID NO: 3533754 - RNA, 13 nt, Human
gaaauaugugaga

SEQ ID NO: 3533755 - RNA, 13 nt, Human
gaaauauuauguu

SEQ ID NO: 3533756 - RNA, 15 nt, Human
gaaauauucccuaga

SEQ ID NO: 3533757 - RNA, 19 nt, Human
gaaauauuuagcaaauaau

SEQ ID NO: 3533758 - RNA, 18 nt, Human
gaaauauuuauuuuaaua

SEQ ID NO: 3533759 - RNA, 22 nt, Human
gaaauauuuauuuuaauaaugu

SEQ ID NO: 3533760 - RNA, 13 nt, Human
gaaauauuuugau

SEQ ID NO: 3533761 - RNA, 19 nt, Human
gaaauauuuugauaauaaa

SEQ ID NO: 3533762 - RNA, 21 nt, Human
gaaauauuuugauaauaaauu

SEQ ID NO: 3533763 - RNA, 23 nt, Human
gaaauauuuugauaauaaauuga

SEQ ID NO: 3533764 - RNA, 16 nt, Human
gaaaucaaauaugcaa

SEQ ID NO: 3533765 - RNA, 17 nt, Human
gaaaucaaauaugcaaa

SEQ ID NO: 3533766 - RNA, 18 nt, Human
gaaaucaaauaugcaaag

SEQ ID NO: 3533767 - RNA, 20 nt, Human
gaaaucaaauaugcaaagca

SEQ ID NO: 3533768 - RNA, 17 nt, Human
gaaaucaaauguaaagu

SEQ ID NO: 3533769 - RNA, 16 nt, Human
gaaaucacagaaucau

SEQ ID NO: 3533770 - RNA, 22 nt, Human
gaaaucauauuuggaauaaaaa

SEQ ID NO: 3533771 - RNA, 14 nt, Human
gaaaucauguuaug

SEQ ID NO: 3533772 - RNA, 19 nt, Human
gaaaucauguuaugauaaa

SEQ ID NO: 3533773 - RNA, 18 nt, Human
gaaauccagggugguggu

SEQ ID NO: 3533774 - RNA, 14 nt, Human
gaaauccauucaca

SEQ ID NO: 3533775 - RNA, 18 nt, Human
gaaaucccugcucacugc

SEQ ID NO: 3533776 - RNA, 18 nt, Human
gaaaucccuguuuaauau

SEQ ID NO: 3533777 - RNA, 19 nt, Human
gaaaucccuguuuaauauu

SEQ ID NO: 3533778 - RNA, 14 nt, Human
gaaaucccuucaua

SEQ ID NO: 3533779 - RNA, 19 nt, Human
gaaaucccuucauacuuga

SEQ ID NO: 3533780 - RNA, 21 nt, Human
gaaauccuaguuuccucuccu

SEQ ID NO: 3533781 - RNA, 22 nt, Human
gaaauccuaguuuccucuccuu

SEQ ID NO: 3533782 - RNA, 14 nt, Human
gaaauccugguucc

SEQ ID NO: 3533783 - RNA, 19 nt, Human
gaaauccuugacuggaccu

SEQ ID NO: 3533784 - RNA, 14 nt, Human
gaaaucuauagaaa

SEQ ID NO: 3533785 - RNA, 19 nt, Human
gaaaucuauagaaaguguu

SEQ ID NO: 3533786 - RNA, 23 nt, Human
gaaaucuauagaaaguguucugu

SEQ ID NO: 3533787 - RNA, 19 nt, Human
gaaaucucacuuuucucca

SEQ ID NO: 3533788 - RNA, 23 nt, Human
gaaaucuggcuucuggccaggaa

SEQ ID NO: 3533789 - RNA, 22 nt, Human
gaaaucuguaucuguagugaga

SEQ ID NO: 3533790 - RNA, 20 nt, Human
gaaaucugucaagaguaguu

SEQ ID NO: 3533791 - RNA, 14 nt, Human
gaaaucuuuuaaaa

SEQ ID NO: 3533792 - RNA, 13 nt, Human
gaaaugaaauuuu

SEQ ID NO: 3533793 - RNA, 19 nt, Human
gaaaugaaauuuuaccaag

SEQ ID NO: 3533794 - RNA, 14 nt, Human
gaaaugaacacaaa

SEQ ID NO: 3533795 - RNA, 13 nt, Human
gaaaugaacauuc

SEQ ID NO: 3533796 - RNA, 14 nt, Human
gaaaugaacauucc

SEQ ID NO: 3533797 - RNA, 18 nt, Human
gaaaugaagagcuguuga

SEQ ID NO: 3533798 - RNA, 18 nt, Human
gaaaugaauaauuuccca

SEQ ID NO: 3533799 - RNA, 12 nt, Human
gaaaugaauaua

SEQ ID NO: 3533800 - RNA, 13 nt, Human
gaaaugaaugugu

SEQ ID NO: 3533801 - RNA, 14 nt, Human
gaaaugaauuucuc

SEQ ID NO: 3533802 - RNA, 24 nt, Human
gaaaugaccuucauucugagacca

SEQ ID NO: 3533803 - RNA, 17 nt, Human
gaaaugagaaggcagcc

SEQ ID NO: 3533804 - RNA, 18 nt, Human
gaaaugagaaggcagcca

SEQ ID NO: 3533805 - RNA, 19 nt, Human
gaaaugagaaggcagccac

SEQ ID NO: 3533806 - RNA, 16 nt, Human
gaaaugagaucaggcu

SEQ ID NO: 3533807 - RNA, 15 nt, Human
gaaaugaggaggaug

SEQ ID NO: 3533808 - RNA, 22 nt, Human
gaaaugaggccauggacucugu

SEQ ID NO: 3533809 - RNA, 18 nt, Human
gaaaugaggucagagccu

SEQ ID NO: 3533810 - RNA, 13 nt, Human
gaaaugcacaaug

SEQ ID NO: 3533811 - RNA, 20 nt, Human
gaaaugccuuacuuuguaug

SEQ ID NO: 3533812 - RNA, 17 nt, Human
gaaaugcuaugucauuu

SEQ ID NO: 3533813 - RNA, 21 nt, Human
gaaaugcuaugucauuucaug

SEQ ID NO: 3533814 - RNA, 18 nt, Human
gaaaugcugauggauaac

SEQ ID NO: 3533815 - RNA, 17 nt, Human
gaaaugcugcauuuuaa

SEQ ID NO: 3533816 - RNA, 18 nt, Human
ggcucggccugcccccac

SEQ ID NO: 3533817 - RNA, 18 nt, Human
ggcucguugacuggcugu

SEQ ID NO: 3533818 - RNA, 14 nt, Human
ggcucuaacgccug

SEQ ID NO: 3533819 - RNA, 16 nt, Human
ggcucuaacgccugag

SEQ ID NO: 3533820 - RNA, 17 nt, Human
ggcucuaacgccugagc

SEQ ID NO: 3533821 - RNA, 23 nt, Human
ggcucuaacgccugagcccaggg

SEQ ID NO: 3533822 - RNA, 19 nt, Human
ggcucuaauucacagugcu

SEQ ID NO: 3533823 - RNA, 14 nt, Human
ggcucuacacauau

SEQ ID NO: 3533824 - RNA, 22 nt, Human
ggcucuagaucauaaggcuuca

SEQ ID NO: 3533825 - RNA, 18 nt, Human
ggcucuauaaggcagccu

SEQ ID NO: 3533826 - RNA, 12 nt, Human
ggcucucagcuc

SEQ ID NO: 3533827 - RNA, 14 nt, Human
ggcucucagcucag

SEQ ID NO: 3533828 - RNA, 19 nt, Human
ggcucucagcucagcgcca

SEQ ID NO: 3533829 - RNA, 13 nt, Human
ggcucucaggcca

SEQ ID NO: 3533830 - RNA, 19 nt, Human
ggcucucaggccagcugcu

SEQ ID NO: 3533831 - RNA, 12 nt, Human
ggcucuccaagu

SEQ ID NO: 3533832 - RNA, 14 nt, Human
ggcucuccaccuca

SEQ ID NO: 3533833 - RNA, 15 nt, Human
ggcucuccaccucag

SEQ ID NO: 3533834 - RNA, 13 nt, Human
ggcucuccaguua

SEQ ID NO: 3533835 - RNA, 14 nt, Human
ggcucucuccagga

SEQ ID NO: 3533836 - RNA, 23 nt, Human
ggcucucuuuccuucuugccuuc

SEQ ID NO: 3533837 - RNA, 19 nt, Human
ggcucugacaaagcuuccc

SEQ ID NO: 3533838 - RNA, 13 nt, Human
ggcucugagaagg

SEQ ID NO: 3533839 - RNA, 12 nt, Human
ggcucugaggcg

SEQ ID NO: 3533840 - RNA, 17 nt, Human
ggcucugaggugccugu

SEQ ID NO: 3533841 - RNA, 20 nt, Human
ggcucugcaaugggcacugg

SEQ ID NO: 3533842 - RNA, 20 nt, Human
ggcucugcaauuccccucug

SEQ ID NO: 3533843 - RNA, 14 nt, Human
ggcucugcaguccu

SEQ ID NO: 3533844 - RNA, 14 nt, Human
ggcucugccacccu

SEQ ID NO: 3533845 - RNA, 12 nt, Human
ggcucugccagu

SEQ ID NO: 3533846 - RNA, 12 nt, Human
ggcucugcccca

SEQ ID NO: 3533847 - RNA, 18 nt, Human
ggcucugccccagaggcc

SEQ ID NO: 3533848 - RNA, 21 nt, Human
ggcucugcccucccuccuucc

SEQ ID NO: 3533849 - RNA, 12 nt, Human
ggcucugcccuu

SEQ ID NO: 3533850 - RNA, 17 nt, Human
ggcucugccucccauca

SEQ ID NO: 3533851 - RNA, 17 nt, Human
ggcucuggagacagccc

SEQ ID NO: 3533852 - RNA, 14 nt, Human
ggcucuggagagaa

SEQ ID NO: 3533853 - RNA, 14 nt, Human
ggcucuggagccca

SEQ ID NO: 3533854 - RNA, 17 nt, Human
ggcucuggcucucccca

SEQ ID NO: 3533855 - RNA, 17 nt, Human
ggcucuguccccagccu

SEQ ID NO: 3533856 - RNA, 12 nt, Human
ggcucugugcug

SEQ ID NO: 3533857 - RNA, 20 nt, Human
ggcucugugcugacccuccu

SEQ ID NO: 3533858 - RNA, 12 nt, Human
ggcucuuccagg

SEQ ID NO: 3533859 - RNA, 18 nt, Human
ggcucuuccaggcuggga

SEQ ID NO: 3533860 - RNA, 24 nt, Human
ggcucuuccaggcugggagagccu

SEQ ID NO: 3533861 - RNA, 13 nt, Human
ggcucuucucauu

SEQ ID NO: 3533862 - RNA, 22 nt, Human
ggcucuucucauuucaccccuc

SEQ ID NO: 3533863 - RNA, 16 nt, Human
ggcucuucuccccaga

SEQ ID NO: 3533864 - RNA, 14 nt, Human
ggcucuucuccuuu

SEQ ID NO: 3533865 - RNA, 16 nt, Human
ggcucuucuccuuuca

SEQ ID NO: 3533866 - RNA, 18 nt, Human
ggcucuugaacugagcuu

SEQ ID NO: 3533867 - RNA, 19 nt, Human
ggcucuugauaccccccuc

SEQ ID NO: 3533868 - RNA, 13 nt, Human
ggcucuuuccuug

SEQ ID NO: 3533869 - RNA, 14 nt, Human
ggcugaaauucaga

SEQ ID NO: 3533870 - RNA, 18 nt, Human
ggcugaaauucuccugga

SEQ ID NO: 3533871 - RNA, 15 nt, Human
ggcugaacccugugc

SEQ ID NO: 3533872 - RNA, 17 nt, Human
ggcugaacccugugcug

SEQ ID NO: 3533873 - RNA, 20 nt, Human
ggcugaacccugugcuggug

SEQ ID NO: 3533874 - RNA, 16 nt, Human
ggcugaauguauguaa

SEQ ID NO: 3533875 - RNA, 19 nt, Human
ggcugaauguauguaaaua

SEQ ID NO: 3533876 - RNA, 24 nt, Human
ggcugacacguccaccccagugca

SEQ ID NO: 3533877 - RNA, 21 nt, Human
ggcugacacuucaaggugaca

SEQ ID NO: 3533878 - RNA, 22 nt, Human
ggcugacagacagcccuccauc

SEQ ID NO: 3533879 - RNA, 14 nt, Human
ggcugacaucugug

SEQ ID NO: 3533880 - RNA, 18 nt, Human
ggcugaccacagcacagc

SEQ ID NO: 3533881 - RNA, 19 nt, Human
ggcugaccacagcacagcc

SEQ ID NO: 3533882 - RNA, 15 nt, Human
ggcugaccaugcuca

SEQ ID NO: 3533883 - RNA, 19 nt, Human
ggcugaccccaaagagccu

SEQ ID NO: 3533884 - RNA, 20 nt, Human
ggcugaccccaaagagccug

SEQ ID NO: 3533885 - RNA, 17 nt, Human
ggcugaccccccucagg

SEQ ID NO: 3533886 - RNA, 23 nt, Human
ggcugaccugccucucacacaca

SEQ ID NO: 3533887 - RNA, 15 nt, Human
ggcugacgugugagg

SEQ ID NO: 3533888 - RNA, 14 nt, Human
ggcugacugggcca

SEQ ID NO: 3533889 - RNA, 15 nt, Human
ggcugagacaggaga

SEQ ID NO: 3533890 - RNA, 17 nt, Human
ggcugagacaggagaaa

SEQ ID NO: 3533891 - RNA, 12 nt, Human
ggcugagacugg

SEQ ID NO: 3533892 - RNA, 13 nt, Human
ggcugagacugga

SEQ ID NO: 3533893 - RNA, 20 nt, Human
ggcugagagccccagcugac

SEQ ID NO: 3533894 - RNA, 16 nt, Human
ggcugagccccuaccc

SEQ ID NO: 3533895 - RNA, 18 nt, Human
ggcugagccccuacccca

SEQ ID NO: 3533896 - RNA, 15 nt, Human
ggcugagcucucugu

SEQ ID NO: 3533897 - RNA, 14 nt, Human
ggcugagcugccca

SEQ ID NO: 3533898 - RNA, 20 nt, Human
ggcugagcugcccacagcag

SEQ ID NO: 3533899 - RNA, 17 nt, Human
ggcugaggaaaggccag

SEQ ID NO: 3533900 - RNA, 22 nt, Human
ggcugaggaaaggccagcuggc

SEQ ID NO: 3533901 - RNA, 16 nt, Human
ggcugaggaggccucc

SEQ ID NO: 3533902 - RNA, 21 nt, Human
ggcugaggauuucaagccugc

SEQ ID NO: 3533903 - RNA, 15 nt, Human
ggcugaggcaggaga

SEQ ID NO: 3533904 - RNA, 20 nt, Human
ggcugaggcaggagacuggc

SEQ ID NO: 3533905 - RNA, 14 nt, Human
ggcugaggccugga

SEQ ID NO: 3533906 - RNA, 18 nt, Human
ggcugaggcuggcacagg

SEQ ID NO: 3533907 - RNA, 23 nt, Human
ggcugaggcuggcacaggacaug

SEQ ID NO: 3533908 - RNA, 13 nt, Human
ggcugagggcagu

SEQ ID NO: 3533909 - RNA, 22 nt, Human
ggcugagggcaguucgcagcca

SEQ ID NO: 3533910 - RNA, 16 nt, Human
ggcugagggccugcug

SEQ ID NO: 3533911 - RNA, 13 nt, Human
ggcugagguggga

SEQ ID NO: 3533912 - RNA, 20 nt, Human
ggcugagguuccucugccug

SEQ ID NO: 3533913 - RNA, 23 nt, Human
ggcugagucaugaucucccugcc

SEQ ID NO: 3533914 - RNA, 15 nt, Human
ggcugagugcaggcc

SEQ ID NO: 3533915 - RNA, 22 nt, Human
ggcugagugcaggcccacccug

SEQ ID NO: 3533916 - RNA, 19 nt, Human
ggcugauaauuccaguggu

SEQ ID NO: 3533917 - RNA, 23 nt, Human
ggcugaugguguggccuguggcu

SEQ ID NO: 3533918 - RNA, 14 nt, Human
ggcugauuucuagg

SEQ ID NO: 3533919 - RNA, 22 nt, Human
ggcugcaaaggguaucaggugc

SEQ ID NO: 3533920 - RNA, 23 nt, Human
ggcugcaaaggguaucaggugcu

SEQ ID NO: 3533921 - RNA, 17 nt, Human
ggcugcacucugugccc

SEQ ID NO: 3533922 - RNA, 19 nt, Human
ggcugcagaggccagaggc

SEQ ID NO: 3533923 - RNA, 15 nt, Human
ggcugcagccucagg

SEQ ID NO: 3533924 - RNA, 16 nt, Human
ggcugcagccucagga

SEQ ID NO: 3533925 - RNA, 20 nt, Human
ggcugcagccucaggacugg

SEQ ID NO: 3533926 - RNA, 16 nt, Human
ggcugcagcuggacag

SEQ ID NO: 3533927 - RNA, 18 nt, Human
ggcugcagcuggacagag

SEQ ID NO: 3533928 - RNA, 24 nt, Human
ggcugcagcuggacagaggggacu

SEQ ID NO: 3533929 - RNA, 13 nt, Human
ggcugcaguccuc

SEQ ID NO: 3533930 - RNA, 22 nt, Human
ggcugcagugacgugcaccugu

SEQ ID NO: 3533931 - RNA, 19 nt, Human
ggcugcauagaaggaggag

SEQ ID NO: 3533932 - RNA, 16 nt, Human
ggcugcaugauguuug

SEQ ID NO: 3533933 - RNA, 20 nt, Human
ggcugcaugcgggcuuccuc

SEQ ID NO: 3533934 - RNA, 20 nt, Human
ggcugcauugaaaagagcug

SEQ ID NO: 3533935 - RNA, 21 nt, Human
ggcugcauugaaaagagcuga

SEQ ID NO: 3533936 - RNA, 15 nt, Human
ggcugccaaggccag

SEQ ID NO: 3533937 - RNA, 15 nt, Human
ggcugccagugccug

SEQ ID NO: 3533938 - RNA, 18 nt, Human
ggcugccagugccugggu

SEQ ID NO: 3533939 - RNA, 23 nt, Human
ggcugccaucucaccuccugcug

SEQ ID NO: 3533940 - RNA, 18 nt, Human
ggcugccaugugaagagg

SEQ ID NO: 3533941 - RNA, 18 nt, Human
ggcugcccacuaugguca

SEQ ID NO: 3533942 - RNA, 20 nt, Human
ggcugccccuaaucucugua

SEQ ID NO: 3533943 - RNA, 15 nt, Human
ggcugccccucucac

SEQ ID NO: 3533944 - RNA, 14 nt, Human
ggcugcccgcuccc

SEQ ID NO: 3533945 - RNA, 17 nt, Human
ggcugcccgcucccagu

SEQ ID NO: 3533946 - RNA, 22 nt, Human
ggcugcccuccugugcucagcc

SEQ ID NO: 3533947 - RNA, 18 nt, Human
ggcugcccugagaagcug

SEQ ID NO: 3533948 - RNA, 24 nt, Human
ggcugcccugagaagcugcuccag

SEQ ID NO: 3533949 - RNA, 11 nt, Human
ggcugcccugg

SEQ ID NO: 3533950 - RNA, 16 nt, Human
ggcugcccuggcccug

SEQ ID NO: 3533951 - RNA, 22 nt, Human
ggcugcccuggcccugaggugu

SEQ ID NO: 3533952 - RNA, 14 nt, Human
ggcugcccuggugc

SEQ ID NO: 3533953 - RNA, 16 nt, Human
ggcugcccuggugcug

SEQ ID NO: 3533954 - RNA, 18 nt, Human
ggcugcccuugggccacc

SEQ ID NO: 3533955 - RNA, 11 nt, Human
ggcugcccuuu

SEQ ID NO: 3533956 - RNA, 13 nt, Human
gggggccaccugc

SEQ ID NO: 3533957 - RNA, 17 nt, Human
gggggccccagucagcc

SEQ ID NO: 3533958 - RNA, 21 nt, Human
gggggccccagucagccucuc

SEQ ID NO: 3533959 - RNA, 17 nt, Human
gggggccucagggcagc

SEQ ID NO: 3533960 - RNA, 17 nt, Human
gggggccucagugccac

SEQ ID NO: 3533961 - RNA, 11 nt, Human
gaagccuuugu

SEQ ID NO: 3533962 - RNA, 16 nt, Human
gaagcggauuuccagg

SEQ ID NO: 3533963 - RNA, 18 nt, Human
gaagcggucguguuguga

SEQ ID NO: 3533964 - RNA, 15 nt, Human
gaagcgugagacgcc

SEQ ID NO: 3533965 - RNA, 19 nt, Human
gaagcguuguccucagccc

SEQ ID NO: 3533966 - RNA, 20 nt, Human
gaagcguuguccucagcccc

SEQ ID NO: 3533967 - RNA, 14 nt, Human
gaagcuaagcugca

SEQ ID NO: 3533968 - RNA, 17 nt, Human
gaagcuaauuauuuuaa

SEQ ID NO: 3533969 - RNA, 14 nt, Human
gaagcuaauuugca

SEQ ID NO: 3533970 - RNA, 23 nt, Human
gaagcuacagguuacaacagauu

SEQ ID NO: 3533971 - RNA, 15 nt, Human
ggcugccguccccua

SEQ ID NO: 3533972 - RNA, 12 nt, Human
ggcugccugagu

SEQ ID NO: 3533973 - RNA, 18 nt, Human
ggcugccuggagccccac

SEQ ID NO: 3533974 - RNA, 16 nt, Human
ggcugccuucuggccu

SEQ ID NO: 3533975 - RNA, 19 nt, Human
ggcugcgacgcuugcucug

SEQ ID NO: 3533976 - RNA, 14 nt, Human
ggcugcgcacugug

SEQ ID NO: 3533977 - RNA, 23 nt, Human
ggcugcgcuuccuauuucuaggg

SEQ ID NO: 3533978 - RNA, 19 nt, Human
ggcugcggcguacaggcug

SEQ ID NO: 3533979 - RNA, 22 nt, Human
ggcugcggcguacaggcuggcg

SEQ ID NO: 3533980 - RNA, 17 nt, Human
ggcugcggggcgggcac

SEQ ID NO: 3533981 - RNA, 20 nt, Human
ggcugcucauguuggggcuc

SEQ ID NO: 3533982 - RNA, 15 nt, Human
ggcugcucccaccug

SEQ ID NO: 3533983 - RNA, 13 nt, Human
ggcugcuccucca

SEQ ID NO: 3533984 - RNA, 15 nt, Human
ggcugcuccuccagg

SEQ ID NO: 3533985 - RNA, 18 nt, Human
ggcugcuccuccagggcc

SEQ ID NO: 3533986 - RNA, 21 nt, Human
ggcugcucggggugcacagga

SEQ ID NO: 3533987 - RNA, 19 nt, Human
ggcugcugaaaaccaucug

SEQ ID NO: 3533988 - RNA, 14 nt, Human
ggcugcugaaggcu

SEQ ID NO: 3533989 - RNA, 18 nt, Human
ggcugcugaaggcucgag

SEQ ID NO: 3533990 - RNA, 21 nt, Human
ggcugcugaccuccacagcuu

SEQ ID NO: 3533991 - RNA, 10 nt, Human
ggcugcugcc

SEQ ID NO: 3533992 - RNA, 12 nt, Human
ggcugcugccca

SEQ ID NO: 3533993 - RNA, 18 nt, Human
ggcugcugcccccacccc

SEQ ID NO: 3533994 - RNA, 15 nt, Human
ggcugcugcuacaau

SEQ ID NO: 3533995 - RNA, 11 nt, Human
ggcugcugcug

SEQ ID NO: 3533996 - RNA, 22 nt, Human
ggcugcugcugcucuuggcugg

SEQ ID NO: 3533997 - RNA, 14 nt, Human
ggcugcugcugggc

SEQ ID NO: 3533998 - RNA, 15 nt, Human
ggcugcuggaggaaa

SEQ ID NO: 3533999 - RNA, 19 nt, Human
ggcugcuggcgccucugca

SEQ ID NO: 3534000 - RNA, 15 nt, Human
ggcugcugugugccu

SEQ ID NO: 3534001 - RNA, 21 nt, Human
ggcugcuucaaggauccugag

SEQ ID NO: 3534002 - RNA, 23 nt, Human
ggcugcuucaaggauccugagcc

SEQ ID NO: 3534003 - RNA, 15 nt, Human
ggcugcuuccuccug

SEQ ID NO: 3534004 - RNA, 18 nt, Human
ggcuggaagauagcugug

SEQ ID NO: 3534005 - RNA, 15 nt, Human
ggcuggaagauccug

SEQ ID NO: 3534006 - RNA, 19 nt, Human
ggcuggaagauccugcggg

SEQ ID NO: 3534007 - RNA, 19 nt, Human
ggcuggaagggguccagcc

SEQ ID NO: 3534008 - RNA, 18 nt, Human
ggcuggaaucuggagagc

SEQ ID NO: 3534009 - RNA, 14 nt, Human
ggcuggacccagcc

SEQ ID NO: 3534010 - RNA, 16 nt, Human
ggcuggaccuaugucc

SEQ ID NO: 3534011 - RNA, 15 nt, Human
ggcuggacguggugg

SEQ ID NO: 3534012 - RNA, 19 nt, Human
ggcuggacuccagaucugc

SEQ ID NO: 3534013 - RNA, 20 nt, Human
ggcuggacuccagaucugca

SEQ ID NO: 3534014 - RNA, 14 nt, Human
ggcuggacugaggc

SEQ ID NO: 3534015 - RNA, 21 nt, Human
ggcuggacuucuaccugcccu

SEQ ID NO: 3534016 - RNA, 20 nt, Human
ggcuggagaauguggagaac

SEQ ID NO: 3534017 - RNA, 23 nt, Human
ggcuggagcccagggagcggaaa

SEQ ID NO: 3534018 - RNA, 13 nt, Human
ggcuggaggcagg

SEQ ID NO: 3534019 - RNA, 17 nt, Human
ggcuggaggcagggccu

SEQ ID NO: 3534020 - RNA, 15 nt, Human
ggcuggaggcccagg

SEQ ID NO: 3534021 - RNA, 20 nt, Human
ggcuggagugcaguggcgca

SEQ ID NO: 3534022 - RNA, 19 nt, Human
ggcuggagugcaguggcgu

SEQ ID NO: 3534023 - RNA, 23 nt, Human
ggcuggaguuagggacugaccag

SEQ ID NO: 3534024 - RNA, 15 nt, Human
ggcuggaguuauuga

SEQ ID NO: 3534025 - RNA, 17 nt, Human
ggcuggaucugugaggg

SEQ ID NO: 3534026 - RNA, 15 nt, Human
ggcuggaugaaauuu

SEQ ID NO: 3534027 - RNA, 15 nt, Human
ggcuggaugagcucc

SEQ ID NO: 3534028 - RNA, 16 nt, Human
ggcuggaugagcuccc

SEQ ID NO: 3534029 - RNA, 13 nt, Human
ggcuggcagggcu

SEQ ID NO: 3534030 - RNA, 13 nt, Human
ggcuggccacugc

SEQ ID NO: 3534031 - RNA, 14 nt, Human
ggcuggccacugca

SEQ ID NO: 3534032 - RNA, 23 nt, Human
ggcuggccacugcacagagcucu

SEQ ID NO: 3534033 - RNA, 11 nt, Human
ggcuggccagc

SEQ ID NO: 3534034 - RNA, 12 nt, Human
ggcuggccagcc

SEQ ID NO: 3534035 - RNA, 20 nt, Human
ggcuggccagccccacagcc

SEQ ID NO: 3534036 - RNA, 13 nt, Human
ggcuggccagccg

SEQ ID NO: 3534037 - RNA, 15 nt, Human
ggcuggccagccgcu

SEQ ID NO: 3534038 - RNA, 16 nt, Human
ggcuggccaguccagg

SEQ ID NO: 3534039 - RNA, 19 nt, Human
ggcuggccauggagaaagc

SEQ ID NO: 3534040 - RNA, 19 nt, Human
ggcuggcccagcccugcug

SEQ ID NO: 3534041 - RNA, 22 nt, Human
ggcuggcccagcccugcuggcc

SEQ ID NO: 3534042 - RNA, 13 nt, Human
ggcuggcccugcc

SEQ ID NO: 3534043 - RNA, 21 nt, Human
ggcuggccuaggagauaucug

SEQ ID NO: 3534044 - RNA, 23 nt, Human
ggcuggccucacccaccccugca

SEQ ID NO: 3534045 - RNA, 15 nt, Human
ggcuggccucagacu

SEQ ID NO: 3534046 - RNA, 19 nt, Human
ggcuggccucuggcucuca

SEQ ID NO: 3534047 - RNA, 17 nt, Human
ggcuggccuggccccuc

SEQ ID NO: 3534048 - RNA, 14 nt, Human
ggcuggcgcagcca

SEQ ID NO: 3534049 - RNA, 20 nt, Human
ggcuggcggcuacucagcag

SEQ ID NO: 3534050 - RNA, 21 nt, Human
ggcuggcuccccugcagcccu

SEQ ID NO: 3534051 - RNA, 16 nt, Human
ggcuggcucccucuug

SEQ ID NO: 3534052 - RNA, 15 nt, Human
ggcuggcugagggca

SEQ ID NO: 3534053 - RNA, 15 nt, Human
ggcuggcugcaguga

SEQ ID NO: 3534054 - RNA, 22 nt, Human
ggcugggaaacacuccuugcau

SEQ ID NO: 3534055 - RNA, 17 nt, Human
ggcugggaacagugugc

SEQ ID NO: 3534056 - RNA, 15 nt, Human
ggcugggagcucugc

SEQ ID NO: 3534057 - RNA, 13 nt, Human
ggcugggaggagg

SEQ ID NO: 3534058 - RNA, 14 nt, Human
ggcugggaguggug

SEQ ID NO: 3534059 - RNA, 19 nt, Human
ggcugggcacugcucucac

SEQ ID NO: 3534060 - RNA, 14 nt, Human
ggcugggcagagga

SEQ ID NO: 3534061 - RNA, 14 nt, Human
ggcugggcccagaa

SEQ ID NO: 3534062 - RNA, 15 nt, Human
ggcugggcccagagg

SEQ ID NO: 3534063 - RNA, 13 nt, Human
ggcugggcccccc

SEQ ID NO: 3534064 - RNA, 22 nt, Human
ggcugggccccccagcucaggg

SEQ ID NO: 3534065 - RNA, 18 nt, Human
ggcugggcucccuuccca

SEQ ID NO: 3534066 - RNA, 14 nt, Human
ggcugggcugggca

SEQ ID NO: 3534067 - RNA, 15 nt, Human
ggcugggcugggcac

SEQ ID NO: 3534068 - RNA, 12 nt, Human
ggcugggcuuca

SEQ ID NO: 3534069 - RNA, 17 nt, Human
ggcugggcuucaguggc

SEQ ID NO: 3534070 - RNA, 15 nt, Human
ggcuggggaggaccu

SEQ ID NO: 3534071 - RNA, 16 nt, Human
ggcuggggcaggaggg

SEQ ID NO: 3534072 - RNA, 22 nt, Human
ggcuggggccuaucagugugcc

SEQ ID NO: 3534073 - RNA, 16 nt, Human
ggcugggggagagccg

SEQ ID NO: 3534074 - RNA, 18 nt, Human
ggcugggggagagccgug

SEQ ID NO: 3534075 - RNA, 21 nt, Human
ggcuggggucccagcagcugc

SEQ ID NO: 3534076 - RNA, 15 nt, Human
ggcugggucgcccug

SEQ ID NO: 3534077 - RNA, 17 nt, Human
ggcugggucgcccugga

SEQ ID NO: 3534078 - RNA, 15 nt, Human
ggcugggugcccaca

SEQ ID NO: 3534079 - RNA, 21 nt, Human
ggcugggugcccacagcccgc

SEQ ID NO: 3534080 - RNA, 14 nt, Human
ggcugggugcgacc

SEQ ID NO: 3534081 - RNA, 14 nt, Human
ggcuggguuggagg

SEQ ID NO: 3534082 - RNA, 16 nt, Human
ggcuggguuggcgcac

SEQ ID NO: 3534083 - RNA, 19 nt, Human
ggcuggguuggcgcacccu

SEQ ID NO: 3534084 - RNA, 20 nt, Human
ggcuggguuggcgcacccuc

SEQ ID NO: 3534085 - RNA, 21 nt, Human
ggcugguagcucaggugggcg

SEQ ID NO: 3534086 - RNA, 18 nt, Human
ggcugguaucucagaaag

SEQ ID NO: 3534087 - RNA, 13 nt, Human
ggcugguccaggg

SEQ ID NO: 3534088 - RNA, 14 nt, Human
ggcuggugcagggc

SEQ ID NO: 3534089 - RNA, 15 nt, Human
ggcuggugggcacca

SEQ ID NO: 3534090 - RNA, 18 nt, Human
ggcuggugugguacagag

SEQ ID NO: 3534091 - RNA, 20 nt, Human
ggcuggugugguacagagaa

SEQ ID NO: 3534092 - RNA, 21 nt, Human
ggcuggugugguacagagaag

SEQ ID NO: 3534093 - RNA, 16 nt, Human
ggcugguguuaacaga

SEQ ID NO: 3534094 - RNA, 17 nt, Human
ggcugguguuaacagaa

SEQ ID NO: 3534095 - RNA, 23 nt, Human
ggcugguucggauuuggggugga

SEQ ID NO: 3534096 - RNA, 22 nt, Human
ggcugguuuuguaagaugcugg

SEQ ID NO: 3534097 - RNA, 23 nt, Human
ggcugguuuuguaagaugcuggg

SEQ ID NO: 3534098 - RNA, 16 nt, Human
ggcuguaaaaugcaug

SEQ ID NO: 3534099 - RNA, 15 nt, Human
ggcuguaacugccag

SEQ ID NO: 3534100 - RNA, 22 nt, Human
ggcuguaucccaugagccucag

SEQ ID NO: 3534101 - RNA, 23 nt, Human
ggcuguaucccaugagccucagc

SEQ ID NO: 3534102 - RNA, 15 nt, Human
ggcugucagcaggaa

SEQ ID NO: 3534103 - RNA, 18 nt, Human
ggcugucaguaugacauu

SEQ ID NO: 3534104 - RNA, 14 nt, Human
ggcugucaucugug

SEQ ID NO: 3534105 - RNA, 11 nt, Human
ggcuguccagu

SEQ ID NO: 3534106 - RNA, 16 nt, Human
ggcuguccagugccca

SEQ ID NO: 3534107 - RNA, 18 nt, Human
gguucuuucuuccucugc

SEQ ID NO: 3534108 - RNA, 17 nt, Human
gguucuuuggaaggagu

SEQ ID NO: 3534109 - RNA, 16 nt, Human
gguugaacucuggugg

SEQ ID NO: 3534110 - RNA, 16 nt, Human
gguugaccccagagga

SEQ ID NO: 3534111 - RNA, 16 nt, Human
gguugacuuucaggua

SEQ ID NO: 3534112 - RNA, 23 nt, Human
gguugagaauggaaaccacaacu

SEQ ID NO: 3534113 - RNA, 11 nt, Human
gguugaggaaa

SEQ ID NO: 3534114 - RNA, 23 nt, Human
gguugagguccagcccuggcuga

SEQ ID NO: 3534115 - RNA, 13 nt, Human
gguugagguuuca

SEQ ID NO: 3534116 - RNA, 17 nt, Human
gguugauaacuuugcuu

SEQ ID NO: 3534117 - RNA, 19 nt, Human
gguugauaacuuugcuugc

SEQ ID NO: 3534118 - RNA, 22 nt, Human
gguugauaguuuaccugaauaa

SEQ ID NO: 3534119 - RNA, 17 nt, Human
gguugcagugagcugag

SEQ ID NO: 3534120 - RNA, 14 nt, Human
gguugcaucagaaa

SEQ ID NO: 3534121 - RNA, 12 nt, Human
gguugccacagg

SEQ ID NO: 3534122 - RNA, 13 nt, Human
gguugccacaggc

SEQ ID NO: 3534123 - RNA, 16 nt, Human
gguugcggggggaggg

SEQ ID NO: 3534124 - RNA, 21 nt, Human
gguugcguccugacggcgccc

SEQ ID NO: 3534125 - RNA, 13 nt, Human
gguugcuggagcc

SEQ ID NO: 3534126 - RNA, 15 nt, Human
gguugcuggagccug

SEQ ID NO: 3534127 - RNA, 22 nt, Human
gguugcuguugaugaggccucu

SEQ ID NO: 3534128 - RNA, 19 nt, Human
gguugcuguuuuccucccu

SEQ ID NO: 3534129 - RNA, 15 nt, Human
gguugcuucugggaa

SEQ ID NO: 3534130 - RNA, 21 nt, Human
gguuggaagcuagcuccccuc

SEQ ID NO: 3534131 - RNA, 14 nt, Human
gguuggaccccaga

SEQ ID NO: 3534132 - RNA, 15 nt, Human
gguuggagagcuaga

SEQ ID NO: 3534133 - RNA, 14 nt, Human
gguuggauggaugg

SEQ ID NO: 3534134 - RNA, 21 nt, Human
gguuggccccugcccggcugc

SEQ ID NO: 3534135 - RNA, 15 nt, Human
gguuggcgcacccuc

SEQ ID NO: 3534136 - RNA, 18 nt, Human
gguuggcgcacccucccc

SEQ ID NO: 3534137 - RNA, 20 nt, Human
gguuggcgcacccuccccuc

SEQ ID NO: 3534138 - RNA, 13 nt, Human
gguuggcucccgc

SEQ ID NO: 3534139 - RNA, 11 nt, Human
gguuggcuggc

SEQ ID NO: 3534140 - RNA, 19 nt, Human
gguuggcugggcccagaag

SEQ ID NO: 3534141 - RNA, 21 nt, Human
gguugggacccaguggcaggg

SEQ ID NO: 3534142 - RNA, 22 nt, Human
gguugggacccaguggcagggc

SEQ ID NO: 3534143 - RNA, 23 nt, Human
gguugggacccaguggcagggca

SEQ ID NO: 3534144 - RNA, 23 nt, Human
gguugggauugggggcuggugcc

SEQ ID NO: 3534145 - RNA, 21 nt, Human
gguugggcagccagaccagca

SEQ ID NO: 3534146 - RNA, 14 nt, Human
gguugggcuggugu

SEQ ID NO: 3534147 - RNA, 15 nt, Human
gguuggggugacagu

SEQ ID NO: 3534148 - RNA, 19 nt, Human
gguugguccucuugccucc

SEQ ID NO: 3534149 - RNA, 15 nt, Human
gguuguauucuuuga

SEQ ID NO: 3534150 - RNA, 13 nt, Human
gguugucaauauu

SEQ ID NO: 3534151 - RNA, 13 nt, Human
gguugucagcucu

SEQ ID NO: 3534152 - RNA, 10 nt, Human
gguugugaau

SEQ ID NO: 3534153 - RNA, 13 nt, Human
gguuguuauguga

SEQ ID NO: 3534154 - RNA, 14 nt, Human
gguuguuucuguuc

SEQ ID NO: 3534155 - RNA, 16 nt, Human
gguuuaaaagaaaaaa

SEQ ID NO: 3534156 - RNA, 18 nt, Human
gguuuaaagaaaguguau

SEQ ID NO: 3534157 - RNA, 22 nt, Human
gguuuaaagagucuagauucaa

SEQ ID NO: 3534158 - RNA, 17 nt, Human
gguuuaaaugaacaaga

SEQ ID NO: 3534159 - RNA, 14 nt, Human
gguuuaacucagau

SEQ ID NO: 3534160 - RNA, 17 nt, Human
gguuuaagaaauagaau

SEQ ID NO: 3534161 - RNA, 19 nt, Human
gguuuaauccccaguaaaa

SEQ ID NO: 3534162 - RNA, 17 nt, Human
gguuuacaauuuacaaa

SEQ ID NO: 3534163 - RNA, 17 nt, Human
gguuuacagucuauuug

SEQ ID NO: 3534164 - RNA, 22 nt, Human
gguuuacauucaucucauucca

SEQ ID NO: 3534165 - RNA, 12 nt, Human
gguuuacauuua

SEQ ID NO: 3534166 - RNA, 15 nt, Human
gguuuacauuuaaag

SEQ ID NO: 3534167 - RNA, 20 nt, Human
gguuuaguguaaaaaugaga

SEQ ID NO: 3534168 - RNA, 14 nt, Human
gguuuauucacugu

SEQ ID NO: 3534169 - RNA, 18 nt, Human
gguuucaaagaugcugug

SEQ ID NO: 3534170 - RNA, 19 nt, Human
gguuucaccauguuggcca

SEQ ID NO: 3534171 - RNA, 22 nt, Human
gguuucacccuuaacccaagga

SEQ ID NO: 3534172 - RNA, 12 nt, Human
gguuucagaaau

SEQ ID NO: 3534173 - RNA, 19 nt, Human
gguuucagcacuagccaaa

SEQ ID NO: 3534174 - RNA, 17 nt, Human
gguuucauacucuagau

SEQ ID NO: 3534175 - RNA, 18 nt, Human
gguuuccaacaauucagc

SEQ ID NO: 3534176 - RNA, 19 nt, Human
gguuuccauggcuucccag

SEQ ID NO: 3534177 - RNA, 18 nt, Human
gguuucccaaugguguuu

SEQ ID NO: 3534178 - RNA, 12 nt, Human
gguuuccugccc

SEQ ID NO: 3534179 - RNA, 23 nt, Human
gggcacacgcugcucugccccag

SEQ ID NO: 3534180 - RNA, 14 nt, Human
gggcacagaaaaug

SEQ ID NO: 3534181 - RNA, 20 nt, Human
gggcacagaaaauggaagac

SEQ ID NO: 3534182 - RNA, 17 nt, Human
gggcacaggagcuaccu

SEQ ID NO: 3534183 - RNA, 18 nt, Human
gggcacagggccuggccc

SEQ ID NO: 3534184 - RNA, 16 nt, Human
gggcacaucauuucaa

SEQ ID NO: 3534185 - RNA, 18 nt, Human
gggcaccagggguuucuc

SEQ ID NO: 3534186 - RNA, 16 nt, Human
gggcacccccagccug

SEQ ID NO: 3534187 - RNA, 19 nt, Human
gggcacccccagccugggc

SEQ ID NO: 3534188 - RNA, 18 nt, Human
gggcaccuggggaguggg

SEQ ID NO: 3534189 - RNA, 18 nt, Human
gggcacgcugugggcagg

SEQ ID NO: 3534190 - RNA, 16 nt, Human
gggcacucagaagaca

SEQ ID NO: 3534191 - RNA, 20 nt, Human
gggcacucagaagacacuga

SEQ ID NO: 3534192 - RNA, 22 nt, Human
gggcacugcuggguggcccauc

SEQ ID NO: 3534193 - RNA, 15 nt, Human
gggcacuggcccagg

SEQ ID NO: 3534194 - RNA, 13 nt, Human
gggcacugguggc

SEQ ID NO: 3534195 - RNA, 14 nt, Human
gggcacuucacaga

SEQ ID NO: 3534196 - RNA, 14 nt, Human
gggcacuucccugc

SEQ ID NO: 3534197 - RNA, 18 nt, Human
gggcacuucccugcugcc

SEQ ID NO: 3534198 - RNA, 22 nt, Human
gggcacuuuuuaauucaccaaa

SEQ ID NO: 3534199 - RNA, 23 nt, Human
gggcacuuuuuaauucaccaaag

SEQ ID NO: 3534200 - RNA, 16 nt, Human
gggcagaagggagaag

SEQ ID NO: 3534201 - RNA, 18 nt, Human
gggcagagaggcuguggu

SEQ ID NO: 3534202 - RNA, 11 nt, Human
gggcagagcag

SEQ ID NO: 3534203 - RNA, 12 nt, Human
gggcagagccca

SEQ ID NO: 3534204 - RNA, 17 nt, Human
gggcagagccgggaagc

SEQ ID NO: 3534205 - RNA, 15 nt, Human
gggcagagcuggugc

SEQ ID NO: 3534206 - RNA, 16 nt, Human
gggcagagcuggugcg

SEQ ID NO: 3534207 - RNA, 14 nt, Human
gggcagaggaaagc

SEQ ID NO: 3534208 - RNA, 21 nt, Human
gggcagaggcaguaccugggc

SEQ ID NO: 3534209 - RNA, 15 nt, Human
gggcagagggcagag

SEQ ID NO: 3534210 - RNA, 20 nt, Human
gggcagagggcagaggcugg

SEQ ID NO: 3534211 - RNA, 12 nt, Human
gggcagagucac

SEQ ID NO: 3534212 - RNA, 16 nt, Human
gggcagaucucccaca

SEQ ID NO: 3534213 - RNA, 22 nt, Human
gggcagaucuuggacucaugag

SEQ ID NO: 3534214 - RNA, 13 nt, Human
gggcagccaggcu

SEQ ID NO: 3534215 - RNA, 14 nt, Human
gggcagccaggcug

SEQ ID NO: 3534216 - RNA, 14 nt, Human
gggcagccagggag

SEQ ID NO: 3534217 - RNA, 22 nt, Human
gggcagccagggagagcccagg

SEQ ID NO: 3534218 - RNA, 18 nt, Human
gggcagccucccccggcu

SEQ ID NO: 3534219 - RNA, 19 nt, Human
gggcagccugcguggcuga

SEQ ID NO: 3534220 - RNA, 20 nt, Human
gggcagccuggcucccagga

SEQ ID NO: 3534221 - RNA, 23 nt, Human
gggcagccuggcucccaggacac

SEQ ID NO: 3534222 - RNA, 13 nt, Human
gggcagcgccagg

SEQ ID NO: 3534223 - RNA, 21 nt, Human
gggcagcgggagccucccugc

SEQ ID NO: 3534224 - RNA, 12 nt, Human
gggcagcuccuc

SEQ ID NO: 3534225 - RNA, 21 nt, Human
gggcagcuccucugucucgag

SEQ ID NO: 3534226 - RNA, 12 nt, Human
gggcagcugccu

SEQ ID NO: 3534227 - RNA, 14 nt, Human
gggcagcugccucc

SEQ ID NO: 3534228 - RNA, 12 nt, Human
gggcagcugcua

SEQ ID NO: 3534229 - RNA, 13 nt, Human
gggcagcugggcc

SEQ ID NO: 3534230 - RNA, 19 nt, Human
gggcagcuguuagagucca

SEQ ID NO: 3534231 - RNA, 22 nt, Human
gggcaggacagguccucccugc

SEQ ID NO: 3534232 - RNA, 15 nt, Human
gggcaggaccagccc

SEQ ID NO: 3534233 - RNA, 20 nt, Human
gggcaggaguagcugagcuc

SEQ ID NO: 3534234 - RNA, 14 nt, Human
gggcaggcacagca

SEQ ID NO: 3534235 - RNA, 17 nt, Human
gggcaggcacagcacag

SEQ ID NO: 3534236 - RNA, 11 nt, Human
gggcaggcagu

SEQ ID NO: 3534237 - RNA, 17 nt, Human
gggcaggcccugcacug

SEQ ID NO: 3534238 - RNA, 19 nt, Human
gggcaggcccugcacuguc

SEQ ID NO: 3534239 - RNA, 22 nt, Human
gggcaggcccugcacuguccug

SEQ ID NO: 3534240 - RNA, 15 nt, Human
gggcaggcugggcca

SEQ ID NO: 3534241 - RNA, 20 nt, Human
gggcagggagcugggcccga

SEQ ID NO: 3534242 - RNA, 18 nt, Human
gggcagggcucccacaga

SEQ ID NO: 3534243 - RNA, 12 nt, Human
gggcagggcugu

SEQ ID NO: 3534244 - RNA, 19 nt, Human
gggcaggggaggccaucug

SEQ ID NO: 3534245 - RNA, 21 nt, Human
gggcagguucugccugcuuug

SEQ ID NO: 3534246 - RNA, 15 nt, Human
gggcaguaccugagg

SEQ ID NO: 3534247 - RNA, 20 nt, Human
gggcaguagaaggucggagg

SEQ ID NO: 3534248 - RNA, 21 nt, Human
gggcagucugagagaggccau

SEQ ID NO: 3534249 - RNA, 14 nt, Human
gggcagucuggagg

SEQ ID NO: 3534250 - RNA, 17 nt, Human
gggcagucuggaggggc

SEQ ID NO: 3534251 - RNA, 20 nt, Human
gggcagugcucacccacacc

SEQ ID NO: 3534252 - RNA, 17 nt, Human
gggcaguucgcagccac

SEQ ID NO: 3534253 - RNA, 16 nt, Human
gaaugaagaauucaga

SEQ ID NO: 3534254 - RNA, 18 nt, Human
gaaugaagauacugaaau

SEQ ID NO: 3534255 - RNA, 18 nt, Human
gaaugaagcuuguguauc

SEQ ID NO: 3534256 - RNA, 20 nt, Human
gaaugaauggcuaagcaaaa

SEQ ID NO: 3534257 - RNA, 18 nt, Human
gaaugaaugucaguguga

SEQ ID NO: 3534258 - RNA, 22 nt, Human
gaaugaaugucagugugacuga

SEQ ID NO: 3534259 - RNA, 16 nt, Human
gaaugaauuaaauaaa

SEQ ID NO: 3534260 - RNA, 15 nt, Human
gaaugaccuuguaau

SEQ ID NO: 3534261 - RNA, 18 nt, Human
gaaugaccuuguugcaug

SEQ ID NO: 3534262 - RNA, 12 nt, Human
gaaugacuccuu

SEQ ID NO: 3534263 - RNA, 19 nt, Human
gaaugagaaguagccacag

SEQ ID NO: 3534264 - RNA, 13 nt, Human
gaaugagacaucc

SEQ ID NO: 3534265 - RNA, 22 nt, Human
gaaugagagacacacugaagaa

SEQ ID NO: 3534266 - RNA, 13 nt, Human
gaaugagcccaga

SEQ ID NO: 3534267 - RNA, 20 nt, Human
gaaugagcccagagaacagc

SEQ ID NO: 3534268 - RNA, 16 nt, Human
gaaugaggaaaauucu

SEQ ID NO: 3534269 - RNA, 20 nt, Human
gaaugaggaggaaggagaga

SEQ ID NO: 3534270 - RNA, 15 nt, Human
gaaugaggcuugcug

SEQ ID NO: 3534271 - RNA, 17 nt, Human
gaaugaggcuugcugag

SEQ ID NO: 3534272 - RNA, 12 nt, Human
gaaugagggggc

SEQ ID NO: 3534273 - RNA, 15 nt, Human
gaaugagggggcuca

SEQ ID NO: 3534274 - RNA, 15 nt, Human
gaaugaggguuugag

SEQ ID NO: 3534275 - RNA, 15 nt, Human
gaaugaggucccagg

SEQ ID NO: 3534276 - RNA, 16 nt, Human
gaaugaggucccaggc

SEQ ID NO: 3534277 - RNA, 18 nt, Human
gaaugaggucugggcuag

SEQ ID NO: 3534278 - RNA, 14 nt, Human
gaaugaggugggag

SEQ ID NO: 3534279 - RNA, 14 nt, Human
gaaugaguuucuua

SEQ ID NO: 3534280 - RNA, 14 nt, Human
gaaugauuaauuaa

SEQ ID NO: 3534281 - RNA, 15 nt, Human
gaaugauucauguua

SEQ ID NO: 3534282 - RNA, 14 nt, Human
gaaugauuucaugc

SEQ ID NO: 3534283 - RNA, 14 nt, Human
gaaugauuugcaua

SEQ ID NO: 3534284 - RNA, 19 nt, Human
gaaugcacaagaauggauc

SEQ ID NO: 3534285 - RNA, 16 nt, Human
gaaugcacagauauac

SEQ ID NO: 3534286 - RNA, 22 nt, Human
gaaugcacagauauacuuugug

SEQ ID NO: 3534287 - RNA, 20 nt, Human
gaaugcacucagacuguaua

SEQ ID NO: 3534288 - RNA, 14 nt, Human
gaaugcauaaaaug

SEQ ID NO: 3534289 - RNA, 22 nt, Human
gaaugccacugccuucgcuucu

SEQ ID NO: 3534290 - RNA, 21 nt, Human
gaaugccauagucaaagagag

SEQ ID NO: 3534291 - RNA, 19 nt, Human
gaaugccaucuaucuaguu

SEQ ID NO: 3534292 - RNA, 19 nt, Human
gaaugccgcgaugggucag

SEQ ID NO: 3534293 - RNA, 20 nt, Human
gaaugccucaaugugaccag

SEQ ID NO: 3534294 - RNA, 18 nt, Human
gaaugccugagugccugg

SEQ ID NO: 3534295 - RNA, 23 nt, Human
gaaugcggcaagaaggaauugac

SEQ ID NO: 3534296 - RNA, 21 nt, Human
gaaugcuaacaguucacuugc

SEQ ID NO: 3534297 - RNA, 13 nt, Human
gaaugcuccccca

SEQ ID NO: 3534298 - RNA, 19 nt, Human
gaaugcucccccauccucc

SEQ ID NO: 3534299 - RNA, 22 nt, Human
gaaugcucccccauccuccccu

SEQ ID NO: 3534300 - RNA, 23 nt, Human
gaaugcucccccauccuccccuu

SEQ ID NO: 3534301 - RNA, 10 nt, Human
gaaugcugcc

SEQ ID NO: 3534302 - RNA, 12 nt, Human
gaaugcugccag

SEQ ID NO: 3534303 - RNA, 18 nt, Human
gaaugcuggacuggaggc

SEQ ID NO: 3534304 - RNA, 16 nt, Human
gaaugcugggacucag

SEQ ID NO: 3534305 - RNA, 18 nt, Human
gaaugcugggacucagcc

SEQ ID NO: 3534306 - RNA, 17 nt, Human
gaaugcugguuuuccua

SEQ ID NO: 3534307 - RNA, 22 nt, Human
gaaugcuuauagguggccucuc

SEQ ID NO: 3534308 - RNA, 16 nt, Human
gaaugcuuccuagaag

SEQ ID NO: 3534309 - RNA, 14 nt, Human
gaaugcuucuaagu

SEQ ID NO: 3534310 - RNA, 23 nt, Human
gaaugcuucuaaguaaauacaau

SEQ ID NO: 3534311 - RNA, 21 nt, Human
gaaugcuucugacuucauaga

SEQ ID NO: 3534312 - RNA, 15 nt, Human
gaaugcuucuucuca

SEQ ID NO: 3534313 - RNA, 13 nt, Human
gaaugcuuggaau

SEQ ID NO: 3534314 - RNA, 15 nt, Human
gaauggaaagcuuca

SEQ ID NO: 3534315 - RNA, 21 nt, Human
gaauggaaggguucuggcugc

SEQ ID NO: 3534316 - RNA, 16 nt, Human
gaauggacuuuggaag

SEQ ID NO: 3534317 - RNA, 21 nt, Human
gaauggagcaguacaugggaa

SEQ ID NO: 3534318 - RNA, 16 nt, Human
gaauggaggggcagag

SEQ ID NO: 3534319 - RNA, 22 nt, Human
gaauggaggggcagagccagga

SEQ ID NO: 3534320 - RNA, 22 nt, Human
gaauggauaaaauaaugcugca

SEQ ID NO: 3534321 - RNA, 14 nt, Human
gaauggaucacaag

SEQ ID NO: 3534322 - RNA, 17 nt, Human
gaauggaucacaagaug

SEQ ID NO: 3534323 - RNA, 19 nt, Human
gaauggaucacaagaugga

SEQ ID NO: 3534324 - RNA, 21 nt, Human
gaauggauuuuucuuuaacug

SEQ ID NO: 3534325 - RNA, 14 nt, Human
gaauggcguccgug

SEQ ID NO: 3534326 - RNA, 14 nt, Human
gaauggcuuuguau

SEQ ID NO: 3534327 - RNA, 21 nt, Human
gaaugggcaaaacugaauuau

SEQ ID NO: 3534328 - RNA, 16 nt, Human
gaaugggcaguuacau

SEQ ID NO: 3534329 - RNA, 18 nt, Human
gaaugguagucuaaccaa

SEQ ID NO: 3534330 - RNA, 19 nt, Human
gaaugguagucuaaccaaa

SEQ ID NO: 3534331 - RNA, 20 nt, Human
gaaugguagucuaaccaaau

SEQ ID NO: 3534332 - RNA, 23 nt, Human
gaaugguccgugcuaaggacuug

SEQ ID NO: 3534333 - RNA, 14 nt, Human
gaauggugauuuua

SEQ ID NO: 3534334 - RNA, 16 nt, Human
gaauggugauuuuaaa

SEQ ID NO: 3534335 - RNA, 13 nt, Human
gaaugguuauaaa

SEQ ID NO: 3534336 - RNA, 16 nt, Human
gaaugguuauaaaagu

SEQ ID NO: 3534337 - RNA, 20 nt, Human
gaauguaaagcuugucugau

SEQ ID NO: 3534338 - RNA, 17 nt, Human
gaauguaaauuuguacu

SEQ ID NO: 3534339 - RNA, 22 nt, Human
gaauguaagguauaucauucua

SEQ ID NO: 3534340 - RNA, 13 nt, Human
gggcccacaccuc

SEQ ID NO: 3534341 - RNA, 15 nt, Human
gggcccaccuggcca

SEQ ID NO: 3534342 - RNA, 22 nt, Human
gggcccaccuggccaccugagg

SEQ ID NO: 3534343 - RNA, 17 nt, Human
gggcccagagcccagcu

SEQ ID NO: 3534344 - RNA, 13 nt, Human
gggcccagaucug

SEQ ID NO: 3534345 - RNA, 18 nt, Human
gggcccagcccccacagu

SEQ ID NO: 3534346 - RNA, 16 nt, Human
gggcccagcugggcuc

SEQ ID NO: 3534347 - RNA, 21 nt, Human
gggcccagcugggcucugcca

SEQ ID NO: 3534348 - RNA, 9 nt, Human
gggcccagg

SEQ ID NO: 3534349 - RNA, 18 nt, Human
gggcccagggacaccagc

SEQ ID NO: 3534350 - RNA, 13 nt, Human
gggcccagugcau

SEQ ID NO: 3534351 - RNA, 15 nt, Human
gggcccaugggaggg

SEQ ID NO: 3534352 - RNA, 18 nt, Human
gggcccaugggagggagc

SEQ ID NO: 3534353 - RNA, 22 nt, Human
gggccccaccugcagcucccuc

SEQ ID NO: 3534354 - RNA, 17 nt, Human
gggccccagcccacccu

SEQ ID NO: 3534355 - RNA, 18 nt, Human
gggccccagcccacccuc

SEQ ID NO: 3534356 - RNA, 22 nt, Human
gggccccccagcucaggggcag

SEQ ID NO: 3534357 - RNA, 21 nt, Human
gggccccccuccuugcucugc

SEQ ID NO: 3534358 - RNA, 13 nt, Human
gggccccuccagc

SEQ ID NO: 3534359 - RNA, 18 nt, Human
gggccccucccuaccuca

SEQ ID NO: 3534360 - RNA, 13 nt, Human
gggccccucuccc

SEQ ID NO: 3534361 - RNA, 21 nt, Human
gggccccucuccccagggaag

SEQ ID NO: 3534362 - RNA, 16 nt, Human
gggccccucugcccag

SEQ ID NO: 3534363 - RNA, 22 nt, Human
gggccccucugcccagcuuggg

SEQ ID NO: 3534364 - RNA, 23 nt, Human
gggccccucugcccagcuugggc

SEQ ID NO: 3534365 - RNA, 19 nt, Human
gggccccugcuucuccagc

SEQ ID NO: 3534366 - RNA, 11 nt, Human
gggccccuggc

SEQ ID NO: 3534367 - RNA, 15 nt, Human
gggccccuggcacuc

SEQ ID NO: 3534368 - RNA, 21 nt, Human
gggccccugggcuuggccugc

SEQ ID NO: 3534369 - RNA, 18 nt, Human
gggccccuuuuuacuccc

SEQ ID NO: 3534370 - RNA, 18 nt, Human
gggcccgacauggcuccg

SEQ ID NO: 3534371 - RNA, 16 nt, Human
gggcccgccuggcaga

SEQ ID NO: 3534372 - RNA, 23 nt, Human
gggcccgccuggcagaacugagc

SEQ ID NO: 3534373 - RNA, 11 nt, Human
gggcccggacg

SEQ ID NO: 3534374 - RNA, 16 nt, Human
gggcccggccagccau

SEQ ID NO: 3534375 - RNA, 20 nt, Human
gggcccggccauguccuuag

SEQ ID NO: 3534376 - RNA, 16 nt, Human
gggcccguugucuccc

SEQ ID NO: 3534377 - RNA, 18 nt, Human
gggcccguugucucccug

SEQ ID NO: 3534378 - RNA, 23 nt, Human
gggcccguugucucccuggcccu

SEQ ID NO: 3534379 - RNA, 21 nt, Human
gggcccuccgaccacuuccag

SEQ ID NO: 3534380 - RNA, 13 nt, Human
gggcccugagcuc

SEQ ID NO: 3534381 - RNA, 18 nt, Human
gggcccugagcugagggc

SEQ ID NO: 3534382 - RNA, 14 nt, Human
gggcccugagucug

SEQ ID NO: 3534383 - RNA, 18 nt, Human
gggcccugcaccugugca

SEQ ID NO: 3534384 - RNA, 19 nt, Human
gggcccugcaccugugcag

SEQ ID NO: 3534385 - RNA, 15 nt, Human
gggcccugcagaggg

SEQ ID NO: 3534386 - RNA, 14 nt, Human
gggcccugcagcuc

SEQ ID NO: 3534387 - RNA, 11 nt, Human
gggcccugcau

SEQ ID NO: 3534388 - RNA, 18 nt, Human
gggcccugcauguagugu

SEQ ID NO: 3534389 - RNA, 12 nt, Human
gggcccugccca

SEQ ID NO: 3534390 - RNA, 13 nt, Human
gggcccuggaggc

SEQ ID NO: 3534391 - RNA, 19 nt, Human
gggcccugguccuuccagg

SEQ ID NO: 3534392 - RNA, 22 nt, Human
gggcccuggugguggcucggga

SEQ ID NO: 3534393 - RNA, 18 nt, Human
gggcccuucuugcugccc

SEQ ID NO: 3534394 - RNA, 22 nt, Human
gggcccuucuugcugcccugcc

SEQ ID NO: 3534395 - RNA, 17 nt, Human
gggcccuuggagcgugg

SEQ ID NO: 3534396 - RNA, 20 nt, Human
gggccgacauugucucccgc

SEQ ID NO: 3534397 - RNA, 12 nt, Human
gggccgaggagg

SEQ ID NO: 3534398 - RNA, 22 nt, Human
gguagacacacaugaaguccaa

SEQ ID NO: 3534399 - RNA, 18 nt, Human
gguagaccuuuauugggu

SEQ ID NO: 3534400 - RNA, 22 nt, Human
gguagagacuuugacucuccag

SEQ ID NO: 3534401 - RNA, 20 nt, Human
gguagagaggcgcggaguga

SEQ ID NO: 3534402 - RNA, 19 nt, Human
gguagagauucauuauuuu

SEQ ID NO: 3534403 - RNA, 17 nt, Human
gguagagccacaaaaga

SEQ ID NO: 3534404 - RNA, 17 nt, Human
gguagaggaugaggaaa

SEQ ID NO: 3534405 - RNA, 14 nt, Human
gguagauguucaga

SEQ ID NO: 3534406 - RNA, 13 nt, Human
gguagcagcugga

SEQ ID NO: 3534407 - RNA, 18 nt, Human
gguagcauuuguguugaa

SEQ ID NO: 3534408 - RNA, 13 nt, Human
gguagccagcaca

SEQ ID NO: 3534409 - RNA, 21 nt, Human
gguagccagcacacagggcag

SEQ ID NO: 3534410 - RNA, 16 nt, Human
gguagccaucauggau

SEQ ID NO: 3534411 - RNA, 19 nt, Human
gguagcccccucuucccug

SEQ ID NO: 3534412 - RNA, 13 nt, Human
gguagcucaggug

SEQ ID NO: 3534413 - RNA, 15 nt, Human
gguagcugccccugg

SEQ ID NO: 3534414 - RNA, 17 nt, Human
gguagcuuugaggugga

SEQ ID NO: 3534415 - RNA, 12 nt, Human
gguaggaaaugu

SEQ ID NO: 3534416 - RNA, 21 nt, Human
gguaggaauagcaugucacua

SEQ ID NO: 3534417 - RNA, 15 nt, Human
gguaggaggaugggc

SEQ ID NO: 3534418 - RNA, 19 nt, Human
gguaggagguuuggauggg

SEQ ID NO: 3534419 - RNA, 23 nt, Human
gguaggccaagguguccuacaga

SEQ ID NO: 3534420 - RNA, 24 nt, Human
gguaggccaagguguccuacagaa

SEQ ID NO: 3534421 - RNA, 14 nt, Human
gguaggggccccuc

SEQ ID NO: 3534422 - RNA, 13 nt, Human
gguagggguuggg

SEQ ID NO: 3534423 - RNA, 15 nt, Human
gguaggguaaaucag

SEQ ID NO: 3534424 - RNA, 13 nt, Human
gguagguggcaca

SEQ ID NO: 3534425 - RNA, 15 nt, Human
gguagguucagccaa

SEQ ID NO: 3534426 - RNA, 19 nt, Human
gguagguugggacaccagg

SEQ ID NO: 3534427 - RNA, 16 nt, Human
gguaguaaaacacaga

SEQ ID NO: 3534428 - RNA, 15 nt, Human
gguagucucacugcu

SEQ ID NO: 3534429 - RNA, 16 nt, Human
gguaguuaguagcaug

SEQ ID NO: 3534430 - RNA, 19 nt, Human
gguaguucaagaaaugaag

SEQ ID NO: 3534431 - RNA, 22 nt, Human
gguaguucaagaaaugaagagc

SEQ ID NO: 3534432 - RNA, 20 nt, Human
gguaguuuuuucaucuucag

SEQ ID NO: 3534433 - RNA, 19 nt, Human
gguauaucuagguuuauga

SEQ ID NO: 3534434 - RNA, 23 nt, Human
gguauaucugggcuggccaguug

SEQ ID NO: 3534435 - RNA, 13 nt, Human
gguauauucauuu

SEQ ID NO: 3534436 - RNA, 18 nt, Human
gguaucaaacagcucagg

SEQ ID NO: 3534437 - RNA, 15 nt, Human
gguauccugcccagu

SEQ ID NO: 3534438 - RNA, 15 nt, Human
gguaucucagaaagu

SEQ ID NO: 3534439 - RNA, 19 nt, Human
gguaucucagaaagugccu

SEQ ID NO: 3534440 - RNA, 14 nt, Human
gguaucuccaggau

SEQ ID NO: 3534441 - RNA, 16 nt, Human
gguaucuccaggauug

SEQ ID NO: 3534442 - RNA, 16 nt, Human
gguaugaacuugagga

SEQ ID NO: 3534443 - RNA, 23 nt, Human
gguaugaacuugaggacacaugu

SEQ ID NO: 3534444 - RNA, 13 nt, Human
gguaugaagagug

SEQ ID NO: 3534445 - RNA, 15 nt, Human
gguaugagcugaggg

SEQ ID NO: 3534446 - RNA, 22 nt, Human
gguaugaucacggcucacugca

SEQ ID NO: 3534447 - RNA, 14 nt, Human
gguaugcaaucaaa

SEQ ID NO: 3534448 - RNA, 21 nt, Human
gguauggaaggguuuguggcu

SEQ ID NO: 3534449 - RNA, 20 nt, Human
gguauggcguaaguacagag

SEQ ID NO: 3534450 - RNA, 12 nt, Human
gguaugucugcc

SEQ ID NO: 3534451 - RNA, 13 nt, Human
gguaugucugcca

SEQ ID NO: 3534452 - RNA, 19 nt, Human
gguauuaaaacuaaauuuc

SEQ ID NO: 3534453 - RNA, 19 nt, Human
gguauuccuuuuguguaca

SEQ ID NO: 3534454 - RNA, 19 nt, Human
gguauuguauuuauucaau

SEQ ID NO: 3534455 - RNA, 23 nt, Human
gguauuguauuuauucaauaaag

SEQ ID NO: 3534456 - RNA, 19 nt, Human
gguauuuaaaguauuuucu

SEQ ID NO: 3534457 - RNA, 19 nt, Human
gguauuuuucagagauuua

SEQ ID NO: 3534458 - RNA, 11 nt, Human
ggucaacagaa

SEQ ID NO: 3534459 - RNA, 17 nt, Human
ggucaacagaaugaaaa

SEQ ID NO: 3534460 - RNA, 14 nt, Human
ggucaacagagaag

SEQ ID NO: 3534461 - RNA, 19 nt, Human
ggucaacauggugaaaccc

SEQ ID NO: 3534462 - RNA, 23 nt, Human
ggucaacuugagcauguuacuga

SEQ ID NO: 3534463 - RNA, 20 nt, Human
ggucaagauuuugaaugcuu

SEQ ID NO: 3534464 - RNA, 18 nt, Human
ggucaaggccugucccug

SEQ ID NO: 3534465 - RNA, 16 nt, Human
ggucaaugcuauuuuu

SEQ ID NO: 3534466 - RNA, 14 nt, Human
ggucacacacugau

SEQ ID NO: 3534467 - RNA, 14 nt, Human
ggucacagccaggc

SEQ ID NO: 3534468 - RNA, 16 nt, Human
ggucacaggacucugc

SEQ ID NO: 3534469 - RNA, 18 nt, Human
ggucacaggacucugccu

SEQ ID NO: 3534470 - RNA, 23 nt, Human
ggucaccagacggggcuggagug

SEQ ID NO: 3534471 - RNA, 16 nt, Human
ggucaccagcuccucc

SEQ ID NO: 3534472 - RNA, 22 nt, Human
ggucaccucacucagcaccacu

SEQ ID NO: 3534473 - RNA, 12 nt, Human
ggucaccuuguu

SEQ ID NO: 3534474 - RNA, 13 nt, Human
ggucacuccuggg

SEQ ID NO: 3534475 - RNA, 17 nt, Human
ggucacucuggcagcuc

SEQ ID NO: 3534476 - RNA, 20 nt, Human
ggucacucuggcagcucaga

SEQ ID NO: 3534477 - RNA, 19 nt, Human
ggucacugaggccugagac

SEQ ID NO: 3534478 - RNA, 22 nt, Human
ggucacugaggccugagaccca

SEQ ID NO: 3534479 - RNA, 23 nt, Human
ggucacugaggccugagacccag

SEQ ID NO: 3534480 - RNA, 12 nt, Human
ggucacugcugu

SEQ ID NO: 3534481 - RNA, 14 nt, Human
ggucacugcuguca

SEQ ID NO: 3534482 - RNA, 15 nt, Human
ggucacuggaaaggg

SEQ ID NO: 3534483 - RNA, 13 nt, Human
ggucacuggcucu

SEQ ID NO: 3534484 - RNA, 15 nt, Human
ggucacuuaaaaugu

SEQ ID NO: 3534485 - RNA, 15 nt, Human
ggucagaaacaggac

SEQ ID NO: 3534486 - RNA, 18 nt, Human
ggucagaaacaggaccgg

SEQ ID NO: 3534487 - RNA, 19 nt, Human
ggucagaagaguugugcac

SEQ ID NO: 3534488 - RNA, 11 nt, Human
ggucagagccu

SEQ ID NO: 3534489 - RNA, 13 nt, Human
ggucagagccugc

SEQ ID NO: 3534490 - RNA, 15 nt, Human
ggucagagccugcag

SEQ ID NO: 3534491 - RNA, 19 nt, Human
ggucagaguaagcugcuuu

SEQ ID NO: 3534492 - RNA, 23 nt, Human
ggucagcccaaaccaccagaagc

SEQ ID NO: 3534493 - RNA, 22 nt, Human
ggucagcuugcugcccuaggcu

SEQ ID NO: 3534494 - RNA, 22 nt, Human
ggucaggagaggggcagaacag

SEQ ID NO: 3534495 - RNA, 17 nt, Human
ggucaggagaucgagac

SEQ ID NO: 3534496 - RNA, 19 nt, Human
ggucaggcagccagugaga

SEQ ID NO: 3534497 - RNA, 16 nt, Human
ggucaggccacggcag

SEQ ID NO: 3534498 - RNA, 16 nt, Human
ggucaggcccuggaac

SEQ ID NO: 3534499 - RNA, 17 nt, Human
ggucaggcccuggaacu

SEQ ID NO: 3534500 - RNA, 18 nt, Human
ggucaggcccuggaacuc

SEQ ID NO: 3534501 - RNA, 14 nt, Human
ggucaggcccuggu

SEQ ID NO: 3534502 - RNA, 17 nt, Human
ggucaggccgggcagag

SEQ ID NO: 3534503 - RNA, 11 nt, Human
ggucaggccuu

SEQ ID NO: 3534504 - RNA, 13 nt, Human
ggucaggccuuug

SEQ ID NO: 3534505 - RNA, 12 nt, Human
ggucaggcuggu

SEQ ID NO: 3534506 - RNA, 20 nt, Human
ggucagggagugcuggcuca

SEQ ID NO: 3534507 - RNA, 19 nt, Human
ggucagguguucaagacca

SEQ ID NO: 3534508 - RNA, 20 nt, Human
ggucagguuauacuccuccu

SEQ ID NO: 3534509 - RNA, 20 nt, Human
ggucaguacccaccugagcu

SEQ ID NO: 3534510 - RNA, 21 nt, Human
ggucaguacccaccugagcuu

SEQ ID NO: 3534511 - RNA, 16 nt, Human
ggucagucugguggga

SEQ ID NO: 3534512 - RNA, 15 nt, Human
ggucagugcugccug

SEQ ID NO: 3534513 - RNA, 21 nt, Human
ggucagugcugccugucccca

SEQ ID NO: 3534514 - RNA, 16 nt, Human
ggucauagcagugcuu

SEQ ID NO: 3534515 - RNA, 18 nt, Human
ggucaugaugcucuuucc

SEQ ID NO: 3534516 - RNA, 19 nt, Human
ggucaugaugcucuuuccc

SEQ ID NO: 3534517 - RNA, 13 nt, Human
ggucauggccaca

SEQ ID NO: 3534518 - RNA, 17 nt, Human
ggucauggccacacugu

SEQ ID NO: 3534519 - RNA, 18 nt, Human
ggucaugugggucuucca

SEQ ID NO: 3534520 - RNA, 14 nt, Human
ggucauguuugcag

SEQ ID NO: 3534521 - RNA, 21 nt, Human
ggucauuuccauguaugcaua

SEQ ID NO: 3534522 - RNA, 20 nt, Human
ggucauuucuucagucagaa

SEQ ID NO: 3534523 - RNA, 16 nt, Human
gguccaaugagcuuuc

SEQ ID NO: 3534524 - RNA, 18 nt, Human
gguccaaugagcuuucug

SEQ ID NO: 3534525 - RNA, 19 nt, Human
gguccaaugagcuuucuga

SEQ ID NO: 3534526 - RNA, 22 nt, Human
gguccaaugagcuuucugaaca

SEQ ID NO: 3534527 - RNA, 23 nt, Human
gguccacacccaauuccacucug

SEQ ID NO: 3534528 - RNA, 17 nt, Human
gguccacaucccgggac

SEQ ID NO: 3534529 - RNA, 16 nt, Human
gguccacccaggagcc

SEQ ID NO: 3534530 - RNA, 17 nt, Human
gguccacccaggagccc

SEQ ID NO: 3534531 - RNA, 22 nt, Human
gguccacccaggagccccgagg

SEQ ID NO: 3534532 - RNA, 21 nt, Human
gguccagaaggagacaggcag

SEQ ID NO: 3534533 - RNA, 19 nt, Human
gguccagcccuggcugaag

SEQ ID NO: 3534534 - RNA, 21 nt, Human
gguccagcccuggcugaagga

SEQ ID NO: 3534535 - RNA, 11 nt, Human
gguccagcucu

SEQ ID NO: 3534536 - RNA, 21 nt, Human
gguccagggaagcuggccgag

SEQ ID NO: 3534537 - RNA, 17 nt, Human
gguccaggggccccucc

SEQ ID NO: 3534538 - RNA, 22 nt, Human
gguccaggggccccuccagcuu

SEQ ID NO: 3534539 - RNA, 13 nt, Human
gguccaggguuga

SEQ ID NO: 3534540 - RNA, 23 nt, Human
ggucccaacaggaggacaauuca

SEQ ID NO: 3534541 - RNA, 19 nt, Human
ggucccaagcugggcccca

SEQ ID NO: 3534542 - RNA, 21 nt, Human
ggucugggggcacaagacuga

SEQ ID NO: 3534543 - RNA, 12 nt, Human
ggucuguaaaau

SEQ ID NO: 3534544 - RNA, 14 nt, Human
ggucuguaaaaucu

SEQ ID NO: 3534545 - RNA, 18 nt, Human
ggucuguacguuaccucu

SEQ ID NO: 3534546 - RNA, 14 nt, Human
ggucuguagggauu

SEQ ID NO: 3534547 - RNA, 19 nt, Human
ggucuguagguugcacacu

SEQ ID NO: 3534548 - RNA, 22 nt, Human
ggucugugccaaagaagaaucc

SEQ ID NO: 3534549 - RNA, 24 nt, Human
ggucugugugaaugugggcacugg

SEQ ID NO: 3534550 - RNA, 17 nt, Human
ggucuguguguguguau

SEQ ID NO: 3534551 - RNA, 21 nt, Human
ggucuguguguguguaugugg

SEQ ID NO: 3534552 - RNA, 13 nt, Human
ggucuguucuuga

SEQ ID NO: 3534553 - RNA, 12 nt, Human
ggucuguucuuu

SEQ ID NO: 3534554 - RNA, 20 nt, Human
ggucuguuggcaggcuggcc

SEQ ID NO: 3534555 - RNA, 15 nt, Human
ggucuguuuaaagug

SEQ ID NO: 3534556 - RNA, 14 nt, Human
ggucuuaagaaaug

SEQ ID NO: 3534557 - RNA, 15 nt, Human
ggucuuacagcaggc

SEQ ID NO: 3534558 - RNA, 17 nt, Human
ggucuucccuaccucag

SEQ ID NO: 3534559 - RNA, 10 nt, Human
ggucuuccua

SEQ ID NO: 3534560 - RNA, 17 nt, Human
ggucuuggaacuugccu

SEQ ID NO: 3534561 - RNA, 13 nt, Human
ggucuugggaaau

SEQ ID NO: 3534562 - RNA, 21 nt, Human
ggucuugguuccagccugcca

SEQ ID NO: 3534563 - RNA, 13 nt, Human
ggucuuguaagag

SEQ ID NO: 3534564 - RNA, 23 nt, Human
ggucuuuaaaucauuuuaggaaa

SEQ ID NO: 3534565 - RNA, 19 nt, Human
ggucuuuccuaaggcugca

SEQ ID NO: 3534566 - RNA, 19 nt, Human
ggucuuuccuaucauggag

SEQ ID NO: 3534567 - RNA, 14 nt, Human
ggucuuuguaagag

SEQ ID NO: 3534568 - RNA, 19 nt, Human
ggucuuuguaagaguguag

SEQ ID NO: 3534569 - RNA, 20 nt, Human
ggucuuuguaagaguguaga

SEQ ID NO: 3534570 - RNA, 16 nt, Human
ggucuuuuauaauucu

SEQ ID NO: 3534571 - RNA, 22 nt, Human
ggucuuuuccucgcuucuuuca

SEQ ID NO: 3534572 - RNA, 17 nt, Human
ggucuuuuuguaaguga

SEQ ID NO: 3534573 - RNA, 14 nt, Human
ggugaaaauuauuu

SEQ ID NO: 3534574 - RNA, 20 nt, Human
ggugaaacauuuucucccug

SEQ ID NO: 3534575 - RNA, 13 nt, Human
ggugaaaggaaau

SEQ ID NO: 3534576 - RNA, 18 nt, Human
ggugaacaaagcagccac

SEQ ID NO: 3534577 - RNA, 17 nt, Human
ggugaaccacuucauuc

SEQ ID NO: 3534578 - RNA, 23 nt, Human
ggugaaccaugucagcaaaaagc

SEQ ID NO: 3534579 - RNA, 19 nt, Human
ggugaagaugggaacgcag

SEQ ID NO: 3534580 - RNA, 18 nt, Human
ggugaagcuauuuaucug

SEQ ID NO: 3534581 - RNA, 13 nt, Human
ggugaaggcuggc

SEQ ID NO: 3534582 - RNA, 18 nt, Human
ggugaagggagagccagc

SEQ ID NO: 3534583 - RNA, 18 nt, Human
ggugaagugaagacaaug

SEQ ID NO: 3534584 - RNA, 18 nt, Human
ggugaauggccuuccuuc

SEQ ID NO: 3534585 - RNA, 20 nt, Human
ggugaauggcuuuguauaga

SEQ ID NO: 3534586 - RNA, 15 nt, Human
ggugacacagacuca

SEQ ID NO: 3534587 - RNA, 17 nt, Human
ggugacagcagucgguu

SEQ ID NO: 3534588 - RNA, 12 nt, Human
ggugacagucau

SEQ ID NO: 3534589 - RNA, 19 nt, Human
ggugacagucaucaucagg

SEQ ID NO: 3534590 - RNA, 20 nt, Human
ggugacagucaucaucaggg

SEQ ID NO: 3534591 - RNA, 22 nt, Human
ggugacagucaucaucagggcc

SEQ ID NO: 3534592 - RNA, 23 nt, Human
ggugacagugagguccugggggc

SEQ ID NO: 3534593 - RNA, 16 nt, Human
ggugacauauacauac

SEQ ID NO: 3534594 - RNA, 18 nt, Human
ggugacaucagguuuuuc

SEQ ID NO: 3534595 - RNA, 22 nt, Human
ggugaccagcaccaucucuccu

SEQ ID NO: 3534596 - RNA, 20 nt, Human
ggugaccccagggcacagga

SEQ ID NO: 3534597 - RNA, 22 nt, Human
ggugaccccagggcacaggagc

SEQ ID NO: 3534598 - RNA, 20 nt, Human
ggugacccggcacccccugc

SEQ ID NO: 3534599 - RNA, 20 nt, Human
ggugaccuccggccaggugc

SEQ ID NO: 3534600 - RNA, 21 nt, Human
ggugaccucugccugaaguca

SEQ ID NO: 3534601 - RNA, 19 nt, Human
ggugaccuuccaagagccu

SEQ ID NO: 3534602 - RNA, 23 nt, Human
ggugacugcgaucuucagagcag

SEQ ID NO: 3534603 - RNA, 19 nt, Human
ggugacugggcccugccuc

SEQ ID NO: 3534604 - RNA, 21 nt, Human
ggugacuuuggauaauaagga

SEQ ID NO: 3534605 - RNA, 23 nt, Human
ggugagaaaccuguaucuuucua

SEQ ID NO: 3534606 - RNA, 18 nt, Human
ggugagacccauggcugu

SEQ ID NO: 3534607 - RNA, 17 nt, Human
ggugagaugcuggagaa

SEQ ID NO: 3534608 - RNA, 23 nt, Human
ggugagcacggccaacaaagcug

SEQ ID NO: 3534609 - RNA, 19 nt, Human
ggugagcagaaguggagcu

SEQ ID NO: 3534610 - RNA, 18 nt, Human
ggugaggaccacuccugu

SEQ ID NO: 3534611 - RNA, 12 nt, Human
ggugaggccugu

SEQ ID NO: 3534612 - RNA, 15 nt, Human
ggugaggccuugcuc

SEQ ID NO: 3534613 - RNA, 18 nt, Human
ggugaguccauucuccca

SEQ ID NO: 3534614 - RNA, 17 nt, Human
ggugagucuuggcggca

SEQ ID NO: 3534615 - RNA, 23 nt, Human
ggugaguuggcuuaccuggccca

SEQ ID NO: 3534616 - RNA, 20 nt, Human
ggugaguuugagcugccuuc

SEQ ID NO: 3534617 - RNA, 21 nt, Human
ggugaguuugagcugccuucc

SEQ ID NO: 3534618 - RNA, 22 nt, Human
ggugauaauagaagaguggcag

SEQ ID NO: 3534619 - RNA, 15 nt, Human
ggugauauccauucu

SEQ ID NO: 3534620 - RNA, 24 nt, Human
ggugauccacccaccucagccucc

SEQ ID NO: 3534621 - RNA, 21 nt, Human
ggugauccacucgccuucauc

SEQ ID NO: 3534622 - RNA, 15 nt, Human
ggugaugagggcagc

SEQ ID NO: 3534623 - RNA, 16 nt, Human
ggugaugagggcagca

SEQ ID NO: 3534624 - RNA, 19 nt, Human
ggugaugagggcagcagcc

SEQ ID NO: 3534625 - RNA, 13 nt, Human
ggugaugccaggu

SEQ ID NO: 3534626 - RNA, 16 nt, Human
ggugaugcugggcugg

SEQ ID NO: 3534627 - RNA, 14 nt, Human
ggugauucaccaaa

SEQ ID NO: 3534628 - RNA, 22 nt, Human
ggugauuguaugaaguuugaau

SEQ ID NO: 3534629 - RNA, 15 nt, Human
ggugauuucagagag

SEQ ID NO: 3534630 - RNA, 15 nt, Human
ggugcaagagggagc

SEQ ID NO: 3534631 - RNA, 13 nt, Human
ggugcaaggaaaa

SEQ ID NO: 3534632 - RNA, 16 nt, Human
ggugcaaugaccuuuc

SEQ ID NO: 3534633 - RNA, 22 nt, Human
ggugcaauguguguauauggac

SEQ ID NO: 3534634 - RNA, 22 nt, Human
ggugcacagcacaaauuaguua

SEQ ID NO: 3534635 - RNA, 22 nt, Human
ggugcacgcuggggaagaauuu

SEQ ID NO: 3534636 - RNA, 14 nt, Human
ggugcacugggagg

SEQ ID NO: 3534637 - RNA, 16 nt, Human
ggugcacuuuguaaau

SEQ ID NO: 3534638 - RNA, 16 nt, Human
ggugcagagcugaaga

SEQ ID NO: 3534639 - RNA, 13 nt, Human
ggugcagaggaag

SEQ ID NO: 3534640 - RNA, 14 nt, Human
ggugcagaggcugu

SEQ ID NO: 3534641 - RNA, 19 nt, Human
ggugcagagugcccagaac

SEQ ID NO: 3534642 - RNA, 15 nt, Human
ggugcagcagugagg

SEQ ID NO: 3534643 - RNA, 13 nt, Human
ggugcaggcgccu

SEQ ID NO: 3534644 - RNA, 12 nt, Human
ggugcagguaga

SEQ ID NO: 3534645 - RNA, 20 nt, Human
ggugcaguugacagcaggug

SEQ ID NO: 3534646 - RNA, 23 nt, Human
ggugccaaacaaaaagguucuca

SEQ ID NO: 3534647 - RNA, 18 nt, Human
ggugccacaaauaaaaug

SEQ ID NO: 3534648 - RNA, 16 nt, Human
ggugccacuuuaccca

SEQ ID NO: 3534649 - RNA, 12 nt, Human
ggugccagcaaa

SEQ ID NO: 3534650 - RNA, 17 nt, Human
ggugccagcaaagcccc

SEQ ID NO: 3534651 - RNA, 14 nt, Human
ggugccagcaacug

SEQ ID NO: 3534652 - RNA, 15 nt, Human
ggugccagccuuccu

SEQ ID NO: 3534653 - RNA, 20 nt, Human
ggugccagccuuccucugca

SEQ ID NO: 3534654 - RNA, 23 nt, Human
ggugccagccuuccucugcagcu

SEQ ID NO: 3534655 - RNA, 17 nt, Human
ggugccagguuuucugg

SEQ ID NO: 3534656 - RNA, 21 nt, Human
ggugccagguuuucugggugu

SEQ ID NO: 3534657 - RNA, 15 nt, Human
ggugccaguuauggc

SEQ ID NO: 3534658 - RNA, 22 nt, Human
ggugccaugaagggacccuuug

SEQ ID NO: 3534659 - RNA, 23 nt, Human
ggugcccaagccagaggcugggu

SEQ ID NO: 3534660 - RNA, 21 nt, Human
ggugcccacaccggggacagg

SEQ ID NO: 3534661 - RNA, 14 nt, Human
ggugcccacaggcc

SEQ ID NO: 3534662 - RNA, 19 nt, Human
ggugcccagaacuucccug

SEQ ID NO: 3534663 - RNA, 21 nt, Human
ggugccccaggaccagcucag

SEQ ID NO: 3534664 - RNA, 22 nt, Human
ggugccccaggaccagcucagg

SEQ ID NO: 3534665 - RNA, 19 nt, Human
ggugcccugcuuucagaua

SEQ ID NO: 3534666 - RNA, 15 nt, Human
ggugcccuggaugcc

SEQ ID NO: 3534667 - RNA, 19 nt, Human
ggugcccuguucucuacca

SEQ ID NO: 3534668 - RNA, 17 nt, Human
ggugcccuuggaggcca

SEQ ID NO: 3534669 - RNA, 22 nt, Human
ggugcccuuggaggccagccag

SEQ ID NO: 3534670 - RNA, 21 nt, Human
ggugccuaggauugugccugu

SEQ ID NO: 3534671 - RNA, 19 nt, Human
ggugccuaguauugacaaa

SEQ ID NO: 3534672 - RNA, 16 nt, Human
ggugccuccaggugug

SEQ ID NO: 3534673 - RNA, 21 nt, Human
ggugccugauucggcugucuc

SEQ ID NO: 3534674 - RNA, 12 nt, Human
ggugccuuuccu

SEQ ID NO: 3534675 - RNA, 15 nt, Human
ggugcgaucuggguu

SEQ ID NO: 3534676 - RNA, 14 nt, Human
ggugcgucugggag

SEQ ID NO: 3534677 - RNA, 12 nt, Human
ggugcuaaaucu

SEQ ID NO: 3534678 - RNA, 23 nt, Human
ggugcuaaauggucgcccaggag

SEQ ID NO: 3534679 - RNA, 17 nt, Human
ggugcuaauuaauaaag

SEQ ID NO: 3534680 - RNA, 19 nt, Human
ggugcuacaaaaacacagc

SEQ ID NO: 3534681 - RNA, 21 nt, Human
ggugcuacaaaaacacagcaa

SEQ ID NO: 3534682 - RNA, 23 nt, Human
ggugcuacaaaaacacagcaagg

SEQ ID NO: 3534683 - RNA, 22 nt, Human
ggugcuacacccuuuuccagcu

SEQ ID NO: 3534684 - RNA, 14 nt, Human
ggugcuacugggga

SEQ ID NO: 3534685 - RNA, 21 nt, Human
gucaacaguuuuccuaugcuu

SEQ ID NO: 3534686 - RNA, 12 nt, Human
gucaaccagaca

SEQ ID NO: 3534687 - RNA, 16 nt, Human
gucaaccagacagagg

SEQ ID NO: 3534688 - RNA, 19 nt, Human
gucaacccuucuggaaacu

SEQ ID NO: 3534689 - RNA, 14 nt, Human
gucaaccugggcaa

SEQ ID NO: 3534690 - RNA, 12 nt, Human
gucaacuucugg

SEQ ID NO: 3534691 - RNA, 18 nt, Human
gucaagagggucugagga

SEQ ID NO: 3534692 - RNA, 20 nt, Human
gucaagagugaauucccuca

SEQ ID NO: 3534693 - RNA, 16 nt, Human
gucaagauucagcuag

SEQ ID NO: 3534694 - RNA, 14 nt, Human
gucaagcauguauu

SEQ ID NO: 3534695 - RNA, 19 nt, Human
gucaagcuccuccucccug

SEQ ID NO: 3534696 - RNA, 21 nt, Human
gucaagcuccuccucccugca

SEQ ID NO: 3534697 - RNA, 23 nt, Human
gucaagcugcucugagccacagu

SEQ ID NO: 3534698 - RNA, 11 nt, Human
gucaaggccag

SEQ ID NO: 3534699 - RNA, 13 nt, Human
gucaaggcuuaga

SEQ ID NO: 3534700 - RNA, 15 nt, Human
gucaaggugcuguug

SEQ ID NO: 3534701 - RNA, 15 nt, Human
gucaaguaagaagac

SEQ ID NO: 3534702 - RNA, 14 nt, Human
gucaagucucugcu

SEQ ID NO: 3534703 - RNA, 21 nt, Human
gucaagucucugcuggcccag

SEQ ID NO: 3534704 - RNA, 15 nt, Human
gucaagugaaaaagg

SEQ ID NO: 3534705 - RNA, 14 nt, Human
gucaaguggcaaag

SEQ ID NO: 3534706 - RNA, 20 nt, Human
gucaaguggcaaagcuguuc

SEQ ID NO: 3534707 - RNA, 18 nt, Human
gucaaguugucagguuau

SEQ ID NO: 3534708 - RNA, 21 nt, Human
gucaauaaaauccauacauuu

SEQ ID NO: 3534709 - RNA, 22 nt, Human
gucaauaaaauccauacauuug

SEQ ID NO: 3534710 - RNA, 13 nt, Human
gucaauaaacagc

SEQ ID NO: 3534711 - RNA, 21 nt, Human
gucaauacaguacaggcagca

SEQ ID NO: 3534712 - RNA, 18 nt, Human
gucaauauuaaauacaga

SEQ ID NO: 3534713 - RNA, 22 nt, Human
gucaauauuaaauacagacacu

SEQ ID NO: 3534714 - RNA, 12 nt, Human
gucaauauuuaa

SEQ ID NO: 3534715 - RNA, 14 nt, Human
gucaaucauuucuc

SEQ ID NO: 3534716 - RNA, 15 nt, Human
gucaaucauuucuca

SEQ ID NO: 3534717 - RNA, 22 nt, Human
gucaauccaagagucugaugau

SEQ ID NO: 3534718 - RNA, 22 nt, Human
gucaauccagauggugggaugu

SEQ ID NO: 3534719 - RNA, 20 nt, Human
gucaaucccaaaagucacca

SEQ ID NO: 3534720 - RNA, 16 nt, Human
gucaauccccucauuc

SEQ ID NO: 3534721 - RNA, 15 nt, Human
gucaauccugugggu

SEQ ID NO: 3534722 - RNA, 19 nt, Human
gucaauccugugggugaag

SEQ ID NO: 3534723 - RNA, 16 nt, Human
gucaaugacaugaauu

SEQ ID NO: 3534724 - RNA, 23 nt, Human
gucaaugacaugaauuuuagcuu

SEQ ID NO: 3534725 - RNA, 14 nt, Human
gucaaugcaguugu

SEQ ID NO: 3534726 - RNA, 22 nt, Human
gucaaugcaguugucucuguuu

SEQ ID NO: 3534727 - RNA, 17 nt, Human
gucaaugggaccugugg

SEQ ID NO: 3534728 - RNA, 15 nt, Human
gucaauguacuagga

SEQ ID NO: 3534729 - RNA, 14 nt, Human
gucaaugugugcac

SEQ ID NO: 3534730 - RNA, 15 nt, Human
gucaauguuuucagu

SEQ ID NO: 3534731 - RNA, 21 nt, Human
gucaauuaccagaaagauaac

SEQ ID NO: 3534732 - RNA, 14 nt, Human
gucacaaagaguuc

SEQ ID NO: 3534733 - RNA, 21 nt, Human
gucacaaauccuaaaagaagc

SEQ ID NO: 3534734 - RNA, 15 nt, Human
gucacaauguucuuu

SEQ ID NO: 3534735 - RNA, 13 nt, Human
gucacacacugau

SEQ ID NO: 3534736 - RNA, 22 nt, Human
gucacacaguauuacuucugcu

SEQ ID NO: 3534737 - RNA, 13 nt, Human
gucacacagugag

SEQ ID NO: 3534738 - RNA, 20 nt, Human
gucacacgcuuuugaauuau

SEQ ID NO: 3534739 - RNA, 14 nt, Human
gucacagccuccuc

SEQ ID NO: 3534740 - RNA, 16 nt, Human
gucacagccuccucug

SEQ ID NO: 3534741 - RNA, 15 nt, Human
gucacaggaaaaagu

SEQ ID NO: 3534742 - RNA, 15 nt, Human
gucacaggaaguaga

SEQ ID NO: 3534743 - RNA, 16 nt, Human
gucacaggagggaggg

SEQ ID NO: 3534744 - RNA, 23 nt, Human
gucacagggcaguaccugagggu

SEQ ID NO: 3534745 - RNA, 19 nt, Human
gucaccaaaagacacugca

SEQ ID NO: 3534746 - RNA, 22 nt, Human
gucaccaaaagacacugcagaa

SEQ ID NO: 3534747 - RNA, 22 nt, Human
gucaccaaauagugugaaauau

SEQ ID NO: 3534748 - RNA, 12 nt, Human
gucaccaagccc

SEQ ID NO: 3534749 - RNA, 23 nt, Human
gucaccaaggaaacgcuaccucu

SEQ ID NO: 3534750 - RNA, 19 nt, Human
gucaccaauguacccaccg

SEQ ID NO: 3534751 - RNA, 15 nt, Human
gucaccaccaccccu

SEQ ID NO: 3534752 - RNA, 14 nt, Human
gucaccaccuuccc

SEQ ID NO: 3534753 - RNA, 19 nt, Human
gucaccaccuucccagcuc

SEQ ID NO: 3534754 - RNA, 20 nt, Human
gucaccaccuucccagcucu

SEQ ID NO: 3534755 - RNA, 18 nt, Human
gucaccacuccauuccca

SEQ ID NO: 3534756 - RNA, 13 nt, Human
gucaccagagacu

SEQ ID NO: 3534757 - RNA, 18 nt, Human
gucaccaggaauguuaaa

SEQ ID NO: 3534758 - RNA, 15 nt, Human
gucaccaucucaggc

SEQ ID NO: 3534759 - RNA, 14 nt, Human
gucacccaugacag

SEQ ID NO: 3534760 - RNA, 23 nt, Human
gucaccccaaguagucugcucac

SEQ ID NO: 3534761 - RNA, 21 nt, Human
gucaccccagagccacacaug

SEQ ID NO: 3534762 - RNA, 15 nt, Human
gucacccggccccca

SEQ ID NO: 3534763 - RNA, 18 nt, Human
gucaccguggaccuuccu

SEQ ID NO: 3534764 - RNA, 20 nt, Human
gucaccguggaccuuccugc

SEQ ID NO: 3534765 - RNA, 18 nt, Human
guaagggaaacugccagc

SEQ ID NO: 3534766 - RNA, 13 nt, Human
guaaggugcaguu

SEQ ID NO: 3534767 - RNA, 15 nt, Human
guaaguaaaugucug

SEQ ID NO: 3534768 - RNA, 13 nt, Human
guaaguaauuauc

SEQ ID NO: 3534769 - RNA, 16 nt, Human
guaaguacagagaagc

SEQ ID NO: 3534770 - RNA, 18 nt, Human
guaaguaccacucaggcc

SEQ ID NO: 3534771 - RNA, 14 nt, Human
guaagucaguguug

SEQ ID NO: 3534772 - RNA, 17 nt, Human
guaagucucaacucugu

SEQ ID NO: 3534773 - RNA, 21 nt, Human
guaagucuugccuauauuuuc

SEQ ID NO: 3534774 - RNA, 16 nt, Human
guaagugagagagaca

SEQ ID NO: 3534775 - RNA, 20 nt, Human
guaagugagugugcugcugu

SEQ ID NO: 3534776 - RNA, 13 nt, Human
guaagugccuucc

SEQ ID NO: 3534777 - RNA, 16 nt, Human
guaaguuaucuuugaa

SEQ ID NO: 3534778 - RNA, 17 nt, Human
guaaguucagcacuugu

SEQ ID NO: 3534779 - RNA, 14 nt, Human
guaaguuccuacua

SEQ ID NO: 3534780 - RNA, 23 nt, Human
guaaguugggcuugcuauucugu

SEQ ID NO: 3534781 - RNA, 21 nt, Human
guaaguuuaaaggauguuggu

SEQ ID NO: 3534782 - RNA, 14 nt, Human
guaaguuucaggug

SEQ ID NO: 3534783 - RNA, 16 nt, Human
guaaguuucaggugac

SEQ ID NO: 3534784 - RNA, 21 nt, Human
guaauaaaauucaacaaacau

SEQ ID NO: 3534785 - RNA, 13 nt, Human
guaauaaacucau

SEQ ID NO: 3534786 - RNA, 16 nt, Human
guaauaaacuguguuu

SEQ ID NO: 3534787 - RNA, 20 nt, Human
guaauaaaguguuuucagag

SEQ ID NO: 3534788 - RNA, 17 nt, Human
guaauaacacccuuccu

SEQ ID NO: 3534789 - RNA, 22 nt, Human
guaauaacugugaaguuuacau

SEQ ID NO: 3534790 - RNA, 19 nt, Human
guaauaagacauaacguuu

SEQ ID NO: 3534791 - RNA, 23 nt, Human
guaauaagacauaacguuuuucc

SEQ ID NO: 3534792 - RNA, 20 nt, Human
guaauaagcacuguaaacuu

SEQ ID NO: 3534793 - RNA, 15 nt, Human
guaauaagguuuuaa

SEQ ID NO: 3534794 - RNA, 12 nt, Human
guaauaauaaag

SEQ ID NO: 3534795 - RNA, 15 nt, Human
guaauaauaccucaa

SEQ ID NO: 3534796 - RNA, 22 nt, Human
guaauacaaacuaauuuaguaa

SEQ ID NO: 3534797 - RNA, 17 nt, Human
guaauacuuccagaagu

SEQ ID NO: 3534798 - RNA, 17 nt, Human
guaauacuucuugugug

SEQ ID NO: 3534799 - RNA, 19 nt, Human
guaauagagcaaaauugau

SEQ ID NO: 3534800 - RNA, 20 nt, Human
guaauaggcguaacuaauuu

SEQ ID NO: 3534801 - RNA, 14 nt, Human
guaauauaaaagau

SEQ ID NO: 3534802 - RNA, 20 nt, Human
guaauauaauggaagagaaa

SEQ ID NO: 3534803 - RNA, 15 nt, Human
guaauauauugcugc

SEQ ID NO: 3534804 - RNA, 15 nt, Human
guaauauuuauuaaa

SEQ ID NO: 3534805 - RNA, 16 nt, Human
guaauauuuauuaaau

SEQ ID NO: 3534806 - RNA, 16 nt, Human
guaaucaauaaagaaa

SEQ ID NO: 3534807 - RNA, 18 nt, Human
guaaucaaugaauauuga

SEQ ID NO: 3534808 - RNA, 14 nt, Human
guaaucaauguuuc

SEQ ID NO: 3534809 - RNA, 15 nt, Human
guaaucauuuguuua

SEQ ID NO: 3534810 - RNA, 18 nt, Human
guaaucauuuguuuacau

SEQ ID NO: 3534811 - RNA, 19 nt, Human
guaauccaggcacagcuga

SEQ ID NO: 3534812 - RNA, 20 nt, Human
guaauccaggcacagcugag

SEQ ID NO: 3534813 - RNA, 14 nt, Human
guaaucccagcacu

SEQ ID NO: 3534814 - RNA, 15 nt, Human
guaaucccagcacuu

SEQ ID NO: 3534815 - RNA, 18 nt, Human
guaaucccagcacuuugg

SEQ ID NO: 3534816 - RNA, 21 nt, Human
guaaucccagcuacucaggag

SEQ ID NO: 3534817 - RNA, 20 nt, Human
guaauccccuaaaauaacag

SEQ ID NO: 3534818 - RNA, 13 nt, Human
guaaucccugcuu

SEQ ID NO: 3534819 - RNA, 18 nt, Human
guaaucccugcuuuuugu

SEQ ID NO: 3534820 - RNA, 13 nt, Human
guaauccuaaauu

SEQ ID NO: 3534821 - RNA, 23 nt, Human
guaauccuagcacuuugggaggc

SEQ ID NO: 3534822 - RNA, 15 nt, Human
guaaucgaccugccu

SEQ ID NO: 3534823 - RNA, 17 nt, Human
guaaucgcuuaaagaug

SEQ ID NO: 3534824 - RNA, 15 nt, Human
guaaucguguccccu

SEQ ID NO: 3534825 - RNA, 18 nt, Human
guaaucucguuucaaaaa

SEQ ID NO: 3534826 - RNA, 19 nt, Human
guaaucucucugcagcugc

SEQ ID NO: 3534827 - RNA, 20 nt, Human
guaaucucucugcagcugcc

SEQ ID NO: 3534828 - RNA, 22 nt, Human
guaaucucucugcagcugccgg

SEQ ID NO: 3534829 - RNA, 14 nt, Human
guaaucugagaaac

SEQ ID NO: 3534830 - RNA, 17 nt, Human
gaccuuguaauguaacu

SEQ ID NO: 3534831 - RNA, 13 nt, Human
gaccuugugaucu

SEQ ID NO: 3534832 - RNA, 22 nt, Human
gaccuuuaagagaaaugagcug

SEQ ID NO: 3534833 - RNA, 13 nt, Human
gaccuuuccacca

SEQ ID NO: 3534834 - RNA, 23 nt, Human
gaccuuuccaccacagccagcac

SEQ ID NO: 3534835 - RNA, 17 nt, Human
gaccuuuccugaggaag

SEQ ID NO: 3534836 - RNA, 13 nt, Human
gaccuuuuaaagu

SEQ ID NO: 3534837 - RNA, 14 nt, Human
gaccuuuuaaagug

SEQ ID NO: 3534838 - RNA, 22 nt, Human
gaccuuuucaacuuggcuuccu

SEQ ID NO: 3534839 - RNA, 14 nt, Human
gacgaacuuccaug

SEQ ID NO: 3534840 - RNA, 17 nt, Human
gacgauggugaggagau

SEQ ID NO: 3534841 - RNA, 14 nt, Human
gacgccaccauucc

SEQ ID NO: 3534842 - RNA, 14 nt, Human
gacgccacccagca

SEQ ID NO: 3534843 - RNA, 17 nt, Human
gacgccacucauuucau

SEQ ID NO: 3534844 - RNA, 14 nt, Human
gacgccaggguaug

SEQ ID NO: 3534845 - RNA, 13 nt, Human
gacgccaucccag

SEQ ID NO: 3534846 - RNA, 17 nt, Human
gacgccaucccagcccc

SEQ ID NO: 3534847 - RNA, 18 nt, Human
gacgccaucccagcccca

SEQ ID NO: 3534848 - RNA, 16 nt, Human
gacgccaugugaugga

SEQ ID NO: 3534849 - RNA, 22 nt, Human
gacgccaugugauggacacucc

SEQ ID NO: 3534850 - RNA, 15 nt, Human
gacgcccucucccca

SEQ ID NO: 3534851 - RNA, 23 nt, Human
gacgcccucuccccaccccuacc

SEQ ID NO: 3534852 - RNA, 14 nt, Human
gacgccugaggaac

SEQ ID NO: 3534853 - RNA, 18 nt, Human
gacgccugcccuccccag

SEQ ID NO: 3534854 - RNA, 23 nt, Human
gacgccugcccuccccagagcac

SEQ ID NO: 3534855 - RNA, 14 nt, Human
gacgccuggcugcu

SEQ ID NO: 3534856 - RNA, 15 nt, Human
gacgccuggcugcug

SEQ ID NO: 3534857 - RNA, 12 nt, Human
gacgccuggggg

SEQ ID NO: 3534858 - RNA, 17 nt, Human
gacgcucccugcuccac

SEQ ID NO: 3534859 - RNA, 17 nt, Human
gacgcucucuggccuuc

SEQ ID NO: 3534860 - RNA, 17 nt, Human
gacgcugaccguggagc

SEQ ID NO: 3534861 - RNA, 16 nt, Human
gacgcugugcugcccu

SEQ ID NO: 3534862 - RNA, 14 nt, Human
gacgcuucacagga

SEQ ID NO: 3534863 - RNA, 14 nt, Human
gacggagccgggaa

SEQ ID NO: 3534864 - RNA, 12 nt, Human
gacggaggggag

SEQ ID NO: 3534865 - RNA, 21 nt, Human
gacggaggggaguagagaagu

SEQ ID NO: 3534866 - RNA, 19 nt, Human
gacggagucucgcucuguc

SEQ ID NO: 3534867 - RNA, 20 nt, Human
gacggcaggcucacugccag

SEQ ID NO: 3534868 - RNA, 15 nt, Human
gacggccugaugcuc

SEQ ID NO: 3534869 - RNA, 20 nt, Human
gacggccugaugcucccucc

SEQ ID NO: 3534870 - RNA, 22 nt, Human
gacggcugggcacacgccuccc

SEQ ID NO: 3534871 - RNA, 23 nt, Human
gacgggacucaggcgggacagug

SEQ ID NO: 3534872 - RNA, 23 nt, Human
gacggggggccccagucagccuc

SEQ ID NO: 3534873 - RNA, 21 nt, Human
gacgguauuaugcuucuugga

SEQ ID NO: 3534874 - RNA, 16 nt, Human
gacggucccacacugg

SEQ ID NO: 3534875 - RNA, 24 nt, Human
gacggugacaaagauggcucagag

SEQ ID NO: 3534876 - RNA, 23 nt, Human
gacggugcccaagccagaggcug

SEQ ID NO: 3534877 - RNA, 13 nt, Human
gacggugucuugu

SEQ ID NO: 3534878 - RNA, 15 nt, Human
gacgguucaccagcc

SEQ ID NO: 3534879 - RNA, 16 nt, Human
gacgguuccuacacag

SEQ ID NO: 3534880 - RNA, 19 nt, Human
gacgguuccuacacaggac

SEQ ID NO: 3534881 - RNA, 21 nt, Human
gacgguuccuacacaggacag

SEQ ID NO: 3534882 - RNA, 14 nt, Human
gacgguuuuuuauu

SEQ ID NO: 3534883 - RNA, 19 nt, Human
gacgguuuuuuauuauugu

SEQ ID NO: 3534884 - RNA, 19 nt, Human
gacguacaaguaguucugu

SEQ ID NO: 3534885 - RNA, 22 nt, Human
gacguacaaguaguucuguauu

SEQ ID NO: 3534886 - RNA, 21 nt, Human
gacguagcugcaaaggacaga

SEQ ID NO: 3534887 - RNA, 20 nt, Human
gacguaggaacgguaaauuu

SEQ ID NO: 3534888 - RNA, 18 nt, Human
gacgucaagucuccuucc

SEQ ID NO: 3534889 - RNA, 22 nt, Human
gacgucccuccacguucacccc

SEQ ID NO: 3534890 - RNA, 21 nt, Human
gacguccugccaccuggggca

SEQ ID NO: 3534891 - RNA, 14 nt, Human
gacgucuuucuuuu

SEQ ID NO: 3534892 - RNA, 18 nt, Human
gacgugcaccuguacuca

SEQ ID NO: 3534893 - RNA, 18 nt, Human
gacguggaaccucugucu

SEQ ID NO: 3534894 - RNA, 20 nt, Human
gacguggagcgggguaugaa

SEQ ID NO: 3534895 - RNA, 16 nt, Human
gacguggcaccuccuc

SEQ ID NO: 3534896 - RNA, 14 nt, Human
gacguggcucagcc

SEQ ID NO: 3534897 - RNA, 15 nt, Human
gacguggcucagcca

SEQ ID NO: 3534898 - RNA, 20 nt, Human
gacgugggcugggcccacaa

SEQ ID NO: 3534899 - RNA, 20 nt, Human
gacguguuaugacuccagaa

SEQ ID NO: 3534900 - RNA, 22 nt, Human
gacguuuuauaagcaucauuau

SEQ ID NO: 3534901 - RNA, 12 nt, Human
gacuaaaagaua

SEQ ID NO: 3534902 - RNA, 19 nt, Human
gacuaaaagauauaagugc

SEQ ID NO: 3534903 - RNA, 20 nt, Human
gacuaaaagauauaagugcu

SEQ ID NO: 3534904 - RNA, 22 nt, Human
gacuaaaccauugugcauucua

SEQ ID NO: 3534905 - RNA, 19 nt, Human
gacuaaacuuuuuuucugu

SEQ ID NO: 3534906 - RNA, 18 nt, Human
gacuaaagagagaaugua

SEQ ID NO: 3534907 - RNA, 12 nt, Human
gacuaaaugaaa

SEQ ID NO: 3534908 - RNA, 20 nt, Human
gacuaaaugccuaguuuuua

SEQ ID NO: 3534909 - RNA, 14 nt, Human
gacuaaauucguga

SEQ ID NO: 3534910 - RNA, 14 nt, Human
gacuaacacucaga

SEQ ID NO: 3534911 - RNA, 22 nt, Human
gacuaacacucagaagccuggg

SEQ ID NO: 3534912 - RNA, 19 nt, Human
gacuaaccccaacgcacag

SEQ ID NO: 3534913 - RNA, 23 nt, Human
gacuaacuagacaccaaaguucu

SEQ ID NO: 3534914 - RNA, 16 nt, Human
gacuaacucaaauaca

SEQ ID NO: 3534915 - RNA, 23 nt, Human
gacuaagaucgguuaacaaauaa

SEQ ID NO: 3534916 - RNA, 15 nt, Human
gacuaagccuaccug

SEQ ID NO: 3534917 - RNA, 15 nt, Human
gacuaaucuuauuca

SEQ ID NO: 3534918 - RNA, 20 nt, Human
gacuaauggcaugagaaaua

SEQ ID NO: 3534919 - RNA, 13 nt, Human
gacuaauuguaua

SEQ ID NO: 3534920 - RNA, 19 nt, Human
gucaccuagcaagcugccg

SEQ ID NO: 3534921 - RNA, 16 nt, Human
gucaccucacucagca

SEQ ID NO: 3534922 - RNA, 23 nt, Human
gucaccucacucagcaccacuca

SEQ ID NO: 3534923 - RNA, 21 nt, Human
gucaccucagagacauacacc

SEQ ID NO: 3534924 - RNA, 22 nt, Human
gucaccucuuccgacucuuucu

SEQ ID NO: 3534925 - RNA, 20 nt, Human
gucaccugaagacucauucu

SEQ ID NO: 3534926 - RNA, 13 nt, Human
gucaccugcuucu

SEQ ID NO: 3534927 - RNA, 14 nt, Human
gucaccugcuucuc

SEQ ID NO: 3534928 - RNA, 17 nt, Human
gucaccuucccuugcca

SEQ ID NO: 3534929 - RNA, 19 nt, Human
gucaccuuuuaaauccugu

SEQ ID NO: 3534930 - RNA, 21 nt, Human
gucaccuuuuaaauccuguug

SEQ ID NO: 3534931 - RNA, 16 nt, Human
gucacgcagccaccag

SEQ ID NO: 3534932 - RNA, 20 nt, Human
gucacggcugcgcacugugu

SEQ ID NO: 3534933 - RNA, 19 nt, Human
gucacguuuggugcuucuc

SEQ ID NO: 3534934 - RNA, 19 nt, Human
gucacucauugcugagccu

SEQ ID NO: 3534935 - RNA, 23 nt, Human
gucacucauugcugagccucugc

SEQ ID NO: 3534936 - RNA, 11 nt, Human
gucacucccaa

SEQ ID NO: 3534937 - RNA, 14 nt, Human
gucacucccaagcc

SEQ ID NO: 3534938 - RNA, 19 nt, Human
gucacucuagucaaugaca

SEQ ID NO: 3534939 - RNA, 19 nt, Human
gucacucuuccugcaagga

SEQ ID NO: 3534940 - RNA, 20 nt, Human
gucacucuuccugcaaggac

SEQ ID NO: 3534941 - RNA, 18 nt, Human
gucacugaggccugagac

SEQ ID NO: 3534942 - RNA, 22 nt, Human
gucacugauguacaauuaaaaa

SEQ ID NO: 3534943 - RNA, 20 nt, Human
gucacugcacagugcaucuc

SEQ ID NO: 3534944 - RNA, 23 nt, Human
gucacugcacagugcaucucagc

SEQ ID NO: 3534945 - RNA, 14 nt, Human
gucacugcaggcac

SEQ ID NO: 3534946 - RNA, 20 nt, Human
gucacugccucucccuggcc

SEQ ID NO: 3534947 - RNA, 18 nt, Human
gucacugccugcagaggu

SEQ ID NO: 3534948 - RNA, 23 nt, Human
gucacugccugcagaggucugug

SEQ ID NO: 3534949 - RNA, 21 nt, Human
gucacugcuuaacuucacaua

SEQ ID NO: 3534950 - RNA, 17 nt, Human
gucacugcuuuuggccu

SEQ ID NO: 3534951 - RNA, 15 nt, Human
gucacuggaaagggg

SEQ ID NO: 3534952 - RNA, 23 nt, Human
gucacuggagguugaagccaagu

SEQ ID NO: 3534953 - RNA, 12 nt, Human
gucacuggcucu

SEQ ID NO: 3534954 - RNA, 16 nt, Human
gucacuggcucuccaa

SEQ ID NO: 3534955 - RNA, 14 nt, Human
gucacuggcugccu

SEQ ID NO: 3534956 - RNA, 16 nt, Human
gucacuggcugccucc

SEQ ID NO: 3534957 - RNA, 23 nt, Human
gucacuggcugccuccacuccca

SEQ ID NO: 3534958 - RNA, 17 nt, Human
gucacugucccucaaau

SEQ ID NO: 3534959 - RNA, 13 nt, Human
gucacuguuucuc

SEQ ID NO: 3534960 - RNA, 16 nt, Human
gucacuguuucucugc

SEQ ID NO: 3534961 - RNA, 18 nt, Human
gucacuuacuguuucugu

SEQ ID NO: 3534962 - RNA, 14 nt, Human
gucacuucuucugu

SEQ ID NO: 3534963 - RNA, 14 nt, Human
gucacuuuuuaugc

SEQ ID NO: 3534964 - RNA, 13 nt, Human
gucagaaagugua

SEQ ID NO: 3534965 - RNA, 19 nt, Human
gucagaacagcagacucag

SEQ ID NO: 3534966 - RNA, 23 nt, Human
gucagaaguuucugccgcagccc

SEQ ID NO: 3534967 - RNA, 20 nt, Human
gucagaauaauaagaggugc

SEQ ID NO: 3534968 - RNA, 15 nt, Human
gucagacacaaacaa

SEQ ID NO: 3534969 - RNA, 20 nt, Human
gucagacacaaacaaacaag

SEQ ID NO: 3534970 - RNA, 12 nt, Human
gucagacauaaa

SEQ ID NO: 3534971 - RNA, 14 nt, Human
gucagacauaaagc

SEQ ID NO: 3534972 - RNA, 15 nt, Human
gucagacauaaagcc

SEQ ID NO: 3534973 - RNA, 20 nt, Human
gucagacauaaagccauguu

SEQ ID NO: 3534974 - RNA, 15 nt, Human
guaucguauagcugu

SEQ ID NO: 3534975 - RNA, 16 nt, Human
guaucguauagcugua

SEQ ID NO: 3534976 - RNA, 20 nt, Human
guaucuagacccaucuucuu

SEQ ID NO: 3534977 - RNA, 18 nt, Human
guaucuaggcaacauagu

SEQ ID NO: 3534978 - RNA, 13 nt, Human
guaucuagugcag

SEQ ID NO: 3534979 - RNA, 11 nt, Human
guaucucagaa

SEQ ID NO: 3534980 - RNA, 21 nt, Human
guaucucagaaagugccugac

SEQ ID NO: 3534981 - RNA, 14 nt, Human
guaucuccaggauu

SEQ ID NO: 3534982 - RNA, 17 nt, Human
guaucucugaagcaugu

SEQ ID NO: 3534983 - RNA, 18 nt, Human
gucucacuauguugccca

SEQ ID NO: 3534984 - RNA, 20 nt, Human
gucucacuauguugcccagg

SEQ ID NO: 3534985 - RNA, 21 nt, Human
gucucacuauguugcccaggc

SEQ ID NO: 3534986 - RNA, 19 nt, Human
gucucacucugucgcccag

SEQ ID NO: 3534987 - RNA, 14 nt, Human
gucucacugcuuga

SEQ ID NO: 3534988 - RNA, 22 nt, Human
gucucacugugggaaggccagc

SEQ ID NO: 3534989 - RNA, 23 nt, Human
gucucacugugggaaggccagcu

SEQ ID NO: 3534990 - RNA, 16 nt, Human
gucucacuguugccca

SEQ ID NO: 3534991 - RNA, 20 nt, Human
gucucacuguugcccaggcu

SEQ ID NO: 3534992 - RNA, 23 nt, Human
gucucacuguugcccaggcuggc

SEQ ID NO: 3534993 - RNA, 24 nt, Human
gucucagacucuuuuuguaccugg

SEQ ID NO: 3534994 - RNA, 19 nt, Human
gucucagacuuuuguacau

SEQ ID NO: 3534995 - RNA, 21 nt, Human
gucucagcagcgaccaccccu

SEQ ID NO: 3534996 - RNA, 15 nt, Human
gucucaggaccuagg

SEQ ID NO: 3534997 - RNA, 16 nt, Human
gucucaggagcauggg

SEQ ID NO: 3534998 - RNA, 17 nt, Human
gucucaggagucucugg

SEQ ID NO: 3534999 - RNA, 14 nt, Human
gucucaggcugccu

SEQ ID NO: 3535000 - RNA, 13 nt, Human
gucucaggcuggu

SEQ ID NO: 3535001 - RNA, 16 nt, Human
gucucaggucccugca

SEQ ID NO: 3535002 - RNA, 18 nt, Human
gucucaguuugugugucu

SEQ ID NO: 3535003 - RNA, 18 nt, Human
gucucauagguuaaaaaa

SEQ ID NO: 3535004 - RNA, 19 nt, Human
gucucauagguugagcaau

SEQ ID NO: 3535005 - RNA, 15 nt, Human
gucucauccaucauc

SEQ ID NO: 3535006 - RNA, 15 nt, Human
gucucauccccaggg

SEQ ID NO: 3535007 - RNA, 13 nt, Human
gucucaucugggg

SEQ ID NO: 3535008 - RNA, 23 nt, Human
gucucaugccaguaacaggcuca

SEQ ID NO: 3535009 - RNA, 19 nt, Human
gucucaugcuccuuaaugg

SEQ ID NO: 3535010 - RNA, 19 nt, Human
gucucauuccguugucugu

SEQ ID NO: 3535011 - RNA, 22 nt, Human
gucuccaaaaaaaaaaaaaaua

SEQ ID NO: 3535012 - RNA, 17 nt, Human
gucuccaaccccccagc

SEQ ID NO: 3535013 - RNA, 21 nt, Human
gucuccaaccccccagcacug

SEQ ID NO: 3535014 - RNA, 22 nt, Human
gucuccaaccccccagcacuga

SEQ ID NO: 3535015 - RNA, 17 nt, Human
gucuccaccaggaaccu

SEQ ID NO: 3535016 - RNA, 19 nt, Human
gucuccaccaggaaccucu

SEQ ID NO: 3535017 - RNA, 13 nt, Human
gucuccagaaagc

SEQ ID NO: 3535018 - RNA, 20 nt, Human
gucuccagacccccaccccu

SEQ ID NO: 3535019 - RNA, 22 nt, Human
gucuccagccccuucucagaau

SEQ ID NO: 3535020 - RNA, 14 nt, Human
gucuccagcugcug

SEQ ID NO: 3535021 - RNA, 15 nt, Human
gucuccaggggcugc

SEQ ID NO: 3535022 - RNA, 19 nt, Human
gucuccagugguugcuguu

SEQ ID NO: 3535023 - RNA, 20 nt, Human
gucuccagugguugcuguug

SEQ ID NO: 3535024 - RNA, 13 nt, Human
gucuccauguuug

SEQ ID NO: 3535025 - RNA, 12 nt, Human
gucucccaaggc

SEQ ID NO: 3535026 - RNA, 19 nt, Human
gucucccagggccuuaaaa

SEQ ID NO: 3535027 - RNA, 18 nt, Human
gucuccccaugugccugc

SEQ ID NO: 3535028 - RNA, 20 nt, Human
gucucccccaacagcuggac

SEQ ID NO: 3535029 - RNA, 18 nt, Human
gucucccccacccuuguu

SEQ ID NO: 3535030 - RNA, 16 nt, Human
gucuccccucugcugg

SEQ ID NO: 3535031 - RNA, 17 nt, Human
gucuccccucugcuggc

SEQ ID NO: 3535032 - RNA, 18 nt, Human
gucuccccuguuccccuc

SEQ ID NO: 3535033 - RNA, 23 nt, Human
gucuccccuguuccccucucccu

SEQ ID NO: 3535034 - RNA, 19 nt, Human
gucucccgccccccacacu

SEQ ID NO: 3535035 - RNA, 12 nt, Human
gucucccuccuc

SEQ ID NO: 3535036 - RNA, 15 nt, Human
gucucccucuccugc

SEQ ID NO: 3535037 - RNA, 22 nt, Human
gucucccucuccugccuacuca

SEQ ID NO: 3535038 - RNA, 12 nt, Human
gucucccuggcc

SEQ ID NO: 3535039 - RNA, 15 nt, Human
gucucccuggcuccc

SEQ ID NO: 3535040 - RNA, 19 nt, Human
gucucccuucucccaugag

SEQ ID NO: 3535041 - RNA, 14 nt, Human
gucucccuucuguu

SEQ ID NO: 3535042 - RNA, 14 nt, Human
gucuccggccucuc

SEQ ID NO: 3535043 - RNA, 14 nt, Human
gucuccuacuccug

SEQ ID NO: 3535044 - RNA, 22 nt, Human
gucuccuauauauuucuauuau

SEQ ID NO: 3535045 - RNA, 23 nt, Human
gucuccucaauuuuugucucaga

SEQ ID NO: 3535046 - RNA, 17 nt, Human
gucuccucagccuccuc

SEQ ID NO: 3535047 - RNA, 14 nt, Human
gucuccucaggacc

SEQ ID NO: 3535048 - RNA, 20 nt, Human
gucuccucuauccugggcuu

SEQ ID NO: 3535049 - RNA, 23 nt, Human
gucuccucuuaaaaaauaaaaac

SEQ ID NO: 3535050 - RNA, 14 nt, Human
gucuccugcaugca

SEQ ID NO: 3535051 - RNA, 15 nt, Human
gucuccugcccccac

SEQ ID NO: 3535052 - RNA, 20 nt, Human
gucuccuuucaccccagggc

SEQ ID NO: 3535053 - RNA, 21 nt, Human
gucuccuuucucagccacaaa

SEQ ID NO: 3535054 - RNA, 22 nt, Human
gucuccuuugcacugagggcca

SEQ ID NO: 3535055 - RNA, 23 nt, Human
gucuccuuugcacugagggccac

SEQ ID NO: 3535056 - RNA, 18 nt, Human
gucuccuuugcaggcuca

SEQ ID NO: 3535057 - RNA, 15 nt, Human
gucucgagcgcccug

SEQ ID NO: 3535058 - RNA, 17 nt, Human
gucucgagcgcccugca

SEQ ID NO: 3535059 - RNA, 18 nt, Human
gucucgagcgcccugcag

SEQ ID NO: 3535060 - RNA, 20 nt, Human
gucucgagcgcccugcagac

SEQ ID NO: 3535061 - RNA, 23 nt, Human
gucucgagcgcccugcagacccu

SEQ ID NO: 3535062 - RNA, 17 nt, Human
gucucgcugaugcuggg

SEQ ID NO: 3535063 - RNA, 23 nt, Human
gucucggaaccugugagcugcac

SEQ ID NO: 3535064 - RNA, 23 nt, Human
gucucggguggcuagucagagag

SEQ ID NO: 3535065 - RNA, 16 nt, Human
gucucggugguaccag

SEQ ID NO: 3535066 - RNA, 13 nt, Human
gucucgugguagg

SEQ ID NO: 3535067 - RNA, 13 nt, Human
gucucuaggcugg

SEQ ID NO: 3535068 - RNA, 16 nt, Human
gucucuagugcuguga

SEQ ID NO: 3535069 - RNA, 18 nt, Human
gucucuauaccaauaaag

SEQ ID NO: 3535070 - RNA, 17 nt, Human
gucucuaucauuaaagu

SEQ ID NO: 3535071 - RNA, 17 nt, Human
gucucuaugccagcuca

SEQ ID NO: 3535072 - RNA, 13 nt, Human
gucucuauuuaaa

SEQ ID NO: 3535073 - RNA, 14 nt, Human
gucucucacagaca

SEQ ID NO: 3535074 - RNA, 19 nt, Human
gucucucacagacaggacc

SEQ ID NO: 3535075 - RNA, 12 nt, Human
gucucucagaau

SEQ ID NO: 3535076 - RNA, 17 nt, Human
gucucucagggccaggc

SEQ ID NO: 3535077 - RNA, 15 nt, Human
gucucucccucaggu

SEQ ID NO: 3535078 - RNA, 21 nt, Human
gucucuccuguaagccaaaga

SEQ ID NO: 3535079 - RNA, 19 nt, Human
gucucuccuuuucuuuugu

SEQ ID NO: 3535080 - RNA, 12 nt, Human
gucucucuccca

SEQ ID NO: 3535081 - RNA, 17 nt, Human
gucucucucccauggag

SEQ ID NO: 3535082 - RNA, 23 nt, Human
gucucucucccauggagccccag

SEQ ID NO: 3535083 - RNA, 21 nt, Human
gucucucuggggccacacaga

SEQ ID NO: 3535084 - RNA, 16 nt, Human
gucucucuuaaaguug

SEQ ID NO: 3535085 - RNA, 22 nt, Human
gucucucuucagacucucagcc

SEQ ID NO: 3535086 - RNA, 15 nt, Human
gucucucuucucucc

SEQ ID NO: 3535087 - RNA, 19 nt, Human
gucucucuucucuccagcu

SEQ ID NO: 3535088 - RNA, 20 nt, Human
gucucucuucucuccagcug

SEQ ID NO: 3535089 - RNA, 21 nt, Human
gucucucuuuggacucucccc

SEQ ID NO: 3535090 - RNA, 15 nt, Human
gucucugaagcguga

SEQ ID NO: 3535091 - RNA, 17 nt, Human
gucucugaaguacuaac

SEQ ID NO: 3535092 - RNA, 15 nt, Human
gucucugaagugaaa

SEQ ID NO: 3535093 - RNA, 13 nt, Human
gucucugagcauu

SEQ ID NO: 3535094 - RNA, 21 nt, Human
gucucugagggcuuccuuugg

SEQ ID NO: 3535095 - RNA, 11 nt, Human
gucucugccau

SEQ ID NO: 3535096 - RNA, 18 nt, Human
gucucugccggcucuuuc

SEQ ID NO: 3535097 - RNA, 12 nt, Human
gucucugccucc

SEQ ID NO: 3535098 - RNA, 13 nt, Human
gucucugcugccg

SEQ ID NO: 3535099 - RNA, 16 nt, Human
gucucugcuggcccag

SEQ ID NO: 3535100 - RNA, 17 nt, Human
gucucugcuggcccagc

SEQ ID NO: 3535101 - RNA, 15 nt, Human
gucucugugagacuc

SEQ ID NO: 3535102 - RNA, 21 nt, Human
gucucuuccaguuugcuuugc

SEQ ID NO: 3535103 - RNA, 15 nt, Human
gucucuucuccacug

SEQ ID NO: 3535104 - RNA, 22 nt, Human
gucucuucucccagaaucccag

SEQ ID NO: 3535105 - RNA, 19 nt, Human
gucucuucugaauaaagca

SEQ ID NO: 3535106 - RNA, 22 nt, Human
gucucuucuuggggcccagugc

SEQ ID NO: 3535107 - RNA, 23 nt, Human
gucucuucuuggggcccagugca

SEQ ID NO: 3535108 - RNA, 23 nt, Human
gucucuugagggagcuuagccaa

SEQ ID NO: 3535109 - RNA, 17 nt, Human
gucucuuuaaucuucag

SEQ ID NO: 3535110 - RNA, 20 nt, Human
gucucuuuaaugucacaggc

SEQ ID NO: 3535111 - RNA, 22 nt, Human
gucucuuucaugaguuuuuccc

SEQ ID NO: 3535112 - RNA, 21 nt, Human
gucucuuuuacccuggccccu

SEQ ID NO: 3535113 - RNA, 23 nt, Human
gucucuuuucuuuagagcauugc

SEQ ID NO: 3535114 - RNA, 11 nt, Human
gucucuuuugu

SEQ ID NO: 3535115 - RNA, 12 nt, Human
gucucuuuugua

SEQ ID NO: 3535116 - RNA, 19 nt, Human
gucucuuuuguaaauuaaa

SEQ ID NO: 3535117 - RNA, 18 nt, Human
gucucuuuuuuacaaagg

SEQ ID NO: 3535118 - RNA, 22 nt, Human
guauucgugcagcauaugagga

SEQ ID NO: 3535119 - RNA, 16 nt, Human
guauucguuaucuaau

SEQ ID NO: 3535120 - RNA, 19 nt, Human
guauucuagcuaauguaau

SEQ ID NO: 3535121 - RNA, 14 nt, Human
guauucucauucuu

SEQ ID NO: 3535122 - RNA, 14 nt, Human
guauucucuuuuca

SEQ ID NO: 3535123 - RNA, 11 nt, Human
guauucuguac

SEQ ID NO: 3535124 - RNA, 22 nt, Human
guauucuucucuuccuuuuauc

SEQ ID NO: 3535125 - RNA, 16 nt, Human
guauucuuugauguua

SEQ ID NO: 3535126 - RNA, 21 nt, Human
guauucuuugauguuaacaca

SEQ ID NO: 3535127 - RNA, 13 nt, Human
guauugaagcauu

SEQ ID NO: 3535128 - RNA, 14 nt, Human
guauugaauauugu

SEQ ID NO: 3535129 - RNA, 17 nt, Human
guauugaaucauguagu

SEQ ID NO: 3535130 - RNA, 16 nt, Human
guauugcacauuguaa

SEQ ID NO: 3535131 - RNA, 15 nt, Human
guauugcaucuguau

SEQ ID NO: 3535132 - RNA, 21 nt, Human
guauugccaaacauuaauguu

SEQ ID NO: 3535133 - RNA, 24 nt, Human
guauugccaaacauuaauguugau

SEQ ID NO: 3535134 - RNA, 12 nt, Human
guauuguaaauu

SEQ ID NO: 3535135 - RNA, 19 nt, Human
guauuguacaaaguauuaa

SEQ ID NO: 3535136 - RNA, 16 nt, Human
guauuguauuuauuca

SEQ ID NO: 3535137 - RNA, 13 nt, Human
guauuguccuauu

SEQ ID NO: 3535138 - RNA, 12 nt, Human
guauugugguau

SEQ ID NO: 3535139 - RNA, 17 nt, Human
guauuguuagauguuug

SEQ ID NO: 3535140 - RNA, 21 nt, Human
guauuguuguccuuuucauag

SEQ ID NO: 3535141 - RNA, 23 nt, Human
guauuguuugggauccuauugaa

SEQ ID NO: 3535142 - RNA, 20 nt, Human
guauuguuuugguuugcuac

SEQ ID NO: 3535143 - RNA, 16 nt, Human
guauuuaaaaauagaa

SEQ ID NO: 3535144 - RNA, 19 nt, Human
guauuuaaaaauagaaaca

SEQ ID NO: 3535145 - RNA, 22 nt, Human
guauuuaaacuaucuuguguga

SEQ ID NO: 3535146 - RNA, 17 nt, Human
guauuuaagcaaauacu

SEQ ID NO: 3535147 - RNA, 12 nt, Human
guauuuaauuag

SEQ ID NO: 3535148 - RNA, 20 nt, Human
guauuuaauuagugcuaagu

SEQ ID NO: 3535149 - RNA, 21 nt, Human
guauuuaauuagugcuaagug

SEQ ID NO: 3535150 - RNA, 16 nt, Human
guauuuaauucauguu

SEQ ID NO: 3535151 - RNA, 16 nt, Human
guauuuaauuguaaac

SEQ ID NO: 3535152 - RNA, 17 nt, Human
guauuuaauuguaaacu

SEQ ID NO: 3535153 - RNA, 13 nt, Human
guauuuaauuuug

SEQ ID NO: 3535154 - RNA, 15 nt, Human
guauuuaccaaaaau

SEQ ID NO: 3535155 - RNA, 16 nt, Human
guauuuacgcuuugau

SEQ ID NO: 3535156 - RNA, 17 nt, Human
guauuuacgcuuugauu

SEQ ID NO: 3535157 - RNA, 14 nt, Human
guauuuagaagcca

SEQ ID NO: 3535158 - RNA, 15 nt, Human
guauuuauauauuua

SEQ ID NO: 3535159 - RNA, 18 nt, Human
guauuuaucuauuguaag

SEQ ID NO: 3535160 - RNA, 13 nt, Human
guauuuaucuuua

SEQ ID NO: 3535161 - RNA, 19 nt, Human
guauuuauguaaugaagua

SEQ ID NO: 3535162 - RNA, 22 nt, Human
guauuuauuccauauucaugua

SEQ ID NO: 3535163 - RNA, 12 nt, Human
guauuuauucuu

SEQ ID NO: 3535164 - RNA, 23 nt, Human
guauuuauuuuccuccccagcag

SEQ ID NO: 3535165 - RNA, 12 nt, Human
guauuuauuuug

SEQ ID NO: 3535166 - RNA, 12 nt, Human
guauuucccagc

SEQ ID NO: 3535167 - RNA, 17 nt, Human
guauuucuaugaaauau

SEQ ID NO: 3535168 - RNA, 22 nt, Human
guauuucuaugaaauauuaugu

SEQ ID NO: 3535169 - RNA, 15 nt, Human
guauuugaaaacaga

SEQ ID NO: 3535170 - RNA, 16 nt, Human
guauuugaaaacagaa

SEQ ID NO: 3535171 - RNA, 15 nt, Human
guauuugaaucagcc

SEQ ID NO: 3535172 - RNA, 12 nt, Human
guauuugcuaau

SEQ ID NO: 3535173 - RNA, 12 nt, Human
guauuugcuuuu

SEQ ID NO: 3535174 - RNA, 19 nt, Human
guauuuggaaauaaaguca

SEQ ID NO: 3535175 - RNA, 15 nt, Human
guauuugggaaacuu

SEQ ID NO: 3535176 - RNA, 20 nt, Human
guauuugggaagugaagacu

SEQ ID NO: 3535177 - RNA, 14 nt, Human
guauuuguuaaugg

SEQ ID NO: 3535178 - RNA, 15 nt, Human
guauuuguucauguu

SEQ ID NO: 3535179 - RNA, 18 nt, Human
guauuuguucauguuugg

SEQ ID NO: 3535180 - RNA, 22 nt, Human
guauuuguucauguuuggugca

SEQ ID NO: 3535181 - RNA, 23 nt, Human
guauuuguuugcauaggugaucu

SEQ ID NO: 3535182 - RNA, 15 nt, Human
guauuuuaaaagcca

SEQ ID NO: 3535183 - RNA, 19 nt, Human
guauuuuagugaacuugaa

SEQ ID NO: 3535184 - RNA, 18 nt, Human
guauuuuauaaaauuaaa

SEQ ID NO: 3535185 - RNA, 13 nt, Human
guauuuuauguua

SEQ ID NO: 3535186 - RNA, 17 nt, Human
guauuuuauguuauaua

SEQ ID NO: 3535187 - RNA, 10 nt, Human
guauuuuauu

SEQ ID NO: 3535188 - RNA, 14 nt, Human
guauuuucauacaa

SEQ ID NO: 3535189 - RNA, 15 nt, Human
guauuuucaugaaaa

SEQ ID NO: 3535190 - RNA, 17 nt, Human
guauuuuccaagugugc

SEQ ID NO: 3535191 - RNA, 11 nt, Human
guauuuuccug

SEQ ID NO: 3535192 - RNA, 22 nt, Human
guauuuucuccaaauguucacu

SEQ ID NO: 3535193 - RNA, 15 nt, Human
guauuuucuucucug

SEQ ID NO: 3535194 - RNA, 13 nt, Human
guauuuucuuucu

SEQ ID NO: 3535195 - RNA, 13 nt, Human
guauuuugaaauu

SEQ ID NO: 3535196 - RNA, 13 nt, Human
guauuuugaaguu

SEQ ID NO: 3535197 - RNA, 19 nt, Human
guauuuugaaguuuacauu

SEQ ID NO: 3535198 - RNA, 20 nt, Human
guauuuugaaguuuacauuu

SEQ ID NO: 3535199 - RNA, 18 nt, Human
guauuuuguauuguuuca

SEQ ID NO: 3535200 - RNA, 21 nt, Human
guauuuugugaguuuguuucu

SEQ ID NO: 3535201 - RNA, 15 nt, Human
guauuuuguguccuc

SEQ ID NO: 3535202 - RNA, 21 nt, Human
guauuuuuagaauaagaauuu

SEQ ID NO: 3535203 - RNA, 14 nt, Human
guauuuuuauauaa

SEQ ID NO: 3535204 - RNA, 17 nt, Human
guauuuuucagagauuu

SEQ ID NO: 3535205 - RNA, 17 nt, Human
guauuuuucuguuagcu

SEQ ID NO: 3535206 - RNA, 15 nt, Human
guauuuuuucuugca

SEQ ID NO: 3535207 - RNA, 20 nt, Human
guauuuuuucuugcauugac

SEQ ID NO: 3535208 - RNA, 15 nt, Human
guauuuuuuuacuaa

SEQ ID NO: 3535209 - RNA, 21 nt, Human
guauuuuuuuacuaauagaca

SEQ ID NO: 3535210 - RNA, 14 nt, Human
guauuuuuuugcaa

SEQ ID NO: 3535211 - RNA, 16 nt, Human
guauuuuuuugcaagu

SEQ ID NO: 3535212 - RNA, 22 nt, Human
guauuuuuuuuucuaagagaag

SEQ ID NO: 3535213 - RNA, 14 nt, Human
gucaaaaauuaaac

SEQ ID NO: 3535214 - RNA, 12 nt, Human
gucaaaacacug

SEQ ID NO: 3535215 - RNA, 21 nt, Human
gucaaaacacuguggaacuaa

SEQ ID NO: 3535216 - RNA, 14 nt, Human
gucaaaacacuugu

SEQ ID NO: 3535217 - RNA, 13 nt, Human
gucaaaacagauu

SEQ ID NO: 3535218 - RNA, 14 nt, Human
gucaaaaggugccu

SEQ ID NO: 3535219 - RNA, 16 nt, Human
gucaaaaggugccugu

SEQ ID NO: 3535220 - RNA, 16 nt, Human
gucaaaaguagaacuu

SEQ ID NO: 3535221 - RNA, 19 nt, Human
gucaaaaguuggacuaaau

SEQ ID NO: 3535222 - RNA, 17 nt, Human
gucaaaauuguuuaaaa

SEQ ID NO: 3535223 - RNA, 15 nt, Human
gucaaacaaagccag

SEQ ID NO: 3535224 - RNA, 17 nt, Human
gucaaacgugaaaaugc

SEQ ID NO: 3535225 - RNA, 16 nt, Human
gucaaacuguagaaau

SEQ ID NO: 3535226 - RNA, 17 nt, Human
gucaaacuuggauacuu

SEQ ID NO: 3535227 - RNA, 15 nt, Human
gucaaaguugaaaau

SEQ ID NO: 3535228 - RNA, 12 nt, Human
gucaaauaaaca

SEQ ID NO: 3535229 - RNA, 17 nt, Human
gucaaaugaugugcaaa

SEQ ID NO: 3535230 - RNA, 16 nt, Human
gucaaauugugugaaa

SEQ ID NO: 3535231 - RNA, 12 nt, Human
gucaacaaaucu

SEQ ID NO: 3535232 - RNA, 14 nt, Human
gucaacagaaugaa

SEQ ID NO: 3535233 - RNA, 17 nt, Human
gucaacagaaugaaaaa

SEQ ID NO: 3535234 - RNA, 13 nt, Human
gucaacaguaaac

SEQ ID NO: 3535235 - RNA, 14 nt, Human
gucaacaguaaacc

SEQ ID NO: 3535236 - RNA, 14 nt, Human
gucaacaguuuucc

SEQ ID NO: 3535237 - RNA, 12 nt, Human
gucaacauugug

SEQ ID NO: 3535238 - RNA, 13 nt, Human
gucaacauuucuc

SEQ ID NO: 3535239 - RNA, 14 nt, Human
gucaaccagacaga

SEQ ID NO: 3535240 - RNA, 17 nt, Human
gucaacccucaggggaa

SEQ ID NO: 3535241 - RNA, 14 nt, Human
gucaaccuccugga

SEQ ID NO: 3535242 - RNA, 19 nt, Human
gucaacucauauuuucaug

SEQ ID NO: 3535243 - RNA, 17 nt, Human
gucaacuucaacauuua

SEQ ID NO: 3535244 - RNA, 13 nt, Human
gucaacuuuaugc

SEQ ID NO: 3535245 - RNA, 18 nt, Human
gucaagaaacagccagca

SEQ ID NO: 3535246 - RNA, 19 nt, Human
gucaagagggucugaggaa

SEQ ID NO: 3535247 - RNA, 17 nt, Human
gucaagaguaguuauau

SEQ ID NO: 3535248 - RNA, 15 nt, Human
gucaagauucagcua

SEQ ID NO: 3535249 - RNA, 11 nt, Human
gucaagcacuc

SEQ ID NO: 3535250 - RNA, 18 nt, Human
gucaagccauuuuuacau

SEQ ID NO: 3535251 - RNA, 13 nt, Human
gucaagcuccucc

SEQ ID NO: 3535252 - RNA, 15 nt, Human
gucaagcuccuccuc

SEQ ID NO: 3535253 - RNA, 22 nt, Human
gucaagcugaguauuaaaaugu

SEQ ID NO: 3535254 - RNA, 12 nt, Human
gucaagcugcuc

SEQ ID NO: 3535255 - RNA, 22 nt, Human
gucaagcugcucugagccacag

SEQ ID NO: 3535256 - RNA, 15 nt, Human
gucaaggaguggcuu

SEQ ID NO: 3535257 - RNA, 13 nt, Human
gucaaggccagca

SEQ ID NO: 3535258 - RNA, 15 nt, Human
gucaaggccugcucc

SEQ ID NO: 3535259 - RNA, 12 nt, Human
gucaaggccugu

SEQ ID NO: 3535260 - RNA, 14 nt, Human
gucaaggcuuagac

SEQ ID NO: 3535261 - RNA, 16 nt, Human
gucaaggcuuagaccc

SEQ ID NO: 3535262 - RNA, 18 nt, Human
gucaaggcuuagacccuc

SEQ ID NO: 3535263 - RNA, 14 nt, Human
gucaaguaagaaga

SEQ ID NO: 3535264 - RNA, 13 nt, Human
gucaagucaacca

SEQ ID NO: 3535265 - RNA, 17 nt, Human
gucaagucucugcuggc

SEQ ID NO: 3535266 - RNA, 22 nt, Human
guccuaaccucgggccugcugc

SEQ ID NO: 3535267 - RNA, 14 nt, Human
guccuaagaaagag

SEQ ID NO: 3535268 - RNA, 20 nt, Human
guccuaagugcuaagugcuu

SEQ ID NO: 3535269 - RNA, 13 nt, Human
guccuaaugguga

SEQ ID NO: 3535270 - RNA, 19 nt, Human
guccuaauucuucuguccu

SEQ ID NO: 3535271 - RNA, 15 nt, Human
guccuacagaaaaac

SEQ ID NO: 3535272 - RNA, 16 nt, Human
guccuacccacccucc

SEQ ID NO: 3535273 - RNA, 15 nt, Human
guccuacucuguguc

SEQ ID NO: 3535274 - RNA, 19 nt, Human
guccuagaggcccuuugcu

SEQ ID NO: 3535275 - RNA, 22 nt, Human
guccuagaggcccuuugcuguc

SEQ ID NO: 3535276 - RNA, 20 nt, Human
guccuagcugcacagggcag

SEQ ID NO: 3535277 - RNA, 19 nt, Human
guccuaggaguauccucau

SEQ ID NO: 3535278 - RNA, 17 nt, Human
guccuaggcuggaagga

SEQ ID NO: 3535279 - RNA, 15 nt, Human
guccuaucugggcuu

SEQ ID NO: 3535280 - RNA, 20 nt, Human
guccuaucugggcuuccugg

SEQ ID NO: 3535281 - RNA, 21 nt, Human
guccuaucugggcuuccugga

SEQ ID NO: 3535282 - RNA, 22 nt, Human
guccuaucugggcuuccuggag

SEQ ID NO: 3535283 - RNA, 20 nt, Human
guccuaugcaauaaaauuau

SEQ ID NO: 3535284 - RNA, 15 nt, Human
guccuauggccucau

SEQ ID NO: 3535285 - RNA, 22 nt, Human
guccuauuaguguuauaugaac

SEQ ID NO: 3535286 - RNA, 19 nt, Human
guccucaaggggccauccu

SEQ ID NO: 3535287 - RNA, 13 nt, Human
guccucaccacau

SEQ ID NO: 3535288 - RNA, 15 nt, Human
guccucaccccuguc

SEQ ID NO: 3535289 - RNA, 22 nt, Human
guccucaccccuguccucacug

SEQ ID NO: 3535290 - RNA, 18 nt, Human
guccucacugcucccuga

SEQ ID NO: 3535291 - RNA, 20 nt, Human
guccucacugcucccugaag

SEQ ID NO: 3535292 - RNA, 17 nt, Human
guccucagguggccaug

SEQ ID NO: 3535293 - RNA, 23 nt, Human
guccucagguggccaugccucag

SEQ ID NO: 3535294 - RNA, 15 nt, Human
guccucaguccauuu

SEQ ID NO: 3535295 - RNA, 16 nt, Human
guccucaguccauuua

SEQ ID NO: 3535296 - RNA, 15 nt, Human
guccucauuucucca

SEQ ID NO: 3535297 - RNA, 21 nt, Human
guccuccaacaccaagcacag

SEQ ID NO: 3535298 - RNA, 14 nt, Human
guccuccacaauaa

SEQ ID NO: 3535299 - RNA, 20 nt, Human
guccuccagaacucuuccuc

SEQ ID NO: 3535300 - RNA, 14 nt, Human
guccuccagaagcc

SEQ ID NO: 3535301 - RNA, 18 nt, Human
guccuccagaagccucug

SEQ ID NO: 3535302 - RNA, 21 nt, Human
guccuccagaagccucuggcu

SEQ ID NO: 3535303 - RNA, 22 nt, Human
guccuccagaagccucuggcua

SEQ ID NO: 3535304 - RNA, 15 nt, Human
guccuccaggagcuu

SEQ ID NO: 3535305 - RNA, 21 nt, Human
guccucccaauuucagacucc

SEQ ID NO: 3535306 - RNA, 17 nt, Human
guccucccauccccugg

SEQ ID NO: 3535307 - RNA, 17 nt, Human
guccucccccugccagu

SEQ ID NO: 3535308 - RNA, 22 nt, Human
guccucccccugccagugccuu

SEQ ID NO: 3535309 - RNA, 11 nt, Human
guccuccccuc

SEQ ID NO: 3535310 - RNA, 12 nt, Human
guccuccccuca

SEQ ID NO: 3535311 - RNA, 16 nt, Human
guccuccccucacagc

SEQ ID NO: 3535312 - RNA, 17 nt, Human
guccuccccucacagcc

SEQ ID NO: 3535313 - RNA, 18 nt, Human
guccuccccucacagccu

SEQ ID NO: 3535314 - RNA, 14 nt, Human
guccuccccucucu

SEQ ID NO: 3535315 - RNA, 13 nt, Human
guccuccccuugg

SEQ ID NO: 3535316 - RNA, 14 nt, Human
guccuccccuuggg

SEQ ID NO: 3535317 - RNA, 15 nt, Human
guccuccccuugggc

SEQ ID NO: 3535318 - RNA, 18 nt, Human
guccuccccuugggcggc

SEQ ID NO: 3535319 - RNA, 21 nt, Human
guccucccgggcccucccuug

SEQ ID NO: 3535320 - RNA, 22 nt, Human
guccucccgggcccucccuugg

SEQ ID NO: 3535321 - RNA, 12 nt, Human
guccucccugac

SEQ ID NO: 3535322 - RNA, 15 nt, Human
guccuccucaccuca

SEQ ID NO: 3535323 - RNA, 14 nt, Human
guccuccuccaggg

SEQ ID NO: 3535324 - RNA, 18 nt, Human
guccuccuccagggacag

SEQ ID NO: 3535325 - RNA, 21 nt, Human
guccuccucggaucaccgaga

SEQ ID NO: 3535326 - RNA, 13 nt, Human
guccuccucugug

SEQ ID NO: 3535327 - RNA, 15 nt, Human
guccuccugcugcca

SEQ ID NO: 3535328 - RNA, 16 nt, Human
guccuccugcugccag

SEQ ID NO: 3535329 - RNA, 22 nt, Human
guccucgaugggagggauggcc

SEQ ID NO: 3535330 - RNA, 14 nt, Human
guccucguuugugu

SEQ ID NO: 3535331 - RNA, 12 nt, Human
guccucuccacc

SEQ ID NO: 3535332 - RNA, 18 nt, Human
guccucuccccuccagcc

SEQ ID NO: 3535333 - RNA, 21 nt, Human
guccucuccccuccagccuuu

SEQ ID NO: 3535334 - RNA, 19 nt, Human
guccucugagacuccagac

SEQ ID NO: 3535335 - RNA, 13 nt, Human
guccucuggagcc

SEQ ID NO: 3535336 - RNA, 11 nt, Human
guccucuggau

SEQ ID NO: 3535337 - RNA, 14 nt, Human
guccucuugccucc

SEQ ID NO: 3535338 - RNA, 18 nt, Human
guccucuuucagcuccug

SEQ ID NO: 3535339 - RNA, 20 nt, Human
guccucuuucagcuccugac

SEQ ID NO: 3535340 - RNA, 14 nt, Human
guccucuuuucuga

SEQ ID NO: 3535341 - RNA, 16 nt, Human
guccugaagaggcggg

SEQ ID NO: 3535342 - RNA, 21 nt, Human
guccugaagaggcgggccagc

SEQ ID NO: 3535343 - RNA, 19 nt, Human
guccugaaggccugagguu

SEQ ID NO: 3535344 - RNA, 13 nt, Human
guccugaccaccc

SEQ ID NO: 3535345 - RNA, 13 nt, Human
guccugacucaac

SEQ ID NO: 3535346 - RNA, 23 nt, Human
guccugacuucaggggcugcccg

SEQ ID NO: 3535347 - RNA, 21 nt, Human
guccugagcacugccaggagg

SEQ ID NO: 3535348 - RNA, 14 nt, Human
guccugagcucagc

SEQ ID NO: 3535349 - RNA, 21 nt, Human
guccugaggguccccaccugg

SEQ ID NO: 3535350 - RNA, 19 nt, Human
guccugcaccggggccugg

SEQ ID NO: 3535351 - RNA, 21 nt, Human
guccugcagcaaacacuccac

SEQ ID NO: 3535352 - RNA, 14 nt, Human
guccugcagccugc

SEQ ID NO: 3535353 - RNA, 17 nt, Human
guccugccacccagccc

SEQ ID NO: 3535354 - RNA, 16 nt, Human
guccugccaccugggg

SEQ ID NO: 3535355 - RNA, 17 nt, Human
guccugccugcaauauu

SEQ ID NO: 3535356 - RNA, 15 nt, Human
guccugccuggccag

SEQ ID NO: 3535357 - RNA, 21 nt, Human
gagcaguuucuguccugcugg

SEQ ID NO: 3535358 - RNA, 22 nt, Human
gagcaguuucuguccugcuggu

SEQ ID NO: 3535359 - RNA, 21 nt, Human
gagcauaauaaauggaugagg

SEQ ID NO: 3535360 - RNA, 12 nt, Human
gagcauaauuua

SEQ ID NO: 3535361 - RNA, 17 nt, Human
gagcauaauuuaaaaau

SEQ ID NO: 3535362 - RNA, 22 nt, Human
gagcauaguccaaaaagcuccu

SEQ ID NO: 3535363 - RNA, 13 nt, Human
gagcaucaggcca

SEQ ID NO: 3535364 - RNA, 14 nt, Human
gagcaucaggccag

SEQ ID NO: 3535365 - RNA, 20 nt, Human
gagcaucaggccaggcccuc

SEQ ID NO: 3535366 - RNA, 21 nt, Human
gagcaucaugccucugaggcc

SEQ ID NO: 3535367 - RNA, 19 nt, Human
gagcaucccggaggaaauc

SEQ ID NO: 3535368 - RNA, 18 nt, Human
gagcaucucuugaggcca

SEQ ID NO: 3535369 - RNA, 20 nt, Human
gagcaucucuugaggccagg

SEQ ID NO: 3535370 - RNA, 23 nt, Human
gagcaucucuugaggccaggagu

SEQ ID NO: 3535371 - RNA, 17 nt, Human
gagcaugaaauuuuuaa

SEQ ID NO: 3535372 - RNA, 14 nt, Human
gagcaugagaggag

SEQ ID NO: 3535373 - RNA, 17 nt, Human
gagcaugagaggaggca

SEQ ID NO: 3535374 - RNA, 13 nt, Human
gagcaugccugga

SEQ ID NO: 3535375 - RNA, 21 nt, Human
gagcaugccuggauggggcug

SEQ ID NO: 3535376 - RNA, 22 nt, Human
gagcaugccuggauggggcugc

SEQ ID NO: 3535377 - RNA, 19 nt, Human
gagcauggaacacuucgag

SEQ ID NO: 3535378 - RNA, 19 nt, Human
gagcauggcugugaggaug

SEQ ID NO: 3535379 - RNA, 21 nt, Human
gagcauggcugugaggauggg

SEQ ID NO: 3535380 - RNA, 22 nt, Human
gagcauguuuagacuuuaacau

SEQ ID NO: 3535381 - RNA, 17 nt, Human
gagcauguuuuguauac

SEQ ID NO: 3535382 - RNA, 18 nt, Human
gagcauguuuuguauaca

SEQ ID NO: 3535383 - RNA, 17 nt, Human
gagcauuacgugagcca

SEQ ID NO: 3535384 - RNA, 20 nt, Human
gagcauuacgugagccaggu

SEQ ID NO: 3535385 - RNA, 21 nt, Human
gagcauuauaaucaccagggc

SEQ ID NO: 3535386 - RNA, 24 nt, Human
gagcauuccagucaggcucucugg

SEQ ID NO: 3535387 - RNA, 19 nt, Human
gagcauuguggcugucagc

SEQ ID NO: 3535388 - RNA, 23 nt, Human
gagcauuuccaacaccacagaca

SEQ ID NO: 3535389 - RNA, 14 nt, Human
gagccaacugcugc

SEQ ID NO: 3535390 - RNA, 16 nt, Human
gagccaagggauggac

SEQ ID NO: 3535391 - RNA, 17 nt, Human
gagccaagggauggaca

SEQ ID NO: 3535392 - RNA, 23 nt, Human
gagccaaggguucagagacucag

SEQ ID NO: 3535393 - RNA, 14 nt, Human
gagccaauggagac

SEQ ID NO: 3535394 - RNA, 20 nt, Human
gagccaauguuuuccaccca

SEQ ID NO: 3535395 - RNA, 13 nt, Human
gagccacaaaaga

SEQ ID NO: 3535396 - RNA, 19 nt, Human
gagccaccaugcccagcuc

SEQ ID NO: 3535397 - RNA, 14 nt, Human
gagccaccgugccu

SEQ ID NO: 3535398 - RNA, 20 nt, Human
gagccaccgugccuggccac

SEQ ID NO: 3535399 - RNA, 13 nt, Human
gagccaccugccc

SEQ ID NO: 3535400 - RNA, 14 nt, Human
gagccacuaacuag

SEQ ID NO: 3535401 - RNA, 15 nt, Human
gagccacuccggccc

SEQ ID NO: 3535402 - RNA, 13 nt, Human
gagccacugcacc

SEQ ID NO: 3535403 - RNA, 16 nt, Human
gagccagaaccuggag

SEQ ID NO: 3535404 - RNA, 21 nt, Human
gagccagaaccuggagggcua

SEQ ID NO: 3535405 - RNA, 15 nt, Human
gagccagagaaguga

SEQ ID NO: 3535406 - RNA, 19 nt, Human
gagccagagaagugacagg

SEQ ID NO: 3535407 - RNA, 15 nt, Human
gagccagauuucacu

SEQ ID NO: 3535408 - RNA, 18 nt, Human
gagccagauuucacucuc

SEQ ID NO: 3535409 - RNA, 23 nt, Human
gagccagauuucacucuccuugg

SEQ ID NO: 3535410 - RNA, 22 nt, Human
guccugucagugccgccgccuc

SEQ ID NO: 3535411 - RNA, 19 nt, Human
guccugucaucaucauggc

SEQ ID NO: 3535412 - RNA, 20 nt, Human
guccugucaucaucauggcc

SEQ ID NO: 3535413 - RNA, 21 nt, Human
guccugucaucaucauggcca

SEQ ID NO: 3535414 - RNA, 16 nt, Human
guccugucuccccucu

SEQ ID NO: 3535415 - RNA, 17 nt, Human
guccugucuccccucug

SEQ ID NO: 3535416 - RNA, 19 nt, Human
guccugugaaugccacugc

SEQ ID NO: 3535417 - RNA, 15 nt, Human
guccugugaucuuau

SEQ ID NO: 3535418 - RNA, 20 nt, Human
guccugugaucuuauuuuuc

SEQ ID NO: 3535419 - RNA, 22 nt, Human
guccugugaucuuauuuuucua

SEQ ID NO: 3535420 - RNA, 16 nt, Human
guccuguggcaggcag

SEQ ID NO: 3535421 - RNA, 17 nt, Human
guccugugucaguuuau

SEQ ID NO: 3535422 - RNA, 18 nt, Human
guccuuaccagcagagca

SEQ ID NO: 3535423 - RNA, 19 nt, Human
guccuuaccagcagagcac

SEQ ID NO: 3535424 - RNA, 13 nt, Human
guccuuacuccug

SEQ ID NO: 3535425 - RNA, 23 nt, Human
guccuuacuccugugggagccuc

SEQ ID NO: 3535426 - RNA, 15 nt, Human
guccuuagaacauuu

SEQ ID NO: 3535427 - RNA, 23 nt, Human
guccuuagccuggaccucugaca

SEQ ID NO: 3535428 - RNA, 16 nt, Human
guccuuaucuagcugc

SEQ ID NO: 3535429 - RNA, 15 nt, Human
guccuucaccucacu

SEQ ID NO: 3535430 - RNA, 22 nt, Human
guccuuccaggcccccaccacu

SEQ ID NO: 3535431 - RNA, 18 nt, Human
guccuucucucaccuccu

SEQ ID NO: 3535432 - RNA, 11 nt, Human
guccuugaaaa

SEQ ID NO: 3535433 - RNA, 19 nt, Human
guccuugcaccccucacuc

SEQ ID NO: 3535434 - RNA, 15 nt, Human
guccuugcaccugca

SEQ ID NO: 3535435 - RNA, 12 nt, Human
guccuugcccuu

SEQ ID NO: 3535436 - RNA, 14 nt, Human
guccuugcuuggcu

SEQ ID NO: 3535437 - RNA, 20 nt, Human
guccuuggcaggcugauuuc

SEQ ID NO: 3535438 - RNA, 23 nt, Human
guccuuggcccccuuucccgggc

SEQ ID NO: 3535439 - RNA, 18 nt, Human
guccuuggggacaucuca

SEQ ID NO: 3535440 - RNA, 18 nt, Human
guccuuuccaaggcuucu

SEQ ID NO: 3535441 - RNA, 22 nt, Human
guccuuuccaguggccuggcuc

SEQ ID NO: 3535442 - RNA, 15 nt, Human
guccuuuucagaagu

SEQ ID NO: 3535443 - RNA, 22 nt, Human
guccuuuucagaagugagcuuu

SEQ ID NO: 3535444 - RNA, 21 nt, Human
guccuuuucauaggucugaaa

SEQ ID NO: 3535445 - RNA, 13 nt, Human
guccuuuuguaaa

SEQ ID NO: 3535446 - RNA, 22 nt, Human
guccuuuuguaccaugguguga

SEQ ID NO: 3535447 - RNA, 16 nt, Human
gucgaauuuuuauuau

SEQ ID NO: 3535448 - RNA, 22 nt, Human
gucgagaaagaggcaccaggaa

SEQ ID NO: 3535449 - RNA, 15 nt, Human
gucgaggaguaacaa

SEQ ID NO: 3535450 - RNA, 12 nt, Human
gucgaggcagga

SEQ ID NO: 3535451 - RNA, 16 nt, Human
gucgaggggcucucag

SEQ ID NO: 3535452 - RNA, 15 nt, Human
gucgagucaaaaugu

SEQ ID NO: 3535453 - RNA, 20 nt, Human
gucgcaauuacuaagaagca

SEQ ID NO: 3535454 - RNA, 15 nt, Human
gucgcagcgcaggac

SEQ ID NO: 3535455 - RNA, 19 nt, Human
gucgccaccuggcauuccu

SEQ ID NO: 3535456 - RNA, 23 nt, Human
gucgcccagucuggaaugcagug

SEQ ID NO: 3535457 - RNA, 20 nt, Human
gucgcccaugcuggagugca

SEQ ID NO: 3535458 - RNA, 15 nt, Human
gucgcccucccaggc

SEQ ID NO: 3535459 - RNA, 12 nt, Human
gucgccucugca

SEQ ID NO: 3535460 - RNA, 17 nt, Human
gucgccuuagcauguuu

SEQ ID NO: 3535461 - RNA, 20 nt, Human
gucgccuuucagcaggcagc

SEQ ID NO: 3535462 - RNA, 16 nt, Human
gucgcugugccacagg

SEQ ID NO: 3535463 - RNA, 17 nt, Human
gucggaggcuugggacc

SEQ ID NO: 3535464 - RNA, 15 nt, Human
gucggccccaccagu

SEQ ID NO: 3535465 - RNA, 22 nt, Human
gucggccccaccagugccucuc

SEQ ID NO: 3535466 - RNA, 23 nt, Human
gucgggcccuucuugcugcccug

SEQ ID NO: 3535467 - RNA, 18 nt, Human
gucgggggcugaggggca

SEQ ID NO: 3535468 - RNA, 15 nt, Human
gucgguccuggugcc

SEQ ID NO: 3535469 - RNA, 17 nt, Human
gucguccuuacuccugu

SEQ ID NO: 3535470 - RNA, 21 nt, Human
gucgugccuccuuccaccucc

SEQ ID NO: 3535471 - RNA, 15 nt, Human
gucgugccugugucc

SEQ ID NO: 3535472 - RNA, 23 nt, Human
gucguggacacacacagacuauu

SEQ ID NO: 3535473 - RNA, 21 nt, Human
gucguggggugugcugggagc

SEQ ID NO: 3535474 - RNA, 14 nt, Human
gucgugggugugug

SEQ ID NO: 3535475 - RNA, 19 nt, Human
gucguugacuuuagggacu

SEQ ID NO: 3535476 - RNA, 14 nt, Human
gucuaaaacaauaa

SEQ ID NO: 3535477 - RNA, 22 nt, Human
gucuaaagauggaguuucuaag

SEQ ID NO: 3535478 - RNA, 11 nt, Human
gucuaaaguuu

SEQ ID NO: 3535479 - RNA, 16 nt, Human
gucuaaaguuuacagu

SEQ ID NO: 3535480 - RNA, 13 nt, Human
gucuaaauauuuc

SEQ ID NO: 3535481 - RNA, 16 nt, Human
gucuaaauauuuccuu

SEQ ID NO: 3535482 - RNA, 13 nt, Human
gucuaaauuugaa

SEQ ID NO: 3535483 - RNA, 16 nt, Human
gucuaaccaaaugcau

SEQ ID NO: 3535484 - RNA, 14 nt, Human
gucuaacuuuugug

SEQ ID NO: 3535485 - RNA, 15 nt, Human
gucuaagaaacauug

SEQ ID NO: 3535486 - RNA, 18 nt, Human
gucuaagaaacauuggaa

SEQ ID NO: 3535487 - RNA, 17 nt, Human
gucuacacuaagagaga

SEQ ID NO: 3535488 - RNA, 13 nt, Human
gucuacagcuccc

SEQ ID NO: 3535489 - RNA, 13 nt, Human
gucuacccagaga

SEQ ID NO: 3535490 - RNA, 14 nt, Human
gucuacccugggau

SEQ ID NO: 3535491 - RNA, 17 nt, Human
gucuagaaguuguuugu

SEQ ID NO: 3535492 - RNA, 16 nt, Human
gucuagacuaaaagau

SEQ ID NO: 3535493 - RNA, 16 nt, Human
gucuagauggcuccuc

SEQ ID NO: 3535494 - RNA, 22 nt, Human
gucuagauucaaagguucuagg

SEQ ID NO: 3535495 - RNA, 14 nt, Human
gucuaggacacagu

SEQ ID NO: 3535496 - RNA, 21 nt, Human
gucuaggagcugggaggaaaa

SEQ ID NO: 3535497 - RNA, 16 nt, Human
gucuagggagagaccc

SEQ ID NO: 3535498 - RNA, 18 nt, Human
gucuagucucuccuguaa

SEQ ID NO: 3535499 - RNA, 17 nt, Human
gucuauaaaagaaacac

SEQ ID NO: 3535500 - RNA, 20 nt, Human
gucuauaaagcauuuaaccc

SEQ ID NO: 3535501 - RNA, 21 nt, Human
gucuauaaucccagcacuuug

SEQ ID NO: 3535502 - RNA, 16 nt, Human
gucuauaccuuaagaa

SEQ ID NO: 3535503 - RNA, 22 nt, Human
gucuaucaaccccagacacugg

SEQ ID NO: 3535504 - RNA, 18 nt, Human
gucuaucaagucaaucau

SEQ ID NO: 3535505 - RNA, 14 nt, Human
gucuaugggacuca

SEQ ID NO: 3535506 - RNA, 22 nt, Human
gucuauguuccgaauugagcac

SEQ ID NO: 3535507 - RNA, 14 nt, Human
gucuauuccagcuc

SEQ ID NO: 3535508 - RNA, 15 nt, Human
gucuauuccagcuca

SEQ ID NO: 3535509 - RNA, 11 nt, Human
gucuauugucu

SEQ ID NO: 3535510 - RNA, 23 nt, Human
gucuauuuaaaaaaaaagucaga

SEQ ID NO: 3535511 - RNA, 17 nt, Human
gucuauuucaucagaac

SEQ ID NO: 3535512 - RNA, 15 nt, Human
gucuauuuuaaaaua

SEQ ID NO: 3535513 - RNA, 16 nt, Human
gucuauuuuaaaauaa

SEQ ID NO: 3535514 - RNA, 14 nt, Human
gucucaaaaaaaca

SEQ ID NO: 3535515 - RNA, 14 nt, Human
gagccgcuggcaga

SEQ ID NO: 3535516 - RNA, 20 nt, Human
gagccgcugugagccccugg

SEQ ID NO: 3535517 - RNA, 16 nt, Human
gagccggccccaggcu

SEQ ID NO: 3535518 - RNA, 13 nt, Human
gagccgggccugg

SEQ ID NO: 3535519 - RNA, 20 nt, Human
gagccgggccuggggcuccu

SEQ ID NO: 3535520 - RNA, 19 nt, Human
gagccgggccuugucgcag

SEQ ID NO: 3535521 - RNA, 18 nt, Human
gagccgguaacuguccug

SEQ ID NO: 3535522 - RNA, 19 nt, Human
gagccguggucccugagga

SEQ ID NO: 3535523 - RNA, 15 nt, Human
gagccuacccacccc

SEQ ID NO: 3535524 - RNA, 17 nt, Human
gagccuacccaccccca

SEQ ID NO: 3535525 - RNA, 15 nt, Human
gagccuaggaccacu

SEQ ID NO: 3535526 - RNA, 19 nt, Human
gagccuaggaccacucagc

SEQ ID NO: 3535527 - RNA, 17 nt, Human
gagccuaggccaggugc

SEQ ID NO: 3535528 - RNA, 21 nt, Human
gagccuaguuuuuaauagcua

SEQ ID NO: 3535529 - RNA, 23 nt, Human
gagccucacuggggcagacaaua

SEQ ID NO: 3535530 - RNA, 13 nt, Human
gagccucagcauc

SEQ ID NO: 3535531 - RNA, 14 nt, Human
gagccucagcaucc

SEQ ID NO: 3535532 - RNA, 19 nt, Human
gagccucagcauccuggca

SEQ ID NO: 3535533 - RNA, 21 nt, Human
gagccucagcauccuggcacc

SEQ ID NO: 3535534 - RNA, 21 nt, Human
gagccucccaaggagaacaaa

SEQ ID NO: 3535535 - RNA, 20 nt, Human
gagccucccucaauuccccc

SEQ ID NO: 3535536 - RNA, 15 nt, Human
gagccucccugccuc

SEQ ID NO: 3535537 - RNA, 22 nt, Human
gagccuccucucucaaacuggg

SEQ ID NO: 3535538 - RNA, 17 nt, Human
gagccuccugcccaguc

SEQ ID NO: 3535539 - RNA, 22 nt, Human
gagccuccugcccuuaccugcc

SEQ ID NO: 3535540 - RNA, 18 nt, Human
gagccuccuuucuggcuu

SEQ ID NO: 3535541 - RNA, 23 nt, Human
gagccucgcaacccgugccaagu

SEQ ID NO: 3535542 - RNA, 16 nt, Human
gagccucugcucccca

SEQ ID NO: 3535543 - RNA, 13 nt, Human
gagccucugucac

SEQ ID NO: 3535544 - RNA, 19 nt, Human
gagccugacagccagaacu

SEQ ID NO: 3535545 - RNA, 10 nt, Human
gagccugagg

SEQ ID NO: 3535546 - RNA, 15 nt, Human
gagccugagggaucu

SEQ ID NO: 3535547 - RNA, 21 nt, Human
gagccugagucagggcccaga

SEQ ID NO: 3535548 - RNA, 14 nt, Human
gagccugaucaccu

SEQ ID NO: 3535549 - RNA, 22 nt, Human
gagccugcacggugaauggcuu

SEQ ID NO: 3535550 - RNA, 23 nt, Human
gagccugcacggugaauggcuuu

SEQ ID NO: 3535551 - RNA, 12 nt, Human
gagccugcagag

SEQ ID NO: 3535552 - RNA, 16 nt, Human
gagccugcagggaagc

SEQ ID NO: 3535553 - RNA, 23 nt, Human
gagccugcaggguggugcuggga

SEQ ID NO: 3535554 - RNA, 18 nt, Human
gugucuguaaaagagccu

SEQ ID NO: 3535555 - RNA, 12 nt, Human
gugucuguacac

SEQ ID NO: 3535556 - RNA, 13 nt, Human
gugucuguacacg

SEQ ID NO: 3535557 - RNA, 17 nt, Human
gugucuguacacguguc

SEQ ID NO: 3535558 - RNA, 14 nt, Human
gugucuguauuuau

SEQ ID NO: 3535559 - RNA, 12 nt, Human
gugucuuccaua

SEQ ID NO: 3535560 - RNA, 13 nt, Human
gugucuuccauaa

SEQ ID NO: 3535561 - RNA, 17 nt, Human
gugucuugcaauggcag

SEQ ID NO: 3535562 - RNA, 19 nt, Human
gugucuugcaauggcagcc

SEQ ID NO: 3535563 - RNA, 21 nt, Human
gugucuugcaauggcagccuu

SEQ ID NO: 3535564 - RNA, 17 nt, Human
gugucuuuccacuccuc

SEQ ID NO: 3535565 - RNA, 21 nt, Human
gugucuuucuuuggugccuuu

SEQ ID NO: 3535566 - RNA, 21 nt, Human
gugucuuuucuguagagcaua

SEQ ID NO: 3535567 - RNA, 15 nt, Human
gugucuuuugcauga

SEQ ID NO: 3535568 - RNA, 16 nt, Human
gugucuuuugcaugau

SEQ ID NO: 3535569 - RNA, 13 nt, Human
gugugaaaauggg

SEQ ID NO: 3535570 - RNA, 14 nt, Human
gugugaaacauacu

SEQ ID NO: 3535571 - RNA, 20 nt, Human
gugugaaacuuucauuccuu

SEQ ID NO: 3535572 - RNA, 12 nt, Human
gaggccagccug

SEQ ID NO: 3535573 - RNA, 13 nt, Human
gaggccagccugg

SEQ ID NO: 3535574 - RNA, 20 nt, Human
gaggccagccuggccuccug

SEQ ID NO: 3535575 - RNA, 13 nt, Human
gaggccagggcag

SEQ ID NO: 3535576 - RNA, 12 nt, Human
gaggccaucugg

SEQ ID NO: 3535577 - RNA, 16 nt, Human
gaggccaucuggagag

SEQ ID NO: 3535578 - RNA, 19 nt, Human
gaggccaucuggagagccc

SEQ ID NO: 3535579 - RNA, 20 nt, Human
gaggccaugauucgcccaaa

SEQ ID NO: 3535580 - RNA, 20 nt, Human
gaggccauggacucuguccu

SEQ ID NO: 3535581 - RNA, 21 nt, Human
gaggccaugggccuccugugu

SEQ ID NO: 3535582 - RNA, 14 nt, Human
gaggccaugugcau

SEQ ID NO: 3535583 - RNA, 13 nt, Human
gaggcccagaggg

SEQ ID NO: 3535584 - RNA, 15 nt, Human
gaggcccagagggcc

SEQ ID NO: 3535585 - RNA, 13 nt, Human
gaggcccaggcug

SEQ ID NO: 3535586 - RNA, 14 nt, Human
gaggcccaggcugc

SEQ ID NO: 3535587 - RNA, 15 nt, Human
gaggcccaggcugcc

SEQ ID NO: 3535588 - RNA, 17 nt, Human
gaggcccaggcugggaa

SEQ ID NO: 3535589 - RNA, 13 nt, Human
gaggcccagggag

SEQ ID NO: 3535590 - RNA, 20 nt, Human
gaggcccaguucacccugau

SEQ ID NO: 3535591 - RNA, 13 nt, Human
gaggccccagccg

SEQ ID NO: 3535592 - RNA, 22 nt, Human
gaggccccagccucccugaagc

SEQ ID NO: 3535593 - RNA, 19 nt, Human
gaggcccccagcccagggc

SEQ ID NO: 3535594 - RNA, 20 nt, Human
gaggcccgcaugcggcccag

SEQ ID NO: 3535595 - RNA, 12 nt, Human
gaggcccuccac

SEQ ID NO: 3535596 - RNA, 19 nt, Human
gaggcccuccacaccugcg

SEQ ID NO: 3535597 - RNA, 19 nt, Human
gaggcccuccugugcuggg

SEQ ID NO: 3535598 - RNA, 11 nt, Human
gaggcccugca

SEQ ID NO: 3535599 - RNA, 13 nt, Human
gaggcccugcaug

SEQ ID NO: 3535600 - RNA, 18 nt, Human
gaggcccugcccaaugag

SEQ ID NO: 3535601 - RNA, 14 nt, Human
gaggcccuggauca

SEQ ID NO: 3535602 - RNA, 22 nt, Human
gaggcccugugccccuugacaa

SEQ ID NO: 3535603 - RNA, 14 nt, Human
gaggcccuucucuc

SEQ ID NO: 3535604 - RNA, 15 nt, Human
gaggcccuucucucc

SEQ ID NO: 3535605 - RNA, 22 nt, Human
gaggcccuucucuccagccccu

SEQ ID NO: 3535606 - RNA, 24 nt, Human
gaggcccuucucuccagccccugg

SEQ ID NO: 3535607 - RNA, 18 nt, Human
gaggccgaagcuaacagg

SEQ ID NO: 3535608 - RNA, 14 nt, Human
gaggccgaggcagg

SEQ ID NO: 3535609 - RNA, 14 nt, Human
gaggccgaggcggg

SEQ ID NO: 3535610 - RNA, 15 nt, Human
gaggccgcuagaggc

SEQ ID NO: 3535611 - RNA, 20 nt, Human
gaggccgcuagaggccugag

SEQ ID NO: 3535612 - RNA, 16 nt, Human
gaggccggggccgggu

SEQ ID NO: 3535613 - RNA, 14 nt, Human
gaggccguggcugc

SEQ ID NO: 3535614 - RNA, 18 nt, Human
gaggccuaccccgcagac

SEQ ID NO: 3535615 - RNA, 20 nt, Human
gaggccucaggugcugucca

SEQ ID NO: 3535616 - RNA, 22 nt, Human
gaggccucaggugcuguccaug

SEQ ID NO: 3535617 - RNA, 21 nt, Human
gaggccucaguggacuuucca

SEQ ID NO: 3535618 - RNA, 11 nt, Human
gaggccuccgg

SEQ ID NO: 3535619 - RNA, 24 nt, Human
gaggccucuuggaccucugcucug

SEQ ID NO: 3535620 - RNA, 17 nt, Human
gaggccugagacccagg

SEQ ID NO: 3535621 - RNA, 18 nt, Human
gaggccugagacccagga

SEQ ID NO: 3535622 - RNA, 20 nt, Human
gaggccugaggaugagcugg

SEQ ID NO: 3535623 - RNA, 20 nt, Human
gaggccugcccucagggauc

SEQ ID NO: 3535624 - RNA, 20 nt, Human
gaggccugccuccagggcug

SEQ ID NO: 3535625 - RNA, 22 nt, Human
gaggccugccuccagggcugga

SEQ ID NO: 3535626 - RNA, 16 nt, Human
gaggccugcgacccug

SEQ ID NO: 3535627 - RNA, 19 nt, Human
gaggccugcgacccugggg

SEQ ID NO: 3535628 - RNA, 20 nt, Human
gaggccugcgacccuggggg

SEQ ID NO: 3535629 - RNA, 18 nt, Human
gaggccuggacuuuccug

SEQ ID NO: 3535630 - RNA, 14 nt, Human
gaggccugggccgc

SEQ ID NO: 3535631 - RNA, 20 nt, Human
gaggccugggccgcugccac

SEQ ID NO: 3535632 - RNA, 17 nt, Human
gaggccugggcugggaa

SEQ ID NO: 3535633 - RNA, 21 nt, Human
gaggccuuacuuaaacccagc

SEQ ID NO: 3535634 - RNA, 18 nt, Human
gaggccuuaucauucauu

SEQ ID NO: 3535635 - RNA, 20 nt, Human
gaggccuuaucauucauucu

SEQ ID NO: 3535636 - RNA, 21 nt, Human
gaggccuuaugaggguccucu

SEQ ID NO: 3535637 - RNA, 16 nt, Human
gaggccuuccagcugc

SEQ ID NO: 3535638 - RNA, 18 nt, Human
gaggccuuccagcugcug

SEQ ID NO: 3535639 - RNA, 19 nt, Human
gaggccuugggcucugcug

SEQ ID NO: 3535640 - RNA, 21 nt, Human
gaggcgaagcguuguccucag

SEQ ID NO: 3535641 - RNA, 17 nt, Human
gaggcgccccaacccgu

SEQ ID NO: 3535642 - RNA, 21 nt, Human
gaggcgccccaacccguggag

SEQ ID NO: 3535643 - RNA, 22 nt, Human
gaggcgccccaacccguggagg

SEQ ID NO: 3535644 - RNA, 16 nt, Human
gaggcgggccagccag

SEQ ID NO: 3535645 - RNA, 17 nt, Human
gaggcgggccagccagg

SEQ ID NO: 3535646 - RNA, 12 nt, Human
gaggcgggugga

SEQ ID NO: 3535647 - RNA, 19 nt, Human
gaggcggguggaucaccug

SEQ ID NO: 3535648 - RNA, 14 nt, Human
gaggcuaaaauguu

SEQ ID NO: 3535649 - RNA, 16 nt, Human
gaggcuaaaauguuuu

SEQ ID NO: 3535650 - RNA, 23 nt, Human
gaggcuaaauuacucaggaagaa

SEQ ID NO: 3535651 - RNA, 15 nt, Human
gaggcuaaguuggga

SEQ ID NO: 3535652 - RNA, 16 nt, Human
gaggcuaugcucaggg

SEQ ID NO: 3535653 - RNA, 20 nt, Human
gaggcuauuauuuucacugu

SEQ ID NO: 3535654 - RNA, 14 nt, Human
gaggcucagauugu

SEQ ID NO: 3535655 - RNA, 12 nt, Human
gaggcuccacuu

SEQ ID NO: 3535656 - RNA, 23 nt, Human
gaggcuccacuuggucugugaga

SEQ ID NO: 3535657 - RNA, 14 nt, Human
gaggcuccaggcag

SEQ ID NO: 3535658 - RNA, 22 nt, Human
gaggcuccugugcuacuuugcc

SEQ ID NO: 3535659 - RNA, 22 nt, Human
gaggcucuaauugaauuuucaa

SEQ ID NO: 3535660 - RNA, 12 nt, Human
gaggcugacucc

SEQ ID NO: 3535661 - RNA, 19 nt, Human
gaggcugacuccugguccu

SEQ ID NO: 3535662 - RNA, 14 nt, Human
gaggcugagacagg

SEQ ID NO: 3535663 - RNA, 15 nt, Human
gaggcugaggcacaa

SEQ ID NO: 3535664 - RNA, 16 nt, Human
gaggcugaggcagaag

SEQ ID NO: 3535665 - RNA, 15 nt, Human
gaggcugaggcagga

SEQ ID NO: 3535666 - RNA, 16 nt, Human
gaggcugaggcaggag

SEQ ID NO: 3535667 - RNA, 17 nt, Human
gaggcugaggcaggagg

SEQ ID NO: 3535668 - RNA, 14 nt, Human
gaggcugaggccug

SEQ ID NO: 3535669 - RNA, 12 nt, Human
gaggcugaggcg

SEQ ID NO: 3535670 - RNA, 19 nt, Human
gaggcugaggcuggcacag

SEQ ID NO: 3535671 - RNA, 18 nt, Human
gaggcugaggugggcaga

SEQ ID NO: 3535672 - RNA, 18 nt, Human
gaggcugcagccaggcca

SEQ ID NO: 3535673 - RNA, 12 nt, Human
gaggcugccccc

SEQ ID NO: 3535674 - RNA, 19 nt, Human
gaggcugcccccggccccc

SEQ ID NO: 3535675 - RNA, 20 nt, Human
gaggcugcccccggcccccu

SEQ ID NO: 3535676 - RNA, 18 nt, Human
gaggcugccccucucacc

SEQ ID NO: 3535677 - RNA, 14 nt, Human
gaggcugcccuccu

SEQ ID NO: 3535678 - RNA, 23 nt, Human
gaggcugcccuccugugcucagc

SEQ ID NO: 3535679 - RNA, 14 nt, Human
gaggcugccucucc

SEQ ID NO: 3535680 - RNA, 24 nt, Human
gaggcugcucggggugcacaggag

SEQ ID NO: 3535681 - RNA, 21 nt, Human
gaggcuggacuccagaucugc

SEQ ID NO: 3535682 - RNA, 15 nt, Human
gaggcuggagcuggc

SEQ ID NO: 3535683 - RNA, 15 nt, Human
gaggcuggaggaagg

SEQ ID NO: 3535684 - RNA, 16 nt, Human
gaggcuggaggcaggg

SEQ ID NO: 3535685 - RNA, 18 nt, Human
gaggcuggaggcagggcc

SEQ ID NO: 3535686 - RNA, 19 nt, Human
gaggcuggaggcagggccu

SEQ ID NO: 3535687 - RNA, 23 nt, Human
gaggcuggauccuagccuuaucc

SEQ ID NO: 3535688 - RNA, 12 nt, Human
gaggcuggcagg

SEQ ID NO: 3535689 - RNA, 13 nt, Human
gaggcuggcaggu

SEQ ID NO: 3535690 - RNA, 22 nt, Human
gaggcugggaauggaggggcag

SEQ ID NO: 3535691 - RNA, 18 nt, Human
gaggcugggacgcucugc

SEQ ID NO: 3535692 - RNA, 15 nt, Human
gaggcugguccuaug

SEQ ID NO: 3535693 - RNA, 16 nt, Human
gaggcugguccuaugg

SEQ ID NO: 3535694 - RNA, 18 nt, Human
gaggcugguccuauggcc

SEQ ID NO: 3535695 - RNA, 22 nt, Human
gaggcuggugcuguggccaggg

SEQ ID NO: 3535696 - RNA, 12 nt, Human
gaggcuguagga

SEQ ID NO: 3535697 - RNA, 12 nt, Human
gaggcuguccug

SEQ ID NO: 3535698 - RNA, 21 nt, Human
gaggcugucuucucaggcucu

SEQ ID NO: 3535699 - RNA, 19 nt, Human
gugauauagaauuagcuuu

SEQ ID NO: 3535700 - RNA, 23 nt, Human
gugauauauaaguguacauaugu

SEQ ID NO: 3535701 - RNA, 15 nt, Human
gugauauauguauua

SEQ ID NO: 3535702 - RNA, 14 nt, Human
gugauaugcacaau

SEQ ID NO: 3535703 - RNA, 13 nt, Human
gugauauggagcc

SEQ ID NO: 3535704 - RNA, 13 nt, Human
gugauauucuaag

SEQ ID NO: 3535705 - RNA, 13 nt, Human
gugauauuucaga

SEQ ID NO: 3535706 - RNA, 15 nt, Human
gugauauuucucuag

SEQ ID NO: 3535707 - RNA, 16 nt, Human
gugauauuucucuagu

SEQ ID NO: 3535708 - RNA, 14 nt, Human
gugauauuuuucuu

SEQ ID NO: 3535709 - RNA, 17 nt, Human
gugaucaauaaaaugug

SEQ ID NO: 3535710 - RNA, 17 nt, Human
gugaucauguguggaag

SEQ ID NO: 3535711 - RNA, 18 nt, Human
gugaucauguguggaagu

SEQ ID NO: 3535712 - RNA, 24 nt, Human
gugauccacccaccucagccuccc

SEQ ID NO: 3535713 - RNA, 20 nt, Human
gugauccacccgccucagcc

SEQ ID NO: 3535714 - RNA, 18 nt, Human
gugaucccguuuucccca

SEQ ID NO: 3535715 - RNA, 23 nt, Human
gugauccucccaccucagccucc

SEQ ID NO: 3535716 - RNA, 15 nt, Human
gugaucucagaucag

SEQ ID NO: 3535717 - RNA, 15 nt, Human
gugaucugaacagaa

SEQ ID NO: 3535718 - RNA, 19 nt, Human
gugaucuuauuuuucuaaa

SEQ ID NO: 3535719 - RNA, 18 nt, Human
gugaucuugcucuaucuc

SEQ ID NO: 3535720 - RNA, 24 nt, Human
gugaucuugcucuaucucacagca

SEQ ID NO: 3535721 - RNA, 17 nt, Human
gugaugagggcagcagc

SEQ ID NO: 3535722 - RNA, 21 nt, Human
gugaugagggcagcagccagc

SEQ ID NO: 3535723 - RNA, 23 nt, Human
gugaugagggcagcagccagccc

SEQ ID NO: 3535724 - RNA, 22 nt, Human
gugaugaugaaaugaggucaga

SEQ ID NO: 3535725 - RNA, 15 nt, Human
gugaugccagguucu

SEQ ID NO: 3535726 - RNA, 18 nt, Human
gugaugccagguucuauu

SEQ ID NO: 3535727 - RNA, 13 nt, Human
gugaugcggcaga

SEQ ID NO: 3535728 - RNA, 16 nt, Human
gugaugcucaggcuug

SEQ ID NO: 3535729 - RNA, 18 nt, Human
gugauggggcccugccuc

SEQ ID NO: 3535730 - RNA, 14 nt, Human
gugaugguuccccu

SEQ ID NO: 3535731 - RNA, 20 nt, Human
gugaugucauacagagaagu

SEQ ID NO: 3535732 - RNA, 21 nt, Human
gugaugucauacagagaaguc

SEQ ID NO: 3535733 - RNA, 13 nt, Human
gugaugugacauu

SEQ ID NO: 3535734 - RNA, 15 nt, Human
gugaugugaguugca

SEQ ID NO: 3535735 - RNA, 10 nt, Human
gugauguguc

SEQ ID NO: 3535736 - RNA, 13 nt, Human
gugauguucuaag

SEQ ID NO: 3535737 - RNA, 16 nt, Human
gugauguucuaaggcu

SEQ ID NO: 3535738 - RNA, 12 nt, Human
gagggaccagcc

SEQ ID NO: 3535739 - RNA, 13 nt, Human
gagggaccucucc

SEQ ID NO: 3535740 - RNA, 15 nt, Human
gagggaccucuccca

SEQ ID NO: 3535741 - RNA, 14 nt, Human
gagggacgccuggg

SEQ ID NO: 3535742 - RNA, 15 nt, Human
gagggacgccugggg

SEQ ID NO: 3535743 - RNA, 20 nt, Human
gagggacggccaagaaugua

SEQ ID NO: 3535744 - RNA, 22 nt, Human
gagggacgucagacuuggcuca

SEQ ID NO: 3535745 - RNA, 18 nt, Human
gagggacugucgcugcuu

SEQ ID NO: 3535746 - RNA, 23 nt, Human
gagggacugucgcugcuucgugg

SEQ ID NO: 3535747 - RNA, 15 nt, Human
gagggagaaauaguc

SEQ ID NO: 3535748 - RNA, 14 nt, Human
gagggagaggugga

SEQ ID NO: 3535749 - RNA, 13 nt, Human
gagggaggaccug

SEQ ID NO: 3535750 - RNA, 16 nt, Human
gagggaggccccaggg

SEQ ID NO: 3535751 - RNA, 15 nt, Human
gagggagggcuccag

SEQ ID NO: 3535752 - RNA, 21 nt, Human
gagggaggggaaaagcauuuu

SEQ ID NO: 3535753 - RNA, 13 nt, Human
gagggagggggcu

SEQ ID NO: 3535754 - RNA, 15 nt, Human
gagggagguguuuaa

SEQ ID NO: 3535755 - RNA, 16 nt, Human
gagggagugacagagg

SEQ ID NO: 3535756 - RNA, 18 nt, Human
gagggagugacagaggca

SEQ ID NO: 3535757 - RNA, 22 nt, Human
gagggagugacagaggcagccc

SEQ ID NO: 3535758 - RNA, 18 nt, Human
gagggaugaggugcuggg

SEQ ID NO: 3535759 - RNA, 16 nt, Human
gagggaugaugaagag

SEQ ID NO: 3535760 - RNA, 15 nt, Human
gagggaugggccugg

SEQ ID NO: 3535761 - RNA, 15 nt, Human
gagggauguggagca

SEQ ID NO: 3535762 - RNA, 19 nt, Human
gagggauuggccgcuuggc

SEQ ID NO: 3535763 - RNA, 22 nt, Human
gagggcaagggccaugcugaag

SEQ ID NO: 3535764 - RNA, 15 nt, Human
gagggcacacacugu

SEQ ID NO: 3535765 - RNA, 14 nt, Human
gagggcacagaaaa

SEQ ID NO: 3535766 - RNA, 20 nt, Human
gagggcacauuccuugccug

SEQ ID NO: 3535767 - RNA, 18 nt, Human
gagggcacugguggcccg

SEQ ID NO: 3535768 - RNA, 20 nt, Human
gagggcagaaagguucugcc

SEQ ID NO: 3535769 - RNA, 14 nt, Human
gagggcagcagcca

SEQ ID NO: 3535770 - RNA, 20 nt, Human
gagggcagcagccagcccug

SEQ ID NO: 3535771 - RNA, 21 nt, Human
gagggcagcagccagcccugc

SEQ ID NO: 3535772 - RNA, 22 nt, Human
gagggcagcagccagcccugcc

SEQ ID NO: 3535773 - RNA, 23 nt, Human
gagggcagcagccagcccugccu

SEQ ID NO: 3535774 - RNA, 14 nt, Human
gagggcagcagggc

SEQ ID NO: 3535775 - RNA, 16 nt, Human
gagggcagcagggcua

SEQ ID NO: 3535776 - RNA, 22 nt, Human
gagggcaugcgcacaaggcuga

SEQ ID NO: 3535777 - RNA, 16 nt, Human
gagggcccagagcagg

SEQ ID NO: 3535778 - RNA, 11 nt, Human
gagggccccuc

SEQ ID NO: 3535779 - RNA, 12 nt, Human
gagggcccuggu

SEQ ID NO: 3535780 - RNA, 22 nt, Human
gagggcccugguguuucuagca

SEQ ID NO: 3535781 - RNA, 22 nt, Human
gagggccugaggucuggcugcu

SEQ ID NO: 3535782 - RNA, 17 nt, Human
gagggccugcaagggag

SEQ ID NO: 3535783 - RNA, 15 nt, Human
gagggcgcaggccgu

SEQ ID NO: 3535784 - RNA, 14 nt, Human
gagggcguggaggg

SEQ ID NO: 3535785 - RNA, 14 nt, Human
gagggcgugggagc

SEQ ID NO: 3535786 - RNA, 12 nt, Human
gagggcgugucu

SEQ ID NO: 3535787 - RNA, 16 nt, Human
gagggcuagaaccugg

SEQ ID NO: 3535788 - RNA, 19 nt, Human
gagggcuagaaccuggaga

SEQ ID NO: 3535789 - RNA, 21 nt, Human
gagggcuagaaccuggagagc

SEQ ID NO: 3535790 - RNA, 20 nt, Human
gagggcuagaaccuggcagg

SEQ ID NO: 3535791 - RNA, 19 nt, Human
gagggcuagaacuggagag

SEQ ID NO: 3535792 - RNA, 18 nt, Human
gagggcuagaaucuggag

SEQ ID NO: 3535793 - RNA, 21 nt, Human
gagggcuagaaucuggagagc

SEQ ID NO: 3535794 - RNA, 14 nt, Human
gagggcucacucag

SEQ ID NO: 3535795 - RNA, 15 nt, Human
gagggcuccagacac

SEQ ID NO: 3535796 - RNA, 21 nt, Human
gagggcucgaggggugggcug

SEQ ID NO: 3535797 - RNA, 11 nt, Human
gagggcucuga

SEQ ID NO: 3535798 - RNA, 12 nt, Human
gagggcucugag

SEQ ID NO: 3535799 - RNA, 20 nt, Human
gagggcugagccugguccca

SEQ ID NO: 3535800 - RNA, 12 nt, Human
gagggcugcagu

SEQ ID NO: 3535801 - RNA, 23 nt, Human
gagggcugcgacgcuugcucugu

SEQ ID NO: 3535802 - RNA, 18 nt, Human
gagggcuggaaucuggag

SEQ ID NO: 3535803 - RNA, 18 nt, Human
gagggcuggcuggccuca

SEQ ID NO: 3535804 - RNA, 15 nt, Human
gagggcuugugaaca

SEQ ID NO: 3535805 - RNA, 12 nt, Human
gaggggaagagg

SEQ ID NO: 3535806 - RNA, 19 nt, Human
gaggggaagaguguacugg

SEQ ID NO: 3535807 - RNA, 19 nt, Human
gaggggacaaaacccaccu

SEQ ID NO: 3535808 - RNA, 13 nt, Human
gaggggaccagga

SEQ ID NO: 3535809 - RNA, 13 nt, Human
gaggggacucugg

SEQ ID NO: 3535810 - RNA, 13 nt, Human
gaggggagcucug

SEQ ID NO: 3535811 - RNA, 11 nt, Human
gaggggagggg

SEQ ID NO: 3535812 - RNA, 12 nt, Human
gaggggagggua

SEQ ID NO: 3535813 - RNA, 21 nt, Human
gaggggaugugugugugcaga

SEQ ID NO: 3535814 - RNA, 13 nt, Human
gaggggcagcccu

SEQ ID NO: 3535815 - RNA, 13 nt, Human
gaggggcaggcug

SEQ ID NO: 3535816 - RNA, 14 nt, Human
gaggggccccugcu

SEQ ID NO: 3535817 - RNA, 22 nt, Human
gaggggccccugcuucuccagc

SEQ ID NO: 3535818 - RNA, 13 nt, Human
gaggggcccgagc

SEQ ID NO: 3535819 - RNA, 17 nt, Human
gaggggcccgcuugccu

SEQ ID NO: 3535820 - RNA, 21 nt, Human
gaggggcccguugucucccug

SEQ ID NO: 3535821 - RNA, 22 nt, Human
gaggggccggcccugugugcag

SEQ ID NO: 3535822 - RNA, 17 nt, Human
gaggggccuaggccuca

SEQ ID NO: 3535823 - RNA, 19 nt, Human
gaggggccuaggccucagc

SEQ ID NO: 3535824 - RNA, 14 nt, Human
gaggggccucaggu

SEQ ID NO: 3535825 - RNA, 22 nt, Human
gaggggccucuuaugggcuggg

SEQ ID NO: 3535826 - RNA, 15 nt, Human
gaggggccugccacc

SEQ ID NO: 3535827 - RNA, 19 nt, Human
gaggggccugccaccugga

SEQ ID NO: 3535828 - RNA, 13 nt, Human
gaggggccuggca

SEQ ID NO: 3535829 - RNA, 13 nt, Human
gaggggcuccugg

SEQ ID NO: 3535830 - RNA, 14 nt, Human
gaggggcuccugga

SEQ ID NO: 3535831 - RNA, 11 nt, Human
gaggggcucuc

SEQ ID NO: 3535832 - RNA, 16 nt, Human
gaggggcucucagcuc

SEQ ID NO: 3535833 - RNA, 23 nt, Human
gaggggcucucagcucagcgcca

SEQ ID NO: 3535834 - RNA, 23 nt, Human
gaggggcuggggacuugugucug

SEQ ID NO: 3535835 - RNA, 17 nt, Human
gaggggcuuucuggaga

SEQ ID NO: 3535836 - RNA, 17 nt, Human
gagggggaauggcagca

SEQ ID NO: 3535837 - RNA, 14 nt, Human
gagggggagaaaag

SEQ ID NO: 3535838 - RNA, 18 nt, Human
gagggggccaccucccca

SEQ ID NO: 3535839 - RNA, 22 nt, Human
gagggggccaccuccccaggcc

SEQ ID NO: 3535840 - RNA, 15 nt, Human
gagggggccuggaug

SEQ ID NO: 3535841 - RNA, 17 nt, Human
gagggggcuugaagcca

SEQ ID NO: 3535842 - RNA, 18 nt, Human
gagggggcuugaagccaa

SEQ ID NO: 3535843 - RNA, 15 nt, Human
gaggggggagguggg

SEQ ID NO: 3535844 - RNA, 15 nt, Human
gaggggggcacaugc

SEQ ID NO: 3535845 - RNA, 22 nt, Human
gugcaguccugggauguggcug

SEQ ID NO: 3535846 - RNA, 19 nt, Human
gugcaguggcccccacaga

SEQ ID NO: 3535847 - RNA, 23 nt, Human
gugcaguggugcgaucuggguuc

SEQ ID NO: 3535848 - RNA, 22 nt, Human
gugcaguucccccaaccucaga

SEQ ID NO: 3535849 - RNA, 21 nt, Human
gugcaguuugguguguccucc

SEQ ID NO: 3535850 - RNA, 19 nt, Human
gugcauaaguuaacuucca

SEQ ID NO: 3535851 - RNA, 21 nt, Human
gugcauaccacuuuuguucuu

SEQ ID NO: 3535852 - RNA, 22 nt, Human
gugcauaccacuuuuguucuug

SEQ ID NO: 3535853 - RNA, 22 nt, Human
gugcauaguuguagacaaagua

SEQ ID NO: 3535854 - RNA, 20 nt, Human
gugcauauuguacacuuuuu

SEQ ID NO: 3535855 - RNA, 11 nt, Human
gugcaucaggc

SEQ ID NO: 3535856 - RNA, 15 nt, Human
gugcaucucagccca

SEQ ID NO: 3535857 - RNA, 18 nt, Human
gugcaugcagcaucuaag

SEQ ID NO: 3535858 - RNA, 19 nt, Human
gugcaugcgccuacucgcu

SEQ ID NO: 3535859 - RNA, 18 nt, Human
gugcaugcucucugcagc

SEQ ID NO: 3535860 - RNA, 21 nt, Human
gugcauggaggcccuccugug

SEQ ID NO: 3535861 - RNA, 13 nt, Human
gugcaugggugaa

SEQ ID NO: 3535862 - RNA, 18 nt, Human
gugcaugggugaagggag

SEQ ID NO: 3535863 - RNA, 14 nt, Human
gugcaugugugugc

SEQ ID NO: 3535864 - RNA, 22 nt, Human
gugcauuagcacagauuuuaau

SEQ ID NO: 3535865 - RNA, 15 nt, Human
gugcauuaucuagau

SEQ ID NO: 3535866 - RNA, 12 nt, Human
gugcauucuccu

SEQ ID NO: 3535867 - RNA, 19 nt, Human
gugcauuguuucugugggc

SEQ ID NO: 3535868 - RNA, 21 nt, Human
gugcauuugaggucuguucuu

SEQ ID NO: 3535869 - RNA, 22 nt, Human
gugcauuugaggucuguucuuu

SEQ ID NO: 3535870 - RNA, 19 nt, Human
gugcauuuggagggaguga

SEQ ID NO: 3535871 - RNA, 15 nt, Human
gugcauuuuuguaaa

SEQ ID NO: 3535872 - RNA, 22 nt, Human
gugcauuuuugugaaaugaaaa

SEQ ID NO: 3535873 - RNA, 22 nt, Human
gugccaaacaaaaagguucuca

SEQ ID NO: 3535874 - RNA, 14 nt, Human
gugccaaagaaagu

SEQ ID NO: 3535875 - RNA, 22 nt, Human
gugccaacacucaagaagcagg

SEQ ID NO: 3535876 - RNA, 23 nt, Human
gugccaacacucaagaagcaggc

SEQ ID NO: 3535877 - RNA, 15 nt, Human
gugccaacuccucac

SEQ ID NO: 3535878 - RNA, 18 nt, Human
gugccaacuguggcuggu

SEQ ID NO: 3535879 - RNA, 18 nt, Human
gugccaagcacagugccu

SEQ ID NO: 3535880 - RNA, 19 nt, Human
gugccaagcacagugccug

SEQ ID NO: 3535881 - RNA, 20 nt, Human
gugccaaggaccuccucuuc

SEQ ID NO: 3535882 - RNA, 19 nt, Human
gugccaauauguauuguaa

SEQ ID NO: 3535883 - RNA, 21 nt, Human
gugccaauauguauuguaaac

SEQ ID NO: 3535884 - RNA, 21 nt, Human
gugccaauuucaaguuccaag

SEQ ID NO: 3535885 - RNA, 18 nt, Human
gugccacaacgccuggcu

SEQ ID NO: 3535886 - RNA, 15 nt, Human
gugccacauuuucuu

SEQ ID NO: 3535887 - RNA, 14 nt, Human
gugccacccugggc

SEQ ID NO: 3535888 - RNA, 20 nt, Human
gugccacccugggcucugug

SEQ ID NO: 3535889 - RNA, 22 nt, Human
gugccacucaccgaagccacuu

SEQ ID NO: 3535890 - RNA, 12 nt, Human
gugccagagccu

SEQ ID NO: 3535891 - RNA, 13 nt, Human
gugccagagccug

SEQ ID NO: 3535892 - RNA, 21 nt, Human
gugccagaggaauccuggcag

SEQ ID NO: 3535893 - RNA, 15 nt, Human
gugccagaggugggc

SEQ ID NO: 3535894 - RNA, 16 nt, Human
gugccagaggugggca

SEQ ID NO: 3535895 - RNA, 19 nt, Human
gugccagauuuaugcauau

SEQ ID NO: 3535896 - RNA, 15 nt, Human
gugccagcaaagccc

SEQ ID NO: 3535897 - RNA, 16 nt, Human
gugccagcaaagcccc

SEQ ID NO: 3535898 - RNA, 15 nt, Human
gaggucaacagagaa

SEQ ID NO: 3535899 - RNA, 23 nt, Human
gaggucaacagagaaggcaggaa

SEQ ID NO: 3535900 - RNA, 16 nt, Human
gaggucaagcccagga

SEQ ID NO: 3535901 - RNA, 24 nt, Human
gaggucaagcccaggaggacugcc

SEQ ID NO: 3535902 - RNA, 21 nt, Human
gaggucacauucaggaagaug

SEQ ID NO: 3535903 - RNA, 22 nt, Human
gaggucacauucaggaagauga

SEQ ID NO: 3535904 - RNA, 16 nt, Human
gaggucacuggaaagg

SEQ ID NO: 3535905 - RNA, 17 nt, Human
gaggucacuggaaaggg

SEQ ID NO: 3535906 - RNA, 18 nt, Human
gaggucacuggaaagggg

SEQ ID NO: 3535907 - RNA, 23 nt, Human
gaggucagcaugucuauucagcu

SEQ ID NO: 3535908 - RNA, 22 nt, Human
gaggucaggaguuagaggccag

SEQ ID NO: 3535909 - RNA, 11 nt, Human
gaggucaggga

SEQ ID NO: 3535910 - RNA, 12 nt, Human
gaggucccaggc

SEQ ID NO: 3535911 - RNA, 14 nt, Human
gaggucccaggcag

SEQ ID NO: 3535912 - RNA, 22 nt, Human
gagguccugagcacugccagga

SEQ ID NO: 3535913 - RNA, 16 nt, Human
gagguccugggggccu

SEQ ID NO: 3535914 - RNA, 23 nt, Human
gagguccugggggccugaccucc

SEQ ID NO: 3535915 - RNA, 19 nt, Human
gagguccuuaggccucuga

SEQ ID NO: 3535916 - RNA, 21 nt, Human
gagguccuuaggccucugaga

SEQ ID NO: 3535917 - RNA, 21 nt, Human
gaggucgguagguucagccaa

SEQ ID NO: 3535918 - RNA, 13 nt, Human
gaggucuaaucua

SEQ ID NO: 3535919 - RNA, 20 nt, Human
gaggucucgcugaugcuggg

SEQ ID NO: 3535920 - RNA, 14 nt, Human
gaggucucuugagg

SEQ ID NO: 3535921 - RNA, 17 nt, Human
gaggucuggcugcuugc

SEQ ID NO: 3535922 - RNA, 21 nt, Human
gaggucuguacguuaccucuu

SEQ ID NO: 3535923 - RNA, 18 nt, Human
gaggucuuuugacaugug

SEQ ID NO: 3535924 - RNA, 16 nt, Human
gaggugaaaaggccaa

SEQ ID NO: 3535925 - RNA, 15 nt, Human
gaggugaaagggagc

SEQ ID NO: 3535926 - RNA, 15 nt, Human
gaggugaccccaggg

SEQ ID NO: 3535927 - RNA, 19 nt, Human
gaggugaccccagggcaca

SEQ ID NO: 3535928 - RNA, 23 nt, Human
gaggugaccccagguuucuaugu

SEQ ID NO: 3535929 - RNA, 15 nt, Human
gaggugagaccaccu

SEQ ID NO: 3535930 - RNA, 16 nt, Human
gaggugcacugggagg

SEQ ID NO: 3535931 - RNA, 16 nt, Human
gaggugcaugccuaau

SEQ ID NO: 3535932 - RNA, 15 nt, Human
gaggugccuucuuca

SEQ ID NO: 3535933 - RNA, 23 nt, Human
gaggugcuacugacuuucucagc

SEQ ID NO: 3535934 - RNA, 20 nt, Human
gaggugcuuaagcagaagca

SEQ ID NO: 3535935 - RNA, 12 nt, Human
gaggugcuucac

SEQ ID NO: 3535936 - RNA, 16 nt, Human
gagguggaagaaggga

SEQ ID NO: 3535937 - RNA, 18 nt, Human
gagguggaagaagggaga

SEQ ID NO: 3535938 - RNA, 19 nt, Human
gagguggaagaagggagaa

SEQ ID NO: 3535939 - RNA, 20 nt, Human
gagguggaagcccuccuucc

SEQ ID NO: 3535940 - RNA, 21 nt, Human
gagguggagcaaagugagggc

SEQ ID NO: 3535941 - RNA, 15 nt, Human
gagguggcagcccug

SEQ ID NO: 3535942 - RNA, 20 nt, Human
gagguggcucuggaaugaca

SEQ ID NO: 3535943 - RNA, 13 nt, Human
gagguggcugccu

SEQ ID NO: 3535944 - RNA, 14 nt, Human
gagguggcuggguu

SEQ ID NO: 3535945 - RNA, 14 nt, Human
gaggugggagcagg

SEQ ID NO: 3535946 - RNA, 17 nt, Human
gaggugggagcaggaga

SEQ ID NO: 3535947 - RNA, 15 nt, Human
gaggugggaggugga

SEQ ID NO: 3535948 - RNA, 13 nt, Human
gaggugggauccu

SEQ ID NO: 3535949 - RNA, 11 nt, Human
gaggugggcag

SEQ ID NO: 3535950 - RNA, 12 nt, Human
gaggugggcagg

SEQ ID NO: 3535951 - RNA, 21 nt, Human
gaggugggccagucuguggau

SEQ ID NO: 3535952 - RNA, 19 nt, Human
gaggugggccguggcccuu

SEQ ID NO: 3535953 - RNA, 22 nt, Human
gaggugguaguaaaacacagag

SEQ ID NO: 3535954 - RNA, 23 nt, Human
gaggugguaguaaaacacagagg

SEQ ID NO: 3535955 - RNA, 19 nt, Human
gagguggucugaauguucu

SEQ ID NO: 3535956 - RNA, 20 nt, Human
gagguggucugaauguucug

SEQ ID NO: 3535957 - RNA, 20 nt, Human
gaggugguggaguggaguga

SEQ ID NO: 3535958 - RNA, 16 nt, Human
gagguguccaacuggc

SEQ ID NO: 3535959 - RNA, 14 nt, Human
gaggugucucaggc

SEQ ID NO: 3535960 - RNA, 15 nt, Human
gagguuaaggcugag

SEQ ID NO: 3535961 - RNA, 17 nt, Human
gagguucauuucaaaua

SEQ ID NO: 3535962 - RNA, 19 nt, Human
gagguuccucugccugccc

SEQ ID NO: 3535963 - RNA, 13 nt, Human
gagguugcaguga

SEQ ID NO: 3535964 - RNA, 19 nt, Human
gagguugcagugagcugag

SEQ ID NO: 3535965 - RNA, 22 nt, Human
gagguuuauagaaagauagaua

SEQ ID NO: 3535966 - RNA, 22 nt, Human
gagguuucaccaugauggccag

SEQ ID NO: 3535967 - RNA, 13 nt, Human
gagguuucaguga

SEQ ID NO: 3535968 - RNA, 19 nt, Human
gagguuugcagucccaagc

SEQ ID NO: 3535969 - RNA, 22 nt, Human
gagguuugcagucccaagcggu

SEQ ID NO: 3535970 - RNA, 22 nt, Human
gagguuuguuuagaagaagugu

SEQ ID NO: 3535971 - RNA, 19 nt, Human
gagguuuuaaaaaaauccc

SEQ ID NO: 3535972 - RNA, 22 nt, Human
gaguaaaauaaauauugucuuu

SEQ ID NO: 3535973 - RNA, 12 nt, Human
gaguaaaggaaa

SEQ ID NO: 3535974 - RNA, 15 nt, Human
gaguaaauauugagg

SEQ ID NO: 3535975 - RNA, 19 nt, Human
gaguaaauauugaggcuuu

SEQ ID NO: 3535976 - RNA, 19 nt, Human
gaguaacaauacaaaugga

SEQ ID NO: 3535977 - RNA, 21 nt, Human
gaguaacaauacaaauggauu

SEQ ID NO: 3535978 - RNA, 20 nt, Human
gaguaagaaauuucagguug

SEQ ID NO: 3535979 - RNA, 12 nt, Human
gaguaagagcug

SEQ ID NO: 3535980 - RNA, 16 nt, Human
gaguaauaugccugcu

SEQ ID NO: 3535981 - RNA, 22 nt, Human
gaguaauccaagcaaaugugaa

SEQ ID NO: 3535982 - RNA, 13 nt, Human
gaguacaaaugcc

SEQ ID NO: 3535983 - RNA, 22 nt, Human
gaguaccccugcuuugggcuug

SEQ ID NO: 3535984 - RNA, 16 nt, Human
gaguacguugugcauu

SEQ ID NO: 3535985 - RNA, 17 nt, Human
gaguacguugugcauuu

SEQ ID NO: 3535986 - RNA, 15 nt, Human
gaguacuacaguccu

SEQ ID NO: 3535987 - RNA, 18 nt, Human
gaguacuacaguccuccc

SEQ ID NO: 3535988 - RNA, 19 nt, Human
guggguggaaccaggaacc

SEQ ID NO: 3535989 - RNA, 21 nt, Human
guggguggauauaaauauaua

SEQ ID NO: 3535990 - RNA, 16 nt, Human
gugggugguggaucug

SEQ ID NO: 3535991 - RNA, 16 nt, Human
gugggugguggggagg

SEQ ID NO: 3535992 - RNA, 14 nt, Human
guggguguagccag

SEQ ID NO: 3535993 - RNA, 18 nt, Human
guggguguccugccuguc

SEQ ID NO: 3535994 - RNA, 22 nt, Human
guggguguccugccugucugcc

SEQ ID NO: 3535995 - RNA, 15 nt, Human
gugggugugugacuc

SEQ ID NO: 3535996 - RNA, 15 nt, Human
guggguuccacagac

SEQ ID NO: 3535997 - RNA, 23 nt, Human
guggguuucuaaagcugccagcc

SEQ ID NO: 3535998 - RNA, 21 nt, Human
guggguuuucaucaagacugg

SEQ ID NO: 3535999 - RNA, 17 nt, Human
guggguuuuuauuuccu

SEQ ID NO: 3536000 - RNA, 12 nt, Human
gugguaaaaagg

SEQ ID NO: 3536001 - RNA, 17 nt, Human
gugguaagagaauguua

SEQ ID NO: 3536002 - RNA, 19 nt, Human
gugguaagagaauguuaua

SEQ ID NO: 3536003 - RNA, 20 nt, Human
gugguacacacagauuacug

SEQ ID NO: 3536004 - RNA, 13 nt, Human
gugguacagagaa

SEQ ID NO: 3536005 - RNA, 14 nt, Human
gugguacagagaag

SEQ ID NO: 3536006 - RNA, 14 nt, Human
gugguacccucugg

SEQ ID NO: 3536007 - RNA, 12 nt, Human
gugguacucuga

SEQ ID NO: 3536008 - RNA, 14 nt, Human
gugguacuugauca

SEQ ID NO: 3536009 - RNA, 13 nt, Human
gugguagaaacaa

SEQ ID NO: 3536010 - RNA, 14 nt, Human
gugguauagaaaug

SEQ ID NO: 3536011 - RNA, 20 nt, Human
gugguauccugugacaugua

SEQ ID NO: 3536012 - RNA, 14 nt, Human
gugguaucuugcag

SEQ ID NO: 3536013 - RNA, 22 nt, Human
gugguaugacauuggauagaac

SEQ ID NO: 3536014 - RNA, 15 nt, Human
gugguaugucugcca

SEQ ID NO: 3536015 - RNA, 21 nt, Human
gugguauuuucaauagccacu

SEQ ID NO: 3536016 - RNA, 23 nt, Human
gugguauuuucaauagccacuaa

SEQ ID NO: 3536017 - RNA, 22 nt, Human
guggucaaaccgcacucaccca

SEQ ID NO: 3536018 - RNA, 16 nt, Human
guggucauuaagcauu

SEQ ID NO: 3536019 - RNA, 12 nt, Human
gugguccaaaua

SEQ ID NO: 3536020 - RNA, 15 nt, Human
guggucccaccccac

SEQ ID NO: 3536021 - RNA, 13 nt, Human
gugguccccaaca

SEQ ID NO: 3536022 - RNA, 20 nt, Human
guggucucuucuuggggccc

SEQ ID NO: 3536023 - RNA, 23 nt, Human
guggucucuucuuggggcccagu

SEQ ID NO: 3536024 - RNA, 13 nt, Human
guggucugaaugu

SEQ ID NO: 3536025 - RNA, 18 nt, Human
guggucugaauguucuga

SEQ ID NO: 3536026 - RNA, 20 nt, Human
guggucugaauguucugaca

SEQ ID NO: 3536027 - RNA, 16 nt, Human
guggucugcaggcagg

SEQ ID NO: 3536028 - RNA, 18 nt, Human
guggucugcucgggccca

SEQ ID NO: 3536029 - RNA, 19 nt, Human
guggucuguuggcaggcug

SEQ ID NO: 3536030 - RNA, 20 nt, Human
guggucuguuggcaggcugg

SEQ ID NO: 3536031 - RNA, 23 nt, Human
guggucuucaaauugucuuuugu

SEQ ID NO: 3536032 - RNA, 17 nt, Human
guggucuuucuggagag

SEQ ID NO: 3536033 - RNA, 23 nt, Human
guggugaaaagcagguugauaaa

SEQ ID NO: 3536034 - RNA, 15 nt, Human
guggugaagaaaacu

SEQ ID NO: 3536035 - RNA, 16 nt, Human
guggugaccccaggag

SEQ ID NO: 3536036 - RNA, 23 nt, Human
guggugagcagaaguggagcugg

SEQ ID NO: 3536037 - RNA, 16 nt, Human
guggugccauccccag

SEQ ID NO: 3536038 - RNA, 17 nt, Human
guggugccauccccagg

SEQ ID NO: 3536039 - RNA, 18 nt, Human
gugguggaagaggggaca

SEQ ID NO: 3536040 - RNA, 19 nt, Human
gugguggaagaggggacag

SEQ ID NO: 3536041 - RNA, 17 nt, Human
gugguggaguggaguga

SEQ ID NO: 3536042 - RNA, 20 nt, Human
gugguggaucuguccaagga

SEQ ID NO: 3536043 - RNA, 14 nt, Human
gugguggcucggga

SEQ ID NO: 3536044 - RNA, 21 nt, Human
guggugggcauucucucucca

SEQ ID NO: 3536045 - RNA, 20 nt, Human
gugguggggaggggcgcugg

SEQ ID NO: 3536046 - RNA, 18 nt, Human
guggugucacugucccuc

SEQ ID NO: 3536047 - RNA, 22 nt, Human
guggugucacugucccuccugg

SEQ ID NO: 3536048 - RNA, 23 nt, Human
guggugucacugucccuccuggu

SEQ ID NO: 3536049 - RNA, 15 nt, Human
guggugucagacccu

SEQ ID NO: 3536050 - RNA, 22 nt, Human
guggugucugccuguugcguga

SEQ ID NO: 3536051 - RNA, 16 nt, Human
gugguguuuccuggca

SEQ ID NO: 3536052 - RNA, 19 nt, Human
gugguuauuuuuauacagu

SEQ ID NO: 3536053 - RNA, 16 nt, Human
gugguuccucugcuca

SEQ ID NO: 3536054 - RNA, 14 nt, Human
gugguugaagagca

SEQ ID NO: 3536055 - RNA, 19 nt, Human
gugguuuaguguaaaaaug

SEQ ID NO: 3536056 - RNA, 23 nt, Human
gugguuucagcaauauuuaagga

SEQ ID NO: 3536057 - RNA, 14 nt, Human
gugguuucauguua

SEQ ID NO: 3536058 - RNA, 16 nt, Human
gugguuugguguguuc

SEQ ID NO: 3536059 - RNA, 14 nt, Human
gugguuuucuguuu

SEQ ID NO: 3536060 - RNA, 17 nt, Human
gugguuuucuguuucua

SEQ ID NO: 3536061 - RNA, 16 nt, Human
gugguuuuugagccau

SEQ ID NO: 3536062 - RNA, 23 nt, Human
guguaaaacgagaauccacccau

SEQ ID NO: 3536063 - RNA, 19 nt, Human
guguaaaauauuuugaauc

SEQ ID NO: 3536064 - RNA, 22 nt, Human
guguaaaccaaagcccuaaaau

SEQ ID NO: 3536065 - RNA, 12 nt, Human
guguaaagcauu

SEQ ID NO: 3536066 - RNA, 19 nt, Human
guguaaaguuagucuacuc

SEQ ID NO: 3536067 - RNA, 14 nt, Human
guguaaauguuagu

SEQ ID NO: 3536068 - RNA, 22 nt, Human
guguaaauuauguaaugcaaaa

SEQ ID NO: 3536069 - RNA, 17 nt, Human
guguaacaauuguguag

SEQ ID NO: 3536070 - RNA, 23 nt, Human
guguaacaauuguguagccuuuu

SEQ ID NO: 3536071 - RNA, 12 nt, Human
guguaacagcug

SEQ ID NO: 3536072 - RNA, 17 nt, Human
guguaacaggucuccuc

SEQ ID NO: 3536073 - RNA, 19 nt, Human
guguaacaggucuccucuu

SEQ ID NO: 3536074 - RNA, 15 nt, Human
guguaacauaugcaa

SEQ ID NO: 3536075 - RNA, 20 nt, Human
guguaacugcccaaagcagc

SEQ ID NO: 3536076 - RNA, 22 nt, Human
guguaauaagacuuagauugug

SEQ ID NO: 3536077 - RNA, 12 nt, Human
guguaauauuac

SEQ ID NO: 3536078 - RNA, 17 nt, Human
guguaaucaauaaacga

SEQ ID NO: 3536079 - RNA, 21 nt, Human
guguaaucauuucuugggccc

SEQ ID NO: 3536080 - RNA, 16 nt, Human
guguaaugaauaccuu

SEQ ID NO: 3536081 - RNA, 17 nt, Human
guguaauuuauaaaauu

SEQ ID NO: 3536082 - RNA, 14 nt, Human
guguaauuugaaga

SEQ ID NO: 3536083 - RNA, 20 nt, Human
guguacaauguacacacugg

SEQ ID NO: 3536084 - RNA, 22 nt, Human
guguacagucuuguauuaaguu

SEQ ID NO: 3536085 - RNA, 22 nt, Human
guguacaucccauguaacagaa

SEQ ID NO: 3536086 - RNA, 22 nt, Human
guguacauggaauaacauguaa

SEQ ID NO: 3536087 - RNA, 17 nt, Human
guguaccauuugccucc

SEQ ID NO: 3536088 - RNA, 16 nt, Human
guguacucuggccucu

SEQ ID NO: 3536089 - RNA, 14 nt, Human
guguacuguaaaga

SEQ ID NO: 3536090 - RNA, 14 nt, Human
guguagaacacuaa

SEQ ID NO: 3536091 - RNA, 19 nt, Human
guguagaacacuaauucau

SEQ ID NO: 3536092 - RNA, 14 nt, Human
guguagaagcauuc

SEQ ID NO: 3536093 - RNA, 19 nt, Human
guguagaagcauuccuucu

SEQ ID NO: 3536094 - RNA, 20 nt, Human
guguagauuuuauagugugu

SEQ ID NO: 3536095 - RNA, 16 nt, Human
guguagcaacuacagu

SEQ ID NO: 3536096 - RNA, 17 nt, Human
guguagccacaccagga

SEQ ID NO: 3536097 - RNA, 17 nt, Human
guguagccuugcccgga

SEQ ID NO: 3536098 - RNA, 20 nt, Human
guguagccuuuuuguauaaa

SEQ ID NO: 3536099 - RNA, 18 nt, Human
guguagcuacagagaaac

SEQ ID NO: 3536100 - RNA, 12 nt, Human
guguagcuguga

SEQ ID NO: 3536101 - RNA, 15 nt, Human
guguagcugugaccu

SEQ ID NO: 3536102 - RNA, 21 nt, Human
guguagcugugaccugcugag

SEQ ID NO: 3536103 - RNA, 13 nt, Human
guguaggcagaca

SEQ ID NO: 3536104 - RNA, 16 nt, Human
guguaggcuuuacuua

SEQ ID NO: 3536105 - RNA, 17 nt, Human
guguaguucauguaaau

SEQ ID NO: 3536106 - RNA, 18 nt, Human
guguauaaaaauaaaaaa

SEQ ID NO: 3536107 - RNA, 19 nt, Human
guguauaaacaagaaaaau

SEQ ID NO: 3536108 - RNA, 16 nt, Human
guguauauuauuuggc

SEQ ID NO: 3536109 - RNA, 14 nt, Human
guguaucaguguuu

SEQ ID NO: 3536110 - RNA, 20 nt, Human
guguauccauuaucaugugu

SEQ ID NO: 3536111 - RNA, 22 nt, Human
guguauccauuaucauguguaa

SEQ ID NO: 3536112 - RNA, 21 nt, Human
guguauccccccccuguauag

SEQ ID NO: 3536113 - RNA, 15 nt, Human
guguauccuggggcu

SEQ ID NO: 3536114 - RNA, 20 nt, Human
guugucauuguaaacaaacu

SEQ ID NO: 3536115 - RNA, 14 nt, Human
guuguccaacuauu

SEQ ID NO: 3536116 - RNA, 16 nt, Human
guuguccuccccuugg

SEQ ID NO: 3536117 - RNA, 15 nt, Human
guugucuaagaaauu

SEQ ID NO: 3536118 - RNA, 16 nt, Human
guugucucccuggccc

SEQ ID NO: 3536119 - RNA, 19 nt, Human
guugucucccuggcccuca

SEQ ID NO: 3536120 - RNA, 18 nt, Human
guugucucugaugcagcu

SEQ ID NO: 3536121 - RNA, 17 nt, Human
guugucucuucuccuua

SEQ ID NO: 3536122 - RNA, 22 nt, Human
guugucugaagucacugcacag

SEQ ID NO: 3536123 - RNA, 16 nt, Human
guugucuggcaaggac

SEQ ID NO: 3536124 - RNA, 13 nt, Human
guugugaauaauu

SEQ ID NO: 3536125 - RNA, 14 nt, Human
guugugaauaauua

SEQ ID NO: 3536126 - RNA, 23 nt, Human
guugugacaacuuccugagggau

SEQ ID NO: 3536127 - RNA, 18 nt, Human
guugugaccugaaguuca

SEQ ID NO: 3536128 - RNA, 22 nt, Human
guugugaggccuggccaggcac

SEQ ID NO: 3536129 - RNA, 21 nt, Human
guugugauagcuaacauuuua

SEQ ID NO: 3536130 - RNA, 18 nt, Human
guugugcagcuuuugguc

SEQ ID NO: 3536131 - RNA, 13 nt, Human
guugugcuugagc

SEQ ID NO: 3536132 - RNA, 13 nt, Human
gaugugucuguau

SEQ ID NO: 3536133 - RNA, 12 nt, Human
gauguguguuga

SEQ ID NO: 3536134 - RNA, 14 nt, Human
gauguguguugaua

SEQ ID NO: 3536135 - RNA, 17 nt, Human
gauguguguugauacug

SEQ ID NO: 3536136 - RNA, 12 nt, Human
gauguguuguga

SEQ ID NO: 3536137 - RNA, 20 nt, Human
gauguuaaaauaaaugguuu

SEQ ID NO: 3536138 - RNA, 23 nt, Human
gauguuacaucacaguguuugca

SEQ ID NO: 3536139 - RNA, 17 nt, Human
gauguuaguuuuccuua

SEQ ID NO: 3536140 - RNA, 13 nt, Human
gauguuauauuuu

SEQ ID NO: 3536141 - RNA, 17 nt, Human
gauguucagcacugucc

SEQ ID NO: 3536142 - RNA, 20 nt, Human
gauguucagcacugucccuu

SEQ ID NO: 3536143 - RNA, 22 nt, Human
gauguucagcacugucccuugc

SEQ ID NO: 3536144 - RNA, 20 nt, Human
gauguucaguguaauuucuu

SEQ ID NO: 3536145 - RNA, 23 nt, Human
gauguucaguguaauuucuuugc

SEQ ID NO: 3536146 - RNA, 23 nt, Human
gauguugaaugcccacaggcaaa

SEQ ID NO: 3536147 - RNA, 23 nt, Human
gauguugaugcaauccuuacaaa

SEQ ID NO: 3536148 - RNA, 15 nt, Human
gauguugccaugugu

SEQ ID NO: 3536149 - RNA, 15 nt, Human
gauguuggcugggaa

SEQ ID NO: 3536150 - RNA, 18 nt, Human
gauguuuaacuuaaucaa

SEQ ID NO: 3536151 - RNA, 19 nt, Human
gauguuucuuuuguaugua

SEQ ID NO: 3536152 - RNA, 23 nt, Human
gauguuucuuuuguauguaaaug

SEQ ID NO: 3536153 - RNA, 13 nt, Human
gauguuuguggcc

SEQ ID NO: 3536154 - RNA, 21 nt, Human
gauguuuuaaggaugcuugua

SEQ ID NO: 3536155 - RNA, 23 nt, Human
gauguuuuccaugaguccccugu

SEQ ID NO: 3536156 - RNA, 20 nt, Human
gauguuuuuaaaaguuucaa

SEQ ID NO: 3536157 - RNA, 21 nt, Human
gauguuuuuaaaaguuucaau

SEQ ID NO: 3536158 - RNA, 17 nt, Human
gauguuuuuaaaaucuu

SEQ ID NO: 3536159 - RNA, 16 nt, Human
gauguuuuucaugaaa

SEQ ID NO: 3536160 - RNA, 22 nt, Human
gauuaaaaauaucaaauuaauu

SEQ ID NO: 3536161 - RNA, 14 nt, Human
gauuaaaaauuaua

SEQ ID NO: 3536162 - RNA, 22 nt, Human
gauuaaaagguauacuuuagua

SEQ ID NO: 3536163 - RNA, 12 nt, Human
gauuaaacuuau

SEQ ID NO: 3536164 - RNA, 18 nt, Human
gauuaaacuuaugaaugu

SEQ ID NO: 3536165 - RNA, 19 nt, Human
gauuaaauauagauuagaa

SEQ ID NO: 3536166 - RNA, 21 nt, Human
gauuaacaaauaugcuaauuu

SEQ ID NO: 3536167 - RNA, 21 nt, Human
gauuaacagguaugaaccacc

SEQ ID NO: 3536168 - RNA, 19 nt, Human
gauuaaccacuucagcuga

SEQ ID NO: 3536169 - RNA, 20 nt, Human
gauuaacugaaauaaaaaau

SEQ ID NO: 3536170 - RNA, 12 nt, Human
gauuaacuugga

SEQ ID NO: 3536171 - RNA, 18 nt, Human
gauuaacuuggaugaguu

SEQ ID NO: 3536172 - RNA, 14 nt, Human
gauuaaguaaugau

SEQ ID NO: 3536173 - RNA, 21 nt, Human
guuauuaaacguaugcaugug

SEQ ID NO: 3536174 - RNA, 13 nt, Human
guuauuaaaugua

SEQ ID NO: 3536175 - RNA, 13 nt, Human
guuauuacauccu

SEQ ID NO: 3536176 - RNA, 15 nt, Human
guuauuacauccuug

SEQ ID NO: 3536177 - RNA, 21 nt, Human
guuauuacccagaguuuuuau

SEQ ID NO: 3536178 - RNA, 13 nt, Human
guuauuauaauug

SEQ ID NO: 3536179 - RNA, 23 nt, Human
guuauuauagagcagaaauucug

SEQ ID NO: 3536180 - RNA, 20 nt, Human
guuauuauauuuacaaaugg

SEQ ID NO: 3536181 - RNA, 17 nt, Human
guuauuaucugggcuua

SEQ ID NO: 3536182 - RNA, 13 nt, Human
guuauucuggagu

SEQ ID NO: 3536183 - RNA, 17 nt, Human
guuauugaagcagagug

SEQ ID NO: 3536184 - RNA, 18 nt, Human
guuauugaagcagagugg

SEQ ID NO: 3536185 - RNA, 14 nt, Human
guuauuguuuuguu

SEQ ID NO: 3536186 - RNA, 13 nt, Human
guuauuuaaagaa

SEQ ID NO: 3536187 - RNA, 11 nt, Human
guuauuuaaau

SEQ ID NO: 3536188 - RNA, 15 nt, Human
guuauuuaaaugagu

SEQ ID NO: 3536189 - RNA, 12 nt, Human
guuauuuagacu

SEQ ID NO: 3536190 - RNA, 14 nt, Human
guuauuuauaauca

SEQ ID NO: 3536191 - RNA, 19 nt, Human
guuauuuauagucauuuau

SEQ ID NO: 3536192 - RNA, 14 nt, Human
guuauuuauauauu

SEQ ID NO: 3536193 - RNA, 17 nt, Human
guuauuuauuuaaaugu

SEQ ID NO: 3536194 - RNA, 19 nt, Human
guuauuucuuacaggcaca

SEQ ID NO: 3536195 - RNA, 16 nt, Human
guuauuuguaauagau

SEQ ID NO: 3536196 - RNA, 19 nt, Human
guuauuuguuauuuucagu

SEQ ID NO: 3536197 - RNA, 16 nt, Human
guuauuuuacuuuuug

SEQ ID NO: 3536198 - RNA, 21 nt, Human
guuauuuuauugauuauuacu

SEQ ID NO: 3536199 - RNA, 15 nt, Human
guuauuuucagcaug

SEQ ID NO: 3536200 - RNA, 13 nt, Human
guuauuuuccagg

SEQ ID NO: 3536201 - RNA, 17 nt, Human
guuauuuucuacagugg

SEQ ID NO: 3536202 - RNA, 13 nt, Human
guuauuuucuccu

SEQ ID NO: 3536203 - RNA, 13 nt, Human
guuauuuugcaac

SEQ ID NO: 3536204 - RNA, 19 nt, Human
guuauuuuuacauucugaa

SEQ ID NO: 3536205 - RNA, 14 nt, Human
guuauuuuuauaca

SEQ ID NO: 3536206 - RNA, 17 nt, Human
guuauuuuuauacagua

SEQ ID NO: 3536207 - RNA, 16 nt, Human
guuauuuuuauaucag

SEQ ID NO: 3536208 - RNA, 14 nt, Human
guuauuuuuguaca

SEQ ID NO: 3536209 - RNA, 16 nt, Human
guuauuuuuuaauuau

SEQ ID NO: 3536210 - RNA, 21 nt, Human
guuauuuuuuaauuauuauuu

SEQ ID NO: 3536211 - RNA, 16 nt, Human
guucaaaccugugaag

SEQ ID NO: 3536212 - RNA, 23 nt, Human
guucaaagccacauuauuucuag

SEQ ID NO: 3536213 - RNA, 13 nt, Human
guucaaagccagc

SEQ ID NO: 3536214 - RNA, 22 nt, Human
guucaacaaagaaacaaagaug

SEQ ID NO: 3536215 - RNA, 16 nt, Human
guucaacccacagcua

SEQ ID NO: 3536216 - RNA, 15 nt, Human
guucaacuuccagaa

SEQ ID NO: 3536217 - RNA, 19 nt, Human
guucaacuuuuccuuugaa

SEQ ID NO: 3536218 - RNA, 20 nt, Human
guucaagaaaugaagagcug

SEQ ID NO: 3536219 - RNA, 17 nt, Human
guucaagaccagccugg

SEQ ID NO: 3536220 - RNA, 14 nt, Human
guucaagaucaaaa

SEQ ID NO: 3536221 - RNA, 18 nt, Human
guucaagcgauucucuug

SEQ ID NO: 3536222 - RNA, 18 nt, Human
guucaagcgauucuucug

SEQ ID NO: 3536223 - RNA, 20 nt, Human
guucaaguaauucugcuguc

SEQ ID NO: 3536224 - RNA, 17 nt, Human
guucaagugauucucuu

SEQ ID NO: 3536225 - RNA, 18 nt, Human
guucaauaauaaauauuu

SEQ ID NO: 3536226 - RNA, 23 nt, Human
guucaaucuggauucauauuuaa

SEQ ID NO: 3536227 - RNA, 12 nt, Human
guucaaugaucu

SEQ ID NO: 3536228 - RNA, 22 nt, Human
guucaaugaucuagguuuaacu

SEQ ID NO: 3536229 - RNA, 17 nt, Human
guucaauggcugcugaa

SEQ ID NO: 3536230 - RNA, 18 nt, Human
guucaauuauuuccccca

SEQ ID NO: 3536231 - RNA, 22 nt, Human
guucaauuuguuaguuccugua

SEQ ID NO: 3536232 - RNA, 16 nt, Human
guucacaccagagaac

SEQ ID NO: 3536233 - RNA, 19 nt, Human
guucacacccugcaaggcc

SEQ ID NO: 3536234 - RNA, 16 nt, Human
guucacauuagaauua

SEQ ID NO: 3536235 - RNA, 12 nt, Human
guucaccagccu

SEQ ID NO: 3536236 - RNA, 16 nt, Human
guucacccacagggcu

SEQ ID NO: 3536237 - RNA, 22 nt, Human
guucaccuauuucaaaaauuug

SEQ ID NO: 3536238 - RNA, 15 nt, Human
guucaccuuuguagc

SEQ ID NO: 3536239 - RNA, 16 nt, Human
guucacgcaacuugaa

SEQ ID NO: 3536240 - RNA, 16 nt, Human
guucacuaaacucuga

SEQ ID NO: 3536241 - RNA, 20 nt, Human
guucacugaaggugauucac

SEQ ID NO: 3536242 - RNA, 17 nt, Human
guucagaaaugcugccu

SEQ ID NO: 3536243 - RNA, 12 nt, Human
guucagaauuua

SEQ ID NO: 3536244 - RNA, 16 nt, Human
guucagagacucaggg

SEQ ID NO: 3536245 - RNA, 14 nt, Human
guucagagcugccc

SEQ ID NO: 3536246 - RNA, 16 nt, Human
guucagagcugcccuc

SEQ ID NO: 3536247 - RNA, 19 nt, Human
guucagagcugcccucucc

SEQ ID NO: 3536248 - RNA, 19 nt, Human
guucagaguccuuaaaaug

SEQ ID NO: 3536249 - RNA, 15 nt, Human
guucagauuggacau

SEQ ID NO: 3536250 - RNA, 17 nt, Human
guucagcaccacccuag

SEQ ID NO: 3536251 - RNA, 16 nt, Human
guucagcacugucccu

SEQ ID NO: 3536252 - RNA, 18 nt, Human
guucagcacugucccuug

SEQ ID NO: 3536253 - RNA, 13 nt, Human
guucagcacuugu

SEQ ID NO: 3536254 - RNA, 22 nt, Human
guucagcacuugucucauuuua

SEQ ID NO: 3536255 - RNA, 23 nt, Human
guucagcacuugucucauuuuaa

SEQ ID NO: 3536256 - RNA, 18 nt, Human
guucagcaguacagccga

SEQ ID NO: 3536257 - RNA, 16 nt, Human
guucagcauucuuagc

SEQ ID NO: 3536258 - RNA, 15 nt, Human
guucagccaagguuu

SEQ ID NO: 3536259 - RNA, 23 nt, Human
guucagccacccugaggccucug

SEQ ID NO: 3536260 - RNA, 14 nt, Human
guucagccccuccu

SEQ ID NO: 3536261 - RNA, 23 nt, Human
guucagccccuccucugccaccu

SEQ ID NO: 3536262 - RNA, 22 nt, Human
guucagcuaagcuaggaaugaa

SEQ ID NO: 3536263 - RNA, 15 nt, Human
guucagcuccagcuc

SEQ ID NO: 3536264 - RNA, 17 nt, Human
guucagcuccagcucac

SEQ ID NO: 3536265 - RNA, 15 nt, Human
guucagcuguccucc

SEQ ID NO: 3536266 - RNA, 23 nt, Human
guucagcuuguaaauagcucagg

SEQ ID NO: 3536267 - RNA, 21 nt, Human
guucaggagucccaaggaaag

SEQ ID NO: 3536268 - RNA, 23 nt, Human
guucagggaagauaaguuggaaa

SEQ ID NO: 3536269 - RNA, 21 nt, Human
guucaggguuggccccugccc

SEQ ID NO: 3536270 - RNA, 13 nt, Human
guucagguagcug

SEQ ID NO: 3536271 - RNA, 16 nt, Human
guucaguaccuggagg

SEQ ID NO: 3536272 - RNA, 18 nt, Human
guucaguauuauguaguu

SEQ ID NO: 3536273 - RNA, 23 nt, Human
guucagucugaaugcugccacaa

SEQ ID NO: 3536274 - RNA, 16 nt, Human
guucaguguaaauagu

SEQ ID NO: 3536275 - RNA, 12 nt, Human
guucaguguaau

SEQ ID NO: 3536276 - RNA, 19 nt, Human
guucaguguaauuucuuug

SEQ ID NO: 3536277 - RNA, 16 nt, Human
uaaaauaaaaugaaaa

SEQ ID NO: 3536278 - RNA, 22 nt, Human
uaaaauaaaaugaaaauuguau

SEQ ID NO: 3536279 - RNA, 14 nt, Human
uaaaauaaacaguu

SEQ ID NO: 3536280 - RNA, 16 nt, Human
uaaaauaaacaguugu

SEQ ID NO: 3536281 - RNA, 17 nt, Human
uaaaauaaacaguugug

SEQ ID NO: 3536282 - RNA, 13 nt, Human
uaaaauaaagaaa

SEQ ID NO: 3536283 - RNA, 13 nt, Human
uaaaauaaaguau

SEQ ID NO: 3536284 - RNA, 13 nt, Human
uaaaauaaauaua

SEQ ID NO: 3536285 - RNA, 14 nt, Human
uaaaauaaauauau

SEQ ID NO: 3536286 - RNA, 23 nt, Human
uaaaauaaauauauauaaaccua

SEQ ID NO: 3536287 - RNA, 17 nt, Human
uaaaauaaauauugucu

SEQ ID NO: 3536288 - RNA, 12 nt, Human
uaaaauaaaugg

SEQ ID NO: 3536289 - RNA, 14 nt, Human
uaaaauaaauuagu

SEQ ID NO: 3536290 - RNA, 20 nt, Human
uaaaauaaccccgggcaaga

SEQ ID NO: 3536291 - RNA, 16 nt, Human
uaaaauaacuaaaaug

SEQ ID NO: 3536292 - RNA, 18 nt, Human
uaaaauaacuaaaaugua

SEQ ID NO: 3536293 - RNA, 21 nt, Human
uaaaauaacuaaaauguaucu

SEQ ID NO: 3536294 - RNA, 22 nt, Human
uaaaauaagaauagaacaacau

SEQ ID NO: 3536295 - RNA, 21 nt, Human
uaaaauaagcagguggaucua

SEQ ID NO: 3536296 - RNA, 17 nt, Human
uaaaauaaggauuuuuc

SEQ ID NO: 3536297 - RNA, 18 nt, Human
uaaaauaagucugauuua

SEQ ID NO: 3536298 - RNA, 19 nt, Human
uaaaauaagucugauuuaa

SEQ ID NO: 3536299 - RNA, 17 nt, Human
uaaaauaauucuaaagg

SEQ ID NO: 3536300 - RNA, 13 nt, Human
uaaaauaauuuug

SEQ ID NO: 3536301 - RNA, 16 nt, Human
uaaaauaauuuuguaa

SEQ ID NO: 3536302 - RNA, 13 nt, Human
uaaaauacauuua

SEQ ID NO: 3536303 - RNA, 21 nt, Human
uaaaauaccagccaguaaaug

SEQ ID NO: 3536304 - RNA, 15 nt, Human
uaaaauacuauuuuu

SEQ ID NO: 3536305 - RNA, 12 nt, Human
uaaaauacugua

SEQ ID NO: 3536306 - RNA, 17 nt, Human
uaaaauacuguagauaa

SEQ ID NO: 3536307 - RNA, 21 nt, Human
uaaaauacuuuuacucugccu

SEQ ID NO: 3536308 - RNA, 17 nt, Human
uaaaauagaguguaguu

SEQ ID NO: 3536309 - RNA, 21 nt, Human
uaaaauagcaacacucuauau

SEQ ID NO: 3536310 - RNA, 21 nt, Human
uaaaauagccacuuaccuuca

SEQ ID NO: 3536311 - RNA, 18 nt, Human
uaaaauagucucuuuaaa

SEQ ID NO: 3536312 - RNA, 17 nt, Human
uaaaauaguuguccaua

SEQ ID NO: 3536313 - RNA, 22 nt, Human
uaaaauauaauuguuuuuuauc

SEQ ID NO: 3536314 - RNA, 19 nt, Human
uaaaauauauauguugauu

SEQ ID NO: 3536315 - RNA, 16 nt, Human
uaaaauaucauucagc

SEQ ID NO: 3536316 - RNA, 19 nt, Human
uaaaauaucauucagcaac

SEQ ID NO: 3536317 - RNA, 20 nt, Human
uaaaauaugaagacauaaac

SEQ ID NO: 3536318 - RNA, 19 nt, Human
uaaaauaugcacuaagucu

SEQ ID NO: 3536319 - RNA, 18 nt, Human
uaaaauauggcuauaaau

SEQ ID NO: 3536320 - RNA, 15 nt, Human
uaaaauauuuaugaa

SEQ ID NO: 3536321 - RNA, 16 nt, Human
uaaaauauuuaugaag

SEQ ID NO: 3536322 - RNA, 13 nt, Human
uaaaauauuuuca

SEQ ID NO: 3536323 - RNA, 13 nt, Human
uaaaauauuuucu

SEQ ID NO: 3536324 - RNA, 15 nt, Human
uaaaauauuuucugu

SEQ ID NO: 3536325 - RNA, 16 nt, Human
uaaaauauuuucugug

SEQ ID NO: 3536326 - RNA, 17 nt, Human
uaaaauauuuucugugu

SEQ ID NO: 3536327 - RNA, 20 nt, Human
uaaaauauuuucuguguguu

SEQ ID NO: 3536328 - RNA, 16 nt, Human
uaaaauauuuugaauc

SEQ ID NO: 3536329 - RNA, 18 nt, Human
uaaaaucaacuuaacaug

SEQ ID NO: 3536330 - RNA, 20 nt, Human
uaaaaucacuaacauuauau

SEQ ID NO: 3536331 - RNA, 18 nt, Human
uaaaaucacucucagugc

SEQ ID NO: 3536332 - RNA, 14 nt, Human
uaaaaucagccaau

SEQ ID NO: 3536333 - RNA, 17 nt, Human
uaaaaucagccaauuau

SEQ ID NO: 3536334 - RNA, 21 nt, Human
uaaaaucagccaauuauguua

SEQ ID NO: 3536335 - RNA, 18 nt, Human
uaaaaucaugaaacuugu

SEQ ID NO: 3536336 - RNA, 18 nt, Human
uaaaaucauguacauuuc

SEQ ID NO: 3536337 - RNA, 19 nt, Human
uaaaaucauguacauuucu

SEQ ID NO: 3536338 - RNA, 22 nt, Human
uaaaauccuaagacacaaaugc

SEQ ID NO: 3536339 - RNA, 22 nt, Human
gauuaaguaaugauaacuggaa

SEQ ID NO: 3536340 - RNA, 18 nt, Human
gauuaauauggggaugca

SEQ ID NO: 3536341 - RNA, 19 nt, Human
gauuaauccagaauaacua

SEQ ID NO: 3536342 - RNA, 14 nt, Human
gauuaauugcugca

SEQ ID NO: 3536343 - RNA, 22 nt, Human
gauuacaagcgugagccacugc

SEQ ID NO: 3536344 - RNA, 23 nt, Human
gauuacaagcgugagccacugca

SEQ ID NO: 3536345 - RNA, 10 nt, Human
gauuacaggc

SEQ ID NO: 3536346 - RNA, 18 nt, Human
gauuacaggcaugugcca

SEQ ID NO: 3536347 - RNA, 17 nt, Human
gauuacaggcuccugcc

SEQ ID NO: 3536348 - RNA, 13 nt, Human
gauuaccuccuga

SEQ ID NO: 3536349 - RNA, 22 nt, Human
gauuagaaauuaccuguggaua

SEQ ID NO: 3536350 - RNA, 17 nt, Human
gauuagaagcugaaaac

SEQ ID NO: 3536351 - RNA, 20 nt, Human
gauuagacuggacagcuugu

SEQ ID NO: 3536352 - RNA, 13 nt, Human
gauuagagggagg

SEQ ID NO: 3536353 - RNA, 14 nt, Human
gauuagagggaggu

SEQ ID NO: 3536354 - RNA, 20 nt, Human
gauuagagggagguguuuaa

SEQ ID NO: 3536355 - RNA, 13 nt, Human
gauuagcucugga

SEQ ID NO: 3536356 - RNA, 14 nt, Human
gauuagcucuggac

SEQ ID NO: 3536357 - RNA, 19 nt, Human
gauuagcuuugucacuguu

SEQ ID NO: 3536358 - RNA, 16 nt, Human
gauuagcuuuguguuu

SEQ ID NO: 3536359 - RNA, 17 nt, Human
gauuagggagagaagau

SEQ ID NO: 3536360 - RNA, 13 nt, Human
gauuaguuuagaa

SEQ ID NO: 3536361 - RNA, 14 nt, Human
gauuaguuuagaac

SEQ ID NO: 3536362 - RNA, 20 nt, Human
gauuauaggcaccuaccacc

SEQ ID NO: 3536363 - RNA, 13 nt, Human
gauuaucguuuuc

SEQ ID NO: 3536364 - RNA, 18 nt, Human
gauuauggaaaaauaaaa

SEQ ID NO: 3536365 - RNA, 18 nt, Human
gauuaugggucacaggaa

SEQ ID NO: 3536366 - RNA, 20 nt, Human
gauuauuagccagguaaugu

SEQ ID NO: 3536367 - RNA, 14 nt, Human
gauuauuaucuaaa

SEQ ID NO: 3536368 - RNA, 17 nt, Human
gauuauucugauuccac

SEQ ID NO: 3536369 - RNA, 19 nt, Human
gauuauucugauuccacuu

SEQ ID NO: 3536370 - RNA, 12 nt, Human
gauuauuuaaua

SEQ ID NO: 3536371 - RNA, 13 nt, Human
gauuauuuaauaa

SEQ ID NO: 3536372 - RNA, 16 nt, Human
gauuauuuaauaacau

SEQ ID NO: 3536373 - RNA, 22 nt, Human
gauuauuuaauaacauuaccuu

SEQ ID NO: 3536374 - RNA, 22 nt, Human
gauuauuucacuuuagaugcug

SEQ ID NO: 3536375 - RNA, 23 nt, Human
gauuauuucacuuuagaugcuga

SEQ ID NO: 3536376 - RNA, 19 nt, Human
gauuauuugcauguuaugu

SEQ ID NO: 3536377 - RNA, 22 nt, Human
gauuauuuguuauuuguacagu

SEQ ID NO: 3536378 - RNA, 21 nt, Human
gauuauuuucuacacauacau

SEQ ID NO: 3536379 - RNA, 23 nt, Human
gauuauuuuggaaaguuuuugua

SEQ ID NO: 3536380 - RNA, 17 nt, Human
gauuauuuuuuuuuucu

SEQ ID NO: 3536381 - RNA, 15 nt, Human
gauucaaaauauuua

SEQ ID NO: 3536382 - RNA, 16 nt, Human
gauucaaaauauuuaa

SEQ ID NO: 3536383 - RNA, 18 nt, Human
gauucaaaauauuuaaaa

SEQ ID NO: 3536384 - RNA, 22 nt, Human
gauucaaaauauuuaaaaaugu

SEQ ID NO: 3536385 - RNA, 14 nt, Human
gauucaaucuguaa

SEQ ID NO: 3536386 - RNA, 16 nt, Human
gauucaaucuguaaac

SEQ ID NO: 3536387 - RNA, 20 nt, Human
gauucaaucuguaaacugug

SEQ ID NO: 3536388 - RNA, 19 nt, Human
gauucaaugccccugaauu

SEQ ID NO: 3536389 - RNA, 21 nt, Human
gauucaaugccccugaauuua

SEQ ID NO: 3536390 - RNA, 16 nt, Human
gauucaauuugaugug

SEQ ID NO: 3536391 - RNA, 16 nt, Human
gauucacaucucauuu

SEQ ID NO: 3536392 - RNA, 18 nt, Human
gauucacauguuuucaaa

SEQ ID NO: 3536393 - RNA, 18 nt, Human
gauucaccuguaaaacuu

SEQ ID NO: 3536394 - RNA, 23 nt, Human
gauucagaaaauguucuguuugc

SEQ ID NO: 3536395 - RNA, 14 nt, Human
gauucagaagggga

SEQ ID NO: 3536396 - RNA, 18 nt, Human
gauucagacagcugccug

SEQ ID NO: 3536397 - RNA, 19 nt, Human
gauucagacagcugccugg

SEQ ID NO: 3536398 - RNA, 13 nt, Human
gauucagccuucu

SEQ ID NO: 3536399 - RNA, 23 nt, Human
gauucagccuucuuuuucuggac

SEQ ID NO: 3536400 - RNA, 13 nt, Human
gauucagcucugc

SEQ ID NO: 3536401 - RNA, 17 nt, Human
gauucaggaaaaggccu

SEQ ID NO: 3536402 - RNA, 17 nt, Human
gauucaggcauuuuccc

SEQ ID NO: 3536403 - RNA, 12 nt, Human
gauucaggcugc

SEQ ID NO: 3536404 - RNA, 15 nt, Human
gauucagggaaagug

SEQ ID NO: 3536405 - RNA, 18 nt, Human
gauucaggugcagaggaa

SEQ ID NO: 3536406 - RNA, 13 nt, Human
gauucagucacau

SEQ ID NO: 3536407 - RNA, 22 nt, Human
gauucagucacauggcaugguu

SEQ ID NO: 3536408 - RNA, 14 nt, Human
gauucagucuugcc

SEQ ID NO: 3536409 - RNA, 20 nt, Human
gauucaguguuaaaugugau

SEQ ID NO: 3536410 - RNA, 19 nt, Human
gauucauaguaacuucuua

SEQ ID NO: 3536411 - RNA, 18 nt, Human
gauucauauuuacuucuu

SEQ ID NO: 3536412 - RNA, 12 nt, Human
gauucaugauuu

SEQ ID NO: 3536413 - RNA, 11 nt, Human
gauucaugugg

SEQ ID NO: 3536414 - RNA, 13 nt, Human
gauucauuuccug

SEQ ID NO: 3536415 - RNA, 21 nt, Human
gauucauuuccugcccuuccu

SEQ ID NO: 3536416 - RNA, 18 nt, Human
gauuccaaaaagcacaua

SEQ ID NO: 3536417 - RNA, 23 nt, Human
gauuccaaagaguagaauugcau

SEQ ID NO: 3536418 - RNA, 17 nt, Human
gauuccaaccccaacuc

SEQ ID NO: 3536419 - RNA, 21 nt, Human
gauuccacuacaccuggcuga

SEQ ID NO: 3536420 - RNA, 19 nt, Human
gauuccagagcacugcucc

SEQ ID NO: 3536421 - RNA, 22 nt, Human
gauuccauuuggcagagcuucu

SEQ ID NO: 3536422 - RNA, 20 nt, Human
uaaauaaaguaucaugcauu

SEQ ID NO: 3536423 - RNA, 21 nt, Human
uaaauaaaguaucaugcauuc

SEQ ID NO: 3536424 - RNA, 12 nt, Human
uaaauaaaguuu

SEQ ID NO: 3536425 - RNA, 16 nt, Human
uaaauaaaucauuaau

SEQ ID NO: 3536426 - RNA, 15 nt, Human
uaaauaaauuguaua

SEQ ID NO: 3536427 - RNA, 18 nt, Human
uaaauaaauuguauauuc

SEQ ID NO: 3536428 - RNA, 19 nt, Human
uaaauaaauuguauauuca

SEQ ID NO: 3536429 - RNA, 20 nt, Human
uaaauaaauuguuugaccau

SEQ ID NO: 3536430 - RNA, 22 nt, Human
uaaauaacaggcauuuguucac

SEQ ID NO: 3536431 - RNA, 18 nt, Human
uaaauaaccccauucuuu

SEQ ID NO: 3536432 - RNA, 19 nt, Human
uaaauaaccccauucuuug

SEQ ID NO: 3536433 - RNA, 21 nt, Human
uaaauaaccccauucuuugcu

SEQ ID NO: 3536434 - RNA, 15 nt, Human
uaaauaacuggaaaa

SEQ ID NO: 3536435 - RNA, 13 nt, Human
uaaauaagaaacu

SEQ ID NO: 3536436 - RNA, 15 nt, Human
uaaauaagaaacuuu

SEQ ID NO: 3536437 - RNA, 11 nt, Human
uaaauaagaga

SEQ ID NO: 3536438 - RNA, 18 nt, Human
uaaauaaguuauaaagau

SEQ ID NO: 3536439 - RNA, 21 nt, Human
uaaauaaugugaaacuggauu

SEQ ID NO: 3536440 - RNA, 13 nt, Human
uaaauaauucuuu

SEQ ID NO: 3536441 - RNA, 16 nt, Human
uaaauaauuuaacuac

SEQ ID NO: 3536442 - RNA, 17 nt, Human
uaaauaauuuaacuacc

SEQ ID NO: 3536443 - RNA, 17 nt, Human
uaaauaauuuauuuaau

SEQ ID NO: 3536444 - RNA, 17 nt, Human
uaaauacaaaacuucca

SEQ ID NO: 3536445 - RNA, 19 nt, Human
uaaauacaaguucuauuua

SEQ ID NO: 3536446 - RNA, 13 nt, Human
uaaauacaauuuu

SEQ ID NO: 3536447 - RNA, 23 nt, Human
uaaauacaauuuuguuucuguac

SEQ ID NO: 3536448 - RNA, 19 nt, Human
uaaauacaauuuuuuuuau

SEQ ID NO: 3536449 - RNA, 18 nt, Human
uaaauacacaacacacac

SEQ ID NO: 3536450 - RNA, 19 nt, Human
uaaauacacauagcaugua

SEQ ID NO: 3536451 - RNA, 23 nt, Human
uaaauacaccaccucacuccugu

SEQ ID NO: 3536452 - RNA, 14 nt, Human
uaaauacagacacu

SEQ ID NO: 3536453 - RNA, 13 nt, Human
uaaauacaggaaa

SEQ ID NO: 3536454 - RNA, 17 nt, Human
uaaauacaggaaacagu

SEQ ID NO: 3536455 - RNA, 22 nt, Human
uaaauacagucuuccauuugca

SEQ ID NO: 3536456 - RNA, 23 nt, Human
uaaauacagucuuccauuugcaa

SEQ ID NO: 3536457 - RNA, 21 nt, Human
uaaauacauacggucagguuu

SEQ ID NO: 3536458 - RNA, 16 nt, Human
uaaauacaugcauaua

SEQ ID NO: 3536459 - RNA, 21 nt, Human
uaaauacaugcauauaaugaa

SEQ ID NO: 3536460 - RNA, 20 nt, Human
uaaauacaugccacaucaaa

SEQ ID NO: 3536461 - RNA, 17 nt, Human
uaaauaccagacacgua

SEQ ID NO: 3536462 - RNA, 14 nt, Human
uaaauaccaggauu

SEQ ID NO: 3536463 - RNA, 17 nt, Human
uaaauaccauugacaca

SEQ ID NO: 3536464 - RNA, 23 nt, Human
uaaauaccucuuagcugagugga

SEQ ID NO: 3536465 - RNA, 16 nt, Human
uaaauacugcaaauca

SEQ ID NO: 3536466 - RNA, 22 nt, Human
uaaauacugcaaaucaggcuuu

SEQ ID NO: 3536467 - RNA, 21 nt, Human
uaaauacuguguggaacuuuu

SEQ ID NO: 3536468 - RNA, 12 nt, Human
uaaauagagcaa

SEQ ID NO: 3536469 - RNA, 19 nt, Human
uaaauagagcaauuacaag

SEQ ID NO: 3536470 - RNA, 18 nt, Human
uaaauagaguauaugcac

SEQ ID NO: 3536471 - RNA, 21 nt, Human
uaaauagaugacauugacuau

SEQ ID NO: 3536472 - RNA, 18 nt, Human
uaaauagcauguauugug

SEQ ID NO: 3536473 - RNA, 21 nt, Human
uaaauagcauguauugugucu

SEQ ID NO: 3536474 - RNA, 14 nt, Human
uaaauagcuauauc

SEQ ID NO: 3536475 - RNA, 18 nt, Human
uaaauagcuauauccaug

SEQ ID NO: 3536476 - RNA, 17 nt, Human
uaaauagcuuuuguguc

SEQ ID NO: 3536477 - RNA, 16 nt, Human
uaaauaggagaggaug

SEQ ID NO: 3536478 - RNA, 12 nt, Human
uaaauaggauuu

SEQ ID NO: 3536479 - RNA, 21 nt, Human
uaaauaggcggggcuugccuu

SEQ ID NO: 3536480 - RNA, 15 nt, Human
uaaauaguuaauaua

SEQ ID NO: 3536481 - RNA, 14 nt, Human
uaaauauaagccuu

SEQ ID NO: 3536482 - RNA, 22 nt, Human
uaaauauaagccuuuuauacug

SEQ ID NO: 3536483 - RNA, 13 nt, Human
uaaauauaauucu

SEQ ID NO: 3536484 - RNA, 19 nt, Human
uaaauauaauucuguaaau

SEQ ID NO: 3536485 - RNA, 19 nt, Human
uaaauauaccacucuuuac

SEQ ID NO: 3536486 - RNA, 23 nt, Human
uaaauauaguuccuaagaagcuu

SEQ ID NO: 3536487 - RNA, 15 nt, Human
uaaauauauaaauau

SEQ ID NO: 3536488 - RNA, 13 nt, Human
uaaauauauauaa

SEQ ID NO: 3536489 - RNA, 14 nt, Human
uaaauauauauaaa

SEQ ID NO: 3536490 - RNA, 18 nt, Human
uaaauauauauaaaccua

SEQ ID NO: 3536491 - RNA, 20 nt, Human
uaaauauaucuaccccagac

SEQ ID NO: 3536492 - RNA, 13 nt, Human
uaaauauauguau

SEQ ID NO: 3536493 - RNA, 14 nt, Human
uaaauauauguaug

SEQ ID NO: 3536494 - RNA, 16 nt, Human
uaaauauauguaugua

SEQ ID NO: 3536495 - RNA, 14 nt, Human
uaaauauauuauua

SEQ ID NO: 3536496 - RNA, 23 nt, Human
uaaauauauuauuacuuguaaau

SEQ ID NO: 3536497 - RNA, 22 nt, Human
uaaauauauuuuaagacgaaac

SEQ ID NO: 3536498 - RNA, 15 nt, Human
uaaauauauuuucaa

SEQ ID NO: 3536499 - RNA, 22 nt, Human
uaaauaucaaucaagccaugua

SEQ ID NO: 3536500 - RNA, 14 nt, Human
uaaauaucaaucau

SEQ ID NO: 3536501 - RNA, 17 nt, Human
uaaauaucaaucauuuu

SEQ ID NO: 3536502 - RNA, 22 nt, Human
uaaauaucuguacuucuucgau

SEQ ID NO: 3536503 - RNA, 18 nt, Human
uaaauaucuucugauuug

SEQ ID NO: 3536504 - RNA, 21 nt, Human
uaaauaucuuuuauguuugaa

SEQ ID NO: 3536505 - RNA, 14 nt, Human
uaaauaugcaguga

SEQ ID NO: 3536506 - RNA, 16 nt, Human
uaaauaugcagugaua

SEQ ID NO: 3536507 - RNA, 17 nt, Human
uaaauauggacugcuca

SEQ ID NO: 3536508 - RNA, 19 nt, Human
uaaauauggacugcucagg

SEQ ID NO: 3536509 - RNA, 19 nt, Human
uaaauauguagauaaugga

SEQ ID NO: 3536510 - RNA, 21 nt, Human
uaaauauuaguuaauggauua

SEQ ID NO: 3536511 - RNA, 18 nt, Human
uaaauauucacacuugaa

SEQ ID NO: 3536512 - RNA, 19 nt, Human
uaaauauucuauuuucauu

SEQ ID NO: 3536513 - RNA, 18 nt, Human
uaaauauugaggcuuugu

SEQ ID NO: 3536514 - RNA, 20 nt, Human
uaaauauugaggcuuugugu

SEQ ID NO: 3536515 - RNA, 21 nt, Human
uaaauauugaggcuuuguguu

SEQ ID NO: 3536516 - RNA, 22 nt, Human
uaaauauugguugggaugacuu

SEQ ID NO: 3536517 - RNA, 20 nt, Human
uaaauauugucuuuuuguau

SEQ ID NO: 3536518 - RNA, 23 nt, Human
uaaauauugucuuuuuguauguc

SEQ ID NO: 3536519 - RNA, 16 nt, Human
uaaauauuuauguaga

SEQ ID NO: 3536520 - RNA, 13 nt, Human
uaaauauuuccuu

SEQ ID NO: 3536521 - RNA, 14 nt, Human
uaaauauuuccuua

SEQ ID NO: 3536522 - RNA, 18 nt, Human
uaaauauuuuaaagaauu

SEQ ID NO: 3536523 - RNA, 17 nt, Human
uaaauauuuucuauuuu

SEQ ID NO: 3536524 - RNA, 22 nt, Human
uaaauauuuuuucuuuucuauu

SEQ ID NO: 3536525 - RNA, 19 nt, Human
uaaaucaaguuggcuucua

SEQ ID NO: 3536526 - RNA, 14 nt, Human
uaaaucaaugucac

SEQ ID NO: 3536527 - RNA, 23 nt, Human
uaaaucaaugucacuuaaaggcu

SEQ ID NO: 3536528 - RNA, 14 nt, Human
uaaaucacauccuu

SEQ ID NO: 3536529 - RNA, 18 nt, Human
uaaaucacgcuuuuugaa

SEQ ID NO: 3536530 - RNA, 22 nt, Human
uaaaucacgcuuuuugaaaaag

SEQ ID NO: 3536531 - RNA, 22 nt, Human
uaaaucagauguuuuggucaag

SEQ ID NO: 3536532 - RNA, 17 nt, Human
uaaaucaguaagaggug

SEQ ID NO: 3536533 - RNA, 16 nt, Human
uaaaucauaaagucag

SEQ ID NO: 3536534 - RNA, 17 nt, Human
uaaaucauaaagucagu

SEQ ID NO: 3536535 - RNA, 21 nt, Human
uaaaucauguuaauccuagcu

SEQ ID NO: 3536536 - RNA, 13 nt, Human
uaaaucauuuuau

SEQ ID NO: 3536537 - RNA, 16 nt, Human
uaaauccauuuggaaa

SEQ ID NO: 3536538 - RNA, 22 nt, Human
uaaauccauuuggaaaucuuua

SEQ ID NO: 3536539 - RNA, 16 nt, Human
uaaaucccauuauuca

SEQ ID NO: 3536540 - RNA, 19 nt, Human
uaaaucccauuauucaaag

SEQ ID NO: 3536541 - RNA, 14 nt, Human
uaaauccugaagag

SEQ ID NO: 3536542 - RNA, 11 nt, Human
uaaauccuguu

SEQ ID NO: 3536543 - RNA, 16 nt, Human
uaaauccuguugaaaa

SEQ ID NO: 3536544 - RNA, 18 nt, Human
uaaauccuguugaaaagc

SEQ ID NO: 3536545 - RNA, 23 nt, Human
guuuccuuuucugucucucucuu

SEQ ID NO: 3536546 - RNA, 21 nt, Human
guuucgagaagcugcucugga

SEQ ID NO: 3536547 - RNA, 15 nt, Human
guuucguggggaggu

SEQ ID NO: 3536548 - RNA, 15 nt, Human
guuucguuucuguau

SEQ ID NO: 3536549 - RNA, 17 nt, Human
guuucuaaacuggagac

SEQ ID NO: 3536550 - RNA, 14 nt, Human
guuucuaaagcugc

SEQ ID NO: 3536551 - RNA, 23 nt, Human
guuucuaaaggcuaccuuuguau

SEQ ID NO: 3536552 - RNA, 17 nt, Human
guuucuaagauucuaaa

SEQ ID NO: 3536553 - RNA, 20 nt, Human
guuucuaagauucuaaaggu

SEQ ID NO: 3536554 - RNA, 21 nt, Human
guuucuaagguaacaagauga

SEQ ID NO: 3536555 - RNA, 22 nt, Human
guuucuaagguccgguguucua

SEQ ID NO: 3536556 - RNA, 16 nt, Human
guuucuaccucccaga

SEQ ID NO: 3536557 - RNA, 15 nt, Human
guuucuagggaaaug

SEQ ID NO: 3536558 - RNA, 23 nt, Human
guuucuagguaauuuuuacagaa

SEQ ID NO: 3536559 - RNA, 20 nt, Human
guuucuaugaguggaaaaag

SEQ ID NO: 3536560 - RNA, 14 nt, Human
guuucucaaagaaa

SEQ ID NO: 3536561 - RNA, 18 nt, Human
guuucucaaagaaauuuc

SEQ ID NO: 3536562 - RNA, 15 nt, Human
guuucucagcuccca

SEQ ID NO: 3536563 - RNA, 19 nt, Human
guuucucagcucccauuuc

SEQ ID NO: 3536564 - RNA, 17 nt, Human
guuucucccccauguuc

SEQ ID NO: 3536565 - RNA, 20 nt, Human
guuuugaagauucuauguua

SEQ ID NO: 3536566 - RNA, 12 nt, Human
uaaauuguuuga

SEQ ID NO: 3536567 - RNA, 20 nt, Human
uaaauuuaaagauauuguuc

SEQ ID NO: 3536568 - RNA, 21 nt, Human
uaaauuuaaagauauuguuca

SEQ ID NO: 3536569 - RNA, 15 nt, Human
uaaauuuaaauuuaa

SEQ ID NO: 3536570 - RNA, 18 nt, Human
uaaauuuaaauuuaaaga

SEQ ID NO: 3536571 - RNA, 22 nt, Human
uaaauuuaaguaaguuuuauaa

SEQ ID NO: 3536572 - RNA, 14 nt, Human
uaaauuuaguguuu

SEQ ID NO: 3536573 - RNA, 13 nt, Human
uaaauuuauguga

SEQ ID NO: 3536574 - RNA, 15 nt, Human
uaaauuuauuuacug

SEQ ID NO: 3536575 - RNA, 15 nt, Human
uaaauuuauuuucuu

SEQ ID NO: 3536576 - RNA, 22 nt, Human
uaaauuuccccaacagugugaa

SEQ ID NO: 3536577 - RNA, 23 nt, Human
uaaauuuccccaacagugugaag

SEQ ID NO: 3536578 - RNA, 15 nt, Human
uaaauuucuuaugug

SEQ ID NO: 3536579 - RNA, 16 nt, Human
uaaauuucuuauguga

SEQ ID NO: 3536580 - RNA, 15 nt, Human
uaaauuugauacuua

SEQ ID NO: 3536581 - RNA, 18 nt, Human
uaaauuugauacuuauau

SEQ ID NO: 3536582 - RNA, 22 nt, Human
uaaauuugauuuacauauauua

SEQ ID NO: 3536583 - RNA, 21 nt, Human
uaaauuuguacuauuuaacug

SEQ ID NO: 3536584 - RNA, 16 nt, Human
uaaauuuuaaagccau

SEQ ID NO: 3536585 - RNA, 23 nt, Human
uaaauuuuccuguccucuuucag

SEQ ID NO: 3536586 - RNA, 24 nt, Human
uaaauuuuccuguccucuuucagc

SEQ ID NO: 3536587 - RNA, 14 nt, Human
uaaauuuucuucag

SEQ ID NO: 3536588 - RNA, 19 nt, Human
uaaauuuugaguucuacau

SEQ ID NO: 3536589 - RNA, 14 nt, Human
uaaauuuuguaaug

SEQ ID NO: 3536590 - RNA, 13 nt, Human
uaaauuuuuaaga

SEQ ID NO: 3536591 - RNA, 20 nt, Human
uaaauuuuuuguugacauua

SEQ ID NO: 3536592 - RNA, 17 nt, Human
uaaauuuuuuuguauga

SEQ ID NO: 3536593 - RNA, 19 nt, Human
uaaauuuuuuuuguuucau

SEQ ID NO: 3536594 - RNA, 23 nt, Human
uaacaaaaaaauauauuuaauga

SEQ ID NO: 3536595 - RNA, 22 nt, Human
uaacaaaacacucggcauuuca

SEQ ID NO: 3536596 - RNA, 14 nt, Human
uaacaaaagaugaa

SEQ ID NO: 3536597 - RNA, 18 nt, Human
uaacaaaagaugaaagca

SEQ ID NO: 3536598 - RNA, 11 nt, Human
uaacaaaaugg

SEQ ID NO: 3536599 - RNA, 20 nt, Human
uaacaaaauguaugucuggu

SEQ ID NO: 3536600 - RNA, 22 nt, Human
uaacaaacaucacucugcugcu

SEQ ID NO: 3536601 - RNA, 13 nt, Human
uaacaaagacaaa

SEQ ID NO: 3536602 - RNA, 12 nt, Human
uaacaaauaaaa

SEQ ID NO: 3536603 - RNA, 18 nt, Human
uaacaaauaacaacuuuu

SEQ ID NO: 3536604 - RNA, 16 nt, Human
uaacaacagcuggugc

SEQ ID NO: 3536605 - RNA, 21 nt, Human
uaacaacauguuuccagcauu

SEQ ID NO: 3536606 - RNA, 18 nt, Human
uaacaagaaacucacccc

SEQ ID NO: 3536607 - RNA, 15 nt, Human
uaacaagaagaugaa

SEQ ID NO: 3536608 - RNA, 16 nt, Human
uaacaagaagaugaau

SEQ ID NO: 3536609 - RNA, 14 nt, Human
uaacaagagugauu

SEQ ID NO: 3536610 - RNA, 20 nt, Human
uaacaagagugauucuugcu

SEQ ID NO: 3536611 - RNA, 15 nt, Human
uaacaagccagauuu

SEQ ID NO: 3536612 - RNA, 15 nt, Human
uaacaagcucccagg

SEQ ID NO: 3536613 - RNA, 16 nt, Human
uaacaaguaccaaagu

SEQ ID NO: 3536614 - RNA, 16 nt, Human
uaacaauaacuacugu

SEQ ID NO: 3536615 - RNA, 14 nt, Human
uaacaauacaaaug

SEQ ID NO: 3536616 - RNA, 17 nt, Human
uaacaaugcgaauggua

SEQ ID NO: 3536617 - RNA, 17 nt, Human
uaacaaugcuguauuuu

SEQ ID NO: 3536618 - RNA, 19 nt, Human
uaacaaugcuguauuuuaa

SEQ ID NO: 3536619 - RNA, 14 nt, Human
uaacaauguauuuu

SEQ ID NO: 3536620 - RNA, 21 nt, Human
uaacaauguuaaggaaacucu

SEQ ID NO: 3536621 - RNA, 13 nt, Human
uaacaauuccucu

SEQ ID NO: 3536622 - RNA, 22 nt, Human
uaacaauuucuguccuucagau

SEQ ID NO: 3536623 - RNA, 13 nt, Human
uaacacacagcua

SEQ ID NO: 3536624 - RNA, 14 nt, Human
uaacacacagcucc

SEQ ID NO: 3536625 - RNA, 15 nt, Human
uaacacacagcuccc

SEQ ID NO: 3536626 - RNA, 20 nt, Human
uaacacacauaaaggauaaa

SEQ ID NO: 3536627 - RNA, 12 nt, Human
uaacacagagag

SEQ ID NO: 3536628 - RNA, 17 nt, Human
uaacacagcauguguau

SEQ ID NO: 3536629 - RNA, 18 nt, Human
uaacaccaugauuaacca

SEQ ID NO: 3536630 - RNA, 15 nt, Human
uaacacccuuccuuc

SEQ ID NO: 3536631 - RNA, 24 nt, Human
uaacacccuuccuucuguaaauac

SEQ ID NO: 3536632 - RNA, 18 nt, Human
uaacaccugauuaacuga

SEQ ID NO: 3536633 - RNA, 19 nt, Human
uaacaccugauuaacugag

SEQ ID NO: 3536634 - RNA, 23 nt, Human
uaacacuaauauauuuaaaaaua

SEQ ID NO: 3536635 - RNA, 14 nt, Human
uaacacuacucaaa

SEQ ID NO: 3536636 - RNA, 23 nt, Human
uaacacuagucugugugcugugg

SEQ ID NO: 3536637 - RNA, 16 nt, Human
uaacacuauaaagguu

SEQ ID NO: 3536638 - RNA, 14 nt, Human
uaacacuauuuuau

SEQ ID NO: 3536639 - RNA, 20 nt, Human
uaacacucagaagccugggg

SEQ ID NO: 3536640 - RNA, 21 nt, Human
uaacacucagaagccuggggg

SEQ ID NO: 3536641 - RNA, 13 nt, Human
uaacacuggcccc

SEQ ID NO: 3536642 - RNA, 16 nt, Human
uaacacugugaagagc

SEQ ID NO: 3536643 - RNA, 11 nt, Human
uaacagaaagg

SEQ ID NO: 3536644 - RNA, 23 nt, Human
uaacagaaagggcaacaauaaaa

SEQ ID NO: 3536645 - RNA, 11 nt, Human
uaacagaaaug

SEQ ID NO: 3536646 - RNA, 14 nt, Human
uaacagaaauguac

SEQ ID NO: 3536647 - RNA, 15 nt, Human
uaacagaaauuguau

SEQ ID NO: 3536648 - RNA, 17 nt, Human
uaacagaaauuguauau

SEQ ID NO: 3536649 - RNA, 12 nt, Human
uaacagaacagc

SEQ ID NO: 3536650 - RNA, 14 nt, Human
uaacagaacagcuu

SEQ ID NO: 3536651 - RNA, 16 nt, Human
uaacagaacagcuuca

SEQ ID NO: 3536652 - RNA, 14 nt, Human
uaacagaagaaaau

SEQ ID NO: 3536653 - RNA, 19 nt, Human
uaacagaagggagggcaga

SEQ ID NO: 3536654 - RNA, 14 nt, Human
uaacagacauuguu

SEQ ID NO: 3536655 - RNA, 12 nt, Human
uaacagaugcaa

SEQ ID NO: 3536656 - RNA, 18 nt, Human
uaacagcaacacaaagcu

SEQ ID NO: 3536657 - RNA, 15 nt, Human
uaacagcaccaaauc

SEQ ID NO: 3536658 - RNA, 23 nt, Human
uaacagcauccccaaaacaaagu

SEQ ID NO: 3536659 - RNA, 17 nt, Human
uaacagcccuccucugc

SEQ ID NO: 3536660 - RNA, 18 nt, Human
uaacagcccuccucugca

SEQ ID NO: 3536661 - RNA, 15 nt, Human
uaacagccgcuccag

SEQ ID NO: 3536662 - RNA, 16 nt, Human
uaacagccgcuccaga

SEQ ID NO: 3536663 - RNA, 18 nt, Human
uaacagcuaccaugacaa

SEQ ID NO: 3536664 - RNA, 11 nt, Human
uaacagcuccu

SEQ ID NO: 3536665 - RNA, 19 nt, Human
uaacagcugaauuaucuau

SEQ ID NO: 3536666 - RNA, 12 nt, Human
uaacagcugcaa

SEQ ID NO: 3536667 - RNA, 12 nt, Human
uaacagcugugg

SEQ ID NO: 3536668 - RNA, 13 nt, Human
uaacaggcaaaca

SEQ ID NO: 3536669 - RNA, 15 nt, Human
uaacaggccaaagag

SEQ ID NO: 3536670 - RNA, 19 nt, Human
uaacaggcucaaacaauga

SEQ ID NO: 3536671 - RNA, 14 nt, Human
uaacaggcuucugg

SEQ ID NO: 3536672 - RNA, 16 nt, Human
uaacagggaaggcagg

SEQ ID NO: 3536673 - RNA, 19 nt, Human
uaacagggaaggcaggcag

SEQ ID NO: 3536674 - RNA, 17 nt, Human
uaacagggauugauuuu

SEQ ID NO: 3536675 - RNA, 18 nt, Human
uaacaggguaaauuauuc

SEQ ID NO: 3536676 - RNA, 14 nt, Human
uaacagguauuuug

SEQ ID NO: 3536677 - RNA, 19 nt, Human
uaacagguauuuuguuucu

SEQ ID NO: 3536678 - RNA, 20 nt, Human
uaacagguauuuuguuucuu

SEQ ID NO: 3536679 - RNA, 13 nt, Human
uaacaggucuccu

SEQ ID NO: 3536680 - RNA, 14 nt, Human
uaacaggucuccuc

SEQ ID NO: 3536681 - RNA, 15 nt, Human
uaacaggucuccucu

SEQ ID NO: 3536682 - RNA, 21 nt, Human
uaacagguuauuuuaguuucu

SEQ ID NO: 3536683 - RNA, 22 nt, Human
uaacagguuauuuuaguuucug

SEQ ID NO: 3536684 - RNA, 15 nt, Human
uaacaguaucucaaa

SEQ ID NO: 3536685 - RNA, 18 nt, Human
uaacagucauuuaaaaaa

SEQ ID NO: 3536686 - RNA, 20 nt, Human
uaacagugccauugucuuua

SEQ ID NO: 3536687 - RNA, 23 nt, Human
uaacagugccauugucuuuauau

SEQ ID NO: 3536688 - RNA, 17 nt, Human
uaacaguggacaaaguu

SEQ ID NO: 3536689 - RNA, 14 nt, Human
uaacaguguuuaaa

SEQ ID NO: 3536690 - RNA, 21 nt, Human
uaacaguucacuugcagugga

SEQ ID NO: 3536691 - RNA, 18 nt, Human
uaacaguucauguuugcu

SEQ ID NO: 3536692 - RNA, 17 nt, Human
uaacaguuccuuucaaa

SEQ ID NO: 3536693 - RNA, 18 nt, Human
uaacaguuguauuuaaca

SEQ ID NO: 3536694 - RNA, 19 nt, Human
uaacaguuguauuuaacag

SEQ ID NO: 3536695 - RNA, 23 nt, Human
uaacaguuguauuuaacagaaau

SEQ ID NO: 3536696 - RNA, 14 nt, Human
uaacaguuuuccau

SEQ ID NO: 3536697 - RNA, 12 nt, Human
uaacauaaaucu

SEQ ID NO: 3536698 - RNA, 18 nt, Human
uaacauaaaucugugaac

SEQ ID NO: 3536699 - RNA, 20 nt, Human
uaacauaaaucugugaacuu

SEQ ID NO: 3536700 - RNA, 12 nt, Human
uaacauaaauuu

SEQ ID NO: 3536701 - RNA, 19 nt, Human
uaacauaagcuauuuuucu

SEQ ID NO: 3536702 - RNA, 19 nt, Human
uaacauaauuuguacauau

SEQ ID NO: 3536703 - RNA, 17 nt, Human
uaacauagaauugcaau

SEQ ID NO: 3536704 - RNA, 19 nt, Human
uaacauaguaaguucagca

SEQ ID NO: 3536705 - RNA, 21 nt, Human
uaacauaugcaguguucuaca

SEQ ID NO: 3536706 - RNA, 20 nt, Human
uaacauauguacauaaauug

SEQ ID NO: 3536707 - RNA, 13 nt, Human
uaacauauuuacu

SEQ ID NO: 3536708 - RNA, 22 nt, Human
uaacauauuuacuaagccacaa

SEQ ID NO: 3536709 - RNA, 23 nt, Human
uaacauccuuucuauugaaaaau

SEQ ID NO: 3536710 - RNA, 20 nt, Human
uaaaguguccauugacaugu

SEQ ID NO: 3536711 - RNA, 13 nt, Human
uaaagugugugau

SEQ ID NO: 3536712 - RNA, 20 nt, Human
uaaaguguucugccagaucu

SEQ ID NO: 3536713 - RNA, 12 nt, Human
uaaaguguuuca

SEQ ID NO: 3536714 - RNA, 21 nt, Human
uaaaguguuucagcuaaggga

SEQ ID NO: 3536715 - RNA, 13 nt, Human
uaaaguguuuuca

SEQ ID NO: 3536716 - RNA, 16 nt, Human
uaaaguuacuuuguca

SEQ ID NO: 3536717 - RNA, 14 nt, Human
uaaaguuagaaucu

SEQ ID NO: 3536718 - RNA, 19 nt, Human
uaaaguuagaaucuauuuu

SEQ ID NO: 3536719 - RNA, 15 nt, Human
uaaaguuagucuacu

SEQ ID NO: 3536720 - RNA, 16 nt, Human
uaaaguuauauuucag

SEQ ID NO: 3536721 - RNA, 19 nt, Human
uaaaguuauucuugaaguc

SEQ ID NO: 3536722 - RNA, 13 nt, Human
uaaaguucuaaga

SEQ ID NO: 3536723 - RNA, 22 nt, Human
uaaaguucuaagauucugauuu

SEQ ID NO: 3536724 - RNA, 17 nt, Human
uaaaguucugaguguuu

SEQ ID NO: 3536725 - RNA, 12 nt, Human
uaaaguucugug

SEQ ID NO: 3536726 - RNA, 23 nt, Human
uaaaguucuguguauuuaauugu

SEQ ID NO: 3536727 - RNA, 16 nt, Human
uaaaguugguaaaccu

SEQ ID NO: 3536728 - RNA, 17 nt, Human
uaaaguugguaaaccuu

SEQ ID NO: 3536729 - RNA, 20 nt, Human
uaaaguugguauuaauaaaa

SEQ ID NO: 3536730 - RNA, 18 nt, Human
uaaaguugguuggauaag

SEQ ID NO: 3536731 - RNA, 14 nt, Human
uaaaguuuacagua

SEQ ID NO: 3536732 - RNA, 19 nt, Human
uaaaguuucaaaaaucuga

SEQ ID NO: 3536733 - RNA, 13 nt, Human
uaaaguuucucag

SEQ ID NO: 3536734 - RNA, 12 nt, Human
uaaaguuugauc

SEQ ID NO: 3536735 - RNA, 14 nt, Human
uaaaguuugcuuag

SEQ ID NO: 3536736 - RNA, 18 nt, Human
uaaaguuugcuuguuucu

SEQ ID NO: 3536737 - RNA, 18 nt, Human
uaaaguuuuauauauuau

SEQ ID NO: 3536738 - RNA, 19 nt, Human
uaaaguuuuauauauuaua

SEQ ID NO: 3536739 - RNA, 17 nt, Human
uaaauaaaaauaauccu

SEQ ID NO: 3536740 - RNA, 14 nt, Human
uaaauaaaaaugga

SEQ ID NO: 3536741 - RNA, 15 nt, Human
uaaauaaaaaugucu

SEQ ID NO: 3536742 - RNA, 21 nt, Human
uaaauaaaacauuuucacaca

SEQ ID NO: 3536743 - RNA, 21 nt, Human
uaaauaaaagaaaaaauaucu

SEQ ID NO: 3536744 - RNA, 14 nt, Human
uaaauaaaagcagc

SEQ ID NO: 3536745 - RNA, 18 nt, Human
uaaauaaaaguuuuacaa

SEQ ID NO: 3536746 - RNA, 22 nt, Human
uaaauaaaaguuuuacaaaggg

SEQ ID NO: 3536747 - RNA, 16 nt, Human
uaaauaaaauauaauu

SEQ ID NO: 3536748 - RNA, 12 nt, Human
uaaauaaaauca

SEQ ID NO: 3536749 - RNA, 14 nt, Human
uaaauaaaauuugu

SEQ ID NO: 3536750 - RNA, 14 nt, Human
uaaauaaaccacug

SEQ ID NO: 3536751 - RNA, 22 nt, Human
uaaauaaaccucaaaaugucua

SEQ ID NO: 3536752 - RNA, 20 nt, Human
uaaauaaacuuuuuuucaau

SEQ ID NO: 3536753 - RNA, 22 nt, Human
uaaauaaacuuuuuuucaaugu

SEQ ID NO: 3536754 - RNA, 23 nt, Human
uaaauaaacuuuuuuucaaugug

SEQ ID NO: 3536755 - RNA, 15 nt, Human
uaaauaaaguaucau

SEQ ID NO: 3536756 - RNA, 17 nt, Human
uaaauaaauaaauagcu

SEQ ID NO: 3536757 - RNA, 14 nt, Human
uaaauaaauagcua

SEQ ID NO: 3536758 - RNA, 22 nt, Human
uaaauaaauguaucuuauucac

SEQ ID NO: 3536759 - RNA, 18 nt, Human
uaaauaaaugucauuaaa

SEQ ID NO: 3536760 - RNA, 12 nt, Human
uaaauaaauugu

SEQ ID NO: 3536761 - RNA, 14 nt, Human
uaaauaaauuguau

SEQ ID NO: 3536762 - RNA, 16 nt, Human
uaaauaaauuguauau

SEQ ID NO: 3536763 - RNA, 14 nt, Human
uaaauaaauuugac

SEQ ID NO: 3536764 - RNA, 13 nt, Human
uaaauaacuuuuu

SEQ ID NO: 3536765 - RNA, 11 nt, Human
uaaauaagaaa

SEQ ID NO: 3536766 - RNA, 16 nt, Human
uaaauaagaaacuuuu

SEQ ID NO: 3536767 - RNA, 13 nt, Human
uaaauaagagauu

SEQ ID NO: 3536768 - RNA, 18 nt, Human
uaaauaagauucuaacgg

SEQ ID NO: 3536769 - RNA, 14 nt, Human
uaaauaauacauua

SEQ ID NO: 3536770 - RNA, 16 nt, Human
uaaauaaucuuacucu

SEQ ID NO: 3536771 - RNA, 17 nt, Human
uaaauaaugcuucagau

SEQ ID NO: 3536772 - RNA, 14 nt, Human
uaaauaauuuauuu

SEQ ID NO: 3536773 - RNA, 22 nt, Human
uaaauaauuuccuacacaaaug

SEQ ID NO: 3536774 - RNA, 17 nt, Human
uaaauacagacacuaag

SEQ ID NO: 3536775 - RNA, 19 nt, Human
uaaauacagacacuaaguu

SEQ ID NO: 3536776 - RNA, 14 nt, Human
uaaauacaggaaac

SEQ ID NO: 3536777 - RNA, 13 nt, Human
uaaauacagucuu

SEQ ID NO: 3536778 - RNA, 20 nt, Human
uaaauacagucuuccauuug

SEQ ID NO: 3536779 - RNA, 20 nt, Human
uaaauacaugcauauaauga

SEQ ID NO: 3536780 - RNA, 19 nt, Human
uaagugcguguguagaguu

SEQ ID NO: 3536781 - RNA, 21 nt, Human
uaagugcguguguagaguuaa

SEQ ID NO: 3536782 - RNA, 23 nt, Human
uaagugcguguguagaguuaaga

SEQ ID NO: 3536783 - RNA, 15 nt, Human
uaagugcugcauuua

SEQ ID NO: 3536784 - RNA, 18 nt, Human
uaagugcugcauuuaaaa

SEQ ID NO: 3536785 - RNA, 22 nt, Human
uaagugcuguauaaaaucagcc

SEQ ID NO: 3536786 - RNA, 23 nt, Human
uaagugcuguauaaaaucagcca

SEQ ID NO: 3536787 - RNA, 16 nt, Human
uaagugguguguguau

SEQ ID NO: 3536788 - RNA, 23 nt, Human
uaaguguauuuuucaauaaagca

SEQ ID NO: 3536789 - RNA, 14 nt, Human
uaaguguuguaaau

SEQ ID NO: 3536790 - RNA, 14 nt, Human
uaaguuaauuuaaa

SEQ ID NO: 3536791 - RNA, 19 nt, Human
uaaguuacuauccuggcuu

SEQ ID NO: 3536792 - RNA, 19 nt, Human
uaaguuaguuccacugaga

SEQ ID NO: 3536793 - RNA, 14 nt, Human
uaaguuauaagacu

SEQ ID NO: 3536794 - RNA, 20 nt, Human
uaaguuauuaagagguaaga

SEQ ID NO: 3536795 - RNA, 22 nt, Human
uaaguuauuaagagguaagacu

SEQ ID NO: 3536796 - RNA, 15 nt, Human
uaaguuauuuuaccu

SEQ ID NO: 3536797 - RNA, 18 nt, Human
uaaguuauuuuaccuguu

SEQ ID NO: 3536798 - RNA, 20 nt, Human
uaaguuauuuuuacauucug

SEQ ID NO: 3536799 - RNA, 19 nt, Human
uaaguuauuuuuguacaug

SEQ ID NO: 3536800 - RNA, 17 nt, Human
uaaguucacauuagaau

SEQ ID NO: 3536801 - RNA, 14 nt, Human
uaaguucagcacuu

SEQ ID NO: 3536802 - RNA, 17 nt, Human
uaaguucuuagauaucu

SEQ ID NO: 3536803 - RNA, 19 nt, Human
uaaguucuuagauaucuuu

SEQ ID NO: 3536804 - RNA, 12 nt, Human
uaaguucuuaug

SEQ ID NO: 3536805 - RNA, 23 nt, Human
uaaguuggaaacacuaaauguua

SEQ ID NO: 3536806 - RNA, 16 nt, Human
uaaguugggcuugcua

SEQ ID NO: 3536807 - RNA, 18 nt, Human
uaaguugggcuugcuauu

SEQ ID NO: 3536808 - RNA, 19 nt, Human
uaaguugggcuugcuauuc

SEQ ID NO: 3536809 - RNA, 18 nt, Human
uaaguuuaugucuaaaga

SEQ ID NO: 3536810 - RNA, 23 nt, Human
uaaguuucaaacuuacuauuuug

SEQ ID NO: 3536811 - RNA, 16 nt, Human
uaaguuucaggugaca

SEQ ID NO: 3536812 - RNA, 17 nt, Human
uaaguuucaggugacau

SEQ ID NO: 3536813 - RNA, 20 nt, Human
uaaguuucaggugacaugug

SEQ ID NO: 3536814 - RNA, 19 nt, Human
uaaguuuccuuccagccca

SEQ ID NO: 3536815 - RNA, 16 nt, Human
uaaguuucuaagauuc

SEQ ID NO: 3536816 - RNA, 17 nt, Human
uaaguuucuaagauucu

SEQ ID NO: 3536817 - RNA, 21 nt, Human
uaaguuucuaagauucuaaag

SEQ ID NO: 3536818 - RNA, 19 nt, Human
uaaguuucucagcucccau

SEQ ID NO: 3536819 - RNA, 23 nt, Human
uaaguuucucagcucccauuucu

SEQ ID NO: 3536820 - RNA, 13 nt, Human
uaaguuugcacuc

SEQ ID NO: 3536821 - RNA, 21 nt, Human
uaaguuuggcaaacagaaugu

SEQ ID NO: 3536822 - RNA, 21 nt, Human
uaaguuuugacaagcuggcuu

SEQ ID NO: 3536823 - RNA, 16 nt, Human
uaauaaaaaaagaaag

SEQ ID NO: 3536824 - RNA, 19 nt, Human
uaauaaaaaaagaaagcau

SEQ ID NO: 3536825 - RNA, 15 nt, Human
uaauaaaaaauggaa

SEQ ID NO: 3536826 - RNA, 15 nt, Human
uaauaaaaaauuaug

SEQ ID NO: 3536827 - RNA, 16 nt, Human
uaauaaaaagauugaa

SEQ ID NO: 3536828 - RNA, 14 nt, Human
uaauaaaaaggcac

SEQ ID NO: 3536829 - RNA, 14 nt, Human
uaauaaaaagguga

SEQ ID NO: 3536830 - RNA, 11 nt, Human
uaauaaaacug

SEQ ID NO: 3536831 - RNA, 12 nt, Human
uaauaaaacuga

SEQ ID NO: 3536832 - RNA, 22 nt, Human
uaauaaaacuuaacuuccaaug

SEQ ID NO: 3536833 - RNA, 18 nt, Human
uaauaaaauaauucuaaa

SEQ ID NO: 3536834 - RNA, 15 nt, Human
uaauaaaauaucauu

SEQ ID NO: 3536835 - RNA, 18 nt, Human
uaauaaaauaucauucag

SEQ ID NO: 3536836 - RNA, 20 nt, Human
uaauaaaauaucauucagca

SEQ ID NO: 3536837 - RNA, 15 nt, Human
uaauaaaauauuuuc

SEQ ID NO: 3536838 - RNA, 19 nt, Human
uaauaaaauauuuucugug

SEQ ID NO: 3536839 - RNA, 18 nt, Human
uaauaaaauguguugaaa

SEQ ID NO: 3536840 - RNA, 22 nt, Human
uaauaaaauguguugaaacugc

SEQ ID NO: 3536841 - RNA, 12 nt, Human
uaauaaacacuc

SEQ ID NO: 3536842 - RNA, 15 nt, Human
uaauaaacauaauga

SEQ ID NO: 3536843 - RNA, 20 nt, Human
uaauaaacuaauaauugcag

SEQ ID NO: 3536844 - RNA, 17 nt, Human
uaauaaacuuuaauaua

SEQ ID NO: 3536845 - RNA, 21 nt, Human
uaauaaacuuuuuuuugagaa

SEQ ID NO: 3536846 - RNA, 20 nt, Human
uaauaaagaauuaacagaga

SEQ ID NO: 3536847 - RNA, 13 nt, Human
uaauaaagacagg

SEQ ID NO: 3536848 - RNA, 15 nt, Human
uaauaaagacucuac

SEQ ID NO: 3536849 - RNA, 17 nt, Human
uaauaaagaugcucuuu

SEQ ID NO: 3536850 - RNA, 15 nt, Human
uaauaaagcuacuga

SEQ ID NO: 3536851 - RNA, 16 nt, Human
uaauaaagcuacugau

SEQ ID NO: 3536852 - RNA, 12 nt, Human
uaauaaaggacu

SEQ ID NO: 3536853 - RNA, 13 nt, Human
uaauaaaggacug

SEQ ID NO: 3536854 - RNA, 20 nt, Human
uaauaaaggacuguaaucuu

SEQ ID NO: 3536855 - RNA, 20 nt, Human
gcagcaggccuguugcuuuu

SEQ ID NO: 3536856 - RNA, 18 nt, Human
gcagcagggagggcuucu

SEQ ID NO: 3536857 - RNA, 20 nt, Human
gcagcagggcuacccugagc

SEQ ID NO: 3536858 - RNA, 15 nt, Human
gcagcaggugcugcu

SEQ ID NO: 3536859 - RNA, 16 nt, Human
gcagcaggugcugcua

SEQ ID NO: 3536860 - RNA, 22 nt, Human
gcagcaggugcugcuacccucc

SEQ ID NO: 3536861 - RNA, 15 nt, Human
gcagcagugaaaaca

SEQ ID NO: 3536862 - RNA, 16 nt, Human
gcagcagugaaaacaa

SEQ ID NO: 3536863 - RNA, 19 nt, Human
gcagcagugugaggccagg

SEQ ID NO: 3536864 - RNA, 21 nt, Human
gcagcagugugaggccagggc

SEQ ID NO: 3536865 - RNA, 20 nt, Human
gcagcaucucuaccuucucc

SEQ ID NO: 3536866 - RNA, 20 nt, Human
gcagcauggucccugccuua

SEQ ID NO: 3536867 - RNA, 13 nt, Human
gcagccaagcucc

SEQ ID NO: 3536868 - RNA, 17 nt, Human
gcagccaagcuccuugg

SEQ ID NO: 3536869 - RNA, 17 nt, Human
gcagccaaguagccucu

SEQ ID NO: 3536870 - RNA, 20 nt, Human
gcagccacacuucucaggac

SEQ ID NO: 3536871 - RNA, 21 nt, Human
gcagccacacuucucaggaca

SEQ ID NO: 3536872 - RNA, 14 nt, Human
gcagccacccugag

SEQ ID NO: 3536873 - RNA, 15 nt, Human
gcagccacccugagg

SEQ ID NO: 3536874 - RNA, 21 nt, Human
gcagccacccugaggagucug

SEQ ID NO: 3536875 - RNA, 19 nt, Human
gcagccagaccagcaggcu

SEQ ID NO: 3536876 - RNA, 14 nt, Human
gcagccagcaucug

SEQ ID NO: 3536877 - RNA, 15 nt, Human
gcagccagcaucugg

SEQ ID NO: 3536878 - RNA, 11 nt, Human
gcagccagccc

SEQ ID NO: 3536879 - RNA, 15 nt, Human
gcagccagcccagcc

SEQ ID NO: 3536880 - RNA, 14 nt, Human
gcagccagcccugc

SEQ ID NO: 3536881 - RNA, 15 nt, Human
gcagccagcccugcc

SEQ ID NO: 3536882 - RNA, 21 nt, Human
gcagccagcccugccuggagg

SEQ ID NO: 3536883 - RNA, 23 nt, Human
gcagccagccgugagugcagacc

SEQ ID NO: 3536884 - RNA, 18 nt, Human
gcagccagcucucagcca

SEQ ID NO: 3536885 - RNA, 12 nt, Human
gcagccaggaca

SEQ ID NO: 3536886 - RNA, 13 nt, Human
gcagccaggacac

SEQ ID NO: 3536887 - RNA, 12 nt, Human
gcagccaggaga

SEQ ID NO: 3536888 - RNA, 21 nt, Human
gcagccaggagagcuuagggu

SEQ ID NO: 3536889 - RNA, 12 nt, Human
gcagccaggcca

SEQ ID NO: 3536890 - RNA, 14 nt, Human
gcagccaggccaca

SEQ ID NO: 3536891 - RNA, 13 nt, Human
gcagccaggcugc

SEQ ID NO: 3536892 - RNA, 14 nt, Human
gcagccaggcugcc

SEQ ID NO: 3536893 - RNA, 17 nt, Human
gcagccaggcugccaag

SEQ ID NO: 3536894 - RNA, 17 nt, Human
gcagccagggagagccc

SEQ ID NO: 3536895 - RNA, 18 nt, Human
gcagccagggagagccca

SEQ ID NO: 3536896 - RNA, 23 nt, Human
gcagccagggcuuaccuguacac

SEQ ID NO: 3536897 - RNA, 17 nt, Human
gcagccagugcccugag

SEQ ID NO: 3536898 - RNA, 19 nt, Human
gcagccagugcccugagcc

SEQ ID NO: 3536899 - RNA, 22 nt, Human
gcagcccagagacuuuguagau

SEQ ID NO: 3536900 - RNA, 20 nt, Human
gcagcccaugcccaccugcc

SEQ ID NO: 3536901 - RNA, 21 nt, Human
gcagcccauuucuccagaacc

SEQ ID NO: 3536902 - RNA, 14 nt, Human
gcagccccacccag

SEQ ID NO: 3536903 - RNA, 22 nt, Human
gcagccccagcaccaccagguc

SEQ ID NO: 3536904 - RNA, 23 nt, Human
gcagccccagcaccaccaggucu

SEQ ID NO: 3536905 - RNA, 14 nt, Human
gcagccccagccug

SEQ ID NO: 3536906 - RNA, 15 nt, Human
gcagccccagccugc

SEQ ID NO: 3536907 - RNA, 16 nt, Human
gcagccccagccugcu

SEQ ID NO: 3536908 - RNA, 17 nt, Human
gcagccccauucugccu

SEQ ID NO: 3536909 - RNA, 21 nt, Human
gcagccccauucugccugccc

SEQ ID NO: 3536910 - RNA, 24 nt, Human
gcagccccauucugccugcccagg

SEQ ID NO: 3536911 - RNA, 19 nt, Human
gcagcccccacccccaagg

SEQ ID NO: 3536912 - RNA, 23 nt, Human
gcagccccgcgccuccuuccuug

SEQ ID NO: 3536913 - RNA, 21 nt, Human
gcagccccuguucuggcagag

SEQ ID NO: 3536914 - RNA, 15 nt, Human
gcagcccguguggcc

SEQ ID NO: 3536915 - RNA, 17 nt, Human
gcagcccguguggcccc

SEQ ID NO: 3536916 - RNA, 21 nt, Human
gcagcccugagaaagcccugu

SEQ ID NO: 3536917 - RNA, 16 nt, Human
gcagcccugcagaggg

SEQ ID NO: 3536918 - RNA, 19 nt, Human
gcagcccugccccacaccu

SEQ ID NO: 3536919 - RNA, 21 nt, Human
gcagcccugcugcugccugcc

SEQ ID NO: 3536920 - RNA, 14 nt, Human
gcagcccuggaguc

SEQ ID NO: 3536921 - RNA, 18 nt, Human
gcagcccuggagucaugc

SEQ ID NO: 3536922 - RNA, 16 nt, Human
gcagcccuucccccag

SEQ ID NO: 3536923 - RNA, 15 nt, Human
gcagcccuuggccag

SEQ ID NO: 3536924 - RNA, 20 nt, Human
gcagccgccccaucugcccc

SEQ ID NO: 3536925 - RNA, 19 nt, Human
gcagccgccuucacagcag

SEQ ID NO: 3536926 - RNA, 15 nt, Human
gcagccgugaucaag

SEQ ID NO: 3536927 - RNA, 14 nt, Human
gcagccgugccuuc

SEQ ID NO: 3536928 - RNA, 17 nt, Human
gcagccgugccuucagc

SEQ ID NO: 3536929 - RNA, 21 nt, Human
gcagccucaaccuccugggcu

SEQ ID NO: 3536930 - RNA, 17 nt, Human
gcagccucacaguccuu

SEQ ID NO: 3536931 - RNA, 18 nt, Human
gcagccuccaacacaagg

SEQ ID NO: 3536932 - RNA, 22 nt, Human
gcagccucccucugaccugcag

SEQ ID NO: 3536933 - RNA, 23 nt, Human
gcagccucccucugaccugcagg

SEQ ID NO: 3536934 - RNA, 19 nt, Human
gcagccuccgcuucccugg

SEQ ID NO: 3536935 - RNA, 21 nt, Human
gcagccucgaacuccugggcu

SEQ ID NO: 3536936 - RNA, 20 nt, Human
gcagccucgccccuggcaga

SEQ ID NO: 3536937 - RNA, 22 nt, Human
gcagccucucagugcccuccag

SEQ ID NO: 3536938 - RNA, 16 nt, Human
gcagccucuccccagg

SEQ ID NO: 3536939 - RNA, 20 nt, Human
gcagccucuccccaggucca

SEQ ID NO: 3536940 - RNA, 22 nt, Human
gcagccucugaaguuggacagc

SEQ ID NO: 3536941 - RNA, 15 nt, Human
gcagccucugggggg

SEQ ID NO: 3536942 - RNA, 13 nt, Human
gcagccugcgugg

SEQ ID NO: 3536943 - RNA, 22 nt, Human
gcagccugcuucccaccucccu

SEQ ID NO: 3536944 - RNA, 14 nt, Human
gcagccuggacccu

SEQ ID NO: 3536945 - RNA, 19 nt, Human
gcagccuggagcccuggag

SEQ ID NO: 3536946 - RNA, 13 nt, Human
gcagccuggcucc

SEQ ID NO: 3536947 - RNA, 14 nt, Human
gcagccuggcuccc

SEQ ID NO: 3536948 - RNA, 17 nt, Human
gcagccuggcuccccug

SEQ ID NO: 3536949 - RNA, 21 nt, Human
gcagccuggcuccccuggggu

SEQ ID NO: 3536950 - RNA, 17 nt, Human
gcagccuggggcuggcc

SEQ ID NO: 3536951 - RNA, 18 nt, Human
gcagccuggguggcuaug

SEQ ID NO: 3536952 - RNA, 19 nt, Human
gcagccuguccugggcugg

SEQ ID NO: 3536953 - RNA, 23 nt, Human
gcagccuguccugggcugguggc

SEQ ID NO: 3536954 - RNA, 14 nt, Human
gcagccuguggcau

SEQ ID NO: 3536955 - RNA, 16 nt, Human
gcagccuguggcaucu

SEQ ID NO: 3536956 - RNA, 22 nt, Human
gcagccuguggcaucuuugccu

SEQ ID NO: 3536957 - RNA, 18 nt, Human
gcagccuuugccuccccg

SEQ ID NO: 3536958 - RNA, 13 nt, Human
gcagcgaccaccc

SEQ ID NO: 3536959 - RNA, 14 nt, Human
gcagcgaccacccc

SEQ ID NO: 3536960 - RNA, 22 nt, Human
gcagcgaccaccccugccucca

SEQ ID NO: 3536961 - RNA, 15 nt, Human
gcagcgccaagcaac

SEQ ID NO: 3536962 - RNA, 18 nt, Human
gcagcgccaagcaaccug

SEQ ID NO: 3536963 - RNA, 16 nt, Human
gcagcgcccuuccucu

SEQ ID NO: 3536964 - RNA, 13 nt, Human
gcagcgccuuucc

SEQ ID NO: 3536965 - RNA, 15 nt, Human
gcagcucaaaggcac

SEQ ID NO: 3536966 - RNA, 17 nt, Human
gcagcucaaaggcacag

SEQ ID NO: 3536967 - RNA, 16 nt, Human
gcagcucaagagaucc

SEQ ID NO: 3536968 - RNA, 15 nt, Human
gcagcucaccucucc

SEQ ID NO: 3536969 - RNA, 21 nt, Human
gcagcucaccucucccuugga

SEQ ID NO: 3536970 - RNA, 19 nt, Human
gcagcucagagaggguggg

SEQ ID NO: 3536971 - RNA, 19 nt, Human
gcagcucaucucuguccca

SEQ ID NO: 3536972 - RNA, 12 nt, Human
gcagcucccuca

SEQ ID NO: 3536973 - RNA, 17 nt, Human
gcagcucccuggcuucu

SEQ ID NO: 3536974 - RNA, 20 nt, Human
gcagcuccucugucucgagc

SEQ ID NO: 3536975 - RNA, 12 nt, Human
gcagcucuuccu

SEQ ID NO: 3536976 - RNA, 14 nt, Human
gcagcucuuccugg

SEQ ID NO: 3536977 - RNA, 15 nt, Human
gcagcucuugcccuu

SEQ ID NO: 3536978 - RNA, 17 nt, Human
gcagcucuugcccuucc

SEQ ID NO: 3536979 - RNA, 19 nt, Human
gcagcucuugcccuucccu

SEQ ID NO: 3536980 - RNA, 23 nt, Human
gcagcucuugcccuucccugucc

SEQ ID NO: 3536981 - RNA, 22 nt, Human
gcagcucuugcuaaucaguguc

SEQ ID NO: 3536982 - RNA, 22 nt, Human
gcagcugaaauaugcuggcugg

SEQ ID NO: 3536983 - RNA, 18 nt, Human
gcagcugaaauugaaaag

SEQ ID NO: 3536984 - RNA, 14 nt, Human
gcagcugaccucug

SEQ ID NO: 3536985 - RNA, 21 nt, Human
uacaaauuauaaaaagccacu

SEQ ID NO: 3536986 - RNA, 18 nt, Human
uacaaauuauaauguauu

SEQ ID NO: 3536987 - RNA, 22 nt, Human
uacaaauuauaauguauucaua

SEQ ID NO: 3536988 - RNA, 13 nt, Human
uacaaauucaagc

SEQ ID NO: 3536989 - RNA, 21 nt, Human
uacaaauugcuuacuuuggaa

SEQ ID NO: 3536990 - RNA, 17 nt, Human
uacaacacaaagagaaa

SEQ ID NO: 3536991 - RNA, 14 nt, Human
uacaacagauuugu

SEQ ID NO: 3536992 - RNA, 15 nt, Human
uacaacagauuugug

SEQ ID NO: 3536993 - RNA, 19 nt, Human
uacaacagauuugugaacu

SEQ ID NO: 3536994 - RNA, 21 nt, Human
uacaacagauuugugaacuca

SEQ ID NO: 3536995 - RNA, 13 nt, Human
uacaacagccuca

SEQ ID NO: 3536996 - RNA, 15 nt, Human
uacaacagccucacu

SEQ ID NO: 3536997 - RNA, 20 nt, Human
uacaacagugcuaaaaaugg

SEQ ID NO: 3536998 - RNA, 21 nt, Human
uacaacauaaucuaguuuaca

SEQ ID NO: 3536999 - RNA, 20 nt, Human
uacaguagugagaagaauau

SEQ ID NO: 3537000 - RNA, 23 nt, Human
uaagaccggaagcuccugguaug

SEQ ID NO: 3537001 - RNA, 16 nt, Human
uaagaccuacuguucu

SEQ ID NO: 3537002 - RNA, 17 nt, Human
uaagaccuacuguucua

SEQ ID NO: 3537003 - RNA, 19 nt, Human
uaagaccuacuguucuaaa

SEQ ID NO: 3537004 - RNA, 21 nt, Human
uaagaccuacuguucuaaagc

SEQ ID NO: 3537005 - RNA, 11 nt, Human
uaagaccuggc

SEQ ID NO: 3537006 - RNA, 17 nt, Human
uaagaccuggcagcucu

SEQ ID NO: 3537007 - RNA, 14 nt, Human
uaagacgacaagga

SEQ ID NO: 3537008 - RNA, 18 nt, Human
uaagacuaaaucuguaag

SEQ ID NO: 3537009 - RNA, 18 nt, Human
uaagacuauauauauaaa

SEQ ID NO: 3537010 - RNA, 18 nt, Human
uaagacucaaauguucua

SEQ ID NO: 3537011 - RNA, 22 nt, Human
uaagacucaaauguucuaaguu

SEQ ID NO: 3537012 - RNA, 16 nt, Human
uaagacucucacacuc

SEQ ID NO: 3537013 - RNA, 16 nt, Human
uaagacuguaaugaau

SEQ ID NO: 3537014 - RNA, 19 nt, Human
uaagacuguaaugaaucua

SEQ ID NO: 3537015 - RNA, 16 nt, Human
uaagacuuaaugagac

SEQ ID NO: 3537016 - RNA, 18 nt, Human
uaagacuuacucuaagau

SEQ ID NO: 3537017 - RNA, 15 nt, Human
uaagacuugugcaug

SEQ ID NO: 3537018 - RNA, 20 nt, Human
uaagacuuugggauaggaaa

SEQ ID NO: 3537019 - RNA, 17 nt, Human
uaagagaaaauguaaau

SEQ ID NO: 3537020 - RNA, 13 nt, Human
uaagagaaacuuu

SEQ ID NO: 3537021 - RNA, 16 nt, Human
uaagagaaacuuuaua

SEQ ID NO: 3537022 - RNA, 12 nt, Human
uaagagaaaugg

SEQ ID NO: 3537023 - RNA, 18 nt, Human
uaagagaaguagaaauca

SEQ ID NO: 3537024 - RNA, 15 nt, Human
uaagagaaguuguaa

SEQ ID NO: 3537025 - RNA, 23 nt, Human
uaagagaauguuauagugaauua

SEQ ID NO: 3537026 - RNA, 15 nt, Human
uaagagacucagccu

SEQ ID NO: 3537027 - RNA, 23 nt, Human
uaagagagaaugagagacacacu

SEQ ID NO: 3537028 - RNA, 17 nt, Human
uaagagagucuauuuac

SEQ ID NO: 3537029 - RNA, 15 nt, Human
uaagagcaccuuccu

SEQ ID NO: 3537030 - RNA, 19 nt, Human
uaagagcaccuuccucacu

SEQ ID NO: 3537031 - RNA, 22 nt, Human
uaagagccauauaaguuugaag

SEQ ID NO: 3537032 - RNA, 20 nt, Human
uaagagcuagcgcugccgca

SEQ ID NO: 3537033 - RNA, 12 nt, Human
uaagagcuauac

SEQ ID NO: 3537034 - RNA, 12 nt, Human
uaagagcucagg

SEQ ID NO: 3537035 - RNA, 15 nt, Human
uaagagcucaggaug

SEQ ID NO: 3537036 - RNA, 22 nt, Human
uaagagcucaggaugagggaaa

SEQ ID NO: 3537037 - RNA, 14 nt, Human
uaagagcugguguc

SEQ ID NO: 3537038 - RNA, 21 nt, Human
uaagagcuuccaauuuuccuu

SEQ ID NO: 3537039 - RNA, 19 nt, Human
uaagagcuuuacaaaaaga

SEQ ID NO: 3537040 - RNA, 20 nt, Human
uaagagcuuuacaaaaagac

SEQ ID NO: 3537041 - RNA, 20 nt, Human
uaagaggcagaaaauugcac

SEQ ID NO: 3537042 - RNA, 15 nt, Human
uaagaggcagggucu

SEQ ID NO: 3537043 - RNA, 15 nt, Human
uaagaggcugauaau

SEQ ID NO: 3537044 - RNA, 12 nt, Human
uaagagggaggg

SEQ ID NO: 3537045 - RNA, 19 nt, Human
uaagagguaagacuuagua

SEQ ID NO: 3537046 - RNA, 16 nt, Human
uaagagguugauuaua

SEQ ID NO: 3537047 - RNA, 18 nt, Human
uaagaguccaagaaucca

SEQ ID NO: 3537048 - RNA, 13 nt, Human
uaagaguguagaa

SEQ ID NO: 3537049 - RNA, 18 nt, Human
uaagaguguagaagcauu

SEQ ID NO: 3537050 - RNA, 19 nt, Human
uaagaguguagaagcauuc

SEQ ID NO: 3537051 - RNA, 13 nt, Human
uaagaguguuuaa

SEQ ID NO: 3537052 - RNA, 22 nt, Human
uaagauaauaauauauguuuac

SEQ ID NO: 3537053 - RNA, 14 nt, Human
uaagauacaaauua

SEQ ID NO: 3537054 - RNA, 15 nt, Human
uaagauauuuuucau

SEQ ID NO: 3537055 - RNA, 18 nt, Human
uaagaucacugccagaga

SEQ ID NO: 3537056 - RNA, 21 nt, Human
uaagaucacugccagagauaa

SEQ ID NO: 3537057 - RNA, 15 nt, Human
uaagaucacuguuua

SEQ ID NO: 3537058 - RNA, 20 nt, Human
uaagaucacuguuuagauuu

SEQ ID NO: 3537059 - RNA, 21 nt, Human
uaagaucacuguuuagauuug

SEQ ID NO: 3537060 - RNA, 17 nt, Human
uaagaucuauagccucu

SEQ ID NO: 3537061 - RNA, 19 nt, Human
uaagaucucagugguuaag

SEQ ID NO: 3537062 - RNA, 18 nt, Human
uaagaucuuuuauuuugc

SEQ ID NO: 3537063 - RNA, 15 nt, Human
uaagaugacauugcu

SEQ ID NO: 3537064 - RNA, 12 nt, Human
uaagaugcuggg

SEQ ID NO: 3537065 - RNA, 19 nt, Human
uaagauggcaggugauguc

SEQ ID NO: 3537066 - RNA, 13 nt, Human
uaagaugugaaaa

SEQ ID NO: 3537067 - RNA, 14 nt, Human
uaagaugugaaaau

SEQ ID NO: 3537068 - RNA, 23 nt, Human
uaagaugugauauucuaagacuu

SEQ ID NO: 3537069 - RNA, 16 nt, Human
uaagaugugucuucaa

SEQ ID NO: 3537070 - RNA, 20 nt, Human
uaagaugugucuucaauuug

SEQ ID NO: 3537071 - RNA, 14 nt, Human
uaagauuauaauug

SEQ ID NO: 3537072 - RNA, 22 nt, Human
uaagauuauagauucuaaagau

SEQ ID NO: 3537073 - RNA, 17 nt, Human
uaagauuccaaaaagca

SEQ ID NO: 3537074 - RNA, 21 nt, Human
uaagauuccagagaguggcuc

SEQ ID NO: 3537075 - RNA, 10 nt, Human
uaagauucua

SEQ ID NO: 3537076 - RNA, 12 nt, Human
uaagauucuaaa

SEQ ID NO: 3537077 - RNA, 13 nt, Human
uaagauucuaaag

SEQ ID NO: 3537078 - RNA, 16 nt, Human
uaagauucuaaagguc

SEQ ID NO: 3537079 - RNA, 13 nt, Human
uaagauucuaacg

SEQ ID NO: 3537080 - RNA, 12 nt, Human
uaagauucuaga

SEQ ID NO: 3537081 - RNA, 21 nt, Human
uaagauucuagaucagaugcu

SEQ ID NO: 3537082 - RNA, 14 nt, Human
uaagauucugauuu

SEQ ID NO: 3537083 - RNA, 18 nt, Human
uaagauuguuauuaaaug

SEQ ID NO: 3537084 - RNA, 14 nt, Human
uaagauuuaauuug

SEQ ID NO: 3537085 - RNA, 18 nt, Human
uaagauuuaauuugccaa

SEQ ID NO: 3537086 - RNA, 15 nt, Human
uaagauuuccuucuu

SEQ ID NO: 3537087 - RNA, 12 nt, Human
uaagauuuguuu

SEQ ID NO: 3537088 - RNA, 12 nt, Human
uaagauuuuaca

SEQ ID NO: 3537089 - RNA, 22 nt, Human
uaagauuuugaaaacuacauuu

SEQ ID NO: 3537090 - RNA, 15 nt, Human
uaagauuuuucucaa

SEQ ID NO: 3537091 - RNA, 15 nt, Human
uaagcaaaagaaaaa

SEQ ID NO: 3537092 - RNA, 15 nt, Human
uaagcaaaaugugau

SEQ ID NO: 3537093 - RNA, 21 nt, Human
uaagcaaaaugugauauguac

SEQ ID NO: 3537094 - RNA, 14 nt, Human
uaagcaaauacuua

SEQ ID NO: 3537095 - RNA, 16 nt, Human
uaagcaacaauuuuca

SEQ ID NO: 3537096 - RNA, 14 nt, Human
uaagcaacaucuuu

SEQ ID NO: 3537097 - RNA, 14 nt, Human
uaagcaacauggcu

SEQ ID NO: 3537098 - RNA, 16 nt, Human
uaagcaacauggcuuu

SEQ ID NO: 3537099 - RNA, 18 nt, Human
uaagcaagagagauguuu

SEQ ID NO: 3537100 - RNA, 21 nt, Human
uaagcaaguuaaguguccucc

SEQ ID NO: 3537101 - RNA, 16 nt, Human
uaagcacuacauaaac

SEQ ID NO: 3537102 - RNA, 13 nt, Human
uaagcacucuuaa

SEQ ID NO: 3537103 - RNA, 13 nt, Human
uaagcacugugcu

SEQ ID NO: 3537104 - RNA, 13 nt, Human
uaagcacuuuuua

SEQ ID NO: 3537105 - RNA, 16 nt, Human
uaagcagaaagugccu

SEQ ID NO: 3537106 - RNA, 19 nt, Human
uaagcagaaagugccuuuc

SEQ ID NO: 3537107 - RNA, 22 nt, Human
uaagcagaaagugccuuucagg

SEQ ID NO: 3537108 - RNA, 21 nt, Human
uaagcagaauuggaaaagacu

SEQ ID NO: 3537109 - RNA, 17 nt, Human
uaagcagaccacugaua

SEQ ID NO: 3537110 - RNA, 13 nt, Human
uaagcagagaagg

SEQ ID NO: 3537111 - RNA, 22 nt, Human
uaagcagcuaaauuuucugaaa

SEQ ID NO: 3537112 - RNA, 17 nt, Human
uaagcagcucuugcuaa

SEQ ID NO: 3537113 - RNA, 18 nt, Human
uaagcagcucuugcuaau

SEQ ID NO: 3537114 - RNA, 22 nt, Human
uaagcagguggaucuauuucau

SEQ ID NO: 3537115 - RNA, 21 nt, Human
uaagcauaagcuuaugcuuaa

SEQ ID NO: 3537116 - RNA, 19 nt, Human
uaagcauacuuuguaaaua

SEQ ID NO: 3537117 - RNA, 22 nt, Human
uaagcauauauuuuuauauuua

SEQ ID NO: 3537118 - RNA, 16 nt, Human
uaagcaucaaacucuu

SEQ ID NO: 3537119 - RNA, 22 nt, Human
uaagcaucauuauuuauguauu

SEQ ID NO: 3537120 - RNA, 23 nt, Human
uaagcaucauuauuuauguauug

SEQ ID NO: 3537121 - RNA, 14 nt, Human
uaagcaucuaaguu

SEQ ID NO: 3537122 - RNA, 22 nt, Human
uaagcaugacagaaaauaugua

SEQ ID NO: 3537123 - RNA, 21 nt, Human
uaagcauuaccacucaggcau

SEQ ID NO: 3537124 - RNA, 16 nt, Human
uaagcauuacucuugu

SEQ ID NO: 3537125 - RNA, 18 nt, Human
uaagcauuacucuuguaa

SEQ ID NO: 3537126 - RNA, 22 nt, Human
uaagcauuacucuuguaagauu

SEQ ID NO: 3537127 - RNA, 15 nt, Human
uaagcauugccuggc

SEQ ID NO: 3537128 - RNA, 18 nt, Human
uaagcauuggguggguaa

SEQ ID NO: 3537129 - RNA, 20 nt, Human
uaagcauuguuugcuuauug

SEQ ID NO: 3537130 - RNA, 21 nt, Human
uaagcauuguuugcuuauugu

SEQ ID NO: 3537131 - RNA, 23 nt, Human
uaagcauuguuugcuuauuguuc

SEQ ID NO: 3537132 - RNA, 17 nt, Human
uaagccaaaauuaaggu

SEQ ID NO: 3537133 - RNA, 19 nt, Human
uaagccaaaauuaaggugu

SEQ ID NO: 3537134 - RNA, 10 nt, Human
uaagccaagg

SEQ ID NO: 3537135 - RNA, 22 nt, Human
uaagccacaagaaauuugauuu

SEQ ID NO: 3537136 - RNA, 17 nt, Human
uaagccacuuaaaaugu

SEQ ID NO: 3537137 - RNA, 23 nt, Human
uaagccagcaccggaccagccug

SEQ ID NO: 3537138 - RNA, 18 nt, Human
uaagccaguguugccuaa

SEQ ID NO: 3537139 - RNA, 17 nt, Human
uaagccaucuugguaaa

SEQ ID NO: 3537140 - RNA, 14 nt, Human
uaagccaugagaau

SEQ ID NO: 3537141 - RNA, 15 nt, Human
uaagccaugggagac

SEQ ID NO: 3537142 - RNA, 20 nt, Human
uaagccauucugacucauau

SEQ ID NO: 3537143 - RNA, 18 nt, Human
uaagcccagugcacugaa

SEQ ID NO: 3537144 - RNA, 13 nt, Human
gcaucucagccca

SEQ ID NO: 3537145 - RNA, 14 nt, Human
gcaucucagcucau

SEQ ID NO: 3537146 - RNA, 17 nt, Human
gcaucucaguaugaauu

SEQ ID NO: 3537147 - RNA, 15 nt, Human
gcaucuccaccugcu

SEQ ID NO: 3537148 - RNA, 14 nt, Human
gcaucuccaggaag

SEQ ID NO: 3537149 - RNA, 20 nt, Human
gcaucucccucacugaaacc

SEQ ID NO: 3537150 - RNA, 22 nt, Human
gcaucuccugaggaucagaaag

SEQ ID NO: 3537151 - RNA, 13 nt, Human
gcaucucugggcu

SEQ ID NO: 3537152 - RNA, 14 nt, Human
gcaucucugggcug

SEQ ID NO: 3537153 - RNA, 20 nt, Human
gcaucucugucccauucccu

SEQ ID NO: 3537154 - RNA, 19 nt, Human
gcaucugacacaaaaaaag

SEQ ID NO: 3537155 - RNA, 14 nt, Human
gcaucugaccagca

SEQ ID NO: 3537156 - RNA, 18 nt, Human
gcaucugaccagcagcgc

SEQ ID NO: 3537157 - RNA, 15 nt, Human
gcaucugauuugcau

SEQ ID NO: 3537158 - RNA, 16 nt, Human
gcaucugauuugcaua

SEQ ID NO: 3537159 - RNA, 21 nt, Human
gcaucugauuugcauauucau

SEQ ID NO: 3537160 - RNA, 17 nt, Human
gcaucugccccuccccc

SEQ ID NO: 3537161 - RNA, 23 nt, Human
gcaucuggaagagcuaggcaggg

SEQ ID NO: 3537162 - RNA, 18 nt, Human
gcaucuggccuggccagu

SEQ ID NO: 3537163 - RNA, 19 nt, Human
gcaucuggccuggccagug

SEQ ID NO: 3537164 - RNA, 20 nt, Human
gcaucugggauucccaccaa

SEQ ID NO: 3537165 - RNA, 12 nt, Human
gcaucugggccu

SEQ ID NO: 3537166 - RNA, 22 nt, Human
gcaucugggccuuggccuggag

SEQ ID NO: 3537167 - RNA, 13 nt, Human
gcaucuguauaag

SEQ ID NO: 3537168 - RNA, 13 nt, Human
gcaucuguccuca

SEQ ID NO: 3537169 - RNA, 13 nt, Human
gcaucuguuuauu

SEQ ID NO: 3537170 - RNA, 15 nt, Human
gcaucuuacugaagg

SEQ ID NO: 3537171 - RNA, 23 nt, Human
gcaucuuacugaagguaaaauug

SEQ ID NO: 3537172 - RNA, 19 nt, Human
gcaucuucucacucccuuc

SEQ ID NO: 3537173 - RNA, 15 nt, Human
gcaucuugccuccag

SEQ ID NO: 3537174 - RNA, 18 nt, Human
gcaucuuugccuugggcu

SEQ ID NO: 3537175 - RNA, 14 nt, Human
gcaugaaaugugaa

SEQ ID NO: 3537176 - RNA, 20 nt, Human
gcaugaaaugugaauuuuua

SEQ ID NO: 3537177 - RNA, 21 nt, Human
gcaugaacagcuaauuguacc

SEQ ID NO: 3537178 - RNA, 18 nt, Human
gcaugaaggaaacugaac

SEQ ID NO: 3537179 - RNA, 22 nt, Human
gcaugaauuuguaaugucuuga

SEQ ID NO: 3537180 - RNA, 15 nt, Human
gcaugaauuugugaa

SEQ ID NO: 3537181 - RNA, 15 nt, Human
gcaugacaagcccca

SEQ ID NO: 3537182 - RNA, 14 nt, Human
gcaugacagccugc

SEQ ID NO: 3537183 - RNA, 16 nt, Human
gcaugacagccugcag

SEQ ID NO: 3537184 - RNA, 15 nt, Human
gcaugagaggaggca

SEQ ID NO: 3537185 - RNA, 17 nt, Human
gcaugagaggaggcagc

SEQ ID NO: 3537186 - RNA, 19 nt, Human
gcaugagggaucacagggc

SEQ ID NO: 3537187 - RNA, 19 nt, Human
gcaugagggguuccucccc

SEQ ID NO: 3537188 - RNA, 19 nt, Human
gcaugauccaagcaagacu

SEQ ID NO: 3537189 - RNA, 15 nt, Human
gcaugauuuuguaac

SEQ ID NO: 3537190 - RNA, 16 nt, Human
gcaugcacuguucccc

SEQ ID NO: 3537191 - RNA, 17 nt, Human
gcaugcacuguuccccc

SEQ ID NO: 3537192 - RNA, 21 nt, Human
gcaugcacuguucccccugug

SEQ ID NO: 3537193 - RNA, 14 nt, Human
gcaugcagaaaggg

SEQ ID NO: 3537194 - RNA, 12 nt, Human
gcaugcagcagc

SEQ ID NO: 3537195 - RNA, 17 nt, Human
gcaugcagcuuugcaaa

SEQ ID NO: 3537196 - RNA, 12 nt, Human
gcaugcccccuc

SEQ ID NO: 3537197 - RNA, 19 nt, Human
gcaugcccccucgugccag

SEQ ID NO: 3537198 - RNA, 19 nt, Human
gcaugccucugauauggga

SEQ ID NO: 3537199 - RNA, 13 nt, Human
gcaugccugagag

SEQ ID NO: 3537200 - RNA, 12 nt, Human
gcaugccuugug

SEQ ID NO: 3537201 - RNA, 14 nt, Human
gcaugcgcacaagg

SEQ ID NO: 3537202 - RNA, 21 nt, Human
gcaugcgcacaaggcugacca

SEQ ID NO: 3537203 - RNA, 17 nt, Human
gcaugcucucugcagcc

SEQ ID NO: 3537204 - RNA, 23 nt, Human
gcaugcucucugcagccagccca

SEQ ID NO: 3537205 - RNA, 14 nt, Human
gcaugcugcuuuaa

SEQ ID NO: 3537206 - RNA, 13 nt, Human
gcaugcuggggca

SEQ ID NO: 3537207 - RNA, 17 nt, Human
uaaucuuguugauaaaa

SEQ ID NO: 3537208 - RNA, 21 nt, Human
uaaucuuucaaaccagcuuca

SEQ ID NO: 3537209 - RNA, 13 nt, Human
uaaucuuucacag

SEQ ID NO: 3537210 - RNA, 18 nt, Human
uaaucuuucuuuaccuga

SEQ ID NO: 3537211 - RNA, 12 nt, Human
uaaucuuugggu

SEQ ID NO: 3537212 - RNA, 11 nt, Human
uaaucuuuuau

SEQ ID NO: 3537213 - RNA, 15 nt, Human
uaaucuuuucugaau

SEQ ID NO: 3537214 - RNA, 16 nt, Human
uaaugaaaacaaugca

SEQ ID NO: 3537215 - RNA, 13 nt, Human
uaaugaaacaaag

SEQ ID NO: 3537216 - RNA, 23 nt, Human
uaaugaaacaaagaguucaagaa

SEQ ID NO: 3537217 - RNA, 20 nt, Human
uaaugaaacaccuucucugg

SEQ ID NO: 3537218 - RNA, 15 nt, Human
uaaugaaacuuggau

SEQ ID NO: 3537219 - RNA, 14 nt, Human
uaaugaaagacugu

SEQ ID NO: 3537220 - RNA, 17 nt, Human
uaaugaaagacuguaca

SEQ ID NO: 3537221 - RNA, 14 nt, Human
uaaugaaauaucug

SEQ ID NO: 3537222 - RNA, 15 nt, Human
uaaugaaauggagga

SEQ ID NO: 3537223 - RNA, 18 nt, Human
uaaugaaccgcugaauau

SEQ ID NO: 3537224 - RNA, 17 nt, Human
uaaugaagaaaguggaa

SEQ ID NO: 3537225 - RNA, 23 nt, Human
uaaugaagaaaguggaaaacaag

SEQ ID NO: 3537226 - RNA, 13 nt, Human
uaaugaagaucua

SEQ ID NO: 3537227 - RNA, 14 nt, Human
uaaugaagaucuaa

SEQ ID NO: 3537228 - RNA, 15 nt, Human
uaaugaagaucuaaa

SEQ ID NO: 3537229 - RNA, 14 nt, Human
uaaugaagcuuuau

SEQ ID NO: 3537230 - RNA, 16 nt, Human
uaaugaaguaaagcca

SEQ ID NO: 3537231 - RNA, 14 nt, Human
uaaugaaguuugaa

SEQ ID NO: 3537232 - RNA, 21 nt, Human
uaaugaaguuugaauguuaaa

SEQ ID NO: 3537233 - RNA, 22 nt, Human
uaaugaaguuugaauguuaaau

SEQ ID NO: 3537234 - RNA, 20 nt, Human
uaaugaaucguaaugaaguu

SEQ ID NO: 3537235 - RNA, 18 nt, Human
uaaugaaugcuuaaagaa

SEQ ID NO: 3537236 - RNA, 20 nt, Human
uaaugaaugcuuaaagaauu

SEQ ID NO: 3537237 - RNA, 15 nt, Human
uaaugaauuuaguga

SEQ ID NO: 3537238 - RNA, 16 nt, Human
uaaugaauuuuuauga

SEQ ID NO: 3537239 - RNA, 21 nt, Human
uaaugaauuuuuaugauauuc

SEQ ID NO: 3537240 - RNA, 20 nt, Human
uaaugacaucaccacaguuu

SEQ ID NO: 3537241 - RNA, 17 nt, Human
uaaugacauucaauaaa

SEQ ID NO: 3537242 - RNA, 19 nt, Human
uaaugacauucaauaaagu

SEQ ID NO: 3537243 - RNA, 20 nt, Human
uaaugaccacaccugccucu

SEQ ID NO: 3537244 - RNA, 14 nt, Human
uaaugaccaugaaa

SEQ ID NO: 3537245 - RNA, 18 nt, Human
uaaugaccaugaaagacu

SEQ ID NO: 3537246 - RNA, 19 nt, Human
uaaugagacuuuaaaagca

SEQ ID NO: 3537247 - RNA, 18 nt, Human
uaaugagcaauaucugcu

SEQ ID NO: 3537248 - RNA, 18 nt, Human
uaaugagcuuaagaaauu

SEQ ID NO: 3537249 - RNA, 23 nt, Human
uaaugaggagagaaaauauaugu

SEQ ID NO: 3537250 - RNA, 15 nt, Human
uaaugagggacugga

SEQ ID NO: 3537251 - RNA, 13 nt, Human
uaaugaguuuaaa

SEQ ID NO: 3537252 - RNA, 16 nt, Human
uaaugauaacuggaaa

SEQ ID NO: 3537253 - RNA, 17 nt, Human
uaaugauaacuggaaac

SEQ ID NO: 3537254 - RNA, 15 nt, Human
uaaugauaugcuugu

SEQ ID NO: 3537255 - RNA, 18 nt, Human
uaaugaucgaaaaaauaa

SEQ ID NO: 3537256 - RNA, 20 nt, Human
uaaugaucgaaaaaauaauu

SEQ ID NO: 3537257 - RNA, 22 nt, Human
uaaugaugacaaaaaauguuuu

SEQ ID NO: 3537258 - RNA, 18 nt, Human
uaaugauggcccauucua

SEQ ID NO: 3537259 - RNA, 18 nt, Human
uaaugcaauagaagugcu

SEQ ID NO: 3537260 - RNA, 16 nt, Human
uaaugcaguaugguac

SEQ ID NO: 3537261 - RNA, 17 nt, Human
uaaugcaguugcuuacu

SEQ ID NO: 3537262 - RNA, 22 nt, Human
uaaugcaucuagauuauggagc

SEQ ID NO: 3537263 - RNA, 22 nt, Human
uaaugcauuaaaccugucucca

SEQ ID NO: 3537264 - RNA, 19 nt, Human
uaaugcauucuucucuguu

SEQ ID NO: 3537265 - RNA, 19 nt, Human
uaaugccacuaaauugaca

SEQ ID NO: 3537266 - RNA, 20 nt, Human
uaaugccauuuuaaggaaaa

SEQ ID NO: 3537267 - RNA, 18 nt, Human
uaaugccucuucauucuu

SEQ ID NO: 3537268 - RNA, 15 nt, Human
uaaugccugcuuuuu

SEQ ID NO: 3537269 - RNA, 21 nt, Human
uaaugccuuacucuucuugaa

SEQ ID NO: 3537270 - RNA, 22 nt, Human
uaaugccuuuaaaguaugaauc

SEQ ID NO: 3537271 - RNA, 17 nt, Human
uaaugcgauuuuauuac

SEQ ID NO: 3537272 - RNA, 23 nt, Human
uaaugcgcaggcuggcccugccc

SEQ ID NO: 3537273 - RNA, 14 nt, Human
uaaugcgugcauac

SEQ ID NO: 3537274 - RNA, 22 nt, Human
uaaugcgugcauaccacuuuug

SEQ ID NO: 3537275 - RNA, 20 nt, Human
uaaugcuaaagaaaaaguca

SEQ ID NO: 3537276 - RNA, 14 nt, Human
uaaugcuaaaugua

SEQ ID NO: 3537277 - RNA, 17 nt, Human
uaaugcuacgugugauu

SEQ ID NO: 3537278 - RNA, 22 nt, Human
uaaugcuacgugugauuuuucu

SEQ ID NO: 3537279 - RNA, 13 nt, Human
uaaugcuggagcg

SEQ ID NO: 3537280 - RNA, 16 nt, Human
uaaugcuuaagaggga

SEQ ID NO: 3537281 - RNA, 14 nt, Human
uaaugcuucagaua

SEQ ID NO: 3537282 - RNA, 14 nt, Human
uaaugcuucauuca

SEQ ID NO: 3537283 - RNA, 19 nt, Human
uaaugcuugcugcugauuu

SEQ ID NO: 3537284 - RNA, 17 nt, Human
uaaugcuuucacaacau

SEQ ID NO: 3537285 - RNA, 15 nt, Human
uaaugcuuugaaauu

SEQ ID NO: 3537286 - RNA, 22 nt, Human
uaauggaaaaaaaaaaaagagg

SEQ ID NO: 3537287 - RNA, 20 nt, Human
uaauggaaguguauuuauuu

SEQ ID NO: 3537288 - RNA, 22 nt, Human
uaauggauuauaaucagaaugg

SEQ ID NO: 3537289 - RNA, 20 nt, Human
gcauguguauuuccagugca

SEQ ID NO: 3537290 - RNA, 19 nt, Human
gcaugugugcgagugugug

SEQ ID NO: 3537291 - RNA, 14 nt, Human
gcaugugugugcuc

SEQ ID NO: 3537292 - RNA, 20 nt, Human
gcauguguuugguucugggg

SEQ ID NO: 3537293 - RNA, 13 nt, Human
gcauguuacauaa

SEQ ID NO: 3537294 - RNA, 14 nt, Human
gcauguuauguuua

SEQ ID NO: 3537295 - RNA, 21 nt, Human
gcauguucacccuuauagucu

SEQ ID NO: 3537296 - RNA, 16 nt, Human
gcauguuccacuaacc

SEQ ID NO: 3537297 - RNA, 15 nt, Human
gcauguucucugagg

SEQ ID NO: 3537298 - RNA, 15 nt, Human
gcauguuugaaauga

SEQ ID NO: 3537299 - RNA, 13 nt, Human
gcauguuuugcau

SEQ ID NO: 3537300 - RNA, 15 nt, Human
gcauguuuugcaugu

SEQ ID NO: 3537301 - RNA, 20 nt, Human
gcauguuuuguauacaaaua

SEQ ID NO: 3537302 - RNA, 18 nt, Human
gcauguuuugugcauuug

SEQ ID NO: 3537303 - RNA, 13 nt, Human
gcauuaaaacuua

SEQ ID NO: 3537304 - RNA, 13 nt, Human
gcauuaaaagaaa

SEQ ID NO: 3537305 - RNA, 15 nt, Human
gcauuaaaagaaaau

SEQ ID NO: 3537306 - RNA, 23 nt, Human
gcauuaaauuuuagcaaagauau

SEQ ID NO: 3537307 - RNA, 18 nt, Human
gcauuaacuaaucuauug

SEQ ID NO: 3537308 - RNA, 12 nt, Human
gcauuaauguuu

SEQ ID NO: 3537309 - RNA, 14 nt, Human
gcauuacagagagg

SEQ ID NO: 3537310 - RNA, 18 nt, Human
gcauuaccgcguuguaaa

SEQ ID NO: 3537311 - RNA, 16 nt, Human
gcauuaccucuuugga

SEQ ID NO: 3537312 - RNA, 18 nt, Human
gcauuacgugagccaggu

SEQ ID NO: 3537313 - RNA, 15 nt, Human
gcauuacucuuguaa

SEQ ID NO: 3537314 - RNA, 17 nt, Human
gcauuacucuuguaaga

SEQ ID NO: 3537315 - RNA, 21 nt, Human
gcauuacucuuguaagauuuu

SEQ ID NO: 3537316 - RNA, 17 nt, Human
gcauuacugcaugcacu

SEQ ID NO: 3537317 - RNA, 21 nt, Human
gcauuagaaauagacaguaua

SEQ ID NO: 3537318 - RNA, 13 nt, Human
gcauuagaaauua

SEQ ID NO: 3537319 - RNA, 20 nt, Human
gcauuagcacagauuuuaau

SEQ ID NO: 3537320 - RNA, 15 nt, Human
gcauuagcuaaaacc

SEQ ID NO: 3537321 - RNA, 17 nt, Human
gcauuagugggaaaaag

SEQ ID NO: 3537322 - RNA, 20 nt, Human
gcauuauaaucaccagggcc

SEQ ID NO: 3537323 - RNA, 17 nt, Human
gcauuaucuagauacug

SEQ ID NO: 3537324 - RNA, 19 nt, Human
gcauuaugcaauuuuuaua

SEQ ID NO: 3537325 - RNA, 22 nt, Human
gcauuauguccacuguguauag

SEQ ID NO: 3537326 - RNA, 11 nt, Human
gcauuauuuga

SEQ ID NO: 3537327 - RNA, 15 nt, Human
gcauuauuugagaag

SEQ ID NO: 3537328 - RNA, 13 nt, Human
gcauuauuuucca

SEQ ID NO: 3537329 - RNA, 20 nt, Human
gcauucacccagacagcucc

SEQ ID NO: 3537330 - RNA, 13 nt, Human
gcauucagagagc

SEQ ID NO: 3537331 - RNA, 15 nt, Human
gcauucauuuuuaua

SEQ ID NO: 3537332 - RNA, 15 nt, Human
gcauuccagccccuc

SEQ ID NO: 3537333 - RNA, 17 nt, Human
gcauuccagucaggcuc

SEQ ID NO: 3537334 - RNA, 13 nt, Human
gcauucccagugg

SEQ ID NO: 3537335 - RNA, 12 nt, Human
gcauuccccacu

SEQ ID NO: 3537336 - RNA, 12 nt, Human
gcauuccccagg

SEQ ID NO: 3537337 - RNA, 19 nt, Human
gcauuccccaggaggccag

SEQ ID NO: 3537338 - RNA, 13 nt, Human
gcauucccugagu

SEQ ID NO: 3537339 - RNA, 14 nt, Human
gcauucccugaguc

SEQ ID NO: 3537340 - RNA, 22 nt, Human
gcauuccugauaugauuuaaaa

SEQ ID NO: 3537341 - RNA, 16 nt, Human
gcauuccuuugucuuc

SEQ ID NO: 3537342 - RNA, 14 nt, Human
gcauucggagggag

SEQ ID NO: 3537343 - RNA, 22 nt, Human
gcauucguuguguuuuuuaaga

SEQ ID NO: 3537344 - RNA, 23 nt, Human
gcauucguuguguuuuuuaagau

SEQ ID NO: 3537345 - RNA, 14 nt, Human
gcauucuauugccu

SEQ ID NO: 3537346 - RNA, 22 nt, Human
gcauucuauugccuucuuugaa

SEQ ID NO: 3537347 - RNA, 15 nt, Human
gcauucucacuccua

SEQ ID NO: 3537348 - RNA, 21 nt, Human
gcauucuccccaguguauguc

SEQ ID NO: 3537349 - RNA, 16 nt, Human
gcauucuccuggaugc

SEQ ID NO: 3537350 - RNA, 20 nt, Human
gcauucugccucucuaggac

SEQ ID NO: 3537351 - RNA, 22 nt, Human
gcauucuuagccuguggcagua

SEQ ID NO: 3537352 - RNA, 14 nt, Human
gcauucuuauucau

SEQ ID NO: 3537353 - RNA, 14 nt, Human
gcauucuucugauc

SEQ ID NO: 3537354 - RNA, 17 nt, Human
gcauucuugguuggcug

SEQ ID NO: 3537355 - RNA, 11 nt, Human
gcauucuuucc

SEQ ID NO: 3537356 - RNA, 13 nt, Human
gcauucuuuccca

SEQ ID NO: 3537357 - RNA, 13 nt, Human
gcauucuuucugu

SEQ ID NO: 3537358 - RNA, 18 nt, Human
gcauucuuucuguauuga

SEQ ID NO: 3537359 - RNA, 20 nt, Human
gcauucuuuuaaaagacaag

SEQ ID NO: 3537360 - RNA, 11 nt, Human
gcauugaaauu

SEQ ID NO: 3537361 - RNA, 21 nt, Human
gcauugaacacaaacuguaaa

SEQ ID NO: 3537362 - RNA, 19 nt, Human
gcauugaauggcuauguuu

SEQ ID NO: 3537363 - RNA, 21 nt, Human
gcauugaauggcuauguuuuu

SEQ ID NO: 3537364 - RNA, 15 nt, Human
gcauugacaaaucug

SEQ ID NO: 3537365 - RNA, 19 nt, Human
gcauugacaaaucugugua

SEQ ID NO: 3537366 - RNA, 21 nt, Human
gcauugacuuucaguaaacau

SEQ ID NO: 3537367 - RNA, 17 nt, Human
gcauugacuuuccccac

SEQ ID NO: 3537368 - RNA, 15 nt, Human
gcauugagcugagau

SEQ ID NO: 3537369 - RNA, 15 nt, Human
gcauugauauuguga

SEQ ID NO: 3537370 - RNA, 16 nt, Human
gcauugccaagggcuu

SEQ ID NO: 3537371 - RNA, 14 nt, Human
gcauugccauuccc

SEQ ID NO: 3537372 - RNA, 17 nt, Human
gcauugcuagauaaaag

SEQ ID NO: 3537373 - RNA, 18 nt, Human
uacugguccaaaagauug

SEQ ID NO: 3537374 - RNA, 19 nt, Human
uacuggucucucuaugccu

SEQ ID NO: 3537375 - RNA, 18 nt, Human
uacuggucuuguggaauu

SEQ ID NO: 3537376 - RNA, 13 nt, Human
uacugguugcaug

SEQ ID NO: 3537377 - RNA, 20 nt, Human
uacuguaaaaugcaaaaaau

SEQ ID NO: 3537378 - RNA, 16 nt, Human
uacuguaacauucagg

SEQ ID NO: 3537379 - RNA, 14 nt, Human
uacuguaagaauaa

SEQ ID NO: 3537380 - RNA, 13 nt, Human
uacuguaagacau

SEQ ID NO: 3537381 - RNA, 23 nt, Human
uacuguaauuugugauacaaugc

SEQ ID NO: 3537382 - RNA, 14 nt, Human
uacuguacaauaaa

SEQ ID NO: 3537383 - RNA, 18 nt, Human
uacuguacaauaaaaaca

SEQ ID NO: 3537384 - RNA, 19 nt, Human
uacuguacagauugcugcu

SEQ ID NO: 3537385 - RNA, 19 nt, Human
uacuguacagcuggcucua

SEQ ID NO: 3537386 - RNA, 22 nt, Human
uacuguacaugaaaacacauuu

SEQ ID NO: 3537387 - RNA, 12 nt, Human
uacuguaguuuu

SEQ ID NO: 3537388 - RNA, 17 nt, Human
uacuguauagacaguuu

SEQ ID NO: 3537389 - RNA, 12 nt, Human
uacuguauuuga

SEQ ID NO: 3537390 - RNA, 18 nt, Human
uacugucaaaauaauuuu

SEQ ID NO: 3537391 - RNA, 14 nt, Human
uacugucucacuga

SEQ ID NO: 3537392 - RNA, 17 nt, Human
uacugucugauuggcuu

SEQ ID NO: 3537393 - RNA, 12 nt, Human
uacugucuuaau

SEQ ID NO: 3537394 - RNA, 13 nt, Human
uacugucuuaauu

SEQ ID NO: 3537395 - RNA, 15 nt, Human
uacugugaaacuggc

SEQ ID NO: 3537396 - RNA, 20 nt, Human
uacuguggaaaaauauuuaa

SEQ ID NO: 3537397 - RNA, 18 nt, Human
uacuguggaaaagaaaca

SEQ ID NO: 3537398 - RNA, 16 nt, Human
uacugugggcaauuua

SEQ ID NO: 3537399 - RNA, 16 nt, Human
uacuguguaaacucau

SEQ ID NO: 3537400 - RNA, 16 nt, Human
uacuguguaauauaaa

SEQ ID NO: 3537401 - RNA, 12 nt, Human
uacuguguacug

SEQ ID NO: 3537402 - RNA, 13 nt, Human
uacuguguacugu

SEQ ID NO: 3537403 - RNA, 23 nt, Human
uacugugucuuugguuugugcua

SEQ ID NO: 3537404 - RNA, 22 nt, Human
uacugugugugugaaugaacac

SEQ ID NO: 3537405 - RNA, 23 nt, Human
uacugugugugugaaugaacacu

SEQ ID NO: 3537406 - RNA, 16 nt, Human
uacuguguuccuggca

SEQ ID NO: 3537407 - RNA, 19 nt, Human
uacuguguuccuggcaaua

SEQ ID NO: 3537408 - RNA, 15 nt, Human
uacuguuaaaggaaa

SEQ ID NO: 3537409 - RNA, 18 nt, Human
uacuguuaaccauuuaag

SEQ ID NO: 3537410 - RNA, 13 nt, Human
uacuguuacuggg

SEQ ID NO: 3537411 - RNA, 16 nt, Human
uacuguuauucuuugc

SEQ ID NO: 3537412 - RNA, 20 nt, Human
uacuguuauucuuugcacuu

SEQ ID NO: 3537413 - RNA, 12 nt, Human
uacuguucuaaa

SEQ ID NO: 3537414 - RNA, 16 nt, Human
uacuguucugugucuu

SEQ ID NO: 3537415 - RNA, 17 nt, Human
uacuguucugugucuuu

SEQ ID NO: 3537416 - RNA, 14 nt, Human
uacuguucuugcug

SEQ ID NO: 3537417 - RNA, 15 nt, Human
uacuguucuugcugc

SEQ ID NO: 3537418 - RNA, 21 nt, Human
uacuguucuugcugcuagaac

SEQ ID NO: 3537419 - RNA, 23 nt, Human
uacuguucuugcugcuagaacuu

SEQ ID NO: 3537420 - RNA, 23 nt, Human
uacuguugcacaauuuugauaaa

SEQ ID NO: 3537421 - RNA, 13 nt, Human
uacuguugcacgu

SEQ ID NO: 3537422 - RNA, 15 nt, Human
uacuguugcacgugu

SEQ ID NO: 3537423 - RNA, 16 nt, Human
uacuguugcacgugug

SEQ ID NO: 3537424 - RNA, 16 nt, Human
uacuguuguaagaauu

SEQ ID NO: 3537425 - RNA, 14 nt, Human
uacuguugugaccu

SEQ ID NO: 3537426 - RNA, 19 nt, Human
uacuguuuaagugaauuga

SEQ ID NO: 3537427 - RNA, 15 nt, Human
uacuguuuauuacuu

SEQ ID NO: 3537428 - RNA, 13 nt, Human
uacuguuucuguc

SEQ ID NO: 3537429 - RNA, 19 nt, Human
uacuguuuuaucuggcccc

SEQ ID NO: 3537430 - RNA, 20 nt, Human
uacuuaaauggaaaaaauga

SEQ ID NO: 3537431 - RNA, 23 nt, Human
uacuuaaaugguaauaagcacug

SEQ ID NO: 3537432 - RNA, 24 nt, Human
uacuuaaaugguaauaagcacugu

SEQ ID NO: 3537433 - RNA, 13 nt, Human
uacuuaacuguuu

SEQ ID NO: 3537434 - RNA, 12 nt, Human
uacuuaagagaa

SEQ ID NO: 3537435 - RNA, 21 nt, Human
uagaaaaagggucaaugcuau

SEQ ID NO: 3537436 - RNA, 20 nt, Human
uagaaaaauucagcaaacca

SEQ ID NO: 3537437 - RNA, 15 nt, Human
uagaaaacaauggaa

SEQ ID NO: 3537438 - RNA, 15 nt, Human
uagaaaacugaaaau

SEQ ID NO: 3537439 - RNA, 16 nt, Human
uagaaaacugaaaauc

SEQ ID NO: 3537440 - RNA, 22 nt, Human
uagaaaacugaaaaucuaauau

SEQ ID NO: 3537441 - RNA, 16 nt, Human
uagaaaacuuuaaagc

SEQ ID NO: 3537442 - RNA, 14 nt, Human
uagaaaacuuuguu

SEQ ID NO: 3537443 - RNA, 18 nt, Human
uagaaaagaacuggaaac

SEQ ID NO: 3537444 - RNA, 21 nt, Human
uagaaaaggcuagguacacag

SEQ ID NO: 3537445 - RNA, 12 nt, Human
uagaaaagguga

SEQ ID NO: 3537446 - RNA, 21 nt, Human
uagaaaaggugauaaaaucau

SEQ ID NO: 3537447 - RNA, 16 nt, Human
uagaaaaguauguucu

SEQ ID NO: 3537448 - RNA, 18 nt, Human
uagaaaaguauguucuaa

SEQ ID NO: 3537449 - RNA, 14 nt, Human
uagaaaaguuauua

SEQ ID NO: 3537450 - RNA, 14 nt, Human
uagaaaauauaagu

SEQ ID NO: 3537451 - RNA, 22 nt, Human
uagaaaauauaaguaaagugau

SEQ ID NO: 3537452 - RNA, 12 nt, Human
uagaaaaugugu

SEQ ID NO: 3537453 - RNA, 22 nt, Human
uagaaaauuuaaaacauuacuc

SEQ ID NO: 3537454 - RNA, 13 nt, Human
uagaaacaaaaua

SEQ ID NO: 3537455 - RNA, 16 nt, Human
uagaaacaaaauacaa

SEQ ID NO: 3537456 - RNA, 15 nt, Human
uagaaacacaacuau

SEQ ID NO: 3537457 - RNA, 14 nt, Human
uagaaacauaaaua

SEQ ID NO: 3537458 - RNA, 15 nt, Human
uagaaacauugaaga

SEQ ID NO: 3537459 - RNA, 18 nt, Human
uagaaacccaagcuccuc

SEQ ID NO: 3537460 - RNA, 21 nt, Human
uagaaacccaagcuccuccuc

SEQ ID NO: 3537461 - RNA, 14 nt, Human
uagaaaccuuaaua

SEQ ID NO: 3537462 - RNA, 18 nt, Human
uagaaacuggaaauacua

SEQ ID NO: 3537463 - RNA, 22 nt, Human
uagaaacuuaucuuacaaagug

SEQ ID NO: 3537464 - RNA, 12 nt, Human
uagaaagaaagu

SEQ ID NO: 3537465 - RNA, 14 nt, Human
uagaaagaagccca

SEQ ID NO: 3537466 - RNA, 23 nt, Human
uagaaagaagcccaauauuauaa

SEQ ID NO: 3537467 - RNA, 15 nt, Human
uagaaagaccaggcc

SEQ ID NO: 3537468 - RNA, 17 nt, Human
uagaaagagauacagag

SEQ ID NO: 3537469 - RNA, 17 nt, Human
uagaaagcagagauuuu

SEQ ID NO: 3537470 - RNA, 14 nt, Human
uagaaagcauuuga

SEQ ID NO: 3537471 - RNA, 20 nt, Human
uagaaagcauuugaaugcau

SEQ ID NO: 3537472 - RNA, 21 nt, Human
uagaaagcauuugaaugcauu

SEQ ID NO: 3537473 - RNA, 22 nt, Human
uagaaagccaaaucaaaauaug

SEQ ID NO: 3537474 - RNA, 11 nt, Human
uagaaagcuau

SEQ ID NO: 3537475 - RNA, 18 nt, Human
uagaaagcugacauugcc

SEQ ID NO: 3537476 - RNA, 21 nt, Human
uagaaagcugacauugccaaa

SEQ ID NO: 3537477 - RNA, 22 nt, Human
uagaaagcuuuguugaaagaaa

SEQ ID NO: 3537478 - RNA, 14 nt, Human
uagaaaggccuuua

SEQ ID NO: 3537479 - RNA, 15 nt, Human
uagaaaggccuuuaa

SEQ ID NO: 3537480 - RNA, 15 nt, Human
uagaaaggggcccag

SEQ ID NO: 3537481 - RNA, 22 nt, Human
uagaaaguguucuguuacaaaa

SEQ ID NO: 3537482 - RNA, 21 nt, Human
uagaaauaaaagugaaugaaa

SEQ ID NO: 3537483 - RNA, 23 nt, Human
uagaaauaaaagugaaugaaaga

SEQ ID NO: 3537484 - RNA, 19 nt, Human
uagaaauaaaggaugugau

SEQ ID NO: 3537485 - RNA, 16 nt, Human
uagaaauaacagaaga

SEQ ID NO: 3537486 - RNA, 14 nt, Human
uagaaauaguuuga

SEQ ID NO: 3537487 - RNA, 15 nt, Human
uagaaauauuuuaaa

SEQ ID NO: 3537488 - RNA, 19 nt, Human
uagaaauauuuuaaaauca

SEQ ID NO: 3537489 - RNA, 20 nt, Human
uagaaauauuuuaaaaucag

SEQ ID NO: 3537490 - RNA, 18 nt, Human
uagaaaugaccaauauua

SEQ ID NO: 3537491 - RNA, 19 nt, Human
uagaaaugaugauguggaa

SEQ ID NO: 3537492 - RNA, 17 nt, Human
uagaaauggaaauuuug

SEQ ID NO: 3537493 - RNA, 19 nt, Human
uagaaaugguuguauuaga

SEQ ID NO: 3537494 - RNA, 20 nt, Human
uagaaaugguuguauuagau

SEQ ID NO: 3537495 - RNA, 15 nt, Human
uagaaauguaaacug

SEQ ID NO: 3537496 - RNA, 18 nt, Human
uagaaauuaccuguggau

SEQ ID NO: 3537497 - RNA, 23 nt, Human
uagaaauuuauuuccuaguucug

SEQ ID NO: 3537498 - RNA, 14 nt, Human
uagaaauuuuacaa

SEQ ID NO: 3537499 - RNA, 22 nt, Human
uagaaauuuuacaauaggugcu

SEQ ID NO: 3537500 - RNA, 16 nt, Human
uagaaauuuuguaaga

SEQ ID NO: 3537501 - RNA, 22 nt, Human
uagaaauuuuucagaugcuucu

SEQ ID NO: 3537502 - RNA, 17 nt, Human
uagaacaauuuucuugu

SEQ ID NO: 3537503 - RNA, 14 nt, Human
uagaacacagaaag

SEQ ID NO: 3537504 - RNA, 15 nt, Human
uagaacacagaaagc

SEQ ID NO: 3537505 - RNA, 19 nt, Human
uagaacacuaauucauaau

SEQ ID NO: 3537506 - RNA, 20 nt, Human
uagaacacuaauucauaauc

SEQ ID NO: 3537507 - RNA, 20 nt, Human
uagaacacuauuuucagaau

SEQ ID NO: 3537508 - RNA, 21 nt, Human
uagaacacuauuuucagaauc

SEQ ID NO: 3537509 - RNA, 22 nt, Human
uagaacacuauuuucagaaucu

SEQ ID NO: 3537510 - RNA, 15 nt, Human
uagaacagaaaacaa

SEQ ID NO: 3537511 - RNA, 16 nt, Human
uagaacagaaaacaac

SEQ ID NO: 3537512 - RNA, 22 nt, Human
uagaacagaaaacaacaaaaaa

SEQ ID NO: 3537513 - RNA, 23 nt, Human
uagaacagagaaagaggaagcuu

SEQ ID NO: 3537514 - RNA, 22 nt, Human
uagaacagggaaaauaggcagg

SEQ ID NO: 3537515 - RNA, 20 nt, Human
uagaacaguggaaacuaugu

SEQ ID NO: 3537516 - RNA, 18 nt, Human
uagaacauugauugcugu

SEQ ID NO: 3537517 - RNA, 16 nt, Human
uagaaccaagaagggc

SEQ ID NO: 3537518 - RNA, 20 nt, Human
uagaaccaccaacaagcaag

SEQ ID NO: 3537519 - RNA, 22 nt, Human
uagaaccaccaacaagcaagcu

SEQ ID NO: 3537520 - RNA, 15 nt, Human
uagaaccacuaugaa

SEQ ID NO: 3537521 - RNA, 16 nt, Human
uagaaccacuaugaag

SEQ ID NO: 3537522 - RNA, 21 nt, Human
uagaaccauguugguugcacu

SEQ ID NO: 3537523 - RNA, 23 nt, Human
uagaaccauguugguugcacuuu

SEQ ID NO: 3537524 - RNA, 15 nt, Human
uagaaccuaauucaa

SEQ ID NO: 3537525 - RNA, 23 nt, Human
uagaaccuaauucaauucaaagc

SEQ ID NO: 3537526 - RNA, 23 nt, Human
uagaaccuagagaagcuaaaacc

SEQ ID NO: 3537527 - RNA, 14 nt, Human
uaauuguguuuaca

SEQ ID NO: 3537528 - RNA, 16 nt, Human
uaauuguguuuacauu

SEQ ID NO: 3537529 - RNA, 17 nt, Human
uaauuguguuuacauuu

SEQ ID NO: 3537530 - RNA, 20 nt, Human
uaauuguguuuacauuuuau

SEQ ID NO: 3537531 - RNA, 12 nt, Human
uaauuguugaaa

SEQ ID NO: 3537532 - RNA, 20 nt, Human
uaauuguugaacagguguuu

SEQ ID NO: 3537533 - RNA, 14 nt, Human
uaauuguugcauag

SEQ ID NO: 3537534 - RNA, 14 nt, Human
uaauuguuguucug

SEQ ID NO: 3537535 - RNA, 16 nt, Human
uaauuguuguucuguu

SEQ ID NO: 3537536 - RNA, 21 nt, Human
uaauuguuguucuguuaacug

SEQ ID NO: 3537537 - RNA, 19 nt, Human
uaauuguuguuuguaugua

SEQ ID NO: 3537538 - RNA, 12 nt, Human
uaauuguuuaaa

SEQ ID NO: 3537539 - RNA, 18 nt, Human
uaauuguuuugcacuuuu

SEQ ID NO: 3537540 - RNA, 17 nt, Human
uaauuuaaacaggccca

SEQ ID NO: 3537541 - RNA, 13 nt, Human
uaauuuaaagaga

SEQ ID NO: 3537542 - RNA, 12 nt, Human
uaauuuaaauga

SEQ ID NO: 3537543 - RNA, 13 nt, Human
uaauuuaaaugaa

SEQ ID NO: 3537544 - RNA, 19 nt, Human
uaauuuaacuuucuggguu

SEQ ID NO: 3537545 - RNA, 21 nt, Human
uaauuuaaggucuguuugcug

SEQ ID NO: 3537546 - RNA, 23 nt, Human
uaauuuaaggucuguuugcuguu

SEQ ID NO: 3537547 - RNA, 15 nt, Human
uaauuuaaguuuuga

SEQ ID NO: 3537548 - RNA, 21 nt, Human
uaauuuaaugcauguuaggaa

SEQ ID NO: 3537549 - RNA, 17 nt, Human
uaauuuaccugaagucu

SEQ ID NO: 3537550 - RNA, 20 nt, Human
uaauuuacuggacaaagaau

SEQ ID NO: 3537551 - RNA, 16 nt, Human
uaauuuacuuguuuug

SEQ ID NO: 3537552 - RNA, 17 nt, Human
uaauuuagacuuggauu

SEQ ID NO: 3537553 - RNA, 20 nt, Human
uaauuuaggaguuuugagaa

SEQ ID NO: 3537554 - RNA, 19 nt, Human
uaauuuaggguacuaaauu

SEQ ID NO: 3537555 - RNA, 21 nt, Human
uaauuuaggguacuaaauuua

SEQ ID NO: 3537556 - RNA, 16 nt, Human
uaauuuaguaaaccaa

SEQ ID NO: 3537557 - RNA, 17 nt, Human
uaauuuaguaaauguua

SEQ ID NO: 3537558 - RNA, 16 nt, Human
uaauuuaguuguuucu

SEQ ID NO: 3537559 - RNA, 19 nt, Human
uaauuuaguuguuucuaga

SEQ ID NO: 3537560 - RNA, 16 nt, Human
uaauuuaguuucauau

SEQ ID NO: 3537561 - RNA, 13 nt, Human
uaauuuauaaaau

SEQ ID NO: 3537562 - RNA, 16 nt, Human
uaauuuauacagguca

SEQ ID NO: 3537563 - RNA, 18 nt, Human
uaauuuauaguuuauaca

SEQ ID NO: 3537564 - RNA, 18 nt, Human
uaauuuaucuaaauuaaa

SEQ ID NO: 3537565 - RNA, 14 nt, Human
uaauuuaugaguuu

SEQ ID NO: 3537566 - RNA, 19 nt, Human
uaauuuauuaauugcuuug

SEQ ID NO: 3537567 - RNA, 14 nt, Human
uaauuuauuauuaa

SEQ ID NO: 3537568 - RNA, 17 nt, Human
uaauuuauuauugaaau

SEQ ID NO: 3537569 - RNA, 20 nt, Human
uaauuuauuauugaaauugu

SEQ ID NO: 3537570 - RNA, 12 nt, Human
uaauuuauuuau

SEQ ID NO: 3537571 - RNA, 18 nt, Human
uaauuuauuuauuaagau

SEQ ID NO: 3537572 - RNA, 18 nt, Human
uaauuucaaaaauauaac

SEQ ID NO: 3537573 - RNA, 11 nt, Human
uaauuucagug

SEQ ID NO: 3537574 - RNA, 15 nt, Human
uaauuucaguguaaa

SEQ ID NO: 3537575 - RNA, 16 nt, Human
uaauuucaguguaaag

SEQ ID NO: 3537576 - RNA, 22 nt, Human
uaauuuccauuuacuuaagacu

SEQ ID NO: 3537577 - RNA, 17 nt, Human
uaauuuccuggugugaa

SEQ ID NO: 3537578 - RNA, 18 nt, Human
uaauuucugccauuucau

SEQ ID NO: 3537579 - RNA, 19 nt, Human
uaccauuucagagaggccu

SEQ ID NO: 3537580 - RNA, 13 nt, Human
uaccauuucagua

SEQ ID NO: 3537581 - RNA, 19 nt, Human
uaccauuuccguaauucuu

SEQ ID NO: 3537582 - RNA, 20 nt, Human
uagcauccuaagaaauaugu

SEQ ID NO: 3537583 - RNA, 18 nt, Human
uagcaucuggaagaucau

SEQ ID NO: 3537584 - RNA, 22 nt, Human
uagcaucuucuggagucuccag

SEQ ID NO: 3537585 - RNA, 16 nt, Human
uagcaugacaagcccc

SEQ ID NO: 3537586 - RNA, 18 nt, Human
uagcaugcacaaagugua

SEQ ID NO: 3537587 - RNA, 18 nt, Human
uagcaugcuuguugcaau

SEQ ID NO: 3537588 - RNA, 15 nt, Human
uagcauggcauauuu

SEQ ID NO: 3537589 - RNA, 21 nt, Human
uagcauggcauauuuuucaca

SEQ ID NO: 3537590 - RNA, 22 nt, Human
uagcauggcauauuuuucacau

SEQ ID NO: 3537591 - RNA, 19 nt, Human
uagcauggcugccaauggg

SEQ ID NO: 3537592 - RNA, 22 nt, Human
uagcauggcugccaaugggagc

SEQ ID NO: 3537593 - RNA, 23 nt, Human
uagcauguauugugucuuuugca

SEQ ID NO: 3537594 - RNA, 20 nt, Human
uagcauguugagccaggccu

SEQ ID NO: 3537595 - RNA, 17 nt, Human
uagcauguuugcugaac

SEQ ID NO: 3537596 - RNA, 15 nt, Human
uagcauuaugcaauu

SEQ ID NO: 3537597 - RNA, 20 nt, Human
uagcauucuuuggaguuaaa

SEQ ID NO: 3537598 - RNA, 18 nt, Human
uagcauuguaaaagcauu

SEQ ID NO: 3537599 - RNA, 21 nt, Human
uagcauuguagugcuuugaga

SEQ ID NO: 3537600 - RNA, 20 nt, Human
uagcauugugaacugacagg

SEQ ID NO: 3537601 - RNA, 15 nt, Human
uagcauuuaugguaa

SEQ ID NO: 3537602 - RNA, 13 nt, Human
uagcauuucauuc

SEQ ID NO: 3537603 - RNA, 14 nt, Human
uagcauuuuaaaca

SEQ ID NO: 3537604 - RNA, 17 nt, Human
uagcauuuucugcaucu

SEQ ID NO: 3537605 - RNA, 14 nt, Human
uagcauuuuugauu

SEQ ID NO: 3537606 - RNA, 20 nt, Human
uagccaaaaaugucuaaaag

SEQ ID NO: 3537607 - RNA, 18 nt, Human
uagccaacggccccagcu

SEQ ID NO: 3537608 - RNA, 12 nt, Human
uagccaaggcca

SEQ ID NO: 3537609 - RNA, 15 nt, Human
uagccaaggccaaag

SEQ ID NO: 3537610 - RNA, 23 nt, Human
uagccaaggugggcugagcccug

SEQ ID NO: 3537611 - RNA, 14 nt, Human
uagccaauguggga

SEQ ID NO: 3537612 - RNA, 20 nt, Human
uagccacaaaauugggaaag

SEQ ID NO: 3537613 - RNA, 19 nt, Human
uagccacaucccuuugaaa

SEQ ID NO: 3537614 - RNA, 16 nt, Human
uagccacauuuggaau

SEQ ID NO: 3537615 - RNA, 20 nt, Human
uagccacauuuggaauacuu

SEQ ID NO: 3537616 - RNA, 18 nt, Human
uagccacccaccacacug

SEQ ID NO: 3537617 - RNA, 19 nt, Human
uagccaccgccuccuacag

SEQ ID NO: 3537618 - RNA, 22 nt, Human
uagccacuaguaaguaauuaug

SEQ ID NO: 3537619 - RNA, 23 nt, Human
uagccacuuaccuucaauaaagu

SEQ ID NO: 3537620 - RNA, 15 nt, Human
uagccagacacucug

SEQ ID NO: 3537621 - RNA, 16 nt, Human
uagccagacacucugc

SEQ ID NO: 3537622 - RNA, 11 nt, Human
uagccagagga

SEQ ID NO: 3537623 - RNA, 18 nt, Human
uagccagauuugucuuuu

SEQ ID NO: 3537624 - RNA, 19 nt, Human
uagccagcacuuguauaua

SEQ ID NO: 3537625 - RNA, 15 nt, Human
uagccaggaucaugg

SEQ ID NO: 3537626 - RNA, 18 nt, Human
uagccaggaucauggugu

SEQ ID NO: 3537627 - RNA, 20 nt, Human
uagccaggaucaugguguaa

SEQ ID NO: 3537628 - RNA, 17 nt, Human
uagccaguaauccugua

SEQ ID NO: 3537629 - RNA, 18 nt, Human
uagccaguaauccuguag

SEQ ID NO: 3537630 - RNA, 23 nt, Human
uagccagugcuccaggcacccag

SEQ ID NO: 3537631 - RNA, 13 nt, Human
uagccaugaccuu

SEQ ID NO: 3537632 - RNA, 17 nt, Human
uagccauguuaacauga

SEQ ID NO: 3537633 - RNA, 19 nt, Human
uagccauuccugguaccca

SEQ ID NO: 3537634 - RNA, 20 nt, Human
uagccauuuuucaaagcaau

SEQ ID NO: 3537635 - RNA, 22 nt, Human
uagccauuuuucaaagcaauug

SEQ ID NO: 3537636 - RNA, 14 nt, Human
uagcccaaaaccaa

SEQ ID NO: 3537637 - RNA, 17 nt, Human
uagcccagcgcucugcc

SEQ ID NO: 3537638 - RNA, 13 nt, Human
uagcccaggagag

SEQ ID NO: 3537639 - RNA, 14 nt, Human
uagcccaggagaga

SEQ ID NO: 3537640 - RNA, 17 nt, Human
uagcccaggagagagaa

SEQ ID NO: 3537641 - RNA, 20 nt, Human
uagcccaggauauauuuuau

SEQ ID NO: 3537642 - RNA, 22 nt, Human
uagcccaggauauauuuuauuu

SEQ ID NO: 3537643 - RNA, 19 nt, Human
uagcccagguccucugaua

SEQ ID NO: 3537644 - RNA, 14 nt, Human
uagcccaucccugc

SEQ ID NO: 3537645 - RNA, 17 nt, Human
uagcccaucccugccug

SEQ ID NO: 3537646 - RNA, 18 nt, Human
uagcccaucccugccugg

SEQ ID NO: 3537647 - RNA, 21 nt, Human
uagcccaucccugccugguca

SEQ ID NO: 3537648 - RNA, 22 nt, Human
uagcccauggacuucacauaag

SEQ ID NO: 3537649 - RNA, 21 nt, Human
uagccccaacccaaaccugga

SEQ ID NO: 3537650 - RNA, 22 nt, Human
uagccccaacccaaaccuggag

SEQ ID NO: 3537651 - RNA, 19 nt, Human
uagccccaagaaggcuggg

SEQ ID NO: 3537652 - RNA, 16 nt, Human
uagccccacaggaggu

SEQ ID NO: 3537653 - RNA, 13 nt, Human
uagccccauaauu

SEQ ID NO: 3537654 - RNA, 15 nt, Human
uagcccccacccacu

SEQ ID NO: 3537655 - RNA, 18 nt, Human
uagcccccacccacuucc

SEQ ID NO: 3537656 - RNA, 18 nt, Human
uagcccccaggcugcugg

SEQ ID NO: 3537657 - RNA, 22 nt, Human
uagccccucccaagcuggcugg

SEQ ID NO: 3537658 - RNA, 16 nt, Human
uagccccucuccugga

SEQ ID NO: 3537659 - RNA, 15 nt, Human
uagcccgaauacaaa

SEQ ID NO: 3537660 - RNA, 16 nt, Human
uagcccgaauacaaac

SEQ ID NO: 3537661 - RNA, 16 nt, Human
uagcccucacauuaga

SEQ ID NO: 3537662 - RNA, 13 nt, Human
uagcccuuucugu

SEQ ID NO: 3537663 - RNA, 16 nt, Human
uagccgaccucagccu

SEQ ID NO: 3537664 - RNA, 17 nt, Human
uagccgaccucagccuu

SEQ ID NO: 3537665 - RNA, 17 nt, Human
uagccgagagccugcuc

SEQ ID NO: 3537666 - RNA, 21 nt, Human
uagccgauaucagaauuugug

SEQ ID NO: 3537667 - RNA, 19 nt, Human
uagccgcccaugcacuggg

SEQ ID NO: 3537668 - RNA, 16 nt, Human
uagccggccacuuugg

SEQ ID NO: 3537669 - RNA, 16 nt, Human
uagccgguuccugucc

SEQ ID NO: 3537670 - RNA, 20 nt, Human
uagccuaacacacuccaaga

SEQ ID NO: 3537671 - RNA, 18 nt, Human
uagccuaagauauacuug

SEQ ID NO: 3537672 - RNA, 18 nt, Human
uagccuagauaugaauau

SEQ ID NO: 3537673 - RNA, 17 nt, Human
uagccuauauuuacagu

SEQ ID NO: 3537674 - RNA, 12 nt, Human
uagccucagggg

SEQ ID NO: 3537675 - RNA, 13 nt, Human
uagccugaugaga

SEQ ID NO: 3537676 - RNA, 17 nt, Human
uagccugccucuucucu

SEQ ID NO: 3537677 - RNA, 14 nt, Human
uagccuggcuuggg

SEQ ID NO: 3537678 - RNA, 17 nt, Human
uagccugggccacaggg

SEQ ID NO: 3537679 - RNA, 15 nt, Human
uagccuggugguuuu

SEQ ID NO: 3537680 - RNA, 14 nt, Human
uagccuguccuguc

SEQ ID NO: 3537681 - RNA, 16 nt, Human
uagccuguccugucau

SEQ ID NO: 3537682 - RNA, 12 nt, Human
uagccuguggcc

SEQ ID NO: 3537683 - RNA, 13 nt, Human
uagccuguggccu

SEQ ID NO: 3537684 - RNA, 20 nt, Human
uagccuguuucuuccuguua

SEQ ID NO: 3537685 - RNA, 21 nt, Human
uagccuuagaagucacacagu

SEQ ID NO: 3537686 - RNA, 15 nt, Human
uagccuuauccucug

SEQ ID NO: 3537687 - RNA, 22 nt, Human
uagccuuccguaacccaacucu

SEQ ID NO: 3537688 - RNA, 15 nt, Human
uagccuucucuguuc

SEQ ID NO: 3537689 - RNA, 16 nt, Human
uagccuucucuguuca

SEQ ID NO: 3537690 - RNA, 14 nt, Human
uagccuugcuuguu

SEQ ID NO: 3537691 - RNA, 15 nt, Human
uagccuugcuuguua

SEQ ID NO: 3537692 - RNA, 22 nt, Human
uagccuuuaccugugaaguguu

SEQ ID NO: 3537693 - RNA, 16 nt, Human
uagccuuuggcucugg

SEQ ID NO: 3537694 - RNA, 22 nt, Human
uagccuuuuuguauaaaauaga

SEQ ID NO: 3537695 - RNA, 19 nt, Human
uagcgacaacagauuggau

SEQ ID NO: 3537696 - RNA, 16 nt, Human
uagcgaucucuccugg

SEQ ID NO: 3537697 - RNA, 20 nt, Human
uagcgaucucuccuggccua

SEQ ID NO: 3537698 - RNA, 14 nt, Human
uagcgcccaguugg

SEQ ID NO: 3537699 - RNA, 21 nt, Human
uagcgcuaucucccugccucc

SEQ ID NO: 3537700 - RNA, 22 nt, Human
uagcgcugccgcaccccagagu

SEQ ID NO: 3537701 - RNA, 14 nt, Human
uagcguguguagau

SEQ ID NO: 3537702 - RNA, 16 nt, Human
uagcguucuuguaauu

SEQ ID NO: 3537703 - RNA, 21 nt, Human
uagcguucuuguaauuuuaca

SEQ ID NO: 3537704 - RNA, 21 nt, Human
uagcguuggaauuaaaacaau

SEQ ID NO: 3537705 - RNA, 16 nt, Human
uagcguuuuuuaaaug

SEQ ID NO: 3537706 - RNA, 17 nt, Human
uagcguuuuuuaaaugu

SEQ ID NO: 3537707 - RNA, 18 nt, Human
uagcguuuuuuaaaugua

SEQ ID NO: 3537708 - RNA, 22 nt, Human
uagcguuuuuuaaauguauacu

SEQ ID NO: 3537709 - RNA, 19 nt, Human
uagcuaaacggauuccaaa

SEQ ID NO: 3537710 - RNA, 20 nt, Human
uagcuaagaaauaaaacugu

SEQ ID NO: 3537711 - RNA, 14 nt, Human
uagcuaaguacaca

SEQ ID NO: 3537712 - RNA, 12 nt, Human
uagcuacagaga

SEQ ID NO: 3537713 - RNA, 21 nt, Human
uagcuacagagaaaccagcuu

SEQ ID NO: 3537714 - RNA, 19 nt, Human
uagcuacccaaaagagaaa

SEQ ID NO: 3537715 - RNA, 21 nt, Human
uagcuagacuggugacugauu

SEQ ID NO: 3537716 - RNA, 14 nt, Human
uagcuagaggaacc

SEQ ID NO: 3537717 - RNA, 15 nt, Human
uagcuagaggaacca

SEQ ID NO: 3537718 - RNA, 19 nt, Human
uagcuauauccauguacug

SEQ ID NO: 3537719 - RNA, 16 nt, Human
uagcuauuuuuaugga

SEQ ID NO: 3537720 - RNA, 16 nt, Human
uagcucaaugagcaug

SEQ ID NO: 3537721 - RNA, 14 nt, Human
uagcucagccccag

SEQ ID NO: 3537722 - RNA, 20 nt, Human
uagcucagccccagcccagc

SEQ ID NO: 3537723 - RNA, 19 nt, Human
uaggacacaguuccuggga

SEQ ID NO: 3537724 - RNA, 23 nt, Human
uaggacauguucccuucuccuuc

SEQ ID NO: 3537725 - RNA, 14 nt, Human
uaggaccaagaaag

SEQ ID NO: 3537726 - RNA, 17 nt, Human
uaggaccaagcaucuug

SEQ ID NO: 3537727 - RNA, 18 nt, Human
uaggaccaagcaucuugg

SEQ ID NO: 3537728 - RNA, 22 nt, Human
uaggaccaagcaucuugggggg

SEQ ID NO: 3537729 - RNA, 19 nt, Human
uaggaccacucagccccua

SEQ ID NO: 3537730 - RNA, 13 nt, Human
uaggacccuuccc

SEQ ID NO: 3537731 - RNA, 21 nt, Human
uaggaccuuuccaccacagcc

SEQ ID NO: 3537732 - RNA, 14 nt, Human
uaggacucugaggc

SEQ ID NO: 3537733 - RNA, 14 nt, Human
uaggacuguagaaa

SEQ ID NO: 3537734 - RNA, 17 nt, Human
uaggacuuguuuuuguu

SEQ ID NO: 3537735 - RNA, 12 nt, Human
uaggagaagcca

SEQ ID NO: 3537736 - RNA, 20 nt, Human
uaggagaagucuucuauuua

SEQ ID NO: 3537737 - RNA, 20 nt, Human
uaggagacuugccagagccg

SEQ ID NO: 3537738 - RNA, 14 nt, Human
uaggagagaccgag

SEQ ID NO: 3537739 - RNA, 21 nt, Human
uaggagagagaucaugagaaa

SEQ ID NO: 3537740 - RNA, 17 nt, Human
uaggagaggagaaccag

SEQ ID NO: 3537741 - RNA, 14 nt, Human
uaggagaggaugag

SEQ ID NO: 3537742 - RNA, 22 nt, Human
uaggagaggaugagagcccaga

SEQ ID NO: 3537743 - RNA, 16 nt, Human
uaggagcaaagccugu

SEQ ID NO: 3537744 - RNA, 15 nt, Human
uaggagccugcuggu

SEQ ID NO: 3537745 - RNA, 16 nt, Human
uaggagcuaaggcucu

SEQ ID NO: 3537746 - RNA, 14 nt, Human
uaggagggacuguc

SEQ ID NO: 3537747 - RNA, 21 nt, Human
uaggagggaguuaucuaaaag

SEQ ID NO: 3537748 - RNA, 13 nt, Human
uaggaggguccuc

SEQ ID NO: 3537749 - RNA, 16 nt, Human
uaggagggugggaagg

SEQ ID NO: 3537750 - RNA, 21 nt, Human
uaggagugggugacaagagcc

SEQ ID NO: 3537751 - RNA, 19 nt, Human
uaggaguggugauuugaaa

SEQ ID NO: 3537752 - RNA, 21 nt, Human
uaggaguucgagaccagccug

SEQ ID NO: 3537753 - RNA, 23 nt, Human
uaggaguucgagaccagccuggc

SEQ ID NO: 3537754 - RNA, 21 nt, Human
uaggauaaaaagccagggcug

SEQ ID NO: 3537755 - RNA, 14 nt, Human
uaggauacugcugc

SEQ ID NO: 3537756 - RNA, 18 nt, Human
uaggauaugccugcucuu

SEQ ID NO: 3537757 - RNA, 21 nt, Human
uaggauaugccugcucuuugg

SEQ ID NO: 3537758 - RNA, 21 nt, Human
uaggauccagugauccuuaca

SEQ ID NO: 3537759 - RNA, 14 nt, Human
uaggauguaaaucu

SEQ ID NO: 3537760 - RNA, 22 nt, Human
uaggauuuaacagucauuuaaa

SEQ ID NO: 3537761 - RNA, 22 nt, Human
uaggauuuuggauguugagagg

SEQ ID NO: 3537762 - RNA, 12 nt, Human
uaggcaacauag

SEQ ID NO: 3537763 - RNA, 18 nt, Human
uaggcacucuuaaaugau

SEQ ID NO: 3537764 - RNA, 18 nt, Human
uaggcacuguaguucuaa

SEQ ID NO: 3537765 - RNA, 19 nt, Human
uaggcacuguaguucuaag

SEQ ID NO: 3537766 - RNA, 17 nt, Human
uaggcacuuuaaaacac

SEQ ID NO: 3537767 - RNA, 15 nt, Human
uaggcagacacaggg

SEQ ID NO: 3537768 - RNA, 13 nt, Human
uaggcagagccuu

SEQ ID NO: 3537769 - RNA, 20 nt, Human
uaggcagauugaaaaggaca

SEQ ID NO: 3537770 - RNA, 13 nt, Human
uaggcagcagcuu

SEQ ID NO: 3537771 - RNA, 12 nt, Human
uaggcaggacca

SEQ ID NO: 3537772 - RNA, 14 nt, Human
uaggcaggaccugu

SEQ ID NO: 3537773 - RNA, 24 nt, Human
uaggcaguuagagaugccucccug

SEQ ID NO: 3537774 - RNA, 16 nt, Human
uaggcauaugcuucuu

SEQ ID NO: 3537775 - RNA, 17 nt, Human
uaggcaucucuguacuu

SEQ ID NO: 3537776 - RNA, 23 nt, Human
uaggcaugaagagcaaaaauauc

SEQ ID NO: 3537777 - RNA, 14 nt, Human
uaggcauguaaaca

SEQ ID NO: 3537778 - RNA, 20 nt, Human
uaggcauuaacacaaaggag

SEQ ID NO: 3537779 - RNA, 20 nt, Human
uaggcauucuggaccucugg

SEQ ID NO: 3537780 - RNA, 18 nt, Human
uaggcauugugggaaggg

SEQ ID NO: 3537781 - RNA, 19 nt, Human
uaggccaaagacaaauagu

SEQ ID NO: 3537782 - RNA, 23 nt, Human
uaggccaagguguccuacagaaa

SEQ ID NO: 3537783 - RNA, 13 nt, Human
uaggccacuccuc

SEQ ID NO: 3537784 - RNA, 15 nt, Human
uaggccacuccucca

SEQ ID NO: 3537785 - RNA, 13 nt, Human
uaggccagcaagc

SEQ ID NO: 3537786 - RNA, 18 nt, Human
uaggccaugggacaggga

SEQ ID NO: 3537787 - RNA, 16 nt, Human
uaggcccacacacagg

SEQ ID NO: 3537788 - RNA, 19 nt, Human
uaggcccccacuugccucu

SEQ ID NO: 3537789 - RNA, 21 nt, Human
uaggcccccacuugccucuuc

SEQ ID NO: 3537790 - RNA, 19 nt, Human
uaggccggugugccugacu

SEQ ID NO: 3537791 - RNA, 17 nt, Human
uaggccguuccuucaaa

SEQ ID NO: 3537792 - RNA, 22 nt, Human
uaggccuacuggggaucagagu

SEQ ID NO: 3537793 - RNA, 18 nt, Human
uaggccucagccagagaa

SEQ ID NO: 3537794 - RNA, 22 nt, Human
uaggccucagccagagaagcua

SEQ ID NO: 3537795 - RNA, 14 nt, Human
uaggccuggcacag

SEQ ID NO: 3537796 - RNA, 17 nt, Human
uaggccuggcacagugu

SEQ ID NO: 3537797 - RNA, 13 nt, Human
uaggccuggccag

SEQ ID NO: 3537798 - RNA, 14 nt, Human
uaggccuucuugug

SEQ ID NO: 3537799 - RNA, 23 nt, Human
uaggccuugcggcuccucaggga

SEQ ID NO: 3537800 - RNA, 15 nt, Human
uaggcgaccaccgcc

SEQ ID NO: 3537801 - RNA, 13 nt, Human
uaggcgaucacaa

SEQ ID NO: 3537802 - RNA, 13 nt, Human
uaggcuaauguca

SEQ ID NO: 3537803 - RNA, 14 nt, Human
uaggcuaaugucaa

SEQ ID NO: 3537804 - RNA, 14 nt, Human
uaggcuacagagaa

SEQ ID NO: 3537805 - RNA, 16 nt, Human
uaggcuacagagaagc

SEQ ID NO: 3537806 - RNA, 20 nt, Human
uaggcuacagagaagccuuc

SEQ ID NO: 3537807 - RNA, 21 nt, Human
uaggcuacagagaagccuuca

SEQ ID NO: 3537808 - RNA, 14 nt, Human
uaggcuauucacaa

SEQ ID NO: 3537809 - RNA, 20 nt, Human
uaggcuauuuucuaaagacu

SEQ ID NO: 3537810 - RNA, 19 nt, Human
uaggcucagagaugugcac

SEQ ID NO: 3537811 - RNA, 22 nt, Human
uaggcuccgucaguaucaggcc

SEQ ID NO: 3537812 - RNA, 22 nt, Human
uaggcucgccuucccuccugcu

SEQ ID NO: 3537813 - RNA, 11 nt, Human
uaggcucugca

SEQ ID NO: 3537814 - RNA, 21 nt, Human
uaggcucugcacagauggauu

SEQ ID NO: 3537815 - RNA, 13 nt, Human
uaggcucugccuu

SEQ ID NO: 3537816 - RNA, 21 nt, Human
uaggcugacaccuaacucuuc

SEQ ID NO: 3537817 - RNA, 23 nt, Human
uaggcugacaccuaacucuucuu

SEQ ID NO: 3537818 - RNA, 12 nt, Human
uaggcuggaagg

SEQ ID NO: 3537819 - RNA, 15 nt, Human
uaggcuggagaagcu

SEQ ID NO: 3537820 - RNA, 19 nt, Human
uaggcuggagaagcucacc

SEQ ID NO: 3537821 - RNA, 21 nt, Human
uaggcuggagaagcucaccca

SEQ ID NO: 3537822 - RNA, 19 nt, Human
uaggcuggagcccagggag

SEQ ID NO: 3537823 - RNA, 12 nt, Human
uaggcugggugc

SEQ ID NO: 3537824 - RNA, 16 nt, Human
uaggcugguggcccag

SEQ ID NO: 3537825 - RNA, 19 nt, Human
uaggcuguaacuacuuuau

SEQ ID NO: 3537826 - RNA, 21 nt, Human
uaggcuguaacuacuuuauaa

SEQ ID NO: 3537827 - RNA, 14 nt, Human
uaggcuuucagcuu

SEQ ID NO: 3537828 - RNA, 21 nt, Human
uagggaaaaaccagcguguga

SEQ ID NO: 3537829 - RNA, 16 nt, Human
uagggaaaacauucca

SEQ ID NO: 3537830 - RNA, 20 nt, Human
uagggaagggugguggagcc

SEQ ID NO: 3537831 - RNA, 21 nt, Human
uagggaagggugguggagcca

SEQ ID NO: 3537832 - RNA, 22 nt, Human
uagggacaggaccccagcucug

SEQ ID NO: 3537833 - RNA, 15 nt, Human
uagggaccccuccuc

SEQ ID NO: 3537834 - RNA, 17 nt, Human
uagggacugaccagcag

SEQ ID NO: 3537835 - RNA, 14 nt, Human
uagggagagaagau

SEQ ID NO: 3537836 - RNA, 13 nt, Human
uagggagauauuu

SEQ ID NO: 3537837 - RNA, 12 nt, Human
uagggagccaug

SEQ ID NO: 3537838 - RNA, 17 nt, Human
uagggagccauuugaga

SEQ ID NO: 3537839 - RNA, 13 nt, Human
uagggaggaccac

SEQ ID NO: 3537840 - RNA, 13 nt, Human
uagggaggcagcc

SEQ ID NO: 3537841 - RNA, 16 nt, Human
uagggaggcagccucc

SEQ ID NO: 3537842 - RNA, 18 nt, Human
uagggagggcggcagggg

SEQ ID NO: 3537843 - RNA, 15 nt, Human
uagggaguauucuaa

SEQ ID NO: 3537844 - RNA, 21 nt, Human
uagggauagucaccuuuuaaa

SEQ ID NO: 3537845 - RNA, 23 nt, Human
uagggaucaaccagcuaagaaaa

SEQ ID NO: 3537846 - RNA, 16 nt, Human
uagggaugccuccuuu

SEQ ID NO: 3537847 - RNA, 15 nt, Human
uagggcaauuggaac

SEQ ID NO: 3537848 - RNA, 15 nt, Human
uagggcacugggcug

SEQ ID NO: 3537849 - RNA, 22 nt, Human
uagggcaggagugagaggucuc

SEQ ID NO: 3537850 - RNA, 16 nt, Human
uagggcauuguaucug

SEQ ID NO: 3537851 - RNA, 16 nt, Human
uagggccaagcccagc

SEQ ID NO: 3537852 - RNA, 11 nt, Human
uagggccaggc

SEQ ID NO: 3537853 - RNA, 23 nt, Human
uagggcuacaaaaccugauguua

SEQ ID NO: 3537854 - RNA, 14 nt, Human
uagggcuggaccua

SEQ ID NO: 3537855 - RNA, 20 nt, Human
uagggcugggcaaggaaaaa

SEQ ID NO: 3537856 - RNA, 21 nt, Human
uagggcugggcaaggaaaaag

SEQ ID NO: 3537857 - RNA, 23 nt, Human
uaggggacacuucccucuguuuc

SEQ ID NO: 3537858 - RNA, 11 nt, Human
uaggggcuggg

SEQ ID NO: 3537859 - RNA, 21 nt, Human
uaggggcuuauaauaaaggac

SEQ ID NO: 3537860 - RNA, 15 nt, Human
uagggggcuggagga

SEQ ID NO: 3537861 - RNA, 18 nt, Human
uagggggcuggaggagcc

SEQ ID NO: 3537862 - RNA, 15 nt, Human
uagggggcuuucugg

SEQ ID NO: 3537863 - RNA, 22 nt, Human
uaggggucugucuuuuaaacuc

SEQ ID NO: 3537864 - RNA, 13 nt, Human
uaggguaaaaauu

SEQ ID NO: 3537865 - RNA, 12 nt, Human
uaggguaaauca

SEQ ID NO: 3537866 - RNA, 13 nt, Human
uaggguaaaucag

SEQ ID NO: 3537867 - RNA, 22 nt, Human
uaggguaaaucaguaagaggug

SEQ ID NO: 3537868 - RNA, 15 nt, Human
uauacauacacuugu

SEQ ID NO: 3537869 - RNA, 20 nt, Human
uauacauacacuuguauaaa

SEQ ID NO: 3537870 - RNA, 16 nt, Human
uauacauagcaugaca

SEQ ID NO: 3537871 - RNA, 19 nt, Human
uauacauauauauauauaa

SEQ ID NO: 3537872 - RNA, 19 nt, Human
uauacauauguagacuaua

SEQ ID NO: 3537873 - RNA, 23 nt, Human
uauacauauguagacuauauaca

SEQ ID NO: 3537874 - RNA, 21 nt, Human
uauacauccuggguaaugaga

SEQ ID NO: 3537875 - RNA, 19 nt, Human
uauacaugaaaauuuuaaa

SEQ ID NO: 3537876 - RNA, 21 nt, Human
uauacaugaagaauagaaaca

SEQ ID NO: 3537877 - RNA, 17 nt, Human
uauacaugacacugaaa

SEQ ID NO: 3537878 - RNA, 15 nt, Human
uauacaugccaguga

SEQ ID NO: 3537879 - RNA, 15 nt, Human
uauacauguguguau

SEQ ID NO: 3537880 - RNA, 16 nt, Human
uauacauguguguaua

SEQ ID NO: 3537881 - RNA, 19 nt, Human
uauacauguguguauauau

SEQ ID NO: 3537882 - RNA, 23 nt, Human
uauacauuaguaaaugucuuugu

SEQ ID NO: 3537883 - RNA, 16 nt, Human
uauacauucuuuaucu

SEQ ID NO: 3537884 - RNA, 15 nt, Human
uauaccaauaaagug

SEQ ID NO: 3537885 - RNA, 19 nt, Human
uauaccaguauaauugagu

SEQ ID NO: 3537886 - RNA, 17 nt, Human
uauaccuauaaugugug

SEQ ID NO: 3537887 - RNA, 21 nt, Human
uauaccuauaauguguguaug

SEQ ID NO: 3537888 - RNA, 21 nt, Human
uauaccucaauuuucacugug

SEQ ID NO: 3537889 - RNA, 22 nt, Human
uauaccugggcauacuaauaaa

SEQ ID NO: 3537890 - RNA, 14 nt, Human
uauaccugugccuc

SEQ ID NO: 3537891 - RNA, 12 nt, Human
uauaccuguguu

SEQ ID NO: 3537892 - RNA, 19 nt, Human
uauaccuguuuaaauugcu

SEQ ID NO: 3537893 - RNA, 21 nt, Human
uauaccuguuuaaauugcuca

SEQ ID NO: 3537894 - RNA, 16 nt, Human
uauaccuuugccuugg

SEQ ID NO: 3537895 - RNA, 16 nt, Human
uauacgaaauaauugu

SEQ ID NO: 3537896 - RNA, 17 nt, Human
uauacgaacaaaacaca

SEQ ID NO: 3537897 - RNA, 15 nt, Human
uauacgcuuuucuuu

SEQ ID NO: 3537898 - RNA, 22 nt, Human
uauacgugaaaauuauuugaaa

SEQ ID NO: 3537899 - RNA, 13 nt, Human
uauacguguagcu

SEQ ID NO: 3537900 - RNA, 13 nt, Human
uauacguuucaaa

SEQ ID NO: 3537901 - RNA, 22 nt, Human
uauacuagggagccauuugaga

SEQ ID NO: 3537902 - RNA, 19 nt, Human
uauacuauuaaaaagguuu

SEQ ID NO: 3537903 - RNA, 16 nt, Human
uauacucauuagaauu

SEQ ID NO: 3537904 - RNA, 22 nt, Human
uauacucauuagaauuaccauu

SEQ ID NO: 3537905 - RNA, 22 nt, Human
uauacuccaguguacauagugu

SEQ ID NO: 3537906 - RNA, 12 nt, Human
uauacugaagga

SEQ ID NO: 3537907 - RNA, 20 nt, Human
uauacugauuaugucuuuua

SEQ ID NO: 3537908 - RNA, 23 nt, Human
uauacuggcaugcuaaagccuuc

SEQ ID NO: 3537909 - RNA, 14 nt, Human
uauacuguaaagaa

SEQ ID NO: 3537910 - RNA, 15 nt, Human
uauacuguaaagaaa

SEQ ID NO: 3537911 - RNA, 14 nt, Human
uauacuguaauuua

SEQ ID NO: 3537912 - RNA, 22 nt, Human
uauacuguaauuuaguuauuga

SEQ ID NO: 3537913 - RNA, 15 nt, Human
uauacuguacaauaa

SEQ ID NO: 3537914 - RNA, 17 nt, Human
uauacuguauuaagagu

SEQ ID NO: 3537915 - RNA, 23 nt, Human
uauacugugugugagugugaaua

SEQ ID NO: 3537916 - RNA, 13 nt, Human
uauacuugaacaa

SEQ ID NO: 3537917 - RNA, 17 nt, Human
uauacuugaacaaaagg

SEQ ID NO: 3537918 - RNA, 15 nt, Human
uauacuuguaauuau

SEQ ID NO: 3537919 - RNA, 16 nt, Human
uauacuuguaauuaug

SEQ ID NO: 3537920 - RNA, 18 nt, Human
uauacuugugguuuucaa

SEQ ID NO: 3537921 - RNA, 14 nt, Human
uauacuuuaaauaa

SEQ ID NO: 3537922 - RNA, 18 nt, Human
uauacuuuaaauaauggu

SEQ ID NO: 3537923 - RNA, 16 nt, Human
uauacuuucccuaccc

SEQ ID NO: 3537924 - RNA, 17 nt, Human
uauacuuuuuucuuauu

SEQ ID NO: 3537925 - RNA, 19 nt, Human
uauacuuuuuucuuauuua

SEQ ID NO: 3537926 - RNA, 22 nt, Human
uauagaaagcaagauguacuau

SEQ ID NO: 3537927 - RNA, 24 nt, Human
uauagaaagcuauauaagacaaga

SEQ ID NO: 3537928 - RNA, 12 nt, Human
uauagaaagugu

SEQ ID NO: 3537929 - RNA, 19 nt, Human
uauagaaauauauacgaac

SEQ ID NO: 3537930 - RNA, 17 nt, Human
uauagaacugaaugaga

SEQ ID NO: 3537931 - RNA, 22 nt, Human
uauagaacuucauggaucagau

SEQ ID NO: 3537932 - RNA, 13 nt, Human
uauagaagucuuc

SEQ ID NO: 3537933 - RNA, 22 nt, Human
uauagaagucuucaugaaaugc

SEQ ID NO: 3537934 - RNA, 13 nt, Human
uauagaaguuuag

SEQ ID NO: 3537935 - RNA, 16 nt, Human
uauagaaguuugucca

SEQ ID NO: 3537936 - RNA, 22 nt, Human
uauagaauaaugugggaagaaa

SEQ ID NO: 3537937 - RNA, 15 nt, Human
uauagaauauuuauu

SEQ ID NO: 3537938 - RNA, 21 nt, Human
uauagaauauuuauuaccucu

SEQ ID NO: 3537939 - RNA, 16 nt, Human
uauagaauuagcuuuu

SEQ ID NO: 3537940 - RNA, 18 nt, Human
uauagaauuuuuaauguu

SEQ ID NO: 3537941 - RNA, 14 nt, Human
uauagacagcuuug

SEQ ID NO: 3537942 - RNA, 21 nt, Human
uauagacaguuuguaaauguu

SEQ ID NO: 3537943 - RNA, 16 nt, Human
uauagacccgaggaaa

SEQ ID NO: 3537944 - RNA, 22 nt, Human
uauagagaaaggucuaugcaga

SEQ ID NO: 3537945 - RNA, 15 nt, Human
uauagagauaugcag

SEQ ID NO: 3537946 - RNA, 17 nt, Human
uauagagcagaaauucu

SEQ ID NO: 3537947 - RNA, 19 nt, Human
uauagagcagaaauucugu

SEQ ID NO: 3537948 - RNA, 21 nt, Human
uauagaggacccuaacacagu

SEQ ID NO: 3537949 - RNA, 16 nt, Human
uauagaguucauccca

SEQ ID NO: 3537950 - RNA, 20 nt, Human
uauagauauaaugaacaaaa

SEQ ID NO: 3537951 - RNA, 13 nt, Human
uauagaucagcca

SEQ ID NO: 3537952 - RNA, 18 nt, Human
gcccacuccaucugguag

SEQ ID NO: 3537953 - RNA, 18 nt, Human
gcccacugcccacccccu

SEQ ID NO: 3537954 - RNA, 23 nt, Human
gcccacugcccacccccucaagc

SEQ ID NO: 3537955 - RNA, 21 nt, Human
gcccacugcugcaguagggga

SEQ ID NO: 3537956 - RNA, 13 nt, Human
gcccacuggauca

SEQ ID NO: 3537957 - RNA, 15 nt, Human
gcccacuguccuggg

SEQ ID NO: 3537958 - RNA, 17 nt, Human
gcccacuguccugggcc

SEQ ID NO: 3537959 - RNA, 24 nt, Human
gcccacuguccugggccugcagaa

SEQ ID NO: 3537960 - RNA, 21 nt, Human
gcccacuguccugggcgcccu

SEQ ID NO: 3537961 - RNA, 16 nt, Human
gcccacugugccucag

SEQ ID NO: 3537962 - RNA, 22 nt, Human
gcccacugugccucagagacca

SEQ ID NO: 3537963 - RNA, 23 nt, Human
gcccacugugcguggggcucccg

SEQ ID NO: 3537964 - RNA, 19 nt, Human
gcccacuuacauuuacaaa

SEQ ID NO: 3537965 - RNA, 13 nt, Human
gcccacuucaggg

SEQ ID NO: 3537966 - RNA, 23 nt, Human
gcccacuucaggguucuccucuc

SEQ ID NO: 3537967 - RNA, 21 nt, Human
gcccagaagaaaauucuccug

SEQ ID NO: 3537968 - RNA, 20 nt, Human
gcccagaauaaguuauugca

SEQ ID NO: 3537969 - RNA, 21 nt, Human
gcccagaauucccagcugucu

SEQ ID NO: 3537970 - RNA, 23 nt, Human
gcccagaauucccagcugucugu

SEQ ID NO: 3537971 - RNA, 18 nt, Human
gcccagacccuggaggaa

SEQ ID NO: 3537972 - RNA, 21 nt, Human
gcccagagaggguggugaccu

SEQ ID NO: 3537973 - RNA, 13 nt, Human
gcccagagcccag

SEQ ID NO: 3537974 - RNA, 17 nt, Human
gcccagagcccagcucc

SEQ ID NO: 3537975 - RNA, 23 nt, Human
gcccagagccucgaggagguaau

SEQ ID NO: 3537976 - RNA, 13 nt, Human
gcccagagccugg

SEQ ID NO: 3537977 - RNA, 13 nt, Human
gcccagagcuggg

SEQ ID NO: 3537978 - RNA, 21 nt, Human
gcccagaggacucccaacccu

SEQ ID NO: 3537979 - RNA, 13 nt, Human
gcccagaggcuga

SEQ ID NO: 3537980 - RNA, 15 nt, Human
gcccagagggcccag

SEQ ID NO: 3537981 - RNA, 20 nt, Human
gcccagagggcccaggcagg

SEQ ID NO: 3537982 - RNA, 18 nt, Human
gcccagagggccugcaag

SEQ ID NO: 3537983 - RNA, 19 nt, Human
gcccagagggccugcaagg

SEQ ID NO: 3537984 - RNA, 20 nt, Human
gcccagagggccugcaaggg

SEQ ID NO: 3537985 - RNA, 14 nt, Human
gcccagagggucug

SEQ ID NO: 3537986 - RNA, 16 nt, Human
gcccagaucagcuccu

SEQ ID NO: 3537987 - RNA, 20 nt, Human
gcccagauuaugagacacag

SEQ ID NO: 3537988 - RNA, 21 nt, Human
gcccagauuccccugugucau

SEQ ID NO: 3537989 - RNA, 21 nt, Human
gcccagcaccacccuccuucc

SEQ ID NO: 3537990 - RNA, 14 nt, Human
gcccagcauugcug

SEQ ID NO: 3537991 - RNA, 12 nt, Human
gcccagccagcg

SEQ ID NO: 3537992 - RNA, 13 nt, Human
gcccagccagcgu

SEQ ID NO: 3537993 - RNA, 22 nt, Human
gcccagccauuaccauggagac

SEQ ID NO: 3537994 - RNA, 18 nt, Human
gcccagccccacuccucu

SEQ ID NO: 3537995 - RNA, 21 nt, Human
gcccagccccuacugcuguga

SEQ ID NO: 3537996 - RNA, 15 nt, Human
gcccagccccuagaa

SEQ ID NO: 3537997 - RNA, 12 nt, Human
gcccagccccuu

SEQ ID NO: 3537998 - RNA, 24 nt, Human
gcccagccccuucugacccaugcu

SEQ ID NO: 3537999 - RNA, 11 nt, Human
gcccagcccug

SEQ ID NO: 3538000 - RNA, 13 nt, Human
gcccagcccugcu

SEQ ID NO: 3538001 - RNA, 16 nt, Human
gcccagccggccucuc

SEQ ID NO: 3538002 - RNA, 18 nt, Human
gcccagccggccucucug

SEQ ID NO: 3538003 - RNA, 20 nt, Human
gcccagccggccucucuggc

SEQ ID NO: 3538004 - RNA, 24 nt, Human
gcccagccggccucucuggccucc

SEQ ID NO: 3538005 - RNA, 18 nt, Human
gcccagcggacaguggca

SEQ ID NO: 3538006 - RNA, 17 nt, Human
gcccagcggccccuccc

SEQ ID NO: 3538007 - RNA, 15 nt, Human
gcccagcuagcugca

SEQ ID NO: 3538008 - RNA, 18 nt, Human
gcccagcuauaccugugc

SEQ ID NO: 3538009 - RNA, 12 nt, Human
gcccagcuccaa

SEQ ID NO: 3538010 - RNA, 13 nt, Human
gcccagcuccccc

SEQ ID NO: 3538011 - RNA, 23 nt, Human
uagacuguugggguggguauaaa

SEQ ID NO: 3538012 - RNA, 23 nt, Human
uagacuucagggagucagcuguu

SEQ ID NO: 3538013 - RNA, 22 nt, Human
uagacuucgacucaggauccag

SEQ ID NO: 3538014 - RNA, 22 nt, Human
uagacuucugcuuuccacaccu

SEQ ID NO: 3538015 - RNA, 18 nt, Human
uagacuucuguuuucaau

SEQ ID NO: 3538016 - RNA, 19 nt, Human
uagacuugaaaagagacag

SEQ ID NO: 3538017 - RNA, 16 nt, Human
uagacuugaggaaacc

SEQ ID NO: 3538018 - RNA, 17 nt, Human
uagacuuuagaaauaaa

SEQ ID NO: 3538019 - RNA, 11 nt, Human
uagacuuucug

SEQ ID NO: 3538020 - RNA, 19 nt, Human
uagagaaaacaugcagaac

SEQ ID NO: 3538021 - RNA, 21 nt, Human
uagagaaaacuaaagaaauuu

SEQ ID NO: 3538022 - RNA, 22 nt, Human
uagagaaaccguccucuuuuuc

SEQ ID NO: 3538023 - RNA, 16 nt, Human
uagagaacgcagcccu

SEQ ID NO: 3538024 - RNA, 12 nt, Human
uagagaacugaa

SEQ ID NO: 3538025 - RNA, 13 nt, Human
uagagaacugaaa

SEQ ID NO: 3538026 - RNA, 21 nt, Human
uagagaacugaaaagagagca

SEQ ID NO: 3538027 - RNA, 13 nt, Human
uagagaagacagg

SEQ ID NO: 3538028 - RNA, 14 nt, Human
uagagaagauaauu

SEQ ID NO: 3538029 - RNA, 16 nt, Human
uagagaagcaaguaaa

SEQ ID NO: 3538030 - RNA, 12 nt, Human
uagagaauguuc

SEQ ID NO: 3538031 - RNA, 16 nt, Human
uagagaauguuccaga

SEQ ID NO: 3538032 - RNA, 22 nt, Human
uagagaauguuccagacauucu

SEQ ID NO: 3538033 - RNA, 21 nt, Human
uagagacagaagcaggcugga

SEQ ID NO: 3538034 - RNA, 18 nt, Human
uagagacuggaacacuag

SEQ ID NO: 3538035 - RNA, 16 nt, Human
uagagacugguuucuc

SEQ ID NO: 3538036 - RNA, 21 nt, Human
uagagacuuuuuucuaguaca

SEQ ID NO: 3538037 - RNA, 21 nt, Human
uagagaguuguuguguacaga

SEQ ID NO: 3538038 - RNA, 17 nt, Human
uagagauaguacauaaa

SEQ ID NO: 3538039 - RNA, 20 nt, Human
uagagauauauauacuugug

SEQ ID NO: 3538040 - RNA, 19 nt, Human
uagagaucauccuuuccag

SEQ ID NO: 3538041 - RNA, 18 nt, Human
uagagaucugguuuugcu

SEQ ID NO: 3538042 - RNA, 13 nt, Human
uagagaugagcuu

SEQ ID NO: 3538043 - RNA, 16 nt, Human
uagagaugagcuuucu

SEQ ID NO: 3538044 - RNA, 15 nt, Human
uagagaugagguuuc

SEQ ID NO: 3538045 - RNA, 14 nt, Human
uagagaugccuccc

SEQ ID NO: 3538046 - RNA, 16 nt, Human
uagagaugccucccug

SEQ ID NO: 3538047 - RNA, 19 nt, Human
uagagauggggaaagaauu

SEQ ID NO: 3538048 - RNA, 20 nt, Human
uagagauuugucuaauugca

SEQ ID NO: 3538049 - RNA, 11 nt, Human
uagagcacugc

SEQ ID NO: 3538050 - RNA, 14 nt, Human
uagagcagaaauuc

SEQ ID NO: 3538051 - RNA, 23 nt, Human
uagagcaggacugaugucuccua

SEQ ID NO: 3538052 - RNA, 11 nt, Human
uagagcaggcg

SEQ ID NO: 3538053 - RNA, 19 nt, Human
uagagcauugaauuggaga

SEQ ID NO: 3538054 - RNA, 19 nt, Human
uagagcauugccauucccu

SEQ ID NO: 3538055 - RNA, 13 nt, Human
uagagccagcuug

SEQ ID NO: 3538056 - RNA, 21 nt, Human
uagagccaggcacacacugug

SEQ ID NO: 3538057 - RNA, 18 nt, Human
uagagccgggugucccca

SEQ ID NO: 3538058 - RNA, 12 nt, Human
uagagccugccu

SEQ ID NO: 3538059 - RNA, 13 nt, Human
uagagccugccug

SEQ ID NO: 3538060 - RNA, 22 nt, Human
uagagccuucugaugucucuaa

SEQ ID NO: 3538061 - RNA, 22 nt, Human
uagagcggagaaaggaagggcu

SEQ ID NO: 3538062 - RNA, 10 nt, Human
uagagcuccu

SEQ ID NO: 3538063 - RNA, 12 nt, Human
uagagcuuucuu

SEQ ID NO: 3538064 - RNA, 23 nt, Human
uagagcuuucuuucacaaaaaag

SEQ ID NO: 3538065 - RNA, 21 nt, Human
uagaggaagccugauuaaaga

SEQ ID NO: 3538066 - RNA, 20 nt, Human
uagaggaucccucucuggau

SEQ ID NO: 3538067 - RNA, 22 nt, Human
uagaggauggucuuacagcagg

SEQ ID NO: 3538068 - RNA, 21 nt, Human
uagaggccugaaauccugguu

SEQ ID NO: 3538069 - RNA, 22 nt, Human
uagaggccugacugccaagcca

SEQ ID NO: 3538070 - RNA, 23 nt, Human
uagaggccugaggaugagcugga

SEQ ID NO: 3538071 - RNA, 13 nt, Human
uagaggcuagcuu

SEQ ID NO: 3538072 - RNA, 14 nt, Human
uagaggcuucuccg

SEQ ID NO: 3538073 - RNA, 18 nt, Human
uagaggcuucuccgccag

SEQ ID NO: 3538074 - RNA, 19 nt, Human
uagaggcuucuccgccagc

SEQ ID NO: 3538075 - RNA, 17 nt, Human
uagagggaacagggcgg

SEQ ID NO: 3538076 - RNA, 23 nt, Human
uagagggaggagaaugagccucg

SEQ ID NO: 3538077 - RNA, 14 nt, Human
uagagggcccuggu

SEQ ID NO: 3538078 - RNA, 14 nt, Human
uagaggguguguaa

SEQ ID NO: 3538079 - RNA, 23 nt, Human
uagagguaccagcaauauguaaa

SEQ ID NO: 3538080 - RNA, 15 nt, Human
uagagguacuagaau

SEQ ID NO: 3538081 - RNA, 18 nt, Human
uagagguacuagaaugcu

SEQ ID NO: 3538082 - RNA, 17 nt, Human
uagagguauauuggaag

SEQ ID NO: 3538083 - RNA, 17 nt, Human
uagagguccucuggagc

SEQ ID NO: 3538084 - RNA, 18 nt, Human
uagagguccucuggagcc

SEQ ID NO: 3538085 - RNA, 13 nt, Human
uagaggugcaugc

SEQ ID NO: 3538086 - RNA, 15 nt, Human
uagagguucaaagau

SEQ ID NO: 3538087 - RNA, 15 nt, Human
uagagguuuuaaagu

SEQ ID NO: 3538088 - RNA, 19 nt, Human
uagagguuuuaaagugauu

SEQ ID NO: 3538089 - RNA, 18 nt, Human
uagaguaaauacagguag

SEQ ID NO: 3538090 - RNA, 14 nt, Human
uagaguaagaaauu

SEQ ID NO: 3538091 - RNA, 15 nt, Human
uagaguaagaaauuu

SEQ ID NO: 3538092 - RNA, 21 nt, Human
uagaguaagaaauuucagguu

SEQ ID NO: 3538093 - RNA, 14 nt, Human
uagaguaaugaaau

SEQ ID NO: 3538094 - RNA, 15 nt, Human
uagaguaaugaaaug

SEQ ID NO: 3538095 - RNA, 13 nt, Human
uagaguacacugc

SEQ ID NO: 3538096 - RNA, 22 nt, Human
uagaguacacugccugccuuaa

SEQ ID NO: 3538097 - RNA, 21 nt, Human
uagaguagaagauuugaugcu

SEQ ID NO: 3538098 - RNA, 19 nt, Human
uagaguagagguauaauug

SEQ ID NO: 3538099 - RNA, 18 nt, Human
uagagucaacuacacaaa

SEQ ID NO: 3538100 - RNA, 21 nt, Human
uagagucaucuccaucagcug

SEQ ID NO: 3538101 - RNA, 19 nt, Human
uagagucauuguaauguug

SEQ ID NO: 3538102 - RNA, 22 nt, Human
uagaguccaacguggggcagca

SEQ ID NO: 3538103 - RNA, 22 nt, Human
uagagucccagguuggcucugc

SEQ ID NO: 3538104 - RNA, 20 nt, Human
uagaguccucacucccaguc

SEQ ID NO: 3538105 - RNA, 19 nt, Human
uauagaugggaaugaagcu

SEQ ID NO: 3538106 - RNA, 14 nt, Human
uauagaugucuuuu

SEQ ID NO: 3538107 - RNA, 10 nt, Human
uauagauguu

SEQ ID NO: 3538108 - RNA, 19 nt, Human
uauagauuagagaguguug

SEQ ID NO: 3538109 - RNA, 13 nt, Human
uauagauucuaaa

SEQ ID NO: 3538110 - RNA, 19 nt, Human
uauagauugaaauuuccua

SEQ ID NO: 3538111 - RNA, 17 nt, Human
uauagauuguccuuuug

SEQ ID NO: 3538112 - RNA, 21 nt, Human
uauagcaaaacuuuuaaacua

SEQ ID NO: 3538113 - RNA, 23 nt, Human
uauagcaaaacuuuuaaacuaca

SEQ ID NO: 3538114 - RNA, 13 nt, Human
uauagcacuuuga

SEQ ID NO: 3538115 - RNA, 20 nt, Human
uauagcacuuugaaauaccu

SEQ ID NO: 3538116 - RNA, 22 nt, Human
uauagcagcaaaaauauaaaau

SEQ ID NO: 3538117 - RNA, 16 nt, Human
uauagcaucacuuaaa

SEQ ID NO: 3538118 - RNA, 19 nt, Human
uauagccuauggcagaaaa

SEQ ID NO: 3538119 - RNA, 16 nt, Human
uauagcuacaggaagc

SEQ ID NO: 3538120 - RNA, 19 nt, Human
uauagcuaggugacauaua

SEQ ID NO: 3538121 - RNA, 14 nt, Human
uauagcucuaaugu

SEQ ID NO: 3538122 - RNA, 16 nt, Human
uauagcucuaauguuu

SEQ ID NO: 3538123 - RNA, 18 nt, Human
uauagcucuaauguuugc

SEQ ID NO: 3538124 - RNA, 20 nt, Human
uauagcucuaauguuugcau

SEQ ID NO: 3538125 - RNA, 21 nt, Human
uauagcugagacuacaagugu

SEQ ID NO: 3538126 - RNA, 18 nt, Human
uauagcuggcaagaaugg

SEQ ID NO: 3538127 - RNA, 18 nt, Human
uauagcuguacaaauaua

SEQ ID NO: 3538128 - RNA, 19 nt, Human
uauaggaacauaugaaaau

SEQ ID NO: 3538129 - RNA, 23 nt, Human
uauaggaacuuaaauaaugugaa

SEQ ID NO: 3538130 - RNA, 15 nt, Human
uauaggcaccuacca

SEQ ID NO: 3538131 - RNA, 21 nt, Human
uauaggcuauuuucuaaagac

SEQ ID NO: 3538132 - RNA, 17 nt, Human
uauaggucacuccuggg

SEQ ID NO: 3538133 - RNA, 16 nt, Human
uauaggugcuacaaaa

SEQ ID NO: 3538134 - RNA, 23 nt, Human
uauaggugcuacaaaaacacagc

SEQ ID NO: 3538135 - RNA, 15 nt, Human
uauagguugugcaaa

SEQ ID NO: 3538136 - RNA, 17 nt, Human
uauagguuuuguuugcu

SEQ ID NO: 3538137 - RNA, 20 nt, Human
uauagguuuuguuugcuauc

SEQ ID NO: 3538138 - RNA, 14 nt, Human
uauaguacaugaua

SEQ ID NO: 3538139 - RNA, 16 nt, Human
uauaguacaugauaaa

SEQ ID NO: 3538140 - RNA, 20 nt, Human
uauaguaccuuugcucuugc

SEQ ID NO: 3538141 - RNA, 18 nt, Human
uauaguauaucuggacaa

SEQ ID NO: 3538142 - RNA, 13 nt, Human
uauaguauuugaa

SEQ ID NO: 3538143 - RNA, 15 nt, Human
uauaguauuugaaaa

SEQ ID NO: 3538144 - RNA, 18 nt, Human
uauaguauuugaaaacag

SEQ ID NO: 3538145 - RNA, 22 nt, Human
uauaguauuugaaaacagaaau

SEQ ID NO: 3538146 - RNA, 18 nt, Human
uauaguauuugauucaaa

SEQ ID NO: 3538147 - RNA, 22 nt, Human
uauagucauuuauuuuaaaaaa

SEQ ID NO: 3538148 - RNA, 16 nt, Human
uauagucuaagacuau

SEQ ID NO: 3538149 - RNA, 19 nt, Human
uauagucuaagacuauaua

SEQ ID NO: 3538150 - RNA, 18 nt, Human
uauagugauguaaucuug

SEQ ID NO: 3538151 - RNA, 14 nt, Human
uauagugcaauaua

SEQ ID NO: 3538152 - RNA, 20 nt, Human
uauagugcuauauauauaaa

SEQ ID NO: 3538153 - RNA, 17 nt, Human
uauaguguagaaaagaa

SEQ ID NO: 3538154 - RNA, 14 nt, Human
uauaguguguugug

SEQ ID NO: 3538155 - RNA, 22 nt, Human
uaugcaggggcaaacaccugcu

SEQ ID NO: 3538156 - RNA, 19 nt, Human
uaugcagugauauggcaga

SEQ ID NO: 3538157 - RNA, 24 nt, Human
uaugcauaauaauccugcaaagua

SEQ ID NO: 3538158 - RNA, 19 nt, Human
uaugcauauauauaugugu

SEQ ID NO: 3538159 - RNA, 20 nt, Human
uaugcauauuauuuuauguu

SEQ ID NO: 3538160 - RNA, 14 nt, Human
uaggggucaaagaa

SEQ ID NO: 3538161 - RNA, 14 nt, Human
uaggguaaaaauug

SEQ ID NO: 3538162 - RNA, 16 nt, Human
uaggguaaaucaguaa

SEQ ID NO: 3538163 - RNA, 15 nt, Human
uaggguaaggugccu

SEQ ID NO: 3538164 - RNA, 13 nt, Human
uaggguacaugug

SEQ ID NO: 3538165 - RNA, 20 nt, Human
uaggguacuaaauuuaaauu

SEQ ID NO: 3538166 - RNA, 15 nt, Human
uaggguauauuuucc

SEQ ID NO: 3538167 - RNA, 14 nt, Human
uaggguccugggga

SEQ ID NO: 3538168 - RNA, 15 nt, Human
uagggucggaaccca

SEQ ID NO: 3538169 - RNA, 12 nt, Human
uaggguggcccu

SEQ ID NO: 3538170 - RNA, 15 nt, Human
uagggugggccuuca

SEQ ID NO: 3538171 - RNA, 14 nt, Human
uaggguucugccuc

SEQ ID NO: 3538172 - RNA, 19 nt, Human
uaggguugguuccuuucca

SEQ ID NO: 3538173 - RNA, 12 nt, Human
uaggguuuaauc

SEQ ID NO: 3538174 - RNA, 21 nt, Human
uagguaaaauguauuuuucua

SEQ ID NO: 3538175 - RNA, 13 nt, Human
uagguaacuucau

SEQ ID NO: 3538176 - RNA, 18 nt, Human
uagguacuuuuugugaag

SEQ ID NO: 3538177 - RNA, 14 nt, Human
uagguagauguuca

SEQ ID NO: 3538178 - RNA, 20 nt, Human
uagguauaaguggugugugu

SEQ ID NO: 3538179 - RNA, 14 nt, Human
uagguauacagugg

SEQ ID NO: 3538180 - RNA, 21 nt, Human
uaggucaaggccugucccugg

SEQ ID NO: 3538181 - RNA, 14 nt, Human
uaggucacuggcuc

SEQ ID NO: 3538182 - RNA, 19 nt, Human
uaggucacuggcucuccaa

SEQ ID NO: 3538183 - RNA, 15 nt, Human
uagguccuuuagaaa

SEQ ID NO: 3538184 - RNA, 19 nt, Human
uaggucguuuuaaaaacaa

SEQ ID NO: 3538185 - RNA, 21 nt, Human
uaggucuuaauacacacaguu

SEQ ID NO: 3538186 - RNA, 23 nt, Human
uaggugacagagugagacucugu

SEQ ID NO: 3538187 - RNA, 19 nt, Human
uaggugauccauguaacug

SEQ ID NO: 3538188 - RNA, 22 nt, Human
uaggugauccauguaacugccu

SEQ ID NO: 3538189 - RNA, 22 nt, Human
uaggugauguuugcucuuguuu

SEQ ID NO: 3538190 - RNA, 20 nt, Human
uaggugcuacaaaaacacag

SEQ ID NO: 3538191 - RNA, 22 nt, Human
uaggugcuacaaaaacacagca

SEQ ID NO: 3538192 - RNA, 19 nt, Human
uaggugggccagccccucc

SEQ ID NO: 3538193 - RNA, 20 nt, Human
uaggugggccagccccuccc

SEQ ID NO: 3538194 - RNA, 23 nt, Human
uaggugggccagccccucccacc

SEQ ID NO: 3538195 - RNA, 21 nt, Human
uaggugugacugaauuucuuu

SEQ ID NO: 3538196 - RNA, 23 nt, Human
uaggugugacugaauuucuuuug

SEQ ID NO: 3538197 - RNA, 21 nt, Human
uagguguuuuguucaccauua

SEQ ID NO: 3538198 - RNA, 23 nt, Human
uagguuaacuauguacaauauuu

SEQ ID NO: 3538199 - RNA, 14 nt, Human
uagguucaauuccc

SEQ ID NO: 3538200 - RNA, 15 nt, Human
uagguucagccaagg

SEQ ID NO: 3538201 - RNA, 15 nt, Human
uagguuccccuguca

SEQ ID NO: 3538202 - RNA, 21 nt, Human
uagguucccuguucuuccucc

SEQ ID NO: 3538203 - RNA, 15 nt, Human
uagguucuaaaguuc

SEQ ID NO: 3538204 - RNA, 16 nt, Human
uagguucuaaaguucu

SEQ ID NO: 3538205 - RNA, 17 nt, Human
uagguucuaaaguucua

SEQ ID NO: 3538206 - RNA, 16 nt, Human
uagguugcacacuuug

SEQ ID NO: 3538207 - RNA, 18 nt, Human
uagguugcacacuuuggu

SEQ ID NO: 3538208 - RNA, 19 nt, Human
uagguugcacacuuuggua

SEQ ID NO: 3538209 - RNA, 21 nt, Human
uagguuggcaaaaaggcagga

SEQ ID NO: 3538210 - RNA, 15 nt, Human
uagguuuaacucaga

SEQ ID NO: 3538211 - RNA, 14 nt, Human
uagguuuuacagau

SEQ ID NO: 3538212 - RNA, 21 nt, Human
uagguuuuguuugcuaucuua

SEQ ID NO: 3538213 - RNA, 20 nt, Human
uagguuuuuuuccuucugaa

SEQ ID NO: 3538214 - RNA, 22 nt, Human
uaguaaaauucuacuguaugga

SEQ ID NO: 3538215 - RNA, 14 nt, Human
uaguaaagaaauga

SEQ ID NO: 3538216 - RNA, 17 nt, Human
uaguaaauaaugcuuug

SEQ ID NO: 3538217 - RNA, 13 nt, Human
uaguaaaugucuu

SEQ ID NO: 3538218 - RNA, 14 nt, Human
uaguaaaugucuuu

SEQ ID NO: 3538219 - RNA, 19 nt, Human
uaguaaaugucuuuguaag

SEQ ID NO: 3538220 - RNA, 20 nt, Human
uaguaaaugucuuuguaagu

SEQ ID NO: 3538221 - RNA, 22 nt, Human
uaguaaaugucuuuguaaguca

SEQ ID NO: 3538222 - RNA, 11 nt, Human
uaguaaauguu

SEQ ID NO: 3538223 - RNA, 22 nt, Human
uaguaagaauaccacaucaaau

SEQ ID NO: 3538224 - RNA, 14 nt, Human
uaguaagaucucuu

SEQ ID NO: 3538225 - RNA, 16 nt, Human
uaguaagcauagaaac

SEQ ID NO: 3538226 - RNA, 13 nt, Human
uaguaaggcugug

SEQ ID NO: 3538227 - RNA, 22 nt, Human
uaguaagucuugccuauauuuu

SEQ ID NO: 3538228 - RNA, 16 nt, Human
uaguaaguuaauguau

SEQ ID NO: 3538229 - RNA, 18 nt, Human
uaguaaguucagcacuug

SEQ ID NO: 3538230 - RNA, 20 nt, Human
uaguaaguuuuucuucauga

SEQ ID NO: 3538231 - RNA, 14 nt, Human
uaguaauaaagacu

SEQ ID NO: 3538232 - RNA, 20 nt, Human
uaguaauagagcaaaauuga

SEQ ID NO: 3538233 - RNA, 21 nt, Human
uaguaauagguaggaaaauga

SEQ ID NO: 3538234 - RNA, 14 nt, Human
uaguaauauaauac

SEQ ID NO: 3538235 - RNA, 15 nt, Human
uaguaauauaauaca

SEQ ID NO: 3538236 - RNA, 21 nt, Human
uaguaauauaauacacaaaau

SEQ ID NO: 3538237 - RNA, 16 nt, Human
uaguaauauauuuaaa

SEQ ID NO: 3538238 - RNA, 23 nt, Human
uaguaauauauuuaaagggaaau

SEQ ID NO: 3538239 - RNA, 15 nt, Human
uaguaaucuguacau

SEQ ID NO: 3538240 - RNA, 16 nt, Human
uaguaaucuguacauu

SEQ ID NO: 3538241 - RNA, 13 nt, Human
uaguaaucuguau

SEQ ID NO: 3538242 - RNA, 14 nt, Human
uaguaaucuguaua

SEQ ID NO: 3538243 - RNA, 15 nt, Human
uaguaaugaguuuaa

SEQ ID NO: 3538244 - RNA, 20 nt, Human
uaguaaugcuacgugugauu

SEQ ID NO: 3538245 - RNA, 20 nt, Human
uaguaauuucuuuuuuuccu

SEQ ID NO: 3538246 - RNA, 14 nt, Human
uaguaauuuguaaa

SEQ ID NO: 3538247 - RNA, 12 nt, Human
uaguacaaaguu

SEQ ID NO: 3538248 - RNA, 17 nt, Human
uaguacaaaguuucaau

SEQ ID NO: 3538249 - RNA, 15 nt, Human
uaguacaaauuauaa

SEQ ID NO: 3538250 - RNA, 13 nt, Human
uaguacacuuuua

SEQ ID NO: 3538251 - RNA, 23 nt, Human
uaguacagguaaggugagggaau

SEQ ID NO: 3538252 - RNA, 14 nt, Human
uaguaccaaaauaa

SEQ ID NO: 3538253 - RNA, 20 nt, Human
uaguaccaaaugcuuuaaaa

SEQ ID NO: 3538254 - RNA, 18 nt, Human
uaguaccauuuauacaaa

SEQ ID NO: 3538255 - RNA, 13 nt, Human
uaguacccaccug

SEQ ID NO: 3538256 - RNA, 23 nt, Human
uaguaccccaagaagaaaauguu

SEQ ID NO: 3538257 - RNA, 20 nt, Human
uaguaccuuuuauaucccau

SEQ ID NO: 3538258 - RNA, 17 nt, Human
uaguacuauaucuguuu

SEQ ID NO: 3538259 - RNA, 17 nt, Human
uaguacuccugcaaaau

SEQ ID NO: 3538260 - RNA, 15 nt, Human
uaguacugcucuugu

SEQ ID NO: 3538261 - RNA, 14 nt, Human
uaguacuguguacu

SEQ ID NO: 3538262 - RNA, 18 nt, Human
uaguacuguguacuguau

SEQ ID NO: 3538263 - RNA, 17 nt, Human
uaguacuucuucuguaa

SEQ ID NO: 3538264 - RNA, 20 nt, Human
uaguagaaauuuuacaauag

SEQ ID NO: 3538265 - RNA, 13 nt, Human
uaguagagacagg

SEQ ID NO: 3538266 - RNA, 13 nt, Human
uaguagagacggg

SEQ ID NO: 3538267 - RNA, 17 nt, Human
uaguagagguacacuug

SEQ ID NO: 3538268 - RNA, 12 nt, Human
uaguagauuuua

SEQ ID NO: 3538269 - RNA, 20 nt, Human
uaguagcagugauugucuua

SEQ ID NO: 3538270 - RNA, 16 nt, Human
uaguagcccuuucugu

SEQ ID NO: 3538271 - RNA, 21 nt, Human
uaguaggauaugccugcucuu

SEQ ID NO: 3538272 - RNA, 20 nt, Human
uaguagggguaccacugaau

SEQ ID NO: 3538273 - RNA, 19 nt, Human
uaguauacauugucucuaa

SEQ ID NO: 3538274 - RNA, 19 nt, Human
uaguauaucuggacaagcc

SEQ ID NO: 3538275 - RNA, 16 nt, Human
uaguauauuaaaaaug

SEQ ID NO: 3538276 - RNA, 17 nt, Human
uaguauauuaaaaaugg

SEQ ID NO: 3538277 - RNA, 12 nt, Human
uaguauauuuau

SEQ ID NO: 3538278 - RNA, 14 nt, Human
uaguauccuccagg

SEQ ID NO: 3538279 - RNA, 16 nt, Human
uaguauccuccagguu

SEQ ID NO: 3538280 - RNA, 20 nt, Human
uaguauccuccagguuuuuc

SEQ ID NO: 3538281 - RNA, 21 nt, Human
uaguauccuccagguuuuuca

SEQ ID NO: 3538282 - RNA, 23 nt, Human
uaguauccuccagguuuuucaau

SEQ ID NO: 3538283 - RNA, 14 nt, Human
uaguaucuaacaug

SEQ ID NO: 3538284 - RNA, 13 nt, Human
uaguaugaaauua

SEQ ID NO: 3538285 - RNA, 19 nt, Human
uaguaugacgcugauacau

SEQ ID NO: 3538286 - RNA, 15 nt, Human
uaguaugaggcauuu

SEQ ID NO: 3538287 - RNA, 18 nt, Human
uaguaugaggcauuuguu

SEQ ID NO: 3538288 - RNA, 19 nt, Human
uaguauugacaaaauguua

SEQ ID NO: 3538289 - RNA, 17 nt, Human
uaguauuguccaggucu

SEQ ID NO: 3538290 - RNA, 21 nt, Human
uaguauuguuguccuuuucau

SEQ ID NO: 3538291 - RNA, 20 nt, Human
uaguauuuauggguggauuu

SEQ ID NO: 3538292 - RNA, 16 nt, Human
uaguauuucuaugaaa

SEQ ID NO: 3538293 - RNA, 17 nt, Human
uaguauuugaaaacaga

SEQ ID NO: 3538294 - RNA, 12 nt, Human
uaguauuugauu

SEQ ID NO: 3538295 - RNA, 17 nt, Human
uaguauuugauucaaaa

SEQ ID NO: 3538296 - RNA, 23 nt, Human
uaguauuugauucaaaauauuua

SEQ ID NO: 3538297 - RNA, 13 nt, Human
uaguauuuucuaa

SEQ ID NO: 3538298 - RNA, 23 nt, Human
uaguauuuuuuacauuuuacaca

SEQ ID NO: 3538299 - RNA, 17 nt, Human
uaguuacuguguaaacu

SEQ ID NO: 3538300 - RNA, 21 nt, Human
uaguuacuguguaaacucauc

SEQ ID NO: 3538301 - RNA, 18 nt, Human
uaguuacuguguaauuag

SEQ ID NO: 3538302 - RNA, 17 nt, Human
uaguuacuguugugacc

SEQ ID NO: 3538303 - RNA, 18 nt, Human
uaguuacuguugugaccu

SEQ ID NO: 3538304 - RNA, 18 nt, Human
uaguuaggaaauaaaacc

SEQ ID NO: 3538305 - RNA, 21 nt, Human
uaguuaggaaauaaaaccuuu

SEQ ID NO: 3538306 - RNA, 23 nt, Human
uaguuaggaaauaaaaccuuuca

SEQ ID NO: 3538307 - RNA, 15 nt, Human
uaguuaggauagcau

SEQ ID NO: 3538308 - RNA, 20 nt, Human
uaguuaggauagcauuuuug

SEQ ID NO: 3538309 - RNA, 15 nt, Human
uaguuaguagcaugu

SEQ ID NO: 3538310 - RNA, 11 nt, Human
uaguuaucaug

SEQ ID NO: 3538311 - RNA, 23 nt, Human
uaguuaucauguuaguaauaccu

SEQ ID NO: 3538312 - RNA, 14 nt, Human
uaguucaagaaaug

SEQ ID NO: 3538313 - RNA, 16 nt, Human
uaguucagaauuuagu

SEQ ID NO: 3538314 - RNA, 23 nt, Human
uaguucagaauuuaguguaucca

SEQ ID NO: 3538315 - RNA, 19 nt, Human
uaguucagacacuuuggaa

SEQ ID NO: 3538316 - RNA, 22 nt, Human
uaguucagcauccgcaggugcu

SEQ ID NO: 3538317 - RNA, 14 nt, Human
uaguucauccaauc

SEQ ID NO: 3538318 - RNA, 18 nt, Human
uaguucauccaauccuca

SEQ ID NO: 3538319 - RNA, 16 nt, Human
uaguucauguaaauaa

SEQ ID NO: 3538320 - RNA, 15 nt, Human
uaguuccacugagac

SEQ ID NO: 3538321 - RNA, 18 nt, Human
uaguuccacuuauagccu

SEQ ID NO: 3538322 - RNA, 15 nt, Human
uaguucccaggugau

SEQ ID NO: 3538323 - RNA, 16 nt, Human
uaguuccccuguuuau

SEQ ID NO: 3538324 - RNA, 19 nt, Human
uaguuccccuguuuauuca

SEQ ID NO: 3538325 - RNA, 12 nt, Human
uauguagaugug

SEQ ID NO: 3538326 - RNA, 16 nt, Human
uauguagaugugcauu

SEQ ID NO: 3538327 - RNA, 17 nt, Human
uauguagaugugcauuu

SEQ ID NO: 3538328 - RNA, 18 nt, Human
uauguauaacuuuaacuu

SEQ ID NO: 3538329 - RNA, 19 nt, Human
uauguauauuuaaaagaaa

SEQ ID NO: 3538330 - RNA, 19 nt, Human
uauguaucaaauguaacuu

SEQ ID NO: 3538331 - RNA, 16 nt, Human
uauguaucagaagaga

SEQ ID NO: 3538332 - RNA, 20 nt, Human
uauguauggaauacaguguu

SEQ ID NO: 3538333 - RNA, 22 nt, Human
uauguauggguaggguaaauca

SEQ ID NO: 3538334 - RNA, 16 nt, Human
uauguauguaaaaaug

SEQ ID NO: 3538335 - RNA, 15 nt, Human
uauguauguguuuag

SEQ ID NO: 3538336 - RNA, 20 nt, Human
uauguauguguuuagaauug

SEQ ID NO: 3538337 - RNA, 22 nt, Human
uauguauuaacacuacucaaag

SEQ ID NO: 3538338 - RNA, 18 nt, Human
uauguauuaauaaauaga

SEQ ID NO: 3538339 - RNA, 19 nt, Human
uauguauuaauauucauug

SEQ ID NO: 3538340 - RNA, 13 nt, Human
uauguauuauuua

SEQ ID NO: 3538341 - RNA, 21 nt, Human
uauguauuauuuacauuuaau

SEQ ID NO: 3538342 - RNA, 16 nt, Human
uauguauucuguaaaa

SEQ ID NO: 3538343 - RNA, 20 nt, Human
uauguauugugcaaugugua

SEQ ID NO: 3538344 - RNA, 22 nt, Human
uauguauuuaccaaaaauuuug

SEQ ID NO: 3538345 - RNA, 14 nt, Human
uauguauuuuaugu

SEQ ID NO: 3538346 - RNA, 17 nt, Human
uaugucaacuuuaugca

SEQ ID NO: 3538347 - RNA, 16 nt, Human
uaugucaagggcagcu

SEQ ID NO: 3538348 - RNA, 21 nt, Human
uaugucaauaaacaacagcug

SEQ ID NO: 3538349 - RNA, 15 nt, Human
uaugucaguacuauu

SEQ ID NO: 3538350 - RNA, 12 nt, Human
uaugucauuuca

SEQ ID NO: 3538351 - RNA, 15 nt, Human
uaugucccuucacau

SEQ ID NO: 3538352 - RNA, 18 nt, Human
uauguccugugagaugug

SEQ ID NO: 3538353 - RNA, 22 nt, Human
uauguccugugagauguguauc

SEQ ID NO: 3538354 - RNA, 20 nt, Human
uaugucgucgagcucccccc

SEQ ID NO: 3538355 - RNA, 12 nt, Human
uaugucuaaaga

SEQ ID NO: 3538356 - RNA, 16 nt, Human
uaugucuaaagagcuu

SEQ ID NO: 3538357 - RNA, 19 nt, Human
uaugucucgcuagugaugu

SEQ ID NO: 3538358 - RNA, 21 nt, Human
uaugucucgugguaggacugu

SEQ ID NO: 3538359 - RNA, 19 nt, Human
uaugucucuucugagcuau

SEQ ID NO: 3538360 - RNA, 21 nt, Human
uaugucugguucucaauucca

SEQ ID NO: 3538361 - RNA, 16 nt, Human
uaugucugucauugua

SEQ ID NO: 3538362 - RNA, 13 nt, Human
uaugucuguuuaa

SEQ ID NO: 3538363 - RNA, 20 nt, Human
uaugucuguuuaagaaaagu

SEQ ID NO: 3538364 - RNA, 15 nt, Human
uaugugaaacaaugu

SEQ ID NO: 3538365 - RNA, 17 nt, Human
uaugugaaacauguuuc

SEQ ID NO: 3538366 - RNA, 20 nt, Human
uaugugacaccaaagccacc

SEQ ID NO: 3538367 - RNA, 19 nt, Human
uaugugagauuuuuuauug

SEQ ID NO: 3538368 - RNA, 22 nt, Human
uaugugagauuuuuuauugcua

SEQ ID NO: 3538369 - RNA, 18 nt, Human
uaugugaguauucucauu

SEQ ID NO: 3538370 - RNA, 21 nt, Human
uaugugauuuuuuuucccauu

SEQ ID NO: 3538371 - RNA, 22 nt, Human
uaugugcacugucacuuugcuc

SEQ ID NO: 3538372 - RNA, 14 nt, Human
uaugugccagauuu

SEQ ID NO: 3538373 - RNA, 23 nt, Human
uaugugcuauuaauauuuguuua

SEQ ID NO: 3538374 - RNA, 15 nt, Human
uaugugcuguaauuu

SEQ ID NO: 3538375 - RNA, 18 nt, Human
uaugugcuuucaucacaa

SEQ ID NO: 3538376 - RNA, 16 nt, Human
uauguggaaguguggg

SEQ ID NO: 3538377 - RNA, 21 nt, Human
uaugugggauauugaauguua

SEQ ID NO: 3538378 - RNA, 23 nt, Human
uaugugggcagauuuucagcaaa

SEQ ID NO: 3538379 - RNA, 18 nt, Human
uaugugggggucugugug

SEQ ID NO: 3538380 - RNA, 17 nt, Human
uaugugguuuuguaauu

SEQ ID NO: 3538381 - RNA, 17 nt, Human
uauguguaaaaugugaa

SEQ ID NO: 3538382 - RNA, 16 nt, Human
uauguguaauaaauau

SEQ ID NO: 3538383 - RNA, 19 nt, Human
uaugugucaguucauuugu

SEQ ID NO: 3538384 - RNA, 12 nt, Human
uaugugugaagu

SEQ ID NO: 3538385 - RNA, 14 nt, Human
uaugugugaaguga

SEQ ID NO: 3538386 - RNA, 17 nt, Human
uaugugugcaugugugu

SEQ ID NO: 3538387 - RNA, 21 nt, Human
uaugugugcauguguguauaa

SEQ ID NO: 3538388 - RNA, 14 nt, Human
uauguguguagaca

SEQ ID NO: 3538389 - RNA, 11 nt, Human
uaugugugugu

SEQ ID NO: 3538390 - RNA, 19 nt, Human
uauguguguguaugcuacu

SEQ ID NO: 3538391 - RNA, 18 nt, Human
uauguguguuucuguccu

SEQ ID NO: 3538392 - RNA, 17 nt, Human
uauguguugaaaaccaa

SEQ ID NO: 3538393 - RNA, 19 nt, Human
uauguguugaaaaccaaaa

SEQ ID NO: 3538394 - RNA, 13 nt, Human
uauguguuuacuu

SEQ ID NO: 3538395 - RNA, 15 nt, Human
uauguguuugugugu

SEQ ID NO: 3538396 - RNA, 15 nt, Human
uauguguuuuucaca

SEQ ID NO: 3538397 - RNA, 14 nt, Human
uauguguuuuucuc

SEQ ID NO: 3538398 - RNA, 17 nt, Human
uauguguuuuucucaua

SEQ ID NO: 3538399 - RNA, 20 nt, Human
uauguuaaacuagcauaucu

SEQ ID NO: 3538400 - RNA, 13 nt, Human
uauguuaaagaga

SEQ ID NO: 3538401 - RNA, 14 nt, Human
uauguuaagcucuu

SEQ ID NO: 3538402 - RNA, 18 nt, Human
uauguuacuacaugcacu

SEQ ID NO: 3538403 - RNA, 15 nt, Human
uauguuacuauuuuc

SEQ ID NO: 3538404 - RNA, 22 nt, Human
uauguuauacaaccuucauuua

SEQ ID NO: 3538405 - RNA, 15 nt, Human
uauguuauauauaaa

SEQ ID NO: 3538406 - RNA, 14 nt, Human
uauguuauugaaaa

SEQ ID NO: 3538407 - RNA, 16 nt, Human
uauguucagaagaaau

SEQ ID NO: 3538408 - RNA, 13 nt, Human
uauguucauuugu

SEQ ID NO: 3538409 - RNA, 14 nt, Human
uauguuccauuaaa

SEQ ID NO: 3538410 - RNA, 20 nt, Human
uauguuccauuaaacgauuu

SEQ ID NO: 3538411 - RNA, 22 nt, Human
uauguucuuaguggauguucug

SEQ ID NO: 3538412 - RNA, 15 nt, Human
uauguugaauacuuu

SEQ ID NO: 3538413 - RNA, 18 nt, Human
uauguugaauacuuuuua

SEQ ID NO: 3538414 - RNA, 14 nt, Human
uauguugacauuug

SEQ ID NO: 3538415 - RNA, 23 nt, Human
uauguugagucgcgcaccgaaaa

SEQ ID NO: 3538416 - RNA, 14 nt, Human
uauguugauaaaag

SEQ ID NO: 3538417 - RNA, 12 nt, Human
uauguugcauag

SEQ ID NO: 3538418 - RNA, 21 nt, Human
uauguugcuauaauaaagaag

SEQ ID NO: 3538419 - RNA, 14 nt, Human
uauguugcucaguc

SEQ ID NO: 3538420 - RNA, 20 nt, Human
uauguugcucagucucccuu

SEQ ID NO: 3538421 - RNA, 16 nt, Human
uauguuguguucuaau

SEQ ID NO: 3538422 - RNA, 17 nt, Human
uauguuguuagagaaaa

SEQ ID NO: 3538423 - RNA, 19 nt, Human
uauguuguuagagaaaaau

SEQ ID NO: 3538424 - RNA, 13 nt, Human
uauguuuaaaaua

SEQ ID NO: 3538425 - RNA, 19 nt, Human
uauguuuaaucuguuaugu

SEQ ID NO: 3538426 - RNA, 14 nt, Human
uauguuuacauauc

SEQ ID NO: 3538427 - RNA, 13 nt, Human
uauguuucaaacu

SEQ ID NO: 3538428 - RNA, 16 nt, Human
uauguuucaaacuuug

SEQ ID NO: 3538429 - RNA, 22 nt, Human
uauguuuguauaaugaaugaga

SEQ ID NO: 3538430 - RNA, 22 nt, Human
uauguuuugacauuuuuaguuu

SEQ ID NO: 3538431 - RNA, 12 nt, Human
uauguuuuggua

SEQ ID NO: 3538432 - RNA, 20 nt, Human
uauguuuugguaucuguucu

SEQ ID NO: 3538433 - RNA, 18 nt, Human
uauguuuuguuucugaaa

SEQ ID NO: 3538434 - RNA, 15 nt, Human
uauguuuuucaguuc

SEQ ID NO: 3538435 - RNA, 18 nt, Human
uauguuuuucaguucaaa

SEQ ID NO: 3538436 - RNA, 19 nt, Human
uauguuuuucaguucaaag

SEQ ID NO: 3538437 - RNA, 14 nt, Human
uauguuuuugaagg

SEQ ID NO: 3538438 - RNA, 17 nt, Human
uauguuuuuuaaaauau

SEQ ID NO: 3538439 - RNA, 23 nt, Human
uauguuuuuuagaucaaauacuu

SEQ ID NO: 3538440 - RNA, 18 nt, Human
uauguuuuuuauuaugcu

SEQ ID NO: 3538441 - RNA, 15 nt, Human
uauguuuuuuuucug

SEQ ID NO: 3538442 - RNA, 22 nt, Human
uauuaaaaagucuuuuaaaaag

SEQ ID NO: 3538443 - RNA, 13 nt, Human
uauuaaaaauaua

SEQ ID NO: 3538444 - RNA, 15 nt, Human
uauaaaauuaagcaa

SEQ ID NO: 3538445 - RNA, 13 nt, Human
uauaaacaagaaa

SEQ ID NO: 3538446 - RNA, 22 nt, Human
uauaaacaagaaaaauaaagaa

SEQ ID NO: 3538447 - RNA, 21 nt, Human
uauaaacagaaauggaaagca

SEQ ID NO: 3538448 - RNA, 18 nt, Human
uauaaacagaagugacug

SEQ ID NO: 3538449 - RNA, 12 nt, Human
uauaaacagcuu

SEQ ID NO: 3538450 - RNA, 18 nt, Human
uauaaacaucacacacac

SEQ ID NO: 3538451 - RNA, 19 nt, Human
uauaaacauuaaaugucuu

SEQ ID NO: 3538452 - RNA, 22 nt, Human
uauaaaccucuaauuuauuuug

SEQ ID NO: 3538453 - RNA, 13 nt, Human
uauaaacuuuacc

SEQ ID NO: 3538454 - RNA, 14 nt, Human
uauaaacuuuaccu

SEQ ID NO: 3538455 - RNA, 22 nt, Human
uauaaacuuuagaguagcauga

SEQ ID NO: 3538456 - RNA, 12 nt, Human
uauaaacuuuua

SEQ ID NO: 3538457 - RNA, 22 nt, Human
uauaaagaacaagguaguuuuu

SEQ ID NO: 3538458 - RNA, 19 nt, Human
uauaaagaagaacuugcau

SEQ ID NO: 3538459 - RNA, 17 nt, Human
uauaaagaauaggacuu

SEQ ID NO: 3538460 - RNA, 21 nt, Human
uauaaagaauaggacuuguuu

SEQ ID NO: 3538461 - RNA, 15 nt, Human
uauaaagaauauaua

SEQ ID NO: 3538462 - RNA, 15 nt, Human
uauaaagagaaaauu

SEQ ID NO: 3538463 - RNA, 12 nt, Human
uauaaagcagua

SEQ ID NO: 3538464 - RNA, 16 nt, Human
uauaaagcaucuaaac

SEQ ID NO: 3538465 - RNA, 17 nt, Human
uauaaagcaucuaaacu

SEQ ID NO: 3538466 - RNA, 21 nt, Human
uauaaagcgauauacagauga

SEQ ID NO: 3538467 - RNA, 23 nt, Human
uauaaagcgauauacagaugaaa

SEQ ID NO: 3538468 - RNA, 16 nt, Human
uauaaaggauaaagaa

SEQ ID NO: 3538469 - RNA, 23 nt, Human
uauaaaguacccaucuaguacuu

SEQ ID NO: 3538470 - RNA, 14 nt, Human
uauaaaguagaaau

SEQ ID NO: 3538471 - RNA, 16 nt, Human
uauaaaguaguccugu

SEQ ID NO: 3538472 - RNA, 15 nt, Human
uauaaaguauagaga

SEQ ID NO: 3538473 - RNA, 20 nt, Human
uauaaaguauagagagaagu

SEQ ID NO: 3538474 - RNA, 14 nt, Human
uauaaaguauucuu

SEQ ID NO: 3538475 - RNA, 16 nt, Human
uauaaauaaauauaua

SEQ ID NO: 3538476 - RNA, 18 nt, Human
uauaaauacugcaaauca

SEQ ID NO: 3538477 - RNA, 14 nt, Human
uauaaauagaaugu

SEQ ID NO: 3538478 - RNA, 22 nt, Human
uauaaauagaauguaaaugucu

SEQ ID NO: 3538479 - RNA, 13 nt, Human
uauaaauaggaga

SEQ ID NO: 3538480 - RNA, 12 nt, Human
gcccucaucccg

SEQ ID NO: 3538481 - RNA, 20 nt, Human
gcccucauuacggcuccucu

SEQ ID NO: 3538482 - RNA, 15 nt, Human
gcccuccaaaagcac

SEQ ID NO: 3538483 - RNA, 16 nt, Human
gcccuccacaccugcg

SEQ ID NO: 3538484 - RNA, 19 nt, Human
gcccuccacaccugcggcc

SEQ ID NO: 3538485 - RNA, 23 nt, Human
gcccuccacugcccucuguucag

SEQ ID NO: 3538486 - RNA, 20 nt, Human
gcccuccagagccccacagc

SEQ ID NO: 3538487 - RNA, 21 nt, Human
gcccuccaucuaaacugcccc

SEQ ID NO: 3538488 - RNA, 21 nt, Human
gcccucccaggcucucaacag

SEQ ID NO: 3538489 - RNA, 18 nt, Human
gcccuccccauggagcca

SEQ ID NO: 3538490 - RNA, 14 nt, Human
gcccucccccuccu

SEQ ID NO: 3538491 - RNA, 16 nt, Human
gcccucccuguccucc

SEQ ID NO: 3538492 - RNA, 20 nt, Human
gcccucccuguuccccagag

SEQ ID NO: 3538493 - RNA, 17 nt, Human
gcccucccuucucccug

SEQ ID NO: 3538494 - RNA, 18 nt, Human
gcccucccuucucccugg

SEQ ID NO: 3538495 - RNA, 19 nt, Human
gcccucccuuggaaaccug

SEQ ID NO: 3538496 - RNA, 23 nt, Human
gcccucccuuggaaaccugcccu

SEQ ID NO: 3538497 - RNA, 18 nt, Human
gcccuccgacagcccccu

SEQ ID NO: 3538498 - RNA, 22 nt, Human
gcccuccgacagcccccucugc

SEQ ID NO: 3538499 - RNA, 23 nt, Human
gcccuccgccauucucaagcccu

SEQ ID NO: 3538500 - RNA, 15 nt, Human
gcccuccgccuucac

SEQ ID NO: 3538501 - RNA, 18 nt, Human
gcccuccgcgaaaauagu

SEQ ID NO: 3538502 - RNA, 24 nt, Human
gcccuccuacccugcgcccagucc

SEQ ID NO: 3538503 - RNA, 22 nt, Human
gcccuccucccucccagcucca

SEQ ID NO: 3538504 - RNA, 20 nt, Human
gcccuccucucccauugucc

SEQ ID NO: 3538505 - RNA, 16 nt, Human
gcccuccucugcacuc

SEQ ID NO: 3538506 - RNA, 18 nt, Human
gcccuccugugcucagcc

SEQ ID NO: 3538507 - RNA, 23 nt, Human
gcccuccugugcucagcccugag

SEQ ID NO: 3538508 - RNA, 16 nt, Human
gcccuccuuguccacc

SEQ ID NO: 3538509 - RNA, 23 nt, Human
gcccucgacacucaccaugaagc

SEQ ID NO: 3538510 - RNA, 17 nt, Human
gcccucgcugccagcuc

SEQ ID NO: 3538511 - RNA, 16 nt, Human
gcccucgcugcuucug

SEQ ID NO: 3538512 - RNA, 18 nt, Human
gcccucgggcccagcccc

SEQ ID NO: 3538513 - RNA, 22 nt, Human
gcccucgggcccagcccccaca

SEQ ID NO: 3538514 - RNA, 18 nt, Human
gcccucgggcgagucacu

SEQ ID NO: 3538515 - RNA, 14 nt, Human
gcccucguggccag

SEQ ID NO: 3538516 - RNA, 18 nt, Human
gcccucguggccagcccg

SEQ ID NO: 3538517 - RNA, 19 nt, Human
gcccucuaucauggugaaa

SEQ ID NO: 3538518 - RNA, 19 nt, Human
gcccucucaggccggcagc

SEQ ID NO: 3538519 - RNA, 16 nt, Human
gcccucucccacccuc

SEQ ID NO: 3538520 - RNA, 18 nt, Human
gcccucuccccugccccc

SEQ ID NO: 3538521 - RNA, 23 nt, Human
gcccucuccccugcccccugcag

SEQ ID NO: 3538522 - RNA, 21 nt, Human
gcccucucccucuaggcucug

SEQ ID NO: 3538523 - RNA, 14 nt, Human
gcccucuccgagcu

SEQ ID NO: 3538524 - RNA, 13 nt, Human
gcccucuccuggg

SEQ ID NO: 3538525 - RNA, 22 nt, Human
gcccucuccugggcagcugccu

SEQ ID NO: 3538526 - RNA, 23 nt, Human
gcccucuccugggcagcugccuc

SEQ ID NO: 3538527 - RNA, 22 nt, Human
gcccucuccuuuguucccggcu

SEQ ID NO: 3538528 - RNA, 16 nt, Human
gcccucucugcucugc

SEQ ID NO: 3538529 - RNA, 17 nt, Human
gcccucugcauccucug

SEQ ID NO: 3538530 - RNA, 18 nt, Human
gcccucugcauccucugg

SEQ ID NO: 3538531 - RNA, 20 nt, Human
gcccucugcauccucuggag

SEQ ID NO: 3538532 - RNA, 21 nt, Human
gcccucugcauccucuggagc

SEQ ID NO: 3538533 - RNA, 17 nt, Human
gcccucuucuucucaag

SEQ ID NO: 3538534 - RNA, 15 nt, Human
gcccugagcucggug

SEQ ID NO: 3538535 - RNA, 16 nt, Human
gcccugagcuuucugc

SEQ ID NO: 3538536 - RNA, 13 nt, Human
gcccugaggugug

SEQ ID NO: 3538537 - RNA, 21 nt, Human
gcccugaggugugggggcugc

SEQ ID NO: 3538538 - RNA, 22 nt, Human
gcccugaguaaucgcuuaaaga

SEQ ID NO: 3538539 - RNA, 17 nt, Human
gcccugagucugggcag

SEQ ID NO: 3538540 - RNA, 23 nt, Human
gcccugaguggaucuccaaggac

SEQ ID NO: 3538541 - RNA, 17 nt, Human
gcccugcaccugugcag

SEQ ID NO: 3538542 - RNA, 18 nt, Human
gcccugcacuguccugcu

SEQ ID NO: 3538543 - RNA, 20 nt, Human
gcccugcacuguccugcucc

SEQ ID NO: 3538544 - RNA, 23 nt, Human
gcccugcacuguccugcuccaca

SEQ ID NO: 3538545 - RNA, 18 nt, Human
gcccugcagacccugccc

SEQ ID NO: 3538546 - RNA, 13 nt, Human
gcccugcagaggg

SEQ ID NO: 3538547 - RNA, 12 nt, Human
gcccugcagcuc

SEQ ID NO: 3538548 - RNA, 13 nt, Human
gcccugcagcucu

SEQ ID NO: 3538549 - RNA, 19 nt, Human
gcccugcagcucucaugcu

SEQ ID NO: 3538550 - RNA, 22 nt, Human
gcccugcaugggccagccccuc

SEQ ID NO: 3538551 - RNA, 15 nt, Human
gcccugccaccuguc

SEQ ID NO: 3538552 - RNA, 12 nt, Human
gcccugccacuc

SEQ ID NO: 3538553 - RNA, 19 nt, Human
gcccugccacucacuaggc

SEQ ID NO: 3538554 - RNA, 15 nt, Human
gcccugcccaccugg

SEQ ID NO: 3538555 - RNA, 20 nt, Human
gcccugcccaccuggccucu

SEQ ID NO: 3538556 - RNA, 13 nt, Human
gcccugccccaca

SEQ ID NO: 3538557 - RNA, 14 nt, Human
gcccugccccacac

SEQ ID NO: 3538558 - RNA, 15 nt, Human
gcccugcccuagcuc

SEQ ID NO: 3538559 - RNA, 11 nt, Human
gcccugcccug

SEQ ID NO: 3538560 - RNA, 20 nt, Human
gcccugcccugaggaaggag

SEQ ID NO: 3538561 - RNA, 15 nt, Human
gcccugcccuggcag

SEQ ID NO: 3538562 - RNA, 17 nt, Human
gcccugcccuggcaggg

SEQ ID NO: 3538563 - RNA, 18 nt, Human
gcccugcccugguuuccu

SEQ ID NO: 3538564 - RNA, 15 nt, Human
gcccugcccuucagc

SEQ ID NO: 3538565 - RNA, 11 nt, Human
gcccugccucc

SEQ ID NO: 3538566 - RNA, 13 nt, Human
gcccugccucucc

SEQ ID NO: 3538567 - RNA, 13 nt, Human
gcccugccucugu

SEQ ID NO: 3538568 - RNA, 11 nt, Human
gcccugccuga

SEQ ID NO: 3538569 - RNA, 13 nt, Human
gcccugccugagg

SEQ ID NO: 3538570 - RNA, 12 nt, Human
gcccugccugga

SEQ ID NO: 3538571 - RNA, 13 nt, Human
gcccugccuggag

SEQ ID NO: 3538572 - RNA, 15 nt, Human
gcccugccuggagga

SEQ ID NO: 3538573 - RNA, 16 nt, Human
gcccugccuggaggac

SEQ ID NO: 3538574 - RNA, 20 nt, Human
gcccugccuggaggaccuga

SEQ ID NO: 3538575 - RNA, 22 nt, Human
gcccugccuggaggaccugagc

SEQ ID NO: 3538576 - RNA, 15 nt, Human
gcccugcggccccgu

SEQ ID NO: 3538577 - RNA, 12 nt, Human
gcccugcucccu

SEQ ID NO: 3538578 - RNA, 13 nt, Human
gcccugcucccuc

SEQ ID NO: 3538579 - RNA, 16 nt, Human
gcccugcuccucccug

SEQ ID NO: 3538580 - RNA, 19 nt, Human
gcccugcuccucccuggcu

SEQ ID NO: 3538581 - RNA, 13 nt, Human
gcccugcugaguc

SEQ ID NO: 3538582 - RNA, 16 nt, Human
gcccugcugaguccca

SEQ ID NO: 3538583 - RNA, 21 nt, Human
gcccugcugagucccaggcug

SEQ ID NO: 3538584 - RNA, 14 nt, Human
gcccugcugcccuc

SEQ ID NO: 3538585 - RNA, 22 nt, Human
gcccugcugcugacccagccug

SEQ ID NO: 3538586 - RNA, 15 nt, Human
gcccugcuuccugcu

SEQ ID NO: 3538587 - RNA, 19 nt, Human
gcccugcuuugggcugccc

SEQ ID NO: 3538588 - RNA, 20 nt, Human
gcccuggacugugugcucag

SEQ ID NO: 3538589 - RNA, 21 nt, Human
uauuuguaaauuuaguguuuu

SEQ ID NO: 3538590 - RNA, 17 nt, Human
uauuuguaagauauuug

SEQ ID NO: 3538591 - RNA, 14 nt, Human
uauuuguaauagau

SEQ ID NO: 3538592 - RNA, 12 nt, Human
uauuuguaauua

SEQ ID NO: 3538593 - RNA, 19 nt, Human
uauuuguacaguucaguuc

SEQ ID NO: 3538594 - RNA, 17 nt, Human
uauuuguacuuucuguu

SEQ ID NO: 3538595 - RNA, 18 nt, Human
uauuuguauaaaagugug

SEQ ID NO: 3538596 - RNA, 15 nt, Human
uauuuguaucucuga

SEQ ID NO: 3538597 - RNA, 23 nt, Human
uauuuguaucucugaagcauguu

SEQ ID NO: 3538598 - RNA, 21 nt, Human
uauuuguauuuuuuugcaagu

SEQ ID NO: 3538599 - RNA, 10 nt, Human
uauuugucaa

SEQ ID NO: 3538600 - RNA, 12 nt, Human
uauuugugacua

SEQ ID NO: 3538601 - RNA, 19 nt, Human
uauuugugacuaauuguau

SEQ ID NO: 3538602 - RNA, 17 nt, Human
uauuugugcuauaguau

SEQ ID NO: 3538603 - RNA, 12 nt, Human
uauuuguggaau

SEQ ID NO: 3538604 - RNA, 13 nt, Human
uauuuguguaaua

SEQ ID NO: 3538605 - RNA, 18 nt, Human
uauuuguguauuuaacag

SEQ ID NO: 3538606 - RNA, 15 nt, Human
uauuugugugcuaaa

SEQ ID NO: 3538607 - RNA, 12 nt, Human
uauuuguguuuu

SEQ ID NO: 3538608 - RNA, 19 nt, Human
uauuuguguuuuaauuuaa

SEQ ID NO: 3538609 - RNA, 17 nt, Human
uauuuguuauuuucagu

SEQ ID NO: 3538610 - RNA, 16 nt, Human
uauuuguucauguuug

SEQ ID NO: 3538611 - RNA, 22 nt, Human
uauuuguucauguuuggugcau

SEQ ID NO: 3538612 - RNA, 19 nt, Human
uauuuguuuaguucagcaa

SEQ ID NO: 3538613 - RNA, 21 nt, Human
uauuuguuuaguucagcaaaa

SEQ ID NO: 3538614 - RNA, 13 nt, Human
uauuuuaaaacaa

SEQ ID NO: 3538615 - RNA, 19 nt, Human
uauuuuaaaaucuccuaaa

SEQ ID NO: 3538616 - RNA, 18 nt, Human
uauuuuaaaaucugucac

SEQ ID NO: 3538617 - RNA, 12 nt, Human
uauuuuaaacaa

SEQ ID NO: 3538618 - RNA, 14 nt, Human
uauuuuaaacaaaa

SEQ ID NO: 3538619 - RNA, 14 nt, Human
uauuuuaaagaauu

SEQ ID NO: 3538620 - RNA, 22 nt, Human
uauuuuaaaggggucugaaauu

SEQ ID NO: 3538621 - RNA, 22 nt, Human
uauuuuaagacgaaacauuugu

SEQ ID NO: 3538622 - RNA, 14 nt, Human
uauuuuaagcauua

SEQ ID NO: 3538623 - RNA, 19 nt, Human
uauuuuaauaauguuucaa

SEQ ID NO: 3538624 - RNA, 22 nt, Human
uauuuuaauaauguuucaaaca

SEQ ID NO: 3538625 - RNA, 15 nt, Human
uauuuuacacagaaa

SEQ ID NO: 3538626 - RNA, 18 nt, Human
uauuuuacacagaaacac

SEQ ID NO: 3538627 - RNA, 12 nt, Human
uauuuuacuauu

SEQ ID NO: 3538628 - RNA, 13 nt, Human
uauuuuacuuuua

SEQ ID NO: 3538629 - RNA, 20 nt, Human
uauuuuagcaguucugcaaa

SEQ ID NO: 3538630 - RNA, 21 nt, Human
uauuuuagcaguucugcaaau

SEQ ID NO: 3538631 - RNA, 22 nt, Human
uauuuuagcaguucugcaaaua

SEQ ID NO: 3538632 - RNA, 22 nt, Human
uauuuuaggcagggauuugagg

SEQ ID NO: 3538633 - RNA, 23 nt, Human
uauuuuaguggacccugaaaugu

SEQ ID NO: 3538634 - RNA, 14 nt, Human
uauuuuaguuucug

SEQ ID NO: 3538635 - RNA, 15 nt, Human
uauuuuauauaauaa

SEQ ID NO: 3538636 - RNA, 21 nt, Human
uauuuuauauaauaaaguauu

SEQ ID NO: 3538637 - RNA, 14 nt, Human
uauuuuaugagaaa

SEQ ID NO: 3538638 - RNA, 12 nt, Human
uauuuuaugauc

SEQ ID NO: 3538639 - RNA, 12 nt, Human
uauuuuauguua

SEQ ID NO: 3538640 - RNA, 14 nt, Human
uauuuuauguuaua

SEQ ID NO: 3538641 - RNA, 15 nt, Human
uauuuuauguugcau

SEQ ID NO: 3538642 - RNA, 14 nt, Human
uauuuuauuacugu

SEQ ID NO: 3538643 - RNA, 15 nt, Human
uauuuuauuacuguu

SEQ ID NO: 3538644 - RNA, 17 nt, Human
uauuuuauuaugaagaa

SEQ ID NO: 3538645 - RNA, 14 nt, Human
uauuuuauuaugca

SEQ ID NO: 3538646 - RNA, 17 nt, Human
uauuuuauuaugcauga

SEQ ID NO: 3538647 - RNA, 19 nt, Human
uauuuuauuguaacagaca

SEQ ID NO: 3538648 - RNA, 17 nt, Human
uauuuuauuuagacaag

SEQ ID NO: 3538649 - RNA, 22 nt, Human
uauuuucaaauuguaucuagug

SEQ ID NO: 3538650 - RNA, 19 nt, Human
uauuuucaacgcagcccug

SEQ ID NO: 3538651 - RNA, 21 nt, Human
uauuuucaacgcagcccugcu

SEQ ID NO: 3538652 - RNA, 19 nt, Human
uauuuucaauagccacuaa

SEQ ID NO: 3538653 - RNA, 12 nt, Human
uauuuucacaau

SEQ ID NO: 3538654 - RNA, 14 nt, Human
uauuuucacaaugu

SEQ ID NO: 3538655 - RNA, 13 nt, Human
uauuuucaccauu

SEQ ID NO: 3538656 - RNA, 18 nt, Human
uauuuucaguaauguuau

SEQ ID NO: 3538657 - RNA, 16 nt, Human
uauuuucauacaaauu

SEQ ID NO: 3538658 - RNA, 21 nt, Human
uauuuucaugacuuuuccaug

SEQ ID NO: 3538659 - RNA, 21 nt, Human
uauuuucauuacaauggaaac

SEQ ID NO: 3538660 - RNA, 13 nt, Human
uauuuucauugua

SEQ ID NO: 3538661 - RNA, 16 nt, Human
uauuuucauuguaaaa

SEQ ID NO: 3538662 - RNA, 22 nt, Human
uauuuuccaaaaguggccucuu

SEQ ID NO: 3538663 - RNA, 16 nt, Human
uauuuuccaugaaaau

SEQ ID NO: 3538664 - RNA, 20 nt, Human
uauuuuccaugaaaaugcaa

SEQ ID NO: 3538665 - RNA, 22 nt, Human
uauuuucccuauuagagaagag

SEQ ID NO: 3538666 - RNA, 16 nt, Human
uauuuuccuaaagaga

SEQ ID NO: 3538667 - RNA, 21 nt, Human
uauuuuccuauauuacgguuu

SEQ ID NO: 3538668 - RNA, 16 nt, Human
uauuuuccuccccagc

SEQ ID NO: 3538669 - RNA, 19 nt, Human
uauuuuccugauagcauau

SEQ ID NO: 3538670 - RNA, 16 nt, Human
uauuuucguaugaaaa

SEQ ID NO: 3538671 - RNA, 14 nt, Human
uauuuucuauguac

SEQ ID NO: 3538672 - RNA, 14 nt, Human
uauuuucuauuuua

SEQ ID NO: 3538673 - RNA, 22 nt, Human
uauuuucugguaaaaagaaaaa

SEQ ID NO: 3538674 - RNA, 20 nt, Human
uauuuucugguagauagaaa

SEQ ID NO: 3538675 - RNA, 14 nt, Human
uauuuucugucaga

SEQ ID NO: 3538676 - RNA, 21 nt, Human
uauuuucugugccugaauauu

SEQ ID NO: 3538677 - RNA, 17 nt, Human
uauuuucuguguguucc

SEQ ID NO: 3538678 - RNA, 21 nt, Human
uauuuucuuacccaauuuccc

SEQ ID NO: 3538679 - RNA, 19 nt, Human
uauuuucuucauccaacuu

SEQ ID NO: 3538680 - RNA, 15 nt, Human
uauuuucuucuaagu

SEQ ID NO: 3538681 - RNA, 14 nt, Human
uauuuucuuuaaug

SEQ ID NO: 3538682 - RNA, 19 nt, Human
uauuuucuuuugaauuguu

SEQ ID NO: 3538683 - RNA, 17 nt, Human
uauuuugaaaagcuucu

SEQ ID NO: 3538684 - RNA, 21 nt, Human
uauuuugaagugagaaaauga

SEQ ID NO: 3538685 - RNA, 19 nt, Human
uaucaauaaauagaccauu

SEQ ID NO: 3538686 - RNA, 15 nt, Human
uaucaauagucaaga

SEQ ID NO: 3538687 - RNA, 19 nt, Human
uaucaauauaauguuuuua

SEQ ID NO: 3538688 - RNA, 18 nt, Human
uaucaaucaguauaauuc

SEQ ID NO: 3538689 - RNA, 16 nt, Human
uaucaaugugucuuuc

SEQ ID NO: 3538690 - RNA, 22 nt, Human
uaucaaugugucuuucuaagaa

SEQ ID NO: 3538691 - RNA, 14 nt, Human
uaucaauuugucau

SEQ ID NO: 3538692 - RNA, 23 nt, Human
uaucacaaccaccguuacaagua

SEQ ID NO: 3538693 - RNA, 17 nt, Human
uaucacacuucugugag

SEQ ID NO: 3538694 - RNA, 12 nt, Human
uaucacauguau

SEQ ID NO: 3538695 - RNA, 13 nt, Human
uaucacauuauuu

SEQ ID NO: 3538696 - RNA, 15 nt, Human
uaucaccacaguaag

SEQ ID NO: 3538697 - RNA, 18 nt, Human
uaucaccagagagggacu

SEQ ID NO: 3538698 - RNA, 15 nt, Human
uaucaccagcugccu

SEQ ID NO: 3538699 - RNA, 17 nt, Human
uaucaccagcugccucu

SEQ ID NO: 3538700 - RNA, 19 nt, Human
uaucacccagaagaaaaua

SEQ ID NO: 3538701 - RNA, 16 nt, Human
uaucaccuagcugaau

SEQ ID NO: 3538702 - RNA, 14 nt, Human
uaucaccuccccuc

SEQ ID NO: 3538703 - RNA, 20 nt, Human
uaucaccuccccuccuugcc

SEQ ID NO: 3538704 - RNA, 12 nt, Human
uaucaccuggcu

SEQ ID NO: 3538705 - RNA, 19 nt, Human
uaucaccuggcuuguuuau

SEQ ID NO: 3538706 - RNA, 20 nt, Human
uaucaccugucuugccuuuu

SEQ ID NO: 3538707 - RNA, 18 nt, Human
uaucacugaagcuuuuua

SEQ ID NO: 3538708 - RNA, 16 nt, Human
uaucacuuaaacuugc

SEQ ID NO: 3538709 - RNA, 17 nt, Human
uaucacuuuuugaacua

SEQ ID NO: 3538710 - RNA, 16 nt, Human
uaucagaagagagggg

SEQ ID NO: 3538711 - RNA, 19 nt, Human
uaucagaauugaaacacuu

SEQ ID NO: 3538712 - RNA, 19 nt, Human
uaucagacacucuggcugg

SEQ ID NO: 3538713 - RNA, 17 nt, Human
uaucagacuaagccagc

SEQ ID NO: 3538714 - RNA, 21 nt, Human
uaucagacucggaaucuauuu

SEQ ID NO: 3538715 - RNA, 20 nt, Human
uaucagaggccuauaaugaa

SEQ ID NO: 3538716 - RNA, 20 nt, Human
uaucagauugcuuuugugca

SEQ ID NO: 3538717 - RNA, 14 nt, Human
uaucagcacgugug

SEQ ID NO: 3538718 - RNA, 19 nt, Human
uaucagccugagucuccug

SEQ ID NO: 3538719 - RNA, 20 nt, Human
uaucagcuacuuaagagaaa

SEQ ID NO: 3538720 - RNA, 15 nt, Human
uaucaggucucccac

SEQ ID NO: 3538721 - RNA, 16 nt, Human
uaucaggugcccaucc

SEQ ID NO: 3538722 - RNA, 17 nt, Human
uaucaggugcugccauc

SEQ ID NO: 3538723 - RNA, 20 nt, Human
uaucaggugcugccauccag

SEQ ID NO: 3538724 - RNA, 22 nt, Human
uaucagucauaacuaaauaaag

SEQ ID NO: 3538725 - RNA, 22 nt, Human
uaucagucuuguaccaaggcaa

SEQ ID NO: 3538726 - RNA, 15 nt, Human
uaucagugacagagu

SEQ ID NO: 3538727 - RNA, 11 nt, Human
uaucagugcuu

SEQ ID NO: 3538728 - RNA, 13 nt, Human
uaucagugugccc

SEQ ID NO: 3538729 - RNA, 18 nt, Human
uaucaguuacucagcccu

SEQ ID NO: 3538730 - RNA, 19 nt, Human
uaucaguuacucagcccug

SEQ ID NO: 3538731 - RNA, 20 nt, Human
uaucaguuacucagcccugg

SEQ ID NO: 3538732 - RNA, 21 nt, Human
uaucaguugcaauaauacuuc

SEQ ID NO: 3538733 - RNA, 13 nt, Human
uaucauaauuacc

SEQ ID NO: 3538734 - RNA, 17 nt, Human
uaucuaggcaacauagu

SEQ ID NO: 3538735 - RNA, 15 nt, Human
uaucuagguuuauga

SEQ ID NO: 3538736 - RNA, 14 nt, Human
uaucuaguaugaaa

SEQ ID NO: 3538737 - RNA, 17 nt, Human
uaucuaguaugaaauua

SEQ ID NO: 3538738 - RNA, 14 nt, Human
uaucuagugcagcu

SEQ ID NO: 3538739 - RNA, 16 nt, Human
uaucuaguguuugauu

SEQ ID NO: 3538740 - RNA, 22 nt, Human
uaucuaguuuaauuaaucugua

SEQ ID NO: 3538741 - RNA, 12 nt, Human
uaucuauaaaau

SEQ ID NO: 3538742 - RNA, 13 nt, Human
uaucuauaaaaua

SEQ ID NO: 3538743 - RNA, 16 nt, Human
uaucuauaaacacugu

SEQ ID NO: 3538744 - RNA, 16 nt, Human
uaucuauaauuuaccu

SEQ ID NO: 3538745 - RNA, 13 nt, Human
uaucuauagcuaa

SEQ ID NO: 3538746 - RNA, 13 nt, Human
uaucuauauaaaa

SEQ ID NO: 3538747 - RNA, 21 nt, Human
uaucuauauauaauucuguac

SEQ ID NO: 3538748 - RNA, 13 nt, Human
uaucuauauaugu

SEQ ID NO: 3538749 - RNA, 16 nt, Human
uaucuauauaugugua

SEQ ID NO: 3538750 - RNA, 16 nt, Human
uaucuauauguacuug

SEQ ID NO: 3538751 - RNA, 16 nt, Human
uaucuaucuauuugag

SEQ ID NO: 3538752 - RNA, 17 nt, Human
uaucuaucuauuugagg

SEQ ID NO: 3538753 - RNA, 13 nt, Human
uaucuaucuuaua

SEQ ID NO: 3538754 - RNA, 15 nt, Human
uaucuauuaauauau

SEQ ID NO: 3538755 - RNA, 19 nt, Human
uaucuauuaauauauguau

SEQ ID NO: 3538756 - RNA, 19 nt, Human
uaucuauucugagaaaaca

SEQ ID NO: 3538757 - RNA, 23 nt, Human
uaucuauucugagaaaacaagca

SEQ ID NO: 3538758 - RNA, 13 nt, Human
uaucuauuguaag

SEQ ID NO: 3538759 - RNA, 14 nt, Human
uaucuauuguaaga

SEQ ID NO: 3538760 - RNA, 18 nt, Human
uaucuauuguaagauaaa

SEQ ID NO: 3538761 - RNA, 12 nt, Human
uaucucaaacaa

SEQ ID NO: 3538762 - RNA, 14 nt, Human
uaucucaaauugua

SEQ ID NO: 3538763 - RNA, 16 nt, Human
uaucucaaugaaccau

SEQ ID NO: 3538764 - RNA, 16 nt, Human
uaucucacuugugcca

SEQ ID NO: 3538765 - RNA, 17 nt, Human
uaucucagauauuugca

SEQ ID NO: 3538766 - RNA, 15 nt, Human
uaucucagauguuaa

SEQ ID NO: 3538767 - RNA, 15 nt, Human
uaucuccaagaccag

SEQ ID NO: 3538768 - RNA, 22 nt, Human
uaucuccaugaugauaguugaa

SEQ ID NO: 3538769 - RNA, 14 nt, Human
uaucucccccagcc

SEQ ID NO: 3538770 - RNA, 16 nt, Human
uaucucccugccuccu

SEQ ID NO: 3538771 - RNA, 18 nt, Human
uaucuccggcucccagcc

SEQ ID NO: 3538772 - RNA, 20 nt, Human
uaucuccggcucccagccuc

SEQ ID NO: 3538773 - RNA, 11 nt, Human
uaucuccugac

SEQ ID NO: 3538774 - RNA, 17 nt, Human
uaucucuauuugagaau

SEQ ID NO: 3538775 - RNA, 20 nt, Human
uaucucugucuaccaucucc

SEQ ID NO: 3538776 - RNA, 11 nt, Human
uaucucugugu

SEQ ID NO: 3538777 - RNA, 15 nt, Human
uaucugaaaacugga

SEQ ID NO: 3538778 - RNA, 15 nt, Human
uaucugaaaauguau

SEQ ID NO: 3538779 - RNA, 18 nt, Human
uaucugaagucagaucug

SEQ ID NO: 3538780 - RNA, 20 nt, Human
uaucugagcucuuugcacua

SEQ ID NO: 3538781 - RNA, 18 nt, Human
uaucugaggaauucugua

SEQ ID NO: 3538782 - RNA, 23 nt, Human
uaucugaguuacagaaaugauua

SEQ ID NO: 3538783 - RNA, 14 nt, Human
uaucugaguugcca

SEQ ID NO: 3538784 - RNA, 16 nt, Human
uaucugauuuugugca

SEQ ID NO: 3538785 - RNA, 22 nt, Human
uaucugauuuugugcaaaagcu

SEQ ID NO: 3538786 - RNA, 15 nt, Human
uaucugcaggcagac

SEQ ID NO: 3538787 - RNA, 19 nt, Human
uaucugcaggcagacacgg

SEQ ID NO: 3538788 - RNA, 13 nt, Human
uaucugccuuuau

SEQ ID NO: 3538789 - RNA, 18 nt, Human
uaucugccuuuauugugu

SEQ ID NO: 3538790 - RNA, 15 nt, Human
uaucugcuguauguc

SEQ ID NO: 3538791 - RNA, 22 nt, Human
uaucugcuguccagacagccug

SEQ ID NO: 3538792 - RNA, 23 nt, Human
uaucugcuuuugguuauaaugug

SEQ ID NO: 3538793 - RNA, 15 nt, Human
uaucuggccucugcu

SEQ ID NO: 3538794 - RNA, 23 nt, Human
uaucugggauuaugguuuuguga

SEQ ID NO: 3538795 - RNA, 21 nt, Human
uaucugggauucuacuuuaag

SEQ ID NO: 3538796 - RNA, 18 nt, Human
uaucugggcugugggcaa

SEQ ID NO: 3538797 - RNA, 14 nt, Human
uaucugggcuuccu

SEQ ID NO: 3538798 - RNA, 19 nt, Human
uaucugggugcaugaucuu

SEQ ID NO: 3538799 - RNA, 22 nt, Human
uaucuguaaugguacugacuuu

SEQ ID NO: 3538800 - RNA, 22 nt, Human
uaucuguauuuaauuuugacac

SEQ ID NO: 3538801 - RNA, 20 nt, Human
uaucuguuuccugacauugu

SEQ ID NO: 3538802 - RNA, 15 nt, Human
uaucuguuugagaaa

SEQ ID NO: 3538803 - RNA, 16 nt, Human
uaucuguuugagaaag

SEQ ID NO: 3538804 - RNA, 19 nt, Human
uaucuguuugagaaaguca

SEQ ID NO: 3538805 - RNA, 15 nt, Human
uaucuguuuuacugc

SEQ ID NO: 3538806 - RNA, 15 nt, Human
uaucuuaaagaaaca

SEQ ID NO: 3538807 - RNA, 20 nt, Human
uaucuuaaagaaacagcuuu

SEQ ID NO: 3538808 - RNA, 14 nt, Human
uaucuuaaagcacu

SEQ ID NO: 3538809 - RNA, 15 nt, Human
uaucuuaaagcacuu

SEQ ID NO: 3538810 - RNA, 14 nt, Human
uaucuuaaauuuga

SEQ ID NO: 3538811 - RNA, 20 nt, Human
uaucuuaauuuugguuguau

SEQ ID NO: 3538812 - RNA, 14 nt, Human
uaucuuacaauauu

SEQ ID NO: 3538813 - RNA, 14 nt, Human
uaucuuacuuuccu

SEQ ID NO: 3538814 - RNA, 19 nt, Human
uaucuuagauguuucacac

SEQ ID NO: 3538815 - RNA, 12 nt, Human
uaucuucacaau

SEQ ID NO: 3538816 - RNA, 18 nt, Human
uaucuucagcucuuuuug

SEQ ID NO: 3538817 - RNA, 14 nt, Human
uaucuucauguaaa

SEQ ID NO: 3538818 - RNA, 15 nt, Human
uaucuucauguaaau

SEQ ID NO: 3538819 - RNA, 14 nt, Human
uaucuuccauauuu

SEQ ID NO: 3538820 - RNA, 23 nt, Human
uaucuucguuaguaaucuguaua

SEQ ID NO: 3538821 - RNA, 18 nt, Human
uaucuucucaaguucuaa

SEQ ID NO: 3538822 - RNA, 15 nt, Human
uaucuucuggacuau

SEQ ID NO: 3538823 - RNA, 17 nt, Human
uaucuugaaggaaaaau

SEQ ID NO: 3538824 - RNA, 15 nt, Human
uaucuugaauaaugu

SEQ ID NO: 3538825 - RNA, 23 nt, Human
uaucuugcaguaucggcacugua

SEQ ID NO: 3538826 - RNA, 15 nt, Human
uaucuugcucuguaa

SEQ ID NO: 3538827 - RNA, 13 nt, Human
uaucuugcuugaa

SEQ ID NO: 3538828 - RNA, 15 nt, Human
uaucuuguuccaagg

SEQ ID NO: 3538829 - RNA, 18 nt, Human
uaucuuguuuuuccacua

SEQ ID NO: 3538830 - RNA, 22 nt, Human
uaucuuguuuuuccacuacugc

SEQ ID NO: 3538831 - RNA, 24 nt, Human
uaucuuuaaacgaaacaaagacaa

SEQ ID NO: 3538832 - RNA, 13 nt, Human
uaucuuucuacag

SEQ ID NO: 3538833 - RNA, 12 nt, Human
uaucuuugauaa

SEQ ID NO: 3538834 - RNA, 14 nt, Human
uaucuuugccaccc

SEQ ID NO: 3538835 - RNA, 17 nt, Human
uaucuuuguaauuauuu

SEQ ID NO: 3538836 - RNA, 16 nt, Human
uaucuuuucuacagca

SEQ ID NO: 3538837 - RNA, 18 nt, Human
uaucuuuuuaccuuucau

SEQ ID NO: 3538838 - RNA, 16 nt, Human
uaucuuuuuauugaug

SEQ ID NO: 3538839 - RNA, 17 nt, Human
uaucuuuuuauugaugu

SEQ ID NO: 3538840 - RNA, 21 nt, Human
uaucuuuuuuuuauuccacau

SEQ ID NO: 3538841 - RNA, 13 nt, Human
uaugaaaacaugg

SEQ ID NO: 3538842 - RNA, 18 nt, Human
uaugaaaacauggaacag

SEQ ID NO: 3538843 - RNA, 22 nt, Human
uaugaaaacuauacaacaaagg

SEQ ID NO: 3538844 - RNA, 14 nt, Human
uaugaaaagcuaga

SEQ ID NO: 3538845 - RNA, 19 nt, Human
uaugaaaaugaguugugaa

SEQ ID NO: 3538846 - RNA, 20 nt, Human
uaugaaaaugaguugugaaa

SEQ ID NO: 3538847 - RNA, 15 nt, Human
gccuaggugacagag

SEQ ID NO: 3538848 - RNA, 14 nt, Human
gccuaguauugaca

SEQ ID NO: 3538849 - RNA, 19 nt, Human
gccuagucagccacauggg

SEQ ID NO: 3538850 - RNA, 19 nt, Human
gccuagucccuuccacacc

SEQ ID NO: 3538851 - RNA, 19 nt, Human
gccuagugaaggcuucucu

SEQ ID NO: 3538852 - RNA, 22 nt, Human
gccuagugaaggcuucucucug

SEQ ID NO: 3538853 - RNA, 14 nt, Human
gccuaguggcuugu

SEQ ID NO: 3538854 - RNA, 22 nt, Human
gccuaguggggucucccucucc

SEQ ID NO: 3538855 - RNA, 17 nt, Human
gccuaguucauccaauc

SEQ ID NO: 3538856 - RNA, 19 nt, Human
gccuauaugagaagaauag

SEQ ID NO: 3538857 - RNA, 19 nt, Human
gccuaucagugugcccccc

SEQ ID NO: 3538858 - RNA, 23 nt, Human
gccuaucagugugccccccaucc

SEQ ID NO: 3538859 - RNA, 16 nt, Human
gccuaugacuugggca

SEQ ID NO: 3538860 - RNA, 20 nt, Human
gccuaugagcauccugagcc

SEQ ID NO: 3538861 - RNA, 22 nt, Human
gccuaugcacauauggacucug

SEQ ID NO: 3538862 - RNA, 17 nt, Human
gccuauggagagcccug

SEQ ID NO: 3538863 - RNA, 18 nt, Human
gccuauggagagcccugg

SEQ ID NO: 3538864 - RNA, 19 nt, Human
gccuauggagagcccuggg

SEQ ID NO: 3538865 - RNA, 21 nt, Human
gccuauggagagcccugggac

SEQ ID NO: 3538866 - RNA, 22 nt, Human
gccuauggagagcccugggacc

SEQ ID NO: 3538867 - RNA, 15 nt, Human
gccuauuauauuaaa

SEQ ID NO: 3538868 - RNA, 20 nt, Human
gccuauuauauuaaaauaug

SEQ ID NO: 3538869 - RNA, 15 nt, Human
gccuauugauacuug

SEQ ID NO: 3538870 - RNA, 18 nt, Human
gccuauuguaaauacaag

SEQ ID NO: 3538871 - RNA, 21 nt, Human
gccuauuguaauauagaaaaa

SEQ ID NO: 3538872 - RNA, 11 nt, Human
gccuauuucau

SEQ ID NO: 3538873 - RNA, 13 nt, Human
gccuauuugugug

SEQ ID NO: 3538874 - RNA, 17 nt, Human
gccuauuuuaauaaaca

SEQ ID NO: 3538875 - RNA, 19 nt, Human
gccucaaauccaggacccu

SEQ ID NO: 3538876 - RNA, 18 nt, Human
gccucaaaugagaaaaug

SEQ ID NO: 3538877 - RNA, 15 nt, Human
gccucaacccucccu

SEQ ID NO: 3538878 - RNA, 14 nt, Human
gccucaaccuccug

SEQ ID NO: 3538879 - RNA, 17 nt, Human
gccucaaccuccugggc

SEQ ID NO: 3538880 - RNA, 19 nt, Human
ucaccccgaggcccugcau

SEQ ID NO: 3538881 - RNA, 15 nt, Human
ucaccccggcaggcc

SEQ ID NO: 3538882 - RNA, 21 nt, Human
ucaccccggcaggcccugcag

SEQ ID NO: 3538883 - RNA, 14 nt, Human
ucaccccgucuggg

SEQ ID NO: 3538884 - RNA, 23 nt, Human
ucaccccuaaaagaaacccugca

SEQ ID NO: 3538885 - RNA, 14 nt, Human
ucaccccucccuuu

SEQ ID NO: 3538886 - RNA, 14 nt, Human
ucaccccuguccuc

SEQ ID NO: 3538887 - RNA, 21 nt, Human
ucacccgaucgccagcaaaac

SEQ ID NO: 3538888 - RNA, 21 nt, Human
ucacccuagcccucucccucu

SEQ ID NO: 3538889 - RNA, 13 nt, Human
ucacccuccaccu

SEQ ID NO: 3538890 - RNA, 15 nt, Human
ucacccuccaccucu

SEQ ID NO: 3538891 - RNA, 17 nt, Human
ucacccuggaggcaccu

SEQ ID NO: 3538892 - RNA, 17 nt, Human
ucacccuuaacccaagg

SEQ ID NO: 3538893 - RNA, 19 nt, Human
ucacccuuaccaugugccu

SEQ ID NO: 3538894 - RNA, 22 nt, Human
ucacccuuauagucuaagacua

SEQ ID NO: 3538895 - RNA, 17 nt, Human
ucacccuuggacaagac

SEQ ID NO: 3538896 - RNA, 22 nt, Human
ucacccuuugcugugaggcugu

SEQ ID NO: 3538897 - RNA, 20 nt, Human
ucaccgaaaacguggcugcu

SEQ ID NO: 3538898 - RNA, 21 nt, Human
ucaccgaaaacguggcugcuu

SEQ ID NO: 3538899 - RNA, 17 nt, Human
ucaccgacgcgucuccu

SEQ ID NO: 3538900 - RNA, 22 nt, Human
ucaccgacugaaaauauuguuu

SEQ ID NO: 3538901 - RNA, 15 nt, Human
ucaccggauccuggg

SEQ ID NO: 3538902 - RNA, 17 nt, Human
ucaccguggaccuuccu

SEQ ID NO: 3538903 - RNA, 19 nt, Human
ucaccguggaccuuccugc

SEQ ID NO: 3538904 - RNA, 16 nt, Human
ucaccgugggcucccu

SEQ ID NO: 3538905 - RNA, 17 nt, Human
ucaccgugggcucccug

SEQ ID NO: 3538906 - RNA, 16 nt, Human
uauucaauuccucugg

SEQ ID NO: 3538907 - RNA, 18 nt, Human
uauucaauuccucuggga

SEQ ID NO: 3538908 - RNA, 15 nt, Human
uauucaccuucaguu

SEQ ID NO: 3538909 - RNA, 17 nt, Human
uauucaccuucaguuuu

SEQ ID NO: 3538910 - RNA, 12 nt, Human
uauucagaauau

SEQ ID NO: 3538911 - RNA, 20 nt, Human
uauucagaauuaugauggaa

SEQ ID NO: 3538912 - RNA, 21 nt, Human
uauucagacaaaauggauaca

SEQ ID NO: 3538913 - RNA, 14 nt, Human
uauucagacaagca

SEQ ID NO: 3538914 - RNA, 19 nt, Human
uauucagcuucauuugugu

SEQ ID NO: 3538915 - RNA, 21 nt, Human
uauucagcuugcacauuuggu

SEQ ID NO: 3538916 - RNA, 20 nt, Human
uauucaggacuugaaagaaa

SEQ ID NO: 3538917 - RNA, 18 nt, Human
uauucaguuaagaaaaaa

SEQ ID NO: 3538918 - RNA, 21 nt, Human
uauucaguuaagaaaaaaaua

SEQ ID NO: 3538919 - RNA, 13 nt, Human
uauucauaugcau

SEQ ID NO: 3538920 - RNA, 16 nt, Human
uauucauauuggaaaa

SEQ ID NO: 3538921 - RNA, 17 nt, Human
uauucauauuggaaaaa

SEQ ID NO: 3538922 - RNA, 15 nt, Human
uauucauauuuguac

SEQ ID NO: 3538923 - RNA, 23 nt, Human
uauucauauuuguacuuucuguu

SEQ ID NO: 3538924 - RNA, 21 nt, Human
uauucauauuuucuuucaaaa

SEQ ID NO: 3538925 - RNA, 17 nt, Human
uauucauccaaguuaaa

SEQ ID NO: 3538926 - RNA, 15 nt, Human
uauucaucucaagga

SEQ ID NO: 3538927 - RNA, 20 nt, Human
uauucaugaagcggucacag

SEQ ID NO: 3538928 - RNA, 14 nt, Human
uauucaugcuucuu

SEQ ID NO: 3538929 - RNA, 18 nt, Human
uauucauuauuugucaaa

SEQ ID NO: 3538930 - RNA, 19 nt, Human
uauucauuauuugucaaau

SEQ ID NO: 3538931 - RNA, 20 nt, Human
uauucauucugugaucauuu

SEQ ID NO: 3538932 - RNA, 13 nt, Human
uauucauuuaaaa

SEQ ID NO: 3538933 - RNA, 17 nt, Human
uauucauuuaaaaugau

SEQ ID NO: 3538934 - RNA, 16 nt, Human
uauucauuuucucuaa

SEQ ID NO: 3538935 - RNA, 19 nt, Human
uauuccaagacaugucugu

SEQ ID NO: 3538936 - RNA, 18 nt, Human
uauuccaccuuaaauuaa

SEQ ID NO: 3538937 - RNA, 22 nt, Human
uauuccagacuugggaggaugu

SEQ ID NO: 3538938 - RNA, 22 nt, Human
uauuccagcuguccccccacuc

SEQ ID NO: 3538939 - RNA, 16 nt, Human
uauuccauaguauauu

SEQ ID NO: 3538940 - RNA, 19 nt, Human
uauuccauaguauauuaaa

SEQ ID NO: 3538941 - RNA, 14 nt, Human
uauuccauauuaga

SEQ ID NO: 3538942 - RNA, 23 nt, Human
uauuccauauuagaaaacuuugu

SEQ ID NO: 3538943 - RNA, 16 nt, Human
uauuccaugaauguau

SEQ ID NO: 3538944 - RNA, 23 nt, Human
uauuccaugaauguaucaggaaa

SEQ ID NO: 3538945 - RNA, 15 nt, Human
uauuccaugacugcu

SEQ ID NO: 3538946 - RNA, 12 nt, Human
uauucccaugag

SEQ ID NO: 3538947 - RNA, 19 nt, Human
uauuccccacccuccccuu

SEQ ID NO: 3538948 - RNA, 20 nt, Human
uauuccccuaucucuagaau

SEQ ID NO: 3538949 - RNA, 21 nt, Human
uauucccuguacaauauuuaa

SEQ ID NO: 3538950 - RNA, 22 nt, Human
uauuccugaccuccgccaucca

SEQ ID NO: 3538951 - RNA, 17 nt, Human
uauuccugcauuuguga

SEQ ID NO: 3538952 - RNA, 14 nt, Human
uauuccuguauguu

SEQ ID NO: 3538953 - RNA, 17 nt, Human
uauuccuguauguuguc

SEQ ID NO: 3538954 - RNA, 15 nt, Human
uauuccuucuggccu

SEQ ID NO: 3538955 - RNA, 21 nt, Human
uauuccuucuggccuuuccuc

SEQ ID NO: 3538956 - RNA, 12 nt, Human
uauuccuuuccc

SEQ ID NO: 3538957 - RNA, 13 nt, Human
uauuccuuucccu

SEQ ID NO: 3538958 - RNA, 16 nt, Human
uauuccuuucccuucc

SEQ ID NO: 3538959 - RNA, 17 nt, Human
uauuccuuucccuuccu

SEQ ID NO: 3538960 - RNA, 21 nt, Human
uauuccuuugggccucugcuu

SEQ ID NO: 3538961 - RNA, 16 nt, Human
uauucgaaugaaaaga

SEQ ID NO: 3538962 - RNA, 22 nt, Human
uauucgcuugagaaaaaaagaa

SEQ ID NO: 3538963 - RNA, 15 nt, Human
uauucuaaauuuuau

SEQ ID NO: 3538964 - RNA, 20 nt, Human
uauucuaaauuuuauaucuu

SEQ ID NO: 3538965 - RNA, 11 nt, Human
uauucuaagac

SEQ ID NO: 3538966 - RNA, 15 nt, Human
uauucuacauuucac

SEQ ID NO: 3538967 - RNA, 16 nt, Human
uauucuagccugcauu

SEQ ID NO: 3538968 - RNA, 19 nt, Human
uauucuagcuaauguaaua

SEQ ID NO: 3538969 - RNA, 10 nt, Human
uauucuaguc

SEQ ID NO: 3538970 - RNA, 19 nt, Human
uauucuauaaaacucugca

SEQ ID NO: 3538971 - RNA, 14 nt, Human
uauucuauaugaau

SEQ ID NO: 3538972 - RNA, 19 nt, Human
uauucuauaugaauuuaaa

SEQ ID NO: 3538973 - RNA, 13 nt, Human
uauucuauuaacu

SEQ ID NO: 3538974 - RNA, 12 nt, Human
uauucuauuuua

SEQ ID NO: 3538975 - RNA, 14 nt, Human
uauucuauuuuaca

SEQ ID NO: 3538976 - RNA, 15 nt, Human
uauucuauuuuacaa

SEQ ID NO: 3538977 - RNA, 22 nt, Human
uauucuauuuucauuuucugca

SEQ ID NO: 3538978 - RNA, 14 nt, Human
uauucucaccagga

SEQ ID NO: 3538979 - RNA, 22 nt, Human
uauucucacuccaccacccaaa

SEQ ID NO: 3538980 - RNA, 22 nt, Human
uauucuccuucugucaaaguca

SEQ ID NO: 3538981 - RNA, 17 nt, Human
uauucucuccuguaccu

SEQ ID NO: 3538982 - RNA, 20 nt, Human
uauucucuccuguaccucuu

SEQ ID NO: 3538983 - RNA, 24 nt, Human
uauucucuccuguaccucuugagc

SEQ ID NO: 3538984 - RNA, 12 nt, Human
uauucucugagc

SEQ ID NO: 3538985 - RNA, 18 nt, Human
uauucucugagcugugca

SEQ ID NO: 3538986 - RNA, 14 nt, Human
uauucucuguacau

SEQ ID NO: 3538987 - RNA, 16 nt, Human
uauucucuguacauau

SEQ ID NO: 3538988 - RNA, 13 nt, Human
uauucucuuuggu

SEQ ID NO: 3538989 - RNA, 18 nt, Human
uauucucuuuuaucuguu

SEQ ID NO: 3538990 - RNA, 20 nt, Human
uauucugccuuugcagaaac

SEQ ID NO: 3538991 - RNA, 17 nt, Human
uauucuggcugauaaaa

SEQ ID NO: 3538992 - RNA, 21 nt, Human
uauucuggcugauaaaagaua

SEQ ID NO: 3538993 - RNA, 22 nt, Human
uauucugggcaccacaaaauau

SEQ ID NO: 3538994 - RNA, 22 nt, Human
uauucugugcuguuacaguuuu

SEQ ID NO: 3538995 - RNA, 16 nt, Human
uauucuguuggccagu

SEQ ID NO: 3538996 - RNA, 18 nt, Human
uauucuuaaaaugcaaua

SEQ ID NO: 3538997 - RNA, 19 nt, Human
uauucuuaaaaugcaauau

SEQ ID NO: 3538998 - RNA, 13 nt, Human
uauucuucuagag

SEQ ID NO: 3538999 - RNA, 14 nt, Human
uauucuucuagagu

SEQ ID NO: 3539000 - RNA, 22 nt, Human
uauucuucucuuccuuuuauca

SEQ ID NO: 3539001 - RNA, 14 nt, Human
uauucuugauguaa

SEQ ID NO: 3539002 - RNA, 20 nt, Human
uauucuugauuuauuugcuu

SEQ ID NO: 3539003 - RNA, 13 nt, Human
uauucuugugcuu

SEQ ID NO: 3539004 - RNA, 21 nt, Human
uauucuuucaauucuguaggu

SEQ ID NO: 3539005 - RNA, 22 nt, Human
uauucuuucgaaagaagaaaau

SEQ ID NO: 3539006 - RNA, 21 nt, Human
uauucuuugauguuaacacau

SEQ ID NO: 3539007 - RNA, 22 nt, Human
uauucuuugauguuaacacauu

SEQ ID NO: 3539008 - RNA, 12 nt, Human
uauucuuuguua

SEQ ID NO: 3539009 - RNA, 17 nt, Human
uauucuuuguuaauuug

SEQ ID NO: 3539010 - RNA, 19 nt, Human
uauucuuuguuaauuugga

SEQ ID NO: 3539011 - RNA, 13 nt, Human
uauucuuuuucca

SEQ ID NO: 3539012 - RNA, 17 nt, Human
uauucuuuuuuucucua

SEQ ID NO: 3539013 - RNA, 14 nt, Human
uauugaaaaaaaua

SEQ ID NO: 3539014 - RNA, 13 nt, Human
uauugaaauucua

SEQ ID NO: 3539015 - RNA, 13 nt, Human
uauugaacuuuuu

SEQ ID NO: 3539016 - RNA, 14 nt, Human
uauugaagaaacag

SEQ ID NO: 3539017 - RNA, 22 nt, Human
uauugaagaaacagauaccaua

SEQ ID NO: 3539018 - RNA, 20 nt, Human
uauugaagacaauuugauac

SEQ ID NO: 3539019 - RNA, 22 nt, Human
uauugaagacaauuugauacau

SEQ ID NO: 3539020 - RNA, 16 nt, Human
uauugaagcauuuuau

SEQ ID NO: 3539021 - RNA, 21 nt, Human
uauugaaggaagccaaauuua

SEQ ID NO: 3539022 - RNA, 22 nt, Human
uauugaaucauguaguaucaaa

SEQ ID NO: 3539023 - RNA, 17 nt, Human
uauugaaucuauuuaag

SEQ ID NO: 3539024 - RNA, 21 nt, Human
ucacuaugaaucuauuauacu

SEQ ID NO: 3539025 - RNA, 15 nt, Human
ucacuaugcauuuua

SEQ ID NO: 3539026 - RNA, 14 nt, Human
ucacuauggugcca

SEQ ID NO: 3539027 - RNA, 17 nt, Human
ucacuauguugcccagg

SEQ ID NO: 3539028 - RNA, 15 nt, Human
ucacucaagcacuga

SEQ ID NO: 3539029 - RNA, 17 nt, Human
ucacucaagcacugaua

SEQ ID NO: 3539030 - RNA, 20 nt, Human
ucacucaaggcggugcuuga

SEQ ID NO: 3539031 - RNA, 14 nt, Human
ucacucagauggaa

SEQ ID NO: 3539032 - RNA, 16 nt, Human
ucacucagcaccacuc

SEQ ID NO: 3539033 - RNA, 17 nt, Human
ucacucagcaccacuca

SEQ ID NO: 3539034 - RNA, 13 nt, Human
ucacucaggcugg

SEQ ID NO: 3539035 - RNA, 21 nt, Human
ucacucaggcuggaguacagu

SEQ ID NO: 3539036 - RNA, 13 nt, Human
ucacucauugcug

SEQ ID NO: 3539037 - RNA, 17 nt, Human
ucacucauugcugagcc

SEQ ID NO: 3539038 - RNA, 18 nt, Human
ucacucauugcugagccu

SEQ ID NO: 3539039 - RNA, 14 nt, Human
ucacuccagccugg

SEQ ID NO: 3539040 - RNA, 23 nt, Human
ucacuccaggaaggggcuggacu

SEQ ID NO: 3539041 - RNA, 14 nt, Human
ucacucccagucca

SEQ ID NO: 3539042 - RNA, 17 nt, Human
ucacuccccaaggaaga

SEQ ID NO: 3539043 - RNA, 18 nt, Human
ucacuccccaaggaagag

SEQ ID NO: 3539044 - RNA, 17 nt, Human
ucacuccccagccuggg

SEQ ID NO: 3539045 - RNA, 19 nt, Human
ucacuccccagccugggcc

SEQ ID NO: 3539046 - RNA, 13 nt, Human
ucacuccccucca

SEQ ID NO: 3539047 - RNA, 18 nt, Human
ucacucccuucuccuuga

SEQ ID NO: 3539048 - RNA, 20 nt, Human
ucacucccuucuccuugaua

SEQ ID NO: 3539049 - RNA, 17 nt, Human
ucacuccggugugccug

SEQ ID NO: 3539050 - RNA, 22 nt, Human
ucacuccggugugccugcagcc

SEQ ID NO: 3539051 - RNA, 17 nt, Human
ucacuccugacugcccg

SEQ ID NO: 3539052 - RNA, 23 nt, Human
ucacuccugagaccccuggccuc

SEQ ID NO: 3539053 - RNA, 12 nt, Human
ucacuccugcug

SEQ ID NO: 3539054 - RNA, 14 nt, Human
ucacuccugcugua

SEQ ID NO: 3539055 - RNA, 16 nt, Human
ucacuccugcuguaaa

SEQ ID NO: 3539056 - RNA, 12 nt, Human
ucacuccugggg

SEQ ID NO: 3539057 - RNA, 13 nt, Human
ucacuccuggggc

SEQ ID NO: 3539058 - RNA, 10 nt, Human
ucacuccugu

SEQ ID NO: 3539059 - RNA, 13 nt, Human
ucacuccuugaaa

SEQ ID NO: 3539060 - RNA, 13 nt, Human
ucacuccuuuuaa

SEQ ID NO: 3539061 - RNA, 18 nt, Human
ucacuccuuuuaaagaaa

SEQ ID NO: 3539062 - RNA, 15 nt, Human
ucacucgcccccggg

SEQ ID NO: 3539063 - RNA, 20 nt, Human
ucacucggguuucucugugg

SEQ ID NO: 3539064 - RNA, 15 nt, Human
ucacucuaagauguu

SEQ ID NO: 3539065 - RNA, 20 nt, Human
ucacucuaagucauguaugu

SEQ ID NO: 3539066 - RNA, 15 nt, Human
uauugauugggaaaa

SEQ ID NO: 3539067 - RNA, 22 nt, Human
uauugauugggaaaacauuugc

SEQ ID NO: 3539068 - RNA, 14 nt, Human
uauugcaaagucag

SEQ ID NO: 3539069 - RNA, 18 nt, Human
uauugcaauaaaguauaa

SEQ ID NO: 3539070 - RNA, 17 nt, Human
uauugcaaugaaggaaa

SEQ ID NO: 3539071 - RNA, 17 nt, Human
uauugcacaugucuuaa

SEQ ID NO: 3539072 - RNA, 20 nt, Human
uauugcacaugucuuaauga

SEQ ID NO: 3539073 - RNA, 22 nt, Human
uauugcacaugucuuaaugaag

SEQ ID NO: 3539074 - RNA, 15 nt, Human
uauugcaguuuauca

SEQ ID NO: 3539075 - RNA, 19 nt, Human
uauugcaguuuaucauuca

SEQ ID NO: 3539076 - RNA, 23 nt, Human
uauugcauacuauuaaacaugcu

SEQ ID NO: 3539077 - RNA, 16 nt, Human
uauugcaucuguauaa

SEQ ID NO: 3539078 - RNA, 22 nt, Human
uauugcauuuggauuggggucc

SEQ ID NO: 3539079 - RNA, 15 nt, Human
uauugccaaacauua

SEQ ID NO: 3539080 - RNA, 14 nt, Human
uauugccaaugcua

SEQ ID NO: 3539081 - RNA, 15 nt, Human
uauugcccaggcugg

SEQ ID NO: 3539082 - RNA, 13 nt, Human
uauugcccagguu

SEQ ID NO: 3539083 - RNA, 15 nt, Human
uauugccucugagag

SEQ ID NO: 3539084 - RNA, 19 nt, Human
uauugccuucucaccagcu

SEQ ID NO: 3539085 - RNA, 19 nt, Human
uauugccuucuuugaagaa

SEQ ID NO: 3539086 - RNA, 21 nt, Human
uauugccuuuuaauuuuuaau

SEQ ID NO: 3539087 - RNA, 20 nt, Human
uauugcuagagcuccucccu

SEQ ID NO: 3539088 - RNA, 14 nt, Human
uauugcuaguauuu

SEQ ID NO: 3539089 - RNA, 16 nt, Human
uauugcuaguauuuga

SEQ ID NO: 3539090 - RNA, 17 nt, Human
uauugcuaguauuugaa

SEQ ID NO: 3539091 - RNA, 18 nt, Human
uauugcuaguauuugaau

SEQ ID NO: 3539092 - RNA, 12 nt, Human
uauugcuggggu

SEQ ID NO: 3539093 - RNA, 16 nt, Human
uauugcuguugcuuga

SEQ ID NO: 3539094 - RNA, 17 nt, Human
uauugcuguugcuugaa

SEQ ID NO: 3539095 - RNA, 17 nt, Human
uauugcuuaguaaaauu

SEQ ID NO: 3539096 - RNA, 23 nt, Human
uauugcuucuucuccuaugugua

SEQ ID NO: 3539097 - RNA, 21 nt, Human
uauugcuugcacaaaccaauu

SEQ ID NO: 3539098 - RNA, 16 nt, Human
uauuggaauauaauug

SEQ ID NO: 3539099 - RNA, 16 nt, Human
uauuggaauuaaccug

SEQ ID NO: 3539100 - RNA, 21 nt, Human
uauuggaggguaaaugaugug

SEQ ID NO: 3539101 - RNA, 23 nt, Human
uauuggggccaugaguaaaauag

SEQ ID NO: 3539102 - RNA, 16 nt, Human
uauuggggucugaccc

SEQ ID NO: 3539103 - RNA, 18 nt, Human
uauuggguucauuauugg

SEQ ID NO: 3539104 - RNA, 15 nt, Human
uauugguaacauccu

SEQ ID NO: 3539105 - RNA, 21 nt, Human
uauugguaacauccuuucuau

SEQ ID NO: 3539106 - RNA, 15 nt, Human
uauugguauacuguu

SEQ ID NO: 3539107 - RNA, 14 nt, Human
uauugguauauccu

SEQ ID NO: 3539108 - RNA, 13 nt, Human
uauugguggaauc

SEQ ID NO: 3539109 - RNA, 18 nt, Human
uauuggugguucucagca

SEQ ID NO: 3539110 - RNA, 20 nt, Human
uauugguuuaaagaaagugu

SEQ ID NO: 3539111 - RNA, 15 nt, Human
uauugguuuuaugau

SEQ ID NO: 3539112 - RNA, 15 nt, Human
uauuguaaaacaggu

SEQ ID NO: 3539113 - RNA, 15 nt, Human
uauuguaaacaugug

SEQ ID NO: 3539114 - RNA, 17 nt, Human
uauuguaaacauguguu

SEQ ID NO: 3539115 - RNA, 17 nt, Human
uauuguaaauuuuagaa

SEQ ID NO: 3539116 - RNA, 11 nt, Human
uauuguaagaa

SEQ ID NO: 3539117 - RNA, 23 nt, Human
uauuguaauauagaaaaaaacau

SEQ ID NO: 3539118 - RNA, 18 nt, Human
uauuguaaugagugaauu

SEQ ID NO: 3539119 - RNA, 21 nt, Human
uauuguacaaaguauuaagca

SEQ ID NO: 3539120 - RNA, 13 nt, Human
uauuguacacuuu

SEQ ID NO: 3539121 - RNA, 11 nt, Human
uauuguacaga

SEQ ID NO: 3539122 - RNA, 14 nt, Human
uauuguacaguuuu

SEQ ID NO: 3539123 - RNA, 15 nt, Human
uauuguacaguuuuu

SEQ ID NO: 3539124 - RNA, 13 nt, Human
uauuguaccuuuu

SEQ ID NO: 3539125 - RNA, 17 nt, Human
uauuguaccuuuuaaca

SEQ ID NO: 3539126 - RNA, 17 nt, Human
uauuguagcauccugga

SEQ ID NO: 3539127 - RNA, 16 nt, Human
uauuguagcauuucuu

SEQ ID NO: 3539128 - RNA, 21 nt, Human
uauuguauaaacuaucaguuu

SEQ ID NO: 3539129 - RNA, 17 nt, Human
uauuguauauuacaaug

SEQ ID NO: 3539130 - RNA, 19 nt, Human
uauuguauauuacaaugau

SEQ ID NO: 3539131 - RNA, 22 nt, Human
uauuguaucaaucuuuagaaaa

SEQ ID NO: 3539132 - RNA, 10 nt, Human
uauuguauuu

SEQ ID NO: 3539133 - RNA, 18 nt, Human
uauuguauuuauucaaua

SEQ ID NO: 3539134 - RNA, 16 nt, Human
uauugucagauauuuu

SEQ ID NO: 3539135 - RNA, 17 nt, Human
uauugucauuaaaggua

SEQ ID NO: 3539136 - RNA, 21 nt, Human
uauugucccuggcuuccuuac

SEQ ID NO: 3539137 - RNA, 22 nt, Human
uauugucccuggcuuccuuacu

SEQ ID NO: 3539138 - RNA, 22 nt, Human
uauuguccuauuaguguuauau

SEQ ID NO: 3539139 - RNA, 17 nt, Human
uauugucuagugaaacu

SEQ ID NO: 3539140 - RNA, 16 nt, Human
uauugucuguaaaucu

SEQ ID NO: 3539141 - RNA, 22 nt, Human
uauugucuguaaaucuaacauu

SEQ ID NO: 3539142 - RNA, 14 nt, Human
uauugucuuuuugu

SEQ ID NO: 3539143 - RNA, 17 nt, Human
uauugugaaguacauau

SEQ ID NO: 3539144 - RNA, 13 nt, Human
uauugugaaugau

SEQ ID NO: 3539145 - RNA, 21 nt, Human
uauugugaucuaucaauaguc

SEQ ID NO: 3539146 - RNA, 19 nt, Human
uauugugcgcuaaacuuuu

SEQ ID NO: 3539147 - RNA, 22 nt, Human
uauugugcgcuaaacuuuucug

SEQ ID NO: 3539148 - RNA, 23 nt, Human
uauugugcgcuaaacuuuucuga

SEQ ID NO: 3539149 - RNA, 23 nt, Human
uauugugguauugaauauugugu

SEQ ID NO: 3539150 - RNA, 19 nt, Human
uauugugucuuuugcauga

SEQ ID NO: 3539151 - RNA, 17 nt, Human
uauuguguguuauuuaa

SEQ ID NO: 3539152 - RNA, 14 nt, Human
uauuguguugugaa

SEQ ID NO: 3539153 - RNA, 17 nt, Human
uauuguguuugucauua

SEQ ID NO: 3539154 - RNA, 16 nt, Human
uauuguuaauacaagg

SEQ ID NO: 3539155 - RNA, 14 nt, Human
uauuguuagauguu

SEQ ID NO: 3539156 - RNA, 14 nt, Human
uauuguucaaacaa

SEQ ID NO: 3539157 - RNA, 18 nt, Human
uauuguuccaagacauug

SEQ ID NO: 3539158 - RNA, 17 nt, Human
uauuguuccagcaguuu

SEQ ID NO: 3539159 - RNA, 15 nt, Human
uauuguucucacacu

SEQ ID NO: 3539160 - RNA, 19 nt, Human
uauuguugacaacugugac

SEQ ID NO: 3539161 - RNA, 23 nt, Human
uauuguugacaacugugacugua

SEQ ID NO: 3539162 - RNA, 17 nt, Human
uauuguugcauugcuuu

SEQ ID NO: 3539163 - RNA, 13 nt, Human
uauuguugguaau

SEQ ID NO: 3539164 - RNA, 20 nt, Human
uauuguuuaaaaucauuucu

SEQ ID NO: 3539165 - RNA, 17 nt, Human
uauuguuuaaaauguaa

SEQ ID NO: 3539166 - RNA, 12 nt, Human
uauuguuucaau

SEQ ID NO: 3539167 - RNA, 18 nt, Human
uauuguuucaauugcauc

SEQ ID NO: 3539168 - RNA, 16 nt, Human
uauuguuucucugaaa

SEQ ID NO: 3539169 - RNA, 15 nt, Human
ucagcuacuaaugau

SEQ ID NO: 3539170 - RNA, 19 nt, Human
ucagcuacugauuuuugug

SEQ ID NO: 3539171 - RNA, 23 nt, Human
ucagcuaggaacaaaucuuccug

SEQ ID NO: 3539172 - RNA, 23 nt, Human
ucagcuauuuaaaaaaaaaagag

SEQ ID NO: 3539173 - RNA, 19 nt, Human
ucagcuauuuacugccaaa

SEQ ID NO: 3539174 - RNA, 13 nt, Human
ucagcucacugca

SEQ ID NO: 3539175 - RNA, 15 nt, Human
ucagcucauccaugc

SEQ ID NO: 3539176 - RNA, 12 nt, Human
ucagcucaugga

SEQ ID NO: 3539177 - RNA, 13 nt, Human
ucagcuccagccc

SEQ ID NO: 3539178 - RNA, 23 nt, Human
ucagcuccagcucaccagcccca

SEQ ID NO: 3539179 - RNA, 24 nt, Human
ucagcuccagcucaccagccccag

SEQ ID NO: 3539180 - RNA, 23 nt, Human
ucagcuccagggaauccaagccu

SEQ ID NO: 3539181 - RNA, 20 nt, Human
ucagcucccacaagccucug

SEQ ID NO: 3539182 - RNA, 15 nt, Human
ucagcuccccagagu

SEQ ID NO: 3539183 - RNA, 17 nt, Human
ucagcuccccagagucc

SEQ ID NO: 3539184 - RNA, 13 nt, Human
ucagcucccccug

SEQ ID NO: 3539185 - RNA, 23 nt, Human
ucagcucccccuguccccucagc

SEQ ID NO: 3539186 - RNA, 17 nt, Human
ucagcuccccucggaga

SEQ ID NO: 3539187 - RNA, 21 nt, Human
ucagcuccccucggagaagag

SEQ ID NO: 3539188 - RNA, 12 nt, Human
ucagcuccugac

SEQ ID NO: 3539189 - RNA, 17 nt, Human
ucagcuccugaccaguu

SEQ ID NO: 3539190 - RNA, 18 nt, Human
ucagcuccugaccaguug

SEQ ID NO: 3539191 - RNA, 14 nt, Human
ucagcuccuuccug

SEQ ID NO: 3539192 - RNA, 16 nt, Human
ucagcuccuuccugga

SEQ ID NO: 3539193 - RNA, 13 nt, Human
ucagcucggcuca

SEQ ID NO: 3539194 - RNA, 19 nt, Human
ucagcucucaguugcagcc

SEQ ID NO: 3539195 - RNA, 20 nt, Human
ucagcucucugcccugugua

SEQ ID NO: 3539196 - RNA, 15 nt, Human
ucagcucucuguaua

SEQ ID NO: 3539197 - RNA, 20 nt, Human
ucagcucucuguauaaacau

SEQ ID NO: 3539198 - RNA, 21 nt, Human
ucagcucugaaagagaaacac

SEQ ID NO: 3539199 - RNA, 20 nt, Human
ucagcucuggcucacagacu

SEQ ID NO: 3539200 - RNA, 12 nt, Human
ucagcucuggga

SEQ ID NO: 3539201 - RNA, 16 nt, Human
ucagcucugggagagg

SEQ ID NO: 3539202 - RNA, 19 nt, Human
ucagcucugggccauucuc

SEQ ID NO: 3539203 - RNA, 16 nt, Human
ucagcugaaccugggu

SEQ ID NO: 3539204 - RNA, 21 nt, Human
ucagcugaaugccuccugugg

SEQ ID NO: 3539205 - RNA, 23 nt, Human
ucagcugaaugccuccugugggg

SEQ ID NO: 3539206 - RNA, 21 nt, Human
ucagcugagccuucugagcug

SEQ ID NO: 3539207 - RNA, 18 nt, Human
ucagcugcauuccgcagc

SEQ ID NO: 3539208 - RNA, 20 nt, Human
ucagcugcauuccgcagccc

SEQ ID NO: 3539209 - RNA, 16 nt, Human
ucagcugccccacagg

SEQ ID NO: 3539210 - RNA, 12 nt, Human
ucagcugccuca

SEQ ID NO: 3539211 - RNA, 24 nt, Human
ucagcugccucacuuccuacaaga

SEQ ID NO: 3539212 - RNA, 12 nt, Human
ucagcugcucag

SEQ ID NO: 3539213 - RNA, 15 nt, Human
ucagcugcuuuguua

SEQ ID NO: 3539214 - RNA, 16 nt, Human
ucagcugcuuuguuac

SEQ ID NO: 3539215 - RNA, 21 nt, Human
ucagcuggcacugucucugcu

SEQ ID NO: 3539216 - RNA, 20 nt, Human
ucagcuguaagaagagacug

SEQ ID NO: 3539217 - RNA, 17 nt, Human
ucagcuguacuucgucu

SEQ ID NO: 3539218 - RNA, 19 nt, Human
ucagcuguccugcagcaaa

SEQ ID NO: 3539219 - RNA, 13 nt, Human
ucagcugucuuuu

SEQ ID NO: 3539220 - RNA, 19 nt, Human
ucagcugucuuuuggagga

SEQ ID NO: 3539221 - RNA, 21 nt, Human
ucagcuuaaaauaaacaguug

SEQ ID NO: 3539222 - RNA, 13 nt, Human
ucagcuuaucucu

SEQ ID NO: 3539223 - RNA, 19 nt, Human
ucagcuuaucucuuuuaua

SEQ ID NO: 3539224 - RNA, 16 nt, Human
ucagcuucauuugugu

SEQ ID NO: 3539225 - RNA, 13 nt, Human
ucagcuuccccag

SEQ ID NO: 3539226 - RNA, 17 nt, Human
ucagcuuccccaguagc

SEQ ID NO: 3539227 - RNA, 15 nt, Human
ucagcuucugcuggg

SEQ ID NO: 3539228 - RNA, 17 nt, Human
ucagcuucugcugggcu

SEQ ID NO: 3539229 - RNA, 18 nt, Human
ucagcuucugcugggcug

SEQ ID NO: 3539230 - RNA, 21 nt, Human
ucagcuucugcugggcugggg

SEQ ID NO: 3539231 - RNA, 14 nt, Human
ucagcuucuuaaua

SEQ ID NO: 3539232 - RNA, 14 nt, Human
ucagcuucuucauc

SEQ ID NO: 3539233 - RNA, 16 nt, Human
ucagcuugugcacaau

SEQ ID NO: 3539234 - RNA, 22 nt, Human
ucagcuuugagaagccuucagc

SEQ ID NO: 3539235 - RNA, 20 nt, Human
ucagcuuuuugucuuuucug

SEQ ID NO: 3539236 - RNA, 16 nt, Human
ucaggaaaaggccugg

SEQ ID NO: 3539237 - RNA, 18 nt, Human
ucaggaaaaggccugggg

SEQ ID NO: 3539238 - RNA, 15 nt, Human
ucaggaaaagguuga

SEQ ID NO: 3539239 - RNA, 21 nt, Human
ucaggaaacgagacuuuccau

SEQ ID NO: 3539240 - RNA, 12 nt, Human
ucaggaaagaau

SEQ ID NO: 3539241 - RNA, 14 nt, Human
ucaggaaagaauag

SEQ ID NO: 3539242 - RNA, 13 nt, Human
ucaggaaagagaa

SEQ ID NO: 3539243 - RNA, 22 nt, Human
ucaggaaaggaaucauuucuau

SEQ ID NO: 3539244 - RNA, 19 nt, Human
ucaggaaauauauaugugu

SEQ ID NO: 3539245 - RNA, 21 nt, Human
ucaggaaaucaaauaugcaaa

SEQ ID NO: 3539246 - RNA, 22 nt, Human
ucaggaaaucaaauaugcaaag

SEQ ID NO: 3539247 - RNA, 18 nt, Human
ucaggaacagcuauggga

SEQ ID NO: 3539248 - RNA, 19 nt, Human
ucaggaaccucgaguacug

SEQ ID NO: 3539249 - RNA, 22 nt, Human
ucaggaaccuggaccaaagcug

SEQ ID NO: 3539250 - RNA, 23 nt, Human
ucaggaaccuggaccaaagcuga

SEQ ID NO: 3539251 - RNA, 22 nt, Human
ucaggaacguuuagcugacaaa

SEQ ID NO: 3539252 - RNA, 23 nt, Human
ucaggaagaaaggagucugcaca

SEQ ID NO: 3539253 - RNA, 15 nt, Human
ucaggaagaaaucac

SEQ ID NO: 3539254 - RNA, 22 nt, Human
ucaggaagaaaucacagaauca

SEQ ID NO: 3539255 - RNA, 22 nt, Human
ucaggaagaacacccucuaaau

SEQ ID NO: 3539256 - RNA, 15 nt, Human
ucaggaagagaagga

SEQ ID NO: 3539257 - RNA, 20 nt, Human
ucaggaagaugaaagaggag

SEQ ID NO: 3539258 - RNA, 13 nt, Human
ucaggaagcucag

SEQ ID NO: 3539259 - RNA, 17 nt, Human
ucaggaauauuuuccaa

SEQ ID NO: 3539260 - RNA, 16 nt, Human
ucaggaauucuuggag

SEQ ID NO: 3539261 - RNA, 15 nt, Human
ucaggacacaggccu

SEQ ID NO: 3539262 - RNA, 18 nt, Human
ucaggacacaggccugug

SEQ ID NO: 3539263 - RNA, 13 nt, Human
ucaggacacuaau

SEQ ID NO: 3539264 - RNA, 15 nt, Human
ucaggacccagagga

SEQ ID NO: 3539265 - RNA, 18 nt, Human
ucaggacccucgcuggcc

SEQ ID NO: 3539266 - RNA, 20 nt, Human
ucaggacccucgcuggcccc

SEQ ID NO: 3539267 - RNA, 21 nt, Human
ucaggacccucgcuggccccc

SEQ ID NO: 3539268 - RNA, 18 nt, Human
ucaggaccuccaagccac

SEQ ID NO: 3539269 - RNA, 18 nt, Human
ucaggacuccagcccauu

SEQ ID NO: 3539270 - RNA, 14 nt, Human
ucaggacuccucuc

SEQ ID NO: 3539271 - RNA, 13 nt, Human
ucaggacugggag

SEQ ID NO: 3539272 - RNA, 14 nt, Human
gcgcuucccagcac

SEQ ID NO: 3539273 - RNA, 15 nt, Human
gcgcuuucuggaaaa

SEQ ID NO: 3539274 - RNA, 22 nt, Human
gcgcuuucuggaaaagaggagu

SEQ ID NO: 3539275 - RNA, 15 nt, Human
gcggacagccacggc

SEQ ID NO: 3539276 - RNA, 19 nt, Human
gcggacagccacggccagg

SEQ ID NO: 3539277 - RNA, 19 nt, Human
gcggacaguggcaggacag

SEQ ID NO: 3539278 - RNA, 13 nt, Human
gcggaccccagcu

SEQ ID NO: 3539279 - RNA, 14 nt, Human
gcggacguuccagc

SEQ ID NO: 3539280 - RNA, 15 nt, Human
gcggacguuccagcc

SEQ ID NO: 3539281 - RNA, 19 nt, Human
gcggacuccuccuuucucc

SEQ ID NO: 3539282 - RNA, 18 nt, Human
gcggagaaccuugugccu

SEQ ID NO: 3539283 - RNA, 17 nt, Human
gcggagcaagaggaggc

SEQ ID NO: 3539284 - RNA, 17 nt, Human
gcggagcacacuggcuc

SEQ ID NO: 3539285 - RNA, 14 nt, Human
gcggagugaagagg

SEQ ID NO: 3539286 - RNA, 20 nt, Human
gcggaucucuggagugagcu

SEQ ID NO: 3539287 - RNA, 16 nt, Human
gcggcaaaaggaaagc

SEQ ID NO: 3539288 - RNA, 17 nt, Human
gcggccagccccggccc

SEQ ID NO: 3539289 - RNA, 19 nt, Human
gcggccagccccggcccug

SEQ ID NO: 3539290 - RNA, 21 nt, Human
gcggccagccccggcccuggg

SEQ ID NO: 3539291 - RNA, 22 nt, Human
gcggcccaauccaagguggggu

SEQ ID NO: 3539292 - RNA, 15 nt, Human
gcggcccagcccggc

SEQ ID NO: 3539293 - RNA, 20 nt, Human
gcggccccaacucgggcucc

SEQ ID NO: 3539294 - RNA, 17 nt, Human
gcggccccggccggggu

SEQ ID NO: 3539295 - RNA, 14 nt, Human
gcggccccucccac

SEQ ID NO: 3539296 - RNA, 15 nt, Human
gcggccccucccaca

SEQ ID NO: 3539297 - RNA, 17 nt, Human
gcggccgcauucccuga

SEQ ID NO: 3539298 - RNA, 18 nt, Human
gcggccuaugacuugggc

SEQ ID NO: 3539299 - RNA, 15 nt, Human
gcggccucuucucuc

SEQ ID NO: 3539300 - RNA, 13 nt, Human
gcggccuggcgcu

SEQ ID NO: 3539301 - RNA, 16 nt, Human
gcggcggagcuggccc

SEQ ID NO: 3539302 - RNA, 18 nt, Human
gcggcggagcuggccccg

SEQ ID NO: 3539303 - RNA, 17 nt, Human
gcggcguacaggcuggc

SEQ ID NO: 3539304 - RNA, 15 nt, Human
gcggcucccggggca

SEQ ID NO: 3539305 - RNA, 23 nt, Human
gcggcugagagccccagcugaca

SEQ ID NO: 3539306 - RNA, 22 nt, Human
gcggcugagucaugaucucccu

SEQ ID NO: 3539307 - RNA, 17 nt, Human
gcggcugcugugugccu

SEQ ID NO: 3539308 - RNA, 16 nt, Human
gcggcuggacuuggag

SEQ ID NO: 3539309 - RNA, 19 nt, Human
gcggcuggccauggagaaa

SEQ ID NO: 3539310 - RNA, 14 nt, Human
gcggcugggaggag

SEQ ID NO: 3539311 - RNA, 17 nt, Human
gcggcugggaggagggc

SEQ ID NO: 3539312 - RNA, 22 nt, Human
gcggcugggaggagggcaggca

SEQ ID NO: 3539313 - RNA, 13 nt, Human
gcuaaaauguuuu

SEQ ID NO: 3539314 - RNA, 15 nt, Human
gcuaaaauguuuuca

SEQ ID NO: 3539315 - RNA, 16 nt, Human
gcuaaaauguuuucag

SEQ ID NO: 3539316 - RNA, 22 nt, Human
gcuaaacguguauguuuuucag

SEQ ID NO: 3539317 - RNA, 20 nt, Human
gcuaaagaaguuugaacauu

SEQ ID NO: 3539318 - RNA, 19 nt, Human
gcuaaauaaaauuuguugc

SEQ ID NO: 3539319 - RNA, 17 nt, Human
gcuaaauauauauuuua

SEQ ID NO: 3539320 - RNA, 18 nt, Human
gcuaaauuacaauuguca

SEQ ID NO: 3539321 - RNA, 22 nt, Human
gcuaaauuacucaggaagaaca

SEQ ID NO: 3539322 - RNA, 21 nt, Human
gcuaaauugauguugaugcaa

SEQ ID NO: 3539323 - RNA, 23 nt, Human
gcuaaauugauguugaugcaauc

SEQ ID NO: 3539324 - RNA, 13 nt, Human
gcuaaauuuucug

SEQ ID NO: 3539325 - RNA, 14 nt, Human
gcuaacaaagacaa

SEQ ID NO: 3539326 - RNA, 20 nt, Human
gcuaacacacagcucccaua

SEQ ID NO: 3539327 - RNA, 22 nt, Human
gcuaacagggaaggcaggcagg

SEQ ID NO: 3539328 - RNA, 19 nt, Human
gcuaacaguucacuugcag

SEQ ID NO: 3539329 - RNA, 22 nt, Human
gcuaacaugaagaccuuuuucu

SEQ ID NO: 3539330 - RNA, 18 nt, Human
gcuaacauggaaguacua

SEQ ID NO: 3539331 - RNA, 13 nt, Human
gcuaacauuuuaa

SEQ ID NO: 3539332 - RNA, 17 nt, Human
gcuaacauuuuaaauaa

SEQ ID NO: 3539333 - RNA, 21 nt, Human
gcuaacccccuucuacugagc

SEQ ID NO: 3539334 - RNA, 21 nt, Human
gcuaaccuuauccugcauugu

SEQ ID NO: 3539335 - RNA, 11 nt, Human
gcuaacugaac

SEQ ID NO: 3539336 - RNA, 13 nt, Human
gcuaacuguaaau

SEQ ID NO: 3539337 - RNA, 18 nt, Human
gcuaacuuggagccccag

SEQ ID NO: 3539338 - RNA, 14 nt, Human
gcuaacuuggguua

SEQ ID NO: 3539339 - RNA, 17 nt, Human
gcuaagaaccuggaacu

SEQ ID NO: 3539340 - RNA, 16 nt, Human
gcuaagaauauuugaa

SEQ ID NO: 3539341 - RNA, 22 nt, Human
gcuaagaauuuuuuauuuuuug

SEQ ID NO: 3539342 - RNA, 13 nt, Human
gcuaagagaagua

SEQ ID NO: 3539343 - RNA, 20 nt, Human
gcuaagagggagggagggcu

SEQ ID NO: 3539344 - RNA, 22 nt, Human
gcuaagagggagggagggcucc

SEQ ID NO: 3539345 - RNA, 18 nt, Human
gcuaagauuaucugggga

SEQ ID NO: 3539346 - RNA, 20 nt, Human
gcuaagcucacguccugaga

SEQ ID NO: 3539347 - RNA, 16 nt, Human
gcuaaggacaggcagg

SEQ ID NO: 3539348 - RNA, 17 nt, Human
gcuaaggacauuuccca

SEQ ID NO: 3539349 - RNA, 12 nt, Human
gcuaaggacuug

SEQ ID NO: 3539350 - RNA, 16 nt, Human
gcuaaggcguggagcu

SEQ ID NO: 3539351 - RNA, 22 nt, Human
gcuaaggcguggagcugccuga

SEQ ID NO: 3539352 - RNA, 23 nt, Human
gcuaagggaagacauuucuuuuc

SEQ ID NO: 3539353 - RNA, 16 nt, Human
gcuaagggguggggcu

SEQ ID NO: 3539354 - RNA, 16 nt, Human
gcuaagguucuaaggc

SEQ ID NO: 3539355 - RNA, 18 nt, Human
gcuaaguaaaucucuucu

SEQ ID NO: 3539356 - RNA, 21 nt, Human
gcuaaguacacaauaagcaaa

SEQ ID NO: 3539357 - RNA, 22 nt, Human
gcuaaguacacaauaagcaaaa

SEQ ID NO: 3539358 - RNA, 17 nt, Human
gcuaaguauuucccagc

SEQ ID NO: 3539359 - RNA, 13 nt, Human
gcuaagugaaaag

SEQ ID NO: 3539360 - RNA, 17 nt, Human
gcuaaguugggaucuag

SEQ ID NO: 3539361 - RNA, 23 nt, Human
gcuaauaaaauaucauucagcaa

SEQ ID NO: 3539362 - RNA, 18 nt, Human
gcuaauaaugagcuauua

SEQ ID NO: 3539363 - RNA, 14 nt, Human
gcuaauauuaaaag

SEQ ID NO: 3539364 - RNA, 18 nt, Human
gcuaaucaaagccagggu

SEQ ID NO: 3539365 - RNA, 14 nt, Human
gcuaaucagcauuc

SEQ ID NO: 3539366 - RNA, 17 nt, Human
gcuaaucagcauucuca

SEQ ID NO: 3539367 - RNA, 15 nt, Human
gcuaaucagugucuc

SEQ ID NO: 3539368 - RNA, 16 nt, Human
gcuaaucagugucuca

SEQ ID NO: 3539369 - RNA, 18 nt, Human
gcuaaucagugucucaca

SEQ ID NO: 3539370 - RNA, 14 nt, Human
gcuaauuaaaaagu

SEQ ID NO: 3539371 - RNA, 20 nt, Human
gcuaauucucagaaaggcaa

SEQ ID NO: 3539372 - RNA, 14 nt, Human
gcuaauucuuugca

SEQ ID NO: 3539373 - RNA, 17 nt, Human
gcuaauucuuugcaaaa

SEQ ID NO: 3539374 - RNA, 20 nt, Human
gcuaauugcuguugaaagca

SEQ ID NO: 3539375 - RNA, 22 nt, Human
gcuaauugcuguugaaagcaaa

SEQ ID NO: 3539376 - RNA, 16 nt, Human
gcuaauuuaaagagac

SEQ ID NO: 3539377 - RNA, 13 nt, Human
gcuaauuugcauu

SEQ ID NO: 3539378 - RNA, 15 nt, Human
gcuaauuugcauuaa

SEQ ID NO: 3539379 - RNA, 22 nt, Human
gcuaauuuucucaaaagcauuu

SEQ ID NO: 3539380 - RNA, 19 nt, Human
gcuacaaaaacacagcaag

SEQ ID NO: 3539381 - RNA, 18 nt, Human
gcuacaaaacgcgcagau

SEQ ID NO: 3539382 - RNA, 18 nt, Human
gcuacaaagaagacaugu

SEQ ID NO: 3539383 - RNA, 19 nt, Human
gcuacaaagaagacauguu

SEQ ID NO: 3539384 - RNA, 22 nt, Human
gcuacaaagaagacauguuuua

SEQ ID NO: 3539385 - RNA, 20 nt, Human
gcuacaaauacucuuaggaa

SEQ ID NO: 3539386 - RNA, 21 nt, Human
gcuacaauuuucucccaggaa

SEQ ID NO: 3539387 - RNA, 20 nt, Human
gcuacacacugcauguuugu

SEQ ID NO: 3539388 - RNA, 14 nt, Human
gcuacacaggggaa

SEQ ID NO: 3539389 - RNA, 16 nt, Human
gcuacaccacucuggc

SEQ ID NO: 3539390 - RNA, 17 nt, Human
gcuacaccacucuggca

SEQ ID NO: 3539391 - RNA, 21 nt, Human
gcuacaccacucuggcagcca

SEQ ID NO: 3539392 - RNA, 22 nt, Human
gcuacaccacucuggcagccac

SEQ ID NO: 3539393 - RNA, 16 nt, Human
gcuacagaagaaacug

SEQ ID NO: 3539394 - RNA, 11 nt, Human
gcuacagagaa

SEQ ID NO: 3539395 - RNA, 21 nt, Human
gcuacagagaaaccagcuucc

SEQ ID NO: 3539396 - RNA, 12 nt, Human
gcuacagagaag

SEQ ID NO: 3539397 - RNA, 19 nt, Human
gcuacagcaauuucuaauu

SEQ ID NO: 3539398 - RNA, 19 nt, Human
gcuacagcuuucuugcucc

SEQ ID NO: 3539399 - RNA, 19 nt, Human
gcuacaggaagcaccccau

SEQ ID NO: 3539400 - RNA, 20 nt, Human
gcuacaggaagcaccccaug

SEQ ID NO: 3539401 - RNA, 12 nt, Human
gcuacagguuac

SEQ ID NO: 3539402 - RNA, 16 nt, Human
gcuacagguuacaaca

SEQ ID NO: 3539403 - RNA, 15 nt, Human
gcuacaguaauaaau

SEQ ID NO: 3539404 - RNA, 20 nt, Human
gcuacaguuuugugaaucuu

SEQ ID NO: 3539405 - RNA, 13 nt, Human
gcuacauaaauug

SEQ ID NO: 3539406 - RNA, 15 nt, Human
gcuacauuauaaacg

SEQ ID NO: 3539407 - RNA, 21 nt, Human
gcuacauuuccgccacauccc

SEQ ID NO: 3539408 - RNA, 14 nt, Human
gcuaccaaaacagu

SEQ ID NO: 3539409 - RNA, 20 nt, Human
gcuaccaaagcaccuuagcu

SEQ ID NO: 3539410 - RNA, 21 nt, Human
gcuaccaacuuguauccaggc

SEQ ID NO: 3539411 - RNA, 12 nt, Human
gcuaccaccagc

SEQ ID NO: 3539412 - RNA, 13 nt, Human
gcuaccaccagcu

SEQ ID NO: 3539413 - RNA, 13 nt, Human
gcuaccaguauuu

SEQ ID NO: 3539414 - RNA, 15 nt, Human
gcuacccaaaagaga

SEQ ID NO: 3539415 - RNA, 16 nt, Human
gcuacccaaaagagaa

SEQ ID NO: 3539416 - RNA, 23 nt, Human
gcuacccaaaagagaaaaaaaau

SEQ ID NO: 3539417 - RNA, 17 nt, Human
gcuacccacuucuaaau

SEQ ID NO: 3539418 - RNA, 22 nt, Human
gcuacccgcagaguucucagaa

SEQ ID NO: 3539419 - RNA, 16 nt, Human
gcuacccgugagcccu

SEQ ID NO: 3539420 - RNA, 16 nt, Human
gcuacccucccugcug

SEQ ID NO: 3539421 - RNA, 23 nt, Human
gcuacccucccugcuguccccuc

SEQ ID NO: 3539422 - RNA, 12 nt, Human
gcuacccugagc

SEQ ID NO: 3539423 - RNA, 16 nt, Human
gcuacccugagcugag

SEQ ID NO: 3539424 - RNA, 20 nt, Human
gcuacccugagcugaggcag

SEQ ID NO: 3539425 - RNA, 14 nt, Human
gcuacccuuuuccu

SEQ ID NO: 3539426 - RNA, 22 nt, Human
gcuacccuuuuucuccagcugg

SEQ ID NO: 3539427 - RNA, 14 nt, Human
gcuaccucucuguc

SEQ ID NO: 3539428 - RNA, 16 nt, Human
gcuaccucucuguccc

SEQ ID NO: 3539429 - RNA, 18 nt, Human
gcuaccugaucccacucc

SEQ ID NO: 3539430 - RNA, 19 nt, Human
gcuaccugcucagcccugc

SEQ ID NO: 3539431 - RNA, 20 nt, Human
gcuaccugcucagcccugca

SEQ ID NO: 3539432 - RNA, 14 nt, Human
ucaggacugggagc

SEQ ID NO: 3539433 - RNA, 21 nt, Human
ucaggacugggagcccccagc

SEQ ID NO: 3539434 - RNA, 23 nt, Human
ucaggacugggagcccccagccu

SEQ ID NO: 3539435 - RNA, 20 nt, Human
ucaggacuuaacggcuccag

SEQ ID NO: 3539436 - RNA, 12 nt, Human
ucaggagaaaaa

SEQ ID NO: 3539437 - RNA, 18 nt, Human
ucaggagaauuagauuuc

SEQ ID NO: 3539438 - RNA, 18 nt, Human
ucaggagaggggcagaac

SEQ ID NO: 3539439 - RNA, 22 nt, Human
ucaggagaucgagaccauccug

SEQ ID NO: 3539440 - RNA, 15 nt, Human
ucaggagcccuggga

SEQ ID NO: 3539441 - RNA, 18 nt, Human
ucaggagcccugggaggc

SEQ ID NO: 3539442 - RNA, 23 nt, Human
ucaggaggaaggcuuacacccac

SEQ ID NO: 3539443 - RNA, 14 nt, Human
ucaggaggcgcccu

SEQ ID NO: 3539444 - RNA, 18 nt, Human
ucaggaggcugaggcaga

SEQ ID NO: 3539445 - RNA, 21 nt, Human
ucaggaggcuggaggaagggg

SEQ ID NO: 3539446 - RNA, 16 nt, Human
ucaggaguguguguga

SEQ ID NO: 3539447 - RNA, 21 nt, Human
ucaggaguuacuggauuuguu

SEQ ID NO: 3539448 - RNA, 19 nt, Human
ucaggaguuagaggccagc

SEQ ID NO: 3539449 - RNA, 22 nt, Human
ucaggaguuagaggccagccug

SEQ ID NO: 3539450 - RNA, 14 nt, Human
ucaggauacaugug

SEQ ID NO: 3539451 - RNA, 15 nt, Human
ucaggauacaugugc

SEQ ID NO: 3539452 - RNA, 20 nt, Human
ucaggauacucugucagaug

SEQ ID NO: 3539453 - RNA, 23 nt, Human
ucaggauauccuuaucagagcua

SEQ ID NO: 3539454 - RNA, 20 nt, Human
ucaggaucaaaccccgacca

SEQ ID NO: 3539455 - RNA, 23 nt, Human
ucaggaucucuuagcauuuuaau

SEQ ID NO: 3539456 - RNA, 15 nt, Human
ucaggaugaacccag

SEQ ID NO: 3539457 - RNA, 20 nt, Human
ucaugucuauuguccaaagu

SEQ ID NO: 3539458 - RNA, 14 nt, Human
ucaugugaaaucau

SEQ ID NO: 3539459 - RNA, 17 nt, Human
ucaugugaaaucauuca

SEQ ID NO: 3539460 - RNA, 18 nt, Human
ucauguggaauauaaaga

SEQ ID NO: 3539461 - RNA, 16 nt, Human
ucauguggcuggaaga

SEQ ID NO: 3539462 - RNA, 19 nt, Human
ucaugugguuucuaugcaa

SEQ ID NO: 3539463 - RNA, 21 nt, Human
ucauguguaaucaauaaacga

SEQ ID NO: 3539464 - RNA, 13 nt, Human
ucaugugucccag

SEQ ID NO: 3539465 - RNA, 14 nt, Human
ucaugugucccaga

SEQ ID NO: 3539466 - RNA, 17 nt, Human
ucaugugucccagaaga

SEQ ID NO: 3539467 - RNA, 18 nt, Human
ucaugugucccagaagau

SEQ ID NO: 3539468 - RNA, 22 nt, Human
ucaugugucccagaagaugacu

SEQ ID NO: 3539469 - RNA, 14 nt, Human
ucaugugugcucuu

SEQ ID NO: 3539470 - RNA, 21 nt, Human
ucauguuaaccucugcuuuua

SEQ ID NO: 3539471 - RNA, 22 nt, Human
ucauguuaauccuagcugugug

SEQ ID NO: 3539472 - RNA, 18 nt, Human
ucauguuaauugauagaa

SEQ ID NO: 3539473 - RNA, 17 nt, Human
ucauguuaguaauaccu

SEQ ID NO: 3539474 - RNA, 18 nt, Human
ucauguuaguaauaccuc

SEQ ID NO: 3539475 - RNA, 22 nt, Human
ucauguucaauuauuuccccca

SEQ ID NO: 3539476 - RNA, 21 nt, Human
ucauguuccuucaagaucaug

SEQ ID NO: 3539477 - RNA, 11 nt, Human
ucauguucuua

SEQ ID NO: 3539478 - RNA, 17 nt, Human
ucauguucuuaauucuu

SEQ ID NO: 3539479 - RNA, 17 nt, Human
ucauguugaagccacug

SEQ ID NO: 3539480 - RNA, 21 nt, Human
ucauguugaucauguacuuuu

SEQ ID NO: 3539481 - RNA, 17 nt, Human
ucauguuggccaggcug

SEQ ID NO: 3539482 - RNA, 15 nt, Human
ucauguuuauaacua

SEQ ID NO: 3539483 - RNA, 17 nt, Human
ucauguuuaugaaaaua

SEQ ID NO: 3539484 - RNA, 15 nt, Human
ucauguuucuuaaau

SEQ ID NO: 3539485 - RNA, 14 nt, Human
ucauguuucuuuga

SEQ ID NO: 3539486 - RNA, 15 nt, Human
ucauguuugcuucau

SEQ ID NO: 3539487 - RNA, 17 nt, Human
ucauguuugcuucauaa

SEQ ID NO: 3539488 - RNA, 20 nt, Human
ucaccguggaccuuccugcc

SEQ ID NO: 3539489 - RNA, 13 nt, Human
ucaccgugggcuc

SEQ ID NO: 3539490 - RNA, 15 nt, Human
ucaccgugggcuccc

SEQ ID NO: 3539491 - RNA, 18 nt, Human
ucaccgugggcucccuga

SEQ ID NO: 3539492 - RNA, 22 nt, Human
ucaccuaacucauacugugcug

SEQ ID NO: 3539493 - RNA, 17 nt, Human
ucaccuaagucucugug

SEQ ID NO: 3539494 - RNA, 16 nt, Human
ucaccuaauuaauuuc

SEQ ID NO: 3539495 - RNA, 15 nt, Human
ucaccuacuuuguaa

SEQ ID NO: 3539496 - RNA, 15 nt, Human
ucaccuagaaauuga

SEQ ID NO: 3539497 - RNA, 14 nt, Human
ucaccuagagccag

SEQ ID NO: 3539498 - RNA, 16 nt, Human
ucaccuagcugaaugu

SEQ ID NO: 3539499 - RNA, 22 nt, Human
ucaccuagcugaauguuuuucu

SEQ ID NO: 3539500 - RNA, 23 nt, Human
ucaccuagcugaauguuuuucua

SEQ ID NO: 3539501 - RNA, 19 nt, Human
ucaccuaggaagccucaga

SEQ ID NO: 3539502 - RNA, 20 nt, Human
ucaccucacucagcaccacu

SEQ ID NO: 3539503 - RNA, 16 nt, Human
ucaccucagauggcag

SEQ ID NO: 3539504 - RNA, 22 nt, Human
ucaccucagauggcagcuuuua

SEQ ID NO: 3539505 - RNA, 18 nt, Human
ucaccucaggccaggugc

SEQ ID NO: 3539506 - RNA, 13 nt, Human
ucaccucaugccc

SEQ ID NO: 3539507 - RNA, 20 nt, Human
ucaccucaugcccacccccu

SEQ ID NO: 3539508 - RNA, 12 nt, Human
ucaccucaugga

SEQ ID NO: 3539509 - RNA, 13 nt, Human
ucaccucccccau

SEQ ID NO: 3539510 - RNA, 15 nt, Human
ucaccucccccaucu

SEQ ID NO: 3539511 - RNA, 23 nt, Human
ucaccuccggucgugucucuggu

SEQ ID NO: 3539512 - RNA, 11 nt, Human
ucaccuccuaa

SEQ ID NO: 3539513 - RNA, 16 nt, Human
ucaccuccuaaaacaa

SEQ ID NO: 3539514 - RNA, 12 nt, Human
ucaccuccucua

SEQ ID NO: 3539515 - RNA, 15 nt, Human
ucaccuccuucaauu

SEQ ID NO: 3539516 - RNA, 23 nt, Human
ucaccucuacccaaacccuaggu

SEQ ID NO: 3539517 - RNA, 15 nt, Human
ucaccucugccucaa

SEQ ID NO: 3539518 - RNA, 12 nt, Human
ucaccucugcua

SEQ ID NO: 3539519 - RNA, 14 nt, Human
ucaccucuuccgac

SEQ ID NO: 3539520 - RNA, 22 nt, Human
ucaccugagcaggaccucugaa

SEQ ID NO: 3539521 - RNA, 21 nt, Human
ucaccugagcccggaugcuuc

SEQ ID NO: 3539522 - RNA, 22 nt, Human
ucaccugagcccggaugcuucu

SEQ ID NO: 3539523 - RNA, 19 nt, Human
ucaccugauucaacuaaaa

SEQ ID NO: 3539524 - RNA, 11 nt, Human
ucaccugcaaa

SEQ ID NO: 3539525 - RNA, 23 nt, Human
ucaccugcccagaucccagaagg

SEQ ID NO: 3539526 - RNA, 14 nt, Human
ucaccugccuguua

SEQ ID NO: 3539527 - RNA, 17 nt, Human
ucaccugcuggccccuc

SEQ ID NO: 3539528 - RNA, 19 nt, Human
ucaccugcuggccccucac

SEQ ID NO: 3539529 - RNA, 15 nt, Human
ucaccugcuucucug

SEQ ID NO: 3539530 - RNA, 17 nt, Human
ucaccugcuucucugcc

SEQ ID NO: 3539531 - RNA, 22 nt, Human
ucaccugcuucucugcccagcu

SEQ ID NO: 3539532 - RNA, 23 nt, Human
ucaccugcuucucugcccagcuu

SEQ ID NO: 3539533 - RNA, 13 nt, Human
ucaccuggaagca

SEQ ID NO: 3539534 - RNA, 22 nt, Human
ucaccuggacuuaagcaucugg

SEQ ID NO: 3539535 - RNA, 13 nt, Human
ucaccuggcccug

SEQ ID NO: 3539536 - RNA, 19 nt, Human
ucaccuggcccugcuuccu

SEQ ID NO: 3539537 - RNA, 18 nt, Human
ucaccuggcuuguuuauu

SEQ ID NO: 3539538 - RNA, 14 nt, Human
ucaccugggcaccu

SEQ ID NO: 3539539 - RNA, 13 nt, Human
ucaccuguaaaac

SEQ ID NO: 3539540 - RNA, 18 nt, Human
ucaccuguaaaacuuuau

SEQ ID NO: 3539541 - RNA, 17 nt, Human
ucaccugucaggccuga

SEQ ID NO: 3539542 - RNA, 20 nt, Human
ucaccugucuugccuuuuuc

SEQ ID NO: 3539543 - RNA, 14 nt, Human
ucaccugugcuucg

SEQ ID NO: 3539544 - RNA, 20 nt, Human
ucaccugugcuucgggcccu

SEQ ID NO: 3539545 - RNA, 20 nt, Human
ucaccuguuuuuaagcuguu

SEQ ID NO: 3539546 - RNA, 20 nt, Human
ucaccuuaggcagggaagug

SEQ ID NO: 3539547 - RNA, 21 nt, Human
ucaccuuccaggaccccuggg

SEQ ID NO: 3539548 - RNA, 15 nt, Human
ucaccuuuacuuuag

SEQ ID NO: 3539549 - RNA, 13 nt, Human
ucaccuuuauucu

SEQ ID NO: 3539550 - RNA, 17 nt, Human
ucaccuuuucuugccug

SEQ ID NO: 3539551 - RNA, 20 nt, Human
ucacgaauauuaugcccagu

SEQ ID NO: 3539552 - RNA, 16 nt, Human
ucacgacgcugcagag

SEQ ID NO: 3539553 - RNA, 16 nt, Human
ucacgagucauccaga

SEQ ID NO: 3539554 - RNA, 18 nt, Human
ucacgaguucaggagauc

SEQ ID NO: 3539555 - RNA, 14 nt, Human
ucacgauucauuuu

SEQ ID NO: 3539556 - RNA, 18 nt, Human
ucacgauugucaucagga

SEQ ID NO: 3539557 - RNA, 15 nt, Human
ucacgcaacuugaaa

SEQ ID NO: 3539558 - RNA, 23 nt, Human
ucacgcucccaacacaagguggg

SEQ ID NO: 3539559 - RNA, 16 nt, Human
ucacgcuuuuugaaaa

SEQ ID NO: 3539560 - RNA, 18 nt, Human
ucacggcugcgcacugug

SEQ ID NO: 3539561 - RNA, 22 nt, Human
ucacgggagauuucuuguugcu

SEQ ID NO: 3539562 - RNA, 19 nt, Human
ucacgggcaugggcacucc

SEQ ID NO: 3539563 - RNA, 14 nt, Human
ucacgugcaaagcc

SEQ ID NO: 3539564 - RNA, 22 nt, Human
ucacgugcgcugggcacuuccc

SEQ ID NO: 3539565 - RNA, 23 nt, Human
ucacgugcgcugggcacuucccu

SEQ ID NO: 3539566 - RNA, 16 nt, Human
ucacguggaggagcag

SEQ ID NO: 3539567 - RNA, 21 nt, Human
ucacguggcucgacuauagaa

SEQ ID NO: 3539568 - RNA, 17 nt, Human
ucacguguacuggcucc

SEQ ID NO: 3539569 - RNA, 16 nt, Human
ucacuaaagcaugaaa

SEQ ID NO: 3539570 - RNA, 18 nt, Human
ucacuaaagcaugaaaug

SEQ ID NO: 3539571 - RNA, 12 nt, Human
ucacuaacauua

SEQ ID NO: 3539572 - RNA, 23 nt, Human
ucacuaauugguacuuuuaaaaa

SEQ ID NO: 3539573 - RNA, 15 nt, Human
ucacuaauuuuugua

SEQ ID NO: 3539574 - RNA, 13 nt, Human
ucacuacaacuga

SEQ ID NO: 3539575 - RNA, 18 nt, Human
ucacuacagguuaaaaga

SEQ ID NO: 3539576 - RNA, 14 nt, Human
ucacuacaguauua

SEQ ID NO: 3539577 - RNA, 17 nt, Human
ucacuaccuucaugcau

SEQ ID NO: 3539578 - RNA, 22 nt, Human
ucacuacgggggggagaaggaa

SEQ ID NO: 3539579 - RNA, 14 nt, Human
ucacuacucagcau

SEQ ID NO: 3539580 - RNA, 14 nt, Human
ucacuacugcaguc

SEQ ID NO: 3539581 - RNA, 14 nt, Human
ucacuagaauggau

SEQ ID NO: 3539582 - RNA, 17 nt, Human
ucacuagauggcgagca

SEQ ID NO: 3539583 - RNA, 21 nt, Human
ucacuaggcccccacuugccu

SEQ ID NO: 3539584 - RNA, 23 nt, Human
ucacuauaggucauacaauccau

SEQ ID NO: 3539585 - RNA, 14 nt, Human
ucacuauccaugca

SEQ ID NO: 3539586 - RNA, 20 nt, Human
ucacuaucccggcugcccuu

SEQ ID NO: 3539587 - RNA, 13 nt, Human
ucacuaugcauuu

SEQ ID NO: 3539588 - RNA, 23 nt, Human
ucacuauggugccaauggaaccu

SEQ ID NO: 3539589 - RNA, 18 nt, Human
ucacuauguugcccaggc

SEQ ID NO: 3539590 - RNA, 19 nt, Human
ucacuauguugcccaggca

SEQ ID NO: 3539591 - RNA, 20 nt, Human
ucacuauuuuuauuuauauu

SEQ ID NO: 3539592 - RNA, 14 nt, Human
ucacucaauuguuu

SEQ ID NO: 3539593 - RNA, 16 nt, Human
ucacucacagagucaa

SEQ ID NO: 3539594 - RNA, 22 nt, Human
ucacucacagagucaaggccug

SEQ ID NO: 3539595 - RNA, 19 nt, Human
ucacucagaaguccagagu

SEQ ID NO: 3539596 - RNA, 14 nt, Human
ucacucagagcagu

SEQ ID NO: 3539597 - RNA, 15 nt, Human
ucacucagcaccacu

SEQ ID NO: 3539598 - RNA, 21 nt, Human
ucacucaucaauggggccagu

SEQ ID NO: 3539599 - RNA, 15 nt, Human
ucacucauugcugag

SEQ ID NO: 3539600 - RNA, 14 nt, Human
ucacuccaccaccc

SEQ ID NO: 3539601 - RNA, 16 nt, Human
ucacuccccuccuuuc

SEQ ID NO: 3539602 - RNA, 20 nt, Human
ucacuugaugugccauuuua

SEQ ID NO: 3539603 - RNA, 16 nt, Human
ucacuugauucauaaa

SEQ ID NO: 3539604 - RNA, 22 nt, Human
ucacuugauucauaaagauuca

SEQ ID NO: 3539605 - RNA, 12 nt, Human
ucacuugcaugu

SEQ ID NO: 3539606 - RNA, 20 nt, Human
ucacuuggugauauguccua

SEQ ID NO: 3539607 - RNA, 13 nt, Human
ucacuuguacaaa

SEQ ID NO: 3539608 - RNA, 14 nt, Human
ucacuuguacaaaa

SEQ ID NO: 3539609 - RNA, 17 nt, Human
ucacuuguacaaaauaa

SEQ ID NO: 3539610 - RNA, 17 nt, Human
ucacuugucaauaaaau

SEQ ID NO: 3539611 - RNA, 22 nt, Human
ucacuugucaggagugugugug

SEQ ID NO: 3539612 - RNA, 23 nt, Human
ucacuugugcuuugcucuugucc

SEQ ID NO: 3539613 - RNA, 12 nt, Human
ucacuugugggg

SEQ ID NO: 3539614 - RNA, 20 nt, Human
ucacuuguuguuuuacuaaa

SEQ ID NO: 3539615 - RNA, 21 nt, Human
ucacuuguuguuuuacuaaag

SEQ ID NO: 3539616 - RNA, 22 nt, Human
ucacuuguuguuuuacuaaaga

SEQ ID NO: 3539617 - RNA, 13 nt, Human
ucacuuuaaaccu

SEQ ID NO: 3539618 - RNA, 15 nt, Human
ucacuuuaauucuca

SEQ ID NO: 3539619 - RNA, 15 nt, Human
ucacuuuagaugcug

SEQ ID NO: 3539620 - RNA, 16 nt, Human
ucacuuuagaugcuga

SEQ ID NO: 3539621 - RNA, 14 nt, Human
ucacuuuauuucau

SEQ ID NO: 3539622 - RNA, 15 nt, Human
ucacuuuauuucauu

SEQ ID NO: 3539623 - RNA, 17 nt, Human
ucacuuucacauagaug

SEQ ID NO: 3539624 - RNA, 12 nt, Human
ucacuuucauaa

SEQ ID NO: 3539625 - RNA, 19 nt, Human
ucacuuugacacuuuucau

SEQ ID NO: 3539626 - RNA, 12 nt, Human
ucacuuugcucu

SEQ ID NO: 3539627 - RNA, 16 nt, Human
ucacuuugcucugggu

SEQ ID NO: 3539628 - RNA, 21 nt, Human
ucacuuuuaaugaacaaaugg

SEQ ID NO: 3539629 - RNA, 12 nt, Human
ucacuuuuauuu

SEQ ID NO: 3539630 - RNA, 13 nt, Human
ucacuuuucagug

SEQ ID NO: 3539631 - RNA, 16 nt, Human
ucacuuuucagugaug

SEQ ID NO: 3539632 - RNA, 15 nt, Human
ucacuuuucccacuc

SEQ ID NO: 3539633 - RNA, 18 nt, Human
ucacuuuugcaagguucc

SEQ ID NO: 3539634 - RNA, 20 nt, Human
ucacuuuuggcaaugacuca

SEQ ID NO: 3539635 - RNA, 21 nt, Human
ucacuuuuuaugcuauuucug

SEQ ID NO: 3539636 - RNA, 22 nt, Human
ucacuuuuugaacuaagaaacu

SEQ ID NO: 3539637 - RNA, 20 nt, Human
ucacuuuuugaggcaaaaga

SEQ ID NO: 3539638 - RNA, 15 nt, Human
ucacuuuuuuccaca

SEQ ID NO: 3539639 - RNA, 15 nt, Human
ucacuuuuuuuuucc

SEQ ID NO: 3539640 - RNA, 21 nt, Human
ucacuuuuuuuuuccaaaaaa

SEQ ID NO: 3539641 - RNA, 22 nt, Human
ucacuuuuuuuuuuuguuugau

SEQ ID NO: 3539642 - RNA, 17 nt, Human
ucagaaaaaaauaaaug

SEQ ID NO: 3539643 - RNA, 16 nt, Human
ucagaaaaaaauucau

SEQ ID NO: 3539644 - RNA, 23 nt, Human
ucagaaaaaagguucuuugugua

SEQ ID NO: 3539645 - RNA, 17 nt, Human
ucagaaaaauggagcaa

SEQ ID NO: 3539646 - RNA, 11 nt, Human
ucagaaaacag

SEQ ID NO: 3539647 - RNA, 16 nt, Human
ucagaaaacagaaaaa

SEQ ID NO: 3539648 - RNA, 22 nt, Human
ucagaaaacuuuaaaaaauauu

SEQ ID NO: 3539649 - RNA, 17 nt, Human
ucagaaaauauuaugug

SEQ ID NO: 3539650 - RNA, 15 nt, Human
ucagaaaauguucug

SEQ ID NO: 3539651 - RNA, 19 nt, Human
ucagaaaauguucuguuug

SEQ ID NO: 3539652 - RNA, 18 nt, Human
ucagaaacaucaguuacu

SEQ ID NO: 3539653 - RNA, 22 nt, Human
ucagaaacaucaguuacucuga

SEQ ID NO: 3539654 - RNA, 16 nt, Human
ucauuucaggagcagc

SEQ ID NO: 3539655 - RNA, 12 nt, Human
ucauuucaucua

SEQ ID NO: 3539656 - RNA, 18 nt, Human
ucauuucaucucauuuaa

SEQ ID NO: 3539657 - RNA, 20 nt, Human
ucauuucaucucauuuaagg

SEQ ID NO: 3539658 - RNA, 19 nt, Human
ucauuucauuguaugaugu

SEQ ID NO: 3539659 - RNA, 13 nt, Human
ucauuuccugugu

SEQ ID NO: 3539660 - RNA, 18 nt, Human
ucauuucuacugugacug

SEQ ID NO: 3539661 - RNA, 19 nt, Human
ucauuucuccagauuaucu

SEQ ID NO: 3539662 - RNA, 14 nt, Human
ucauuucuuugagu

SEQ ID NO: 3539663 - RNA, 22 nt, Human
ucauuucuuuuugggagagacu

SEQ ID NO: 3539664 - RNA, 21 nt, Human
ucauuugcccuuaaggacaaa

SEQ ID NO: 3539665 - RNA, 20 nt, Human
ucauuugcuaacuagcuugg

SEQ ID NO: 3539666 - RNA, 14 nt, Human
ucauuugcugugaa

SEQ ID NO: 3539667 - RNA, 16 nt, Human
ucauuugcuuuggaag

SEQ ID NO: 3539668 - RNA, 23 nt, Human
ucauuuggaggaaaaaaagcaug

SEQ ID NO: 3539669 - RNA, 17 nt, Human
ucauuuguaugucaaag

SEQ ID NO: 3539670 - RNA, 14 nt, Human
ucauuugucacaca

SEQ ID NO: 3539671 - RNA, 18 nt, Human
ucauuugugccagaaugc

SEQ ID NO: 3539672 - RNA, 18 nt, Human
ucauuuguggguuuuuau

SEQ ID NO: 3539673 - RNA, 23 nt, Human
ucauuuguggguuuuuauuuccu

SEQ ID NO: 3539674 - RNA, 23 nt, Human
ucauuuguggugauauagaauua

SEQ ID NO: 3539675 - RNA, 22 nt, Human
ucauuuguucugggaguauaaa

SEQ ID NO: 3539676 - RNA, 15 nt, Human
ucauuuguuggaaug

SEQ ID NO: 3539677 - RNA, 21 nt, Human
ucauuuguuuaaaaaggcagu

SEQ ID NO: 3539678 - RNA, 12 nt, Human
ucauuuguuuac

SEQ ID NO: 3539679 - RNA, 19 nt, Human
ucauuuguuuguuuuccuu

SEQ ID NO: 3539680 - RNA, 20 nt, Human
ucauuuuaacaucugagaaa

SEQ ID NO: 3539681 - RNA, 22 nt, Human
ucauuuuaacaucugagaaaag

SEQ ID NO: 3539682 - RNA, 15 nt, Human
ucauuuuaauguaaa

SEQ ID NO: 3539683 - RNA, 19 nt, Human
ucauuuuaauguaaagauu

SEQ ID NO: 3539684 - RNA, 13 nt, Human
ucauuuuaauuau

SEQ ID NO: 3539685 - RNA, 14 nt, Human
ucauuuuaauuauu

SEQ ID NO: 3539686 - RNA, 15 nt, Human
ucauuuuaggaaagg

SEQ ID NO: 3539687 - RNA, 22 nt, Human
ucauuuuauauaugaaaacuaa

SEQ ID NO: 3539688 - RNA, 18 nt, Human
ucauuuuauauugaaaaa

SEQ ID NO: 3539689 - RNA, 13 nt, Human
ucauuuuccaaua

SEQ ID NO: 3539690 - RNA, 12 nt, Human
ucauuuucuaga

SEQ ID NO: 3539691 - RNA, 20 nt, Human
ucauuuucuauaacagauau

SEQ ID NO: 3539692 - RNA, 13 nt, Human
ucauuuucucuaa

SEQ ID NO: 3539693 - RNA, 15 nt, Human
ucauuuucucuaaua

SEQ ID NO: 3539694 - RNA, 18 nt, Human
ucauuuucugcaagccug

SEQ ID NO: 3539695 - RNA, 14 nt, Human
ucauuuugaaauug

SEQ ID NO: 3539696 - RNA, 20 nt, Human
ucauuuuguaacaaaugaac

SEQ ID NO: 3539697 - RNA, 16 nt, Human
ucauuuuuaaucauga

SEQ ID NO: 3539698 - RNA, 21 nt, Human
ucauuuuuacaauguaauuau

SEQ ID NO: 3539699 - RNA, 19 nt, Human
ucauuuuuaguagagacag

SEQ ID NO: 3539700 - RNA, 16 nt, Human
ucauuuuuauagcaac

SEQ ID NO: 3539701 - RNA, 21 nt, Human
ucauuuuuauagcaacaacaa

SEQ ID NO: 3539702 - RNA, 22 nt, Human
ucauuuuuccuucccuucucca

SEQ ID NO: 3539703 - RNA, 14 nt, Human
ucauuuuugaauac

SEQ ID NO: 3539704 - RNA, 16 nt, Human
ucauuuuuguacaguu

SEQ ID NO: 3539705 - RNA, 22 nt, Human
ucauuuuuguacaguuugcugu

SEQ ID NO: 3539706 - RNA, 23 nt, Human
ucauuuuuuauggcugcauagua

SEQ ID NO: 3539707 - RNA, 13 nt, Human
ucauuuuuuucca

SEQ ID NO: 3539708 - RNA, 16 nt, Human
ucauuuuuuuccaggc

SEQ ID NO: 3539709 - RNA, 17 nt, Human
ucauuuuuuuuaagaaa

SEQ ID NO: 3539710 - RNA, 17 nt, Human
ucauuuuuuuuaauuga

SEQ ID NO: 3539711 - RNA, 20 nt, Human
ucauuuuuuuucuuugaaua

SEQ ID NO: 3539712 - RNA, 21 nt, Human
uccaaaaaaaaaaaaaauaca

SEQ ID NO: 3539713 - RNA, 13 nt, Human
uccaaaaaaauac

SEQ ID NO: 3539714 - RNA, 14 nt, Human
uccaaaaaaauacu

SEQ ID NO: 3539715 - RNA, 17 nt, Human
uccaaaaauguguaaga

SEQ ID NO: 3539716 - RNA, 22 nt, Human
uccaaaaauuauuauaagcauu

SEQ ID NO: 3539717 - RNA, 22 nt, Human
uccaaaaccgccagcucuguuc

SEQ ID NO: 3539718 - RNA, 12 nt, Human
uccaaaacugcc

SEQ ID NO: 3539719 - RNA, 14 nt, Human
uccaaaagaagccc

SEQ ID NO: 3539720 - RNA, 20 nt, Human
uccaaaagauugcugaaauu

SEQ ID NO: 3539721 - RNA, 20 nt, Human
uccaaaagcaaccacaaacc

SEQ ID NO: 3539722 - RNA, 16 nt, Human
uccaaaagcuuuuuau

SEQ ID NO: 3539723 - RNA, 16 nt, Human
uccaaaauaaaacuuu

SEQ ID NO: 3539724 - RNA, 18 nt, Human
uccaaaauaaaacuuuuu

SEQ ID NO: 3539725 - RNA, 20 nt, Human
uccaaaauaaaacuuuuuaa

SEQ ID NO: 3539726 - RNA, 22 nt, Human
uccaaaauguuggucauuuuau

SEQ ID NO: 3539727 - RNA, 19 nt, Human
uccaaaauuuuucaacccc

SEQ ID NO: 3539728 - RNA, 21 nt, Human
uccaaaauuuuucaaccccac

SEQ ID NO: 3539729 - RNA, 14 nt, Human
uccaaacauccucu

SEQ ID NO: 3539730 - RNA, 22 nt, Human
uccaaacaugagguucucucua

SEQ ID NO: 3539731 - RNA, 20 nt, Human
uccaaacauguauuuaugua

SEQ ID NO: 3539732 - RNA, 14 nt, Human
uccaaaccaaauuu

SEQ ID NO: 3539733 - RNA, 17 nt, Human
uccaaaccaaauuuuaa

SEQ ID NO: 3539734 - RNA, 12 nt, Human
uccaaaccacuu

SEQ ID NO: 3539735 - RNA, 15 nt, Human
uccaaaccuuaucuc

SEQ ID NO: 3539736 - RNA, 18 nt, Human
uccaaaccuucacacaca

SEQ ID NO: 3539737 - RNA, 20 nt, Human
uccaaagaauguuagagcac

SEQ ID NO: 3539738 - RNA, 23 nt, Human
uccaaagaauguuagagcacagu

SEQ ID NO: 3539739 - RNA, 17 nt, Human
uccaaagacucuuggga

SEQ ID NO: 3539740 - RNA, 14 nt, Human
uccaaagaggcugc

SEQ ID NO: 3539741 - RNA, 16 nt, Human
uccaaagaggcugccc

SEQ ID NO: 3539742 - RNA, 18 nt, Human
uccaaagaggcugccccu

SEQ ID NO: 3539743 - RNA, 22 nt, Human
uccaaagaguagaauugcauug

SEQ ID NO: 3539744 - RNA, 14 nt, Human
uccaaagcagacag

SEQ ID NO: 3539745 - RNA, 15 nt, Human
uccaaagcagacagc

SEQ ID NO: 3539746 - RNA, 17 nt, Human
ucagcuccuuccuggag

SEQ ID NO: 3539747 - RNA, 17 nt, Human
ucagcucggggagccuu

SEQ ID NO: 3539748 - RNA, 19 nt, Human
ucagcucucugcccugugu

SEQ ID NO: 3539749 - RNA, 18 nt, Human
ucagcucugaaagagaaa

SEQ ID NO: 3539750 - RNA, 14 nt, Human
ucagcucuggcuca

SEQ ID NO: 3539751 - RNA, 17 nt, Human
ucagcucuggcucacag

SEQ ID NO: 3539752 - RNA, 18 nt, Human
ucagcucugggagaggau

SEQ ID NO: 3539753 - RNA, 13 nt, Human
ucagcucuuuuug

SEQ ID NO: 3539754 - RNA, 14 nt, Human
ucagcugagccuuc

SEQ ID NO: 3539755 - RNA, 20 nt, Human
ucagcugcaagguacucugg

SEQ ID NO: 3539756 - RNA, 21 nt, Human
ucagcugcaagguacucuggu

SEQ ID NO: 3539757 - RNA, 12 nt, Human
ucagcugccagu

SEQ ID NO: 3539758 - RNA, 12 nt, Human
ucagcugccccc

SEQ ID NO: 3539759 - RNA, 14 nt, Human
ucagcugccucacu

SEQ ID NO: 3539760 - RNA, 15 nt, Human
ucagcugccucacuu

SEQ ID NO: 3539761 - RNA, 12 nt, Human
ucagcuguacuu

SEQ ID NO: 3539762 - RNA, 13 nt, Human
ucagcuguccucc

SEQ ID NO: 3539763 - RNA, 18 nt, Human
ucagcuguccucccucca

SEQ ID NO: 3539764 - RNA, 17 nt, Human
ucagcugucuguggcuu

SEQ ID NO: 3539765 - RNA, 15 nt, Human
ucagcuguuugucau

SEQ ID NO: 3539766 - RNA, 22 nt, Human
ucagcuuacaucccugagcagg

SEQ ID NO: 3539767 - RNA, 18 nt, Human
ucagcuucauuuguguca

SEQ ID NO: 3539768 - RNA, 21 nt, Human
ucagcuucauuugugucaaug

SEQ ID NO: 3539769 - RNA, 19 nt, Human
ucagcuuccccaguagcug

SEQ ID NO: 3539770 - RNA, 19 nt, Human
ucagcuucguuuauuuuca

SEQ ID NO: 3539771 - RNA, 14 nt, Human
ucagcuucugcugg

SEQ ID NO: 3539772 - RNA, 13 nt, Human
ucagcuucuuaau

SEQ ID NO: 3539773 - RNA, 16 nt, Human
ucagcuugcacauuug

SEQ ID NO: 3539774 - RNA, 21 nt, Human
ucagcuuguaaauagcucagg

SEQ ID NO: 3539775 - RNA, 21 nt, Human
ucagcuuucuuuaaaguucuu

SEQ ID NO: 3539776 - RNA, 16 nt, Human
ucagcuuugccuucca

SEQ ID NO: 3539777 - RNA, 18 nt, Human
ucagcuuuuugucuuuuc

SEQ ID NO: 3539778 - RNA, 20 nt, Human
ucaggaaaacugacagagga

SEQ ID NO: 3539779 - RNA, 21 nt, Human
ucaggaaaacugacagaggag

SEQ ID NO: 3539780 - RNA, 18 nt, Human
ucaggaaaagccucugug

SEQ ID NO: 3539781 - RNA, 15 nt, Human
ucaggaaaaggccug

SEQ ID NO: 3539782 - RNA, 17 nt, Human
ucaggaaaaggccuggg

SEQ ID NO: 3539783 - RNA, 19 nt, Human
ucaggaaaagguugaauaa

SEQ ID NO: 3539784 - RNA, 12 nt, Human
ucaggaaaauug

SEQ ID NO: 3539785 - RNA, 18 nt, Human
ucaggaaaauugaaugca

SEQ ID NO: 3539786 - RNA, 9 nt, Human
ucaggaaac

SEQ ID NO: 3539787 - RNA, 22 nt, Human
ucaggaaacgagacuuuccauu

SEQ ID NO: 3539788 - RNA, 20 nt, Human
ucaggaaagaauagaaagaa

SEQ ID NO: 3539789 - RNA, 14 nt, Human
ucaggaaagacgga

SEQ ID NO: 3539790 - RNA, 19 nt, Human
ucaggaaagagaacuucca

SEQ ID NO: 3539791 - RNA, 21 nt, Human
ucaggaaauauauaugugugu

SEQ ID NO: 3539792 - RNA, 20 nt, Human
ucaggaaaucaaauaugcaa

SEQ ID NO: 3539793 - RNA, 13 nt, Human
ucaggaacagaag

SEQ ID NO: 3539794 - RNA, 17 nt, Human
ucaggaaccgaggcagg

SEQ ID NO: 3539795 - RNA, 18 nt, Human
ucaggaaccgaggcaggg

SEQ ID NO: 3539796 - RNA, 15 nt, Human
ucaggaaccuggacc

SEQ ID NO: 3539797 - RNA, 17 nt, Human
ucaggaaccuggaccaa

SEQ ID NO: 3539798 - RNA, 23 nt, Human
ucaggaacguuuagcugacaaaa

SEQ ID NO: 3539799 - RNA, 12 nt, Human
ucaggaagaaau

SEQ ID NO: 3539800 - RNA, 20 nt, Human
ucaggaagagaaggagcaga

SEQ ID NO: 3539801 - RNA, 15 nt, Human
ucaggaagcucaggg

SEQ ID NO: 3539802 - RNA, 16 nt, Human
ucaggaagcucagggc

SEQ ID NO: 3539803 - RNA, 19 nt, Human
ucaggaagcucagggccug

SEQ ID NO: 3539804 - RNA, 20 nt, Human
ucaggaagcucagggccugg

SEQ ID NO: 3539805 - RNA, 23 nt, Human
ucaggaagcucagggccuggcuc

SEQ ID NO: 3539806 - RNA, 14 nt, Human
ucaggaaugggcug

SEQ ID NO: 3539807 - RNA, 16 nt, Human
ucaggacacaggccug

SEQ ID NO: 3539808 - RNA, 19 nt, Human
ucaggacacaggccugugu

SEQ ID NO: 3539809 - RNA, 23 nt, Human
ucaggacacaggccuguguagcu

SEQ ID NO: 3539810 - RNA, 14 nt, Human
ucaggaccaggcaa

SEQ ID NO: 3539811 - RNA, 16 nt, Human
ucaggacccagaggaa

SEQ ID NO: 3539812 - RNA, 17 nt, Human
ucaggacccucgcuggc

SEQ ID NO: 3539813 - RNA, 17 nt, Human
ucaggaccugggaccuc

SEQ ID NO: 3539814 - RNA, 21 nt, Human
ucaggacucagaagccucugg

SEQ ID NO: 3539815 - RNA, 12 nt, Human
ucaggacuccag

SEQ ID NO: 3539816 - RNA, 12 nt, Human
ucaggacuggga

SEQ ID NO: 3539817 - RNA, 15 nt, Human
ucaggacuuggucug

SEQ ID NO: 3539818 - RNA, 20 nt, Human
ucaggagagaguugaaccua

SEQ ID NO: 3539819 - RNA, 13 nt, Human
ucaggagagcagc

SEQ ID NO: 3539820 - RNA, 22 nt, Human
ucaggagaguagaacagauaau

SEQ ID NO: 3539821 - RNA, 11 nt, Human
ucaggagcaca

SEQ ID NO: 3539822 - RNA, 12 nt, Human
ucaggagcccug

SEQ ID NO: 3539823 - RNA, 20 nt, Human
ucaggagcccugggaggcuc

SEQ ID NO: 3539824 - RNA, 16 nt, Human
ucaggaggaaggcuua

SEQ ID NO: 3539825 - RNA, 17 nt, Human
ucaggaggaauacugaa

SEQ ID NO: 3539826 - RNA, 18 nt, Human
ucaggaggccaagguggg

SEQ ID NO: 3539827 - RNA, 12 nt, Human
ucaggaggcgcc

SEQ ID NO: 3539828 - RNA, 18 nt, Human
ucaggaggcugaggggag

SEQ ID NO: 3539829 - RNA, 13 nt, Human
ucaggaggcugga

SEQ ID NO: 3539830 - RNA, 18 nt, Human
ucaggaguccaagaccag

SEQ ID NO: 3539831 - RNA, 19 nt, Human
ucaggagucccaaggaaag

SEQ ID NO: 3539832 - RNA, 17 nt, Human
ucaggaguuagaggcca

SEQ ID NO: 3539833 - RNA, 16 nt, Human
ucaggaucaagaaagu

SEQ ID NO: 3539834 - RNA, 20 nt, Human
ucaggauccaagcuaagcac

SEQ ID NO: 3539835 - RNA, 14 nt, Human
ucaggaucuauuuu

SEQ ID NO: 3539836 - RNA, 17 nt, Human
ucaggaugaacccagga

SEQ ID NO: 3539837 - RNA, 14 nt, Human
ucaggaugcccagg

SEQ ID NO: 3539838 - RNA, 23 nt, Human
ucaggauucuccuuuuuaccccu

SEQ ID NO: 3539839 - RNA, 17 nt, Human
ucaggauucuguuccuu

SEQ ID NO: 3539840 - RNA, 13 nt, Human
ucaggauugcgag

SEQ ID NO: 3539841 - RNA, 18 nt, Human
ucaggauugcgagagaug

SEQ ID NO: 3539842 - RNA, 16 nt, Human
ucaggauuuaaaaacu

SEQ ID NO: 3539843 - RNA, 17 nt, Human
ucaggauuuccucuuga

SEQ ID NO: 3539844 - RNA, 12 nt, Human
ucaggcaccagu

SEQ ID NO: 3539845 - RNA, 16 nt, Human
ucaggcacuagccuuu

SEQ ID NO: 3539846 - RNA, 20 nt, Human
ucaggcagccagugagauga

SEQ ID NO: 3539847 - RNA, 17 nt, Human
ucaggcaggggccucca

SEQ ID NO: 3539848 - RNA, 21 nt, Human
ucaggcaggggccuccauggg

SEQ ID NO: 3539849 - RNA, 17 nt, Human
ucaggcaggugggaugg

SEQ ID NO: 3539850 - RNA, 20 nt, Human
ucaggcauaggccugggugc

SEQ ID NO: 3539851 - RNA, 18 nt, Human
ucaggcaugaacauguac

SEQ ID NO: 3539852 - RNA, 20 nt, Human
ucaggcauuggauauuuuuu

SEQ ID NO: 3539853 - RNA, 18 nt, Human
ucaggccaaccccaaaga

SEQ ID NO: 3539854 - RNA, 14 nt, Human
ucaggccacggcag

SEQ ID NO: 3539855 - RNA, 17 nt, Human
ucaggccagagccaagg

SEQ ID NO: 3539856 - RNA, 11 nt, Human
ucaggccaggc

SEQ ID NO: 3539857 - RNA, 12 nt, Human
ucaggccaggcc

SEQ ID NO: 3539858 - RNA, 14 nt, Human
ucaggccaggcccu

SEQ ID NO: 3539859 - RNA, 23 nt, Human
ucaggccaggcccucugcccacu

SEQ ID NO: 3539860 - RNA, 18 nt, Human
ucaggccaggugcagugg

SEQ ID NO: 3539861 - RNA, 23 nt, Human
ucaggccaucaucaguggagcca

SEQ ID NO: 3539862 - RNA, 12 nt, Human
ucaggcccaggc

SEQ ID NO: 3539863 - RNA, 13 nt, Human
gcugaggcagcag

SEQ ID NO: 3539864 - RNA, 21 nt, Human
gcugaggcaggagacuggcgu

SEQ ID NO: 3539865 - RNA, 15 nt, Human
gcugaggcaggagga

SEQ ID NO: 3539866 - RNA, 12 nt, Human
gcugaggccugg

SEQ ID NO: 3539867 - RNA, 13 nt, Human
gcugaggccuggg

SEQ ID NO: 3539868 - RNA, 20 nt, Human
gcugaggccugggccgcugc

SEQ ID NO: 3539869 - RNA, 13 nt, Human
gcugaggcuggca

SEQ ID NO: 3539870 - RNA, 15 nt, Human
gcugagggaccagcc

SEQ ID NO: 3539871 - RNA, 16 nt, Human
gcugagggccugcugg

SEQ ID NO: 3539872 - RNA, 23 nt, Human
gcugaggggggccgugcccaggg

SEQ ID NO: 3539873 - RNA, 14 nt, Human
gcugaggguuugaa

SEQ ID NO: 3539874 - RNA, 15 nt, Human
gcugaggugagagga

SEQ ID NO: 3539875 - RNA, 16 nt, Human
gcugaggugcccagga

SEQ ID NO: 3539876 - RNA, 18 nt, Human
gcugaggugcccaggaga

SEQ ID NO: 3539877 - RNA, 15 nt, Human
gcugaggugggagga

SEQ ID NO: 3539878 - RNA, 19 nt, Human
gcugaggugggaggaucac

SEQ ID NO: 3539879 - RNA, 16 nt, Human
gcugagguuccucugc

SEQ ID NO: 3539880 - RNA, 18 nt, Human
gcugagguuccucugccu

SEQ ID NO: 3539881 - RNA, 19 nt, Human
gcugagguuccucugccug

SEQ ID NO: 3539882 - RNA, 22 nt, Human
gcugagguuccucugccugccc

SEQ ID NO: 3539883 - RNA, 23 nt, Human
gcugagguuccucugccugcccc

SEQ ID NO: 3539884 - RNA, 16 nt, Human
gcugaguauuaaaaug

SEQ ID NO: 3539885 - RNA, 17 nt, Human
gcugaguauuaaaaugu

SEQ ID NO: 3539886 - RNA, 15 nt, Human
gcugagucaucuguu

SEQ ID NO: 3539887 - RNA, 23 nt, Human
gcugagucaucuguuagggccuu

SEQ ID NO: 3539888 - RNA, 21 nt, Human
gcugagucaugaucucccugc

SEQ ID NO: 3539889 - RNA, 14 nt, Human
gcugagucucccaa

SEQ ID NO: 3539890 - RNA, 15 nt, Human
gcugagucucccaag

SEQ ID NO: 3539891 - RNA, 17 nt, Human
gcugagucucccaaggc

SEQ ID NO: 3539892 - RNA, 17 nt, Human
aagaaagagaaggagcc

SEQ ID NO: 3539893 - RNA, 12 nt, Human
aagaaagagaga

SEQ ID NO: 3539894 - RNA, 14 nt, Human
aagaaagagagaaa

SEQ ID NO: 3539895 - RNA, 18 nt, Human
aagaaagagagaaaauaa

SEQ ID NO: 3539896 - RNA, 20 nt, Human
aagaaagagagaaaauaaaa

SEQ ID NO: 3539897 - RNA, 23 nt, Human
aagaaagagcaacaauccaucuc

SEQ ID NO: 3539898 - RNA, 12 nt, Human
aagaaagaggaa

SEQ ID NO: 3539899 - RNA, 17 nt, Human
aagaaagaggaaaagaa

SEQ ID NO: 3539900 - RNA, 19 nt, Human
aagaaagccagucuuaaca

SEQ ID NO: 3539901 - RNA, 13 nt, Human
aagaaagccugag

SEQ ID NO: 3539902 - RNA, 15 nt, Human
aagaaaggaacauuu

SEQ ID NO: 3539903 - RNA, 15 nt, Human
aagaaaggcugcugu

SEQ ID NO: 3539904 - RNA, 21 nt, Human
aagaaaggggcaggagcucag

SEQ ID NO: 3539905 - RNA, 16 nt, Human
aagaaaggguguuuuu

SEQ ID NO: 3539906 - RNA, 19 nt, Human
aagaaagucuaucuaauga

SEQ ID NO: 3539907 - RNA, 22 nt, Human
aagaaagucuaucuaaugacau

SEQ ID NO: 3539908 - RNA, 15 nt, Human
aagaaaguguauuug

SEQ ID NO: 3539909 - RNA, 23 nt, Human
aagaaaguuuccccaccagugaa

SEQ ID NO: 3539910 - RNA, 13 nt, Human
aagaaauaaccac

SEQ ID NO: 3539911 - RNA, 21 nt, Human
aagaaauaauuuuauuccaga

SEQ ID NO: 3539912 - RNA, 13 nt, Human
aagaaauacugua

SEQ ID NO: 3539913 - RNA, 14 nt, Human
aagaaauagaacaa

SEQ ID NO: 3539914 - RNA, 15 nt, Human
aagaaauaucuguga

SEQ ID NO: 3539915 - RNA, 18 nt, Human
aagaaauaucugugaaau

SEQ ID NO: 3539916 - RNA, 16 nt, Human
aagaaauaugugagau

SEQ ID NO: 3539917 - RNA, 18 nt, Human
aagaaauaugugagauuu

SEQ ID NO: 3539918 - RNA, 20 nt, Human
aagaaauaugugagauuuuu

SEQ ID NO: 3539919 - RNA, 20 nt, Human
aagaaauauuccaaaugucu

SEQ ID NO: 3539920 - RNA, 18 nt, Human
aagaaaucacagaaucau

SEQ ID NO: 3539921 - RNA, 13 nt, Human
aagaaaucauguu

SEQ ID NO: 3539922 - RNA, 14 nt, Human
aagaaaucauguua

SEQ ID NO: 3539923 - RNA, 23 nt, Human
aagaaaucccuguuuaauauuua

SEQ ID NO: 3539924 - RNA, 14 nt, Human
aagaaaucuauaga

SEQ ID NO: 3539925 - RNA, 16 nt, Human
aagaaaucuauagaaa

SEQ ID NO: 3539926 - RNA, 13 nt, Human
aagaaaucuauuu

SEQ ID NO: 3539927 - RNA, 14 nt, Human
aagaaaugaaauuu

SEQ ID NO: 3539928 - RNA, 13 nt, Human
aagaaaugaagag

SEQ ID NO: 3539929 - RNA, 14 nt, Human
aagaaaugacacuu

SEQ ID NO: 3539930 - RNA, 15 nt, Human
aagaaaugacuaauu

SEQ ID NO: 3539931 - RNA, 19 nt, Human
aagaaaugcacaaugucuu

SEQ ID NO: 3539932 - RNA, 21 nt, Human
aagaaauguaguugauguauc

SEQ ID NO: 3539933 - RNA, 13 nt, Human
aagaaaugucuua

SEQ ID NO: 3539934 - RNA, 13 nt, Human
aagaaauuaugug

SEQ ID NO: 3539935 - RNA, 17 nt, Human
aagaaauuccuguagca

SEQ ID NO: 3539936 - RNA, 13 nt, Human
aagaaauugcaau

SEQ ID NO: 3539937 - RNA, 16 nt, Human
aagaaauugcaauaac

SEQ ID NO: 3539938 - RNA, 14 nt, Human
aagaaauuucaggu

SEQ ID NO: 3539939 - RNA, 15 nt, Human
aagaaauuuuuuaaa

SEQ ID NO: 3539940 - RNA, 20 nt, Human
aagaacaaaaaaaucugcag

SEQ ID NO: 3539941 - RNA, 21 nt, Human
aagaacaauuguccauggucu

SEQ ID NO: 3539942 - RNA, 21 nt, Human
aagaacacaaagcggggggag

SEQ ID NO: 3539943 - RNA, 12 nt, Human
aagaacauaaag

SEQ ID NO: 3539944 - RNA, 18 nt, Human
aagaacauggacuuguau

SEQ ID NO: 3539945 - RNA, 11 nt, Human
aagaacaugug

SEQ ID NO: 3539946 - RNA, 13 nt, Human
aagaaccacuugu

SEQ ID NO: 3539947 - RNA, 14 nt, Human
aagaaccccucugc

SEQ ID NO: 3539948 - RNA, 17 nt, Human
aagaaccuaacauuuau

SEQ ID NO: 3539949 - RNA, 21 nt, Human
aagaacguuuuuuccucagug

SEQ ID NO: 3539950 - RNA, 21 nt, Human
aagaacuacaaacaaaauuuc

SEQ ID NO: 3539951 - RNA, 23 nt, Human
aagaacuauugugcucagagaca

SEQ ID NO: 3539952 - RNA, 20 nt, Human
aagaacucaaacuucuggcu

SEQ ID NO: 3539953 - RNA, 18 nt, Human
aagaacucaccaggguuu

SEQ ID NO: 3539954 - RNA, 13 nt, Human
aagaacucucugg

SEQ ID NO: 3539955 - RNA, 11 nt, Human
aagaacugaaa

SEQ ID NO: 3539956 - RNA, 16 nt, Human
aagaacugaaaacaua

SEQ ID NO: 3539957 - RNA, 18 nt, Human
aagaacugaaaacauaaa

SEQ ID NO: 3539958 - RNA, 22 nt, Human
aagaacugucauguaaacauac

SEQ ID NO: 3539959 - RNA, 15 nt, Human
aagaacuuacugauu

SEQ ID NO: 3539960 - RNA, 15 nt, Human
aagaacuugcaugga

SEQ ID NO: 3539961 - RNA, 15 nt, Human
aagaacuuguuuaau

SEQ ID NO: 3539962 - RNA, 18 nt, Human
aagaacuuugagcuacug

SEQ ID NO: 3539963 - RNA, 9 nt, Human
aagaagaaa

SEQ ID NO: 3539964 - RNA, 12 nt, Human
aagaagaaaaaa

SEQ ID NO: 3539965 - RNA, 21 nt, Human
aagaagaaaagagaagaagaa

SEQ ID NO: 3539966 - RNA, 16 nt, Human
aagaagaaacgucuau

SEQ ID NO: 3539967 - RNA, 15 nt, Human
aagaagaaagacucu

SEQ ID NO: 3539968 - RNA, 15 nt, Human
aagaagaacuugcau

SEQ ID NO: 3539969 - RNA, 13 nt, Human
aagaagaagggca

SEQ ID NO: 3539970 - RNA, 14 nt, Human
aagaagacauguuu

SEQ ID NO: 3539971 - RNA, 15 nt, Human
aagaagacauguuuu

SEQ ID NO: 3539972 - RNA, 19 nt, Human
aagaagaccagacugugga

SEQ ID NO: 3539973 - RNA, 21 nt, Human
aagaagaccagacuguggaga

SEQ ID NO: 3539974 - RNA, 20 nt, Human
aagaagaccugagaauguau

SEQ ID NO: 3539975 - RNA, 15 nt, Human
aagaagacugcauua

SEQ ID NO: 3539976 - RNA, 17 nt, Human
aagaagagaagcugcug

SEQ ID NO: 3539977 - RNA, 19 nt, Human
aagaagagaagcugcugac

SEQ ID NO: 3539978 - RNA, 11 nt, Human
aagaagagaca

SEQ ID NO: 3539979 - RNA, 22 nt, Human
aagaagagagaagacccuucuc

SEQ ID NO: 3539980 - RNA, 22 nt, Human
aagaagagcgagagaucaaaga

SEQ ID NO: 3539981 - RNA, 23 nt, Human
aagaagagcgagagaucaaagau

SEQ ID NO: 3539982 - RNA, 21 nt, Human
aagaagaucacgcuccccgcc

SEQ ID NO: 3539983 - RNA, 19 nt, Human
aagaagauccuaaaacaaa

SEQ ID NO: 3539984 - RNA, 14 nt, Human
aagaagaucuguaa

SEQ ID NO: 3539985 - RNA, 12 nt, Human
aagaagaugcuc

SEQ ID NO: 3539986 - RNA, 22 nt, Human
aagaagaugcuccagcaacaca

SEQ ID NO: 3539987 - RNA, 16 nt, Human
aagaagcaaauaaaua

SEQ ID NO: 3539988 - RNA, 14 nt, Human
aagaagcaaauuuu

SEQ ID NO: 3539989 - RNA, 16 nt, Human
aagaagcaaggaacca

SEQ ID NO: 3539990 - RNA, 12 nt, Human
aagaagcagaga

SEQ ID NO: 3539991 - RNA, 22 nt, Human
aagaagcaguggccuuauugca

SEQ ID NO: 3539992 - RNA, 22 nt, Human
aagaagcauuuuguaaguugaa

SEQ ID NO: 3539993 - RNA, 15 nt, Human
aagaagcccccagcu

SEQ ID NO: 3539994 - RNA, 19 nt, Human
aagaagcccggcuccuggu

SEQ ID NO: 3539995 - RNA, 14 nt, Human
aagaagcucucucc

SEQ ID NO: 3539996 - RNA, 21 nt, Human
aagaagcuguuguacauuuau

SEQ ID NO: 3539997 - RNA, 23 nt, Human
aagaagcuguuguacauuuauga

SEQ ID NO: 3539998 - RNA, 15 nt, Human
aagaagcuucuaaua

SEQ ID NO: 3539999 - RNA, 21 nt, Human
aagaagcuuuaauauuuaaau

SEQ ID NO: 3540000 - RNA, 17 nt, Human
aagaaggaaaaggcagg

SEQ ID NO: 3540001 - RNA, 23 nt, Human
aagaaggaaaaugaucugagucc

SEQ ID NO: 3540002 - RNA, 14 nt, Human
aagaaggaaagaug

SEQ ID NO: 3540003 - RNA, 15 nt, Human
aagaaggcaaaaaua

SEQ ID NO: 3540004 - RNA, 22 nt, Human
aagaagggcugcaugauguuug

SEQ ID NO: 3540005 - RNA, 21 nt, Human
aagaaggggacaauggcagaa

SEQ ID NO: 3540006 - RNA, 17 nt, Human
aagaaggguccuucccu

SEQ ID NO: 3540007 - RNA, 24 nt, Human
aagaaggguccuucccucucccca

SEQ ID NO: 3540008 - RNA, 16 nt, Human
aagaagguggaccuuu

SEQ ID NO: 3540009 - RNA, 23 nt, Human
aagaagguuucagaaagaagugg

SEQ ID NO: 3540010 - RNA, 14 nt, Human
aagaaguaaaagca

SEQ ID NO: 3540011 - RNA, 20 nt, Human
aagaaguaggggaagacaug

SEQ ID NO: 3540012 - RNA, 21 nt, Human
aagaagugaguguuucuauga

SEQ ID NO: 3540013 - RNA, 19 nt, Human
aagaaguguccgagaacua

SEQ ID NO: 3540014 - RNA, 19 nt, Human
aagaagugugucacccuua

SEQ ID NO: 3540015 - RNA, 15 nt, Human
aagaaguuucaucau

SEQ ID NO: 3540016 - RNA, 21 nt, Human
aagaauaaaauguugaaaagu

SEQ ID NO: 3540017 - RNA, 16 nt, Human
aagaauaaaggcagcu

SEQ ID NO: 3540018 - RNA, 12 nt, Human
aagaauaauaaa

SEQ ID NO: 3540019 - RNA, 14 nt, Human
aagaauaauaaaau

SEQ ID NO: 3540020 - RNA, 15 nt, Human
aagaauaauaaaauc

SEQ ID NO: 3540021 - RNA, 23 nt, Human
aagaauaaucacgcuuuccugaa

SEQ ID NO: 3540022 - RNA, 11 nt, Human
aagaauaauuu

SEQ ID NO: 3540023 - RNA, 18 nt, Human
aagaauaauuuauaguaa

SEQ ID NO: 3540024 - RNA, 20 nt, Human
aagaauaauuuauaguaaug

SEQ ID NO: 3540025 - RNA, 13 nt, Human
aagaauacagaaa

SEQ ID NO: 3540026 - RNA, 22 nt, Human
aagaauacuucucauuuuuuaa

SEQ ID NO: 3540027 - RNA, 17 nt, Human
aagaauacuugaacuug

SEQ ID NO: 3540028 - RNA, 11 nt, Human
aagaauagaac

SEQ ID NO: 3540029 - RNA, 20 nt, Human
aagaauagccuagauaugaa

SEQ ID NO: 3540030 - RNA, 17 nt, Human
aagaauagcuuuaauga

SEQ ID NO: 3540031 - RNA, 16 nt, Human
ucaguccauuuauaua

SEQ ID NO: 3540032 - RNA, 17 nt, Human
ucagucccaucagagag

SEQ ID NO: 3540033 - RNA, 23 nt, Human
ucaguccccucccaucugggagu

SEQ ID NO: 3540034 - RNA, 17 nt, Human
ucagucccuauguauuu

SEQ ID NO: 3540035 - RNA, 23 nt, Human
ucagucccuauguauuugcaguu

SEQ ID NO: 3540036 - RNA, 19 nt, Human
ucaguccuccccucacagc

SEQ ID NO: 3540037 - RNA, 22 nt, Human
uccaaacaugguuuauugguga

SEQ ID NO: 3540038 - RNA, 16 nt, Human
uccaaaccaaauaaaa

SEQ ID NO: 3540039 - RNA, 23 nt, Human
uccaaaccuucacacacagacug

SEQ ID NO: 3540040 - RNA, 16 nt, Human
uccaaacuaauuuuua

SEQ ID NO: 3540041 - RNA, 19 nt, Human
uccaaacugaagcagccuc

SEQ ID NO: 3540042 - RNA, 20 nt, Human
uccaaacugccuaagcccuc

SEQ ID NO: 3540043 - RNA, 17 nt, Human
uccaaacuggaaugagc

SEQ ID NO: 3540044 - RNA, 13 nt, Human
uccaaagaaaguu

SEQ ID NO: 3540045 - RNA, 13 nt, Human
uccaaagaauguu

SEQ ID NO: 3540046 - RNA, 20 nt, Human
uccaaagaguagaauugcau

SEQ ID NO: 3540047 - RNA, 11 nt, Human
uccaaagcaaa

SEQ ID NO: 3540048 - RNA, 19 nt, Human
uccaaagcaaaaccagaac

SEQ ID NO: 3540049 - RNA, 17 nt, Human
uccaaagcuuuccugga

SEQ ID NO: 3540050 - RNA, 22 nt, Human
uccaaaggaggauggcauauaa

SEQ ID NO: 3540051 - RNA, 13 nt, Human
uccaaaggaggcu

SEQ ID NO: 3540052 - RNA, 13 nt, Human
uccaaaguacacu

SEQ ID NO: 3540053 - RNA, 15 nt, Human
uccaaagucauaauu

SEQ ID NO: 3540054 - RNA, 14 nt, Human
uccaaagucucuaa

SEQ ID NO: 3540055 - RNA, 15 nt, Human
uccaaauaauaaagu

SEQ ID NO: 3540056 - RNA, 17 nt, Human
uccaaauacuaaugaaa

SEQ ID NO: 3540057 - RNA, 16 nt, Human
uccaaaugaaugaccu

SEQ ID NO: 3540058 - RNA, 20 nt, Human
uccaaauggcgucuggaagu

SEQ ID NO: 3540059 - RNA, 17 nt, Human
uccaaauuauuucuuaa

SEQ ID NO: 3540060 - RNA, 14 nt, Human
uccaaauucaguuu

SEQ ID NO: 3540061 - RNA, 16 nt, Human
uccaaauucaguuuca

SEQ ID NO: 3540062 - RNA, 18 nt, Human
uccaaauucaguuucaua

SEQ ID NO: 3540063 - RNA, 15 nt, Human
uccaaauugugcuuc

SEQ ID NO: 3540064 - RNA, 22 nt, Human
uccaaauugugcuucuccccag

SEQ ID NO: 3540065 - RNA, 23 nt, Human
uccaacaccaagcacagcagccu

SEQ ID NO: 3540066 - RNA, 19 nt, Human
uccaacaccacagacacac

SEQ ID NO: 3540067 - RNA, 21 nt, Human
uccaacaccacagacacacac

SEQ ID NO: 3540068 - RNA, 17 nt, Human
uccaacagaacuaaaug

SEQ ID NO: 3540069 - RNA, 15 nt, Human
uccaacaguuuaaug

SEQ ID NO: 3540070 - RNA, 15 nt, Human
uccaacauccacucu

SEQ ID NO: 3540071 - RNA, 16 nt, Human
uccaaccagaccugga

SEQ ID NO: 3540072 - RNA, 19 nt, Human
uccaaccccaacuccagua

SEQ ID NO: 3540073 - RNA, 17 nt, Human
uccaaccccccaccugc

SEQ ID NO: 3540074 - RNA, 14 nt, Human
uccaaccccccagc

SEQ ID NO: 3540075 - RNA, 18 nt, Human
uccaaccccccagcacug

SEQ ID NO: 3540076 - RNA, 21 nt, Human
uccaaccccccagcacugagg

SEQ ID NO: 3540077 - RNA, 13 nt, Human
uccaaccccucgc

SEQ ID NO: 3540078 - RNA, 14 nt, Human
uccaaccccucgcc

SEQ ID NO: 3540079 - RNA, 19 nt, Human
uccaaccccucgcccaguc

SEQ ID NO: 3540080 - RNA, 12 nt, Human
uccaacccugcc

SEQ ID NO: 3540081 - RNA, 13 nt, Human
uccaacccugccg

SEQ ID NO: 3540082 - RNA, 21 nt, Human
uccaacccugccgucaccacc

SEQ ID NO: 3540083 - RNA, 22 nt, Human
uccaacccugccgucaccacca

SEQ ID NO: 3540084 - RNA, 20 nt, Human
uccaaccuaaccccuuuccu

SEQ ID NO: 3540085 - RNA, 17 nt, Human
uccccuugggcggcuga

SEQ ID NO: 3540086 - RNA, 20 nt, Human
uccccuugucugaacuggag

SEQ ID NO: 3540087 - RNA, 21 nt, Human
uccccuuguuugucccuucua

SEQ ID NO: 3540088 - RNA, 17 nt, Human
uccccuuuccuguccca

SEQ ID NO: 3540089 - RNA, 16 nt, Human
uccccuuucgcccaca

SEQ ID NO: 3540090 - RNA, 24 nt, Human
uccccuuugcuucauucaagucag

SEQ ID NO: 3540091 - RNA, 22 nt, Human
uccccuuuucuuuucuacccua

SEQ ID NO: 3540092 - RNA, 23 nt, Human
ucccgaaccccaaggagggagau

SEQ ID NO: 3540093 - RNA, 20 nt, Human
ucccgaagaauggagaggaa

SEQ ID NO: 3540094 - RNA, 15 nt, Human
ucccgaguacagucu

SEQ ID NO: 3540095 - RNA, 16 nt, Human
ucccgaguacagucug

SEQ ID NO: 3540096 - RNA, 15 nt, Human
ucccgaguagcuggg

SEQ ID NO: 3540097 - RNA, 18 nt, Human
ucccgaguagcugggacu

SEQ ID NO: 3540098 - RNA, 20 nt, Human
ucccgaguagcugggacuac

SEQ ID NO: 3540099 - RNA, 15 nt, Human
ucccgagucugggac

SEQ ID NO: 3540100 - RNA, 21 nt, Human
ucccgcaaacccccuuugugc

SEQ ID NO: 3540101 - RNA, 23 nt, Human
ucccgcaucaaggucagcaugag

SEQ ID NO: 3540102 - RNA, 18 nt, Human
ucccgccagacuguuaga

SEQ ID NO: 3540103 - RNA, 17 nt, Human
ucccgccagagggcuug

SEQ ID NO: 3540104 - RNA, 19 nt, Human
ucccgcccaaaccuuuccc

SEQ ID NO: 3540105 - RNA, 20 nt, Human
ucccgcccaaaccuuucccc

SEQ ID NO: 3540106 - RNA, 16 nt, Human
ucccgccccccacacu

SEQ ID NO: 3540107 - RNA, 19 nt, Human
ucccgccccccacacuucc

SEQ ID NO: 3540108 - RNA, 21 nt, Human
ucccgccccuucccacucacc

SEQ ID NO: 3540109 - RNA, 21 nt, Human
ucccgccuccaaccccucgcc

SEQ ID NO: 3540110 - RNA, 16 nt, Human
ucccgcucagcccucc

SEQ ID NO: 3540111 - RNA, 15 nt, Human
ucccgcugcugcugc

SEQ ID NO: 3540112 - RNA, 17 nt, Human
ucccggcacuccaugcu

SEQ ID NO: 3540113 - RNA, 23 nt, Human
ucccggcaugggaaagccaccuc

SEQ ID NO: 3540114 - RNA, 15 nt, Human
ucccggcccugccug

SEQ ID NO: 3540115 - RNA, 13 nt, Human
ucccggcugcccu

SEQ ID NO: 3540116 - RNA, 14 nt, Human
ucccggcugcccuu

SEQ ID NO: 3540117 - RNA, 15 nt, Human
ucccggcugcccuuu

SEQ ID NO: 3540118 - RNA, 16 nt, Human
ucccggcuuuggugcg

SEQ ID NO: 3540119 - RNA, 14 nt, Human
ucccgggacucugc

SEQ ID NO: 3540120 - RNA, 14 nt, Human
ucccggggcuccac

SEQ ID NO: 3540121 - RNA, 16 nt, Human
ucccgguucuuccagu

SEQ ID NO: 3540122 - RNA, 17 nt, Human
ucccgucuacucauucc

SEQ ID NO: 3540123 - RNA, 13 nt, Human
ucccguggcccca

SEQ ID NO: 3540124 - RNA, 18 nt, Human
ucccguggccccagccug

SEQ ID NO: 3540125 - RNA, 22 nt, Human
ucccguggccccagccuggccc

SEQ ID NO: 3540126 - RNA, 24 nt, Human
ucccguggccccagccuggcccag

SEQ ID NO: 3540127 - RNA, 23 nt, Human
ucccguuuagaguuauuuaggcu

SEQ ID NO: 3540128 - RNA, 20 nt, Human
ucccguuucuccaccuagac

SEQ ID NO: 3540129 - RNA, 13 nt, Human
ucccuaaacugua

SEQ ID NO: 3540130 - RNA, 13 nt, Human
ucccuaagccagc

SEQ ID NO: 3540131 - RNA, 13 nt, Human
ucccuaauaaagc

SEQ ID NO: 3540132 - RNA, 16 nt, Human
ucccuaaucuaugguc

SEQ ID NO: 3540133 - RNA, 23 nt, Human
ucccuaaucuauggucgggagac

SEQ ID NO: 3540134 - RNA, 20 nt, Human
ucccuaaugcugcagauuug

SEQ ID NO: 3540135 - RNA, 20 nt, Human
ucccuaauuuaacccagcuc

SEQ ID NO: 3540136 - RNA, 24 nt, Human
ucccuacauguauugcacauugua

SEQ ID NO: 3540137 - RNA, 13 nt, Human
ucccuaccaccuc

SEQ ID NO: 3540138 - RNA, 15 nt, Human
ucccuaccgacccag

SEQ ID NO: 3540139 - RNA, 22 nt, Human
ucccuaccgagucucuucucca

SEQ ID NO: 3540140 - RNA, 11 nt, Human
ucccuaccuca

SEQ ID NO: 3540141 - RNA, 20 nt, Human
ucccuaccucaaccuguaaa

SEQ ID NO: 3540142 - RNA, 22 nt, Human
ucccuaccucaaccuguaaauu

SEQ ID NO: 3540143 - RNA, 19 nt, Human
ucccuagaaacuuccaaau

SEQ ID NO: 3540144 - RNA, 13 nt, Human
ucccuagacuuua

SEQ ID NO: 3540145 - RNA, 14 nt, Human
ucccuagacuuuag

SEQ ID NO: 3540146 - RNA, 17 nt, Human
ucccuagaggguuccug

SEQ ID NO: 3540147 - RNA, 18 nt, Human
ucccuagaggguuccugu

SEQ ID NO: 3540148 - RNA, 16 nt, Human
ucccuagcagugaacu

SEQ ID NO: 3540149 - RNA, 22 nt, Human
ucccuagcuuuagacccugggu

SEQ ID NO: 3540150 - RNA, 15 nt, Human
ucccuagggcugggu

SEQ ID NO: 3540151 - RNA, 18 nt, Human
ucccuaggggacacuucc

SEQ ID NO: 3540152 - RNA, 17 nt, Human
ucccuagucuauucauu

SEQ ID NO: 3540153 - RNA, 15 nt, Human
ucccuauacugcuug

SEQ ID NO: 3540154 - RNA, 18 nt, Human
ucccuauguauuugcagu

SEQ ID NO: 3540155 - RNA, 18 nt, Human
ucccuauuagagaagaga

SEQ ID NO: 3540156 - RNA, 18 nt, Human
ucccuauuuuucucuccu

SEQ ID NO: 3540157 - RNA, 20 nt, Human
ucccuauuuuucucuccugu

SEQ ID NO: 3540158 - RNA, 21 nt, Human
ucccuauuuuuuuucuguuau

SEQ ID NO: 3540159 - RNA, 22 nt, Human
ucccuauuuuuuuucuguuaua

SEQ ID NO: 3540160 - RNA, 18 nt, Human
ucccucaacaagggagag

SEQ ID NO: 3540161 - RNA, 22 nt, Human
ucccucaacaagggagagaccu

SEQ ID NO: 3540162 - RNA, 16 nt, Human
ucccucaauucccccu

SEQ ID NO: 3540163 - RNA, 13 nt, Human
ucccucacaagug

SEQ ID NO: 3540164 - RNA, 10 nt, Human
ucccucaccc

SEQ ID NO: 3540165 - RNA, 17 nt, Human
ucccucacccacccaca

SEQ ID NO: 3540166 - RNA, 12 nt, Human
ucccucaccccc

SEQ ID NO: 3540167 - RNA, 20 nt, Human
ucccucacccccucccaccc

SEQ ID NO: 3540168 - RNA, 23 nt, Human
ucccucacccccucccaccccca

SEQ ID NO: 3540169 - RNA, 19 nt, Human
ucccucacccugagccccu

SEQ ID NO: 3540170 - RNA, 12 nt, Human
ucccucaccugu

SEQ ID NO: 3540171 - RNA, 20 nt, Human
ucccucaccuguagcagcca

SEQ ID NO: 3540172 - RNA, 14 nt, Human
ucccucaccuucug

SEQ ID NO: 3540173 - RNA, 15 nt, Human
ucccucaccuuggca

SEQ ID NO: 3540174 - RNA, 20 nt, Human
ucccucaccuuggcaccaga

SEQ ID NO: 3540175 - RNA, 18 nt, Human
ucccucacucgucucccc

SEQ ID NO: 3540176 - RNA, 20 nt, Human
ucccucacucgucuccccca

SEQ ID NO: 3540177 - RNA, 15 nt, Human
ucccucacucucagg

SEQ ID NO: 3540178 - RNA, 17 nt, Human
ucccucacucucaggaa

SEQ ID NO: 3540179 - RNA, 14 nt, Human
ucccucagacuggg

SEQ ID NO: 3540180 - RNA, 16 nt, Human
ucccucagacuggggc

SEQ ID NO: 3540181 - RNA, 20 nt, Human
uccacucuacccucccaccc

SEQ ID NO: 3540182 - RNA, 21 nt, Human
uccacucuacccucccacccc

SEQ ID NO: 3540183 - RNA, 18 nt, Human
uccacucugauagaauua

SEQ ID NO: 3540184 - RNA, 23 nt, Human
uccacucugcuucucugacuucu

SEQ ID NO: 3540185 - RNA, 20 nt, Human
uccacucuggauucagccuu

SEQ ID NO: 3540186 - RNA, 21 nt, Human
uccacucuggauucagccuuc

SEQ ID NO: 3540187 - RNA, 22 nt, Human
uccacucuggauucagccuucu

SEQ ID NO: 3540188 - RNA, 13 nt, Human
uccacugagcucc

SEQ ID NO: 3540189 - RNA, 18 nt, Human
uccacugccucugccuua

SEQ ID NO: 3540190 - RNA, 17 nt, Human
uccacuggacuugagcu

SEQ ID NO: 3540191 - RNA, 22 nt, Human
uccacuggccggagucagugcc

SEQ ID NO: 3540192 - RNA, 18 nt, Human
uccacuggggauugggcc

SEQ ID NO: 3540193 - RNA, 17 nt, Human
uccacugugccuuugca

SEQ ID NO: 3540194 - RNA, 12 nt, Human
uccacuguguau

SEQ ID NO: 3540195 - RNA, 16 nt, Human
uccacuuauagccucu

SEQ ID NO: 3540196 - RNA, 20 nt, Human
uccacuuauagccucugucu

SEQ ID NO: 3540197 - RNA, 22 nt, Human
uccacuuauagccucugucugg

SEQ ID NO: 3540198 - RNA, 23 nt, Human
uccacuuauagccucugucuggc

SEQ ID NO: 3540199 - RNA, 13 nt, Human
uccacuuggucug

SEQ ID NO: 3540200 - RNA, 16 nt, Human
uccacuuggucuguga

SEQ ID NO: 3540201 - RNA, 17 nt, Human
uccacuuggucugugag

SEQ ID NO: 3540202 - RNA, 17 nt, Human
uccacuuuaucuugaau

SEQ ID NO: 3540203 - RNA, 14 nt, Human
uccacuuucuagcc

SEQ ID NO: 3540204 - RNA, 18 nt, Human
uccacuuuguuucguggg

SEQ ID NO: 3540205 - RNA, 13 nt, Human
uccagaaaacaaa

SEQ ID NO: 3540206 - RNA, 21 nt, Human
uccagaaacggccauucagca

SEQ ID NO: 3540207 - RNA, 15 nt, Human
uccagaaacuuguuc

SEQ ID NO: 3540208 - RNA, 20 nt, Human
uccagaaagccccacccagg

SEQ ID NO: 3540209 - RNA, 17 nt, Human
uccagaaaggauauuua

SEQ ID NO: 3540210 - RNA, 19 nt, Human
uccagaaaggauauuuaag

SEQ ID NO: 3540211 - RNA, 23 nt, Human
uccagaaaggauauuuaagaaaa

SEQ ID NO: 3540212 - RNA, 16 nt, Human
uccagaaaugucccuu

SEQ ID NO: 3540213 - RNA, 16 nt, Human
uccagaacucuuccuc

SEQ ID NO: 3540214 - RNA, 18 nt, Human
uccagaacucuuccucca

SEQ ID NO: 3540215 - RNA, 20 nt, Human
uccagaagaagagaagcugc

SEQ ID NO: 3540216 - RNA, 18 nt, Human
uccagaagaauauucagg

SEQ ID NO: 3540217 - RNA, 22 nt, Human
uccagaagaauauucaggacuu

SEQ ID NO: 3540218 - RNA, 21 nt, Human
uccagaagggguuuggucugg

SEQ ID NO: 3540219 - RNA, 15 nt, Human
uccagaagugugauu

SEQ ID NO: 3540220 - RNA, 22 nt, Human
uccagaaguuugagaucagccu

SEQ ID NO: 3540221 - RNA, 14 nt, Human
uccagaauaucugg

SEQ ID NO: 3540222 - RNA, 19 nt, Human
uccagaaucuaaagccagu

SEQ ID NO: 3540223 - RNA, 13 nt, Human
uccagaaugcugu

SEQ ID NO: 3540224 - RNA, 15 nt, Human
uccagaaugcuguac

SEQ ID NO: 3540225 - RNA, 17 nt, Human
uccagaaugcuguacau

SEQ ID NO: 3540226 - RNA, 21 nt, Human
uccagaaugcuguacaucuau

SEQ ID NO: 3540227 - RNA, 15 nt, Human
uccagaauuucccaa

SEQ ID NO: 3540228 - RNA, 19 nt, Human
uccagacaaaccagaagca

SEQ ID NO: 3540229 - RNA, 17 nt, Human
uccagacccccaccccu

SEQ ID NO: 3540230 - RNA, 22 nt, Human
uccagacccccaccccuucccc

SEQ ID NO: 3540231 - RNA, 23 nt, Human
uccagaccccuggcuuuucacug

SEQ ID NO: 3540232 - RNA, 15 nt, Human
uccagacccggcugc

SEQ ID NO: 3540233 - RNA, 18 nt, Human
uccagacccggcugcgug

SEQ ID NO: 3540234 - RNA, 16 nt, Human
uccagaccugaagaau

SEQ ID NO: 3540235 - RNA, 19 nt, Human
uccagaccugauccuggag

SEQ ID NO: 3540236 - RNA, 20 nt, Human
uccagacuuccuugagacac

SEQ ID NO: 3540237 - RNA, 19 nt, Human
uccagagaguccucuggau

SEQ ID NO: 3540238 - RNA, 16 nt, Human
uccagagaguggcucc

SEQ ID NO: 3540239 - RNA, 17 nt, Human
uccagagaguggcuccu

SEQ ID NO: 3540240 - RNA, 16 nt, Human
uccagagauucauuuu

SEQ ID NO: 3540241 - RNA, 18 nt, Human
uccagagauucauuuucu

SEQ ID NO: 3540242 - RNA, 23 nt, Human
uccagagauucauuuucuagaua

SEQ ID NO: 3540243 - RNA, 12 nt, Human
uccagagcauuc

SEQ ID NO: 3540244 - RNA, 21 nt, Human
uccagagcggaggcugugugc

SEQ ID NO: 3540245 - RNA, 15 nt, Human
uccagagcugccagu

SEQ ID NO: 3540246 - RNA, 15 nt, Human
uccagagcugcuucc

SEQ ID NO: 3540247 - RNA, 22 nt, Human
ucccucucccccuuaccccaca

SEQ ID NO: 3540248 - RNA, 14 nt, Human
ucccucucccuguc

SEQ ID NO: 3540249 - RNA, 13 nt, Human
ucccucuccugcc

SEQ ID NO: 3540250 - RNA, 15 nt, Human
ucccucuccugccua

SEQ ID NO: 3540251 - RNA, 16 nt, Human
ucccucucucauaccc

SEQ ID NO: 3540252 - RNA, 12 nt, Human
ucccucucucug

SEQ ID NO: 3540253 - RNA, 14 nt, Human
ucccucucucugga

SEQ ID NO: 3540254 - RNA, 20 nt, Human
ucccucucucuucugcucca

SEQ ID NO: 3540255 - RNA, 23 nt, Human
ucccucucucuucugcuccaccc

SEQ ID NO: 3540256 - RNA, 14 nt, Human
ucccucucuggaga

SEQ ID NO: 3540257 - RNA, 21 nt, Human
ucccucugagaauuccaagga

SEQ ID NO: 3540258 - RNA, 16 nt, Human
ucccucugaggcugua

SEQ ID NO: 3540259 - RNA, 19 nt, Human
ucccucugaggcuguagga

SEQ ID NO: 3540260 - RNA, 16 nt, Human
ucccucugcagucucu

SEQ ID NO: 3540261 - RNA, 15 nt, Human
ucccucugccccucc

SEQ ID NO: 3540262 - RNA, 21 nt, Human
ucccucugccugaaccuucca

SEQ ID NO: 3540263 - RNA, 16 nt, Human
ucccucugcucagcca

SEQ ID NO: 3540264 - RNA, 21 nt, Human
ucccucugcucagccaagcuu

SEQ ID NO: 3540265 - RNA, 16 nt, Human
ucccucuggcccugcc

SEQ ID NO: 3540266 - RNA, 17 nt, Human
ucccucuggcccugccu

SEQ ID NO: 3540267 - RNA, 18 nt, Human
ucccucuggcccugccuu

SEQ ID NO: 3540268 - RNA, 19 nt, Human
ucccucuggcccugccuuc

SEQ ID NO: 3540269 - RNA, 13 nt, Human
ucccucuggggcu

SEQ ID NO: 3540270 - RNA, 18 nt, Human
ucccucuguccaccagcc

SEQ ID NO: 3540271 - RNA, 12 nt, Human
ucccucuucacu

SEQ ID NO: 3540272 - RNA, 15 nt, Human
ucccucuucccucag

SEQ ID NO: 3540273 - RNA, 14 nt, Human
ucccucuucucaag

SEQ ID NO: 3540274 - RNA, 17 nt, Human
ucccucuucucaagugc

SEQ ID NO: 3540275 - RNA, 20 nt, Human
ucccucuucuuucagacuug

SEQ ID NO: 3540276 - RNA, 17 nt, Human
ucccucuuguuuuguuu

SEQ ID NO: 3540277 - RNA, 13 nt, Human
ucccucuuuucuu

SEQ ID NO: 3540278 - RNA, 16 nt, Human
ucccucuuuucuuacu

SEQ ID NO: 3540279 - RNA, 18 nt, Human
ucccucuuuucuuacucc

SEQ ID NO: 3540280 - RNA, 22 nt, Human
ucccucuuuucuuacuccuccu

SEQ ID NO: 3540281 - RNA, 17 nt, Human
ucccugaaaauguuuuu

SEQ ID NO: 3540282 - RNA, 15 nt, Human
ucccugaacugggac

SEQ ID NO: 3540283 - RNA, 16 nt, Human
ucccugaacugggacc

SEQ ID NO: 3540284 - RNA, 19 nt, Human
ucccugaagccagccuucu

SEQ ID NO: 3540285 - RNA, 15 nt, Human
ucccugaaggccccg

SEQ ID NO: 3540286 - RNA, 16 nt, Human
ucccugaaggccccgc

SEQ ID NO: 3540287 - RNA, 22 nt, Human
ucccugaaggccccgcccaggc

SEQ ID NO: 3540288 - RNA, 16 nt, Human
ucccugacccuguaua

SEQ ID NO: 3540289 - RNA, 17 nt, Human
ucccugacccuguauau

SEQ ID NO: 3540290 - RNA, 22 nt, Human
ucccugacccuguauauagccc

SEQ ID NO: 3540291 - RNA, 16 nt, Human
ucccugaccucccucu

SEQ ID NO: 3540292 - RNA, 14 nt, Human
ucccugacugggag

SEQ ID NO: 3540293 - RNA, 21 nt, Human
ucccugaggacugauuucaga

SEQ ID NO: 3540294 - RNA, 15 nt, Human
ucccugaggaugggu

SEQ ID NO: 3540295 - RNA, 22 nt, Human
ucccugaggaugggucagagcu

SEQ ID NO: 3540296 - RNA, 15 nt, Human
ucccugagucaccag

SEQ ID NO: 3540297 - RNA, 21 nt, Human
ucccugagucaccaggaaugu

SEQ ID NO: 3540298 - RNA, 15 nt, Human
ucccugauaaauauu

SEQ ID NO: 3540299 - RNA, 18 nt, Human
ucccugauugaccugcuc

SEQ ID NO: 3540300 - RNA, 22 nt, Human
ucccugcagaugccacccuagc

SEQ ID NO: 3540301 - RNA, 18 nt, Human
ucccugcaucugaccagc

SEQ ID NO: 3540302 - RNA, 20 nt, Human
ucccugcaucugaccagcag

SEQ ID NO: 3540303 - RNA, 15 nt, Human
ucccugccaaacuga

SEQ ID NO: 3540304 - RNA, 16 nt, Human
ucccugccccccagcc

SEQ ID NO: 3540305 - RNA, 14 nt, Human
ucccugccccuccc

SEQ ID NO: 3540306 - RNA, 16 nt, Human
ucccugcccucaucuc

SEQ ID NO: 3540307 - RNA, 23 nt, Human
ucccugccucaccucugccauuu

SEQ ID NO: 3540308 - RNA, 13 nt, Human
ucccugccuccug

SEQ ID NO: 3540309 - RNA, 23 nt, Human
ucccugccucucaucaacugaau

SEQ ID NO: 3540310 - RNA, 11 nt, Human
ucccugccugg

SEQ ID NO: 3540311 - RNA, 21 nt, Human
ucccugcgccugugaugcugg

SEQ ID NO: 3540312 - RNA, 17 nt, Human
ucccugcuccacgucug

SEQ ID NO: 3540313 - RNA, 21 nt, Human
ucccugcuguccccucuugcc

SEQ ID NO: 3540314 - RNA, 22 nt, Human
ucccugcuguccccucuugccc

SEQ ID NO: 3540315 - RNA, 19 nt, Human
ucccugcugucgucuuagc

SEQ ID NO: 3540316 - RNA, 16 nt, Human
ucccugcuguguuccc

SEQ ID NO: 3540317 - RNA, 18 nt, Human
ucccugcuuccaggaaac

SEQ ID NO: 3540318 - RNA, 20 nt, Human
ucccuggaaaccuuccaccc

SEQ ID NO: 3540319 - RNA, 22 nt, Human
ucccuggaaaccuuccacccag

SEQ ID NO: 3540320 - RNA, 22 nt, Human
ucccuggaaugaguugaggcca

SEQ ID NO: 3540321 - RNA, 11 nt, Human
ucccuggacca

SEQ ID NO: 3540322 - RNA, 18 nt, Human
ucccuggaccagaugcug

SEQ ID NO: 3540323 - RNA, 17 nt, Human
ucccuggagccagacuc

SEQ ID NO: 3540324 - RNA, 10 nt, Human
ucccuggagu

SEQ ID NO: 3540325 - RNA, 12 nt, Human
gcuuugauucau

SEQ ID NO: 3540326 - RNA, 17 nt, Human
gcuuugauuccaucucc

SEQ ID NO: 3540327 - RNA, 23 nt, Human
gcuuugcauguuccacuaacccc

SEQ ID NO: 3540328 - RNA, 22 nt, Human
gcuuugcauuccuacaaagaug

SEQ ID NO: 3540329 - RNA, 18 nt, Human
gcuuugcccaaccucagc

SEQ ID NO: 3540330 - RNA, 19 nt, Human
gcuuugcccaaccucagca

SEQ ID NO: 3540331 - RNA, 12 nt, Human
gcuuugcccagc

SEQ ID NO: 3540332 - RNA, 17 nt, Human
gcuuugcccuucuuucu

SEQ ID NO: 3540333 - RNA, 18 nt, Human
gcuuugccuuccacgcug

SEQ ID NO: 3540334 - RNA, 19 nt, Human
gcuuugcgugcccggggca

SEQ ID NO: 3540335 - RNA, 18 nt, Human
gcuuugcugcugaaggcu

SEQ ID NO: 3540336 - RNA, 17 nt, Human
gcuuuggacccaaggaa

SEQ ID NO: 3540337 - RNA, 17 nt, Human
gcuuuggaccuaaucca

SEQ ID NO: 3540338 - RNA, 19 nt, Human
gcuuuggacgcacacagcu

SEQ ID NO: 3540339 - RNA, 17 nt, Human
gcuuuggauuugacauu

SEQ ID NO: 3540340 - RNA, 14 nt, Human
gcuuugggcugccc

SEQ ID NO: 3540341 - RNA, 17 nt, Human
gcuuuggucacuuuuag

SEQ ID NO: 3540342 - RNA, 20 nt, Human
gcuuugguuauauuuagcuc

SEQ ID NO: 3540343 - RNA, 20 nt, Human
gcuuuguauagaaccucuuu

SEQ ID NO: 3540344 - RNA, 15 nt, Human
gcuuugucccacagc

SEQ ID NO: 3540345 - RNA, 15 nt, Human
gcuuuguccccugcu

SEQ ID NO: 3540346 - RNA, 22 nt, Human
gcuuuguggcacuggggcaggg

SEQ ID NO: 3540347 - RNA, 15 nt, Human
gcuuuguguuguaau

SEQ ID NO: 3540348 - RNA, 18 nt, Human
gcuuuguugugugccucu

SEQ ID NO: 3540349 - RNA, 20 nt, Human
gcuuuguuuggauguaauuu

SEQ ID NO: 3540350 - RNA, 14 nt, Human
gcuuuguuuugcac

SEQ ID NO: 3540351 - RNA, 17 nt, Human
gcuuuuaaaaaaaaaua

SEQ ID NO: 3540352 - RNA, 14 nt, Human
gcuuuuaaaacuac

SEQ ID NO: 3540353 - RNA, 16 nt, Human
gcuuuuaaaauuuuaa

SEQ ID NO: 3540354 - RNA, 17 nt, Human
gcuuuuaacuucugaua

SEQ ID NO: 3540355 - RNA, 15 nt, Human
gcuuuuaauuaaaua

SEQ ID NO: 3540356 - RNA, 13 nt, Human
gcuuuuagacaga

SEQ ID NO: 3540357 - RNA, 23 nt, Human
gcuuuuaguacccaccugagcuu

SEQ ID NO: 3540358 - RNA, 21 nt, Human
gcuuuuaguauuuuagugaac

SEQ ID NO: 3540359 - RNA, 18 nt, Human
gcuuuuauaucuguaugu

SEQ ID NO: 3540360 - RNA, 13 nt, Human
gcuuuuaugugaa

SEQ ID NO: 3540361 - RNA, 19 nt, Human
gcuuuuaugugaaacaugu

SEQ ID NO: 3540362 - RNA, 15 nt, Human
gcuuuuauuaaauuu

SEQ ID NO: 3540363 - RNA, 14 nt, Human
gcuuuucacugcug

SEQ ID NO: 3540364 - RNA, 16 nt, Human
gcuuuucacugcugca

SEQ ID NO: 3540365 - RNA, 18 nt, Human
gcuuuucacugcuggcug

SEQ ID NO: 3540366 - RNA, 18 nt, Human
gcuuuuccccggucccuu

SEQ ID NO: 3540367 - RNA, 12 nt, Human
gcuuuucccucu

SEQ ID NO: 3540368 - RNA, 17 nt, Human
gcuuuucccucuuuucu

SEQ ID NO: 3540369 - RNA, 16 nt, Human
gcuuuucccuuuguga

SEQ ID NO: 3540370 - RNA, 22 nt, Human
gcuuuuccucaaagggagagag

SEQ ID NO: 3540371 - RNA, 15 nt, Human
gcuuuuccucccuug

SEQ ID NO: 3540372 - RNA, 14 nt, Human
gcuuuuccuugggg

SEQ ID NO: 3540373 - RNA, 22 nt, Human
gcuuuuccuuggggcaggcagu

SEQ ID NO: 3540374 - RNA, 13 nt, Human
gcuuuucuccucu

SEQ ID NO: 3540375 - RNA, 17 nt, Human
gcuuuucuccucuuucc

SEQ ID NO: 3540376 - RNA, 15 nt, Human
gcuuuucugauccag

SEQ ID NO: 3540377 - RNA, 16 nt, Human
gcuuuucugauccagu

SEQ ID NO: 3540378 - RNA, 19 nt, Human
gcuuuucugcccuggcugc

SEQ ID NO: 3540379 - RNA, 13 nt, Human
gcuuuugaaaucu

SEQ ID NO: 3540380 - RNA, 21 nt, Human
gcuuuugcccauuuugaauca

SEQ ID NO: 3540381 - RNA, 15 nt, Human
gcuuuugcuggucac

SEQ ID NO: 3540382 - RNA, 19 nt, Human
gcuuuugcuggucacugcc

SEQ ID NO: 3540383 - RNA, 21 nt, Human
gcuuuugcuggucacugccau

SEQ ID NO: 3540384 - RNA, 11 nt, Human
gcuuuuggcaa

SEQ ID NO: 3540385 - RNA, 12 nt, Human
gcuuuuggccug

SEQ ID NO: 3540386 - RNA, 14 nt, Human
gcuuuuggccugga

SEQ ID NO: 3540387 - RNA, 22 nt, Human
gcuuuuggcggggaggaggaaa

SEQ ID NO: 3540388 - RNA, 15 nt, Human
gcuuuuggucugugu

SEQ ID NO: 3540389 - RNA, 20 nt, Human
gcuuuugucuaauuaaaaca

SEQ ID NO: 3540390 - RNA, 20 nt, Human
gcuuuugucuacacacccug

SEQ ID NO: 3540391 - RNA, 21 nt, Human
gcuuuugugggggacuguaag

SEQ ID NO: 3540392 - RNA, 17 nt, Human
gcuuuuuaaaacauuag

SEQ ID NO: 3540393 - RNA, 13 nt, Human
gcuuuuuaauuaa

SEQ ID NO: 3540394 - RNA, 13 nt, Human
gcuuuuuaauugu

SEQ ID NO: 3540395 - RNA, 12 nt, Human
gcuuuuuauaaa

SEQ ID NO: 3540396 - RNA, 19 nt, Human
gcuuuuuauuccuccugcu

SEQ ID NO: 3540397 - RNA, 11 nt, Human
gcuuuuucuga

SEQ ID NO: 3540398 - RNA, 12 nt, Human
gcuuuuucugac

SEQ ID NO: 3540399 - RNA, 14 nt, Human
gcuuuuucugacuc

SEQ ID NO: 3540400 - RNA, 14 nt, Human
gcuuuuugaaauga

SEQ ID NO: 3540401 - RNA, 13 nt, Human
gcuuuuuggaauc

SEQ ID NO: 3540402 - RNA, 14 nt, Human
gcuuuuugguguau

SEQ ID NO: 3540403 - RNA, 16 nt, Human
gcuuuuugucuuuucu

SEQ ID NO: 3540404 - RNA, 17 nt, Human
gcuuuuuuccaaaacaa

SEQ ID NO: 3540405 - RNA, 13 nt, Human
gcuuuuuuugaaa

SEQ ID NO: 3540406 - RNA, 22 nt, Human
gcuuuuuuuguguguauuugcu

SEQ ID NO: 3540407 - RNA, 17 nt, Human
gcuuuuuuuuuuccagc

SEQ ID NO: 3540408 - RNA, 21 nt, Human
gcuuuuuuuuuuccagcaagu

SEQ ID NO: 3540409 - RNA, 16 nt, Human
gcuuuuuuuuuuuaau

SEQ ID NO: 3540410 - RNA, 20 nt, Human
gcuuuuuuuuuuuaauuuug

SEQ ID NO: 3540411 - RNA, 23 nt, Human
ggaaaaaaacuuuuauaaauuaa

SEQ ID NO: 3540412 - RNA, 12 nt, Human
ggaaaaaaagac

SEQ ID NO: 3540413 - RNA, 14 nt, Human
ggaaaaaaaugacu

SEQ ID NO: 3540414 - RNA, 12 nt, Human
ggaaaaaaaugu

SEQ ID NO: 3540415 - RNA, 15 nt, Human
ggaaaaaauaacaau

SEQ ID NO: 3540416 - RNA, 19 nt, Human
ggaaaaaauguuggauuua

SEQ ID NO: 3540417 - RNA, 14 nt, Human
ggaaaaacugauuu

SEQ ID NO: 3540418 - RNA, 17 nt, Human
ggaaaaacuuuggaacc

SEQ ID NO: 3540419 - RNA, 23 nt, Human
ggaaaaagcaaguucgucuguug

SEQ ID NO: 3540420 - RNA, 23 nt, Human
ggaaaaaggacaggcagaaagag

SEQ ID NO: 3540421 - RNA, 21 nt, Human
ggaaaaaguaucauggaaaua

SEQ ID NO: 3540422 - RNA, 15 nt, Human
ggaaaaauagccugc

SEQ ID NO: 3540423 - RNA, 14 nt, Human
ggaaaaauauuuaa

SEQ ID NO: 3540424 - RNA, 15 nt, Human
ggaaaaauauuuaag

SEQ ID NO: 3540425 - RNA, 18 nt, Human
ggaaaacagacucagguu

SEQ ID NO: 3540426 - RNA, 23 nt, Human
ggaaaagaaaaaaaaaagaagaa

SEQ ID NO: 3540427 - RNA, 17 nt, Human
ggaaaagaaagaaguua

SEQ ID NO: 3540428 - RNA, 13 nt, Human
ggaaaagaaaucu

SEQ ID NO: 3540429 - RNA, 14 nt, Human
ggaaaagaauacag

SEQ ID NO: 3540430 - RNA, 21 nt, Human
ggaaaagaggaguuucgaggu

SEQ ID NO: 3540431 - RNA, 10 nt, Human
ggaaaagcuu

SEQ ID NO: 3540432 - RNA, 20 nt, Human
ggaaaaggcagggagcgagg

SEQ ID NO: 3540433 - RNA, 15 nt, Human
ggaaaaggcauauau

SEQ ID NO: 3540434 - RNA, 20 nt, Human
ggaaaagguugaauaauaua

SEQ ID NO: 3540435 - RNA, 18 nt, Human
ggaaaaguuuaauauuaa

SEQ ID NO: 3540436 - RNA, 21 nt, Human
ggaaaauaaaaaaagaaaaaa

SEQ ID NO: 3540437 - RNA, 14 nt, Human
ggaaaauaaauuau

SEQ ID NO: 3540438 - RNA, 19 nt, Human
ggaaaauaggcaggaagcc

SEQ ID NO: 3540439 - RNA, 16 nt, Human
ggaaaauauguccaua

SEQ ID NO: 3540440 - RNA, 12 nt, Human
ggaaaauauuuu

SEQ ID NO: 3540441 - RNA, 15 nt, Human
ggaaaaucagccugc

SEQ ID NO: 3540442 - RNA, 18 nt, Human
ggaaaauucuaacccagg

SEQ ID NO: 3540443 - RNA, 14 nt, Human
ggaaacaaagcuua

SEQ ID NO: 3540444 - RNA, 16 nt, Human
ggaaacaacagcuuua

SEQ ID NO: 3540445 - RNA, 22 nt, Human
ggaaacagacucgauucauauu

SEQ ID NO: 3540446 - RNA, 21 nt, Human
ggaaacagcaucuccaagcag

SEQ ID NO: 3540447 - RNA, 20 nt, Human
ggaaacagcuaaugggacac

SEQ ID NO: 3540448 - RNA, 14 nt, Human
ggaaacagucauuu

SEQ ID NO: 3540449 - RNA, 24 nt, Human
ggaaacccauaggcccacacacag

SEQ ID NO: 3540450 - RNA, 17 nt, Human
ggaaaccugcccugccu

SEQ ID NO: 3540451 - RNA, 22 nt, Human
ggaaaccugcccugccugaggg

SEQ ID NO: 3540452 - RNA, 17 nt, Human
ggaaacuaagauucuuu

SEQ ID NO: 3540453 - RNA, 22 nt, Human
uccucuagaagccaagggaaag

SEQ ID NO: 3540454 - RNA, 14 nt, Human
uccucuaggagguc

SEQ ID NO: 3540455 - RNA, 13 nt, Human
uccucucaauaaa

SEQ ID NO: 3540456 - RNA, 22 nt, Human
uccucucacuccccagccuggg

SEQ ID NO: 3540457 - RNA, 14 nt, Human
uccucucagccccu

SEQ ID NO: 3540458 - RNA, 16 nt, Human
uccucuccacugccuu

SEQ ID NO: 3540459 - RNA, 13 nt, Human
uccucucccaucc

SEQ ID NO: 3540460 - RNA, 15 nt, Human
uccucucccaucccc

SEQ ID NO: 3540461 - RNA, 17 nt, Human
uccucucccaucccccu

SEQ ID NO: 3540462 - RNA, 22 nt, Human
uccucucccauugucccucugc

SEQ ID NO: 3540463 - RNA, 15 nt, Human
uccucuccccagcaa

SEQ ID NO: 3540464 - RNA, 15 nt, Human
uccucuccccagccc

SEQ ID NO: 3540465 - RNA, 21 nt, Human
uccucuccccagcccagagac

SEQ ID NO: 3540466 - RNA, 17 nt, Human
uccucuccccaugaugu

SEQ ID NO: 3540467 - RNA, 17 nt, Human
uccucuccccuaccacu

SEQ ID NO: 3540468 - RNA, 18 nt, Human
uccucuccccuaccacug

SEQ ID NO: 3540469 - RNA, 20 nt, Human
uccucuccgcaguuccuguc

SEQ ID NO: 3540470 - RNA, 12 nt, Human
uccucuccugga

SEQ ID NO: 3540471 - RNA, 14 nt, Human
uccugauuccucuc

SEQ ID NO: 3540472 - RNA, 23 nt, Human
uccugauugguuucucuucuccc

SEQ ID NO: 3540473 - RNA, 20 nt, Human
uccugcaaccaaacucccau

SEQ ID NO: 3540474 - RNA, 18 nt, Human
uccugcaacucaaggacu

SEQ ID NO: 3540475 - RNA, 20 nt, Human
uccugcacaguuuucuggcu

SEQ ID NO: 3540476 - RNA, 19 nt, Human
uccugcaccggggccuggg

SEQ ID NO: 3540477 - RNA, 21 nt, Human
uccugcaccggggccugggca

SEQ ID NO: 3540478 - RNA, 17 nt, Human
uccugcacugacucugg

SEQ ID NO: 3540479 - RNA, 21 nt, Human
uccugcacugacucuggaaaa

SEQ ID NO: 3540480 - RNA, 13 nt, Human
uccugcagcaaac

SEQ ID NO: 3540481 - RNA, 16 nt, Human
uccugcagcagagccu

SEQ ID NO: 3540482 - RNA, 15 nt, Human
uccugcagccuccuc

SEQ ID NO: 3540483 - RNA, 19 nt, Human
uccugcagccuccuccuga

SEQ ID NO: 3540484 - RNA, 17 nt, Human
uccugcagccugcagga

SEQ ID NO: 3540485 - RNA, 17 nt, Human
uccugcagccuggaggc

SEQ ID NO: 3540486 - RNA, 13 nt, Human
uccugcaggcagc

SEQ ID NO: 3540487 - RNA, 14 nt, Human
uccugcaggcagcc

SEQ ID NO: 3540488 - RNA, 19 nt, Human
uccugcaggcagccaggcc

SEQ ID NO: 3540489 - RNA, 19 nt, Human
uccugcaggccaggccagc

SEQ ID NO: 3540490 - RNA, 20 nt, Human
uccugcaggccaggccagcu

SEQ ID NO: 3540491 - RNA, 23 nt, Human
uccugcauugggugaucauucac

SEQ ID NO: 3540492 - RNA, 16 nt, Human
uccugcauuugugaaa

SEQ ID NO: 3540493 - RNA, 16 nt, Human
uccugccacccagccc

SEQ ID NO: 3540494 - RNA, 20 nt, Human
uccugccacccagccccagc

SEQ ID NO: 3540495 - RNA, 14 nt, Human
uccugccagcccca

SEQ ID NO: 3540496 - RNA, 15 nt, Human
uccugccagccccac

SEQ ID NO: 3540497 - RNA, 21 nt, Human
uccugccagccccacacagcu

SEQ ID NO: 3540498 - RNA, 14 nt, Human
uccugccagccccu

SEQ ID NO: 3540499 - RNA, 20 nt, Human
uccugcccacugcugcagua

SEQ ID NO: 3540500 - RNA, 17 nt, Human
uccugcccaguccccca

SEQ ID NO: 3540501 - RNA, 14 nt, Human
uccugccccaggcc

SEQ ID NO: 3540502 - RNA, 15 nt, Human
uccugccccaggccu

SEQ ID NO: 3540503 - RNA, 16 nt, Human
uccugcccccacaccu

SEQ ID NO: 3540504 - RNA, 19 nt, Human
uccugcccccacaccuggc

SEQ ID NO: 3540505 - RNA, 20 nt, Human
uccugcccccacaccuggcc

SEQ ID NO: 3540506 - RNA, 23 nt, Human
uccugcccccacaccuggcccug

SEQ ID NO: 3540507 - RNA, 17 nt, Human
uccugcccccugaaacu

SEQ ID NO: 3540508 - RNA, 12 nt, Human
uccugccccucu

SEQ ID NO: 3540509 - RNA, 19 nt, Human
uccugccccucuuucucuu

SEQ ID NO: 3540510 - RNA, 17 nt, Human
uccugccccugagccca

SEQ ID NO: 3540511 - RNA, 16 nt, Human
uccugccccuguucuc

SEQ ID NO: 3540512 - RNA, 22 nt, Human
uccugcccgccacacagaccac

SEQ ID NO: 3540513 - RNA, 14 nt, Human
uccugcccuacaga

SEQ ID NO: 3540514 - RNA, 10 nt, Human
uccugcccug

SEQ ID NO: 3540515 - RNA, 15 nt, Human
uccugcccugggagg

SEQ ID NO: 3540516 - RNA, 12 nt, Human
uccugcccuguu

SEQ ID NO: 3540517 - RNA, 20 nt, Human
uccugcccuuaccugccagg

SEQ ID NO: 3540518 - RNA, 15 nt, Human
uccugcccuuccuca

SEQ ID NO: 3540519 - RNA, 13 nt, Human
uccugccgcagag

SEQ ID NO: 3540520 - RNA, 17 nt, Human
uccugccgcagagcugg

SEQ ID NO: 3540521 - RNA, 22 nt, Human
uccugccggagaggaagagaca

SEQ ID NO: 3540522 - RNA, 14 nt, Human
uccugccggcuccu

SEQ ID NO: 3540523 - RNA, 14 nt, Human
uccugccuccgccu

SEQ ID NO: 3540524 - RNA, 12 nt, Human
uccugccuggcc

SEQ ID NO: 3540525 - RNA, 14 nt, Human
uccugccuggucuc

SEQ ID NO: 3540526 - RNA, 17 nt, Human
uccugccuggucuccug

SEQ ID NO: 3540527 - RNA, 18 nt, Human
uccugccugucugaagcc

SEQ ID NO: 3540528 - RNA, 19 nt, Human
uccugccugucugccccag

SEQ ID NO: 3540529 - RNA, 12 nt, Human
uccugccugugc

SEQ ID NO: 3540530 - RNA, 22 nt, Human
uccugccuucuguccugguguc

SEQ ID NO: 3540531 - RNA, 16 nt, Human
uccugccuugaaaaag

SEQ ID NO: 3540532 - RNA, 18 nt, Human
uccugccuuugccuccag

SEQ ID NO: 3540533 - RNA, 17 nt, Human
uccugcgaggcuaugag

SEQ ID NO: 3540534 - RNA, 21 nt, Human
uccugcggagugaagaggggc

SEQ ID NO: 3540535 - RNA, 12 nt, Human
uccugcgggcuu

SEQ ID NO: 3540536 - RNA, 13 nt, Human
uccugcggguggg

SEQ ID NO: 3540537 - RNA, 13 nt, Human
uccugcguccucc

SEQ ID NO: 3540538 - RNA, 21 nt, Human
uccugcguccuccucaccuca

SEQ ID NO: 3540539 - RNA, 21 nt, Human
uccugcuaccucccuugccuu

SEQ ID NO: 3540540 - RNA, 18 nt, Human
uccugcuacucuguuccu

SEQ ID NO: 3540541 - RNA, 22 nt, Human
uccugcuauuucccaagcugga

SEQ ID NO: 3540542 - RNA, 13 nt, Human
uccugcucagcag

SEQ ID NO: 3540543 - RNA, 22 nt, Human
uccugcucauuaugccacuucc

SEQ ID NO: 3540544 - RNA, 14 nt, Human
uccugcuccacagc

SEQ ID NO: 3540545 - RNA, 12 nt, Human
uccugcuccaga

SEQ ID NO: 3540546 - RNA, 17 nt, Human
uccugcucucuacccag

SEQ ID NO: 3540547 - RNA, 19 nt, Human
uccugcucucuacccagcc

SEQ ID NO: 3540548 - RNA, 22 nt, Human
uccugcucucuacccagcccau

SEQ ID NO: 3540549 - RNA, 13 nt, Human
uccugcucugccc

SEQ ID NO: 3540550 - RNA, 13 nt, Human
uccugcugcacca

SEQ ID NO: 3540551 - RNA, 17 nt, Human
uccugcugcaccaaccc

SEQ ID NO: 3540552 - RNA, 21 nt, Human
uccugcugcagaggggcaggc

SEQ ID NO: 3540553 - RNA, 13 nt, Human
uccugcugcaguu

SEQ ID NO: 3540554 - RNA, 14 nt, Human
uccugcugcucccu

SEQ ID NO: 3540555 - RNA, 18 nt, Human
uccugcugcucccucaga

SEQ ID NO: 3540556 - RNA, 13 nt, Human
uccugcugcuguc

SEQ ID NO: 3540557 - RNA, 17 nt, Human
uccugcugcugucuggg

SEQ ID NO: 3540558 - RNA, 14 nt, Human
uccugcugcugugu

SEQ ID NO: 3540559 - RNA, 13 nt, Human
uccugcuuccuca

SEQ ID NO: 3540560 - RNA, 19 nt, Human
uccugcuugccaaggcaga

SEQ ID NO: 3540561 - RNA, 19 nt, Human
uccugcuuugcgugcccgg

SEQ ID NO: 3540562 - RNA, 16 nt, Human
uccuggaaaucagggu

SEQ ID NO: 3540563 - RNA, 14 nt, Human
uccuggaacaauau

SEQ ID NO: 3540564 - RNA, 16 nt, Human
uccuggaacaauauuu

SEQ ID NO: 3540565 - RNA, 20 nt, Human
uccuggaacaauauuuuaug

SEQ ID NO: 3540566 - RNA, 21 nt, Human
uccuggaacaauauuuuaugg

SEQ ID NO: 3540567 - RNA, 18 nt, Human
uccuggaaccuugcuguc

SEQ ID NO: 3540568 - RNA, 20 nt, Human
uccuggaaccuugcuguccu

SEQ ID NO: 3540569 - RNA, 19 nt, Human
uccuggacacucagaccug

SEQ ID NO: 3540570 - RNA, 14 nt, Human
uccuggacagcugu

SEQ ID NO: 3540571 - RNA, 15 nt, Human
uccuggacaggccag

SEQ ID NO: 3540572 - RNA, 17 nt, Human
uccuggacaggccaggu

SEQ ID NO: 3540573 - RNA, 21 nt, Human
uccuggacauccucuucugcu

SEQ ID NO: 3540574 - RNA, 22 nt, Human
uccuggacaugaagauucuuuc

SEQ ID NO: 3540575 - RNA, 22 nt, Human
uccuggacugagggggccugga

SEQ ID NO: 3540576 - RNA, 13 nt, Human
uccuggagcagaa

SEQ ID NO: 3540577 - RNA, 18 nt, Human
uccuggagcagaagcagc

SEQ ID NO: 3540578 - RNA, 18 nt, Human
uccuggagcccagaggag

SEQ ID NO: 3540579 - RNA, 18 nt, Human
uccuggagccuuugaaua

SEQ ID NO: 3540580 - RNA, 19 nt, Human
uccuggagguuccccagcc

SEQ ID NO: 3540581 - RNA, 14 nt, Human
uccuggaguugcau

SEQ ID NO: 3540582 - RNA, 16 nt, Human
uccuggaguugcauug

SEQ ID NO: 3540583 - RNA, 20 nt, Human
uccuggcaauaguguguucu

SEQ ID NO: 3540584 - RNA, 21 nt, Human
uccuggcaauaguguguucug

SEQ ID NO: 3540585 - RNA, 14 nt, Human
uccuggcacccggc

SEQ ID NO: 3540586 - RNA, 16 nt, Human
uccuggcacccggccc

SEQ ID NO: 3540587 - RNA, 20 nt, Human
uccuggcacccggccccugc

SEQ ID NO: 3540588 - RNA, 21 nt, Human
uccuggcacccggccccugcu

SEQ ID NO: 3540589 - RNA, 22 nt, Human
uccuggcacccggccccugcug

SEQ ID NO: 3540590 - RNA, 18 nt, Human
uccuggcacugcuuccag

SEQ ID NO: 3540591 - RNA, 13 nt, Human
uccuggcacugga

SEQ ID NO: 3540592 - RNA, 16 nt, Human
uccuggcagcccagag

SEQ ID NO: 3540593 - RNA, 16 nt, Human
uccuggccaucccaca

SEQ ID NO: 3540594 - RNA, 11 nt, Human
uccuggcccau

SEQ ID NO: 3540595 - RNA, 14 nt, Human
uccuggcccaucag

SEQ ID NO: 3540596 - RNA, 18 nt, Human
uccuggcccaucagugua

SEQ ID NO: 3540597 - RNA, 14 nt, Human
uccuggccccucaa

SEQ ID NO: 3540598 - RNA, 18 nt, Human
uccuggccccucaaccuc

SEQ ID NO: 3540599 - RNA, 13 nt, Human
uccuggccucaga

SEQ ID NO: 3540600 - RNA, 14 nt, Human
uccuggccucagac

SEQ ID NO: 3540601 - RNA, 17 nt, Human
uccuggccucagacugc

SEQ ID NO: 3540602 - RNA, 13 nt, Human
uccuggccuggca

SEQ ID NO: 3540603 - RNA, 23 nt, Human
uccuggccuggcacaucagaaag

SEQ ID NO: 3540604 - RNA, 12 nt, Human
uccuggcgccug

SEQ ID NO: 3540605 - RNA, 21 nt, Human
uccuggcuucccauccccagc

SEQ ID NO: 3540606 - RNA, 15 nt, Human
uccuggcuuugccca

SEQ ID NO: 3540607 - RNA, 21 nt, Human
uccugggaaauauucccuaga

SEQ ID NO: 3540608 - RNA, 20 nt, Human
uccugggagaaccucaggcu

SEQ ID NO: 3540609 - RNA, 15 nt, Human
uccugggagacccau

SEQ ID NO: 3540610 - RNA, 15 nt, Human
uccugggagcuuuug

SEQ ID NO: 3540611 - RNA, 12 nt, Human
uccugggaguga

SEQ ID NO: 3540612 - RNA, 18 nt, Human
uccugggagugagcuggu

SEQ ID NO: 3540613 - RNA, 19 nt, Human
uccugggcagcugccuccc

SEQ ID NO: 3540614 - RNA, 23 nt, Human
uccugggcagcugccuccccucc

SEQ ID NO: 3540615 - RNA, 16 nt, Human
uccugggccccucccu

SEQ ID NO: 3540616 - RNA, 17 nt, Human
uccugggccccucccua

SEQ ID NO: 3540617 - RNA, 18 nt, Human
ucggccccaccagugccu

SEQ ID NO: 3540618 - RNA, 15 nt, Human
ucggccuccauccug

SEQ ID NO: 3540619 - RNA, 18 nt, Human
ucggccucuaaccccagg

SEQ ID NO: 3540620 - RNA, 19 nt, Human
ucggccucuaaccccaggc

SEQ ID NO: 3540621 - RNA, 20 nt, Human
ucggccucuaaccccaggcc

SEQ ID NO: 3540622 - RNA, 22 nt, Human
ucggccucuaaccccaggcccc

SEQ ID NO: 3540623 - RNA, 23 nt, Human
ucggccucuaaccccaggccccg

SEQ ID NO: 3540624 - RNA, 15 nt, Human
ucggcuccugcugca

SEQ ID NO: 3540625 - RNA, 21 nt, Human
ucggcuccuggacucauugcu

SEQ ID NO: 3540626 - RNA, 13 nt, Human
ucggcucugggug

SEQ ID NO: 3540627 - RNA, 15 nt, Human
ucggcugaccaugcu

SEQ ID NO: 3540628 - RNA, 16 nt, Human
ucggcugaccaugcuc

SEQ ID NO: 3540629 - RNA, 21 nt, Human
ucggcuggcuccccugcagcc

SEQ ID NO: 3540630 - RNA, 21 nt, Human
ucgggaaaagguagaggaguc

SEQ ID NO: 3540631 - RNA, 15 nt, Human
ucgggaacaguguuu

SEQ ID NO: 3540632 - RNA, 16 nt, Human
ucgggaaccucacucu

SEQ ID NO: 3540633 - RNA, 20 nt, Human
ucgggaagagaggaguucaa

SEQ ID NO: 3540634 - RNA, 20 nt, Human
ucgggaauacuagggagaag

SEQ ID NO: 3540635 - RNA, 10 nt, Human
ucgggaccag

SEQ ID NO: 3540636 - RNA, 11 nt, Human
ucgggaccagg

SEQ ID NO: 3540637 - RNA, 16 nt, Human
ucgggagacagcauca

SEQ ID NO: 3540638 - RNA, 14 nt, Human
ucgggagcaguguc

SEQ ID NO: 3540639 - RNA, 15 nt, Human
ucgggagcagugucu

SEQ ID NO: 3540640 - RNA, 23 nt, Human
ucgggagcagugucuuccauaau

SEQ ID NO: 3540641 - RNA, 23 nt, Human
ucgggaggcugaggcaggagacu

SEQ ID NO: 3540642 - RNA, 22 nt, Human
ucgggcagcacaaguguaauga

SEQ ID NO: 3540643 - RNA, 12 nt, Human
ucgggcaugaca

SEQ ID NO: 3540644 - RNA, 21 nt, Human
ucgggcccaccuggccaccug

SEQ ID NO: 3540645 - RNA, 14 nt, Human
ucgggcccagcccc

SEQ ID NO: 3540646 - RNA, 15 nt, Human
ucgggcccagccccc

SEQ ID NO: 3540647 - RNA, 20 nt, Human
ucgggccccaccugcagcuc

SEQ ID NO: 3540648 - RNA, 13 nt, Human
ucgggcccuucuu

SEQ ID NO: 3540649 - RNA, 16 nt, Human
ucgggcucagcucugg

SEQ ID NO: 3540650 - RNA, 14 nt, Human
ucgggcuccagcca

SEQ ID NO: 3540651 - RNA, 15 nt, Human
ucgggcuccugugcc

SEQ ID NO: 3540652 - RNA, 16 nt, Human
ucggggcaugcugggg

SEQ ID NO: 3540653 - RNA, 16 nt, Human
ucggggcugggaaguc

SEQ ID NO: 3540654 - RNA, 19 nt, Human
ucgggggggacccuccaag

SEQ ID NO: 3540655 - RNA, 14 nt, Human
ucggggugcacagg

SEQ ID NO: 3540656 - RNA, 15 nt, Human
ucggggugcacagga

SEQ ID NO: 3540657 - RNA, 16 nt, Human
ucgguccuggugcccu

SEQ ID NO: 3540658 - RNA, 15 nt, Human
ucgguguccauuuau

SEQ ID NO: 3540659 - RNA, 15 nt, Human
ucgguuaacaaauaa

SEQ ID NO: 3540660 - RNA, 20 nt, Human
ucgguuaacaaauaacaacu

SEQ ID NO: 3540661 - RNA, 22 nt, Human
ucgguuugccaaaauucauuuc

SEQ ID NO: 3540662 - RNA, 20 nt, Human
ucguaagauuuccuucuuuu

SEQ ID NO: 3540663 - RNA, 13 nt, Human
ucguaaugacuua

SEQ ID NO: 3540664 - RNA, 14 nt, Human
ucguacaguucuuc

SEQ ID NO: 3540665 - RNA, 12 nt, Human
ucguagcuuucc

SEQ ID NO: 3540666 - RNA, 20 nt, Human
ucguauagaagucuucauga

SEQ ID NO: 3540667 - RNA, 17 nt, Human
ucguauagcuguauuga

SEQ ID NO: 3540668 - RNA, 21 nt, Human
ucguauagcuguauugaauca

SEQ ID NO: 3540669 - RNA, 20 nt, Human
ucguaucccgagucugggac

SEQ ID NO: 3540670 - RNA, 12 nt, Human
ucguaugaaaau

SEQ ID NO: 3540671 - RNA, 21 nt, Human
ucguaugauacuucgacacug

SEQ ID NO: 3540672 - RNA, 13 nt, Human
ucguccucccccu

SEQ ID NO: 3540673 - RNA, 16 nt, Human
ucguccuuacuccugu

SEQ ID NO: 3540674 - RNA, 15 nt, Human
ucgucugacugugug

SEQ ID NO: 3540675 - RNA, 16 nt, Human
ucgucuuaacucacca

SEQ ID NO: 3540676 - RNA, 19 nt, Human
ucgucuuccgucucccccg

SEQ ID NO: 3540677 - RNA, 22 nt, Human
ucgucuuccgucucccccgugu

SEQ ID NO: 3540678 - RNA, 19 nt, Human
ggagaagcagugagccgca

SEQ ID NO: 3540679 - RNA, 12 nt, Human
ggagaagccagg

SEQ ID NO: 3540680 - RNA, 17 nt, Human
ggagaagccauugucuu

SEQ ID NO: 3540681 - RNA, 16 nt, Human
ggagaagcugaugcuu

SEQ ID NO: 3540682 - RNA, 13 nt, Human
ggagaagcugcag

SEQ ID NO: 3540683 - RNA, 12 nt, Human
ggagaaggaagg

SEQ ID NO: 3540684 - RNA, 14 nt, Human
ggagaaggcaugaa

SEQ ID NO: 3540685 - RNA, 22 nt, Human
ggagaagucuuagacuugaaau

SEQ ID NO: 3540686 - RNA, 20 nt, Human
ggagaagucuucuauuuauu

SEQ ID NO: 3540687 - RNA, 16 nt, Human
ggagaauaauucuuug

SEQ ID NO: 3540688 - RNA, 17 nt, Human
ggagaauaauucuuuga

SEQ ID NO: 3540689 - RNA, 13 nt, Human
ggagaaucacagg

SEQ ID NO: 3540690 - RNA, 15 nt, Human
ggagaaucacaggcu

SEQ ID NO: 3540691 - RNA, 17 nt, Human
ggagaaucacaggcugg

SEQ ID NO: 3540692 - RNA, 18 nt, Human
ggagaaucauguuucuuu

SEQ ID NO: 3540693 - RNA, 20 nt, Human
ggagaaucgcuugaacccag

SEQ ID NO: 3540694 - RNA, 17 nt, Human
ggagaaugcaccauacu

SEQ ID NO: 3540695 - RNA, 20 nt, Human
ggagaaugcaccauacucau

SEQ ID NO: 3540696 - RNA, 23 nt, Human
ggagacaaugcagaugccagagc

SEQ ID NO: 3540697 - RNA, 21 nt, Human
ggagacacauccagcaauugu

SEQ ID NO: 3540698 - RNA, 17 nt, Human
ggagacacuggccccuc

SEQ ID NO: 3540699 - RNA, 22 nt, Human
ggagacagagcaaccccuggac

SEQ ID NO: 3540700 - RNA, 14 nt, Human
ggagacagccccag

SEQ ID NO: 3540701 - RNA, 20 nt, Human
ggagacagccccagagcagg

SEQ ID NO: 3540702 - RNA, 12 nt, Human
ggagacaggcag

SEQ ID NO: 3540703 - RNA, 19 nt, Human
ggagacagguuagcugcuc

SEQ ID NO: 3540704 - RNA, 18 nt, Human
ggagacagugaucuccau

SEQ ID NO: 3540705 - RNA, 12 nt, Human
ggagaccaccag

SEQ ID NO: 3540706 - RNA, 18 nt, Human
ggagaccaugcagagcgc

SEQ ID NO: 3540707 - RNA, 19 nt, Human
ggagaccaugcagagcgcc

SEQ ID NO: 3540708 - RNA, 19 nt, Human
ggagacccaccccaccugc

SEQ ID NO: 3540709 - RNA, 20 nt, Human
ggagacccaccccaccugca

SEQ ID NO: 3540710 - RNA, 17 nt, Human
ggagaccccaccagccu

SEQ ID NO: 3540711 - RNA, 21 nt, Human
ggagaccccuuggggagcagg

SEQ ID NO: 3540712 - RNA, 16 nt, Human
ggagacccugcaaaca

SEQ ID NO: 3540713 - RNA, 21 nt, Human
ggagacccugcaaacagaaca

SEQ ID NO: 3540714 - RNA, 20 nt, Human
ggagaccggccugccaggag

SEQ ID NO: 3540715 - RNA, 21 nt, Human
ggagaccggccugccaggagg

SEQ ID NO: 3540716 - RNA, 12 nt, Human
ggagacgccaug

SEQ ID NO: 3540717 - RNA, 21 nt, Human
ggagacgguuuccagggaggg

SEQ ID NO: 3540718 - RNA, 16 nt, Human
ggagacuaagcccugu

SEQ ID NO: 3540719 - RNA, 19 nt, Human
ggagacuagauugccuuug

SEQ ID NO: 3540720 - RNA, 17 nt, Human
ggagacuaucagcccaa

SEQ ID NO: 3540721 - RNA, 9 nt, Human
ggagacuca

SEQ ID NO: 3540722 - RNA, 17 nt, Human
ggagacucaccucugcc

SEQ ID NO: 3540723 - RNA, 13 nt, Human
ggagacuccuagg

SEQ ID NO: 3540724 - RNA, 13 nt, Human
ggagacucugugg

SEQ ID NO: 3540725 - RNA, 16 nt, Human
ggagacucuguggggc

SEQ ID NO: 3540726 - RNA, 20 nt, Human
ggagacugcuccugagcccc

SEQ ID NO: 3540727 - RNA, 22 nt, Human
ggagacugcugagucaacccaa

SEQ ID NO: 3540728 - RNA, 14 nt, Human
ggagacugcuuccc

SEQ ID NO: 3540729 - RNA, 15 nt, Human
ggagacugcuuccca

SEQ ID NO: 3540730 - RNA, 18 nt, Human
ggagacugcuucccaucc

SEQ ID NO: 3540731 - RNA, 13 nt, Human
ggagacugggcug

SEQ ID NO: 3540732 - RNA, 20 nt, Human
ggagacugguccugugugca

SEQ ID NO: 3540733 - RNA, 20 nt, Human
ggagacugugugugcccucu

SEQ ID NO: 3540734 - RNA, 13 nt, Human
ggagagaaaaaag

SEQ ID NO: 3540735 - RNA, 15 nt, Human
ggagagaaaauauau

SEQ ID NO: 3540736 - RNA, 18 nt, Human
ggagagaaagugggugag

SEQ ID NO: 3540737 - RNA, 18 nt, Human
ggagagaccgagugaacc

SEQ ID NO: 3540738 - RNA, 15 nt, Human
ggagagacgggcccu

SEQ ID NO: 3540739 - RNA, 19 nt, Human
ggagagagacguguacaua

SEQ ID NO: 3540740 - RNA, 18 nt, Human
ggagagauagccuguggc

SEQ ID NO: 3540741 - RNA, 19 nt, Human
ggagagauagccuguggcc

SEQ ID NO: 3540742 - RNA, 12 nt, Human
ggagagcaggcu

SEQ ID NO: 3540743 - RNA, 22 nt, Human
ggagagccaccaagagggacgc

SEQ ID NO: 3540744 - RNA, 12 nt, Human
ggagagccagcc

SEQ ID NO: 3540745 - RNA, 14 nt, Human
ggagagccagcccu

SEQ ID NO: 3540746 - RNA, 23 nt, Human
ggagagccagcccucccuguccu

SEQ ID NO: 3540747 - RNA, 12 nt, Human
ggagagcccagg

SEQ ID NO: 3540748 - RNA, 22 nt, Human
ggagagcccaggagcuccccuc

SEQ ID NO: 3540749 - RNA, 12 nt, Human
ggagagcccugg

SEQ ID NO: 3540750 - RNA, 11 nt, Human
ggagagccugc

SEQ ID NO: 3540751 - RNA, 16 nt, Human
ggagagccugcuggca

SEQ ID NO: 3540752 - RNA, 20 nt, Human
ggagagcuagaacccggcag

SEQ ID NO: 3540753 - RNA, 18 nt, Human
ggagagcuagaaccugga

SEQ ID NO: 3540754 - RNA, 21 nt, Human
ggagagcuaggagcaaagccu

SEQ ID NO: 3540755 - RNA, 18 nt, Human
ggagagcuggagccuggu

SEQ ID NO: 3540756 - RNA, 15 nt, Human
ggagagcuggugccc

SEQ ID NO: 3540757 - RNA, 16 nt, Human
ggagagcuuagggucu

SEQ ID NO: 3540758 - RNA, 18 nt, Human
ggagagcuuagggucuca

SEQ ID NO: 3540759 - RNA, 20 nt, Human
ggagagcuuagggucucagg

SEQ ID NO: 3540760 - RNA, 17 nt, Human
ggagaggaaaaguaagg

SEQ ID NO: 3540761 - RNA, 17 nt, Human
ggagaggaacuccuugg

SEQ ID NO: 3540762 - RNA, 18 nt, Human
ggagcuggccccgccgcc

SEQ ID NO: 3540763 - RNA, 17 nt, Human
ggagcuggcgucugucu

SEQ ID NO: 3540764 - RNA, 21 nt, Human
ggagcugggacacuuaacaga

SEQ ID NO: 3540765 - RNA, 18 nt, Human
ggagcugggcagaaggcc

SEQ ID NO: 3540766 - RNA, 14 nt, Human
ggagcugggccugg

SEQ ID NO: 3540767 - RNA, 17 nt, Human
ggagcuggggaucccuc

SEQ ID NO: 3540768 - RNA, 20 nt, Human
ggagcuguucucugucguga

SEQ ID NO: 3540769 - RNA, 18 nt, Human
ggagcuuaagccacugcc

SEQ ID NO: 3540770 - RNA, 21 nt, Human
ggagcuucucugaugugauau

SEQ ID NO: 3540771 - RNA, 15 nt, Human
ggagcuucugggguc

SEQ ID NO: 3540772 - RNA, 20 nt, Human
ggagcuucuuguuuccuugu

SEQ ID NO: 3540773 - RNA, 19 nt, Human
ggagcuuugacucaggagc

SEQ ID NO: 3540774 - RNA, 21 nt, Human
ggagcuuuuuuccuuaaucca

SEQ ID NO: 3540775 - RNA, 12 nt, Human
ggaggaaagcaa

SEQ ID NO: 3540776 - RNA, 23 nt, Human
ggaggaaauuugaauggguccau

SEQ ID NO: 3540777 - RNA, 21 nt, Human
ggaggaagaagcuuaggcagg

SEQ ID NO: 3540778 - RNA, 14 nt, Human
ggaggaagcagaau

SEQ ID NO: 3540779 - RNA, 19 nt, Human
ggaggaaggaaacccagcu

SEQ ID NO: 3540780 - RNA, 13 nt, Human
ggaggaaggauug

SEQ ID NO: 3540781 - RNA, 23 nt, Human
ggaggaaucgaggaaccagagcc

SEQ ID NO: 3540782 - RNA, 17 nt, Human
ggaggaaugcuccccca

SEQ ID NO: 3540783 - RNA, 13 nt, Human
ggaggacaauuca

SEQ ID NO: 3540784 - RNA, 13 nt, Human
ggaggaccagggc

SEQ ID NO: 3540785 - RNA, 15 nt, Human
ggaggacccaggaca

SEQ ID NO: 3540786 - RNA, 22 nt, Human
ggaggaccugacccuacucccu

SEQ ID NO: 3540787 - RNA, 14 nt, Human
ggaggaccugagcc

SEQ ID NO: 3540788 - RNA, 15 nt, Human
ggaggaccugagccu

SEQ ID NO: 3540789 - RNA, 22 nt, Human
ggaggaccugagccugccgagc

SEQ ID NO: 3540790 - RNA, 14 nt, Human
ggaggaccugcccg

SEQ ID NO: 3540791 - RNA, 12 nt, Human
ggaggaccuggg

SEQ ID NO: 3540792 - RNA, 13 nt, Human
ggaggaccugggg

SEQ ID NO: 3540793 - RNA, 12 nt, Human
ggaggaccuuau

SEQ ID NO: 3540794 - RNA, 16 nt, Human
ggaggacgcucucugg

SEQ ID NO: 3540795 - RNA, 19 nt, Human
ggaggacgcucucuggccu

SEQ ID NO: 3540796 - RNA, 11 nt, Human
ggaggagagcc

SEQ ID NO: 3540797 - RNA, 14 nt, Human
ggaggagagccugg

SEQ ID NO: 3540798 - RNA, 12 nt, Human
ggaggagcaaag

SEQ ID NO: 3540799 - RNA, 17 nt, Human
ggaggagcaaaggcuga

SEQ ID NO: 3540800 - RNA, 17 nt, Human
ggaggagcagugcaggc

SEQ ID NO: 3540801 - RNA, 13 nt, Human
ggaggagcccagg

SEQ ID NO: 3540802 - RNA, 20 nt, Human
ggaggagcccaggccaggac

SEQ ID NO: 3540803 - RNA, 12 nt, Human
ggaggagccugu

SEQ ID NO: 3540804 - RNA, 13 nt, Human
ggaggagccuguc

SEQ ID NO: 3540805 - RNA, 20 nt, Human
ggaggaggacccuggaaaug

SEQ ID NO: 3540806 - RNA, 13 nt, Human
ggaggaggaggca

SEQ ID NO: 3540807 - RNA, 13 nt, Human
ggaggaggccacc

SEQ ID NO: 3540808 - RNA, 16 nt, Human
ggaggaggccaccucu

SEQ ID NO: 3540809 - RNA, 22 nt, Human
ggaggaggccaccucuccaagg

SEQ ID NO: 3540810 - RNA, 12 nt, Human
ggaggaggccug

SEQ ID NO: 3540811 - RNA, 22 nt, Human
ggaggaggccugggggcaggga

SEQ ID NO: 3540812 - RNA, 15 nt, Human
ggaggagggcaggca

SEQ ID NO: 3540813 - RNA, 20 nt, Human
ggaggagggucuagaggccu

SEQ ID NO: 3540814 - RNA, 18 nt, Human
ggaggaucaguuuuuugu

SEQ ID NO: 3540815 - RNA, 21 nt, Human
ggaggaucucuugagccuggg

SEQ ID NO: 3540816 - RNA, 20 nt, Human
ggaggaucuuuugaacccag

SEQ ID NO: 3540817 - RNA, 12 nt, Human
ggaggauggaga

SEQ ID NO: 3540818 - RNA, 20 nt, Human
ggaggaugucccugggccag

SEQ ID NO: 3540819 - RNA, 18 nt, Human
ggaggauguucugggaca

SEQ ID NO: 3540820 - RNA, 20 nt, Human
ggaggauugcuugagcccag

SEQ ID NO: 3540821 - RNA, 17 nt, Human
ggaggcaaagcuggcuc

SEQ ID NO: 3540822 - RNA, 21 nt, Human
ggaggcaaagcuggcucaccu

SEQ ID NO: 3540823 - RNA, 19 nt, Human
ggaggcaagagggguggag

SEQ ID NO: 3540824 - RNA, 16 nt, Human
ggaggcacacagcugc

SEQ ID NO: 3540825 - RNA, 21 nt, Human
ggaggcagaaagcagaggcug

SEQ ID NO: 3540826 - RNA, 19 nt, Human
ggaggcagagaagaaagaa

SEQ ID NO: 3540827 - RNA, 13 nt, Human
ggaggcagcagga

SEQ ID NO: 3540828 - RNA, 17 nt, Human
ggaggcaggaguuucgu

SEQ ID NO: 3540829 - RNA, 13 nt, Human
ggaggcaggggcu

SEQ ID NO: 3540830 - RNA, 17 nt, Human
ggaggcauggcccuggg

SEQ ID NO: 3540831 - RNA, 14 nt, Human
ggaggccaccucuc

SEQ ID NO: 3540832 - RNA, 12 nt, Human
ggaggccagcca

SEQ ID NO: 3540833 - RNA, 12 nt, Human
ggaggccagccu

SEQ ID NO: 3540834 - RNA, 23 nt, Human
ggaggccaggccggcgagcccug

SEQ ID NO: 3540835 - RNA, 17 nt, Human
ggaggccauugugugag

SEQ ID NO: 3540836 - RNA, 22 nt, Human
ggaggcccaggcugggaacuca

SEQ ID NO: 3540837 - RNA, 19 nt, Human
ggaggcccaguucacccug

SEQ ID NO: 3540838 - RNA, 22 nt, Human
ggaggccccaacccuguccucc

SEQ ID NO: 3540839 - RNA, 16 nt, Human
ggaggccccacugaug

SEQ ID NO: 3540840 - RNA, 17 nt, Human
ggaggccccacugggga

SEQ ID NO: 3540841 - RNA, 16 nt, Human
ggaggccccuggccca

SEQ ID NO: 3540842 - RNA, 17 nt, Human
ggaggcccguccggcag

SEQ ID NO: 3540843 - RNA, 16 nt, Human
uccggaaugccaccca

SEQ ID NO: 3540844 - RNA, 15 nt, Human
uccggacacuccuag

SEQ ID NO: 3540845 - RNA, 18 nt, Human
uccggacacuccuagaga

SEQ ID NO: 3540846 - RNA, 14 nt, Human
uccggacuggugcc

SEQ ID NO: 3540847 - RNA, 21 nt, Human
uccggagugagaagcuuugcc

SEQ ID NO: 3540848 - RNA, 17 nt, Human
uccggauuggcuugugu

SEQ ID NO: 3540849 - RNA, 13 nt, Human
uccggcauggaca

SEQ ID NO: 3540850 - RNA, 19 nt, Human
uccggccaggugccuccug

SEQ ID NO: 3540851 - RNA, 23 nt, Human
uccggcccuccuacccugcgccc

SEQ ID NO: 3540852 - RNA, 16 nt, Human
uccggccucuccagcc

SEQ ID NO: 3540853 - RNA, 17 nt, Human
uccggcgucagccucca

SEQ ID NO: 3540854 - RNA, 18 nt, Human
uccggcgucagccuccag

SEQ ID NO: 3540855 - RNA, 21 nt, Human
uccggcgucagccuccagccu

SEQ ID NO: 3540856 - RNA, 17 nt, Human
uccggcuaagcaggcgc

SEQ ID NO: 3540857 - RNA, 18 nt, Human
uccggcucccagccucag

SEQ ID NO: 3540858 - RNA, 21 nt, Human
uccggcucccagccucagcgc

SEQ ID NO: 3540859 - RNA, 14 nt, Human
uccggcuccugugc

SEQ ID NO: 3540860 - RNA, 17 nt, Human
uccggcuccugugcuuu

SEQ ID NO: 3540861 - RNA, 21 nt, Human
uccggcuugaccuguuucucu

SEQ ID NO: 3540862 - RNA, 13 nt, Human
uccgggaccccca

SEQ ID NO: 3540863 - RNA, 21 nt, Human
uccgggaccuggugcugccuc

SEQ ID NO: 3540864 - RNA, 19 nt, Human
uccgggcaaaugccagggc

SEQ ID NO: 3540865 - RNA, 20 nt, Human
uccgggcaaaugccagggcc

SEQ ID NO: 3540866 - RNA, 16 nt, Human
uccggggagcgcccgc

SEQ ID NO: 3540867 - RNA, 14 nt, Human
uccgggucuuccua

SEQ ID NO: 3540868 - RNA, 15 nt, Human
uccgguuuacuuuaa

SEQ ID NO: 3540869 - RNA, 14 nt, Human
uccgguuugccaug

SEQ ID NO: 3540870 - RNA, 16 nt, Human
uccgucaaaacagauu

SEQ ID NO: 3540871 - RNA, 18 nt, Human
uccgucaacguuguacug

SEQ ID NO: 3540872 - RNA, 15 nt, Human
uccgucacuaccugg

SEQ ID NO: 3540873 - RNA, 18 nt, Human
uccgucacuaccuggcug

SEQ ID NO: 3540874 - RNA, 18 nt, Human
uccguccccugcccaugc

SEQ ID NO: 3540875 - RNA, 15 nt, Human
uccgugagcagugug

SEQ ID NO: 3540876 - RNA, 23 nt, Human
uccgugagcagugugucuccugc

SEQ ID NO: 3540877 - RNA, 21 nt, Human
uccgugccuccaccaccacug

SEQ ID NO: 3540878 - RNA, 16 nt, Human
uccgugccucuuuuua

SEQ ID NO: 3540879 - RNA, 16 nt, Human
uccgugcuaaggacuu

SEQ ID NO: 3540880 - RNA, 17 nt, Human
uccgugcuaaggacuug

SEQ ID NO: 3540881 - RNA, 18 nt, Human
uccgugcuaaggacuugu

SEQ ID NO: 3540882 - RNA, 23 nt, Human
uccgugcuaaggacuuguuagau

SEQ ID NO: 3540883 - RNA, 13 nt, Human
uccgugcugacag

SEQ ID NO: 3540884 - RNA, 19 nt, Human
uccgugcugacagcugcuc

SEQ ID NO: 3540885 - RNA, 21 nt, Human
uccgugcugacagcugcuccu

SEQ ID NO: 3540886 - RNA, 23 nt, Human
uccgugggacggugcccaagcca

SEQ ID NO: 3540887 - RNA, 21 nt, Human
uccguggguugcuaacugaac

SEQ ID NO: 3540888 - RNA, 18 nt, Human
uccgugucaccgccaccc

SEQ ID NO: 3540889 - RNA, 15 nt, Human
uccguguccaccccc

SEQ ID NO: 3540890 - RNA, 17 nt, Human
uccguguggauccaaug

SEQ ID NO: 3540891 - RNA, 22 nt, Human
uccguguugcagguucauggau

SEQ ID NO: 3540892 - RNA, 15 nt, Human
uccguuagcuccugu

SEQ ID NO: 3540893 - RNA, 19 nt, Human
uccguuagcuccuguggcc

SEQ ID NO: 3540894 - RNA, 13 nt, Human
uccguuggccacu

SEQ ID NO: 3540895 - RNA, 22 nt, Human
uccguugggccccagccuucuu

SEQ ID NO: 3540896 - RNA, 19 nt, Human
uccguuuccagguguuuau

SEQ ID NO: 3540897 - RNA, 15 nt, Human
uccuaaaacaaauag

SEQ ID NO: 3540898 - RNA, 12 nt, Human
uccuaaaacaac

SEQ ID NO: 3540899 - RNA, 14 nt, Human
uccuaaaagcaaaa

SEQ ID NO: 3540900 - RNA, 23 nt, Human
uccuaaaagcaaaauaaaaacua

SEQ ID NO: 3540901 - RNA, 15 nt, Human
uccuaaaaggcccag

SEQ ID NO: 3540902 - RNA, 13 nt, Human
uccuaaaaguuca

SEQ ID NO: 3540903 - RNA, 17 nt, Human
uccuaaaauaagggcag

SEQ ID NO: 3540904 - RNA, 17 nt, Human
uccuaaaauuauggaaa

SEQ ID NO: 3540905 - RNA, 18 nt, Human
uccuaaagagaguauuuu

SEQ ID NO: 3540906 - RNA, 14 nt, Human
uccuaaauauuaug

SEQ ID NO: 3540907 - RNA, 14 nt, Human
ucuccacugccuuc

SEQ ID NO: 3540908 - RNA, 12 nt, Human
ucuccacugugc

SEQ ID NO: 3540909 - RNA, 19 nt, Human
ucuccacugugccuuugca

SEQ ID NO: 3540910 - RNA, 14 nt, Human
ucuccacuuucagc

SEQ ID NO: 3540911 - RNA, 18 nt, Human
ucuccacuuucagcuguc

SEQ ID NO: 3540912 - RNA, 18 nt, Human
ucuccagaaagccccacc

SEQ ID NO: 3540913 - RNA, 19 nt, Human
ucuccagacccccaccccu

SEQ ID NO: 3540914 - RNA, 17 nt, Human
ucuccagaggccaagga

SEQ ID NO: 3540915 - RNA, 14 nt, Human
ucuccagauuuuua

SEQ ID NO: 3540916 - RNA, 11 nt, Human
ucuccagcagg

SEQ ID NO: 3540917 - RNA, 14 nt, Human
ucuccagcaggccc

SEQ ID NO: 3540918 - RNA, 15 nt, Human
ucuccagccagcaau

SEQ ID NO: 3540919 - RNA, 14 nt, Human
ucuccagccccugg

SEQ ID NO: 3540920 - RNA, 15 nt, Human
ucuccagccccugga

SEQ ID NO: 3540921 - RNA, 16 nt, Human
ucuccagccccuggau

SEQ ID NO: 3540922 - RNA, 18 nt, Human
ucuccagccccuggaugc

SEQ ID NO: 3540923 - RNA, 19 nt, Human
ucuccagccucagccuccc

SEQ ID NO: 3540924 - RNA, 19 nt, Human
ucuccagccuggaccccca

SEQ ID NO: 3540925 - RNA, 21 nt, Human
ucuccagccuggacccccagc

SEQ ID NO: 3540926 - RNA, 20 nt, Human
ucuccagcucagaacccagg

SEQ ID NO: 3540927 - RNA, 21 nt, Human
ucuccagcucagaacccaggg

SEQ ID NO: 3540928 - RNA, 23 nt, Human
ucuccagcucagaacccagggcu

SEQ ID NO: 3540929 - RNA, 15 nt, Human
ucuccagcugacuaa

SEQ ID NO: 3540930 - RNA, 13 nt, Human
ucuccagcugcug

SEQ ID NO: 3540931 - RNA, 23 nt, Human
ucuccaggcacccuucuuuccuc

SEQ ID NO: 3540932 - RNA, 15 nt, Human
ucuccaggcaggucu

SEQ ID NO: 3540933 - RNA, 15 nt, Human
ucuccaggcgccggc

SEQ ID NO: 3540934 - RNA, 11 nt, Human
ucuccaggcug

SEQ ID NO: 3540935 - RNA, 16 nt, Human
ucuccagggguuuaca

SEQ ID NO: 3540936 - RNA, 19 nt, Human
ucuccagggguuuacagug

SEQ ID NO: 3540937 - RNA, 21 nt, Human
ucuccagggucagaaacagga

SEQ ID NO: 3540938 - RNA, 19 nt, Human
ucuccaggucucacgggca

SEQ ID NO: 3540939 - RNA, 19 nt, Human
ucuccaguauccacuuugc

SEQ ID NO: 3540940 - RNA, 17 nt, Human
ucuccagucuuccaccu

SEQ ID NO: 3540941 - RNA, 21 nt, Human
ucuccagugcuguccaugcuu

SEQ ID NO: 3540942 - RNA, 18 nt, Human
ucuccaguggauucccag

SEQ ID NO: 3540943 - RNA, 18 nt, Human
ucuccagugguugcuguu

SEQ ID NO: 3540944 - RNA, 15 nt, Human
ucuccaguuuucagu

SEQ ID NO: 3540945 - RNA, 17 nt, Human
ucuccauaaccccaccc

SEQ ID NO: 3540946 - RNA, 20 nt, Human
ucuccauaaccccacccuug

SEQ ID NO: 3540947 - RNA, 17 nt, Human
ucuccaucagcuguaag

SEQ ID NO: 3540948 - RNA, 17 nt, Human
ucuccauccuuucugcc

SEQ ID NO: 3540949 - RNA, 19 nt, Human
ucuccauccuuucugccuc

SEQ ID NO: 3540950 - RNA, 18 nt, Human
ucuccaucuucagcuucu

SEQ ID NO: 3540951 - RNA, 20 nt, Human
ucuccauggcuuccuccucc

SEQ ID NO: 3540952 - RNA, 19 nt, Human
ucucccaaggcugcgucug

SEQ ID NO: 3540953 - RNA, 16 nt, Human
ucucccacccucuucc

SEQ ID NO: 3540954 - RNA, 19 nt, Human
ucucccacccucuuccuac

SEQ ID NO: 3540955 - RNA, 20 nt, Human
ucucccacccucuuccuacu

SEQ ID NO: 3540956 - RNA, 18 nt, Human
ucucccacuccagcgcug

SEQ ID NO: 3540957 - RNA, 14 nt, Human
ucucccacucuccu

SEQ ID NO: 3540958 - RNA, 15 nt, Human
ucucccacucuccua

SEQ ID NO: 3540959 - RNA, 15 nt, Human
ucucccagaauccca

SEQ ID NO: 3540960 - RNA, 17 nt, Human
ucucccagaaucccagc

SEQ ID NO: 3540961 - RNA, 19 nt, Human
ucucccagaaucccagccg

SEQ ID NO: 3540962 - RNA, 16 nt, Human
ucucccagauaaugug

SEQ ID NO: 3540963 - RNA, 19 nt, Human
ucucccaggcaaggcugug

SEQ ID NO: 3540964 - RNA, 20 nt, Human
ucucccaggcaaggcugugg

SEQ ID NO: 3540965 - RNA, 12 nt, Human
ucucccaggccc

SEQ ID NO: 3540966 - RNA, 20 nt, Human
ucucccaggccccaugaccu

SEQ ID NO: 3540967 - RNA, 21 nt, Human
ucucccaggccccaugaccuc

SEQ ID NO: 3540968 - RNA, 23 nt, Human
ucucccaggccccaugaccucca

SEQ ID NO: 3540969 - RNA, 23 nt, Human
ucucccauccagugucucacagc

SEQ ID NO: 3540970 - RNA, 17 nt, Human
ucucccaucccccugcc

SEQ ID NO: 3540971 - RNA, 19 nt, Human
ucucccaucccccugcccu

SEQ ID NO: 3540972 - RNA, 20 nt, Human
ucucccaucccccugcccuc

SEQ ID NO: 3540973 - RNA, 13 nt, Human
ucucccauggagc

SEQ ID NO: 3540974 - RNA, 21 nt, Human
ucucccauggagccccagccc

SEQ ID NO: 3540975 - RNA, 23 nt, Human
ucucccauuuuggaauuugccug

SEQ ID NO: 3540976 - RNA, 20 nt, Human
ucuccccaacccccauucuc

SEQ ID NO: 3540977 - RNA, 22 nt, Human
ucuccccacacuaaccuggguu

SEQ ID NO: 3540978 - RNA, 20 nt, Human
ucuccccacgagggcuggcu

SEQ ID NO: 3540979 - RNA, 23 nt, Human
ucuccccagcaagugagagcugg

SEQ ID NO: 3540980 - RNA, 14 nt, Human
ucuccccagcuccc

SEQ ID NO: 3540981 - RNA, 19 nt, Human
ucuccccagguccagcucu

SEQ ID NO: 3540982 - RNA, 15 nt, Human
ucucccccacccccu

SEQ ID NO: 3540983 - RNA, 19 nt, Human
ucucccccacccccucccc

SEQ ID NO: 3540984 - RNA, 20 nt, Human
ucucccccacccccuccccg

SEQ ID NO: 3540985 - RNA, 14 nt, Human
ucucccccagcccc

SEQ ID NO: 3540986 - RNA, 18 nt, Human
ucucccccagccccaucc

SEQ ID NO: 3540987 - RNA, 20 nt, Human
ucucccccagccccauccuc

SEQ ID NO: 3540988 - RNA, 22 nt, Human
ucucccccagccccauccucug

SEQ ID NO: 3540989 - RNA, 14 nt, Human
ucucccccauccua

SEQ ID NO: 3540990 - RNA, 20 nt, Human
ucucccccccggggcugggu

SEQ ID NO: 3540991 - RNA, 13 nt, Human
ucucccccugggc

SEQ ID NO: 3540992 - RNA, 14 nt, Human
ucucccccugggcu

SEQ ID NO: 3540993 - RNA, 20 nt, Human
ucucccccugggcucugccc

SEQ ID NO: 3540994 - RNA, 19 nt, Human
ucuccccgcuaaggaagau

SEQ ID NO: 3540995 - RNA, 11 nt, Human
ucuccccucaa

SEQ ID NO: 3540996 - RNA, 16 nt, Human
ucuccccucaaagucu

SEQ ID NO: 3540997 - RNA, 14 nt, Human
ucuccccucagcuc

SEQ ID NO: 3540998 - RNA, 12 nt, Human
ucuccccuccag

SEQ ID NO: 3540999 - RNA, 15 nt, Human
ucuccccuccagccu

SEQ ID NO: 3541000 - RNA, 12 nt, Human
ucuccccucugc

SEQ ID NO: 3541001 - RNA, 15 nt, Human
ucuccccucuuaugu

SEQ ID NO: 3541002 - RNA, 13 nt, Human
ucuccccugcacu

SEQ ID NO: 3541003 - RNA, 14 nt, Human
ucuccccugcacug

SEQ ID NO: 3541004 - RNA, 17 nt, Human
ucuccccugcacuguaa

SEQ ID NO: 3541005 - RNA, 14 nt, Human
ucuccccugccccc

SEQ ID NO: 3541006 - RNA, 20 nt, Human
ucuccccugcccccaggacu

SEQ ID NO: 3541007 - RNA, 14 nt, Human
ucuccccugcccug

SEQ ID NO: 3541008 - RNA, 16 nt, Human
ucucccgggacucugc

SEQ ID NO: 3541009 - RNA, 20 nt, Human
ucucccgucagggcccaagu

SEQ ID NO: 3541010 - RNA, 15 nt, Human
ucucccuagcuccuc

SEQ ID NO: 3541011 - RNA, 18 nt, Human
ucucccucuccugccuac

SEQ ID NO: 3541012 - RNA, 16 nt, Human
ucucccucuggaucaa

SEQ ID NO: 3541013 - RNA, 19 nt, Human
ucucccucuggcccugccu

SEQ ID NO: 3541014 - RNA, 20 nt, Human
ucucccucuggcccugccuu

SEQ ID NO: 3541015 - RNA, 15 nt, Human
ucucccucuucucaa

SEQ ID NO: 3541016 - RNA, 22 nt, Human
ucucccucuucucaagugccuu

SEQ ID NO: 3541017 - RNA, 10 nt, Human
ucucccugga

SEQ ID NO: 3541018 - RNA, 22 nt, Human
ucucccuggaucuaccuggagg

SEQ ID NO: 3541019 - RNA, 15 nt, Human
ucucccuucccuccu

SEQ ID NO: 3541020 - RNA, 16 nt, Human
ucucccuucccuccuc

SEQ ID NO: 3541021 - RNA, 18 nt, Human
ucucccuucucccaugag

SEQ ID NO: 3541022 - RNA, 11 nt, Human
ucucccuugga

SEQ ID NO: 3541023 - RNA, 16 nt, Human
ucucccuugggcucug

SEQ ID NO: 3541024 - RNA, 15 nt, Human
ucucccuuucccuuc

SEQ ID NO: 3541025 - RNA, 13 nt, Human
ucuccgccagccu

SEQ ID NO: 3541026 - RNA, 15 nt, Human
ucuccgccagccucc

SEQ ID NO: 3541027 - RNA, 21 nt, Human
ucuccgccagccuccucugga

SEQ ID NO: 3541028 - RNA, 16 nt, Human
ucuccgccccugagcc

SEQ ID NO: 3541029 - RNA, 17 nt, Human
ucuccggcucccagccu

SEQ ID NO: 3541030 - RNA, 17 nt, Human
ucuccguuagcuccugu

SEQ ID NO: 3541031 - RNA, 19 nt, Human
ucuccguuagcuccugugg

SEQ ID NO: 3541032 - RNA, 20 nt, Human
ucuccguuagcuccuguggc

SEQ ID NO: 3541033 - RNA, 20 nt, Human
ucuccguuuauuauaaacug

SEQ ID NO: 3541034 - RNA, 23 nt, Human
ucuccuaagcaccuguaaugugc

SEQ ID NO: 3541035 - RNA, 19 nt, Human
ucuccuaagcuggagugca

SEQ ID NO: 3541036 - RNA, 20 nt, Human
ucuccuacauaucccuucca

SEQ ID NO: 3541037 - RNA, 20 nt, Human
ucuccuagagacagaagcag

SEQ ID NO: 3541038 - RNA, 19 nt, Human
ucuccuaggcauucuggac

SEQ ID NO: 3541039 - RNA, 23 nt, Human
ucuccuaggcauucuggaccucu

SEQ ID NO: 3541040 - RNA, 18 nt, Human
ucuccuauauauuucuau

SEQ ID NO: 3541041 - RNA, 22 nt, Human
ucuccuauauauuucuauuauu

SEQ ID NO: 3541042 - RNA, 12 nt, Human
ucuccuauuuuu

SEQ ID NO: 3541043 - RNA, 13 nt, Human
ucuccuauuuuuu

SEQ ID NO: 3541044 - RNA, 15 nt, Human
ucuccucacuguauc

SEQ ID NO: 3541045 - RNA, 13 nt, Human
ucuccucagccuc

SEQ ID NO: 3541046 - RNA, 14 nt, Human
ucuccucaucucua

SEQ ID NO: 3541047 - RNA, 15 nt, Human
ucuccucaucucuaa

SEQ ID NO: 3541048 - RNA, 19 nt, Human
ucuccuccaagacacugug

SEQ ID NO: 3541049 - RNA, 16 nt, Human
ucuccuccaugggaga

SEQ ID NO: 3541050 - RNA, 12 nt, Human
ucuccuccccaa

SEQ ID NO: 3541051 - RNA, 18 nt, Human
ucuccuccccacccgccc

SEQ ID NO: 3541052 - RNA, 14 nt, Human
uccuugcuacccag

SEQ ID NO: 3541053 - RNA, 21 nt, Human
uccuugcuccuggccuugcug

SEQ ID NO: 3541054 - RNA, 14 nt, Human
uccuugcucucccu

SEQ ID NO: 3541055 - RNA, 19 nt, Human
uccuugcucucccucuucu

SEQ ID NO: 3541056 - RNA, 17 nt, Human
uccuugcuguccuaggc

SEQ ID NO: 3541057 - RNA, 22 nt, Human
uccuuggaaaucaaauguaaag

SEQ ID NO: 3541058 - RNA, 21 nt, Human
uccuuggagaaaugaaaacag

SEQ ID NO: 3541059 - RNA, 19 nt, Human
uccuuggauaggcuuuuua

SEQ ID NO: 3541060 - RNA, 12 nt, Human
uccuuggcacca

SEQ ID NO: 3541061 - RNA, 15 nt, Human
uccuuggcaccaaag

SEQ ID NO: 3541062 - RNA, 16 nt, Human
uccuuggcaccaaaga

SEQ ID NO: 3541063 - RNA, 18 nt, Human
uccuuggcaugccuucca

SEQ ID NO: 3541064 - RNA, 23 nt, Human
uccuuggccugcuaaggucuugg

SEQ ID NO: 3541065 - RNA, 20 nt, Human
uccuuggcucccauucacuc

SEQ ID NO: 3541066 - RNA, 15 nt, Human
uccuuggcuggugca

SEQ ID NO: 3541067 - RNA, 20 nt, Human
uccuuggcuuaccugaccuc

SEQ ID NO: 3541068 - RNA, 15 nt, Human
uccuugggaggaagc

SEQ ID NO: 3541069 - RNA, 17 nt, Human
uccuugggaggaagcag

SEQ ID NO: 3541070 - RNA, 18 nt, Human
uccuugggaggaagcaga

SEQ ID NO: 3541071 - RNA, 21 nt, Human
uccuugggaggccccacuggg

SEQ ID NO: 3541072 - RNA, 17 nt, Human
uccuugggcacuuuuua

SEQ ID NO: 3541073 - RNA, 23 nt, Human
uccuuggucuuuguaucuuccau

SEQ ID NO: 3541074 - RNA, 21 nt, Human
uccuuggugucgggcaugaca

SEQ ID NO: 3541075 - RNA, 21 nt, Human
uccuuggugugacccucugaa

SEQ ID NO: 3541076 - RNA, 15 nt, Human
uccuuguagccuuuu

SEQ ID NO: 3541077 - RNA, 13 nt, Human
ggcagaggccugg

SEQ ID NO: 3541078 - RNA, 13 nt, Human
ggcagaggcugga

SEQ ID NO: 3541079 - RNA, 21 nt, Human
ggcagaggcuggaggcagggc

SEQ ID NO: 3541080 - RNA, 22 nt, Human
ggcagaggcuggaggcagggcc

SEQ ID NO: 3541081 - RNA, 23 nt, Human
ggcagaggcuggaggcagggccu

SEQ ID NO: 3541082 - RNA, 14 nt, Human
ggcagagggcagag

SEQ ID NO: 3541083 - RNA, 20 nt, Human
ggcagagggcuggaggccca

SEQ ID NO: 3541084 - RNA, 18 nt, Human
ggcagaguuacaguucug

SEQ ID NO: 3541085 - RNA, 19 nt, Human
ggcagaguuacaguucugu

SEQ ID NO: 3541086 - RNA, 17 nt, Human
ggcagaguugaagacag

SEQ ID NO: 3541087 - RNA, 23 nt, Human
ggcagaguugaagacagagcuac

SEQ ID NO: 3541088 - RNA, 17 nt, Human
ggcagaguuguaaauau

SEQ ID NO: 3541089 - RNA, 22 nt, Human
ggcagaguuguaaauauauaaa

SEQ ID NO: 3541090 - RNA, 18 nt, Human
ggcagauaaucagccucu

SEQ ID NO: 3541091 - RNA, 23 nt, Human
ggcagauacaggaaaagcugcug

SEQ ID NO: 3541092 - RNA, 18 nt, Human
ggcagaucaccagagguc

SEQ ID NO: 3541093 - RNA, 20 nt, Human
ggcagaucugugccccaugc

SEQ ID NO: 3541094 - RNA, 18 nt, Human
ggcagaugcagcucuucc

SEQ ID NO: 3541095 - RNA, 20 nt, Human
ggcagaugcagcucuuccug

SEQ ID NO: 3541096 - RNA, 20 nt, Human
ggcagauguaggagggacug

SEQ ID NO: 3541097 - RNA, 16 nt, Human
ggcagauuuuacaaaa

SEQ ID NO: 3541098 - RNA, 21 nt, Human
ggcagauuuuacagagcgcac

SEQ ID NO: 3541099 - RNA, 13 nt, Human
ggcagcaaggccc

SEQ ID NO: 3541100 - RNA, 18 nt, Human
ggcagcaaggcccgagca

SEQ ID NO: 3541101 - RNA, 20 nt, Human
ggcagcaaggcccgagcagc

SEQ ID NO: 3541102 - RNA, 21 nt, Human
ggcagcaaggcccgagcagcu

SEQ ID NO: 3541103 - RNA, 21 nt, Human
ggcagcacagagacccccgga

SEQ ID NO: 3541104 - RNA, 13 nt, Human
ggcagcacccagg

SEQ ID NO: 3541105 - RNA, 12 nt, Human
ggcagcaccgcc

SEQ ID NO: 3541106 - RNA, 10 nt, Human
ggcagcagau

SEQ ID NO: 3541107 - RNA, 15 nt, Human
ggcagcagcagcccu

SEQ ID NO: 3541108 - RNA, 17 nt, Human
ggcagcagcagcccugc

SEQ ID NO: 3541109 - RNA, 17 nt, Human
ggcagcagccagcccug

SEQ ID NO: 3541110 - RNA, 19 nt, Human
ggcagcagccagcccugcc

SEQ ID NO: 3541111 - RNA, 20 nt, Human
ggcagcagccagcccugccu

SEQ ID NO: 3541112 - RNA, 21 nt, Human
ggcagcagccagcccugccug

SEQ ID NO: 3541113 - RNA, 12 nt, Human
ggcagcagccau

SEQ ID NO: 3541114 - RNA, 17 nt, Human
ggcagcauagcaagaca

SEQ ID NO: 3541115 - RNA, 19 nt, Human
ggcagcauagcaagacaca

SEQ ID NO: 3541116 - RNA, 16 nt, Human
ggcagccaaacccaug

SEQ ID NO: 3541117 - RNA, 19 nt, Human
ggcagccaaacccaugagg

SEQ ID NO: 3541118 - RNA, 20 nt, Human
ggcagccaaacccaugaggc

SEQ ID NO: 3541119 - RNA, 20 nt, Human
ggcagccagggagagcccag

SEQ ID NO: 3541120 - RNA, 21 nt, Human
ggcagccagggagagcccagg

SEQ ID NO: 3541121 - RNA, 15 nt, Human
ggcagccagugcccu

SEQ ID NO: 3541122 - RNA, 21 nt, Human
ggcagcccagagacuuuguag

SEQ ID NO: 3541123 - RNA, 13 nt, Human
ggcagcccagcca

SEQ ID NO: 3541124 - RNA, 15 nt, Human
ggcagccccagccug

SEQ ID NO: 3541125 - RNA, 18 nt, Human
ggcagccccagccugcua

SEQ ID NO: 3541126 - RNA, 18 nt, Human
ggcagccccaggccaaag

SEQ ID NO: 3541127 - RNA, 22 nt, Human
ggcagccccuguucuggcagag

SEQ ID NO: 3541128 - RNA, 21 nt, Human
ggcagcccuugcuuguuggga

SEQ ID NO: 3541129 - RNA, 19 nt, Human
ggcagccgugccuucagcu

SEQ ID NO: 3541130 - RNA, 22 nt, Human
ggcagccgugggccccacccuc

SEQ ID NO: 3541131 - RNA, 19 nt, Human
ggcagccuacuagggaccu

SEQ ID NO: 3541132 - RNA, 22 nt, Human
ggcagccucccauccagggccc

SEQ ID NO: 3541133 - RNA, 12 nt, Human
ggcagccucugu

SEQ ID NO: 3541134 - RNA, 20 nt, Human
ggcagccucugucaggccuu

SEQ ID NO: 3541135 - RNA, 14 nt, Human
ggcagccugccugg

SEQ ID NO: 3541136 - RNA, 23 nt, Human
ggcagccugccuugcccacuccu

SEQ ID NO: 3541137 - RNA, 19 nt, Human
ggcagccugcguggcugac

SEQ ID NO: 3541138 - RNA, 22 nt, Human
ggcagccugcguggcugacccc

SEQ ID NO: 3541139 - RNA, 18 nt, Human
ggcagcgccaagcaaccu

SEQ ID NO: 3541140 - RNA, 14 nt, Human
ggcagcgccaggcu

SEQ ID NO: 3541141 - RNA, 21 nt, Human
ggcagcgccaggcugaccaca

SEQ ID NO: 3541142 - RNA, 22 nt, Human
ggcagcgccaggcugaccacag

SEQ ID NO: 3541143 - RNA, 16 nt, Human
ggcagcgcccuuccuc

SEQ ID NO: 3541144 - RNA, 17 nt, Human
ggcagcgcccuuccucu

SEQ ID NO: 3541145 - RNA, 15 nt, Human
ggcagcuauaggaaa

SEQ ID NO: 3541146 - RNA, 21 nt, Human
ggcagcucaccucucccuugg

SEQ ID NO: 3541147 - RNA, 16 nt, Human
ggcagcucuccaguca

SEQ ID NO: 3541148 - RNA, 21 nt, Human
ggcagcugaacuauuggaggg

SEQ ID NO: 3541149 - RNA, 11 nt, Human
ggcagcugccu

SEQ ID NO: 3541150 - RNA, 21 nt, Human
ggcagcugccuccccuccucu

SEQ ID NO: 3541151 - RNA, 22 nt, Human
ggcagcugccuccccuccucug

SEQ ID NO: 3541152 - RNA, 12 nt, Human
ggcagcugggcc

SEQ ID NO: 3541153 - RNA, 13 nt, Human
ggcagcugggccc

SEQ ID NO: 3541154 - RNA, 15 nt, Human
ggcagcuuagggccc

SEQ ID NO: 3541155 - RNA, 20 nt, Human
ggcagcuucugcccccugca

SEQ ID NO: 3541156 - RNA, 23 nt, Human
ggcagcuucugcccccugcagaa

SEQ ID NO: 3541157 - RNA, 19 nt, Human
ggcaggaccagcccacgcu

SEQ ID NO: 3541158 - RNA, 23 nt, Human
ggcaggaccuucgggcugugccc

SEQ ID NO: 3541159 - RNA, 15 nt, Human
ggcaggagcucagau

SEQ ID NO: 3541160 - RNA, 14 nt, Human
ggcaggagggcccu

SEQ ID NO: 3541161 - RNA, 17 nt, Human
ggcaggaguagcugagc

SEQ ID NO: 3541162 - RNA, 15 nt, Human
ggcaggauuggggaa

SEQ ID NO: 3541163 - RNA, 20 nt, Human
ggcaggcagaggcccaggcu

SEQ ID NO: 3541164 - RNA, 15 nt, Human
ggcaggcagcgccaa

SEQ ID NO: 3541165 - RNA, 11 nt, Human
ggcaggcaggg

SEQ ID NO: 3541166 - RNA, 14 nt, Human
ggcaggcagggcuc

SEQ ID NO: 3541167 - RNA, 16 nt, Human
ggcaggcauggcccug

SEQ ID NO: 3541168 - RNA, 18 nt, Human
ggcaggcauggcccuggg

SEQ ID NO: 3541169 - RNA, 20 nt, Human
ggcaggcauggcccugggcg

SEQ ID NO: 3541170 - RNA, 18 nt, Human
ggcaggccaccuggcucu

SEQ ID NO: 3541171 - RNA, 12 nt, Human
ggcaggcccugc

SEQ ID NO: 3541172 - RNA, 13 nt, Human
ggcaggcccugca

SEQ ID NO: 3541173 - RNA, 21 nt, Human
ggcaggcccugcacuguccug

SEQ ID NO: 3541174 - RNA, 14 nt, Human
ggcaggcccugcag

SEQ ID NO: 3541175 - RNA, 16 nt, Human
ggcaggcccugcagug

SEQ ID NO: 3541176 - RNA, 21 nt, Human
ggcaggcuaaggcguggagcu

SEQ ID NO: 3541177 - RNA, 22 nt, Human
ggcaggcucacugccaggccag

SEQ ID NO: 3541178 - RNA, 17 nt, Human
ggcaggcuggccagucc

SEQ ID NO: 3541179 - RNA, 15 nt, Human
ggcaggcugggccau

SEQ ID NO: 3541180 - RNA, 22 nt, Human
ggcaggcugggccauguccaaa

SEQ ID NO: 3541181 - RNA, 17 nt, Human
ggcagggaacaugggga

SEQ ID NO: 3541182 - RNA, 20 nt, Human
ggcagggaacauggggagga

SEQ ID NO: 3541183 - RNA, 20 nt, Human
ggcagggaagaggggugcag

SEQ ID NO: 3541184 - RNA, 14 nt, Human
ggcagggaccacac

SEQ ID NO: 3541185 - RNA, 16 nt, Human
ggcagggaggcagccg

SEQ ID NO: 3541186 - RNA, 13 nt, Human
ggcagggagggga

SEQ ID NO: 3541187 - RNA, 23 nt, Human
ggcagggcaaaugacaugcacug

SEQ ID NO: 3541188 - RNA, 19 nt, Human
ggcagggcacagggccugg

SEQ ID NO: 3541189 - RNA, 22 nt, Human
ggcagggcacagggccuggccc

SEQ ID NO: 3541190 - RNA, 15 nt, Human
ggcagggcaucuccu

SEQ ID NO: 3541191 - RNA, 17 nt, Human
ggcagggccagggggug

SEQ ID NO: 3541192 - RNA, 22 nt, Human
ggcagggcgggcagagggcugg

SEQ ID NO: 3541193 - RNA, 23 nt, Human
ggcagggcgggcagagggcugga

SEQ ID NO: 3541194 - RNA, 17 nt, Human
ggcagggcucuccuggc

SEQ ID NO: 3541195 - RNA, 17 nt, Human
ggcccagcauugcuggu

SEQ ID NO: 3541196 - RNA, 16 nt, Human
ggcccagcccccacag

SEQ ID NO: 3541197 - RNA, 14 nt, Human
ggcccagccccuag

SEQ ID NO: 3541198 - RNA, 24 nt, Human
ggcccagccccuagaaacccaagc

SEQ ID NO: 3541199 - RNA, 16 nt, Human
ggcccagcccggcucc

SEQ ID NO: 3541200 - RNA, 12 nt, Human
ggcccagcccug

SEQ ID NO: 3541201 - RNA, 22 nt, Human
ggcccagcccugcuggccgccu

SEQ ID NO: 3541202 - RNA, 19 nt, Human
ggcccagccgacccccucu

SEQ ID NO: 3541203 - RNA, 22 nt, Human
ggcccagcgcggacauccccug

SEQ ID NO: 3541204 - RNA, 15 nt, Human
ggcccaggaccagcu

SEQ ID NO: 3541205 - RNA, 18 nt, Human
ggcccaggaguuuggcca

SEQ ID NO: 3541206 - RNA, 21 nt, Human
ggcccaggaguuuggccagaa

SEQ ID NO: 3541207 - RNA, 23 nt, Human
ggcccaggaguuuggccagaagu

SEQ ID NO: 3541208 - RNA, 15 nt, Human
ggcccaggcugccgu

SEQ ID NO: 3541209 - RNA, 15 nt, Human
ggcccagggcccaga

SEQ ID NO: 3541210 - RNA, 17 nt, Human
ggcccagggcccagagc

SEQ ID NO: 3541211 - RNA, 22 nt, Human
ggcccagggcccagagcccagc

SEQ ID NO: 3541212 - RNA, 22 nt, Human
ggcccagggggcuuccugaggg

SEQ ID NO: 3541213 - RNA, 17 nt, Human
ggcccaguaugagcccu

SEQ ID NO: 3541214 - RNA, 14 nt, Human
ggcccaguccuggc

SEQ ID NO: 3541215 - RNA, 21 nt, Human
ggcccagugcaugguggccag

SEQ ID NO: 3541216 - RNA, 22 nt, Human
ggcccagugucaaguugugcuu

SEQ ID NO: 3541217 - RNA, 23 nt, Human
ggcccauagaaacaugacacuga

SEQ ID NO: 3541218 - RNA, 21 nt, Human
ggcccaucaggguaggcugga

SEQ ID NO: 3541219 - RNA, 13 nt, Human
ggcccaucccccc

SEQ ID NO: 3541220 - RNA, 14 nt, Human
ggcccaucucccug

SEQ ID NO: 3541221 - RNA, 16 nt, Human
ggcccaucucccugcu

SEQ ID NO: 3541222 - RNA, 18 nt, Human
ggcccaucucccugcuuu

SEQ ID NO: 3541223 - RNA, 19 nt, Human
ggcccaucucccugcuuug

SEQ ID NO: 3541224 - RNA, 20 nt, Human
ggcccaugggagggagcuga

SEQ ID NO: 3541225 - RNA, 15 nt, Human
ggcccauucuacuug

SEQ ID NO: 3541226 - RNA, 19 nt, Human
ggccccaacccuguccucc

SEQ ID NO: 3541227 - RNA, 13 nt, Human
ggccccacaccag

SEQ ID NO: 3541228 - RNA, 14 nt, Human
ggccccaccaccua

SEQ ID NO: 3541229 - RNA, 16 nt, Human
ggccccaccagugccu

SEQ ID NO: 3541230 - RNA, 23 nt, Human
ggccccacccugggcccugggcu

SEQ ID NO: 3541231 - RNA, 19 nt, Human
ggccccaccugcagcuccc

SEQ ID NO: 3541232 - RNA, 13 nt, Human
ggccccaccuggc

SEQ ID NO: 3541233 - RNA, 22 nt, Human
ggccccaccuggcccucucuga

SEQ ID NO: 3541234 - RNA, 13 nt, Human
ggccccagagacu

SEQ ID NO: 3541235 - RNA, 18 nt, Human
ggccccagagacucagag

SEQ ID NO: 3541236 - RNA, 11 nt, Human
ggccccagcca

SEQ ID NO: 3541237 - RNA, 23 nt, Human
ggccccagcccacccuccugucu

SEQ ID NO: 3541238 - RNA, 16 nt, Human
ggccccagcccugcug

SEQ ID NO: 3541239 - RNA, 12 nt, Human
ggccccagccug

SEQ ID NO: 3541240 - RNA, 13 nt, Human
ggccccagccugg

SEQ ID NO: 3541241 - RNA, 19 nt, Human
ggccccagccuggcccagc

SEQ ID NO: 3541242 - RNA, 19 nt, Human
ggccccagcuucucagcuc

SEQ ID NO: 3541243 - RNA, 16 nt, Human
ggccccagggcacccu

SEQ ID NO: 3541244 - RNA, 14 nt, Human
ggccccaugaccuc

SEQ ID NO: 3541245 - RNA, 18 nt, Human
ggccccaugaccuccagc

SEQ ID NO: 3541246 - RNA, 14 nt, Human
ggcccccaaaugga

SEQ ID NO: 3541247 - RNA, 13 nt, Human
ggcccccacaugg

SEQ ID NO: 3541248 - RNA, 20 nt, Human
ggcccccaccacacauccca

SEQ ID NO: 3541249 - RNA, 22 nt, Human
ggcccccaccacacaucccagc

SEQ ID NO: 3541250 - RNA, 12 nt, Human
ggcccccacugg

SEQ ID NO: 3541251 - RNA, 12 nt, Human
ggcccccagagc

SEQ ID NO: 3541252 - RNA, 15 nt, Human
ggcccccagagcgcc

SEQ ID NO: 3541253 - RNA, 14 nt, Human
ggcccccagcccag

SEQ ID NO: 3541254 - RNA, 23 nt, Human
ggcccccagcccagggcuccugc

SEQ ID NO: 3541255 - RNA, 15 nt, Human
ggcccccagcugugg

SEQ ID NO: 3541256 - RNA, 17 nt, Human
ggccccccuccuugcuc

SEQ ID NO: 3541257 - RNA, 20 nt, Human
ggccccccuccuugcucugc

SEQ ID NO: 3541258 - RNA, 21 nt, Human
ggccccccugguccccuccuu

SEQ ID NO: 3541259 - RNA, 13 nt, Human
ggcccccgagcug

SEQ ID NO: 3541260 - RNA, 15 nt, Human
ggcccccgagcuggg

SEQ ID NO: 3541261 - RNA, 16 nt, Human
ggcccccgggaggacg

SEQ ID NO: 3541262 - RNA, 16 nt, Human
ggcccccucccuggau

SEQ ID NO: 3541263 - RNA, 20 nt, Human
ggcccccucucaggagccau

SEQ ID NO: 3541264 - RNA, 13 nt, Human
ggcccccugccug

SEQ ID NO: 3541265 - RNA, 17 nt, Human
ggcccccugccugcccu

SEQ ID NO: 3541266 - RNA, 18 nt, Human
ggcccccuggucucuggu

SEQ ID NO: 3541267 - RNA, 17 nt, Human
ggccccgaggacccaga

SEQ ID NO: 3541268 - RNA, 15 nt, Human
ggccccgcccaggcu

SEQ ID NO: 3541269 - RNA, 15 nt, Human
ggccccgccgccugg

SEQ ID NO: 3541270 - RNA, 18 nt, Human
ggccccgccgccugguac

SEQ ID NO: 3541271 - RNA, 21 nt, Human
ggccccgcuuguccagcgccu

SEQ ID NO: 3541272 - RNA, 18 nt, Human
ggccccggccccagccag

SEQ ID NO: 3541273 - RNA, 22 nt, Human
ggccccuauguaguccgugcug

SEQ ID NO: 3541274 - RNA, 19 nt, Human
ggccccucacccugccuua

SEQ ID NO: 3541275 - RNA, 15 nt, Human
ggccccucaccuacu

SEQ ID NO: 3541276 - RNA, 19 nt, Human
ggccccucagggucccugg

SEQ ID NO: 3541277 - RNA, 12 nt, Human
ggccccuccagc

SEQ ID NO: 3541278 - RNA, 13 nt, Human
ggccccucccccg

SEQ ID NO: 3541279 - RNA, 16 nt, Human
ggccccucccccugag

SEQ ID NO: 3541280 - RNA, 14 nt, Human
ggccccuccccucc

SEQ ID NO: 3541281 - RNA, 18 nt, Human
ucugcccacauuggaccc

SEQ ID NO: 3541282 - RNA, 22 nt, Human
ucugcccaccucagccucccaa

SEQ ID NO: 3541283 - RNA, 14 nt, Human
ucugcccacucccu

SEQ ID NO: 3541284 - RNA, 18 nt, Human
ucugcccacucccugcaa

SEQ ID NO: 3541285 - RNA, 13 nt, Human
ucugcccaggcac

SEQ ID NO: 3541286 - RNA, 22 nt, Human
ucugcccaggcacugcuaggcu

SEQ ID NO: 3541287 - RNA, 19 nt, Human
ucugcccaggggugccccc

SEQ ID NO: 3541288 - RNA, 21 nt, Human
ucugcccaggggugcccccuc

SEQ ID NO: 3541289 - RNA, 22 nt, Human
ucugcccaggggugcccccucc

SEQ ID NO: 3541290 - RNA, 19 nt, Human
ucugcccauuccccagccu

SEQ ID NO: 3541291 - RNA, 14 nt, Human
ucugccccagaggc

SEQ ID NO: 3541292 - RNA, 14 nt, Human
ucugccccagcucu

SEQ ID NO: 3541293 - RNA, 17 nt, Human
ucugccccagcucuggc

SEQ ID NO: 3541294 - RNA, 21 nt, Human
ucugccccauccuccagcagg

SEQ ID NO: 3541295 - RNA, 14 nt, Human
ucugcccccagccc

SEQ ID NO: 3541296 - RNA, 15 nt, Human
ucugcccccagccca

SEQ ID NO: 3541297 - RNA, 20 nt, Human
ucugccccccccccccaucu

SEQ ID NO: 3541298 - RNA, 14 nt, Human
ucugcccccugcag

SEQ ID NO: 3541299 - RNA, 15 nt, Human
ucugcccccugcaga

SEQ ID NO: 3541300 - RNA, 16 nt, Human
ucugcccccugcuggc

SEQ ID NO: 3541301 - RNA, 12 nt, Human
ucugccccuccc

SEQ ID NO: 3541302 - RNA, 15 nt, Human
ucugccccuccccca

SEQ ID NO: 3541303 - RNA, 13 nt, Human
ucugccccucccu

SEQ ID NO: 3541304 - RNA, 23 nt, Human
ucugcccgccugcccaccugccu

SEQ ID NO: 3541305 - RNA, 10 nt, Human
ucugcccggg

SEQ ID NO: 3541306 - RNA, 18 nt, Human
ucugcccucauuacuggg

SEQ ID NO: 3541307 - RNA, 18 nt, Human
ucugcccuccaagaccuu

SEQ ID NO: 3541308 - RNA, 19 nt, Human
ucugcccuccaagaccuuc

SEQ ID NO: 3541309 - RNA, 18 nt, Human
ucugcccucccuccuucc

SEQ ID NO: 3541310 - RNA, 10 nt, Human
ucugcccugc

SEQ ID NO: 3541311 - RNA, 22 nt, Human
ucugcccugcgggucacaggag

SEQ ID NO: 3541312 - RNA, 15 nt, Human
ucugcccuggcugcu

SEQ ID NO: 3541313 - RNA, 16 nt, Human
ucugcccuggcugcug

SEQ ID NO: 3541314 - RNA, 21 nt, Human
ucugcccuggcugcugccccc

SEQ ID NO: 3541315 - RNA, 20 nt, Human
ucugcccugugggaccccag

SEQ ID NO: 3541316 - RNA, 22 nt, Human
ucugcccugugggaccccaggc

SEQ ID NO: 3541317 - RNA, 12 nt, Human
ucugcccuuggu

SEQ ID NO: 3541318 - RNA, 14 nt, Human
ucugccgcagcccu

SEQ ID NO: 3541319 - RNA, 15 nt, Human
ucugccuaaggacuu

SEQ ID NO: 3541320 - RNA, 16 nt, Human
ucugccuaaggacuuc

SEQ ID NO: 3541321 - RNA, 20 nt, Human
ucugccuaaggacuucuuua

SEQ ID NO: 3541322 - RNA, 21 nt, Human
ucugccuacagaacuucagaa

SEQ ID NO: 3541323 - RNA, 21 nt, Human
ucugccucaaugugaaucaga

SEQ ID NO: 3541324 - RNA, 21 nt, Human
ucugccucaccgcuucccucc

SEQ ID NO: 3541325 - RNA, 12 nt, Human
ucugccucccau

SEQ ID NO: 3541326 - RNA, 21 nt, Human
ucugccucccaucacccgcua

SEQ ID NO: 3541327 - RNA, 22 nt, Human
ucugccuccccuuaaaggggag

SEQ ID NO: 3541328 - RNA, 12 nt, Human
ucugccucucaa

SEQ ID NO: 3541329 - RNA, 15 nt, Human
ucugccucugacaca

SEQ ID NO: 3541330 - RNA, 18 nt, Human
ucugccucugacacacag

SEQ ID NO: 3541331 - RNA, 22 nt, Human
ucugccucugacacacagcucu

SEQ ID NO: 3541332 - RNA, 19 nt, Human
ucugccucuucugggaggg

SEQ ID NO: 3541333 - RNA, 19 nt, Human
ucugccugaagucacacag

SEQ ID NO: 3541334 - RNA, 21 nt, Human
ucugccugaggggcagccugc

SEQ ID NO: 3541335 - RNA, 22 nt, Human
ucugccugaggggcagccugcc

SEQ ID NO: 3541336 - RNA, 21 nt, Human
ucugccugccagcugcacuga

SEQ ID NO: 3541337 - RNA, 21 nt, Human
ucugccuggaguguaugacug

SEQ ID NO: 3541338 - RNA, 12 nt, Human
ucugccugucuc

SEQ ID NO: 3541339 - RNA, 21 nt, Human
ucugccuguuauaacucugca

SEQ ID NO: 3541340 - RNA, 17 nt, Human
ggcccuccacaccugcg

SEQ ID NO: 3541341 - RNA, 15 nt, Human
ggcccuccagagccc

SEQ ID NO: 3541342 - RNA, 15 nt, Human
ggcccuccgacagcc

SEQ ID NO: 3541343 - RNA, 17 nt, Human
ggcccuccuacccugcg

SEQ ID NO: 3541344 - RNA, 21 nt, Human
ggcccuccuacccugcgccca

SEQ ID NO: 3541345 - RNA, 14 nt, Human
ggcccuccugugcu

SEQ ID NO: 3541346 - RNA, 20 nt, Human
ggcccuccugugcuggggga

SEQ ID NO: 3541347 - RNA, 22 nt, Human
ggcccucgcugccagcucugua

SEQ ID NO: 3541348 - RNA, 17 nt, Human
ggcccucgggcccagcc

SEQ ID NO: 3541349 - RNA, 19 nt, Human
ggcccucgggcccagcccc

SEQ ID NO: 3541350 - RNA, 23 nt, Human
ggcccucuccccugcccccugca

SEQ ID NO: 3541351 - RNA, 14 nt, Human
ggcccucuccugcc

SEQ ID NO: 3541352 - RNA, 23 nt, Human
ggcccucucugaaggaggccacc

SEQ ID NO: 3541353 - RNA, 21 nt, Human
ggcccucucugcucugcgugu

SEQ ID NO: 3541354 - RNA, 13 nt, Human
ggcccucugccca

SEQ ID NO: 3541355 - RNA, 15 nt, Human
ggcccucugcccacu

SEQ ID NO: 3541356 - RNA, 16 nt, Human
ggcccucugcccacuc

SEQ ID NO: 3541357 - RNA, 17 nt, Human
ggcccucugcccacucc

SEQ ID NO: 3541358 - RNA, 19 nt, Human
ggcccucugguagacacag

SEQ ID NO: 3541359 - RNA, 19 nt, Human
ggcccugacauuggagccu

SEQ ID NO: 3541360 - RNA, 11 nt, Human
ggcccugagcg

SEQ ID NO: 3541361 - RNA, 23 nt, Human
ggcccugagcgaguggagucugc

SEQ ID NO: 3541362 - RNA, 19 nt, Human
ggcccugagcucgguggac

SEQ ID NO: 3541363 - RNA, 21 nt, Human
ggcccugagcucgguggaccc

SEQ ID NO: 3541364 - RNA, 16 nt, Human
ggcccugagguguggg

SEQ ID NO: 3541365 - RNA, 18 nt, Human
ggcccugagguguggggg

SEQ ID NO: 3541366 - RNA, 19 nt, Human
ggcccugaggugugggggc

SEQ ID NO: 3541367 - RNA, 19 nt, Human
ggcccugagucugggcagc

SEQ ID NO: 3541368 - RNA, 18 nt, Human
ggcccugcaccugugcag

SEQ ID NO: 3541369 - RNA, 23 nt, Human
ggcccugcacuguccugcuccac

SEQ ID NO: 3541370 - RNA, 23 nt, Human
ggcccugcaguguucgcuuggcu

SEQ ID NO: 3541371 - RNA, 12 nt, Human
ggcccugcccac

SEQ ID NO: 3541372 - RNA, 20 nt, Human
ggcccugcccacaccuccug

SEQ ID NO: 3541373 - RNA, 13 nt, Human
ggcccugcccugg

SEQ ID NO: 3541374 - RNA, 11 nt, Human
ggcccugccug

SEQ ID NO: 3541375 - RNA, 14 nt, Human
ggcccugccuucuu

SEQ ID NO: 3541376 - RNA, 18 nt, Human
ggcccugcuccugcagca

SEQ ID NO: 3541377 - RNA, 13 nt, Human
ggcccugcugccc

SEQ ID NO: 3541378 - RNA, 14 nt, Human
ggcccugcugccca

SEQ ID NO: 3541379 - RNA, 18 nt, Human
ggcccugcuuccugcuug

SEQ ID NO: 3541380 - RNA, 21 nt, Human
ggcccuggagcagccacccca

SEQ ID NO: 3541381 - RNA, 13 nt, Human
ggcccuggcuccc

SEQ ID NO: 3541382 - RNA, 18 nt, Human
ggcccuggcucugcuguc

SEQ ID NO: 3541383 - RNA, 18 nt, Human
ggcccugggccugccuca

SEQ ID NO: 3541384 - RNA, 23 nt, Human
ggcccugggccugccucaccacg

SEQ ID NO: 3541385 - RNA, 18 nt, Human
ggcccugggcucggaggc

SEQ ID NO: 3541386 - RNA, 12 nt, Human
ggcccugggcug

SEQ ID NO: 3541387 - RNA, 11 nt, Human
ggcccuggggc

SEQ ID NO: 3541388 - RNA, 16 nt, Human
ggcccuggggccugua

SEQ ID NO: 3541389 - RNA, 17 nt, Human
ggcccuggggccuguac

SEQ ID NO: 3541390 - RNA, 23 nt, Human
ggcccuggggccuguacugccug

SEQ ID NO: 3541391 - RNA, 19 nt, Human
ggcccugucauccagcuca

SEQ ID NO: 3541392 - RNA, 17 nt, Human
ggcccugucccucccac

SEQ ID NO: 3541393 - RNA, 21 nt, Human
ggcccugucccucccaccucu

SEQ ID NO: 3541394 - RNA, 17 nt, Human
ggcccugugccuuggug

SEQ ID NO: 3541395 - RNA, 14 nt, Human
ggcccugugugcag

SEQ ID NO: 3541396 - RNA, 16 nt, Human
ggcccuuccuccucca

SEQ ID NO: 3541397 - RNA, 13 nt, Human
ggcccuuccucuc

SEQ ID NO: 3541398 - RNA, 18 nt, Human
ggcccuuccucuccacug

SEQ ID NO: 3541399 - RNA, 17 nt, Human
ggcccuuccuggacagc

SEQ ID NO: 3541400 - RNA, 19 nt, Human
ggcccuuccuggacagcug

SEQ ID NO: 3541401 - RNA, 21 nt, Human
ggcccuuccuggacagcugug

SEQ ID NO: 3541402 - RNA, 19 nt, Human
ggcccuucucuccagcccc

SEQ ID NO: 3541403 - RNA, 17 nt, Human
ggcccuucuugcugccc

SEQ ID NO: 3541404 - RNA, 18 nt, Human
ggcccuucuugcugcccu

SEQ ID NO: 3541405 - RNA, 21 nt, Human
ggcccuugcaguucagcacca

SEQ ID NO: 3541406 - RNA, 13 nt, Human
ggcccuuugcugu

SEQ ID NO: 3541407 - RNA, 18 nt, Human
ggccgaagcucuggcuga

SEQ ID NO: 3541408 - RNA, 14 nt, Human
ggccgacggagccg

SEQ ID NO: 3541409 - RNA, 15 nt, Human
ggccgagaagcaaga

SEQ ID NO: 3541410 - RNA, 18 nt, Human
ggccgaggguccuggcuc

SEQ ID NO: 3541411 - RNA, 15 nt, Human
ggccgaugcccagag

SEQ ID NO: 3541412 - RNA, 20 nt, Human
ggccgauuugggaaccaagc

SEQ ID NO: 3541413 - RNA, 16 nt, Human
ggccgcauucccugag

SEQ ID NO: 3541414 - RNA, 12 nt, Human
ggccgcccccug

SEQ ID NO: 3541415 - RNA, 16 nt, Human
ggccgcccccugcccc

SEQ ID NO: 3541416 - RNA, 13 nt, Human
ggccgccucaccc

SEQ ID NO: 3541417 - RNA, 17 nt, Human
ggccgccugcgggcugc

SEQ ID NO: 3541418 - RNA, 22 nt, Human
ggccgcgccaaauaaugucucu

SEQ ID NO: 3541419 - RNA, 19 nt, Human
ggccgcgcguccagcugcc

SEQ ID NO: 3541420 - RNA, 16 nt, Human
ggccgcggagccugca

SEQ ID NO: 3541421 - RNA, 19 nt, Human
ggccgcuagaggccugagg

SEQ ID NO: 3541422 - RNA, 16 nt, Human
ggccgcuagaugggca

SEQ ID NO: 3541423 - RNA, 19 nt, Human
ggccgcuagaugggcaugg

SEQ ID NO: 3541424 - RNA, 17 nt, Human
ggccgcugaguggcagg

SEQ ID NO: 3541425 - RNA, 12 nt, Human
ggccgcugccac

SEQ ID NO: 3541426 - RNA, 15 nt, Human
ggccgcugccaccca

SEQ ID NO: 3541427 - RNA, 19 nt, Human
ggccgcugccacccaccuc

SEQ ID NO: 3541428 - RNA, 19 nt, Human
ggccgcuguucacccacag

SEQ ID NO: 3541429 - RNA, 13 nt, Human
ggccggccagcca

SEQ ID NO: 3541430 - RNA, 19 nt, Human
ggccggccagccagccacu

SEQ ID NO: 3541431 - RNA, 15 nt, Human
ggccggccagccccu

SEQ ID NO: 3541432 - RNA, 13 nt, Human
ggccggccagccu

SEQ ID NO: 3541433 - RNA, 15 nt, Human
ggccggcgagcccug

SEQ ID NO: 3541434 - RNA, 19 nt, Human
ggccggcuugccacacccc

SEQ ID NO: 3541435 - RNA, 22 nt, Human
ggccgggaccccgagccuggcu

SEQ ID NO: 3541436 - RNA, 15 nt, Human
ggccgggcacagcug

SEQ ID NO: 3541437 - RNA, 22 nt, Human
ggccgggccuguacagucuguc

SEQ ID NO: 3541438 - RNA, 19 nt, Human
ggccggggaacuggccaag

SEQ ID NO: 3541439 - RNA, 21 nt, Human
ggccggggaacuggccaagcu

SEQ ID NO: 3541440 - RNA, 18 nt, Human
ggccggucugcaagucag

SEQ ID NO: 3541441 - RNA, 20 nt, Human
ggccggucugcaagucagag

SEQ ID NO: 3541442 - RNA, 15 nt, Human
ggccggugugggcug

SEQ ID NO: 3541443 - RNA, 23 nt, Human
ggccgguuucgaaguugaugcaa

SEQ ID NO: 3541444 - RNA, 19 nt, Human
ggccgucaggacccaccau

SEQ ID NO: 3541445 - RNA, 18 nt, Human
ucugggagucacacagug

SEQ ID NO: 3541446 - RNA, 19 nt, Human
ucugggaguggggaaguga

SEQ ID NO: 3541447 - RNA, 19 nt, Human
ucugggcaggaccucagag

SEQ ID NO: 3541448 - RNA, 19 nt, Human
ucugggcaucuguucuggu

SEQ ID NO: 3541449 - RNA, 16 nt, Human
ucugggccaaguuccu

SEQ ID NO: 3541450 - RNA, 20 nt, Human
ucugggcccggccauguccu

SEQ ID NO: 3541451 - RNA, 18 nt, Human
ucugggccuuggccugga

SEQ ID NO: 3541452 - RNA, 15 nt, Human
ucugggcuauggaca

SEQ ID NO: 3541453 - RNA, 23 nt, Human
ucugggcuguaacguggcacugg

SEQ ID NO: 3541454 - RNA, 20 nt, Human
ucugggcuuauaucuggccu

SEQ ID NO: 3541455 - RNA, 15 nt, Human
ucugggcuuccugga

SEQ ID NO: 3541456 - RNA, 19 nt, Human
ucugggcuuggggcuuccu

SEQ ID NO: 3541457 - RNA, 22 nt, Human
ucuggggaaagacacugccugg

SEQ ID NO: 3541458 - RNA, 15 nt, Human
ucuggggaccagcuu

SEQ ID NO: 3541459 - RNA, 23 nt, Human
ucuggggagcgggucugcuccca

SEQ ID NO: 3541460 - RNA, 18 nt, Human
ucuggggauacuggcaaa

SEQ ID NO: 3541461 - RNA, 23 nt, Human
ucuggggcagcacccuauaaauc

SEQ ID NO: 3541462 - RNA, 11 nt, Human
ucuggggcugu

SEQ ID NO: 3541463 - RNA, 14 nt, Human
ucuggggcuguuca

SEQ ID NO: 3541464 - RNA, 19 nt, Human
ucugggggcacaagacuga

SEQ ID NO: 3541465 - RNA, 15 nt, Human
ucugggggcugcagu

SEQ ID NO: 3541466 - RNA, 18 nt, Human
ucuggggggacccagugc

SEQ ID NO: 3541467 - RNA, 19 nt, Human
ucugggggguggccaggcc

SEQ ID NO: 3541468 - RNA, 21 nt, Human
ucugggguauggcguaaguac

SEQ ID NO: 3541469 - RNA, 16 nt, Human
ucugggguucagcccc

SEQ ID NO: 3541470 - RNA, 19 nt, Human
ucugggguucagccccucc

SEQ ID NO: 3541471 - RNA, 21 nt, Human
ucugggguucagccccuccuc

SEQ ID NO: 3541472 - RNA, 18 nt, Human
ucuggguagcuguaaggc

SEQ ID NO: 3541473 - RNA, 18 nt, Human
ucugggugcuacugggga

SEQ ID NO: 3541474 - RNA, 16 nt, Human
ucugggugguugcccu

SEQ ID NO: 3541475 - RNA, 16 nt, Human
ucuggguucacugcaa

SEQ ID NO: 3541476 - RNA, 16 nt, Human
ucuggguuccuuccuc

SEQ ID NO: 3541477 - RNA, 15 nt, Human
ucuggguucugggug

SEQ ID NO: 3541478 - RNA, 16 nt, Human
ucuggguuugagaaau

SEQ ID NO: 3541479 - RNA, 15 nt, Human
ucugguacucuccua

SEQ ID NO: 3541480 - RNA, 21 nt, Human
ucugguagaagggaaagccca

SEQ ID NO: 3541481 - RNA, 18 nt, Human
ucugguagauagaaauaa

SEQ ID NO: 3541482 - RNA, 20 nt, Human
ucugguagauuuuuaacgaa

SEQ ID NO: 3541483 - RNA, 14 nt, Human
ucugguauuaaaug

SEQ ID NO: 3541484 - RNA, 19 nt, Human
ucucuuuucuuuagagcau

SEQ ID NO: 3541485 - RNA, 22 nt, Human
ucucuuuugaauccaugcuugg

SEQ ID NO: 3541486 - RNA, 18 nt, Human
ucucuuuuugcuuucgaa

SEQ ID NO: 3541487 - RNA, 20 nt, Human
ucucuuuuuggaggugcuua

SEQ ID NO: 3541488 - RNA, 12 nt, Human
ucucuuuuuguu

SEQ ID NO: 3541489 - RNA, 14 nt, Human
ucucuuuuuguuug

SEQ ID NO: 3541490 - RNA, 14 nt, Human
ucucuuuuuuaagu

SEQ ID NO: 3541491 - RNA, 17 nt, Human
ucucuuuuuuacaaagg

SEQ ID NO: 3541492 - RNA, 19 nt, Human
ucucuuuuuuuggcccagg

SEQ ID NO: 3541493 - RNA, 23 nt, Human
ucugaaaaauuccuuuguguuuc

SEQ ID NO: 3541494 - RNA, 12 nt, Human
ucugaaaacugg

SEQ ID NO: 3541495 - RNA, 12 nt, Human
ucugaaaagaaa

SEQ ID NO: 3541496 - RNA, 14 nt, Human
ucugaaaauauaac

SEQ ID NO: 3541497 - RNA, 16 nt, Human
ucugaaaauguaugug

SEQ ID NO: 3541498 - RNA, 22 nt, Human
ucugaaaauguuguuaugcuau

SEQ ID NO: 3541499 - RNA, 17 nt, Human
ucugaaaauuaacacug

SEQ ID NO: 3541500 - RNA, 21 nt, Human
ucugaaacacacugaaagcuc

SEQ ID NO: 3541501 - RNA, 14 nt, Human
ucuucgacuguugu

SEQ ID NO: 3541502 - RNA, 15 nt, Human
ucuucgcgcccgccc

SEQ ID NO: 3541503 - RNA, 17 nt, Human
ucuucgggaccaggauu

SEQ ID NO: 3541504 - RNA, 14 nt, Human
ucuucguacaguuc

SEQ ID NO: 3541505 - RNA, 17 nt, Human
ucuucguacaguucuuc

SEQ ID NO: 3541506 - RNA, 16 nt, Human
ucuucuaaaaaaaaac

SEQ ID NO: 3541507 - RNA, 18 nt, Human
ucuucuacaacucauaca

SEQ ID NO: 3541508 - RNA, 12 nt, Human
ucuucuagaguu

SEQ ID NO: 3541509 - RNA, 22 nt, Human
ucuucuauauaauuccuguuuu

SEQ ID NO: 3541510 - RNA, 15 nt, Human
ucuucuauugccucu

SEQ ID NO: 3541511 - RNA, 16 nt, Human
ucuucuauugccucug

SEQ ID NO: 3541512 - RNA, 17 nt, Human
ucuucucaagugccuua

SEQ ID NO: 3541513 - RNA, 19 nt, Human
ucuucucaaguucuaagau

SEQ ID NO: 3541514 - RNA, 21 nt, Human
ucuucucaaguucuaagauuc

SEQ ID NO: 3541515 - RNA, 20 nt, Human
ucuucucaggcucugcccug

SEQ ID NO: 3541516 - RNA, 17 nt, Human
ucuucucauagcauuaa

SEQ ID NO: 3541517 - RNA, 20 nt, Human
ucuucucauagcauuaacua

SEQ ID NO: 3541518 - RNA, 10 nt, Human
ucuucucauu

SEQ ID NO: 3541519 - RNA, 17 nt, Human
ucuucucauuacuuguu

SEQ ID NO: 3541520 - RNA, 20 nt, Human
ucuucucauuucaccccucc

SEQ ID NO: 3541521 - RNA, 12 nt, Human
ucuucuccacca

SEQ ID NO: 3541522 - RNA, 12 nt, Human
ucuucuccacug

SEQ ID NO: 3541523 - RNA, 19 nt, Human
ucuucuccacuuucuagcc

SEQ ID NO: 3541524 - RNA, 23 nt, Human
ucuucuccagauuuuucggaggc

SEQ ID NO: 3541525 - RNA, 16 nt, Human
ucuucucccaauucau

SEQ ID NO: 3541526 - RNA, 22 nt, Human
ucuucucccagaaucccagccg

SEQ ID NO: 3541527 - RNA, 14 nt, Human
ucuucuccccaggu

SEQ ID NO: 3541528 - RNA, 17 nt, Human
ucuucuccuauguguaa

SEQ ID NO: 3541529 - RNA, 13 nt, Human
ucuucucucagac

SEQ ID NO: 3541530 - RNA, 20 nt, Human
ucuucucucucaauuuuauc

SEQ ID NO: 3541531 - RNA, 12 nt, Human
ucuucucucugc

SEQ ID NO: 3541532 - RNA, 14 nt, Human
ucuucucugugaga

SEQ ID NO: 3541533 - RNA, 18 nt, Human
ucuucucugugagaaggu

SEQ ID NO: 3541534 - RNA, 13 nt, Human
ucuucugaaauga

SEQ ID NO: 3541535 - RNA, 22 nt, Human
ucuucugaaaugaaacaaauaa

SEQ ID NO: 3541536 - RNA, 18 nt, Human
ucuucugaauaaagcaau

SEQ ID NO: 3541537 - RNA, 16 nt, Human
ucuucugaauauuuua

SEQ ID NO: 3541538 - RNA, 22 nt, Human
ucuucugacaaacuguguacau

SEQ ID NO: 3541539 - RNA, 19 nt, Human
ucuucugagcuauuucauc

SEQ ID NO: 3541540 - RNA, 23 nt, Human
ucuucugcauuuuucagagaaua

SEQ ID NO: 3541541 - RNA, 20 nt, Human
ucuucugcccaauuggagga

SEQ ID NO: 3541542 - RNA, 12 nt, Human
ucuucugcucca

SEQ ID NO: 3541543 - RNA, 20 nt, Human
ucuucugcuccacccuuggc

SEQ ID NO: 3541544 - RNA, 23 nt, Human
ucuucugcuccacccuuggccug

SEQ ID NO: 3541545 - RNA, 16 nt, Human
ucuucugcucuuucuu

SEQ ID NO: 3541546 - RNA, 19 nt, Human
ucuucugcuucagccuccc

SEQ ID NO: 3541547 - RNA, 12 nt, Human
ucuucugcuuug

SEQ ID NO: 3541548 - RNA, 21 nt, Human
ucuucugcuuuguugugugcc

SEQ ID NO: 3541549 - RNA, 20 nt, Human
ucuucugggagggcagcagg

SEQ ID NO: 3541550 - RNA, 16 nt, Human
ucuucugggcacccuc

SEQ ID NO: 3541551 - RNA, 21 nt, Human
ucuucuggggcaggcugggcc

SEQ ID NO: 3541552 - RNA, 22 nt, Human
ucuucugguacuuucuguuaug

SEQ ID NO: 3541553 - RNA, 15 nt, Human
ucuucuguaauauuu

SEQ ID NO: 3541554 - RNA, 18 nt, Human
ucuucuguaauauuuaca

SEQ ID NO: 3541555 - RNA, 15 nt, Human
ucuucuguacgucug

SEQ ID NO: 3541556 - RNA, 22 nt, Human
ucuucuguacgucugacaggca

SEQ ID NO: 3541557 - RNA, 14 nt, Human
ucuucugucaucua

SEQ ID NO: 3541558 - RNA, 17 nt, Human
ucuucugucaucuaccu

SEQ ID NO: 3541559 - RNA, 12 nt, Human
ucuucuguccaa

SEQ ID NO: 3541560 - RNA, 23 nt, Human
ucuucugugauucgguggagacu

SEQ ID NO: 3541561 - RNA, 16 nt, Human
ucuucuguuuucuguu

SEQ ID NO: 3541562 - RNA, 17 nt, Human
ucuucuguuuucuguuu

SEQ ID NO: 3541563 - RNA, 16 nt, Human
ucuucuuaauguacau

SEQ ID NO: 3541564 - RNA, 24 nt, Human
ucuucuuaauguacauagugcuaa

SEQ ID NO: 3541565 - RNA, 18 nt, Human
ucuucuuccacacaugca

SEQ ID NO: 3541566 - RNA, 22 nt, Human
ucuucuugaacacucaugcuga

SEQ ID NO: 3541567 - RNA, 23 nt, Human
ucuucuugaacacucaugcugaa

SEQ ID NO: 3541568 - RNA, 23 nt, Human
ucuucuuggccaugggaggccuu

SEQ ID NO: 3541569 - RNA, 15 nt, Human
ucuucuuguuucucc

SEQ ID NO: 3541570 - RNA, 17 nt, Human
ucuucuuucagacuugc

SEQ ID NO: 3541571 - RNA, 17 nt, Human
ucuucuuucugucuuua

SEQ ID NO: 3541572 - RNA, 19 nt, Human
ucuucuuuugagcaacuuu

SEQ ID NO: 3541573 - RNA, 18 nt, Human
ucuucuuuuuuugugaug

SEQ ID NO: 3541574 - RNA, 17 nt, Human
ucuugaaagaagaaugu

SEQ ID NO: 3541575 - RNA, 18 nt, Human
ucuugaaagaagaaugug

SEQ ID NO: 3541576 - RNA, 14 nt, Human
ucuugaaagcugug

SEQ ID NO: 3541577 - RNA, 21 nt, Human
ucuugaaauauaggaacuuaa

SEQ ID NO: 3541578 - RNA, 14 nt, Human
ucuugaaauuaaga

SEQ ID NO: 3541579 - RNA, 20 nt, Human
ucuugaaauuaagaaggcaa

SEQ ID NO: 3541580 - RNA, 21 nt, Human
ucuugaaauuaagaaggcaaa

SEQ ID NO: 3541581 - RNA, 19 nt, Human
ucuugaacacucaugcuga

SEQ ID NO: 3541582 - RNA, 17 nt, Human
ucuugaacuccuggccu

SEQ ID NO: 3541583 - RNA, 17 nt, Human
ucuugaacugagcuugg

SEQ ID NO: 3541584 - RNA, 22 nt, Human
ucuugaagacuuuucuuucagc

SEQ ID NO: 3541585 - RNA, 15 nt, Human
ucuugaagggcccag

SEQ ID NO: 3541586 - RNA, 16 nt, Human
ucuugaagggcccagg

SEQ ID NO: 3541587 - RNA, 16 nt, Human
ucuugaauccuuccau

SEQ ID NO: 3541588 - RNA, 22 nt, Human
ucuugaauggcaauguuuugcu

SEQ ID NO: 3541589 - RNA, 23 nt, Human
ucuugaauggcaauguuuugcuu

SEQ ID NO: 3541590 - RNA, 12 nt, Human
ucuugaaugugg

SEQ ID NO: 3541591 - RNA, 13 nt, Human
ucuugaauuuaau

SEQ ID NO: 3541592 - RNA, 16 nt, Human
ucuugacccugcaccc

SEQ ID NO: 3541593 - RNA, 17 nt, Human
ucuugacccugcacccu

SEQ ID NO: 3541594 - RNA, 17 nt, Human
ucuugagcaaguuccuu

SEQ ID NO: 3541595 - RNA, 16 nt, Human
ucuugagccugggagg

SEQ ID NO: 3541596 - RNA, 12 nt, Human
ucuugagcuggc

SEQ ID NO: 3541597 - RNA, 14 nt, Human
ucuugagcuggccu

SEQ ID NO: 3541598 - RNA, 22 nt, Human
ucuugaggggaagcuagucuuu

SEQ ID NO: 3541599 - RNA, 18 nt, Human
ucuugaggggaccaggag

SEQ ID NO: 3541600 - RNA, 22 nt, Human
ucuugaggugguaguaaaacac

SEQ ID NO: 3541601 - RNA, 20 nt, Human
ucuugaguauaagaaaugca

SEQ ID NO: 3541602 - RNA, 21 nt, Human
ucuugaguauaagaaaugcau

SEQ ID NO: 3541603 - RNA, 13 nt, Human
ucuugaguuuguc

SEQ ID NO: 3541604 - RNA, 14 nt, Human
ucuugaguuugucg

SEQ ID NO: 3541605 - RNA, 18 nt, Human
ucuugaguuuuucaggua

SEQ ID NO: 3541606 - RNA, 14 nt, Human
ucuugauaagacca

SEQ ID NO: 3541607 - RNA, 19 nt, Human
ucuugaucaacaucuuuuc

SEQ ID NO: 3541608 - RNA, 16 nt, Human
ucuugaucaguuaaga

SEQ ID NO: 3541609 - RNA, 22 nt, Human
ucuugaucugcucagcccugga

SEQ ID NO: 3541610 - RNA, 12 nt, Human
ucuugaugacca

SEQ ID NO: 3541611 - RNA, 18 nt, Human
ucuugaugacuggaauuu

SEQ ID NO: 3541612 - RNA, 20 nt, Human
ucuugaugacuggaauuuuu

SEQ ID NO: 3541613 - RNA, 21 nt, Human
ucuugaugcaugcacuguucc

SEQ ID NO: 3541614 - RNA, 18 nt, Human
ucuugauguggugaggca

SEQ ID NO: 3541615 - RNA, 23 nt, Human
ucuugauuauccauauugaguca

SEQ ID NO: 3541616 - RNA, 23 nt, Human
ucuugauucguagauuuaauaac

SEQ ID NO: 3541617 - RNA, 17 nt, Human
ucuugcaaaauuccuga

SEQ ID NO: 3541618 - RNA, 17 nt, Human
ucuugcaagcaugcuug

SEQ ID NO: 3541619 - RNA, 18 nt, Human
ucuugcaauggcagccuu

SEQ ID NO: 3541620 - RNA, 19 nt, Human
ucuugcacagucacugcuc

SEQ ID NO: 3541621 - RNA, 20 nt, Human
ucuugcacagucacugcucu

SEQ ID NO: 3541622 - RNA, 18 nt, Human
ucuugcacccgccucucc

SEQ ID NO: 3541623 - RNA, 13 nt, Human
ucuugcagugauu

SEQ ID NO: 3541624 - RNA, 23 nt, Human
ucuugcauccuuccuauaacuug

SEQ ID NO: 3541625 - RNA, 19 nt, Human
ucuugccaaauauaaauaa

SEQ ID NO: 3541626 - RNA, 20 nt, Human
ucuugccaaccuguaauaaa

SEQ ID NO: 3541627 - RNA, 13 nt, Human
ucuugcccauccu

SEQ ID NO: 3541628 - RNA, 9 nt, Human
ucugagaaa

SEQ ID NO: 3541629 - RNA, 22 nt, Human
ucugagaaaagaacguauuuua

SEQ ID NO: 3541630 - RNA, 15 nt, Human
ucugagaaacaauga

SEQ ID NO: 3541631 - RNA, 14 nt, Human
ucugagaaagacua

SEQ ID NO: 3541632 - RNA, 13 nt, Human
ucugagaacucau

SEQ ID NO: 3541633 - RNA, 16 nt, Human
ucugagaagaggagcc

SEQ ID NO: 3541634 - RNA, 17 nt, Human
ucugagaagguccuuaa

SEQ ID NO: 3541635 - RNA, 12 nt, Human
ucugagaaucuu

SEQ ID NO: 3541636 - RNA, 22 nt, Human
ucugagaaucuuuauugagaaa

SEQ ID NO: 3541637 - RNA, 18 nt, Human
ucugagaauuccaaggag

SEQ ID NO: 3541638 - RNA, 20 nt, Human
ucugagaauuccaaggaguu

SEQ ID NO: 3541639 - RNA, 23 nt, Human
ucugagacucgcgacaaugcaaa

SEQ ID NO: 3541640 - RNA, 20 nt, Human
ucugagagaggcuaaaaugu

SEQ ID NO: 3541641 - RNA, 16 nt, Human
ucugagagcaaacugg

SEQ ID NO: 3541642 - RNA, 12 nt, Human
ucugagagcugu

SEQ ID NO: 3541643 - RNA, 16 nt, Human
ucugagaggcccugga

SEQ ID NO: 3541644 - RNA, 17 nt, Human
ucugagaggcccuggau

SEQ ID NO: 3541645 - RNA, 19 nt, Human
ucugagagucuagauucuc

SEQ ID NO: 3541646 - RNA, 24 nt, Human
ucugagaucaaaacgguuuuacug

SEQ ID NO: 3541647 - RNA, 18 nt, Human
ucugagauggcucccagg

SEQ ID NO: 3541648 - RNA, 19 nt, Human
ucugagcagcgagccugcu

SEQ ID NO: 3541649 - RNA, 20 nt, Human
ucugagcauuagauuucuca

SEQ ID NO: 3541650 - RNA, 18 nt, Human
ucugagccaaagagaaug

SEQ ID NO: 3541651 - RNA, 15 nt, Human
ucugagccacagcag

SEQ ID NO: 3541652 - RNA, 20 nt, Human
ucugagccagugcuuuaaug

SEQ ID NO: 3541653 - RNA, 22 nt, Human
ucugagccaguucaguaccugg

SEQ ID NO: 3541654 - RNA, 15 nt, Human
ucugagcccgggcug

SEQ ID NO: 3541655 - RNA, 21 nt, Human
ucugagcccgggcugccuggg

SEQ ID NO: 3541656 - RNA, 24 nt, Human
ucugagcccgggcugccugggcug

SEQ ID NO: 3541657 - RNA, 17 nt, Human
ucugagcccucaaagug

SEQ ID NO: 3541658 - RNA, 14 nt, Human
ucugagcgccucca

SEQ ID NO: 3541659 - RNA, 16 nt, Human
ucugagcgggaggcag

SEQ ID NO: 3541660 - RNA, 22 nt, Human
ucugagcuauuucaucuauuuu

SEQ ID NO: 3541661 - RNA, 12 nt, Human
ucugagcuccug

SEQ ID NO: 3541662 - RNA, 20 nt, Human
ucugagcuccuguccccugc

SEQ ID NO: 3541663 - RNA, 18 nt, Human
ucugagcucugcauuugu

SEQ ID NO: 3541664 - RNA, 18 nt, Human
ucugagcucuuugcacua

SEQ ID NO: 3541665 - RNA, 23 nt, Human
ggcucugaagcaaggcgguggac

SEQ ID NO: 3541666 - RNA, 18 nt, Human
ggcucugagaaggggagg

SEQ ID NO: 3541667 - RNA, 15 nt, Human
ggcucugagagucua

SEQ ID NO: 3541668 - RNA, 18 nt, Human
ggcucugagagucuagau

SEQ ID NO: 3541669 - RNA, 20 nt, Human
ggcucugagagucuagauuc

SEQ ID NO: 3541670 - RNA, 19 nt, Human
ggcucugaggugccugucc

SEQ ID NO: 3541671 - RNA, 16 nt, Human
ggcucugccccagagg

SEQ ID NO: 3541672 - RNA, 21 nt, Human
ggcucugccccagaggccucu

SEQ ID NO: 3541673 - RNA, 20 nt, Human
ggcucugccccagcucuggc

SEQ ID NO: 3541674 - RNA, 21 nt, Human
ggcucugccccagucguuaga

SEQ ID NO: 3541675 - RNA, 13 nt, Human
ggcucugcccugc

SEQ ID NO: 3541676 - RNA, 13 nt, Human
ggcucugccuccc

SEQ ID NO: 3541677 - RNA, 19 nt, Human
ggcucugcuggccggagca

SEQ ID NO: 3541678 - RNA, 15 nt, Human
ggcucuggagacagc

SEQ ID NO: 3541679 - RNA, 13 nt, Human
ggcucuggagccc

SEQ ID NO: 3541680 - RNA, 17 nt, Human
ggcucuggagcccacug

SEQ ID NO: 3541681 - RNA, 23 nt, Human
ggcucuggagcccacuguacuug

SEQ ID NO: 3541682 - RNA, 14 nt, Human
ggcucuguccccag

SEQ ID NO: 3541683 - RNA, 16 nt, Human
ggcucuguccccagcc

SEQ ID NO: 3541684 - RNA, 18 nt, Human
ggcucuguccccagccug

SEQ ID NO: 3541685 - RNA, 16 nt, Human
ggcucugugcugaccc

SEQ ID NO: 3541686 - RNA, 14 nt, Human
ggcucugugggcug

SEQ ID NO: 3541687 - RNA, 19 nt, Human
ggcucuuagcagcuuccag

SEQ ID NO: 3541688 - RNA, 11 nt, Human
ggcucuuccaa

SEQ ID NO: 3541689 - RNA, 20 nt, Human
ggcucuuccaggcugggaga

SEQ ID NO: 3541690 - RNA, 23 nt, Human
ggcucuuccaggcugggagagcc

SEQ ID NO: 3541691 - RNA, 12 nt, Human
ggcucuucuccu

SEQ ID NO: 3541692 - RNA, 13 nt, Human
ggcucuucugacu

SEQ ID NO: 3541693 - RNA, 17 nt, Human
ggcucuuuccuugcuca

SEQ ID NO: 3541694 - RNA, 13 nt, Human
ggcugaaaacaau

SEQ ID NO: 3541695 - RNA, 24 nt, Human
ggcugaaagaacauggacuuguau

SEQ ID NO: 3541696 - RNA, 13 nt, Human
ggcugaaagacag

SEQ ID NO: 3541697 - RNA, 21 nt, Human
ggcugaaaggaagcugugcgu

SEQ ID NO: 3541698 - RNA, 14 nt, Human
ggcugaaauucucc

SEQ ID NO: 3541699 - RNA, 17 nt, Human
ggcugaaauucuccugg

SEQ ID NO: 3541700 - RNA, 19 nt, Human
ggcugaaauucuccuggag

SEQ ID NO: 3541701 - RNA, 22 nt, Human
ggcugaaauucuccuggagguc

SEQ ID NO: 3541702 - RNA, 14 nt, Human
ggcugaacccugug

SEQ ID NO: 3541703 - RNA, 22 nt, Human
ggcugaacccugugcugguguc

SEQ ID NO: 3541704 - RNA, 23 nt, Human
ggcugaacccugugcuggugucc

SEQ ID NO: 3541705 - RNA, 17 nt, Human
ggcugaacggggagaaa

SEQ ID NO: 3541706 - RNA, 14 nt, Human
ggcugaaggacugu

SEQ ID NO: 3541707 - RNA, 16 nt, Human
ggcugaauagcagaag

SEQ ID NO: 3541708 - RNA, 18 nt, Human
ggcugacaucuguguuuc

SEQ ID NO: 3541709 - RNA, 16 nt, Human
ggcugaccacagcaca

SEQ ID NO: 3541710 - RNA, 17 nt, Human
ggcugaccacagcacag

SEQ ID NO: 3541711 - RNA, 22 nt, Human
ggcugaccacagcacagccaac

SEQ ID NO: 3541712 - RNA, 18 nt, Human
ggcugacccagucccugg

SEQ ID NO: 3541713 - RNA, 20 nt, Human
ggcugaccuuccucgcagag

SEQ ID NO: 3541714 - RNA, 23 nt, Human
ggcugacgugugagggaggacag

SEQ ID NO: 3541715 - RNA, 24 nt, Human
ggcugacuagaagggccaguccug

SEQ ID NO: 3541716 - RNA, 17 nt, Human
ggcugagaacccugcgu

SEQ ID NO: 3541717 - RNA, 18 nt, Human
ggcugagacaggagaauc

SEQ ID NO: 3541718 - RNA, 15 nt, Human
ggcugagagaguggc

SEQ ID NO: 3541719 - RNA, 17 nt, Human
ggcugagagaguggcau

SEQ ID NO: 3541720 - RNA, 14 nt, Human
ggcugagagcccca

SEQ ID NO: 3541721 - RNA, 16 nt, Human
ggcugagagccccagc

SEQ ID NO: 3541722 - RNA, 17 nt, Human
ggcugagagccccagcu

SEQ ID NO: 3541723 - RNA, 19 nt, Human
ggcugagagccccagcuga

SEQ ID NO: 3541724 - RNA, 22 nt, Human
ggcugagccccuaccccacacc

SEQ ID NO: 3541725 - RNA, 14 nt, Human
ggcugagcccuggc

SEQ ID NO: 3541726 - RNA, 21 nt, Human
ggcugaggaagcacagcagca

SEQ ID NO: 3541727 - RNA, 13 nt, Human
ggcugaggagcag

SEQ ID NO: 3541728 - RNA, 20 nt, Human
ggcugaggaggccuccaucu

SEQ ID NO: 3541729 - RNA, 17 nt, Human
ggcugaggcagaagaau

SEQ ID NO: 3541730 - RNA, 18 nt, Human
ggcugaggcaggagaauc

SEQ ID NO: 3541731 - RNA, 15 nt, Human
ggcugagggagccug

SEQ ID NO: 3541732 - RNA, 16 nt, Human
ggcugagggagccugg

SEQ ID NO: 3541733 - RNA, 22 nt, Human
ggcugagggauggacugaugcu

SEQ ID NO: 3541734 - RNA, 13 nt, Human
ggcugagggccug

SEQ ID NO: 3541735 - RNA, 17 nt, Human
ggcugagggccugcugg

SEQ ID NO: 3541736 - RNA, 18 nt, Human
ggcugagguuccucugcc

SEQ ID NO: 3541737 - RNA, 22 nt, Human
ggcugagguuccucugccugcc

SEQ ID NO: 3541738 - RNA, 17 nt, Human
ggcugaguagcucugcc

SEQ ID NO: 3541739 - RNA, 13 nt, Human
ggcugagugcagg

SEQ ID NO: 3541740 - RNA, 18 nt, Human
ggcugagugcaggcccac

SEQ ID NO: 3541741 - RNA, 13 nt, Human
ggcugaucucagg

SEQ ID NO: 3541742 - RNA, 14 nt, Human
ggcugaucucaggg

SEQ ID NO: 3541743 - RNA, 21 nt, Human
ggcugaugccaaguuguuuga

SEQ ID NO: 3541744 - RNA, 22 nt, Human
ggcugaugccaaguuguuugag

SEQ ID NO: 3541745 - RNA, 18 nt, Human
ggcugcaaaggguaucag

SEQ ID NO: 3541746 - RNA, 15 nt, Human
ggcugcacucugugc

SEQ ID NO: 3541747 - RNA, 13 nt, Human
ggcugcagaggcc

SEQ ID NO: 3541748 - RNA, 20 nt, Human
ggcugcagcagcgguggccu

SEQ ID NO: 3541749 - RNA, 12 nt, Human
ggcugcagcaug

SEQ ID NO: 3541750 - RNA, 22 nt, Human
ggcugcagccaggccacuggcc

SEQ ID NO: 3541751 - RNA, 14 nt, Human
ggcugcagccucag

SEQ ID NO: 3541752 - RNA, 17 nt, Human
ggcugcagcuggacaga

SEQ ID NO: 3541753 - RNA, 19 nt, Human
ggcugcagcuggacagagg

SEQ ID NO: 3541754 - RNA, 12 nt, Human
ggcugcagggag

SEQ ID NO: 3541755 - RNA, 22 nt, Human
ggcugcaguccuccgguugcau

SEQ ID NO: 3541756 - RNA, 15 nt, Human
ggcugcagugagcca

SEQ ID NO: 3541757 - RNA, 17 nt, Human
ggcugcaguucuacuca

SEQ ID NO: 3541758 - RNA, 21 nt, Human
ggcugcauacccgggcagggc

SEQ ID NO: 3541759 - RNA, 13 nt, Human
ggcugcauagaag

SEQ ID NO: 3541760 - RNA, 22 nt, Human
ggcugcaugauguuugcccaaa

SEQ ID NO: 3541761 - RNA, 22 nt, Human
ggcugcaugcgggcuuccuccu

SEQ ID NO: 3541762 - RNA, 19 nt, Human
ggcugccaaugggagcuca

SEQ ID NO: 3541763 - RNA, 20 nt, Human
ggcugccaaugggagcucau

SEQ ID NO: 3541764 - RNA, 17 nt, Human
ggcugccagugccuggg

SEQ ID NO: 3541765 - RNA, 21 nt, Human
ggcugcccccggcccccuggu

SEQ ID NO: 3541766 - RNA, 23 nt, Human
ggcugccccuaaucucuguagga

SEQ ID NO: 3541767 - RNA, 16 nt, Human
ggcugcccgcucccag

SEQ ID NO: 3541768 - RNA, 13 nt, Human
ggcugcccuccug

SEQ ID NO: 3541769 - RNA, 14 nt, Human
ggcugcccugagaa

SEQ ID NO: 3541770 - RNA, 21 nt, Human
ggcugcccugagaagcugcuc

SEQ ID NO: 3541771 - RNA, 17 nt, Human
ggcugcccuggcccuga

SEQ ID NO: 3541772 - RNA, 15 nt, Human
ucuggggcaggguua

SEQ ID NO: 3541773 - RNA, 19 nt, Human
ucuggggccuaauaaaacu

SEQ ID NO: 3541774 - RNA, 18 nt, Human
ucugggggcacaagacug

SEQ ID NO: 3541775 - RNA, 20 nt, Human
ucuggggggacccagugcag

SEQ ID NO: 3541776 - RNA, 17 nt, Human
ucugggggguggccagg

SEQ ID NO: 3541777 - RNA, 18 nt, Human
ucugggggguggccaggc

SEQ ID NO: 3541778 - RNA, 20 nt, Human
ucugggggguggccaggccg

SEQ ID NO: 3541779 - RNA, 19 nt, Human
ucugggguccccagggcug

SEQ ID NO: 3541780 - RNA, 22 nt, Human
ucuggggucuuuuuaugcauuu

SEQ ID NO: 3541781 - RNA, 17 nt, Human
ucugggguuaugauggc

SEQ ID NO: 3541782 - RNA, 22 nt, Human
ucugggguucagccccuccucu

SEQ ID NO: 3541783 - RNA, 23 nt, Human
ucugggguucagccccuccucug

SEQ ID NO: 3541784 - RNA, 13 nt, Human
ucuggguggcccu

SEQ ID NO: 3541785 - RNA, 13 nt, Human
ucuggguggccuc

SEQ ID NO: 3541786 - RNA, 19 nt, Human
ucugggugguugcccuuca

SEQ ID NO: 3541787 - RNA, 14 nt, Human
ucuggguucacugc

SEQ ID NO: 3541788 - RNA, 16 nt, Human
ucuggguucugggugg

SEQ ID NO: 3541789 - RNA, 23 nt, Human
ucugguagaagggaaagcccaua

SEQ ID NO: 3541790 - RNA, 22 nt, Human
ucugguaugaacuugaggacac

SEQ ID NO: 3541791 - RNA, 15 nt, Human
ucugguauuaaaugc

SEQ ID NO: 3541792 - RNA, 18 nt, Human
ucugguccauagagagca

SEQ ID NO: 3541793 - RNA, 14 nt, Human
ucuggucccuugca

SEQ ID NO: 3541794 - RNA, 13 nt, Human
ucugguccuaccc

SEQ ID NO: 3541795 - RNA, 13 nt, Human
ucugguccuuuuu

SEQ ID NO: 3541796 - RNA, 15 nt, Human
ucuggucgcuccugc

SEQ ID NO: 3541797 - RNA, 17 nt, Human
ucuggucgcuccugccc

SEQ ID NO: 3541798 - RNA, 22 nt, Human
ucuggucuaaauuguguuacua

SEQ ID NO: 3541799 - RNA, 18 nt, Human
ucuggucuccucagccuc

SEQ ID NO: 3541800 - RNA, 16 nt, Human
ucuggucucuaggcug

SEQ ID NO: 3541801 - RNA, 15 nt, Human
ucuggucucucuauu

SEQ ID NO: 3541802 - RNA, 17 nt, Human
ucuggugaagcucacuu

SEQ ID NO: 3541803 - RNA, 23 nt, Human
ucuggugaccuuccaagagccug

SEQ ID NO: 3541804 - RNA, 16 nt, Human
ucuggugacuuuccuc

SEQ ID NO: 3541805 - RNA, 23 nt, Human
ucuggugacuuuccucuuugguc

SEQ ID NO: 3541806 - RNA, 20 nt, Human
ucuggugagucaccacuuca

SEQ ID NO: 3541807 - RNA, 16 nt, Human
ucuggugauaaggaca

SEQ ID NO: 3541808 - RNA, 16 nt, Human
ucuggugccuccagag

SEQ ID NO: 3541809 - RNA, 12 nt, Human
ucugguggcccc

SEQ ID NO: 3541810 - RNA, 13 nt, Human
ucuggugucugcu

SEQ ID NO: 3541811 - RNA, 17 nt, Human
ucugguuagcucagccc

SEQ ID NO: 3541812 - RNA, 22 nt, Human
ucugguuagcucagccccagcc

SEQ ID NO: 3541813 - RNA, 13 nt, Human
ucugguuccuccc

SEQ ID NO: 3541814 - RNA, 15 nt, Human
ucugguuguuucugu

SEQ ID NO: 3541815 - RNA, 18 nt, Human
ucugguuguuucuguucc

SEQ ID NO: 3541816 - RNA, 22 nt, Human
ucugguuguuucuguuccaaau

SEQ ID NO: 3541817 - RNA, 14 nt, Human
ucugguuucucauu

SEQ ID NO: 3541818 - RNA, 22 nt, Human
ucugguuugacuccgcuggagg

SEQ ID NO: 3541819 - RNA, 15 nt, Human
ucugguuuugcuauu

SEQ ID NO: 3541820 - RNA, 11 nt, Human
ucuguaaaauc

SEQ ID NO: 3541821 - RNA, 13 nt, Human
ucuguaaaaucuu

SEQ ID NO: 3541822 - RNA, 18 nt, Human
ucuguaaacucaaaacuu

SEQ ID NO: 3541823 - RNA, 14 nt, Human
ucuguaaacugugu

SEQ ID NO: 3541824 - RNA, 16 nt, Human
ucuguaaauauguuuu

SEQ ID NO: 3541825 - RNA, 22 nt, Human
ucuguaagcuguuugguuuuaa

SEQ ID NO: 3541826 - RNA, 23 nt, Human
ucuguaagcuguuugguuuuaaa

SEQ ID NO: 3541827 - RNA, 24 nt, Human
ucuguaauaaacucauuucuagca

SEQ ID NO: 3541828 - RNA, 13 nt, Human
ucuguaauauuua

SEQ ID NO: 3541829 - RNA, 17 nt, Human
ucuguaauuguguguga

SEQ ID NO: 3541830 - RNA, 23 nt, Human
ucuguacagagcccacgccccca

SEQ ID NO: 3541831 - RNA, 23 nt, Human
ucuguacagagccguaaaaacug

SEQ ID NO: 3541832 - RNA, 18 nt, Human
ucuguacauagccuauau

SEQ ID NO: 3541833 - RNA, 22 nt, Human
ucuguaccaguuaauuuuucca

SEQ ID NO: 3541834 - RNA, 17 nt, Human
ucuguacgucugacagg

SEQ ID NO: 3541835 - RNA, 22 nt, Human
ucuguacuaaacaguaagauau

SEQ ID NO: 3541836 - RNA, 14 nt, Human
ucuguacuuccuga

SEQ ID NO: 3541837 - RNA, 14 nt, Human
ucuguacuuuuugg

SEQ ID NO: 3541838 - RNA, 18 nt, Human
ucuguagagggcccuggu

SEQ ID NO: 3541839 - RNA, 19 nt, Human
ucuguagagggcccuggug

SEQ ID NO: 3541840 - RNA, 13 nt, Human
ucuguagcuccuc

SEQ ID NO: 3541841 - RNA, 23 nt, Human
ucuguaggccaguaguucucaaa

SEQ ID NO: 3541842 - RNA, 22 nt, Human
ucuguagggauuuuuggcuaca

SEQ ID NO: 3541843 - RNA, 16 nt, Human
ucuguagggcuggacc

SEQ ID NO: 3541844 - RNA, 20 nt, Human
ucuguagguugcacacuuug

SEQ ID NO: 3541845 - RNA, 19 nt, Human
ucuguaguacuccuuaaga

SEQ ID NO: 3541846 - RNA, 19 nt, Human
ucuguagucauuuacuaaa

SEQ ID NO: 3541847 - RNA, 22 nt, Human
ucuguauaaacauuaaaugucu

SEQ ID NO: 3541848 - RNA, 23 nt, Human
ucuguauaaacauuaaaugucuu

SEQ ID NO: 3541849 - RNA, 23 nt, Human
ucuguauaaagccuguauucuca

SEQ ID NO: 3541850 - RNA, 20 nt, Human
ucuguauaaaugucuuuaau

SEQ ID NO: 3541851 - RNA, 17 nt, Human
ucuguauaaguaagaaa

SEQ ID NO: 3541852 - RNA, 22 nt, Human
ucuguauaaguaagaaaauauu

SEQ ID NO: 3541853 - RNA, 16 nt, Human
ucuguauaauacuuug

SEQ ID NO: 3541854 - RNA, 19 nt, Human
ucuguauaauacuuuguau

SEQ ID NO: 3541855 - RNA, 15 nt, Human
ucuguauauaaaugg

SEQ ID NO: 3541856 - RNA, 13 nt, Human
ucuguaucucucu

SEQ ID NO: 3541857 - RNA, 13 nt, Human
ucuguauguauua

SEQ ID NO: 3541858 - RNA, 15 nt, Human
ucuguauguguucua

SEQ ID NO: 3541859 - RNA, 23 nt, Human
ucuguauuuaugugugaggagcu

SEQ ID NO: 3541860 - RNA, 13 nt, Human
ucuguauuugaaa

SEQ ID NO: 3541861 - RNA, 22 nt, Human
ucuguauuuuuucuugcauuga

SEQ ID NO: 3541862 - RNA, 17 nt, Human
ucugucaaaacacugug

SEQ ID NO: 3541863 - RNA, 19 nt, Human
ucugucaaaacacugugga

SEQ ID NO: 3541864 - RNA, 20 nt, Human
ucugucaaaacacuguggaa

SEQ ID NO: 3541865 - RNA, 13 nt, Human
ucugucaagaaga

SEQ ID NO: 3541866 - RNA, 14 nt, Human
ugaacaaaaggguc

SEQ ID NO: 3541867 - RNA, 14 nt, Human
ugaacaaaauaaau

SEQ ID NO: 3541868 - RNA, 15 nt, Human
ugaacaaaaucuguu

SEQ ID NO: 3541869 - RNA, 13 nt, Human
ugaacaaacuaaa

SEQ ID NO: 3541870 - RNA, 14 nt, Human
ugaacaaagcagcc

SEQ ID NO: 3541871 - RNA, 16 nt, Human
ugaacaaagcagccac

SEQ ID NO: 3541872 - RNA, 17 nt, Human
ugaacaaagcagccacg

SEQ ID NO: 3541873 - RNA, 22 nt, Human
ugaacaaccucggcuccuggac

SEQ ID NO: 3541874 - RNA, 11 nt, Human
ugaacaagaau

SEQ ID NO: 3541875 - RNA, 12 nt, Human
ugaacaagaauu

SEQ ID NO: 3541876 - RNA, 23 nt, Human
ugaacaagcaaacccagacggcu

SEQ ID NO: 3541877 - RNA, 15 nt, Human
ugaacaagcauucuc

SEQ ID NO: 3541878 - RNA, 16 nt, Human
ugaacaagugaacaca

SEQ ID NO: 3541879 - RNA, 19 nt, Human
ugaacaaguuguuucauug

SEQ ID NO: 3541880 - RNA, 22 nt, Human
ugaacaaguuguuucauugacu

SEQ ID NO: 3541881 - RNA, 18 nt, Human
ugaacaaguuuuaaugua

SEQ ID NO: 3541882 - RNA, 21 nt, Human
ugaacaauugucgaaaagagu

SEQ ID NO: 3541883 - RNA, 12 nt, Human
ugaacacaaauu

SEQ ID NO: 3541884 - RNA, 17 nt, Human
ugaacacaaauuaugcu

SEQ ID NO: 3541885 - RNA, 18 nt, Human
ugaacacacuguguccug

SEQ ID NO: 3541886 - RNA, 23 nt, Human
ugaacacacuguguccuggugcu

SEQ ID NO: 3541887 - RNA, 14 nt, Human
ugaacacaggcagc

SEQ ID NO: 3541888 - RNA, 11 nt, Human
ugaacacagua

SEQ ID NO: 3541889 - RNA, 16 nt, Human
ugaacacucaugcuga

SEQ ID NO: 3541890 - RNA, 18 nt, Human
ugaacacucaugcugaaa

SEQ ID NO: 3541891 - RNA, 18 nt, Human
ugaacacuccaauuaagg

SEQ ID NO: 3541892 - RNA, 14 nt, Human
ugaacacuggggga

SEQ ID NO: 3541893 - RNA, 15 nt, Human
ugaacacuuauugcu

SEQ ID NO: 3541894 - RNA, 17 nt, Human
ugaacacuuauugcuuu

SEQ ID NO: 3541895 - RNA, 18 nt, Human
ugaacacuuauugcuuug

SEQ ID NO: 3541896 - RNA, 16 nt, Human
ugaacacuuggugcug

SEQ ID NO: 3541897 - RNA, 18 nt, Human
ugaacacuuggugcuggg

SEQ ID NO: 3541898 - RNA, 19 nt, Human
ugaacacuuggugcuggga

SEQ ID NO: 3541899 - RNA, 13 nt, Human
ugaacagaacaua

SEQ ID NO: 3541900 - RNA, 16 nt, Human
ugaacagaagcucuua

SEQ ID NO: 3541901 - RNA, 17 nt, Human
ugaacagacugaccuug

SEQ ID NO: 3541902 - RNA, 23 nt, Human
ugaacagcauggcacucccucca

SEQ ID NO: 3541903 - RNA, 21 nt, Human
ugaacagcggcuggacuugga

SEQ ID NO: 3541904 - RNA, 22 nt, Human
ugaacagcggcuggacuuggag

SEQ ID NO: 3541905 - RNA, 13 nt, Human
ugaacagcuggug

SEQ ID NO: 3541906 - RNA, 19 nt, Human
ugaacaggugggugucugc

SEQ ID NO: 3541907 - RNA, 12 nt, Human
ugaacagugcac

SEQ ID NO: 3541908 - RNA, 22 nt, Human
ugaacaguuuaugcagugcugc

SEQ ID NO: 3541909 - RNA, 17 nt, Human
ugaacauauuguugaaa

SEQ ID NO: 3541910 - RNA, 17 nt, Human
ugaacauccccucccau

SEQ ID NO: 3541911 - RNA, 17 nt, Human
ugaacauccuuccuucc

SEQ ID NO: 3541912 - RNA, 14 nt, Human
ugaacauggacucu

SEQ ID NO: 3541913 - RNA, 17 nt, Human
ugaacauugcaauagaa

SEQ ID NO: 3541914 - RNA, 12 nt, Human
ugaacauugcau

SEQ ID NO: 3541915 - RNA, 20 nt, Human
ugaacauuuacuacaguuuu

SEQ ID NO: 3541916 - RNA, 16 nt, Human
ucuguucugauauuaa

SEQ ID NO: 3541917 - RNA, 14 nt, Human
ucuguucuguggaa

SEQ ID NO: 3541918 - RNA, 23 nt, Human
ucuguucuguggaaaguguaaag

SEQ ID NO: 3541919 - RNA, 22 nt, Human
ucuguucuuuccaaaguacacu

SEQ ID NO: 3541920 - RNA, 12 nt, Human
ucuguugaaguu

SEQ ID NO: 3541921 - RNA, 16 nt, Human
ucuguugcaagugcaa

SEQ ID NO: 3541922 - RNA, 22 nt, Human
ucuguugcaauuaggauuuuga

SEQ ID NO: 3541923 - RNA, 22 nt, Human
ucuguuggaagcuuguuuucca

SEQ ID NO: 3541924 - RNA, 18 nt, Human
ucuguuggauuccaugcu

SEQ ID NO: 3541925 - RNA, 15 nt, Human
ucuguuggcaggcug

SEQ ID NO: 3541926 - RNA, 12 nt, Human
ucuguuggccag

SEQ ID NO: 3541927 - RNA, 18 nt, Human
ucuguuggccagugugac

SEQ ID NO: 3541928 - RNA, 23 nt, Human
ucuguuggguggcaucauuccag

SEQ ID NO: 3541929 - RNA, 14 nt, Human
ucuguuguaacuua

SEQ ID NO: 3541930 - RNA, 16 nt, Human
ucuguuguaacuuaug

SEQ ID NO: 3541931 - RNA, 12 nt, Human
ucuguuguuuuu

SEQ ID NO: 3541932 - RNA, 17 nt, Human
ucuguuuaaaguagauu

SEQ ID NO: 3541933 - RNA, 13 nt, Human
ucuguuuaagaaa

SEQ ID NO: 3541934 - RNA, 18 nt, Human
ucuguuuaauuuucacuu

SEQ ID NO: 3541935 - RNA, 12 nt, Human
ucuguuucaagg

SEQ ID NO: 3541936 - RNA, 23 nt, Human
ucuguuucaaggcacucuagauu

SEQ ID NO: 3541937 - RNA, 16 nt, Human
ucuguuucucuuuccu

SEQ ID NO: 3541938 - RNA, 13 nt, Human
ucuguuugcugug

SEQ ID NO: 3541939 - RNA, 14 nt, Human
ucuguuugcuguug

SEQ ID NO: 3541940 - RNA, 13 nt, Human
ucuguuuguuaaa

SEQ ID NO: 3541941 - RNA, 16 nt, Human
ucuguuuuaaaaaccu

SEQ ID NO: 3541942 - RNA, 14 nt, Human
ucuguuuuacaagu

SEQ ID NO: 3541943 - RNA, 18 nt, Human
ucuguuuuauaauuuugu

SEQ ID NO: 3541944 - RNA, 17 nt, Human
ucuguuuuaugacuuca

SEQ ID NO: 3541945 - RNA, 13 nt, Human
ucuguuuuccuuu

SEQ ID NO: 3541946 - RNA, 12 nt, Human
ucuguuuucugu

SEQ ID NO: 3541947 - RNA, 17 nt, Human
ucuguuuugaaggcaaa

SEQ ID NO: 3541948 - RNA, 22 nt, Human
ucuguuuuguaaaguccccaga

SEQ ID NO: 3541949 - RNA, 19 nt, Human
ucuguuuuguuucgcucuu

SEQ ID NO: 3541950 - RNA, 21 nt, Human
ucuguuuuguuucgcucuuug

SEQ ID NO: 3541951 - RNA, 23 nt, Human
ucuguuuuguuuggcaaggaaag

SEQ ID NO: 3541952 - RNA, 14 nt, Human
ucuguuuuuaaaaa

SEQ ID NO: 3541953 - RNA, 13 nt, Human
ucuuaaaaaguaa

SEQ ID NO: 3541954 - RNA, 13 nt, Human
ucuuaaaaagugg

SEQ ID NO: 3541955 - RNA, 19 nt, Human
ucuuaaaaaguuguucaac

SEQ ID NO: 3541956 - RNA, 13 nt, Human
ucuuaaaaccugc

SEQ ID NO: 3541957 - RNA, 13 nt, Human
ucuuaaaacuccu

SEQ ID NO: 3541958 - RNA, 19 nt, Human
ucuuaaaagcuaucuucau

SEQ ID NO: 3541959 - RNA, 14 nt, Human
ucuuaaaauaacuu

SEQ ID NO: 3541960 - RNA, 16 nt, Human
ucuuaaaaugcaauau

SEQ ID NO: 3541961 - RNA, 21 nt, Human
ucuuaaaaugcaauauuugua

SEQ ID NO: 3541962 - RNA, 20 nt, Human
ucuuaaaauguuucaaaugg

SEQ ID NO: 3541963 - RNA, 17 nt, Human
ucuuaaagaaacagcuu

SEQ ID NO: 3541964 - RNA, 22 nt, Human
ucuuaaagaaacagcuuucaag

SEQ ID NO: 3541965 - RNA, 23 nt, Human
ucuuaaagcugccuguaguuagg

SEQ ID NO: 3541966 - RNA, 19 nt, Human
ucuuaaagugccaguauuu

SEQ ID NO: 3541967 - RNA, 21 nt, Human
ucuuaaaguugaauuuauugg

SEQ ID NO: 3541968 - RNA, 13 nt, Human
ucuuaaauaaaag

SEQ ID NO: 3541969 - RNA, 15 nt, Human
ucuuaaauaaaccuu

SEQ ID NO: 3541970 - RNA, 19 nt, Human
ucuuaaauaauaaagauca

SEQ ID NO: 3541971 - RNA, 22 nt, Human
ucuuaaauaaugcuucagauau

SEQ ID NO: 3541972 - RNA, 11 nt, Human
ucuuaaauuuu

SEQ ID NO: 3541973 - RNA, 15 nt, Human
ucuuaacaauuucug

SEQ ID NO: 3541974 - RNA, 19 nt, Human
ucuuaacaauuucuguccu

SEQ ID NO: 3541975 - RNA, 12 nt, Human
ucuuaaccaucu

SEQ ID NO: 3541976 - RNA, 14 nt, Human
ucuuaagaaauaaa

SEQ ID NO: 3541977 - RNA, 16 nt, Human
ucuuaagaaauaaauc

SEQ ID NO: 3541978 - RNA, 18 nt, Human
ucuuaagaagacugcauu

SEQ ID NO: 3541979 - RNA, 21 nt, Human
ucuuaagacagcauguguuaa

SEQ ID NO: 3541980 - RNA, 22 nt, Human
ucuuaagaccaccucaaauuua

SEQ ID NO: 3541981 - RNA, 16 nt, Human
ucuuaagccaucuugg

SEQ ID NO: 3541982 - RNA, 17 nt, Human
ucuuaagccaucuuggu

SEQ ID NO: 3541983 - RNA, 19 nt, Human
ucuuaaggacaaagugcca

SEQ ID NO: 3541984 - RNA, 16 nt, Human
ucuuaaggggcagcuu

SEQ ID NO: 3541985 - RNA, 18 nt, Human
ucuuaaggugaggccugu

SEQ ID NO: 3541986 - RNA, 23 nt, Human
ucuuaaggugaggccugucugug

SEQ ID NO: 3541987 - RNA, 18 nt, Human
ucuuaaguuucucagcuc

SEQ ID NO: 3541988 - RNA, 14 nt, Human
ucuuaauauaaauu

SEQ ID NO: 3541989 - RNA, 20 nt, Human
ucuuaauauaaauucacuuu

SEQ ID NO: 3541990 - RNA, 15 nt, Human
ucuuaauauaacugc

SEQ ID NO: 3541991 - RNA, 18 nt, Human
ucuuaauauaacugccuu

SEQ ID NO: 3541992 - RNA, 14 nt, Human
ucuuaaucauuuuu

SEQ ID NO: 3541993 - RNA, 18 nt, Human
ucuuaaucuuuucacaaa

SEQ ID NO: 3541994 - RNA, 19 nt, Human
ucuuaaugaaguuugaaug

SEQ ID NO: 3541995 - RNA, 22 nt, Human
ucuuaaugaaguuugaauguua

SEQ ID NO: 3541996 - RNA, 19 nt, Human
ucuuaauggaugaaaucau

SEQ ID NO: 3541997 - RNA, 19 nt, Human
ucuuaauguacauagugcu

SEQ ID NO: 3541998 - RNA, 13 nt, Human
ucuuaauguuccu

SEQ ID NO: 3541999 - RNA, 15 nt, Human
ucuuaauguuccuca

SEQ ID NO: 3542000 - RNA, 21 nt, Human
ucuuaauuaaguaaacuaaug

SEQ ID NO: 3542001 - RNA, 14 nt, Human
ucuuaauuaauuug

SEQ ID NO: 3542002 - RNA, 19 nt, Human
ucuuaauuauuauaaaaau

SEQ ID NO: 3542003 - RNA, 20 nt, Human
ucuuaauuauuauuuguguu

SEQ ID NO: 3542004 - RNA, 19 nt, Human
ucuuaauugccaccucuaa

SEQ ID NO: 3542005 - RNA, 21 nt, Human
ucuuaauuuugguuguauucu

SEQ ID NO: 3542006 - RNA, 13 nt, Human
ucuuacaaagugu

SEQ ID NO: 3542007 - RNA, 16 nt, Human
ucuuacaaaguguauu

SEQ ID NO: 3542008 - RNA, 23 nt, Human
ucuuacacugccuguauacuuua

SEQ ID NO: 3542009 - RNA, 15 nt, Human
ucuuacccaauuucc

SEQ ID NO: 3542010 - RNA, 22 nt, Human
ucuuacccuguacauauguaaa

SEQ ID NO: 3542011 - RNA, 15 nt, Human
ucuuacccuucugug

SEQ ID NO: 3542012 - RNA, 18 nt, Human
ucuuacccuucugugccc

SEQ ID NO: 3542013 - RNA, 22 nt, Human
ucuuacccuucugugcccagcu

SEQ ID NO: 3542014 - RNA, 17 nt, Human
ucuuaccgacaagcaca

SEQ ID NO: 3542015 - RNA, 19 nt, Human
ucuuacgcccaacccuucc

SEQ ID NO: 3542016 - RNA, 24 nt, Human
ucuuacuaaacauuuuguuauugg

SEQ ID NO: 3542017 - RNA, 20 nt, Human
ucuuacuaauguaaaaugau

SEQ ID NO: 3542018 - RNA, 21 nt, Human
ucuuacuauuaagcaguaaaa

SEQ ID NO: 3542019 - RNA, 19 nt, Human
ucuuacuccuccucuuucu

SEQ ID NO: 3542020 - RNA, 20 nt, Human
ucuuacuccuccucuuucuc

SEQ ID NO: 3542021 - RNA, 21 nt, Human
ucuuacuccuccucuuucucu

SEQ ID NO: 3542022 - RNA, 13 nt, Human
ucuuacugaaggu

SEQ ID NO: 3542023 - RNA, 14 nt, Human
ucuuacugauaauu

SEQ ID NO: 3542024 - RNA, 18 nt, Human
ucuuacuguaccuguucc

SEQ ID NO: 3542025 - RNA, 17 nt, Human
ucuuacuugagccuuua

SEQ ID NO: 3542026 - RNA, 23 nt, Human
ucuuacuuuccuuuccccagccc

SEQ ID NO: 3542027 - RNA, 13 nt, Human
ucuuacuuuguaa

SEQ ID NO: 3542028 - RNA, 18 nt, Human
ucuuacuuuguaaauucu

SEQ ID NO: 3542029 - RNA, 20 nt, Human
ucuuacuuuguaaauucuga

SEQ ID NO: 3542030 - RNA, 22 nt, Human
ucuuacuuuguaaauucugauu

SEQ ID NO: 3542031 - RNA, 20 nt, Human
ucuuagaaaaggugauaaaa

SEQ ID NO: 3542032 - RNA, 13 nt, Human
ucuuagaaaugaa

SEQ ID NO: 3542033 - RNA, 11 nt, Human
ucuuagaaauu

SEQ ID NO: 3542034 - RNA, 15 nt, Human
ucuuagaagaauauu

SEQ ID NO: 3542035 - RNA, 17 nt, Human
ucuuagaagaauauugu

SEQ ID NO: 3542036 - RNA, 18 nt, Human
ucuuagaagaauauugua

SEQ ID NO: 3542037 - RNA, 19 nt, Human
ucuuagaagaauauuguau

SEQ ID NO: 3542038 - RNA, 14 nt, Human
gggaggggcuccuu

SEQ ID NO: 3542039 - RNA, 13 nt, Human
gggagggggcaga

SEQ ID NO: 3542040 - RNA, 15 nt, Human
gggagggggcagaag

SEQ ID NO: 3542041 - RNA, 17 nt, Human
gggaggggggcacaugc

SEQ ID NO: 3542042 - RNA, 21 nt, Human
gggaggggguuacaaacugca

SEQ ID NO: 3542043 - RNA, 23 nt, Human
gggagggguugccacaggccucc

SEQ ID NO: 3542044 - RNA, 16 nt, Human
gggaggguaggcagga

SEQ ID NO: 3542045 - RNA, 17 nt, Human
gggaggguuggggaggg

SEQ ID NO: 3542046 - RNA, 18 nt, Human
gggaggucaaggcugcag

SEQ ID NO: 3542047 - RNA, 15 nt, Human
gggaggucaggcccu

SEQ ID NO: 3542048 - RNA, 16 nt, Human
gggaggucgagguagg

SEQ ID NO: 3542049 - RNA, 23 nt, Human
gggaggugcuucuaguucugcca

SEQ ID NO: 3542050 - RNA, 20 nt, Human
gggaggugggauccuccagg

SEQ ID NO: 3542051 - RNA, 17 nt, Human
gggaguagacuugcuuu

SEQ ID NO: 3542052 - RNA, 21 nt, Human
gggaguaugcaaaaguucuga

SEQ ID NO: 3542053 - RNA, 17 nt, Human
gggaguccccuuuucuu

SEQ ID NO: 3542054 - RNA, 15 nt, Human
gggagucccgucagg

SEQ ID NO: 3542055 - RNA, 14 nt, Human
gggagucugccagg

SEQ ID NO: 3542056 - RNA, 17 nt, Human
gggagugacagaggcag

SEQ ID NO: 3542057 - RNA, 19 nt, Human
gggagugagacagaaguaa

SEQ ID NO: 3542058 - RNA, 14 nt, Human
gggagugagcuggu

SEQ ID NO: 3542059 - RNA, 15 nt, Human
gggaguggaguggaa

SEQ ID NO: 3542060 - RNA, 13 nt, Human
gggaguggccaca

SEQ ID NO: 3542061 - RNA, 20 nt, Human
ucuugucuuccuauuucaga

SEQ ID NO: 3542062 - RNA, 14 nt, Human
ucuugugaaauggc

SEQ ID NO: 3542063 - RNA, 18 nt, Human
ucuugugaauauguacau

SEQ ID NO: 3542064 - RNA, 16 nt, Human
ucuugugacuagugcu

SEQ ID NO: 3542065 - RNA, 22 nt, Human
ucuugugacuagugcugaagcu

SEQ ID NO: 3542066 - RNA, 22 nt, Human
ucuugugcacuggcaccaagug

SEQ ID NO: 3542067 - RNA, 23 nt, Human
ucuugugcuggauggagcccagg

SEQ ID NO: 3542068 - RNA, 18 nt, Human
ucuugugcuuuuccugau

SEQ ID NO: 3542069 - RNA, 22 nt, Human
ucuuguggcuuugcaaccauuu

SEQ ID NO: 3542070 - RNA, 18 nt, Human
ucuugugugauuaacuua

SEQ ID NO: 3542071 - RNA, 19 nt, Human
ucuugugugauuaacuuau

SEQ ID NO: 3542072 - RNA, 15 nt, Human
ucuuguguguaugca

SEQ ID NO: 3542073 - RNA, 12 nt, Human
ucuuguguuucu

SEQ ID NO: 3542074 - RNA, 16 nt, Human
ucuuguuaagugcagu

SEQ ID NO: 3542075 - RNA, 11 nt, Human
ucuuguugcuu

SEQ ID NO: 3542076 - RNA, 13 nt, Human
ucuuguugcuuug

SEQ ID NO: 3542077 - RNA, 19 nt, Human
ucuuguugcuuuguugcac

SEQ ID NO: 3542078 - RNA, 13 nt, Human
ucuuguuuauuga

SEQ ID NO: 3542079 - RNA, 14 nt, Human
ucuuguuucaauuc

SEQ ID NO: 3542080 - RNA, 15 nt, Human
ucuuguuuccuuguu

SEQ ID NO: 3542081 - RNA, 22 nt, Human
ucuuguuucuuuucacauagcu

SEQ ID NO: 3542082 - RNA, 16 nt, Human
ucuuguuuugcuuccc

SEQ ID NO: 3542083 - RNA, 15 nt, Human
ucuuguuuuguuugu

SEQ ID NO: 3542084 - RNA, 22 nt, Human
ucuuguuuuguuugucucuccu

SEQ ID NO: 3542085 - RNA, 21 nt, Human
ucuuguuuuuaaguuugcacu

SEQ ID NO: 3542086 - RNA, 21 nt, Human
ucuuguuuuuauuaauuuaua

SEQ ID NO: 3542087 - RNA, 18 nt, Human
ucuuuaaaaaaaaaauug

SEQ ID NO: 3542088 - RNA, 19 nt, Human
ucuuuaaaaaaaaaauugg

SEQ ID NO: 3542089 - RNA, 12 nt, Human
ucuuuaaaaacu

SEQ ID NO: 3542090 - RNA, 15 nt, Human
ucuuuaaaaacuguu

SEQ ID NO: 3542091 - RNA, 14 nt, Human
ucuuuaaaacaaaa

SEQ ID NO: 3542092 - RNA, 16 nt, Human
ucuuuaaaacaaaaca

SEQ ID NO: 3542093 - RNA, 22 nt, Human
ugacccuucccaaucagcacug

SEQ ID NO: 3542094 - RNA, 15 nt, Human
ugacccuugcuguga

SEQ ID NO: 3542095 - RNA, 14 nt, Human
ugaccggaggcaaa

SEQ ID NO: 3542096 - RNA, 14 nt, Human
ugaccgugaggcca

SEQ ID NO: 3542097 - RNA, 20 nt, Human
ugaccgugggcggggccuug

SEQ ID NO: 3542098 - RNA, 17 nt, Human
ugaccuaaauuauuuac

SEQ ID NO: 3542099 - RNA, 16 nt, Human
ugaccuacaaaucaau

SEQ ID NO: 3542100 - RNA, 20 nt, Human
ugaccucaggcaaucugccc

SEQ ID NO: 3542101 - RNA, 21 nt, Human
ugaccucaggcaaucugcccg

SEQ ID NO: 3542102 - RNA, 21 nt, Human
ugaccucaggugauccaccca

SEQ ID NO: 3542103 - RNA, 13 nt, Human
ugaccucaugcau

SEQ ID NO: 3542104 - RNA, 16 nt, Human
ugaccucaugcaucuc

SEQ ID NO: 3542105 - RNA, 22 nt, Human
ugaccucaugcaucuccaccug

SEQ ID NO: 3542106 - RNA, 21 nt, Human
ugaccucauuaaccgaugcuu

SEQ ID NO: 3542107 - RNA, 15 nt, Human
ugaccuccacagcuu

SEQ ID NO: 3542108 - RNA, 17 nt, Human
ugaccuccacagcuucc

SEQ ID NO: 3542109 - RNA, 13 nt, Human
ugaccuccagcuu

SEQ ID NO: 3542110 - RNA, 22 nt, Human
ugaccuccaugacugcacagua

SEQ ID NO: 3542111 - RNA, 14 nt, Human
ugaccucccagccc

SEQ ID NO: 3542112 - RNA, 16 nt, Human
ugaccucccagcccua

SEQ ID NO: 3542113 - RNA, 13 nt, Human
ugaccucccccuc

SEQ ID NO: 3542114 - RNA, 22 nt, Human
ugaccucccucuaauuuaucuu

SEQ ID NO: 3542115 - RNA, 19 nt, Human
ugaccuccgccauccaccc

SEQ ID NO: 3542116 - RNA, 19 nt, Human
ugaccuccucccuguuauu

SEQ ID NO: 3542117 - RNA, 21 nt, Human
ugaccucuauaauugccacug

SEQ ID NO: 3542118 - RNA, 13 nt, Human
ugaccucugcagc

SEQ ID NO: 3542119 - RNA, 21 nt, Human
ugaccucugcagcaauaaagc

SEQ ID NO: 3542120 - RNA, 17 nt, Human
ugaccucuguccucccu

SEQ ID NO: 3542121 - RNA, 19 nt, Human
ugaccucuguuguccuccc

SEQ ID NO: 3542122 - RNA, 16 nt, Human
ugaccucuugcugucu

SEQ ID NO: 3542123 - RNA, 17 nt, Human
ugaccucuugcugucuc

SEQ ID NO: 3542124 - RNA, 21 nt, Human
ugaccucuugcugucucugcu

SEQ ID NO: 3542125 - RNA, 23 nt, Human
ugaccucuugcugucucugcucg

SEQ ID NO: 3542126 - RNA, 13 nt, Human
ugaccugaaguuc

SEQ ID NO: 3542127 - RNA, 22 nt, Human
ugaccugacuugccuccguguc

SEQ ID NO: 3542128 - RNA, 15 nt, Human
ugaccugaggcccuu

SEQ ID NO: 3542129 - RNA, 17 nt, Human
ugaccugaggcccuucu

SEQ ID NO: 3542130 - RNA, 18 nt, Human
ugaccugaggcccuucuc

SEQ ID NO: 3542131 - RNA, 19 nt, Human
ugaccugaggcccuucucu

SEQ ID NO: 3542132 - RNA, 18 nt, Human
ugaccugaggcuccugug

SEQ ID NO: 3542133 - RNA, 17 nt, Human
ugaccugaggcuguggu

SEQ ID NO: 3542134 - RNA, 11 nt, Human
ugaccugcagg

SEQ ID NO: 3542135 - RNA, 12 nt, Human
ugaccugcauug

SEQ ID NO: 3542136 - RNA, 18 nt, Human
ugaccugcauuguaaaua

SEQ ID NO: 3542137 - RNA, 16 nt, Human
ugaccugccaggcaca

SEQ ID NO: 3542138 - RNA, 16 nt, Human
ugaccugccucccuuc

SEQ ID NO: 3542139 - RNA, 23 nt, Human
ugaccugccucccuucaugcaug

SEQ ID NO: 3542140 - RNA, 18 nt, Human
ugaccugcuaggccagag

SEQ ID NO: 3542141 - RNA, 18 nt, Human
ugaccugcuccgcugcuc

SEQ ID NO: 3542142 - RNA, 13 nt, Human
ugaccugcugacc

SEQ ID NO: 3542143 - RNA, 14 nt, Human
ugaccugcugagcu

SEQ ID NO: 3542144 - RNA, 15 nt, Human
ugaccugcugagcuc

SEQ ID NO: 3542145 - RNA, 21 nt, Human
ugaccugcugagcucugagag

SEQ ID NO: 3542146 - RNA, 15 nt, Human
ugaccugguccacag

SEQ ID NO: 3542147 - RNA, 20 nt, Human
ugaccugguccacagggcac

SEQ ID NO: 3542148 - RNA, 16 nt, Human
ugaccugucaugcccc

SEQ ID NO: 3542149 - RNA, 21 nt, Human
ugaccuguggggauuucuccc

SEQ ID NO: 3542150 - RNA, 14 nt, Human
ugaccugugucacu

SEQ ID NO: 3542151 - RNA, 15 nt, Human
ugaccugugucacua

SEQ ID NO: 3542152 - RNA, 15 nt, Human
ugaccuguuucucug

SEQ ID NO: 3542153 - RNA, 15 nt, Human
ugaccuuaguguuuc

SEQ ID NO: 3542154 - RNA, 20 nt, Human
ugaccuucauuucauguaua

SEQ ID NO: 3542155 - RNA, 18 nt, Human
ugaccuuccaagagccug

SEQ ID NO: 3542156 - RNA, 20 nt, Human
ugaccuuccucgcagagagg

SEQ ID NO: 3542157 - RNA, 14 nt, Human
ugaccuuccuuccu

SEQ ID NO: 3542158 - RNA, 17 nt, Human
ugaccuucuaggaagcu

SEQ ID NO: 3542159 - RNA, 19 nt, Human
ugaccuugaacuccugggc

SEQ ID NO: 3542160 - RNA, 22 nt, Human
ugaccuugaggagucuugugug

SEQ ID NO: 3542161 - RNA, 20 nt, Human
ugaccuuggagagacacagc

SEQ ID NO: 3542162 - RNA, 16 nt, Human
ugaccuuguaauguaa

SEQ ID NO: 3542163 - RNA, 16 nt, Human
ugaccuuuagguauua

SEQ ID NO: 3542164 - RNA, 14 nt, Human
ugaccuuuguacag

SEQ ID NO: 3542165 - RNA, 23 nt, Human
ugaccuuuuauguaguaauugac

SEQ ID NO: 3542166 - RNA, 15 nt, Human
ugacgaggcugggcc

SEQ ID NO: 3542167 - RNA, 19 nt, Human
ugacgcaacccacguguaa

SEQ ID NO: 3542168 - RNA, 23 nt, Human
ugacgccaggguaugaagagugu

SEQ ID NO: 3542169 - RNA, 15 nt, Human
ugacgccaucccagc

SEQ ID NO: 3542170 - RNA, 18 nt, Human
ugacgcugaauaaauguc

SEQ ID NO: 3542171 - RNA, 14 nt, Human
ugacgcugauacau

SEQ ID NO: 3542172 - RNA, 23 nt, Human
ugacgcugauacauaacuaaauu

SEQ ID NO: 3542173 - RNA, 14 nt, Human
ugacggaagaacau

SEQ ID NO: 3542174 - RNA, 18 nt, Human
ugacggaagaacauagaa

SEQ ID NO: 3542175 - RNA, 23 nt, Human
ugacggaaggaccuauguuugcu

SEQ ID NO: 3542176 - RNA, 20 nt, Human
ugacggcccucaucuaugag

SEQ ID NO: 3542177 - RNA, 12 nt, Human
ugacggcccugc

SEQ ID NO: 3542178 - RNA, 18 nt, Human
ugacggcgcccccagugu

SEQ ID NO: 3542179 - RNA, 20 nt, Human
ugacggcgcccccagugugc

SEQ ID NO: 3542180 - RNA, 18 nt, Human
ugacgguauuaugcuucu

SEQ ID NO: 3542181 - RNA, 23 nt, Human
ugacggucccacacuggugacug

SEQ ID NO: 3542182 - RNA, 23 nt, Human
ugacgguuccuacacaggacagg

SEQ ID NO: 3542183 - RNA, 19 nt, Human
ugacguacaaguaguucug

SEQ ID NO: 3542184 - RNA, 21 nt, Human
ugacguacaaguaguucugua

SEQ ID NO: 3542185 - RNA, 14 nt, Human
ugacgucugaagcu

SEQ ID NO: 3542186 - RNA, 15 nt, Human
ugacgucuggguggc

SEQ ID NO: 3542187 - RNA, 18 nt, Human
ugacgucuggguggcccu

SEQ ID NO: 3542188 - RNA, 22 nt, Human
ugacgugaccggacuuuucugc

SEQ ID NO: 3542189 - RNA, 24 nt, Human
ugacgugaccggacuuuucugcaa

SEQ ID NO: 3542190 - RNA, 16 nt, Human
ugacgugccuuuugca

SEQ ID NO: 3542191 - RNA, 12 nt, Human
ugacguuuacau

SEQ ID NO: 3542192 - RNA, 15 nt, Human
ugacuaaaaaacaaa

SEQ ID NO: 3542193 - RNA, 14 nt, Human
ugacuaaaauauuu

SEQ ID NO: 3542194 - RNA, 15 nt, Human
ugacuaaaccauugu

SEQ ID NO: 3542195 - RNA, 16 nt, Human
ugacuaaagagagaau

SEQ ID NO: 3542196 - RNA, 19 nt, Human
ugacuaaauucgugauuuu

SEQ ID NO: 3542197 - RNA, 16 nt, Human
ugacuaaauuugggga

SEQ ID NO: 3542198 - RNA, 20 nt, Human
ugacuaacuagacaccaaag

SEQ ID NO: 3542199 - RNA, 22 nt, Human
ugacuaacucaaauacacauuu

SEQ ID NO: 3542200 - RNA, 16 nt, Human
ugacuaauggcaugag

SEQ ID NO: 3542201 - RNA, 23 nt, Human
ugacuaauucuugcauauuuugu

SEQ ID NO: 3542202 - RNA, 15 nt, Human
ugacuaauuguauaa

SEQ ID NO: 3542203 - RNA, 17 nt, Human
ugacuaauuguauaaca

SEQ ID NO: 3542204 - RNA, 19 nt, Human
ugacuaauuguauaacagg

SEQ ID NO: 3542205 - RNA, 14 nt, Human
ucuuuccuuccucu

SEQ ID NO: 3542206 - RNA, 16 nt, Human
ucuuuccuuccucuca

SEQ ID NO: 3542207 - RNA, 19 nt, Human
ucuuucuaguucagcugcc

SEQ ID NO: 3542208 - RNA, 15 nt, Human
ucuuucuaugcugcu

SEQ ID NO: 3542209 - RNA, 18 nt, Human
ucuuucuaugcugcuuuu

SEQ ID NO: 3542210 - RNA, 15 nt, Human
ucuuucuauuccaaa

SEQ ID NO: 3542211 - RNA, 17 nt, Human
ucuuucucacuaaaucu

SEQ ID NO: 3542212 - RNA, 18 nt, Human
ucuuucucacuaaaucuu

SEQ ID NO: 3542213 - RNA, 21 nt, Human
ucuuucuccaaaguuauccag

SEQ ID NO: 3542214 - RNA, 18 nt, Human
ucuuucuccuuagucuuc

SEQ ID NO: 3542215 - RNA, 21 nt, Human
ucuuucuccuugaauaucuuu

SEQ ID NO: 3542216 - RNA, 16 nt, Human
ucuuucucuacuuuga

SEQ ID NO: 3542217 - RNA, 14 nt, Human
ucuuucucucagcc

SEQ ID NO: 3542218 - RNA, 21 nt, Human
ucuuucucucagccuuacauu

SEQ ID NO: 3542219 - RNA, 12 nt, Human
ucuuucucuccc

SEQ ID NO: 3542220 - RNA, 12 nt, Human
ucuuucucuccu

SEQ ID NO: 3542221 - RNA, 18 nt, Human
ucuuucucucuucccuca

SEQ ID NO: 3542222 - RNA, 13 nt, Human
ucuuucucugagg

SEQ ID NO: 3542223 - RNA, 17 nt, Human
ucuuucucugccaguga

SEQ ID NO: 3542224 - RNA, 13 nt, Human
ucuuucucuuuua

SEQ ID NO: 3542225 - RNA, 21 nt, Human
ucuuucugagcacacuuuagu

SEQ ID NO: 3542226 - RNA, 18 nt, Human
ucuuucugagugccuucu

SEQ ID NO: 3542227 - RNA, 14 nt, Human
ucuuucugauaacu

SEQ ID NO: 3542228 - RNA, 20 nt, Human
ucuuucugauaacuagaugg

SEQ ID NO: 3542229 - RNA, 21 nt, Human
ucuuucugcagaaacagaaag

SEQ ID NO: 3542230 - RNA, 13 nt, Human
ucuuucuggaguc

SEQ ID NO: 3542231 - RNA, 18 nt, Human
ucuuucuggccugccuuc

SEQ ID NO: 3542232 - RNA, 19 nt, Human
ucuuucuguccccucuucc

SEQ ID NO: 3542233 - RNA, 15 nt, Human
ucuuucuuccucugc

SEQ ID NO: 3542234 - RNA, 16 nt, Human
ucuuucuuccucugcu

SEQ ID NO: 3542235 - RNA, 15 nt, Human
ucuuucuuccuuuac

SEQ ID NO: 3542236 - RNA, 14 nt, Human
ucuuucuugcuccc

SEQ ID NO: 3542237 - RNA, 17 nt, Human
ucuuucuuuaccugaga

SEQ ID NO: 3542238 - RNA, 16 nt, Human
ucuuucuuucaauaaa

SEQ ID NO: 3542239 - RNA, 12 nt, Human
ucuuucuuugga

SEQ ID NO: 3542240 - RNA, 23 nt, Human
ucuuucuuugggaauauuugaau

SEQ ID NO: 3542241 - RNA, 14 nt, Human
ucuuugaaacaacu

SEQ ID NO: 3542242 - RNA, 23 nt, Human
ucuuugaaagacuuccaaagaau

SEQ ID NO: 3542243 - RNA, 22 nt, Human
ucuuugaaauagucugugugaa

SEQ ID NO: 3542244 - RNA, 12 nt, Human
ucuuugaaauua

SEQ ID NO: 3542245 - RNA, 21 nt, Human
ucuuugaauaaaugucacuuu

SEQ ID NO: 3542246 - RNA, 18 nt, Human
ucuuugaauacaaagaac

SEQ ID NO: 3542247 - RNA, 13 nt, Human
ucuuugaauuuuc

SEQ ID NO: 3542248 - RNA, 14 nt, Human
ucuuugaauuuuca

SEQ ID NO: 3542249 - RNA, 15 nt, Human
ucuuugaauuuucau

SEQ ID NO: 3542250 - RNA, 19 nt, Human
ucuuugaauuuucauuuua

SEQ ID NO: 3542251 - RNA, 21 nt, Human
ucuuugaauuuucauuuuaca

SEQ ID NO: 3542252 - RNA, 17 nt, Human
ucuuugaauuuucugug

SEQ ID NO: 3542253 - RNA, 21 nt, Human
ucuuugacaauugggagcugc

SEQ ID NO: 3542254 - RNA, 23 nt, Human
ucuuugaccucaaccugugauga

SEQ ID NO: 3542255 - RNA, 17 nt, Human
ucuuugagauagaagaa

SEQ ID NO: 3542256 - RNA, 23 nt, Human
ucuuugagggacugccucugcca

SEQ ID NO: 3542257 - RNA, 20 nt, Human
ucuuugauaaagaaaagaau

SEQ ID NO: 3542258 - RNA, 13 nt, Human
ucuuugauaaugu

SEQ ID NO: 3542259 - RNA, 20 nt, Human
ucuuugaucaugaauaacug

SEQ ID NO: 3542260 - RNA, 15 nt, Human
ucuuugauccuucuc

SEQ ID NO: 3542261 - RNA, 19 nt, Human
ucuuugauguuaacacauu

SEQ ID NO: 3542262 - RNA, 19 nt, Human
ucuuugauuauuugcaugu

SEQ ID NO: 3542263 - RNA, 15 nt, Human
ucuuugauucuccuu

SEQ ID NO: 3542264 - RNA, 22 nt, Human
ucuuugcaaaaauccaaauauu

SEQ ID NO: 3542265 - RNA, 15 nt, Human
ucuuugcaaaguauu

SEQ ID NO: 3542266 - RNA, 23 nt, Human
ucuuugcaaaguauuguaaauua

SEQ ID NO: 3542267 - RNA, 13 nt, Human
ucuuugcagacag

SEQ ID NO: 3542268 - RNA, 15 nt, Human
ucuuugcauggaauu

SEQ ID NO: 3542269 - RNA, 21 nt, Human
ucuuugccaagaccuuucaaa

SEQ ID NO: 3542270 - RNA, 12 nt, Human
ucuuugccaagu

SEQ ID NO: 3542271 - RNA, 17 nt, Human
ucuuugccacccucaug

SEQ ID NO: 3542272 - RNA, 18 nt, Human
ucuuugccacccucaugc

SEQ ID NO: 3542273 - RNA, 21 nt, Human
ucuuugccacccucaugcugu

SEQ ID NO: 3542274 - RNA, 22 nt, Human
ucuuugccacccucaugcugug

SEQ ID NO: 3542275 - RNA, 21 nt, Human
ucuuugccagucauucagcag

SEQ ID NO: 3542276 - RNA, 16 nt, Human
ucuuugccaucucugc

SEQ ID NO: 3542277 - RNA, 12 nt, Human
ucuuugccucaa

SEQ ID NO: 3542278 - RNA, 12 nt, Human
ucuuugccucuc

SEQ ID NO: 3542279 - RNA, 14 nt, Human
ucuuugccuugggc

SEQ ID NO: 3542280 - RNA, 21 nt, Human
ucuuugccuugggcugcuccu

SEQ ID NO: 3542281 - RNA, 15 nt, Human
ucuuugcuugaacac

SEQ ID NO: 3542282 - RNA, 15 nt, Human
ucuuugcuugccucu

SEQ ID NO: 3542283 - RNA, 17 nt, Human
ucuuugcuuugcccagc

SEQ ID NO: 3542284 - RNA, 21 nt, Human
ucuuuggacccugaggcccag

SEQ ID NO: 3542285 - RNA, 22 nt, Human
ucuuuggagaaaugcuuagaaa

SEQ ID NO: 3542286 - RNA, 16 nt, Human
ucuuugggaauauuug

SEQ ID NO: 3542287 - RNA, 20 nt, Human
ucuuugggaauauuugaauc

SEQ ID NO: 3542288 - RNA, 18 nt, Human
ucuuugggaauguuuguc

SEQ ID NO: 3542289 - RNA, 21 nt, Human
ucuuuggggucagccagggcc

SEQ ID NO: 3542290 - RNA, 13 nt, Human
ucuuuggugccuu

SEQ ID NO: 3542291 - RNA, 15 nt, Human
ucuuuggugccuuuc

SEQ ID NO: 3542292 - RNA, 15 nt, Human
ucuuugguucuaagg

SEQ ID NO: 3542293 - RNA, 16 nt, Human
ucuuugguucuaagga

SEQ ID NO: 3542294 - RNA, 19 nt, Human
ucuuugguuuaauuuaaag

SEQ ID NO: 3542295 - RNA, 20 nt, Human
ucuuuguaagaacuaaagaa

SEQ ID NO: 3542296 - RNA, 21 nt, Human
ucuuuguaagaacuaaagaag

SEQ ID NO: 3542297 - RNA, 22 nt, Human
ucuuuguaagaguguagaagca

SEQ ID NO: 3542298 - RNA, 23 nt, Human
ucuuuguaagaguguagaagcau

SEQ ID NO: 3542299 - RNA, 13 nt, Human
ucuuuguaaugaa

SEQ ID NO: 3542300 - RNA, 15 nt, Human
ucuuuguacagacaa

SEQ ID NO: 3542301 - RNA, 20 nt, Human
ucuuuguacagacaacaaac

SEQ ID NO: 3542302 - RNA, 12 nt, Human
ucuuuguaucuu

SEQ ID NO: 3542303 - RNA, 21 nt, Human
ucuuugucagggaguguuccc

SEQ ID NO: 3542304 - RNA, 22 nt, Human
ucuuugugauaauuuaagagcu

SEQ ID NO: 3542305 - RNA, 14 nt, Human
ucuuuguggcuucc

SEQ ID NO: 3542306 - RNA, 13 nt, Human
ucuuuguguagcu

SEQ ID NO: 3542307 - RNA, 17 nt, Human
ucuuugugucaacauga

SEQ ID NO: 3542308 - RNA, 14 nt, Human
ucuuuguuaauuug

SEQ ID NO: 3542309 - RNA, 15 nt, Human
ucuuuguuauaccau

SEQ ID NO: 3542310 - RNA, 12 nt, Human
ucuuuguucuca

SEQ ID NO: 3542311 - RNA, 16 nt, Human
ucuuuguucucagcuc

SEQ ID NO: 3542312 - RNA, 19 nt, Human
ucuuuguucucagcucccc

SEQ ID NO: 3542313 - RNA, 15 nt, Human
ucuuuguuucuuucu

SEQ ID NO: 3542314 - RNA, 19 nt, Human
ucuuuuaaaaauucaaaug

SEQ ID NO: 3542315 - RNA, 21 nt, Human
ucuuuuaaaguguuacuuuuu

SEQ ID NO: 3542316 - RNA, 23 nt, Human
ucuuuuaaaguguuacuuuuugu

SEQ ID NO: 3542317 - RNA, 19 nt, Human
ucuuuuaaauuagaaaaua

SEQ ID NO: 3542318 - RNA, 21 nt, Human
ucuuuuaaauuagaaaauauu

SEQ ID NO: 3542319 - RNA, 12 nt, Human
ucuuuuaaugcu

SEQ ID NO: 3542320 - RNA, 19 nt, Human
ucuuuuaaugcuucauuca

SEQ ID NO: 3542321 - RNA, 12 nt, Human
ucuuuuacaacu

SEQ ID NO: 3542322 - RNA, 17 nt, Human
ucuuuuacccuggcccc

SEQ ID NO: 3542323 - RNA, 22 nt, Human
ucuuuuacccuggccccucucc

SEQ ID NO: 3542324 - RNA, 14 nt, Human
ucuuuuaccugcug

SEQ ID NO: 3542325 - RNA, 20 nt, Human
ucuuuuaccugcugcuucuc

SEQ ID NO: 3542326 - RNA, 18 nt, Human
ucuuuuacucaugaucuu

SEQ ID NO: 3542327 - RNA, 18 nt, Human
ucuuuuauacucagcuuu

SEQ ID NO: 3542328 - RNA, 15 nt, Human
ucuuuuauguuugaa

SEQ ID NO: 3542329 - RNA, 16 nt, Human
ucuuuuauguuugaau

SEQ ID NO: 3542330 - RNA, 22 nt, Human
ucuuuucaucugggaaagacau

SEQ ID NO: 3542331 - RNA, 20 nt, Human
ucuuuucccauuuaucuaaa

SEQ ID NO: 3542332 - RNA, 19 nt, Human
ucuuuucccccauuaauca

SEQ ID NO: 3542333 - RNA, 24 nt, Human
ucuuuucccccuuugugcacauuu

SEQ ID NO: 3542334 - RNA, 17 nt, Human
ucuuuuccccuuuccug

SEQ ID NO: 3542335 - RNA, 16 nt, Human
ucuuuuccuacuuuuc

SEQ ID NO: 3542336 - RNA, 12 nt, Human
ucuuuucuacag

SEQ ID NO: 3542337 - RNA, 18 nt, Human
ucuuuucuacccuagcca

SEQ ID NO: 3542338 - RNA, 19 nt, Human
ucuuuucuacccuagccau

SEQ ID NO: 3542339 - RNA, 18 nt, Human
ucuuuucuauuuucccuc

SEQ ID NO: 3542340 - RNA, 14 nt, Human
ucuuuucucaugug

SEQ ID NO: 3542341 - RNA, 18 nt, Human
ucuuuucugaaucuucug

SEQ ID NO: 3542342 - RNA, 22 nt, Human
ucuuuucugaaucuucugaaac

SEQ ID NO: 3542343 - RNA, 12 nt, Human
ucuuuucuuauu

SEQ ID NO: 3542344 - RNA, 16 nt, Human
ucuuuucuugccucug

SEQ ID NO: 3542345 - RNA, 12 nt, Human
ucuuuucuugga

SEQ ID NO: 3542346 - RNA, 13 nt, Human
ucuuuucuuggac

SEQ ID NO: 3542347 - RNA, 17 nt, Human
ucuuuucuuuagagaac

SEQ ID NO: 3542348 - RNA, 22 nt, Human
ucuuuucuuuagagaacugaaa

SEQ ID NO: 3542349 - RNA, 13 nt, Human
ucuuuucuuuuua

SEQ ID NO: 3542350 - RNA, 16 nt, Human
ugagugugcauggagg

SEQ ID NO: 3542351 - RNA, 22 nt, Human
ugagugugcggcugugugugca

SEQ ID NO: 3542352 - RNA, 23 nt, Human
ugagugugcugcuguaagaaauc

SEQ ID NO: 3542353 - RNA, 14 nt, Human
ugaguguggcuccc

SEQ ID NO: 3542354 - RNA, 16 nt, Human
ugaguguggcuccccu

SEQ ID NO: 3542355 - RNA, 17 nt, Human
ugaguguggcuccccuc

SEQ ID NO: 3542356 - RNA, 18 nt, Human
ugagugugugugugcaug

SEQ ID NO: 3542357 - RNA, 14 nt, Human
ugaguguuucuaug

SEQ ID NO: 3542358 - RNA, 23 nt, Human
ugaguuacaccagaccuguucug

SEQ ID NO: 3542359 - RNA, 14 nt, Human
ugaguuacagaaau

SEQ ID NO: 3542360 - RNA, 24 nt, Human
ugaguuacuugcugcccugugcuc

SEQ ID NO: 3542361 - RNA, 13 nt, Human
ugaguuaggaaca

SEQ ID NO: 3542362 - RNA, 18 nt, Human
ugaguuaggaaugagaag

SEQ ID NO: 3542363 - RNA, 21 nt, Human
ugaguuaucaugaauuuuaaa

SEQ ID NO: 3542364 - RNA, 15 nt, Human
ugaguuaugauguaa

SEQ ID NO: 3542365 - RNA, 21 nt, Human
ugaguuauugagauuguccuc

SEQ ID NO: 3542366 - RNA, 15 nt, Human
ugaguucagguagcu

SEQ ID NO: 3542367 - RNA, 17 nt, Human
ugaguuccggcaccagu

SEQ ID NO: 3542368 - RNA, 20 nt, Human
ugaguucuacauaaguaauu

SEQ ID NO: 3542369 - RNA, 17 nt, Human
ugaguucucagggcucc

SEQ ID NO: 3542370 - RNA, 20 nt, Human
ugaguugauagcacagaccc

SEQ ID NO: 3542371 - RNA, 16 nt, Human
ugaguugauugagaag

SEQ ID NO: 3542372 - RNA, 17 nt, Human
ugaguugccaagacaaa

SEQ ID NO: 3542373 - RNA, 18 nt, Human
ugaguugccaagacaaau

SEQ ID NO: 3542374 - RNA, 19 nt, Human
ugaguugccaagacaaauc

SEQ ID NO: 3542375 - RNA, 17 nt, Human
ugaguuggcugggaaua

SEQ ID NO: 3542376 - RNA, 17 nt, Human
ugaguuggggucuggca

SEQ ID NO: 3542377 - RNA, 21 nt, Human
ugaguuggggucuggcagccu

SEQ ID NO: 3542378 - RNA, 20 nt, Human
ugaguugguguugacaugug

SEQ ID NO: 3542379 - RNA, 22 nt, Human
ugaguuguuaccccaagcgccc

SEQ ID NO: 3542380 - RNA, 18 nt, Human
ugaguuguugcccugggu

SEQ ID NO: 3542381 - RNA, 15 nt, Human
ugaguuguuuuugua

SEQ ID NO: 3542382 - RNA, 18 nt, Human
ugaguuguuuuuguauau

SEQ ID NO: 3542383 - RNA, 12 nt, Human
ugaguuuaaaaa

SEQ ID NO: 3542384 - RNA, 19 nt, Human
ugaguuuaaaaaucaacuu

SEQ ID NO: 3542385 - RNA, 14 nt, Human
ugaguuuaaagcaa

SEQ ID NO: 3542386 - RNA, 15 nt, Human
ugaguuuaccauuug

SEQ ID NO: 3542387 - RNA, 19 nt, Human
ugaguuuaccauuuguaau

SEQ ID NO: 3542388 - RNA, 14 nt, Human
ugaguuucauagcu

SEQ ID NO: 3542389 - RNA, 11 nt, Human
ugaguuuccua

SEQ ID NO: 3542390 - RNA, 16 nt, Human
ugaguuuccucaggcu

SEQ ID NO: 3542391 - RNA, 17 nt, Human
ugaguuuccucaggcug

SEQ ID NO: 3542392 - RNA, 22 nt, Human
ugaguuuccucaggcugcugga

SEQ ID NO: 3542393 - RNA, 14 nt, Human
ugaguuucuuagac

SEQ ID NO: 3542394 - RNA, 13 nt, Human
ugaguuugcuuau

SEQ ID NO: 3542395 - RNA, 22 nt, Human
ugaguuugcuuauguaaucuca

SEQ ID NO: 3542396 - RNA, 16 nt, Human
ugaguuuguagguaaa

SEQ ID NO: 3542397 - RNA, 18 nt, Human
ugaguuuguagguaaaau

SEQ ID NO: 3542398 - RNA, 20 nt, Human
ugaguuugucgcucaugugu

SEQ ID NO: 3542399 - RNA, 13 nt, Human
ugaguuuguuucu

SEQ ID NO: 3542400 - RNA, 20 nt, Human
ugaguuuguuucuuugaauu

SEQ ID NO: 3542401 - RNA, 13 nt, Human
ugaguuuuaccaa

SEQ ID NO: 3542402 - RNA, 18 nt, Human
ugaguuuucuucugugau

SEQ ID NO: 3542403 - RNA, 18 nt, Human
ugaguuuuguguuuguug

SEQ ID NO: 3542404 - RNA, 21 nt, Human
ugaguuuuguguuuguuguag

SEQ ID NO: 3542405 - RNA, 13 nt, Human
ugaguuuuugaua

SEQ ID NO: 3542406 - RNA, 18 nt, Human
ugaguuuuugauagcuuu

SEQ ID NO: 3542407 - RNA, 17 nt, Human
ugaguuuuuucucuugg

SEQ ID NO: 3542408 - RNA, 19 nt, Human
ugaguuuuuucucuugggc

SEQ ID NO: 3542409 - RNA, 22 nt, Human
ugauaaaaaauuuuguaauuuu

SEQ ID NO: 3542410 - RNA, 14 nt, Human
ugauaaaaacucag

SEQ ID NO: 3542411 - RNA, 17 nt, Human
ugauaaaagauacauuu

SEQ ID NO: 3542412 - RNA, 17 nt, Human
ugauaaagaaaagaauc

SEQ ID NO: 3542413 - RNA, 20 nt, Human
ugauaaagccucaagguuuu

SEQ ID NO: 3542414 - RNA, 17 nt, Human
ugauaaauaguguuauu

SEQ ID NO: 3542415 - RNA, 20 nt, Human
ugauaaaucauuuuauguca

SEQ ID NO: 3542416 - RNA, 19 nt, Human
ugauaaauuccacuggacu

SEQ ID NO: 3542417 - RNA, 17 nt, Human
ugauaaauuugacuguu

SEQ ID NO: 3542418 - RNA, 20 nt, Human
ugauaaccauagcauuaaua

SEQ ID NO: 3542419 - RNA, 23 nt, Human
ugauaacuagauggugcugagaa

SEQ ID NO: 3542420 - RNA, 22 nt, Human
ugauaacuguuuauauguguug

SEQ ID NO: 3542421 - RNA, 24 nt, Human
ugauaagcagucauccucagauca

SEQ ID NO: 3542422 - RNA, 16 nt, Human
ugauaagggaaaagau

SEQ ID NO: 3542423 - RNA, 15 nt, Human
ugauaaguucauaca

SEQ ID NO: 3542424 - RNA, 19 nt, Human
ugauaaguuccuuuccuuu

SEQ ID NO: 3542425 - RNA, 13 nt, Human
ugauaauaaauug

SEQ ID NO: 3542426 - RNA, 18 nt, Human
ugauaauaaauugaaauu

SEQ ID NO: 3542427 - RNA, 19 nt, Human
ugauaauauuguggugcca

SEQ ID NO: 3542428 - RNA, 21 nt, Human
ugauaaugauaaaacaccuca

SEQ ID NO: 3542429 - RNA, 16 nt, Human
ugauaauguuaaauuu

SEQ ID NO: 3542430 - RNA, 13 nt, Human
ugauaauuuaaga

SEQ ID NO: 3542431 - RNA, 16 nt, Human
ugauacaagauuagaa

SEQ ID NO: 3542432 - RNA, 16 nt, Human
ugauacaaugaacacu

SEQ ID NO: 3542433 - RNA, 13 nt, Human
ugauacauaauaa

SEQ ID NO: 3542434 - RNA, 16 nt, Human
ugauacauccaaagca

SEQ ID NO: 3542435 - RNA, 14 nt, Human
ugauaccagcugga

SEQ ID NO: 3542436 - RNA, 18 nt, Human
ugauaccccccucugucu

SEQ ID NO: 3542437 - RNA, 19 nt, Human
ugauaccgaauugugacuc

SEQ ID NO: 3542438 - RNA, 16 nt, Human
ugauacgaugcuucaa

SEQ ID NO: 3542439 - RNA, 19 nt, Human
ugauacgcaacauaauuaa

SEQ ID NO: 3542440 - RNA, 15 nt, Human
ugauacuaauaaacu

SEQ ID NO: 3542441 - RNA, 16 nt, Human
ugauacucauuucuua

SEQ ID NO: 3542442 - RNA, 11 nt, Human
ugauacuguug

SEQ ID NO: 3542443 - RNA, 16 nt, Human
ugauacuguugcacgu

SEQ ID NO: 3542444 - RNA, 15 nt, Human
ugauacuuauauuuu

SEQ ID NO: 3542445 - RNA, 16 nt, Human
ugauacuuauauuuuc

SEQ ID NO: 3542446 - RNA, 13 nt, Human
ugauacuucauuu

SEQ ID NO: 3542447 - RNA, 14 nt, Human
ugauacuuguuuuc

SEQ ID NO: 3542448 - RNA, 15 nt, Human
ugauacuuuugacaa

SEQ ID NO: 3542449 - RNA, 17 nt, Human
ugauacuuuuuugaaau

SEQ ID NO: 3542450 - RNA, 20 nt, Human
ugauacuuuuuugaaaucag

SEQ ID NO: 3542451 - RNA, 19 nt, Human
ugauagaaaugccaagcac

SEQ ID NO: 3542452 - RNA, 15 nt, Human
ugauagaggaagccu

SEQ ID NO: 3542453 - RNA, 12 nt, Human
ugauagauuuga

SEQ ID NO: 3542454 - RNA, 18 nt, Human
ugauagauuugaccuccu

SEQ ID NO: 3542455 - RNA, 17 nt, Human
ugauagcaaaaucaaga

SEQ ID NO: 3542456 - RNA, 14 nt, Human
ugauagcacagacc

SEQ ID NO: 3542457 - RNA, 15 nt, Human
ugauagcacagaccc

SEQ ID NO: 3542458 - RNA, 17 nt, Human
ugauagcacagacccug

SEQ ID NO: 3542459 - RNA, 21 nt, Human
ugauagcacagacccugcccu

SEQ ID NO: 3542460 - RNA, 12 nt, Human
ugauagcacuuu

SEQ ID NO: 3542461 - RNA, 14 nt, Human
ugauagcauuguaa

SEQ ID NO: 3542462 - RNA, 17 nt, Human
ggucugccaggccccca

SEQ ID NO: 3542463 - RNA, 23 nt, Human
ggucugccucuucugggagggca

SEQ ID NO: 3542464 - RNA, 20 nt, Human
ggucugcucccaaggggccu

SEQ ID NO: 3542465 - RNA, 19 nt, Human
ggucugcucgggcccaggc

SEQ ID NO: 3542466 - RNA, 16 nt, Human
ggucugcucuuucucu

SEQ ID NO: 3542467 - RNA, 22 nt, Human
ggucugcucuuucucugccagu

SEQ ID NO: 3542468 - RNA, 19 nt, Human
ggucuggacugacagcaug

SEQ ID NO: 3542469 - RNA, 14 nt, Human
ggucuggaggaccu

SEQ ID NO: 3542470 - RNA, 12 nt, Human
ggucuggcuggu

SEQ ID NO: 3542471 - RNA, 16 nt, Human
ggucugggacuuccuu

SEQ ID NO: 3542472 - RNA, 20 nt, Human
ggucugggggucaggaggca

SEQ ID NO: 3542473 - RNA, 19 nt, Human
ggucugugucucuuuucuc

SEQ ID NO: 3542474 - RNA, 15 nt, Human
ggucugugugaaugu

SEQ ID NO: 3542475 - RNA, 17 nt, Human
ggucuguucuguuucaa

SEQ ID NO: 3542476 - RNA, 17 nt, Human
ggucuguucuuuccaaa

SEQ ID NO: 3542477 - RNA, 16 nt, Human
ggucuguuggcaggcu

SEQ ID NO: 3542478 - RNA, 18 nt, Human
ggucuguuggcaggcugg

SEQ ID NO: 3542479 - RNA, 19 nt, Human
ggucuguuggcaggcuggc

SEQ ID NO: 3542480 - RNA, 12 nt, Human
ggucuguuugca

SEQ ID NO: 3542481 - RNA, 20 nt, Human
ggucuguuuuccuuucucac

SEQ ID NO: 3542482 - RNA, 18 nt, Human
ggucuuccuacucuucuc

SEQ ID NO: 3542483 - RNA, 22 nt, Human
ggucuucuuacaugcauuugag

SEQ ID NO: 3542484 - RNA, 21 nt, Human
ggucuugaacuccuggacuca

SEQ ID NO: 3542485 - RNA, 21 nt, Human
ggucuugaacuccuggccuca

SEQ ID NO: 3542486 - RNA, 16 nt, Human
ggucuugcauuuaaaa

SEQ ID NO: 3542487 - RNA, 19 nt, Human
ggucuugccccaucacugc

SEQ ID NO: 3542488 - RNA, 23 nt, Human
ggucuuggaacuugccugccuuu

SEQ ID NO: 3542489 - RNA, 18 nt, Human
ggucuuggagcugagccu

SEQ ID NO: 3542490 - RNA, 23 nt, Human
ggucuuggagcugagccucucac

SEQ ID NO: 3542491 - RNA, 20 nt, Human
ggucuugguuccagccugcc

SEQ ID NO: 3542492 - RNA, 18 nt, Human
ggucuuuccuaaggcugc

SEQ ID NO: 3542493 - RNA, 17 nt, Human
ggucuuugagcucccac

SEQ ID NO: 3542494 - RNA, 16 nt, Human
ggucuuuucaucuggg

SEQ ID NO: 3542495 - RNA, 14 nt, Human
ugaugagaggaaau

SEQ ID NO: 3542496 - RNA, 14 nt, Human
ugaugaggcccucc

SEQ ID NO: 3542497 - RNA, 17 nt, Human
ugaugaggcccuccaca

SEQ ID NO: 3542498 - RNA, 18 nt, Human
ugaugaggccucuuggac

SEQ ID NO: 3542499 - RNA, 17 nt, Human
ugaugagggcagcagcc

SEQ ID NO: 3542500 - RNA, 21 nt, Human
ugaugagggcagcagccagcc

SEQ ID NO: 3542501 - RNA, 14 nt, Human
ugaugaggggaggg

SEQ ID NO: 3542502 - RNA, 19 nt, Human
ugaugagguauuuuuuccu

SEQ ID NO: 3542503 - RNA, 18 nt, Human
ugaugaguguaacaagaa

SEQ ID NO: 3542504 - RNA, 21 nt, Human
ugaugaguguaacaagaaagg

SEQ ID NO: 3542505 - RNA, 22 nt, Human
ugaugaguguaacaagaaagga

SEQ ID NO: 3542506 - RNA, 15 nt, Human
ugaugauacaagauu

SEQ ID NO: 3542507 - RNA, 20 nt, Human
ugaugauccuaggcauuugc

SEQ ID NO: 3542508 - RNA, 14 nt, Human
ugaugaucuuuaaa

SEQ ID NO: 3542509 - RNA, 19 nt, Human
ugaugaucuuugcagacag

SEQ ID NO: 3542510 - RNA, 20 nt, Human
ugaugaucuuugcagacagg

SEQ ID NO: 3542511 - RNA, 14 nt, Human
ugaugaugaaaauu

SEQ ID NO: 3542512 - RNA, 15 nt, Human
ugaugaugauaauga

SEQ ID NO: 3542513 - RNA, 20 nt, Human
ugaugauuuagagugcuguc

SEQ ID NO: 3542514 - RNA, 16 nt, Human
ugaugauuucagaaac

SEQ ID NO: 3542515 - RNA, 16 nt, Human
ugaugcacagagaagc

SEQ ID NO: 3542516 - RNA, 14 nt, Human
ugaugcacauuuca

SEQ ID NO: 3542517 - RNA, 14 nt, Human
ugaugcagcauuug

SEQ ID NO: 3542518 - RNA, 22 nt, Human
ugaugcaggauuuguucucugu

SEQ ID NO: 3542519 - RNA, 14 nt, Human
ugaugcagucuccu

SEQ ID NO: 3542520 - RNA, 17 nt, Human
ugaugcaugcacuguuc

SEQ ID NO: 3542521 - RNA, 17 nt, Human
ugaugcauuaaaagaaa

SEQ ID NO: 3542522 - RNA, 18 nt, Human
ugaugcauuaaaagaaaa

SEQ ID NO: 3542523 - RNA, 18 nt, Human
ugaugccaaaaaaaaaua

SEQ ID NO: 3542524 - RNA, 22 nt, Human
ugaugccaauacuagucacccc

SEQ ID NO: 3542525 - RNA, 23 nt, Human
ugaugccacaccaagcugugcca

SEQ ID NO: 3542526 - RNA, 14 nt, Human
ugaugccaugagga

SEQ ID NO: 3542527 - RNA, 18 nt, Human
ugaugcccugcuccaggg

SEQ ID NO: 3542528 - RNA, 14 nt, Human
ugaugccucccugu

SEQ ID NO: 3542529 - RNA, 20 nt, Human
ugaugccugugaacugaacu

SEQ ID NO: 3542530 - RNA, 13 nt, Human
ugaugcuauuugc

SEQ ID NO: 3542531 - RNA, 20 nt, Human
ugaugcuauuugcaauuccu

SEQ ID NO: 3542532 - RNA, 16 nt, Human
ugaugcucccuccccu

SEQ ID NO: 3542533 - RNA, 22 nt, Human
ugaugcucuuucccacccagcc

SEQ ID NO: 3542534 - RNA, 21 nt, Human
ugaugcugagauucuucaggc

SEQ ID NO: 3542535 - RNA, 18 nt, Human
ugaugcuggaacucuuga

SEQ ID NO: 3542536 - RNA, 12 nt, Human
ugaugcugggau

SEQ ID NO: 3542537 - RNA, 14 nt, Human
ugaugcugggcugg

SEQ ID NO: 3542538 - RNA, 15 nt, Human
ugaugcugggcuggg

SEQ ID NO: 3542539 - RNA, 13 nt, Human
ugaugcuguauuc

SEQ ID NO: 3542540 - RNA, 14 nt, Human
ugauggaaacaaag

SEQ ID NO: 3542541 - RNA, 17 nt, Human
ugauggaaacaaagugg

SEQ ID NO: 3542542 - RNA, 23 nt, Human
ugauggaaacaaaguggaaggaa

SEQ ID NO: 3542543 - RNA, 15 nt, Human
ugauggaacacagaa

SEQ ID NO: 3542544 - RNA, 14 nt, Human
ugauggaaccuuaa

SEQ ID NO: 3542545 - RNA, 22 nt, Human
ugauggaaguaaagccucaacc

SEQ ID NO: 3542546 - RNA, 20 nt, Human
ugauggaauuuuuuuguacg

SEQ ID NO: 3542547 - RNA, 20 nt, Human
ugauggaccuucuagaauua

SEQ ID NO: 3542548 - RNA, 12 nt, Human
ugauggagaagg

SEQ ID NO: 3542549 - RNA, 13 nt, Human
ugauggagaagga

SEQ ID NO: 3542550 - RNA, 16 nt, Human
ugauggagaaggaagg

SEQ ID NO: 3542551 - RNA, 18 nt, Human
ugauggagguuucauacu

SEQ ID NO: 3542552 - RNA, 15 nt, Human
ugauggagugugagc

SEQ ID NO: 3542553 - RNA, 18 nt, Human
ugauggcaacagaucugg

SEQ ID NO: 3542554 - RNA, 23 nt, Human
ugauggcaacagaucuggaaccu

SEQ ID NO: 3542555 - RNA, 15 nt, Human
ugauggcaauuuugu

SEQ ID NO: 3542556 - RNA, 20 nt, Human
ugauggcaggauggccuggc

SEQ ID NO: 3542557 - RNA, 19 nt, Human
ugauggcccauucuacuug

SEQ ID NO: 3542558 - RNA, 13 nt, Human
ugaugggaaaacu

SEQ ID NO: 3542559 - RNA, 20 nt, Human
ugaugggaugauugaagaaa

SEQ ID NO: 3542560 - RNA, 21 nt, Human
ugaugggaugauugaagaaac

SEQ ID NO: 3542561 - RNA, 22 nt, Human
ugaugggcaacccccagccugc

SEQ ID NO: 3542562 - RNA, 17 nt, Human
ugaugggcagccugcug

SEQ ID NO: 3542563 - RNA, 22 nt, Human
ugaugggcagccugcuggucag

SEQ ID NO: 3542564 - RNA, 16 nt, Human
ugauggggcccugccu

SEQ ID NO: 3542565 - RNA, 15 nt, Human
ugaugggggaggggg

SEQ ID NO: 3542566 - RNA, 19 nt, Human
ugauggguuaguggaugga

SEQ ID NO: 3542567 - RNA, 23 nt, Human
ugauggguuaguggauggaaggg

SEQ ID NO: 3542568 - RNA, 23 nt, Human
ugauggucacuuaaaaugugcag

SEQ ID NO: 3542569 - RNA, 15 nt, Human
ugauggucagcuccc

SEQ ID NO: 3542570 - RNA, 16 nt, Human
ugauggucagcucccu

SEQ ID NO: 3542571 - RNA, 16 nt, Human
ugauggucuucagccu

SEQ ID NO: 3542572 - RNA, 23 nt, Human
ugauggugcaaugaccuuucaau

SEQ ID NO: 3542573 - RNA, 15 nt, Human
ugauggugguauguu

SEQ ID NO: 3542574 - RNA, 13 nt, Human
ugaugguuguaca

SEQ ID NO: 3542575 - RNA, 16 nt, Human
ugauguaaaaucuugu

SEQ ID NO: 3542576 - RNA, 23 nt, Human
ugauguaaaaucuugucaugugu

SEQ ID NO: 3542577 - RNA, 21 nt, Human
ugauguaaaugaaguaacuug

SEQ ID NO: 3542578 - RNA, 16 nt, Human
ugauguaauuaugguu

SEQ ID NO: 3542579 - RNA, 17 nt, Human
ugauguacagauucuuu

SEQ ID NO: 3542580 - RNA, 18 nt, Human
ugauguacagucugucau

SEQ ID NO: 3542581 - RNA, 15 nt, Human
ugauguaccugaugc

SEQ ID NO: 3542582 - RNA, 21 nt, Human
ugauguacugauugagaaguu

SEQ ID NO: 3542583 - RNA, 17 nt, Human
ugauguagugccucuuu

SEQ ID NO: 3542584 - RNA, 18 nt, Human
ugaugucacaucuuggca

SEQ ID NO: 3542585 - RNA, 18 nt, Human
ugaugucagcaguugcug

SEQ ID NO: 3542586 - RNA, 22 nt, Human
ugaugucagcaguugcugguaa

SEQ ID NO: 3542587 - RNA, 14 nt, Human
ugaugucauacaga

SEQ ID NO: 3542588 - RNA, 17 nt, Human
ugaugucauacagagaa

SEQ ID NO: 3542589 - RNA, 20 nt, Human
ugaugucauacagagaaguc

SEQ ID NO: 3542590 - RNA, 15 nt, Human
ugauguccagaagaa

SEQ ID NO: 3542591 - RNA, 19 nt, Human
ugauguccuguaaacacuc

SEQ ID NO: 3542592 - RNA, 14 nt, Human
ugaugugaagccaa

SEQ ID NO: 3542593 - RNA, 14 nt, Human
ugaugugcaaaaau

SEQ ID NO: 3542594 - RNA, 17 nt, Human
ugaugugcaaaaauuuu

SEQ ID NO: 3542595 - RNA, 21 nt, Human
ugaugugcaaaaauuuuugga

SEQ ID NO: 3542596 - RNA, 22 nt, Human
ugaugugcaaaaauuuuuggau

SEQ ID NO: 3542597 - RNA, 22 nt, Human
ugaugugcaaaaccuuuuacug

SEQ ID NO: 3542598 - RNA, 21 nt, Human
ugaugugccauuuuaaaaaaa

SEQ ID NO: 3542599 - RNA, 17 nt, Human
ugaugugcuuaacaggg

SEQ ID NO: 3542600 - RNA, 14 nt, Human
ugauguggcaacug

SEQ ID NO: 3542601 - RNA, 16 nt, Human
ugauguggcaacugcu

SEQ ID NO: 3542602 - RNA, 18 nt, Human
ugauguggcaacugcuga

SEQ ID NO: 3542603 - RNA, 18 nt, Human
ugaugugggucaaggaau

SEQ ID NO: 3542604 - RNA, 16 nt, Human
ugauguguuaucucuu

SEQ ID NO: 3542605 - RNA, 18 nt, Human
ugauguguugccacuuuc

SEQ ID NO: 3542606 - RNA, 23 nt, Human
ugauguguugugauagcuaacau

SEQ ID NO: 3542607 - RNA, 14 nt, Human
ugauguguuuauuu

SEQ ID NO: 3542608 - RNA, 17 nt, Human
ugauguuaaaauuccau

SEQ ID NO: 3542609 - RNA, 16 nt, Human
ugauguuaacacauuu

SEQ ID NO: 3542610 - RNA, 17 nt, Human
ugauguuaacacauuuu

SEQ ID NO: 3542611 - RNA, 18 nt, Human
ugauguuaacacauuuug

SEQ ID NO: 3542612 - RNA, 21 nt, Human
ugauguuaacacauuuuguau

SEQ ID NO: 3542613 - RNA, 22 nt, Human
ugauguuaacacauuuuguaua

SEQ ID NO: 3542614 - RNA, 13 nt, Human
ugauguucagugu

SEQ ID NO: 3542615 - RNA, 20 nt, Human
ugauguucaguguaauuucu

SEQ ID NO: 3542616 - RNA, 14 nt, Human
ugauguucuaaggc

SEQ ID NO: 3542617 - RNA, 20 nt, Human
ugauguucuuucacccuuuu

SEQ ID NO: 3542618 - RNA, 17 nt, Human
ugauguugagggaacag

SEQ ID NO: 3542619 - RNA, 14 nt, Human
ugauguugaugcaa

SEQ ID NO: 3542620 - RNA, 16 nt, Human
ugauguugccuuaaua

SEQ ID NO: 3542621 - RNA, 15 nt, Human
ugauguuggcuggga

SEQ ID NO: 3542622 - RNA, 15 nt, Human
ugauguuugcccaaa

SEQ ID NO: 3542623 - RNA, 19 nt, Human
ugauguuugcccaaaauuu

SEQ ID NO: 3542624 - RNA, 13 nt, Human
ugauguuugcucu

SEQ ID NO: 3542625 - RNA, 13 nt, Human
ugauguuuguccu

SEQ ID NO: 3542626 - RNA, 14 nt, Human
ugauguuugugcag

SEQ ID NO: 3542627 - RNA, 20 nt, Human
ggugcugcuaauucuuugca

SEQ ID NO: 3542628 - RNA, 22 nt, Human
ggugcugcuaauucuuugcaaa

SEQ ID NO: 3542629 - RNA, 13 nt, Human
ggugcugcuaccc

SEQ ID NO: 3542630 - RNA, 20 nt, Human
ggugcuggagcacugggcuc

SEQ ID NO: 3542631 - RNA, 16 nt, Human
ggugcuggagguggga

SEQ ID NO: 3542632 - RNA, 23 nt, Human
ggugcuggagguuggaucuugau

SEQ ID NO: 3542633 - RNA, 14 nt, Human
ggugcugggacuga

SEQ ID NO: 3542634 - RNA, 19 nt, Human
ggugcugggacugagccag

SEQ ID NO: 3542635 - RNA, 20 nt, Human
ggugcugggacugagccagu

SEQ ID NO: 3542636 - RNA, 12 nt, Human
ggugcugggaga

SEQ ID NO: 3542637 - RNA, 15 nt, Human
ggugcugggaggagg

SEQ ID NO: 3542638 - RNA, 20 nt, Human
ggugcugggaggagggagag

SEQ ID NO: 3542639 - RNA, 13 nt, Human
guaagauuuccuu

SEQ ID NO: 3542640 - RNA, 16 nt, Human
guaagauuuguuuuua

SEQ ID NO: 3542641 - RNA, 16 nt, Human
guaagcacugacuggg

SEQ ID NO: 3542642 - RNA, 19 nt, Human
guaagcacuguuuuuccau

SEQ ID NO: 3542643 - RNA, 18 nt, Human
guaagcaucuacuucagg

SEQ ID NO: 3542644 - RNA, 22 nt, Human
guaagcggcucaagcccaggag

SEQ ID NO: 3542645 - RNA, 20 nt, Human
guaagcguauggcuuuauuu

SEQ ID NO: 3542646 - RNA, 24 nt, Human
guaagcuccuuuguggagugcugg

SEQ ID NO: 3542647 - RNA, 21 nt, Human
guaagcuguuugguuuuaaaa

SEQ ID NO: 3542648 - RNA, 18 nt, Human
guaaggaauaccuguccc

SEQ ID NO: 3542649 - RNA, 23 nt, Human
guaaggaauaccugucccccuga

SEQ ID NO: 3542650 - RNA, 18 nt, Human
guaaggauccggaaagaa

SEQ ID NO: 3542651 - RNA, 19 nt, Human
guaaggauccggaaagaag

SEQ ID NO: 3542652 - RNA, 14 nt, Human
guaaggcuguguaa

SEQ ID NO: 3542653 - RNA, 19 nt, Human
guaaggcuguguaagauuu

SEQ ID NO: 3542654 - RNA, 15 nt, Human
guaagggaaauagaa

SEQ ID NO: 3542655 - RNA, 23 nt, Human
guaagggaggaggagcuucuggg

SEQ ID NO: 3542656 - RNA, 16 nt, Human
guaagggauuucuuag

SEQ ID NO: 3542657 - RNA, 17 nt, Human
guaagggugacaaaugg

SEQ ID NO: 3542658 - RNA, 19 nt, Human
guaagguauaucauucuaa

SEQ ID NO: 3542659 - RNA, 17 nt, Human
guaaguaaacugcccug

SEQ ID NO: 3542660 - RNA, 15 nt, Human
guaaguacagagaag

SEQ ID NO: 3542661 - RNA, 18 nt, Human
guaaguauaucucaguuu

SEQ ID NO: 3542662 - RNA, 22 nt, Human
guaaguauucuuauuuaaugaa

SEQ ID NO: 3542663 - RNA, 17 nt, Human
guaagucaguguugaga

SEQ ID NO: 3542664 - RNA, 14 nt, Human
guaagugggcccac

SEQ ID NO: 3542665 - RNA, 21 nt, Human
guaagugggguugcaaccacu

SEQ ID NO: 3542666 - RNA, 22 nt, Human
guaagugggguugcaaccacug

SEQ ID NO: 3542667 - RNA, 20 nt, Human
guaagugugaguaagagcug

SEQ ID NO: 3542668 - RNA, 21 nt, Human
guaagugugaguaagagcugg

SEQ ID NO: 3542669 - RNA, 20 nt, Human
guaauaaaauucaacaaaca

SEQ ID NO: 3542670 - RNA, 15 nt, Human
guaauaaacuuuaau

SEQ ID NO: 3542671 - RNA, 14 nt, Human
guaauaaaguauau

SEQ ID NO: 3542672 - RNA, 17 nt, Human
guaauaaaguauauaau

SEQ ID NO: 3542673 - RNA, 16 nt, Human
guaauaaaguguuuuc

SEQ ID NO: 3542674 - RNA, 18 nt, Human
guaauaaaguguuuucag

SEQ ID NO: 3542675 - RNA, 11 nt, Human
guaauaaauau

SEQ ID NO: 3542676 - RNA, 12 nt, Human
guaauaaauaug

SEQ ID NO: 3542677 - RNA, 16 nt, Human
guaauaacugugaagu

SEQ ID NO: 3542678 - RNA, 20 nt, Human
guaauaagaauggaaaagag

SEQ ID NO: 3542679 - RNA, 14 nt, Human
guaauaagacauaa

SEQ ID NO: 3542680 - RNA, 13 nt, Human
guaauaagcacug

SEQ ID NO: 3542681 - RNA, 18 nt, Human
guaauaagggaaaaauca

SEQ ID NO: 3542682 - RNA, 16 nt, Human
guaauaauaaagaaua

SEQ ID NO: 3542683 - RNA, 23 nt, Human
ugcaccaacccagccgcugcccg

SEQ ID NO: 3542684 - RNA, 22 nt, Human
ugcaccaagcaggaaaugaaaa

SEQ ID NO: 3542685 - RNA, 12 nt, Human
ugcaccaccaag

SEQ ID NO: 3542686 - RNA, 15 nt, Human
ugcaccaccaagcca

SEQ ID NO: 3542687 - RNA, 14 nt, Human
ugcaccacugcacu

SEQ ID NO: 3542688 - RNA, 10 nt, Human
ugcaccagga

SEQ ID NO: 3542689 - RNA, 13 nt, Human
ugcaccauacuca

SEQ ID NO: 3542690 - RNA, 15 nt, Human
ugcaccaucccuuuu

SEQ ID NO: 3542691 - RNA, 17 nt, Human
ugcacccacccaggagu

SEQ ID NO: 3542692 - RNA, 14 nt, Human
ugcacccagaacag

SEQ ID NO: 3542693 - RNA, 17 nt, Human
ugcacccagaacagugg

SEQ ID NO: 3542694 - RNA, 14 nt, Human
ugcacccagcccag

SEQ ID NO: 3542695 - RNA, 15 nt, Human
ugcacccaugggcuc

SEQ ID NO: 3542696 - RNA, 18 nt, Human
ugcacccaugggcucuga

SEQ ID NO: 3542697 - RNA, 22 nt, Human
ugcaccccaaagcuuuccugcc

SEQ ID NO: 3542698 - RNA, 14 nt, Human
ugcaccccccuggg

SEQ ID NO: 3542699 - RNA, 16 nt, Human
ugcaccccccugggcu

SEQ ID NO: 3542700 - RNA, 14 nt, Human
ugcacccccuccug

SEQ ID NO: 3542701 - RNA, 18 nt, Human
ugcacccccuccugcugc

SEQ ID NO: 3542702 - RNA, 19 nt, Human
ugcacccccuccugcugca

SEQ ID NO: 3542703 - RNA, 13 nt, Human
ugcaccccuuccu

SEQ ID NO: 3542704 - RNA, 15 nt, Human
ugcaccccuucucuc

SEQ ID NO: 3542705 - RNA, 20 nt, Human
ugcaccccuucucuccuccc

SEQ ID NO: 3542706 - RNA, 14 nt, Human
ugcacccgccucuc

SEQ ID NO: 3542707 - RNA, 14 nt, Human
ugcacccuucuuuu

SEQ ID NO: 3542708 - RNA, 23 nt, Human
ugcacccuucuuuucucaugugu

SEQ ID NO: 3542709 - RNA, 15 nt, Human
ugcaccggcuggccu

SEQ ID NO: 3542710 - RNA, 18 nt, Human
ugcaccggcuggccuggc

SEQ ID NO: 3542711 - RNA, 15 nt, Human
ugcaccuaaaacuua

SEQ ID NO: 3542712 - RNA, 13 nt, Human
ugcaccuaaagaa

SEQ ID NO: 3542713 - RNA, 14 nt, Human
ugcaccuaaagaaa

SEQ ID NO: 3542714 - RNA, 19 nt, Human
ugcaccuagcugugcaaga

SEQ ID NO: 3542715 - RNA, 19 nt, Human
ugcaccuccccccacugca

SEQ ID NO: 3542716 - RNA, 15 nt, Human
ugcaccugccagccu

SEQ ID NO: 3542717 - RNA, 19 nt, Human
ugcaccugccagccuggcu

SEQ ID NO: 3542718 - RNA, 22 nt, Human
ugcaccugccagccuggcuucu

SEQ ID NO: 3542719 - RNA, 22 nt, Human
ugcaccuggaauauauaaccag

SEQ ID NO: 3542720 - RNA, 16 nt, Human
ugcaccuguacucagg

SEQ ID NO: 3542721 - RNA, 17 nt, Human
ugcaccuguacucagga

SEQ ID NO: 3542722 - RNA, 17 nt, Human
ugcaccuguccccaccc

SEQ ID NO: 3542723 - RNA, 21 nt, Human
ugcaccuguccccacccucca

SEQ ID NO: 3542724 - RNA, 13 nt, Human
ugcaccuuaccaa

SEQ ID NO: 3542725 - RNA, 19 nt, Human
ugcaccuuaccaacuuucu

SEQ ID NO: 3542726 - RNA, 20 nt, Human
ugcaccuuaccaacuuucug

SEQ ID NO: 3542727 - RNA, 17 nt, Human
ugcacgcacacugucug

SEQ ID NO: 3542728 - RNA, 22 nt, Human
ugcacgcugggcaaugagaauc

SEQ ID NO: 3542729 - RNA, 22 nt, Human
ugcacgguuucgaagucauuaa

SEQ ID NO: 3542730 - RNA, 23 nt, Human
ugcacgguuucgaagucauuaaa

SEQ ID NO: 3542731 - RNA, 16 nt, Human
ugcacguaaaguacuu

SEQ ID NO: 3542732 - RNA, 21 nt, Human
ugcacguaaaguacuuguagu

SEQ ID NO: 3542733 - RNA, 19 nt, Human
ugcacguacacacacauac

SEQ ID NO: 3542734 - RNA, 22 nt, Human
ugcacguaguagggucaggcca

SEQ ID NO: 3542735 - RNA, 16 nt, Human
ugcacguggagagcug

SEQ ID NO: 3542736 - RNA, 17 nt, Human
ugcacguggagagcugg

SEQ ID NO: 3542737 - RNA, 18 nt, Human
ugcacguggagagcuggu

SEQ ID NO: 3542738 - RNA, 20 nt, Human
ugcacguggagagcuggugc

SEQ ID NO: 3542739 - RNA, 12 nt, Human
ugcacgugugca

SEQ ID NO: 3542740 - RNA, 12 nt, Human
ugcacguguguu

SEQ ID NO: 3542741 - RNA, 17 nt, Human
ugcacguuaugguguuu

SEQ ID NO: 3542742 - RNA, 17 nt, Human
ugcacuaaagccagccu

SEQ ID NO: 3542743 - RNA, 18 nt, Human
ugcacuaaagccagccug

SEQ ID NO: 3542744 - RNA, 19 nt, Human
ugcacuaaagccagccuga

SEQ ID NO: 3542745 - RNA, 22 nt, Human
ugcacuaaagccagccugaccu

SEQ ID NO: 3542746 - RNA, 18 nt, Human
ugcacuaaaguauguaaa

SEQ ID NO: 3542747 - RNA, 13 nt, Human
ugcacuaaauaug

SEQ ID NO: 3542748 - RNA, 23 nt, Human
ugcacuaaggggcccggccagcc

SEQ ID NO: 3542749 - RNA, 23 nt, Human
ugcacuaagucucuuuuuuacaa

SEQ ID NO: 3542750 - RNA, 15 nt, Human
ugcacuacuccucug

SEQ ID NO: 3542751 - RNA, 18 nt, Human
ugcacuacuccucugcag

SEQ ID NO: 3542752 - RNA, 14 nt, Human
ugcacuacugacau

SEQ ID NO: 3542753 - RNA, 22 nt, Human
ugcacuauagccuaggugacag

SEQ ID NO: 3542754 - RNA, 14 nt, Human
ugcacuauaugcaa

SEQ ID NO: 3542755 - RNA, 15 nt, Human
ugcacuaucuuucag

SEQ ID NO: 3542756 - RNA, 15 nt, Human
ugcacucaaaucuua

SEQ ID NO: 3542757 - RNA, 13 nt, Human
ugcacuccagccu

SEQ ID NO: 3542758 - RNA, 16 nt, Human
ugcacuccagccuggg

SEQ ID NO: 3542759 - RNA, 17 nt, Human
ugcacucccaccugaca

SEQ ID NO: 3542760 - RNA, 15 nt, Human
ugcacuccccugcug

SEQ ID NO: 3542761 - RNA, 17 nt, Human
ugcacuccccugcuggg

SEQ ID NO: 3542762 - RNA, 19 nt, Human
ugcacuccccugcugggug

SEQ ID NO: 3542763 - RNA, 16 nt, Human
ugcacuccucagggca

SEQ ID NO: 3542764 - RNA, 18 nt, Human
ugcacucuaaaagguuca

SEQ ID NO: 3542765 - RNA, 22 nt, Human
ugcacucuaacccuaggcauca

SEQ ID NO: 3542766 - RNA, 13 nt, Human
ugcacucugugcc

SEQ ID NO: 3542767 - RNA, 13 nt, Human
ugcacugaaguuu

SEQ ID NO: 3542768 - RNA, 20 nt, Human
ugcacugacccuuccagaca

SEQ ID NO: 3542769 - RNA, 13 nt, Human
ugcacugacucug

SEQ ID NO: 3542770 - RNA, 14 nt, Human
ugcacugagggcca

SEQ ID NO: 3542771 - RNA, 15 nt, Human
ugcacugagggccac

SEQ ID NO: 3542772 - RNA, 17 nt, Human
ugcacugagggccacac

SEQ ID NO: 3542773 - RNA, 13 nt, Human
ugcacugauguug

SEQ ID NO: 3542774 - RNA, 19 nt, Human
ugcacugcccauggacagg

SEQ ID NO: 3542775 - RNA, 18 nt, Human
ugcacuggaguccagucu

SEQ ID NO: 3542776 - RNA, 16 nt, Human
ugcacuggccccaccc

SEQ ID NO: 3542777 - RNA, 12 nt, Human
ugcacugggagg

SEQ ID NO: 3542778 - RNA, 20 nt, Human
ugcacugggaggcuccccuu

SEQ ID NO: 3542779 - RNA, 16 nt, Human
ugcacuggggagcccg

SEQ ID NO: 3542780 - RNA, 12 nt, Human
ugcacuguaaaa

SEQ ID NO: 3542781 - RNA, 13 nt, Human
ugcacuguaaaau

SEQ ID NO: 3542782 - RNA, 14 nt, Human
ugcacuguaaaaug

SEQ ID NO: 3542783 - RNA, 15 nt, Human
ugcacuguaaaaugu

SEQ ID NO: 3542784 - RNA, 15 nt, Human
guaauuuguguaaua

SEQ ID NO: 3542785 - RNA, 16 nt, Human
guaauuuguguaauaa

SEQ ID NO: 3542786 - RNA, 21 nt, Human
guaauuuguguaauaaagugu

SEQ ID NO: 3542787 - RNA, 15 nt, Human
guaauuuuauaugaa

SEQ ID NO: 3542788 - RNA, 23 nt, Human
guaauuuuggguggggagaagag

SEQ ID NO: 3542789 - RNA, 21 nt, Human
guaauuuuguucuaguuuuca

SEQ ID NO: 3542790 - RNA, 21 nt, Human
guaauuuuuuuaucgucacug

SEQ ID NO: 3542791 - RNA, 15 nt, Human
guaauuuuuuucacc

SEQ ID NO: 3542792 - RNA, 12 nt, Human
guacaaaaauaa

SEQ ID NO: 3542793 - RNA, 16 nt, Human
guacaaaagggacaug

SEQ ID NO: 3542794 - RNA, 14 nt, Human
guacaaaauaaagu

SEQ ID NO: 3542795 - RNA, 12 nt, Human
guacaaaauuaa

SEQ ID NO: 3542796 - RNA, 18 nt, Human
guacaaacuaaggugcua

SEQ ID NO: 3542797 - RNA, 17 nt, Human
guacaaauauaagaaua

SEQ ID NO: 3542798 - RNA, 15 nt, Human
guacaacggaggccu

SEQ ID NO: 3542799 - RNA, 21 nt, Human
guacaacuuuuuaccuaguac

SEQ ID NO: 3542800 - RNA, 15 nt, Human
guacaagaagcauuu

SEQ ID NO: 3542801 - RNA, 13 nt, Human
guacaaggcaugg

SEQ ID NO: 3542802 - RNA, 14 nt, Human
guacaaguaguucu

SEQ ID NO: 3542803 - RNA, 15 nt, Human
guacaaguaguucug

SEQ ID NO: 3542804 - RNA, 16 nt, Human
guacaaguaguucugu

SEQ ID NO: 3542805 - RNA, 22 nt, Human
guacaaguaguucuguauuuga

SEQ ID NO: 3542806 - RNA, 17 nt, Human
guacaagucaguuucua

SEQ ID NO: 3542807 - RNA, 19 nt, Human
guacaauaauucauauucu

SEQ ID NO: 3542808 - RNA, 14 nt, Human
guacaauauuuaaa

SEQ ID NO: 3542809 - RNA, 16 nt, Human
guacaauguacacacu

SEQ ID NO: 3542810 - RNA, 18 nt, Human
guacacaauaagcaaaaa

SEQ ID NO: 3542811 - RNA, 23 nt, Human
guacacagaacacauaauucagg

SEQ ID NO: 3542812 - RNA, 18 nt, Human
guacacagcaccagaaug

SEQ ID NO: 3542813 - RNA, 20 nt, Human
guacacagcucuagacacug

SEQ ID NO: 3542814 - RNA, 16 nt, Human
guacacccaugaaaga

SEQ ID NO: 3542815 - RNA, 14 nt, Human
guacaccccaccuc

SEQ ID NO: 3542816 - RNA, 17 nt, Human
guacaccccaccucuuc

SEQ ID NO: 3542817 - RNA, 19 nt, Human
guacacguaaaucuguuca

SEQ ID NO: 3542818 - RNA, 18 nt, Human
guacacucugcuguuuga

SEQ ID NO: 3542819 - RNA, 13 nt, Human
guacacugccugc

SEQ ID NO: 3542820 - RNA, 17 nt, Human
guacacugccugccuua

SEQ ID NO: 3542821 - RNA, 22 nt, Human
guacacuucaguuaucuugauc

SEQ ID NO: 3542822 - RNA, 15 nt, Human
guacacuugugaaua

SEQ ID NO: 3542823 - RNA, 13 nt, Human
guacagaaagcug

SEQ ID NO: 3542824 - RNA, 17 nt, Human
guacagaauauuucuau

SEQ ID NO: 3542825 - RNA, 21 nt, Human
guacagaaucauugcuuauga

SEQ ID NO: 3542826 - RNA, 15 nt, Human
guacagaauuugaau

SEQ ID NO: 3542827 - RNA, 15 nt, Human
guacagaauuuugga

SEQ ID NO: 3542828 - RNA, 16 nt, Human
guacagacaacaaacc

SEQ ID NO: 3542829 - RNA, 16 nt, Human
guacagacauauuuaa

SEQ ID NO: 3542830 - RNA, 14 nt, Human
guacagagaagcca

SEQ ID NO: 3542831 - RNA, 16 nt, Human
guacagagaagccagc

SEQ ID NO: 3542832 - RNA, 18 nt, Human
guacagagaagccagcuu

SEQ ID NO: 3542833 - RNA, 23 nt, Human
guacagagaagccagcuuguuua

SEQ ID NO: 3542834 - RNA, 18 nt, Human
guacagagaagccaucac

SEQ ID NO: 3542835 - RNA, 14 nt, Human
guacagagaaggaa

SEQ ID NO: 3542836 - RNA, 19 nt, Human
guacagaugaaugauaaac

SEQ ID NO: 3542837 - RNA, 17 nt, Human
guacagauugcugcuuc

SEQ ID NO: 3542838 - RNA, 20 nt, Human
guacagauugcugcuucugc

SEQ ID NO: 3542839 - RNA, 20 nt, Human
guacagcaaggagauuuaca

SEQ ID NO: 3542840 - RNA, 22 nt, Human
guacagcacuuucuucuuccca

SEQ ID NO: 3542841 - RNA, 15 nt, Human
guacagcuggcucua

SEQ ID NO: 3542842 - RNA, 12 nt, Human
guacaggcagca

SEQ ID NO: 3542843 - RNA, 17 nt, Human
guacaggcagcacagag

SEQ ID NO: 3542844 - RNA, 15 nt, Human
guacagguaagguga

SEQ ID NO: 3542845 - RNA, 17 nt, Human
guacaguaggauaagcc

SEQ ID NO: 3542846 - RNA, 24 nt, Human
guacaguauggggguuguaaauug

SEQ ID NO: 3542847 - RNA, 17 nt, Human
guacagucugucuucug

SEQ ID NO: 3542848 - RNA, 20 nt, Human
guacaguggugccaucauug

SEQ ID NO: 3542849 - RNA, 13 nt, Human
ugcagacuggagg

SEQ ID NO: 3542850 - RNA, 17 nt, Human
ugcagacuggaggggac

SEQ ID NO: 3542851 - RNA, 22 nt, Human
ugcagacuucccagcuaggaag

SEQ ID NO: 3542852 - RNA, 24 nt, Human
ugcagagacagagaggacgugggc

SEQ ID NO: 3542853 - RNA, 15 nt, Human
ugcagagagaagccu

SEQ ID NO: 3542854 - RNA, 21 nt, Human
ugcagagagccauuuugugaa

SEQ ID NO: 3542855 - RNA, 23 nt, Human
ugcagagagccauuuugugaaug

SEQ ID NO: 3542856 - RNA, 15 nt, Human
ugcagagauuucuca

SEQ ID NO: 3542857 - RNA, 21 nt, Human
ugcagagcaggaaacaugacu

SEQ ID NO: 3542858 - RNA, 16 nt, Human
ugcagagccuucucag

SEQ ID NO: 3542859 - RNA, 17 nt, Human
ugcagagccuucucaga

SEQ ID NO: 3542860 - RNA, 21 nt, Human
ugcagaggaaguacaaacuaa

SEQ ID NO: 3542861 - RNA, 15 nt, Human
ugcagaggccagagg

SEQ ID NO: 3542862 - RNA, 17 nt, Human
ugcagaggccagaggcc

SEQ ID NO: 3542863 - RNA, 17 nt, Human
ugcagaggggcaggccc

SEQ ID NO: 3542864 - RNA, 22 nt, Human
ugcagaggggcaggcccugcac

SEQ ID NO: 3542865 - RNA, 19 nt, Human
ugcagaggguacuuuaaga

SEQ ID NO: 3542866 - RNA, 20 nt, Human
ugcagagguaaaagugugag

SEQ ID NO: 3542867 - RNA, 19 nt, Human
ugcagaggucugugcugag

SEQ ID NO: 3542868 - RNA, 22 nt, Human
ugcagaggucugugcugaggcc

SEQ ID NO: 3542869 - RNA, 13 nt, Human
ugcagagucagca

SEQ ID NO: 3542870 - RNA, 17 nt, Human
ugcagagucagcagaac

SEQ ID NO: 3542871 - RNA, 17 nt, Human
ugcagaguccugcacag

SEQ ID NO: 3542872 - RNA, 15 nt, Human
ugcagagugcccaga

SEQ ID NO: 3542873 - RNA, 18 nt, Human
ugcagagugcccagaacu

SEQ ID NO: 3542874 - RNA, 23 nt, Human
ugcagagugccccaucggucacc

SEQ ID NO: 3542875 - RNA, 24 nt, Human
ugcagaguucagggaagauaaguu

SEQ ID NO: 3542876 - RNA, 16 nt, Human
ugcagauaaacaguag

SEQ ID NO: 3542877 - RNA, 16 nt, Human
ugcagauagaaagcau

SEQ ID NO: 3542878 - RNA, 17 nt, Human
ugcagauaucacagagg

SEQ ID NO: 3542879 - RNA, 15 nt, Human
ugcagaugcaauugu

SEQ ID NO: 3542880 - RNA, 16 nt, Human
ugcagaugccagagca

SEQ ID NO: 3542881 - RNA, 14 nt, Human
ugcagaugccuggg

SEQ ID NO: 3542882 - RNA, 13 nt, Human
ugcagauucauuu

SEQ ID NO: 3542883 - RNA, 16 nt, Human
ugcagauuugggcugg

SEQ ID NO: 3542884 - RNA, 18 nt, Human
ugcagcaaacacuccacc

SEQ ID NO: 3542885 - RNA, 14 nt, Human
ugcagcaaccagag

SEQ ID NO: 3542886 - RNA, 16 nt, Human
ugcagcaaccagagca

SEQ ID NO: 3542887 - RNA, 22 nt, Human
ugcagcaaccagagcacuguau

SEQ ID NO: 3542888 - RNA, 19 nt, Human
ugcagcaaggcccugcugc

SEQ ID NO: 3542889 - RNA, 14 nt, Human
ugcagcaauaaagc

SEQ ID NO: 3542890 - RNA, 15 nt, Human
ugcagcaauaaagca

SEQ ID NO: 3542891 - RNA, 23 nt, Human
ugcagcaauaaagcagcguuucu

SEQ ID NO: 3542892 - RNA, 17 nt, Human
ugcagcaaucuuugaaa

SEQ ID NO: 3542893 - RNA, 22 nt, Human
ugcagcaauuaaaaauugucuu

SEQ ID NO: 3542894 - RNA, 23 nt, Human
ugcagcacagcugagaggcuguc

SEQ ID NO: 3542895 - RNA, 21 nt, Human
ugcagcaccgaggggccuuug

SEQ ID NO: 3542896 - RNA, 17 nt, Human
ugcagcacggacaauaa

SEQ ID NO: 3542897 - RNA, 19 nt, Human
ugcagcacggacaauaaac

SEQ ID NO: 3542898 - RNA, 13 nt, Human
ugcagcagagccu

SEQ ID NO: 3542899 - RNA, 13 nt, Human
ugcagcagauugg

SEQ ID NO: 3542900 - RNA, 18 nt, Human
ugcagcagcgguggccuc

SEQ ID NO: 3542901 - RNA, 12 nt, Human
ugcagcagcuug

SEQ ID NO: 3542902 - RNA, 23 nt, Human
ugcagcaggaguggugcagacag

SEQ ID NO: 3542903 - RNA, 16 nt, Human
ugcagcagggaugccc

SEQ ID NO: 3542904 - RNA, 18 nt, Human
ugcagcagugagucucuu

SEQ ID NO: 3542905 - RNA, 22 nt, Human
ugcagcaugaccugugaccagc

SEQ ID NO: 3542906 - RNA, 23 nt, Human
ugcagcauguugcugaggaguga

SEQ ID NO: 3542907 - RNA, 23 nt, Human
ugcagccagaccuauuccuccug

SEQ ID NO: 3542908 - RNA, 14 nt, Human
ugcagccagcccag

SEQ ID NO: 3542909 - RNA, 17 nt, Human
ugcagccagcccagccc

SEQ ID NO: 3542910 - RNA, 21 nt, Human
ugcagccagcccagcccagcu

SEQ ID NO: 3542911 - RNA, 23 nt, Human
ugcagccagcccagcccagcugg

SEQ ID NO: 3542912 - RNA, 11 nt, Human
ugcagccagcu

SEQ ID NO: 3542913 - RNA, 13 nt, Human
ugcagcccaugcc

SEQ ID NO: 3542914 - RNA, 18 nt, Human
ugcagcccaugcccaccu

SEQ ID NO: 3542915 - RNA, 23 nt, Human
ugcagcccaugcccaccugccca

SEQ ID NO: 3542916 - RNA, 20 nt, Human
ugcagcccauuucuccagaa

SEQ ID NO: 3542917 - RNA, 21 nt, Human
ugcagcccauuucuccagaac

SEQ ID NO: 3542918 - RNA, 22 nt, Human
ugcagcccggcgccaccauccu

SEQ ID NO: 3542919 - RNA, 19 nt, Human
ugcagcccguguggccccu

SEQ ID NO: 3542920 - RNA, 13 nt, Human
ugcagcccuggcc

SEQ ID NO: 3542921 - RNA, 16 nt, Human
ugcagccgccuuccuu

SEQ ID NO: 3542922 - RNA, 18 nt, Human
ugcagccucaaccuccug

SEQ ID NO: 3542923 - RNA, 21 nt, Human
ugcagccucaaccuccugggc

SEQ ID NO: 3542924 - RNA, 22 nt, Human
ugcagccucaaccuccugggcu

SEQ ID NO: 3542925 - RNA, 23 nt, Human
ugcagccucaaccuccugggcua

SEQ ID NO: 3542926 - RNA, 13 nt, Human
ugcagccucacag

SEQ ID NO: 3542927 - RNA, 17 nt, Human
ugcagccucacaguccu

SEQ ID NO: 3542928 - RNA, 20 nt, Human
guaguauggccugugucacu

SEQ ID NO: 3542929 - RNA, 15 nt, Human
guaguauucuucccu

SEQ ID NO: 3542930 - RNA, 15 nt, Human
guaguauuuuuugua

SEQ ID NO: 3542931 - RNA, 21 nt, Human
guagucagaauuagcugcuuc

SEQ ID NO: 3542932 - RNA, 23 nt, Human
guagucccagcuacuugggaggc

SEQ ID NO: 3542933 - RNA, 16 nt, Human
guaguccgugcugaca

SEQ ID NO: 3542934 - RNA, 12 nt, Human
guaguccuguga

SEQ ID NO: 3542935 - RNA, 14 nt, Human
guagucggcacagc

SEQ ID NO: 3542936 - RNA, 15 nt, Human
guagucuaaccaaau

SEQ ID NO: 3542937 - RNA, 19 nt, Human
guagucuaaccaaaugcau

SEQ ID NO: 3542938 - RNA, 14 nt, Human
guagucucugugcu

SEQ ID NO: 3542939 - RNA, 19 nt, Human
guagugaagacuccagaaa

SEQ ID NO: 3542940 - RNA, 14 nt, Human
guagugagauagca

SEQ ID NO: 3542941 - RNA, 22 nt, Human
guagugugggaggcuccuguua

SEQ ID NO: 3542942 - RNA, 21 nt, Human
guaguguuauugccaggaaag

SEQ ID NO: 3542943 - RNA, 21 nt, Human
guaguuaaaaaaaaaaaaagg

SEQ ID NO: 3542944 - RNA, 15 nt, Human
guaguuaauuuaucu

SEQ ID NO: 3542945 - RNA, 13 nt, Human
guaguuaggaaau

SEQ ID NO: 3542946 - RNA, 15 nt, Human
guaguuaggaaauaa

SEQ ID NO: 3542947 - RNA, 16 nt, Human
guaguuaggaaauaaa

SEQ ID NO: 3542948 - RNA, 23 nt, Human
guaguuccacuuauagccucugu

SEQ ID NO: 3542949 - RNA, 20 nt, Human
guaguucccugaaaacccag

SEQ ID NO: 3542950 - RNA, 14 nt, Human
guaguucucaaagu

SEQ ID NO: 3542951 - RNA, 20 nt, Human
guaguucucuugguguuaaa

SEQ ID NO: 3542952 - RNA, 17 nt, Human
guaguucuguauuugaa

SEQ ID NO: 3542953 - RNA, 18 nt, Human
guaguucuguauuugaaa

SEQ ID NO: 3542954 - RNA, 21 nt, Human
guaguucuguuuggugugucc

SEQ ID NO: 3542955 - RNA, 14 nt, Human
guaguucuuuaaac

SEQ ID NO: 3542956 - RNA, 17 nt, Human
guaguucuuuaaacugu

SEQ ID NO: 3542957 - RNA, 21 nt, Human
guaguuuuaucacauguaugu

SEQ ID NO: 3542958 - RNA, 22 nt, Human
guaguuuuuacagcuguguuau

SEQ ID NO: 3542959 - RNA, 13 nt, Human
guaguuuuuucau

SEQ ID NO: 3542960 - RNA, 23 nt, Human
guaguuuuuuuuuuuuuuaugug

SEQ ID NO: 3542961 - RNA, 19 nt, Human
guauaaaaauaaaaaagau

SEQ ID NO: 3542962 - RNA, 13 nt, Human
guauaaaagaugg

SEQ ID NO: 3542963 - RNA, 18 nt, Human
guauaaaagggacugaga

SEQ ID NO: 3542964 - RNA, 15 nt, Human
guauaaaauaauuuu

SEQ ID NO: 3542965 - RNA, 22 nt, Human
guauaaaauacauagugaaaau

SEQ ID NO: 3542966 - RNA, 17 nt, Human
guauaaaaucagccaau

SEQ ID NO: 3542967 - RNA, 19 nt, Human
guauaaaaugguguuuuca

SEQ ID NO: 3542968 - RNA, 14 nt, Human
guauaaacauuaaa

SEQ ID NO: 3542969 - RNA, 18 nt, Human
guauaaacauuaaauguc

SEQ ID NO: 3542970 - RNA, 16 nt, Human
guauaaacugauggau

SEQ ID NO: 3542971 - RNA, 13 nt, Human
guauaaagaaaag

SEQ ID NO: 3542972 - RNA, 14 nt, Human
guauaaagaaaagu

SEQ ID NO: 3542973 - RNA, 12 nt, Human
guauaaagaaca

SEQ ID NO: 3542974 - RNA, 21 nt, Human
guauaaagaauaggacuuguu

SEQ ID NO: 3542975 - RNA, 12 nt, Human
guauaaauauac

SEQ ID NO: 3542976 - RNA, 12 nt, Human
guauaaaugguu

SEQ ID NO: 3542977 - RNA, 21 nt, Human
guauaaauguauauacacaua

SEQ ID NO: 3542978 - RNA, 22 nt, Human
guauaaauguauauacacauau

SEQ ID NO: 3542979 - RNA, 16 nt, Human
guauaaaugucuuuaa

SEQ ID NO: 3542980 - RNA, 17 nt, Human
guauaagcacugaaaaa

SEQ ID NO: 3542981 - RNA, 17 nt, Human
guauaaguaagaaaaua

SEQ ID NO: 3542982 - RNA, 18 nt, Human
guauaaguaagaaaauau

SEQ ID NO: 3542983 - RNA, 17 nt, Human
guauaagugcacacaga

SEQ ID NO: 3542984 - RNA, 19 nt, Human
guauaaguggaggcacuuu

SEQ ID NO: 3542985 - RNA, 13 nt, Human
guauaauaaaauu

SEQ ID NO: 3542986 - RNA, 12 nt, Human
guauaauaggcu

SEQ ID NO: 3542987 - RNA, 14 nt, Human
guauaauauaaaaa

SEQ ID NO: 3542988 - RNA, 12 nt, Human
guauaauauuuu

SEQ ID NO: 3542989 - RNA, 15 nt, Human
guauaauauuuuuaa

SEQ ID NO: 3542990 - RNA, 19 nt, Human
guauaaugguugacugggu

SEQ ID NO: 3542991 - RNA, 10 nt, Human
guauaauuaa

SEQ ID NO: 3542992 - RNA, 14 nt, Human
guauaauuaacaug

SEQ ID NO: 3542993 - RNA, 23 nt, Human
guauaauuaacauguuaaaccau

SEQ ID NO: 3542994 - RNA, 19 nt, Human
guauaauuggauuuccuaa

SEQ ID NO: 3542995 - RNA, 20 nt, Human
guauaauuggauuuccuaau

SEQ ID NO: 3542996 - RNA, 18 nt, Human
guauaauuguaucguaua

SEQ ID NO: 3542997 - RNA, 14 nt, Human
guauaauuucgaga

SEQ ID NO: 3542998 - RNA, 15 nt, Human
guauacaaauauauu

SEQ ID NO: 3542999 - RNA, 15 nt, Human
guauacaauauauaa

SEQ ID NO: 3543000 - RNA, 17 nt, Human
guauacaauauauaaaa

SEQ ID NO: 3543001 - RNA, 17 nt, Human
guauacauccuggguaa

SEQ ID NO: 3543002 - RNA, 12 nt, Human
guauacaugcca

SEQ ID NO: 3543003 - RNA, 15 nt, Human
guauaccugauuuuu

SEQ ID NO: 3543004 - RNA, 15 nt, Human
guauacuauaguacc

SEQ ID NO: 3543005 - RNA, 22 nt, Human
guauacuuuaaauaauuuaacu

SEQ ID NO: 3543006 - RNA, 23 nt, Human
guauagaaaugcugguuuuucag

SEQ ID NO: 3543007 - RNA, 16 nt, Human
guauagacaggagaag

SEQ ID NO: 3543008 - RNA, 15 nt, Human
guauagacaguuugu

SEQ ID NO: 3543009 - RNA, 17 nt, Human
guauagacaguuuguaa

SEQ ID NO: 3543010 - RNA, 16 nt, Human
guauagacuccugaaa

SEQ ID NO: 3543011 - RNA, 14 nt, Human
guauagaugcaaga

SEQ ID NO: 3543012 - RNA, 14 nt, Human
guauagauuagaau

SEQ ID NO: 3543013 - RNA, 20 nt, Human
guauagcaugcaucuguuua

SEQ ID NO: 3543014 - RNA, 18 nt, Human
guauagcugcuuccagug

SEQ ID NO: 3543015 - RNA, 19 nt, Human
guauaguacuggcauggua

SEQ ID NO: 3543016 - RNA, 15 nt, Human
guauaguauuugaaa

SEQ ID NO: 3543017 - RNA, 17 nt, Human
guauaguauuugaaaac

SEQ ID NO: 3543018 - RNA, 18 nt, Human
guauaguauuugaaaaca

SEQ ID NO: 3543019 - RNA, 21 nt, Human
guauaguauuugaaaacagaa

SEQ ID NO: 3543020 - RNA, 13 nt, Human
guauaguguaaaa

SEQ ID NO: 3543021 - RNA, 15 nt, Human
guauaguguaaaaua

SEQ ID NO: 3543022 - RNA, 19 nt, Human
guauaguuaggauagcauu

SEQ ID NO: 3543023 - RNA, 19 nt, Human
guauaguugauguaacauu

SEQ ID NO: 3543024 - RNA, 16 nt, Human
guauauaaaauauuuu

SEQ ID NO: 3543025 - RNA, 12 nt, Human
guauauaauuuu

SEQ ID NO: 3543026 - RNA, 13 nt, Human
guauauacacaua

SEQ ID NO: 3543027 - RNA, 15 nt, Human
guauauacacauaua

SEQ ID NO: 3543028 - RNA, 16 nt, Human
guauauacgcaucuau

SEQ ID NO: 3543029 - RNA, 11 nt, Human
guauauauaca

SEQ ID NO: 3543030 - RNA, 16 nt, Human
guauauauacauaaca

SEQ ID NO: 3543031 - RNA, 14 nt, Human
guauauauguguau

SEQ ID NO: 3543032 - RNA, 14 nt, Human
guauauaugugugu

SEQ ID NO: 3543033 - RNA, 19 nt, Human
guauauauguguguuuaaa

SEQ ID NO: 3543034 - RNA, 13 nt, Human
guauauauuccca

SEQ ID NO: 3543035 - RNA, 13 nt, Human
guauauauuuugu

SEQ ID NO: 3543036 - RNA, 14 nt, Human
guauauccuuuucu

SEQ ID NO: 3543037 - RNA, 18 nt, Human
guauaucguuaucacugu

SEQ ID NO: 3543038 - RNA, 19 nt, Human
guauaucuagguuuaugac

SEQ ID NO: 3543039 - RNA, 17 nt, Human
guauaucuggacaagcc

SEQ ID NO: 3543040 - RNA, 18 nt, Human
guauaucuggacaagcca

SEQ ID NO: 3543041 - RNA, 21 nt, Human
guauaucugggcuggccaguu

SEQ ID NO: 3543042 - RNA, 17 nt, Human
guauauguaugugugua

SEQ ID NO: 3543043 - RNA, 18 nt, Human
guauauuacacauuugua

SEQ ID NO: 3543044 - RNA, 22 nt, Human
guauauuacacauuuguacaga

SEQ ID NO: 3543045 - RNA, 17 nt, Human
ugccaggccagccuccg

SEQ ID NO: 3543046 - RNA, 17 nt, Human
ugccaggcccccaccac

SEQ ID NO: 3543047 - RNA, 21 nt, Human
ugccaggcccccaccacacau

SEQ ID NO: 3543048 - RNA, 14 nt, Human
ugccaggcucucuu

SEQ ID NO: 3543049 - RNA, 20 nt, Human
ugccaggcuggagugcagug

SEQ ID NO: 3543050 - RNA, 17 nt, Human
ugccagggcaaugauga

SEQ ID NO: 3543051 - RNA, 15 nt, Human
ugccagggcagggcc

SEQ ID NO: 3543052 - RNA, 17 nt, Human
ugccagggccccucucc

SEQ ID NO: 3543053 - RNA, 23 nt, Human
ugccagggccccucuccccaggg

SEQ ID NO: 3543054 - RNA, 22 nt, Human
ugccaggucccuuucauuugcu

SEQ ID NO: 3543055 - RNA, 20 nt, Human
ugccagguccuugcccuuug

SEQ ID NO: 3543056 - RNA, 17 nt, Human
ugccaggugaggucagc

SEQ ID NO: 3543057 - RNA, 17 nt, Human
ugccagguuuuuggucu

SEQ ID NO: 3543058 - RNA, 18 nt, Human
ugccagguuuuuggucug

SEQ ID NO: 3543059 - RNA, 19 nt, Human
ugccagguuuuuggucuga

SEQ ID NO: 3543060 - RNA, 24 nt, Human
ugccagguuuuuggucugacccac

SEQ ID NO: 3543061 - RNA, 23 nt, Human
ugccaguaacacaggccacccug

SEQ ID NO: 3543062 - RNA, 23 nt, Human
ugccaguaccagccccacccugu

SEQ ID NO: 3543063 - RNA, 14 nt, Human
ugccagucaccccg

SEQ ID NO: 3543064 - RNA, 15 nt, Human
ugccagucaccccgg

SEQ ID NO: 3543065 - RNA, 13 nt, Human
ugccaguccuguc

SEQ ID NO: 3543066 - RNA, 12 nt, Human
ugccagucgcgc

SEQ ID NO: 3543067 - RNA, 19 nt, Human
ugccagucgcgcugccugu

SEQ ID NO: 3543068 - RNA, 20 nt, Human
ugccagucgcgcugccugug

SEQ ID NO: 3543069 - RNA, 19 nt, Human
ugccagugacagacaggcu

SEQ ID NO: 3543070 - RNA, 12 nt, Human
ugccagugccug

SEQ ID NO: 3543071 - RNA, 15 nt, Human
ugccagugccuuacc

SEQ ID NO: 3543072 - RNA, 16 nt, Human
ugccaguggggccuga

SEQ ID NO: 3543073 - RNA, 16 nt, Human
ugccaguguccugagc

SEQ ID NO: 3543074 - RNA, 17 nt, Human
ugaguagaaaggccuuu

SEQ ID NO: 3543075 - RNA, 18 nt, Human
ugaguagaaaggccuuua

SEQ ID NO: 3543076 - RNA, 23 nt, Human
ugaguagaaaggccuuuaaaauu

SEQ ID NO: 3543077 - RNA, 14 nt, Human
ugaguagaguugau

SEQ ID NO: 3543078 - RNA, 17 nt, Human
ugaguagaguugaucaa

SEQ ID NO: 3543079 - RNA, 13 nt, Human
ugaguagcuggga

SEQ ID NO: 3543080 - RNA, 15 nt, Human
ugaguauacaauaua

SEQ ID NO: 3543081 - RNA, 15 nt, Human
ugaguauauuauaau

SEQ ID NO: 3543082 - RNA, 14 nt, Human
ugaguauuaaaaug

SEQ ID NO: 3543083 - RNA, 17 nt, Human
ugaguauuaaaauguau

SEQ ID NO: 3543084 - RNA, 18 nt, Human
ugaguauuaaaauguaug

SEQ ID NO: 3543085 - RNA, 15 nt, Human
ugaguauuguuuaaa

SEQ ID NO: 3543086 - RNA, 23 nt, Human
ugaguauuguuuaaaauguaauu

SEQ ID NO: 3543087 - RNA, 18 nt, Human
ugagucaaguuguuccuu

SEQ ID NO: 3543088 - RNA, 15 nt, Human
ugagucaaugugcag

SEQ ID NO: 3543089 - RNA, 18 nt, Human
ugagucaccaagcccagu

SEQ ID NO: 3543090 - RNA, 16 nt, Human
ugagucacccaugaag

SEQ ID NO: 3543091 - RNA, 23 nt, Human
ugagucacuaugggaugagaaaa

SEQ ID NO: 3543092 - RNA, 15 nt, Human
ugagucagggcccag

SEQ ID NO: 3543093 - RNA, 17 nt, Human
ugagucagggcccagag

SEQ ID NO: 3543094 - RNA, 18 nt, Human
ugagucagggcccagagg

SEQ ID NO: 3543095 - RNA, 22 nt, Human
ugagucaugaucucccugccgc

SEQ ID NO: 3543096 - RNA, 17 nt, Human
ugaguccauucucccag

SEQ ID NO: 3543097 - RNA, 20 nt, Human
ugaguccauucucccaggua

SEQ ID NO: 3543098 - RNA, 19 nt, Human
ugagucccaggcugagccu

SEQ ID NO: 3543099 - RNA, 21 nt, Human
ugagucccaggcugagccuca

SEQ ID NO: 3543100 - RNA, 20 nt, Human
ugaguccccauugaggcuug

SEQ ID NO: 3543101 - RNA, 22 nt, Human
ugaguccccauugaggcuuggu

SEQ ID NO: 3543102 - RNA, 18 nt, Human
ugagucccuuccaggcca

SEQ ID NO: 3543103 - RNA, 21 nt, Human
ugagucccuuccaggccauca

SEQ ID NO: 3543104 - RNA, 16 nt, Human
ugaguccuagagcuac

SEQ ID NO: 3543105 - RNA, 17 nt, Human
ugaguccuccagaacuc

SEQ ID NO: 3543106 - RNA, 23 nt, Human
ugaguccuccagaacucuuccuc

SEQ ID NO: 3543107 - RNA, 19 nt, Human
ugaguccuggaugauacua

SEQ ID NO: 3543108 - RNA, 18 nt, Human
ugaguccuggcaugggaa

SEQ ID NO: 3543109 - RNA, 22 nt, Human
ugaguccuggcaugggaaugaa

SEQ ID NO: 3543110 - RNA, 13 nt, Human
ugaguccuggccc

SEQ ID NO: 3543111 - RNA, 18 nt, Human
ugaguccuuaaacagggc

SEQ ID NO: 3543112 - RNA, 18 nt, Human
ugaguccuugauuucaaa

SEQ ID NO: 3543113 - RNA, 18 nt, Human
ugagucgaggacagggag

SEQ ID NO: 3543114 - RNA, 17 nt, Human
ugagucgugaccugcua

SEQ ID NO: 3543115 - RNA, 23 nt, Human
ugagucucccaaggcugcgucug

SEQ ID NO: 3543116 - RNA, 15 nt, Human
ugagucucucugggc

SEQ ID NO: 3543117 - RNA, 14 nt, Human
ugagucucuggggc

SEQ ID NO: 3543118 - RNA, 13 nt, Human
ugagucugaaggc

SEQ ID NO: 3543119 - RNA, 18 nt, Human
ugagucugaaggcugggu

SEQ ID NO: 3543120 - RNA, 14 nt, Human
ugagucugggcagc

SEQ ID NO: 3543121 - RNA, 17 nt, Human
ugagucuguucugguaa

SEQ ID NO: 3543122 - RNA, 17 nt, Human
ugagucuguuuuguaaa

SEQ ID NO: 3543123 - RNA, 16 nt, Human
ugagucuuggcggcag

SEQ ID NO: 3543124 - RNA, 18 nt, Human
ugagucuuggcggcagca

SEQ ID NO: 3543125 - RNA, 22 nt, Human
ugagucuuuuuuuuuuaaguga

SEQ ID NO: 3543126 - RNA, 21 nt, Human
ugagugaaauacuguacaggg

SEQ ID NO: 3543127 - RNA, 15 nt, Human
ugagugaauaaaugu

SEQ ID NO: 3543128 - RNA, 14 nt, Human
ugagugagcaugcc

SEQ ID NO: 3543129 - RNA, 14 nt, Human
ugagugagccuggc

SEQ ID NO: 3543130 - RNA, 20 nt, Human
ugagugaugcggcagauuga

SEQ ID NO: 3543131 - RNA, 20 nt, Human
ugagugcaaacuucagaguu

SEQ ID NO: 3543132 - RNA, 12 nt, Human
ugagugccuucu

SEQ ID NO: 3543133 - RNA, 13 nt, Human
ugagugccuucug

SEQ ID NO: 3543134 - RNA, 18 nt, Human
ugagugccuucugugggg

SEQ ID NO: 3543135 - RNA, 18 nt, Human
ugaguggaugauguuucg

SEQ ID NO: 3543136 - RNA, 13 nt, Human
ugaguggcagggg

SEQ ID NO: 3543137 - RNA, 12 nt, Human
ugaguggcccuu

SEQ ID NO: 3543138 - RNA, 19 nt, Human
ugaguggcuucacuccugc

SEQ ID NO: 3543139 - RNA, 22 nt, Human
ugaguggcuucacuccugcugu

SEQ ID NO: 3543140 - RNA, 12 nt, Human
ugagugggaagc

SEQ ID NO: 3543141 - RNA, 14 nt, Human
ugagugggaagccc

SEQ ID NO: 3543142 - RNA, 15 nt, Human
ugagugggagaaggc

SEQ ID NO: 3543143 - RNA, 19 nt, Human
ugaguggggagacaccuca

SEQ ID NO: 3543144 - RNA, 20 nt, Human
ugaguggggagacaccucag

SEQ ID NO: 3543145 - RNA, 21 nt, Human
ugaguggggagacaccucaga

SEQ ID NO: 3543146 - RNA, 21 nt, Human
ugagugggggaucacagccuc

SEQ ID NO: 3543147 - RNA, 22 nt, Human
ugagugggguuaucucuguguu

SEQ ID NO: 3543148 - RNA, 14 nt, Human
ugaguguaagugug

SEQ ID NO: 3543149 - RNA, 11 nt, Human
ugaguguacca

SEQ ID NO: 3543150 - RNA, 14 nt, Human
ugaguguaugagua

SEQ ID NO: 3543151 - RNA, 17 nt, Human
ugagugugacagggcca

SEQ ID NO: 3543152 - RNA, 21 nt, Human
ugagugugauccaguuuuuca

SEQ ID NO: 3543153 - RNA, 12 nt, Human
ugaguguggaag

SEQ ID NO: 3543154 - RNA, 17 nt, Human
ugaguguguccaagugu

SEQ ID NO: 3543155 - RNA, 15 nt, Human
ugagugugugugugc

SEQ ID NO: 3543156 - RNA, 16 nt, Human
ugagugugugugugca

SEQ ID NO: 3543157 - RNA, 18 nt, Human
ugaguguuuaauaaaguu

SEQ ID NO: 3543158 - RNA, 21 nt, Human
ugaguguuuuaugagaaagcc

SEQ ID NO: 3543159 - RNA, 17 nt, Human
ugaguuacugugcauug

SEQ ID NO: 3543160 - RNA, 12 nt, Human
ugaguuaggaac

SEQ ID NO: 3543161 - RNA, 16 nt, Human
ugaguuauguuaaaau

SEQ ID NO: 3543162 - RNA, 22 nt, Human
ugaguuauuccuugaucauuuu

SEQ ID NO: 3543163 - RNA, 23 nt, Human
ugaguuauuccuugaucauuuug

SEQ ID NO: 3543164 - RNA, 14 nt, Human
ugaguuauuuuaau

SEQ ID NO: 3543165 - RNA, 17 nt, Human
ugaguuccaguugaagu

SEQ ID NO: 3543166 - RNA, 18 nt, Human
ugaguuccuagccaccgc

SEQ ID NO: 3543167 - RNA, 21 nt, Human
ugaguucgaggacuacaacca

SEQ ID NO: 3543168 - RNA, 13 nt, Human
ugaguucucaggg

SEQ ID NO: 3543169 - RNA, 19 nt, Human
ugaguucucagggcuccug

SEQ ID NO: 3543170 - RNA, 15 nt, Human
ugaguucucccugua

SEQ ID NO: 3543171 - RNA, 14 nt, Human
ugaguucugcugaa

SEQ ID NO: 3543172 - RNA, 15 nt, Human
ugaguucuuccugua

SEQ ID NO: 3543173 - RNA, 23 nt, Human
ugaguugacuugacagaacacug

SEQ ID NO: 3543174 - RNA, 21 nt, Human
ugaguugauagcacagacccu

SEQ ID NO: 3543175 - RNA, 14 nt, Human
ugaguuggcuggga

SEQ ID NO: 3543176 - RNA, 18 nt, Human
ugaguugugaaaguuuug

SEQ ID NO: 3543177 - RNA, 23 nt, Human
ugaguuguuuucagacucagacu

SEQ ID NO: 3543178 - RNA, 17 nt, Human
ugaguuguuuuuguaua

SEQ ID NO: 3543179 - RNA, 20 nt, Human
ugaguuguuuuuguauauug

SEQ ID NO: 3543180 - RNA, 16 nt, Human
ugaguuuaaaaaucaa

SEQ ID NO: 3543181 - RNA, 20 nt, Human
ugaguuuaaaaaucaacuuu

SEQ ID NO: 3543182 - RNA, 20 nt, Human
ugaguuuaccauuuguaaua

SEQ ID NO: 3543183 - RNA, 21 nt, Human
ugaguuuagugaucugaacag

SEQ ID NO: 3543184 - RNA, 17 nt, Human
ugaguuuauaucucuca

SEQ ID NO: 3543185 - RNA, 18 nt, Human
ugaguuucauucuccugc

SEQ ID NO: 3543186 - RNA, 19 nt, Human
ugaguuucucucacauuac

SEQ ID NO: 3543187 - RNA, 18 nt, Human
ugaguuugagcugccuuc

SEQ ID NO: 3543188 - RNA, 21 nt, Human
ugaguuugagcugccuucccu

SEQ ID NO: 3543189 - RNA, 14 nt, Human
ugaguuugcccugg

SEQ ID NO: 3543190 - RNA, 23 nt, Human
ugaguuugggccccagaggcugg

SEQ ID NO: 3543191 - RNA, 21 nt, Human
ugaguuuguagguaaaaugua

SEQ ID NO: 3543192 - RNA, 23 nt, Human
ugaguuuucucuuuguggggcuu

SEQ ID NO: 3543193 - RNA, 17 nt, Human
ugaguuuuguguuuguu

SEQ ID NO: 3543194 - RNA, 20 nt, Human
ugaguuuuguuuuaaaauua

SEQ ID NO: 3543195 - RNA, 18 nt, Human
ugaguuuuuauggggcug

SEQ ID NO: 3543196 - RNA, 19 nt, Human
ugaguuuuugauagcuuua

SEQ ID NO: 3543197 - RNA, 18 nt, Human
ugaguuuuuucucuuggg

SEQ ID NO: 3543198 - RNA, 16 nt, Human
ugauaaaaaauuuugu

SEQ ID NO: 3543199 - RNA, 19 nt, Human
ugauaaaaaauuuuguaau

SEQ ID NO: 3543200 - RNA, 17 nt, Human
ugauaaaggccagauua

SEQ ID NO: 3543201 - RNA, 19 nt, Human
ugauaaaguaguaaaaauu

SEQ ID NO: 3543202 - RNA, 13 nt, Human
ugauaaaguuucu

SEQ ID NO: 3543203 - RNA, 16 nt, Human
ugauaaaguuucucag

SEQ ID NO: 3543204 - RNA, 22 nt, Human
ugauaaaguuucucagauccuu

SEQ ID NO: 3543205 - RNA, 14 nt, Human
ugauaaauaguguu

SEQ ID NO: 3543206 - RNA, 21 nt, Human
ugauaaauauucacacuugaa

SEQ ID NO: 3543207 - RNA, 14 nt, Human
ugauaaaucauuuu

SEQ ID NO: 3543208 - RNA, 13 nt, Human
ugauaaauccauc

SEQ ID NO: 3543209 - RNA, 17 nt, Human
ugauaacaaccuggaga

SEQ ID NO: 3543210 - RNA, 14 nt, Human
guauuagauguucu

SEQ ID NO: 3543211 - RNA, 17 nt, Human
guauuagauguucucua

SEQ ID NO: 3543212 - RNA, 18 nt, Human
guauuagauguucucuau

SEQ ID NO: 3543213 - RNA, 22 nt, Human
guauuagauguucucuaucauu

SEQ ID NO: 3543214 - RNA, 22 nt, Human
guauuagugauauuucucuagu

SEQ ID NO: 3543215 - RNA, 23 nt, Human
guauuauaaacaagaaugaaggu

SEQ ID NO: 3543216 - RNA, 20 nt, Human
guauuauaaauuauguuuau

SEQ ID NO: 3543217 - RNA, 18 nt, Human
guauuauaccaaaauguu

SEQ ID NO: 3543218 - RNA, 22 nt, Human
guccaugcagggggcuccuggg

SEQ ID NO: 3543219 - RNA, 14 nt, Human
guccauggaaugcu

SEQ ID NO: 3543220 - RNA, 15 nt, Human
guccauggaaugcuu

SEQ ID NO: 3543221 - RNA, 18 nt, Human
guccauggaaugcuugaa

SEQ ID NO: 3543222 - RNA, 14 nt, Human
guccaugugugugc

SEQ ID NO: 3543223 - RNA, 15 nt, Human
guccauugacaugua

SEQ ID NO: 3543224 - RNA, 19 nt, Human
guccauugacauguacaga

SEQ ID NO: 3543225 - RNA, 16 nt, Human
guccauuuacacguau

SEQ ID NO: 3543226 - RNA, 22 nt, Human
guccauuuauauaugaaaacua

SEQ ID NO: 3543227 - RNA, 13 nt, Human
guccauuucuacc

SEQ ID NO: 3543228 - RNA, 15 nt, Human
guccauuuguaaaac

SEQ ID NO: 3543229 - RNA, 15 nt, Human
guccauuuugugaag

SEQ ID NO: 3543230 - RNA, 23 nt, Human
guccauuuuuacaaguuauagua

SEQ ID NO: 3543231 - RNA, 19 nt, Human
gucccaaauccuucccaag

SEQ ID NO: 3543232 - RNA, 15 nt, Human
gucccaacuuguaaa

SEQ ID NO: 3543233 - RNA, 21 nt, Human
gucccaacuuguaaaaauuaa

SEQ ID NO: 3543234 - RNA, 15 nt, Human
gucccaagcugggcc

SEQ ID NO: 3543235 - RNA, 21 nt, Human
gucccaagcugggccccagcc

SEQ ID NO: 3543236 - RNA, 23 nt, Human
gucccaagcugggccccagccca

SEQ ID NO: 3543237 - RNA, 16 nt, Human
gucccaaggaaagccc

SEQ ID NO: 3543238 - RNA, 22 nt, Human
gucccaaggcaaggggugccug

SEQ ID NO: 3543239 - RNA, 23 nt, Human
gucccaaugcacauccauuccca

SEQ ID NO: 3543240 - RNA, 17 nt, Human
gucccacacuggugacu

SEQ ID NO: 3543241 - RNA, 11 nt, Human
gucccacagcu

SEQ ID NO: 3543242 - RNA, 17 nt, Human
gucccacaucccugggc

SEQ ID NO: 3543243 - RNA, 19 nt, Human
gucccacaucccugggccu

SEQ ID NO: 3543244 - RNA, 20 nt, Human
gucccacaucccugggccug

SEQ ID NO: 3543245 - RNA, 22 nt, Human
gucccacaucccugggccugcu

SEQ ID NO: 3543246 - RNA, 23 nt, Human
gucccacaucccugggccugcug

SEQ ID NO: 3543247 - RNA, 23 nt, Human
gucccaccucaaaugggucuggg

SEQ ID NO: 3543248 - RNA, 16 nt, Human
gucccaccuccagccc

SEQ ID NO: 3543249 - RNA, 17 nt, Human
gucccaccuccagcccg

SEQ ID NO: 3543250 - RNA, 13 nt, Human
gucccaccucuuc

SEQ ID NO: 3543251 - RNA, 19 nt, Human
gucccaccucuucucuucc

SEQ ID NO: 3543252 - RNA, 22 nt, Human
gucccaccucuucucuuccugu

SEQ ID NO: 3543253 - RNA, 17 nt, Human
gucccaccuuggcugca

SEQ ID NO: 3543254 - RNA, 18 nt, Human
gucccaccuuggcugcag

SEQ ID NO: 3543255 - RNA, 20 nt, Human
gucccacgaauuugcugggg

SEQ ID NO: 3543256 - RNA, 13 nt, Human
gucccacgugucu

SEQ ID NO: 3543257 - RNA, 16 nt, Human
gucccacucaagccaa

SEQ ID NO: 3543258 - RNA, 21 nt, Human
gucccacucaagccaagcagc

SEQ ID NO: 3543259 - RNA, 14 nt, Human
gucccacucagucc

SEQ ID NO: 3543260 - RNA, 15 nt, Human
gucccacucagucca

SEQ ID NO: 3543261 - RNA, 13 nt, Human
gucccacuccaag

SEQ ID NO: 3543262 - RNA, 18 nt, Human
gucccacugccucagguu

SEQ ID NO: 3543263 - RNA, 12 nt, Human
gucccacugugc

SEQ ID NO: 3543264 - RNA, 16 nt, Human
ugauucgagcuauauu

SEQ ID NO: 3543265 - RNA, 18 nt, Human
ugauucguagauuuaaua

SEQ ID NO: 3543266 - RNA, 12 nt, Human
ugauucucaggg

SEQ ID NO: 3543267 - RNA, 22 nt, Human
ugauucucagggucucugcugc

SEQ ID NO: 3543268 - RNA, 21 nt, Human
ugauucuccugccucagccuc

SEQ ID NO: 3543269 - RNA, 21 nt, Human
ugauucuccuucagcccucac

SEQ ID NO: 3543270 - RNA, 12 nt, Human
ugauucugccuu

SEQ ID NO: 3543271 - RNA, 17 nt, Human
ugauucugcuugagaau

SEQ ID NO: 3543272 - RNA, 18 nt, Human
ugauucugcuugagaaua

SEQ ID NO: 3543273 - RNA, 17 nt, Human
ugauucugcuuuuacca

SEQ ID NO: 3543274 - RNA, 14 nt, Human
ugauucuggcuuua

SEQ ID NO: 3543275 - RNA, 18 nt, Human
ugauucuggcuuuaagcc

SEQ ID NO: 3543276 - RNA, 13 nt, Human
ugauucugugugu

SEQ ID NO: 3543277 - RNA, 15 nt, Human
ugauucuguguguuu

SEQ ID NO: 3543278 - RNA, 14 nt, Human
ugauucuuuguuac

SEQ ID NO: 3543279 - RNA, 12 nt, Human
ugauugaagaaa

SEQ ID NO: 3543280 - RNA, 19 nt, Human
ugauugaauaaugccacca

SEQ ID NO: 3543281 - RNA, 17 nt, Human
ugauugacagcuuugcu

SEQ ID NO: 3543282 - RNA, 19 nt, Human
ugauugacagcuuugcugc

SEQ ID NO: 3543283 - RNA, 21 nt, Human
ugauugaccguguuggucugu

SEQ ID NO: 3543284 - RNA, 15 nt, Human
ugauugaccugcucc

SEQ ID NO: 3543285 - RNA, 15 nt, Human
ugauugaugacccuu

SEQ ID NO: 3543286 - RNA, 12 nt, Human
ugauugcagcuu

SEQ ID NO: 3543287 - RNA, 14 nt, Human
ugauugcuaaaugu

SEQ ID NO: 3543288 - RNA, 19 nt, Human
ugauugcuaaauguaacag

SEQ ID NO: 3543289 - RNA, 22 nt, Human
ugauugcuaaauguaacagucu

SEQ ID NO: 3543290 - RNA, 16 nt, Human
ugauugcuuuuaaaau

SEQ ID NO: 3543291 - RNA, 19 nt, Human
ugauugcuuuuaaaauuuu

SEQ ID NO: 3543292 - RNA, 20 nt, Human
ugauugcuuuuaaaauuuua

SEQ ID NO: 3543293 - RNA, 22 nt, Human
ugauugcuuuuaaaauuuuaag

SEQ ID NO: 3543294 - RNA, 19 nt, Human
ugauuggaagggcuuuuca

SEQ ID NO: 3543295 - RNA, 22 nt, Human
ugauuggacaggcaugggugca

SEQ ID NO: 3543296 - RNA, 23 nt, Human
ugauuggacauuuucuucagaga

SEQ ID NO: 3543297 - RNA, 16 nt, Human
ugauuggaccaggcca

SEQ ID NO: 3543298 - RNA, 17 nt, Human
ugauuggaccaggccau

SEQ ID NO: 3543299 - RNA, 20 nt, Human
ugauuggcaggaguuggaag

SEQ ID NO: 3543300 - RNA, 12 nt, Human
ugauuggcucac

SEQ ID NO: 3543301 - RNA, 15 nt, Human
ugauugggaaaacau

SEQ ID NO: 3543302 - RNA, 17 nt, Human
ugauugggaaaacauuu

SEQ ID NO: 3543303 - RNA, 12 nt, Human
ugauugggaaua

SEQ ID NO: 3543304 - RNA, 17 nt, Human
ugauugggaauaaauau

SEQ ID NO: 3543305 - RNA, 20 nt, Human
ugauugggaauaaauaugcc

SEQ ID NO: 3543306 - RNA, 18 nt, Human
ugauugggcacaucauuu

SEQ ID NO: 3543307 - RNA, 20 nt, Human
ugauugggcacaucauuuca

SEQ ID NO: 3543308 - RNA, 23 nt, Human
ugauugggcacaucauuucaaga

SEQ ID NO: 3543309 - RNA, 17 nt, Human
ugauuggugcaacccuu

SEQ ID NO: 3543310 - RNA, 12 nt, Human
ugauuguaaaau

SEQ ID NO: 3543311 - RNA, 14 nt, Human
ugauuguaaaauag

SEQ ID NO: 3543312 - RNA, 23 nt, Human
ugauuguaacguugcugugggaa

SEQ ID NO: 3543313 - RNA, 23 nt, Human
ugauuguacagaaucauugcuua

SEQ ID NO: 3543314 - RNA, 21 nt, Human
ugauuguccuuuaaaaaagaa

SEQ ID NO: 3543315 - RNA, 13 nt, Human
ugauugucuuaau

SEQ ID NO: 3543316 - RNA, 16 nt, Human
ugauugugucucuugg

SEQ ID NO: 3543317 - RNA, 19 nt, Human
ugauuguucgggugugcaa

SEQ ID NO: 3543318 - RNA, 19 nt, Human
ugauuguuucucaaaucuu

SEQ ID NO: 3543319 - RNA, 17 nt, Human
ugauuuaaacacauuaa

SEQ ID NO: 3543320 - RNA, 18 nt, Human
ugauuuaaacacauuaaa

SEQ ID NO: 3543321 - RNA, 20 nt, Human
ugauuuaagugucucacuaa

SEQ ID NO: 3543322 - RNA, 14 nt, Human
ugauuuaauaaaau

SEQ ID NO: 3543323 - RNA, 15 nt, Human
ugauuuaauaaaaua

SEQ ID NO: 3543324 - RNA, 22 nt, Human
ugauuuaauaaaauaauucuaa

SEQ ID NO: 3543325 - RNA, 23 nt, Human
ugauuuaauaaaauaauucuaaa

SEQ ID NO: 3543326 - RNA, 20 nt, Human
ugauuuaauaacauaacaaa

SEQ ID NO: 3543327 - RNA, 14 nt, Human
ugauuuaauaugga

SEQ ID NO: 3543328 - RNA, 13 nt, Human
ugauuuaauguuu

SEQ ID NO: 3543329 - RNA, 16 nt, Human
ugauuuaauguuuuca

SEQ ID NO: 3543330 - RNA, 17 nt, Human
ugauuuacaguuucaaa

SEQ ID NO: 3543331 - RNA, 17 nt, Human
ugauuuagauugaguaa

SEQ ID NO: 3543332 - RNA, 20 nt, Human
ugauuuagauugaguaagau

SEQ ID NO: 3543333 - RNA, 17 nt, Human
ugauuuagcaggaagcu

SEQ ID NO: 3543334 - RNA, 20 nt, Human
ugauuuagcaggaagcugug

SEQ ID NO: 3543335 - RNA, 22 nt, Human
ugauuuaguguuuuuaccucug

SEQ ID NO: 3543336 - RNA, 20 nt, Human
ugauuuauaaaugccauuua

SEQ ID NO: 3543337 - RNA, 16 nt, Human
ugauuuauaguuugua

SEQ ID NO: 3543338 - RNA, 22 nt, Human
ugauuuauaguuuguacaugca

SEQ ID NO: 3543339 - RNA, 22 nt, Human
ugauuuaucugagucaacuccu

SEQ ID NO: 3543340 - RNA, 15 nt, Human
ugauuuauuaacuua

SEQ ID NO: 3543341 - RNA, 19 nt, Human
ugauuuauuaacuuaauaa

SEQ ID NO: 3543342 - RNA, 17 nt, Human
ugauuuauuugcuucuu

SEQ ID NO: 3543343 - RNA, 19 nt, Human
ugauuucacaaauauuaaa

SEQ ID NO: 3543344 - RNA, 19 nt, Human
ugauuucacaacagaucaa

SEQ ID NO: 3543345 - RNA, 14 nt, Human
ugauuucacuagaa

SEQ ID NO: 3543346 - RNA, 20 nt, Human
ugauuucagcaccuacagug

SEQ ID NO: 3543347 - RNA, 11 nt, Human
ugauuucagga

SEQ ID NO: 3543348 - RNA, 18 nt, Human
ugauuucaggauacucug

SEQ ID NO: 3543349 - RNA, 15 nt, Human
ugauuucaguucuag

SEQ ID NO: 3543350 - RNA, 18 nt, Human
ugauuucaguucuaggaa

SEQ ID NO: 3543351 - RNA, 17 nt, Human
ugauuucauuucaacug

SEQ ID NO: 3543352 - RNA, 16 nt, Human
ugauuuccccccuccg

SEQ ID NO: 3543353 - RNA, 20 nt, Human
ugauuuccccccuccgccuc

SEQ ID NO: 3543354 - RNA, 13 nt, Human
ugauuuccccucu

SEQ ID NO: 3543355 - RNA, 23 nt, Human
ugauuuccccuuuugcauucucc

SEQ ID NO: 3543356 - RNA, 17 nt, Human
ugauuucccguggcccc

SEQ ID NO: 3543357 - RNA, 14 nt, Human
ugauuuccuguguc

SEQ ID NO: 3543358 - RNA, 13 nt, Human
ugauuucuagaac

SEQ ID NO: 3543359 - RNA, 11 nt, Human
ugauuucuagg

SEQ ID NO: 3543360 - RNA, 19 nt, Human
ugauuucuucuguuuucug

SEQ ID NO: 3543361 - RNA, 23 nt, Human
ugauuucuuuucaccauucguac

SEQ ID NO: 3543362 - RNA, 16 nt, Human
ugcuagugagcugggc

SEQ ID NO: 3543363 - RNA, 19 nt, Human
ugcuagugagcugggcaug

SEQ ID NO: 3543364 - RNA, 16 nt, Human
ugcuaguggugggcag

SEQ ID NO: 3543365 - RNA, 11 nt, Human
ugcuaguguga

SEQ ID NO: 3543366 - RNA, 20 nt, Human
ugcuauaaagcuagaugcuu

SEQ ID NO: 3543367 - RNA, 23 nt, Human
ugcuauaggcuggagaagcucac

SEQ ID NO: 3543368 - RNA, 15 nt, Human
ugcuauaguauuuga

SEQ ID NO: 3543369 - RNA, 21 nt, Human
ugcuauauauaaaacggugcu

SEQ ID NO: 3543370 - RNA, 12 nt, Human
ugcuauauauau

SEQ ID NO: 3543371 - RNA, 16 nt, Human
ugcuauauauauaaau

SEQ ID NO: 3543372 - RNA, 17 nt, Human
ugcuauauauauaaaua

SEQ ID NO: 3543373 - RNA, 18 nt, Human
ugcuauauuuucaugacu

SEQ ID NO: 3543374 - RNA, 15 nt, Human
ugcuauccauuucuc

SEQ ID NO: 3543375 - RNA, 19 nt, Human
ugcuauccccaucucccug

SEQ ID NO: 3543376 - RNA, 22 nt, Human
ugcuaucgcaccacuguguauu

SEQ ID NO: 3543377 - RNA, 13 nt, Human
ugcuaucuccccc

SEQ ID NO: 3543378 - RNA, 14 nt, Human
ugcuaucuccccca

SEQ ID NO: 3543379 - RNA, 16 nt, Human
ugcuaucucugugugc

SEQ ID NO: 3543380 - RNA, 20 nt, Human
ugcuaucuggaggccuucca

SEQ ID NO: 3543381 - RNA, 19 nt, Human
ugcuaugagcuggggaugu

SEQ ID NO: 3543382 - RNA, 20 nt, Human
ugcuaugagcuggggauguc

SEQ ID NO: 3543383 - RNA, 22 nt, Human
ugcuaugagcuggggaugucuc

SEQ ID NO: 3543384 - RNA, 16 nt, Human
ugcuauggauggcuuc

SEQ ID NO: 3543385 - RNA, 12 nt, Human
ugcuauggggac

SEQ ID NO: 3543386 - RNA, 18 nt, Human
ugcuauggggagaaaaga

SEQ ID NO: 3543387 - RNA, 14 nt, Human
ugcuaugguuuucu

SEQ ID NO: 3543388 - RNA, 15 nt, Human
ugcuaugucauuuca

SEQ ID NO: 3543389 - RNA, 16 nt, Human
ugcuaugucauuucau

SEQ ID NO: 3543390 - RNA, 16 nt, Human
ugcuauguuacuauuu

SEQ ID NO: 3543391 - RNA, 19 nt, Human
ugcuauguuacuauuuucu

SEQ ID NO: 3543392 - RNA, 12 nt, Human
ugcuauuaaagu

SEQ ID NO: 3543393 - RNA, 13 nt, Human
ugcuauuaauauu

SEQ ID NO: 3543394 - RNA, 13 nt, Human
ugcuauucugucc

SEQ ID NO: 3543395 - RNA, 15 nt, Human
ugcuauucugucccu

SEQ ID NO: 3543396 - RNA, 20 nt, Human
ugcuauucugucccuaggug

SEQ ID NO: 3543397 - RNA, 21 nt, Human
ugcuauugacaauaaaauauu

SEQ ID NO: 3543398 - RNA, 16 nt, Human
ugcuauuguaaauaug

SEQ ID NO: 3543399 - RNA, 18 nt, Human
ugcuauuguagagccaga

SEQ ID NO: 3543400 - RNA, 20 nt, Human
ugcuauuguuacucuuacga

SEQ ID NO: 3543401 - RNA, 13 nt, Human
ugcuauuucuaua

SEQ ID NO: 3543402 - RNA, 20 nt, Human
ugcuauuucuauauuuucau

SEQ ID NO: 3543403 - RNA, 21 nt, Human
ugcuauuucuauauuuucauu

SEQ ID NO: 3543404 - RNA, 17 nt, Human
ugcuauuugaacaagug

SEQ ID NO: 3543405 - RNA, 19 nt, Human
ugcuauuuuacugucuuaa

SEQ ID NO: 3543406 - RNA, 19 nt, Human
ugcuauuuuucauccuaaa

SEQ ID NO: 3543407 - RNA, 13 nt, Human
ugcuauuuuugua

SEQ ID NO: 3543408 - RNA, 15 nt, Human
ugcuauuuuuguaaa

SEQ ID NO: 3543409 - RNA, 17 nt, Human
ugcuauuuuuguaaagu

SEQ ID NO: 3543410 - RNA, 15 nt, Human
ugcucaaaaaaugag

SEQ ID NO: 3543411 - RNA, 15 nt, Human
ugcucaaaaaucugu

SEQ ID NO: 3543412 - RNA, 13 nt, Human
ugcucaaaaugca

SEQ ID NO: 3543413 - RNA, 15 nt, Human
ugcucaaaaugcaaa

SEQ ID NO: 3543414 - RNA, 18 nt, Human
ugcucaaaauuugaagaa

SEQ ID NO: 3543415 - RNA, 14 nt, Human
ugcucaaagaaauc

SEQ ID NO: 3543416 - RNA, 21 nt, Human
ugcucaaaucuauucagacaa

SEQ ID NO: 3543417 - RNA, 16 nt, Human
ugcucaaggccagcuu

SEQ ID NO: 3543418 - RNA, 18 nt, Human
ugcucaaugacucucugg

SEQ ID NO: 3543419 - RNA, 15 nt, Human
ugcucacaccccauu

SEQ ID NO: 3543420 - RNA, 13 nt, Human
ugcucacagucuc

SEQ ID NO: 3543421 - RNA, 16 nt, Human
ugcucacauaucuguc

SEQ ID NO: 3543422 - RNA, 17 nt, Human
ugcucacauaucuguca

SEQ ID NO: 3543423 - RNA, 19 nt, Human
ugcucacccagugcccucu

SEQ ID NO: 3543424 - RNA, 22 nt, Human
ugcucacguuaccuugacacau

SEQ ID NO: 3543425 - RNA, 15 nt, Human
ugcaaaauuuccagu

SEQ ID NO: 3543426 - RNA, 16 nt, Human
ugcaaaauuuccagua

SEQ ID NO: 3543427 - RNA, 19 nt, Human
ugcaaaauuuuuuuaaucu

SEQ ID NO: 3543428 - RNA, 18 nt, Human
ugcaaacagaacaggguc

SEQ ID NO: 3543429 - RNA, 19 nt, Human
ugcaaacagaacaggguca

SEQ ID NO: 3543430 - RNA, 20 nt, Human
ugcaaacauaacaaaaucac

SEQ ID NO: 3543431 - RNA, 22 nt, Human
ugcaaacaugggguuggcuggg

SEQ ID NO: 3543432 - RNA, 13 nt, Human
ugcaaaccaucau

SEQ ID NO: 3543433 - RNA, 14 nt, Human
ugcaaacgcugccu

SEQ ID NO: 3543434 - RNA, 21 nt, Human
ugcaaacgcugccugccggua

SEQ ID NO: 3543435 - RNA, 22 nt, Human
ugcaaacugggaaccccuuucc

SEQ ID NO: 3543436 - RNA, 23 nt, Human
ugcaaacugggaaccccuuuccc

SEQ ID NO: 3543437 - RNA, 19 nt, Human
ugcaaacugggcuggaaga

SEQ ID NO: 3543438 - RNA, 17 nt, Human
ugcaaacuuuauuuuca

SEQ ID NO: 3543439 - RNA, 12 nt, Human
ugcaaagaaaau

SEQ ID NO: 3543440 - RNA, 19 nt, Human
ugcaaagaggcaagaggcu

SEQ ID NO: 3543441 - RNA, 23 nt, Human
ugcaaagaugaaggucuguuuug

SEQ ID NO: 3543442 - RNA, 18 nt, Human
ugcaaagcacugacuucu

SEQ ID NO: 3543443 - RNA, 13 nt, Human
ugcaaaggaaaua

SEQ ID NO: 3543444 - RNA, 23 nt, Human
ugcaaaguacaauguguuuuucu

SEQ ID NO: 3543445 - RNA, 15 nt, Human
ugcaaaguacuguaa

SEQ ID NO: 3543446 - RNA, 21 nt, Human
ugcaaaguauaaauuugugua

SEQ ID NO: 3543447 - RNA, 16 nt, Human
ugcaaaguauuguaaa

SEQ ID NO: 3543448 - RNA, 17 nt, Human
ugcaaaguauuguaaau

SEQ ID NO: 3543449 - RNA, 17 nt, Human
ugcaaagucaggaauca

SEQ ID NO: 3543450 - RNA, 18 nt, Human
ugcaaagucaggaaucau

SEQ ID NO: 3543451 - RNA, 20 nt, Human
ugcaaagucaugcaaaggcu

SEQ ID NO: 3543452 - RNA, 21 nt, Human
ugcaaagucaugcaaaggcug

SEQ ID NO: 3543453 - RNA, 21 nt, Human
ugcaaaguguuuuguaccagu

SEQ ID NO: 3543454 - RNA, 22 nt, Human
ugcaaaguguuuuguaccagug

SEQ ID NO: 3543455 - RNA, 13 nt, Human
ugcaaaguucugu

SEQ ID NO: 3543456 - RNA, 23 nt, Human
ugcaaauaaauauccuuuaauug

SEQ ID NO: 3543457 - RNA, 23 nt, Human
ugcaaauaaguguauuuugaaau

SEQ ID NO: 3543458 - RNA, 15 nt, Human
ugcaaauagaaaaca

SEQ ID NO: 3543459 - RNA, 17 nt, Human
ugcaaauagaaaacagg

SEQ ID NO: 3543460 - RNA, 21 nt, Human
ugcaaauauuuuuuuguagau

SEQ ID NO: 3543461 - RNA, 10 nt, Human
ugcaaauccu

SEQ ID NO: 3543462 - RNA, 17 nt, Human
ugcaaauccuaugugau

SEQ ID NO: 3543463 - RNA, 14 nt, Human
ugcaaaucuugaaa

SEQ ID NO: 3543464 - RNA, 18 nt, Human
ugcaaaugagcucugaaa

SEQ ID NO: 3543465 - RNA, 21 nt, Human
ugcaaaugagcucugaaaucu

SEQ ID NO: 3543466 - RNA, 21 nt, Human
ugcaaaugcuaugagaugcau

SEQ ID NO: 3543467 - RNA, 15 nt, Human
ugcaaaugcuguauu

SEQ ID NO: 3543468 - RNA, 24 nt, Human
ugcaaauggugguuguuucuucca

SEQ ID NO: 3543469 - RNA, 16 nt, Human
ugcaacaaaauguaga

SEQ ID NO: 3543470 - RNA, 13 nt, Human
ugcaacaacaugu

SEQ ID NO: 3543471 - RNA, 15 nt, Human
ugcaacaacauguau

SEQ ID NO: 3543472 - RNA, 15 nt, Human
ugcaacacacagaca

SEQ ID NO: 3543473 - RNA, 13 nt, Human
ugcaacagcacug

SEQ ID NO: 3543474 - RNA, 14 nt, Human
ugcaacagcacugg

SEQ ID NO: 3543475 - RNA, 15 nt, Human
ugcaacaggcacuca

SEQ ID NO: 3543476 - RNA, 15 nt, Human
ugcaacauuuacagu

SEQ ID NO: 3543477 - RNA, 11 nt, Human
ugcaaccacug

SEQ ID NO: 3543478 - RNA, 13 nt, Human
ugcaaccacugca

SEQ ID NO: 3543479 - RNA, 20 nt, Human
ugcaaccagggagcugcagg

SEQ ID NO: 3543480 - RNA, 16 nt, Human
ugcaaccauuugaaac

SEQ ID NO: 3543481 - RNA, 21 nt, Human
ugcaacccaaggacugaggga

SEQ ID NO: 3543482 - RNA, 18 nt, Human
ugcaaccuccaccuccug

SEQ ID NO: 3543483 - RNA, 20 nt, Human
ugcaaccuccgccucuuggg

SEQ ID NO: 3543484 - RNA, 14 nt, Human
ugcaaccucgcuga

SEQ ID NO: 3543485 - RNA, 19 nt, Human
ugcaaccucgcuggacucu

SEQ ID NO: 3543486 - RNA, 12 nt, Human
ugcaaccucugc

SEQ ID NO: 3543487 - RNA, 21 nt, Human
ugcaaccucugccuccugggu

SEQ ID NO: 3543488 - RNA, 20 nt, Human
ugcaaccucugcuucccagg

SEQ ID NO: 3543489 - RNA, 19 nt, Human
ugcaaccugauugugucuc

SEQ ID NO: 3543490 - RNA, 20 nt, Human
ugcaaccugauugugucucu

SEQ ID NO: 3543491 - RNA, 18 nt, Human
ugcaaccuucgccaccug

SEQ ID NO: 3543492 - RNA, 21 nt, Human
ugcaaccuucgccaccugggu

SEQ ID NO: 3543493 - RNA, 19 nt, Human
ugcaaccuuguuuauuaaa

SEQ ID NO: 3543494 - RNA, 22 nt, Human
ugcaacggucuccugacuggug

SEQ ID NO: 3543495 - RNA, 22 nt, Human
ugcaacucugaaggguaauuau

SEQ ID NO: 3543496 - RNA, 15 nt, Human
ugcaacuucauguca

SEQ ID NO: 3543497 - RNA, 22 nt, Human
ugcaacuucaugucaacuucug

SEQ ID NO: 3543498 - RNA, 18 nt, Human
ugcaacuuguaaaugugg

SEQ ID NO: 3543499 - RNA, 18 nt, Human
ugcaacuuuguauaaaag

SEQ ID NO: 3543500 - RNA, 21 nt, Human
ugcaagaacucaucacugugg

SEQ ID NO: 3543501 - RNA, 22 nt, Human
ugcaagaaguggggcagcagca

SEQ ID NO: 3543502 - RNA, 19 nt, Human
ugcaagagugauugcagcu

SEQ ID NO: 3543503 - RNA, 15 nt, Human
ugcaagaugugaauu

SEQ ID NO: 3543504 - RNA, 13 nt, Human
ugcaagcagagga

SEQ ID NO: 3543505 - RNA, 19 nt, Human
ugcaagcaggacuuugagg

SEQ ID NO: 3543506 - RNA, 12 nt, Human
ugcuccuuggcu

SEQ ID NO: 3543507 - RNA, 15 nt, Human
ugcuccuuggcuuac

SEQ ID NO: 3543508 - RNA, 14 nt, Human
ugcuccuugggccc

SEQ ID NO: 3543509 - RNA, 15 nt, Human
ugcuccuugggcccu

SEQ ID NO: 3543510 - RNA, 16 nt, Human
ugcuccuugggcccuu

SEQ ID NO: 3543511 - RNA, 14 nt, Human
ugcuccuuuccccu

SEQ ID NO: 3543512 - RNA, 18 nt, Human
ugcuccuuucuuguuuua

SEQ ID NO: 3543513 - RNA, 14 nt, Human
ugcucgccccagca

SEQ ID NO: 3543514 - RNA, 15 nt, Human
ugcucggccgucuuc

SEQ ID NO: 3543515 - RNA, 15 nt, Human
ugcucgggcccaggc

SEQ ID NO: 3543516 - RNA, 16 nt, Human
ugcucgggcccaggcc

SEQ ID NO: 3543517 - RNA, 12 nt, Human
ugcucuaaaaua

SEQ ID NO: 3543518 - RNA, 13 nt, Human
ugcucuaaaauau

SEQ ID NO: 3543519 - RNA, 19 nt, Human
ugcucuaaaauauuuauga

SEQ ID NO: 3543520 - RNA, 20 nt, Human
ugcucuaaaauauuuaugaa

SEQ ID NO: 3543521 - RNA, 18 nt, Human
ugcucuaagcacacggag

SEQ ID NO: 3543522 - RNA, 19 nt, Human
ugcucuagaugagcugggc

SEQ ID NO: 3543523 - RNA, 19 nt, Human
ugcucuaggaagacauuuu

SEQ ID NO: 3543524 - RNA, 14 nt, Human
ugcucuaucuugcu

SEQ ID NO: 3543525 - RNA, 21 nt, Human
ugcucuaucuugcucuguaau

SEQ ID NO: 3543526 - RNA, 12 nt, Human
ugcucuaugcuu

SEQ ID NO: 3543527 - RNA, 21 nt, Human
ugcucuaugcuuuccaaaccu

SEQ ID NO: 3543528 - RNA, 20 nt, Human
ugcucucaaaccccugaccu

SEQ ID NO: 3543529 - RNA, 22 nt, Human
ugcucucaccuugguuccuggg

SEQ ID NO: 3543530 - RNA, 14 nt, Human
ugcucucacuguuu

SEQ ID NO: 3543531 - RNA, 18 nt, Human
ugcucuccaagucucagu

SEQ ID NO: 3543532 - RNA, 20 nt, Human
ugcucuccagccugggaggc

SEQ ID NO: 3543533 - RNA, 12 nt, Human
ugcucuccccug

SEQ ID NO: 3543534 - RNA, 15 nt, Human
ugcucuccccugccc

SEQ ID NO: 3543535 - RNA, 17 nt, Human
ugcucuccccugcccug

SEQ ID NO: 3543536 - RNA, 20 nt, Human
ugcucuccccugcccugcug

SEQ ID NO: 3543537 - RNA, 23 nt, Human
ugcucuccgaccagacaccuuga

SEQ ID NO: 3543538 - RNA, 22 nt, Human
ugcucuccucuugccacugccu

SEQ ID NO: 3543539 - RNA, 23 nt, Human
ugcucuccuuccuggagcccaga

SEQ ID NO: 3543540 - RNA, 19 nt, Human
ugcucucgcaccuuuccaa

SEQ ID NO: 3543541 - RNA, 22 nt, Human
ugcucucuacccagcccaucuu

SEQ ID NO: 3543542 - RNA, 13 nt, Human
ugcucucugcagc

SEQ ID NO: 3543543 - RNA, 15 nt, Human
ugcucucugcagcca

SEQ ID NO: 3543544 - RNA, 21 nt, Human
ugcucucugcagccagcccag

SEQ ID NO: 3543545 - RNA, 22 nt, Human
ugcucugaauuaguccuugcuu

SEQ ID NO: 3543546 - RNA, 20 nt, Human
ugcucugagaauuguugaga

SEQ ID NO: 3543547 - RNA, 17 nt, Human
ugcucugaggcuuccag

SEQ ID NO: 3543548 - RNA, 22 nt, Human
ugcucugaucauccacugugcc

SEQ ID NO: 3543549 - RNA, 13 nt, Human
ugcucugaucccu

SEQ ID NO: 3543550 - RNA, 16 nt, Human
ugcucugaugcaucag

SEQ ID NO: 3543551 - RNA, 19 nt, Human
ugcucugcaggcaccuuag

SEQ ID NO: 3543552 - RNA, 15 nt, Human
ugcucugcauguuac

SEQ ID NO: 3543553 - RNA, 11 nt, Human
ugcucugccca

SEQ ID NO: 3543554 - RNA, 12 nt, Human
ugcucugcccag

SEQ ID NO: 3543555 - RNA, 14 nt, Human
ugcucugcccagag

SEQ ID NO: 3543556 - RNA, 22 nt, Human
ugcucugcccagagcuggguga

SEQ ID NO: 3543557 - RNA, 14 nt, Human
ugcucugccccagc

SEQ ID NO: 3543558 - RNA, 15 nt, Human
ugcucugccccagcu

SEQ ID NO: 3543559 - RNA, 17 nt, Human
ugcucugccccagcuug

SEQ ID NO: 3543560 - RNA, 23 nt, Human
ugcucugcgugucaccugugcuu

SEQ ID NO: 3543561 - RNA, 18 nt, Human
ugcucugcuggucuucaa

SEQ ID NO: 3543562 - RNA, 16 nt, Human
ugcucugcuugacaac

SEQ ID NO: 3543563 - RNA, 23 nt, Human
ugcucuggaaaaugugacccaga

SEQ ID NO: 3543564 - RNA, 19 nt, Human
ugcucugugcccacccucc

SEQ ID NO: 3543565 - RNA, 19 nt, Human
ugcucuuacuacacugagg

SEQ ID NO: 3543566 - RNA, 14 nt, Human
ugcucuucaagaaa

SEQ ID NO: 3543567 - RNA, 13 nt, Human
ugcucuucagugg

SEQ ID NO: 3543568 - RNA, 17 nt, Human
ugcucuucaucccauuc

SEQ ID NO: 3543569 - RNA, 14 nt, Human
ugcucuuggcugga

SEQ ID NO: 3543570 - RNA, 19 nt, Human
ugcucuuggcuggacccag

SEQ ID NO: 3543571 - RNA, 17 nt, Human
ugcucuugggcaauauu

SEQ ID NO: 3543572 - RNA, 21 nt, Human
ugcucuugucccacgugucuu

SEQ ID NO: 3543573 - RNA, 19 nt, Human
ugcucuuguccuagcuugg

SEQ ID NO: 3543574 - RNA, 18 nt, Human
ugcucuuguuuuuauuaa

SEQ ID NO: 3543575 - RNA, 18 nt, Human
ugcucuuucaucucugcu

SEQ ID NO: 3543576 - RNA, 16 nt, Human
ugcucuuucccaccca

SEQ ID NO: 3543577 - RNA, 16 nt, Human
ugcucuuucuacucug

SEQ ID NO: 3543578 - RNA, 15 nt, Human
ugcucuuucucugcc

SEQ ID NO: 3543579 - RNA, 21 nt, Human
ugcucuuucucugccagugac

SEQ ID NO: 3543580 - RNA, 22 nt, Human
ugcucuuucucugccagugaca

SEQ ID NO: 3543581 - RNA, 23 nt, Human
ugcucuuuggccugaugaccaau

SEQ ID NO: 3543582 - RNA, 14 nt, Human
ugcucuuuguuuug

SEQ ID NO: 3543583 - RNA, 15 nt, Human
ugcucuuuguuuugu

SEQ ID NO: 3543584 - RNA, 18 nt, Human
ugcucuuuguuuuguguc

SEQ ID NO: 3543585 - RNA, 16 nt, Human
ugcaauuaaagugaua

SEQ ID NO: 3543586 - RNA, 19 nt, Human
ugcaauuagccucauaguu

SEQ ID NO: 3543587 - RNA, 14 nt, Human
ugcaauucaaaagu

SEQ ID NO: 3543588 - RNA, 17 nt, Human
ugcaauucaaaaguucc

SEQ ID NO: 3543589 - RNA, 18 nt, Human
ugcaauucaaaaguucca

SEQ ID NO: 3543590 - RNA, 19 nt, Human
ugcaauucaaaaguuccaa

SEQ ID NO: 3543591 - RNA, 23 nt, Human
ugcaauuggcaccgaagcccaga

SEQ ID NO: 3543592 - RNA, 22 nt, Human
ugcaauuguaggggugugugug

SEQ ID NO: 3543593 - RNA, 20 nt, Human
ugcaauuucaagguucuaac

SEQ ID NO: 3543594 - RNA, 14 nt, Human
ugcaauuucuacua

SEQ ID NO: 3543595 - RNA, 19 nt, Human
ugcaauuugggagauauau

SEQ ID NO: 3543596 - RNA, 18 nt, Human
ugcaauuuuaacacacau

SEQ ID NO: 3543597 - RNA, 20 nt, Human
ugcaauuuuaauugauuauu

SEQ ID NO: 3543598 - RNA, 22 nt, Human
ugcaauuuuauaaggacuuccu

SEQ ID NO: 3543599 - RNA, 23 nt, Human
ugcaauuuucuaagcaauuucuu

SEQ ID NO: 3543600 - RNA, 13 nt, Human
ugcacaaaaugua

SEQ ID NO: 3543601 - RNA, 21 nt, Human
ugcacaaaauucgaccugauu

SEQ ID NO: 3543602 - RNA, 15 nt, Human
ugcacaaacagaggc

SEQ ID NO: 3543603 - RNA, 15 nt, Human
ugcacaaagcccuuc

SEQ ID NO: 3543604 - RNA, 14 nt, Human
ugcacaaaguggca

SEQ ID NO: 3543605 - RNA, 21 nt, Human
ugcacaaauacggauccugca

SEQ ID NO: 3543606 - RNA, 15 nt, Human
ugcacaagaauggau

SEQ ID NO: 3543607 - RNA, 23 nt, Human
ugcacaagaauggaucacaagau

SEQ ID NO: 3543608 - RNA, 13 nt, Human
ugcacaagccagg

SEQ ID NO: 3543609 - RNA, 15 nt, Human
ugcacaaggauugaa

SEQ ID NO: 3543610 - RNA, 13 nt, Human
ugcacaaguaggg

SEQ ID NO: 3543611 - RNA, 21 nt, Human
ugcacaauaaaaauguuuaac

SEQ ID NO: 3543612 - RNA, 21 nt, Human
ugcacaauaacuccucccagg

SEQ ID NO: 3543613 - RNA, 22 nt, Human
ugcacaauaacuccucccaggg

SEQ ID NO: 3543614 - RNA, 14 nt, Human
ugcacaaugucuug

SEQ ID NO: 3543615 - RNA, 21 nt, Human
ugcacaauuccaugacaauau

SEQ ID NO: 3543616 - RNA, 22 nt, Human
ugcacacacacacacaugcaca

SEQ ID NO: 3543617 - RNA, 13 nt, Human
ugcacacacauau

SEQ ID NO: 3543618 - RNA, 15 nt, Human
ugcacacacauauau

SEQ ID NO: 3543619 - RNA, 17 nt, Human
ugcacacaccagagccc

SEQ ID NO: 3543620 - RNA, 19 nt, Human
ugcacacagaaauauauau

SEQ ID NO: 3543621 - RNA, 23 nt, Human
ugcacacagaaauauauauacau

SEQ ID NO: 3543622 - RNA, 16 nt, Human
ugcacacaucaucugu

SEQ ID NO: 3543623 - RNA, 17 nt, Human
ugcacacaucaucugua

SEQ ID NO: 3543624 - RNA, 21 nt, Human
ugcacacaucaucuguaagcu

SEQ ID NO: 3543625 - RNA, 18 nt, Human
ugcacacccacucagcuc

SEQ ID NO: 3543626 - RNA, 23 nt, Human
ugcacacgagcagacacccuugg

SEQ ID NO: 3543627 - RNA, 19 nt, Human
ugcacacuagccucuccag

SEQ ID NO: 3543628 - RNA, 21 nt, Human
ugcacacuguccuauuauauu

SEQ ID NO: 3543629 - RNA, 14 nt, Human
ugcacacuuugcca

SEQ ID NO: 3543630 - RNA, 13 nt, Human
ugcacacuuuggc

SEQ ID NO: 3543631 - RNA, 17 nt, Human
ugcacacuuuggcccag

SEQ ID NO: 3543632 - RNA, 13 nt, Human
ugcacacuuuggu

SEQ ID NO: 3543633 - RNA, 22 nt, Human
ugcacagaaguccuguaugucu

SEQ ID NO: 3543634 - RNA, 12 nt, Human
ugcacagagaag

SEQ ID NO: 3543635 - RNA, 17 nt, Human
ugcacagagaagcuggg

SEQ ID NO: 3543636 - RNA, 14 nt, Human
ugcacagagcucuc

SEQ ID NO: 3543637 - RNA, 16 nt, Human
ugcacagagcucucca

SEQ ID NO: 3543638 - RNA, 18 nt, Human
ugcacagagcucuccagc

SEQ ID NO: 3543639 - RNA, 23 nt, Human
ugcacagaguuguuacauuuuua

SEQ ID NO: 3543640 - RNA, 18 nt, Human
ugcacagcacaaauuagu

SEQ ID NO: 3543641 - RNA, 22 nt, Human
ugcacagcaggcugccagugcc

SEQ ID NO: 3543642 - RNA, 14 nt, Human
ugcacagcaucuca

SEQ ID NO: 3543643 - RNA, 18 nt, Human
ugcacagcuaacauggaa

SEQ ID NO: 3543644 - RNA, 23 nt, Human
ugcacagcuaacauggaaguacu

SEQ ID NO: 3543645 - RNA, 11 nt, Human
ugcacagcugu

SEQ ID NO: 3543646 - RNA, 19 nt, Human
ugcacagcuguaguacccc

SEQ ID NO: 3543647 - RNA, 12 nt, Human
ugcacagcuguc

SEQ ID NO: 3543648 - RNA, 14 nt, Human
ugcacagggagacg

SEQ ID NO: 3543649 - RNA, 16 nt, Human
ugcacagggcagcugg

SEQ ID NO: 3543650 - RNA, 13 nt, Human
gucucgagcgccc

SEQ ID NO: 3543651 - RNA, 18 nt, Human
gucucgcucugucaccca

SEQ ID NO: 3543652 - RNA, 18 nt, Human
gucucgcugaugcugggc

SEQ ID NO: 3543653 - RNA, 19 nt, Human
gucucgcugaugcugggcu

SEQ ID NO: 3543654 - RNA, 19 nt, Human
gucucggaaccugugagcu

SEQ ID NO: 3543655 - RNA, 20 nt, Human
gucucggaucaggcucccag

SEQ ID NO: 3543656 - RNA, 15 nt, Human
gucucggccuucaca

SEQ ID NO: 3543657 - RNA, 14 nt, Human
gucucuaaagcacu

SEQ ID NO: 3543658 - RNA, 18 nt, Human
gucucuagagcagggauu

SEQ ID NO: 3543659 - RNA, 14 nt, Human
gucucuagccacuu

SEQ ID NO: 3543660 - RNA, 15 nt, Human
gucucuaggcugggg

SEQ ID NO: 3543661 - RNA, 18 nt, Human
gucucuagugcugugaaa

SEQ ID NO: 3543662 - RNA, 19 nt, Human
gucucuauuuaaauucuuu

SEQ ID NO: 3543663 - RNA, 12 nt, Human
gucucucacaga

SEQ ID NO: 3543664 - RNA, 23 nt, Human
gucucucacagacaggaccccug

SEQ ID NO: 3543665 - RNA, 23 nt, Human
gucucucuauuaccacugaagau

SEQ ID NO: 3543666 - RNA, 13 nt, Human
gucucucucccau

SEQ ID NO: 3543667 - RNA, 16 nt, Human
gucucucucccaugga

SEQ ID NO: 3543668 - RNA, 18 nt, Human
gucucucugggccuuagg

SEQ ID NO: 3543669 - RNA, 20 nt, Human
gucucucuucagacucucag

SEQ ID NO: 3543670 - RNA, 18 nt, Human
gucucucuucucagagug

SEQ ID NO: 3543671 - RNA, 23 nt, Human
gucucucuucucuccagcugacu

SEQ ID NO: 3543672 - RNA, 20 nt, Human
gucucucuuuggacucuccc

SEQ ID NO: 3543673 - RNA, 21 nt, Human
gucucugaagugaaacugcuu

SEQ ID NO: 3543674 - RNA, 14 nt, Human
gucucugagggcuu

SEQ ID NO: 3543675 - RNA, 19 nt, Human
gucucugaggggcuaccag

SEQ ID NO: 3543676 - RNA, 15 nt, Human
gucucugaugcagcu

SEQ ID NO: 3543677 - RNA, 19 nt, Human
gucucugaugcagcuuaua

SEQ ID NO: 3543678 - RNA, 17 nt, Human
gucucugccggcucuuu

SEQ ID NO: 3543679 - RNA, 18 nt, Human
gucucugccucccucacc

SEQ ID NO: 3543680 - RNA, 16 nt, Human
gucucugccuugccuu

SEQ ID NO: 3543681 - RNA, 15 nt, Human
gucucugcucgcccu

SEQ ID NO: 3543682 - RNA, 23 nt, Human
gucucugcucgcccuccuuucug

SEQ ID NO: 3543683 - RNA, 12 nt, Human
gucucugcugaa

SEQ ID NO: 3543684 - RNA, 22 nt, Human
gucucugcugcauuugugucau

SEQ ID NO: 3543685 - RNA, 12 nt, Human
gucucugcugcc

SEQ ID NO: 3543686 - RNA, 13 nt, Human
gucucugcuggcc

SEQ ID NO: 3543687 - RNA, 13 nt, Human
gucucuggccugu

SEQ ID NO: 3543688 - RNA, 20 nt, Human
gucucuguugacuggcugug

SEQ ID NO: 3543689 - RNA, 22 nt, Human
gucucuuauggauguccccagc

SEQ ID NO: 3543690 - RNA, 13 nt, Human
gucucuuccccuc

SEQ ID NO: 3543691 - RNA, 17 nt, Human
gucucuucuccacugga

SEQ ID NO: 3543692 - RNA, 18 nt, Human
gucucuucuccacuggau

SEQ ID NO: 3543693 - RNA, 14 nt, Human
gucucuucucccag

SEQ ID NO: 3543694 - RNA, 20 nt, Human
gucucuucugaauaaagcaa

SEQ ID NO: 3543695 - RNA, 22 nt, Human
gucucuucugaauaaagcaauu

SEQ ID NO: 3543696 - RNA, 22 nt, Human
gucucuucugagcuauuucauc

SEQ ID NO: 3543697 - RNA, 20 nt, Human
gucucuucuuggggcccagu

SEQ ID NO: 3543698 - RNA, 21 nt, Human
gucucuucuuggggcccagug

SEQ ID NO: 3543699 - RNA, 13 nt, Human
gucucuugaggga

SEQ ID NO: 3543700 - RNA, 13 nt, Human
gucucuugguccu

SEQ ID NO: 3543701 - RNA, 19 nt, Human
gucucuuuaaugucacagg

SEQ ID NO: 3543702 - RNA, 22 nt, Human
gucucuuuaaugucacaggcag

SEQ ID NO: 3543703 - RNA, 14 nt, Human
gucucuuuuacccu

SEQ ID NO: 3543704 - RNA, 20 nt, Human
gucucuuuuacccuggcccc

SEQ ID NO: 3543705 - RNA, 15 nt, Human
gucucuuuuuuacaa

SEQ ID NO: 3543706 - RNA, 16 nt, Human
gucucuuuuuuacaaa

SEQ ID NO: 3543707 - RNA, 13 nt, Human
gucugaaauuuuu

SEQ ID NO: 3543708 - RNA, 11 nt, Human
gucugaacuuu

SEQ ID NO: 3543709 - RNA, 16 nt, Human
gucugaacuuugggaa

SEQ ID NO: 3543710 - RNA, 14 nt, Human
gucugaagcagaug

SEQ ID NO: 3543711 - RNA, 19 nt, Human
gucugaaggacacuuccug

SEQ ID NO: 3543712 - RNA, 19 nt, Human
gucugaaggcuggguucug

SEQ ID NO: 3543713 - RNA, 19 nt, Human
gucugaagucacugcacag

SEQ ID NO: 3543714 - RNA, 17 nt, Human
gucugaauguucugaca

SEQ ID NO: 3543715 - RNA, 13 nt, Human
gucugacaggcaa

SEQ ID NO: 3543716 - RNA, 20 nt, Human
gucugacaggcaaugcuggc

SEQ ID NO: 3543717 - RNA, 24 nt, Human
gucugacaucagagguaucuuacu

SEQ ID NO: 3543718 - RNA, 13 nt, Human
gucugacccacug

SEQ ID NO: 3543719 - RNA, 14 nt, Human
gucugacugugugu

SEQ ID NO: 3543720 - RNA, 21 nt, Human
gucugagacucacaggaagga

SEQ ID NO: 3543721 - RNA, 18 nt, Human
gucugagagaggccauuc

SEQ ID NO: 3543722 - RNA, 21 nt, Human
gucugagccacagcagcauuu

SEQ ID NO: 3543723 - RNA, 19 nt, Human
gucugaggaauccagaccc

SEQ ID NO: 3543724 - RNA, 17 nt, Human
gucugagguugggagag

SEQ ID NO: 3543725 - RNA, 20 nt, Human
gucugaucgugacgcugaau

SEQ ID NO: 3543726 - RNA, 13 nt, Human
gucugaucugugc

SEQ ID NO: 3543727 - RNA, 21 nt, Human
gucugaucugugcuuuccagc

SEQ ID NO: 3543728 - RNA, 18 nt, Human
gucugauggaucccgaag

SEQ ID NO: 3543729 - RNA, 18 nt, Human
gucugauucccaagcucu

SEQ ID NO: 3543730 - RNA, 19 nt, Human
gucugauucccaagcucug

SEQ ID NO: 3543731 - RNA, 20 nt, Human
gucugauucccaagcucugc

SEQ ID NO: 3543732 - RNA, 20 nt, Human
gucugauugguuuuaauuga

SEQ ID NO: 3543733 - RNA, 22 nt, Human
gucugcaacuuuaagcagcucu

SEQ ID NO: 3543734 - RNA, 22 nt, Human
gucugcaagauucugaaacauu

SEQ ID NO: 3543735 - RNA, 15 nt, Human
gucugcaagucagag

SEQ ID NO: 3543736 - RNA, 21 nt, Human
gucugcaagucagaggauggc

SEQ ID NO: 3543737 - RNA, 20 nt, Human
gucugcacaccuugaaucug

SEQ ID NO: 3543738 - RNA, 17 nt, Human
gucugcacccaggggug

SEQ ID NO: 3543739 - RNA, 19 nt, Human
gucugcagauagaaagcau

SEQ ID NO: 3543740 - RNA, 12 nt, Human
gucugcagcccu

SEQ ID NO: 3543741 - RNA, 22 nt, Human
gucugcaggauugauuaugcag

SEQ ID NO: 3543742 - RNA, 19 nt, Human
gucugccaaccuaaaacuc

SEQ ID NO: 3543743 - RNA, 18 nt, Human
gucugccaauuuuugccu

SEQ ID NO: 3543744 - RNA, 17 nt, Human
gucugccacacaaacgu

SEQ ID NO: 3543745 - RNA, 14 nt, Human
gucugccacccagg

SEQ ID NO: 3543746 - RNA, 16 nt, Human
gucugccagccagcag

SEQ ID NO: 3543747 - RNA, 21 nt, Human
gucugccaggcccccaccaca

SEQ ID NO: 3543748 - RNA, 11 nt, Human
gucugccaggg

SEQ ID NO: 3543749 - RNA, 18 nt, Human
gucugccccaaguuuugu

SEQ ID NO: 3543750 - RNA, 10 nt, Human
gucugcccuu

SEQ ID NO: 3543751 - RNA, 17 nt, Human
gucugcccuucacccca

SEQ ID NO: 3543752 - RNA, 11 nt, Human
gucugccucuu

SEQ ID NO: 3543753 - RNA, 19 nt, Human
gucugcucccaaggggccu

SEQ ID NO: 3543754 - RNA, 19 nt, Human
gucugcucuuucucugcca

SEQ ID NO: 3543755 - RNA, 20 nt, Human
gucugcucuuucucugccag

SEQ ID NO: 3543756 - RNA, 17 nt, Human
gucugcugaauaauaaa

SEQ ID NO: 3543757 - RNA, 19 nt, Human
gucugcugaauaauaaacu

SEQ ID NO: 3543758 - RNA, 13 nt, Human
gucugcugcccuc

SEQ ID NO: 3543759 - RNA, 14 nt, Human
gucugcuguagaaa

SEQ ID NO: 3543760 - RNA, 12 nt, Human
gucugcuuagaa

SEQ ID NO: 3543761 - RNA, 14 nt, Human
gucugcuuagaaau

SEQ ID NO: 3543762 - RNA, 16 nt, Human
gucugcuucugcaccu

SEQ ID NO: 3543763 - RNA, 21 nt, Human
gucugcuucugcaccuuaucu

SEQ ID NO: 3543764 - RNA, 23 nt, Human
gucuggaagauggggaccagcag

SEQ ID NO: 3543765 - RNA, 15 nt, Human
gucuggaaugcagug

SEQ ID NO: 3543766 - RNA, 15 nt, Human
gucuggacugacagc

SEQ ID NO: 3543767 - RNA, 21 nt, Human
gucuggagaauaauucuuuga

SEQ ID NO: 3543768 - RNA, 10 nt, Human
gucuggagac

SEQ ID NO: 3543769 - RNA, 18 nt, Human
gucuggaggaccugcccg

SEQ ID NO: 3543770 - RNA, 11 nt, Human
gucuggagggg

SEQ ID NO: 3543771 - RNA, 12 nt, Human
gucuggaguggg

SEQ ID NO: 3543772 - RNA, 21 nt, Human
gucuggaguugaucuggaacc

SEQ ID NO: 3543773 - RNA, 18 nt, Human
gucuggauaacuuccaca

SEQ ID NO: 3543774 - RNA, 14 nt, Human
gucuggaucaguaa

SEQ ID NO: 3543775 - RNA, 23 nt, Human
gucuggaugcgggcauggcagcc

SEQ ID NO: 3543776 - RNA, 22 nt, Human
gucuggcaaugccacagcccug

SEQ ID NO: 3543777 - RNA, 17 nt, Human
gucuggcacagccugca

SEQ ID NO: 3543778 - RNA, 22 nt, Human
gucuggcagccucccauccagg

SEQ ID NO: 3543779 - RNA, 15 nt, Human
gucuggcccaccagg

SEQ ID NO: 3543780 - RNA, 14 nt, Human
uggaaacaggacca

SEQ ID NO: 3543781 - RNA, 21 nt, Human
uggaaacccauaggcccacac

SEQ ID NO: 3543782 - RNA, 18 nt, Human
uggaaacccgaggguuga

SEQ ID NO: 3543783 - RNA, 15 nt, Human
uggaaaccugaaaaa

SEQ ID NO: 3543784 - RNA, 22 nt, Human
uggaaaccugcccugccugagg

SEQ ID NO: 3543785 - RNA, 13 nt, Human
uggaaacuaauaa

SEQ ID NO: 3543786 - RNA, 15 nt, Human
uggaaacuaauaaaa

SEQ ID NO: 3543787 - RNA, 17 nt, Human
uggaaacuaauaaaaua

SEQ ID NO: 3543788 - RNA, 21 nt, Human
uggaaacuaauaaaauauuuu

SEQ ID NO: 3543789 - RNA, 23 nt, Human
uggaaacuucagcgguuuauaua

SEQ ID NO: 3543790 - RNA, 22 nt, Human
uggaaacuuuucuuaaaaaguu

SEQ ID NO: 3543791 - RNA, 19 nt, Human
uggaaagcaucaccucagg

SEQ ID NO: 3543792 - RNA, 21 nt, Human
uggaaagcaucaccucaggcc

SEQ ID NO: 3543793 - RNA, 16 nt, Human
uggaaagccucugcug

SEQ ID NO: 3543794 - RNA, 14 nt, Human
uggaaguguggguc

SEQ ID NO: 3543795 - RNA, 18 nt, Human
uggaaguuauuaacuuua

SEQ ID NO: 3543796 - RNA, 16 nt, Human
uggaaguugcauggca

SEQ ID NO: 3543797 - RNA, 16 nt, Human
uggaaguuuguguucu

SEQ ID NO: 3543798 - RNA, 23 nt, Human
uggaaguuuguguucuguuuguu

SEQ ID NO: 3543799 - RNA, 19 nt, Human
uggaaguuuuccuacacuu

SEQ ID NO: 3543800 - RNA, 14 nt, Human
uggaaguuuugcau

SEQ ID NO: 3543801 - RNA, 23 nt, Human
uggaauaaaaauuccagaaugaa

SEQ ID NO: 3543802 - RNA, 18 nt, Human
uggaauaaaauacuauuu

SEQ ID NO: 3543803 - RNA, 14 nt, Human
uggaauaacaugua

SEQ ID NO: 3543804 - RNA, 14 nt, Human
uggaauaauguaaa

SEQ ID NO: 3543805 - RNA, 16 nt, Human
uggaauacucuuauau

SEQ ID NO: 3543806 - RNA, 18 nt, Human
uggaauacuuuuuguuau

SEQ ID NO: 3543807 - RNA, 17 nt, Human
uggaauaguauccucca

SEQ ID NO: 3543808 - RNA, 21 nt, Human
uggaauaguauccuccagguu

SEQ ID NO: 3543809 - RNA, 22 nt, Human
uggaauaguauccuccagguuu

SEQ ID NO: 3543810 - RNA, 13 nt, Human
uggaauauaaaga

SEQ ID NO: 3543811 - RNA, 18 nt, Human
uggaauauaaggaaagca

SEQ ID NO: 3543812 - RNA, 23 nt, Human
uggaaucccacuaaugcaaacug

SEQ ID NO: 3543813 - RNA, 18 nt, Human
uggaaucccacuguauga

SEQ ID NO: 3543814 - RNA, 13 nt, Human
uggaauccuuuca

SEQ ID NO: 3543815 - RNA, 16 nt, Human
uggaaucuagaagaaa

SEQ ID NO: 3543816 - RNA, 21 nt, Human
uggaaucuagaagaaaugaaa

SEQ ID NO: 3543817 - RNA, 20 nt, Human
uggaaucuucucuuugacaa

SEQ ID NO: 3543818 - RNA, 21 nt, Human
uggaaucuucucuuugacaau

SEQ ID NO: 3543819 - RNA, 18 nt, Human
uggaaugagugugcaugg

SEQ ID NO: 3543820 - RNA, 19 nt, Human
uggaaugagugugcaugga

SEQ ID NO: 3543821 - RNA, 21 nt, Human
uggaaugagugugcauggagg

SEQ ID NO: 3543822 - RNA, 17 nt, Human
uggaaugcccuucacug

SEQ ID NO: 3543823 - RNA, 16 nt, Human
uggaaugcuguguuaa

SEQ ID NO: 3543824 - RNA, 24 nt, Human
uggaaugcuuccuagaaguuacug

SEQ ID NO: 3543825 - RNA, 18 nt, Human
uggaaugcuucuucucag

SEQ ID NO: 3543826 - RNA, 21 nt, Human
uggaaugguuauaaaagugau

SEQ ID NO: 3543827 - RNA, 15 nt, Human
uggaauguuggauaa

SEQ ID NO: 3543828 - RNA, 21 nt, Human
uggaauguuggauaaggaauu

SEQ ID NO: 3543829 - RNA, 17 nt, Human
uggaauuaaaaggauag

SEQ ID NO: 3543830 - RNA, 21 nt, Human
uggaauuaaccuggugcugga

SEQ ID NO: 3543831 - RNA, 22 nt, Human
uggaauuagaacccuugcacag

SEQ ID NO: 3543832 - RNA, 22 nt, Human
uggaauuagcuuggggccaggg

SEQ ID NO: 3543833 - RNA, 20 nt, Human
uggaauuauuuuaaaagaua

SEQ ID NO: 3543834 - RNA, 16 nt, Human
uggaauucacaaagua

SEQ ID NO: 3543835 - RNA, 15 nt, Human
uggaauucuguucau

SEQ ID NO: 3543836 - RNA, 16 nt, Human
uggaauugcuuaccaa

SEQ ID NO: 3543837 - RNA, 13 nt, Human
uggaauuguggcu

SEQ ID NO: 3543838 - RNA, 20 nt, Human
uggaauuuauaauucaguau

SEQ ID NO: 3543839 - RNA, 22 nt, Human
uggaauuucucccagucauuua

SEQ ID NO: 3543840 - RNA, 14 nt, Human
uggaauuucuuguu

SEQ ID NO: 3543841 - RNA, 15 nt, Human
uggaauuucuuguuu

SEQ ID NO: 3543842 - RNA, 17 nt, Human
uggaauuucuuguuucu

SEQ ID NO: 3543843 - RNA, 14 nt, Human
uggaauuugaaaca

SEQ ID NO: 3543844 - RNA, 16 nt, Human
uggaauuuguaaccuc

SEQ ID NO: 3543845 - RNA, 15 nt, Human
uggaauuuugcaaag

SEQ ID NO: 3543846 - RNA, 22 nt, Human
uggaauuuugcaaagauuuaau

SEQ ID NO: 3543847 - RNA, 18 nt, Human
uggaauuuuuauuaugca

SEQ ID NO: 3543848 - RNA, 19 nt, Human
uggaauuuuuauuaugcau

SEQ ID NO: 3543849 - RNA, 23 nt, Human
uggaauuuuuauuaugcauaacu

SEQ ID NO: 3543850 - RNA, 23 nt, Human
uggaauuuuucauugauaugaaa

SEQ ID NO: 3543851 - RNA, 14 nt, Human
uggacaaaaugacu

SEQ ID NO: 3543852 - RNA, 20 nt, Human
uggacaaacuggagucugga

SEQ ID NO: 3543853 - RNA, 22 nt, Human
uggacaaacuggagucuggagu

SEQ ID NO: 3543854 - RNA, 15 nt, Human
uggacaaagaaccuu

SEQ ID NO: 3543855 - RNA, 20 nt, Human
uggacaaagaauuccaaagc

SEQ ID NO: 3543856 - RNA, 23 nt, Human
uggacaaagaauuccaaagcaaa

SEQ ID NO: 3543857 - RNA, 22 nt, Human
uggacaaaucacauauuuuaaa

SEQ ID NO: 3543858 - RNA, 16 nt, Human
uggacaaggaggucug

SEQ ID NO: 3543859 - RNA, 17 nt, Human
uggacacacaaggugca

SEQ ID NO: 3543860 - RNA, 14 nt, Human
uggacacacacagc

SEQ ID NO: 3543861 - RNA, 13 nt, Human
uggacacagcucu

SEQ ID NO: 3543862 - RNA, 14 nt, Human
uggacacagcucuu

SEQ ID NO: 3543863 - RNA, 23 nt, Human
uggacacagcucuucuccaggcu

SEQ ID NO: 3543864 - RNA, 20 nt, Human
uggacaccccuuauccagga

SEQ ID NO: 3543865 - RNA, 23 nt, Human
uggacaccccuuauccaggacuc

SEQ ID NO: 3543866 - RNA, 16 nt, Human
uggacaccugcccugc

SEQ ID NO: 3543867 - RNA, 18 nt, Human
uggacaccugcccugccc

SEQ ID NO: 3543868 - RNA, 23 nt, Human
uggacaccugcccugcccugcca

SEQ ID NO: 3543869 - RNA, 18 nt, Human
uggacaccuuuagguucu

SEQ ID NO: 3543870 - RNA, 16 nt, Human
uggacacuccagggac

SEQ ID NO: 3543871 - RNA, 17 nt, Human
uggacacuccagugcca

SEQ ID NO: 3543872 - RNA, 23 nt, Human
uggacacuuaauacuaccuugaa

SEQ ID NO: 3543873 - RNA, 20 nt, Human
uggacacuuaauucuguucu

SEQ ID NO: 3543874 - RNA, 14 nt, Human
uggacacuuugaaa

SEQ ID NO: 3543875 - RNA, 20 nt, Human
uggacacuuugaaauguguu

SEQ ID NO: 3543876 - RNA, 16 nt, Human
uggacacuuuucaccu

SEQ ID NO: 3543877 - RNA, 12 nt, Human
uggacagaagaa

SEQ ID NO: 3543878 - RNA, 15 nt, Human
uggacagagaagggc

SEQ ID NO: 3543879 - RNA, 12 nt, Human
uggacagagggg

SEQ ID NO: 3543880 - RNA, 14 nt, Human
uggacagaggggac

SEQ ID NO: 3543881 - RNA, 16 nt, Human
uggacagauuaauauu

SEQ ID NO: 3543882 - RNA, 15 nt, Human
uggacagcaaaacca

SEQ ID NO: 3543883 - RNA, 14 nt, Human
uggacagccccacc

SEQ ID NO: 3543884 - RNA, 15 nt, Human
uggacagcugugccu

SEQ ID NO: 3543885 - RNA, 13 nt, Human
uggacagcuugug

SEQ ID NO: 3543886 - RNA, 14 nt, Human
uggacaggucuggg

SEQ ID NO: 3543887 - RNA, 23 nt, Human
uggacaguaucacugucuuuccu

SEQ ID NO: 3543888 - RNA, 13 nt, Human
uggacagucacug

SEQ ID NO: 3543889 - RNA, 13 nt, Human
uggacaguccugg

SEQ ID NO: 3543890 - RNA, 14 nt, Human
uggacaguccuggg

SEQ ID NO: 3543891 - RNA, 15 nt, Human
uggacaguccuggga

SEQ ID NO: 3543892 - RNA, 19 nt, Human
uggacaguucacacccugc

SEQ ID NO: 3543893 - RNA, 20 nt, Human
uggacauccuccucccaccc

SEQ ID NO: 3543894 - RNA, 22 nt, Human
uggacauggcaggccgauuugg

SEQ ID NO: 3543895 - RNA, 15 nt, Human
uggacauucagaaca

SEQ ID NO: 3543896 - RNA, 18 nt, Human
uggacauuugccuugcug

SEQ ID NO: 3543897 - RNA, 16 nt, Human
uggacauuuuaugucu

SEQ ID NO: 3543898 - RNA, 17 nt, Human
uggaccaaaaaccagua

SEQ ID NO: 3543899 - RNA, 13 nt, Human
uggaccaaagcug

SEQ ID NO: 3543900 - RNA, 19 nt, Human
uggaccaauuauugauaua

SEQ ID NO: 3543901 - RNA, 22 nt, Human
uggaccaauuauugauauauau

SEQ ID NO: 3543902 - RNA, 15 nt, Human
uggaccacuguuucu

SEQ ID NO: 3543903 - RNA, 18 nt, Human
uggaccacuguuucuugc

SEQ ID NO: 3543904 - RNA, 13 nt, Human
uggaccagaugcu

SEQ ID NO: 3543905 - RNA, 14 nt, Human
uggaccagaugcug

SEQ ID NO: 3543906 - RNA, 15 nt, Human
uggaccagccucucc

SEQ ID NO: 3543907 - RNA, 16 nt, Human
uggaccagccucucca

SEQ ID NO: 3543908 - RNA, 14 nt, Human
uggaccaggacagg

SEQ ID NO: 3543909 - RNA, 18 nt, Human
uggaccaguggucucaca

SEQ ID NO: 3543910 - RNA, 19 nt, Human
uggaccagugguuuccagu

SEQ ID NO: 3543911 - RNA, 22 nt, Human
uggaccaugcugucuggcacag

SEQ ID NO: 3543912 - RNA, 19 nt, Human
uggaccauggaguggcagc

SEQ ID NO: 3543913 - RNA, 15 nt, Human
uggacccaaggaaaa

SEQ ID NO: 3543914 - RNA, 20 nt, Human
uggacccaaggaaaacugca

SEQ ID NO: 3543915 - RNA, 21 nt, Human
uggacccaaggaaaacugcau

SEQ ID NO: 3543916 - RNA, 18 nt, Human
uggacccagccaggccca

SEQ ID NO: 3543917 - RNA, 21 nt, Human
uggacccagccaggcccagcc

SEQ ID NO: 3543918 - RNA, 14 nt, Human
uggaccccagccuc

SEQ ID NO: 3543919 - RNA, 15 nt, Human
uggaccccagccuca

SEQ ID NO: 3543920 - RNA, 16 nt, Human
uggaccccagcuggga

SEQ ID NO: 3543921 - RNA, 16 nt, Human
uggaccccaucuguga

SEQ ID NO: 3543922 - RNA, 17 nt, Human
uggaccccccuuucaca

SEQ ID NO: 3543923 - RNA, 12 nt, Human
uggaccccugca

SEQ ID NO: 3543924 - RNA, 14 nt, Human
uggacccgcucugg

SEQ ID NO: 3543925 - RNA, 15 nt, Human
uggacccgcucugga

SEQ ID NO: 3543926 - RNA, 16 nt, Human
uggacccgcucuggac

SEQ ID NO: 3543927 - RNA, 16 nt, Human
uggacccugaaaugug

SEQ ID NO: 3543928 - RNA, 18 nt, Human
uggacccugaaaugugug

SEQ ID NO: 3543929 - RNA, 20 nt, Human
uggacccugaccagcucccc

SEQ ID NO: 3543930 - RNA, 23 nt, Human
uggacccugaccagcucccccuc

SEQ ID NO: 3543931 - RNA, 19 nt, Human
uggacccugaggcccagag

SEQ ID NO: 3543932 - RNA, 16 nt, Human
uggacccuguugcuaa

SEQ ID NO: 3543933 - RNA, 13 nt, Human
uggaccgaguaga

SEQ ID NO: 3543934 - RNA, 17 nt, Human
uggaccgaguagaggca

SEQ ID NO: 3543935 - RNA, 15 nt, Human
uggaccggagagugg

SEQ ID NO: 3543936 - RNA, 22 nt, Human
uggaccggagaguggggguggg

SEQ ID NO: 3543937 - RNA, 15 nt, Human
uggaccuaacauucg

SEQ ID NO: 3543938 - RNA, 23 nt, Human
aagaucaaaaaggcuuauaaaac

SEQ ID NO: 3543939 - RNA, 20 nt, Human
aagaucaaaagguuaauaaa

SEQ ID NO: 3543940 - RNA, 17 nt, Human
aagaucaaaauaaaaag

SEQ ID NO: 3543941 - RNA, 16 nt, Human
aagaucacgcuccccg

SEQ ID NO: 3543942 - RNA, 17 nt, Human
aagaucacgcuccccgc

SEQ ID NO: 3543943 - RNA, 19 nt, Human
aagaucacgcuccccgccu

SEQ ID NO: 3543944 - RNA, 12 nt, Human
aagaucacuguu

SEQ ID NO: 3543945 - RNA, 14 nt, Human
aagaucacuguuua

SEQ ID NO: 3543946 - RNA, 19 nt, Human
aagaucacuuguuguuuua

SEQ ID NO: 3543947 - RNA, 21 nt, Human
aagaucacuuguuguuuuacu

SEQ ID NO: 3543948 - RNA, 17 nt, Human
aagaucacuuucucagu

SEQ ID NO: 3543949 - RNA, 17 nt, Human
aagaucauauacgugaa

SEQ ID NO: 3543950 - RNA, 14 nt, Human
aagauccagcugcc

SEQ ID NO: 3543951 - RNA, 22 nt, Human
aagauccuaaaacaaaagcuca

SEQ ID NO: 3543952 - RNA, 21 nt, Human
aagauccugucuuuaaggaaa

SEQ ID NO: 3543953 - RNA, 14 nt, Human
aagauccugugagg

SEQ ID NO: 3543954 - RNA, 16 nt, Human
aagaucguucucugcc

SEQ ID NO: 3543955 - RNA, 15 nt, Human
aagaucucuuucuaa

SEQ ID NO: 3543956 - RNA, 19 nt, Human
aagaucucuuucuaaagac

SEQ ID NO: 3543957 - RNA, 17 nt, Human
aagaucuguccucagcc

SEQ ID NO: 3543958 - RNA, 17 nt, Human
aagaucugugcagcccc

SEQ ID NO: 3543959 - RNA, 15 nt, Human
aagaucuuaaauuuu

SEQ ID NO: 3543960 - RNA, 13 nt, Human
aagaucuuagauu

SEQ ID NO: 3543961 - RNA, 17 nt, Human
aagaucuuagauucucu

SEQ ID NO: 3543962 - RNA, 23 nt, Human
aagaucuucaaaaguaaugccuc

SEQ ID NO: 3543963 - RNA, 13 nt, Human
aagaucuuucagg

SEQ ID NO: 3543964 - RNA, 11 nt, Human
aagaucuuuua

SEQ ID NO: 3543965 - RNA, 19 nt, Human
aagaugaaaggcaggccua

SEQ ID NO: 3543966 - RNA, 22 nt, Human
aagaugaacccgaggcugagaa

SEQ ID NO: 3543967 - RNA, 14 nt, Human
aagaugaaguuuua

SEQ ID NO: 3543968 - RNA, 11 nt, Human
aagaugaauga

SEQ ID NO: 3543969 - RNA, 13 nt, Human
aagaugacauugc

SEQ ID NO: 3543970 - RNA, 15 nt, Human
aagaugacauugcua

SEQ ID NO: 3543971 - RNA, 23 nt, Human
aagaugacauugcuaagaugcuc

SEQ ID NO: 3543972 - RNA, 22 nt, Human
aagaugagaacagauaaagauu

SEQ ID NO: 3543973 - RNA, 17 nt, Human
aagaugagagaacugga

SEQ ID NO: 3543974 - RNA, 21 nt, Human
aagaugagauuggcauggcuu

SEQ ID NO: 3543975 - RNA, 15 nt, Human
aagaugaucagaccu

SEQ ID NO: 3543976 - RNA, 20 nt, Human
aagaugcaaggaccaggacu

SEQ ID NO: 3543977 - RNA, 18 nt, Human
aagaugcacuuugcuuua

SEQ ID NO: 3543978 - RNA, 18 nt, Human
aagaugcauuguaguuua

SEQ ID NO: 3543979 - RNA, 22 nt, Human
aagaugccacauucaaaauagg

SEQ ID NO: 3543980 - RNA, 21 nt, Human
aagaugcucuaucuugcucug

SEQ ID NO: 3543981 - RNA, 15 nt, Human
aagaugcucuuuuaa

SEQ ID NO: 3543982 - RNA, 16 nt, Human
aagaugcuucucacug

SEQ ID NO: 3543983 - RNA, 17 nt, Human
aagaugcuucucacugc

SEQ ID NO: 3543984 - RNA, 19 nt, Human
aagaugcuucucacugcca

SEQ ID NO: 3543985 - RNA, 22 nt, Human
aagaugcuuuuaacagagucug

SEQ ID NO: 3543986 - RNA, 14 nt, Human
aagauggaguuucu

SEQ ID NO: 3543987 - RNA, 15 nt, Human
aagauggaguuucua

SEQ ID NO: 3543988 - RNA, 20 nt, Human
aagauggaguuucuaagguc

SEQ ID NO: 3543989 - RNA, 21 nt, Human
aagauggauucucagauauuu

SEQ ID NO: 3543990 - RNA, 21 nt, Human
aagauggauugguguaaaagg

SEQ ID NO: 3543991 - RNA, 21 nt, Human
aagauggcugugccucugccu

SEQ ID NO: 3543992 - RNA, 21 nt, Human
aagaugggaacgcagaugauc

SEQ ID NO: 3543993 - RNA, 18 nt, Human
aagaugggcagcuaguuc

SEQ ID NO: 3543994 - RNA, 20 nt, Human
aagaugggcaucuuuuguau

SEQ ID NO: 3543995 - RNA, 18 nt, Human
aagauggggaccagcagc

SEQ ID NO: 3543996 - RNA, 20 nt, Human
aagauggggaccagcagccc

SEQ ID NO: 3543997 - RNA, 17 nt, Human
uggccaagcugaggugc

SEQ ID NO: 3543998 - RNA, 23 nt, Human
uggccaagcugaggugcccagga

SEQ ID NO: 3543999 - RNA, 16 nt, Human
uggccaaggaaaggca

SEQ ID NO: 3544000 - RNA, 17 nt, Human
uggccaaggagcugcua

SEQ ID NO: 3544001 - RNA, 19 nt, Human
uggccaaggagcugcuaua

SEQ ID NO: 3544002 - RNA, 22 nt, Human
uggccaaugcaccuaaagaaaa

SEQ ID NO: 3544003 - RNA, 16 nt, Human
uggccacacugugaca

SEQ ID NO: 3544004 - RNA, 12 nt, Human
uggccacagcca

SEQ ID NO: 3544005 - RNA, 16 nt, Human
uggccacagccagggg

SEQ ID NO: 3544006 - RNA, 18 nt, Human
uggccaccaggcuggcgc

SEQ ID NO: 3544007 - RNA, 19 nt, Human
uggccaccaggcuggcgca

SEQ ID NO: 3544008 - RNA, 20 nt, Human
uggccaccaggcuggcgcag

SEQ ID NO: 3544009 - RNA, 21 nt, Human
uggccaccaggcuggcgcagc

SEQ ID NO: 3544010 - RNA, 22 nt, Human
uggccaccaggugccuuucaaa

SEQ ID NO: 3544011 - RNA, 20 nt, Human
uggccaccucucuccuuugc

SEQ ID NO: 3544012 - RNA, 22 nt, Human
uggccaccugaggugggcccag

SEQ ID NO: 3544013 - RNA, 17 nt, Human
uggccacgcagccagga

SEQ ID NO: 3544014 - RNA, 11 nt, Human
uggccacgccc

SEQ ID NO: 3544015 - RNA, 18 nt, Human
uggccacuaagcagagga

SEQ ID NO: 3544016 - RNA, 12 nt, Human
uggccacucagc

SEQ ID NO: 3544017 - RNA, 15 nt, Human
uggccacucagcuuc

SEQ ID NO: 3544018 - RNA, 22 nt, Human
uggccacuccagaccccuggcu

SEQ ID NO: 3544019 - RNA, 20 nt, Human
uggccacuccgagagguggg

SEQ ID NO: 3544020 - RNA, 19 nt, Human
uggccacugcucccuaagc

SEQ ID NO: 3544021 - RNA, 22 nt, Human
uggccacuuuaagagagaaauc

SEQ ID NO: 3544022 - RNA, 20 nt, Human
uggccagaagggggccauga

SEQ ID NO: 3544023 - RNA, 12 nt, Human
uggccagacaca

SEQ ID NO: 3544024 - RNA, 15 nt, Human
uggccagaccagagc

SEQ ID NO: 3544025 - RNA, 21 nt, Human
uggccagaccagagcucugga

SEQ ID NO: 3544026 - RNA, 22 nt, Human
uggccagaccagagcucuggag

SEQ ID NO: 3544027 - RNA, 12 nt, Human
uggccagacucg

SEQ ID NO: 3544028 - RNA, 13 nt, Human
uggccagagagcc

SEQ ID NO: 3544029 - RNA, 18 nt, Human
uggccagagcugggaggc

SEQ ID NO: 3544030 - RNA, 14 nt, Human
uggccagaggcuug

SEQ ID NO: 3544031 - RNA, 17 nt, Human
uggccagaugcaccagc

SEQ ID NO: 3544032 - RNA, 18 nt, Human
uggccagaugcaccagcc

SEQ ID NO: 3544033 - RNA, 15 nt, Human
uggccagcagcaccu

SEQ ID NO: 3544034 - RNA, 21 nt, Human
uggccagccaacuuuugcaug

SEQ ID NO: 3544035 - RNA, 12 nt, Human
uggccagcccca

SEQ ID NO: 3544036 - RNA, 13 nt, Human
uggccagccccac

SEQ ID NO: 3544037 - RNA, 17 nt, Human
uggccagccccacagcc

SEQ ID NO: 3544038 - RNA, 19 nt, Human
uggccagccccacagccca

SEQ ID NO: 3544039 - RNA, 12 nt, Human
uggccagccccu

SEQ ID NO: 3544040 - RNA, 20 nt, Human
uggccagccccuuagacaga

SEQ ID NO: 3544041 - RNA, 14 nt, Human
uggccagccgcucu

SEQ ID NO: 3544042 - RNA, 17 nt, Human
uggccagccgcucuccu

SEQ ID NO: 3544043 - RNA, 18 nt, Human
uggccagccgcucuccug

SEQ ID NO: 3544044 - RNA, 21 nt, Human
uggccagccgcucuccugcca

SEQ ID NO: 3544045 - RNA, 16 nt, Human
uggccagccuggaucu

SEQ ID NO: 3544046 - RNA, 23 nt, Human
uggccagcgagcgcccagcuccu

SEQ ID NO: 3544047 - RNA, 19 nt, Human
uggccaggaaguagcacag

SEQ ID NO: 3544048 - RNA, 21 nt, Human
uggccaggaaguagcacaggc

SEQ ID NO: 3544049 - RNA, 12 nt, Human
uggccaggagca

SEQ ID NO: 3544050 - RNA, 14 nt, Human
uggccaggagcagg

SEQ ID NO: 3544051 - RNA, 22 nt, Human
uggccaggagcucuucaggccu

SEQ ID NO: 3544052 - RNA, 23 nt, Human
uggccaggagcucuucaggccuc

SEQ ID NO: 3544053 - RNA, 14 nt, Human
uggccaggauggag

SEQ ID NO: 3544054 - RNA, 20 nt, Human
uggccaggcacccccuggag

SEQ ID NO: 3544055 - RNA, 21 nt, Human
uggccaggcacccccuggaga

SEQ ID NO: 3544056 - RNA, 12 nt, Human
uggccaggcaga

SEQ ID NO: 3544057 - RNA, 16 nt, Human
uggccaggcagaucug

SEQ ID NO: 3544058 - RNA, 22 nt, Human
uggccaggccgggaaaaagccc

SEQ ID NO: 3544059 - RNA, 20 nt, Human
uggccaggcugaucucgaac

SEQ ID NO: 3544060 - RNA, 17 nt, Human
uggccaggcuggucuca

SEQ ID NO: 3544061 - RNA, 20 nt, Human
uggccagggccacgcuccag

SEQ ID NO: 3544062 - RNA, 11 nt, Human
uggccaggugg

SEQ ID NO: 3544063 - RNA, 21 nt, Human
uggccaguccacccugccugc

SEQ ID NO: 3544064 - RNA, 16 nt, Human
uggccaguccaggcug

SEQ ID NO: 3544065 - RNA, 20 nt, Human
uggccagucuggucucgaac

SEQ ID NO: 3544066 - RNA, 15 nt, Human
uggccaguggcugga

SEQ ID NO: 3544067 - RNA, 23 nt, Human
uggccagugugacaaggauugcu

SEQ ID NO: 3544068 - RNA, 16 nt, Human
uggccagugugauccc

SEQ ID NO: 3544069 - RNA, 15 nt, Human
uggccauauuuaccu

SEQ ID NO: 3544070 - RNA, 20 nt, Human
uggccauauuuaccucagcc

SEQ ID NO: 3544071 - RNA, 13 nt, Human
uggccaucccaca

SEQ ID NO: 3544072 - RNA, 14 nt, Human
uggccaucccugug

SEQ ID NO: 3544073 - RNA, 16 nt, Human
uggccaucccugugag

SEQ ID NO: 3544074 - RNA, 16 nt, Human
uggccaucucuggaug

SEQ ID NO: 3544075 - RNA, 16 nt, Human
uggccaugacccugcc

SEQ ID NO: 3544076 - RNA, 17 nt, Human
uggccaugacccugccu

SEQ ID NO: 3544077 - RNA, 22 nt, Human
uggccaugccacccuguuuuca

SEQ ID NO: 3544078 - RNA, 21 nt, Human
uggccaugcuccucuucccca

SEQ ID NO: 3544079 - RNA, 18 nt, Human
uggccauggagaaagcug

SEQ ID NO: 3544080 - RNA, 23 nt, Human
uggccauggagaaagcugacuug

SEQ ID NO: 3544081 - RNA, 22 nt, Human
uggccaugguacccccuucugg

SEQ ID NO: 3544082 - RNA, 23 nt, Human
ugccgggcugagggccugcugga

SEQ ID NO: 3544083 - RNA, 16 nt, Human
ugccggggcagccccc

SEQ ID NO: 3544084 - RNA, 14 nt, Human
ugccggguuuuaua

SEQ ID NO: 3544085 - RNA, 15 nt, Human
ugccggugagaccca

SEQ ID NO: 3544086 - RNA, 14 nt, Human
ugccguaauuuaac

SEQ ID NO: 3544087 - RNA, 16 nt, Human
ugccgucaccaccacc

SEQ ID NO: 3544088 - RNA, 18 nt, Human
ugccgucaccaccacccc

SEQ ID NO: 3544089 - RNA, 14 nt, Human
ugccgucucuggag

SEQ ID NO: 3544090 - RNA, 20 nt, Human
ugccguggauugcacguggc

SEQ ID NO: 3544091 - RNA, 16 nt, Human
ugccgugugaguguga

SEQ ID NO: 3544092 - RNA, 22 nt, Human
ugccgugugagugugacagggc

SEQ ID NO: 3544093 - RNA, 23 nt, Human
ugccgugugagugugacagggcc

SEQ ID NO: 3544094 - RNA, 20 nt, Human
ugccgugugcccucgggcga

SEQ ID NO: 3544095 - RNA, 16 nt, Human
ugccguuacucuccaa

SEQ ID NO: 3544096 - RNA, 19 nt, Human
ugccguuacucuccaaccu

SEQ ID NO: 3544097 - RNA, 20 nt, Human
ugccguuacuuuucauauuu

SEQ ID NO: 3544098 - RNA, 12 nt, Human
ugccuaaaauaa

SEQ ID NO: 3544099 - RNA, 13 nt, Human
ugccuaaauccau

SEQ ID NO: 3544100 - RNA, 20 nt, Human
ugccuaaauccauuuggaaa

SEQ ID NO: 3544101 - RNA, 18 nt, Human
ugccuaagaauaaacauu

SEQ ID NO: 3544102 - RNA, 13 nt, Human
ugccuaaggacuu

SEQ ID NO: 3544103 - RNA, 17 nt, Human
ugccuaaguauuccuuu

SEQ ID NO: 3544104 - RNA, 22 nt, Human
ugccuaauacauuaaagcaguc

SEQ ID NO: 3544105 - RNA, 17 nt, Human
ugccuacagaacuucag

SEQ ID NO: 3544106 - RNA, 15 nt, Human
ugccuagaggcccca

SEQ ID NO: 3544107 - RNA, 16 nt, Human
ugccuagcaagcuggc

SEQ ID NO: 3544108 - RNA, 17 nt, Human
ugccuagcaagcuggcc

SEQ ID NO: 3544109 - RNA, 19 nt, Human
ugccuagcacucacaugcu

SEQ ID NO: 3544110 - RNA, 20 nt, Human
ugccuaggauucacacccca

SEQ ID NO: 3544111 - RNA, 23 nt, Human
ugccuaggauucacaccccaccu

SEQ ID NO: 3544112 - RNA, 14 nt, Human
ugccuaggccuggg

SEQ ID NO: 3544113 - RNA, 14 nt, Human
ugccuaggcugacc

SEQ ID NO: 3544114 - RNA, 16 nt, Human
ugccuaguauugacaa

SEQ ID NO: 3544115 - RNA, 20 nt, Human
ugccuauaagccaaaauuaa

SEQ ID NO: 3544116 - RNA, 15 nt, Human
ugccuauauuuuccu

SEQ ID NO: 3544117 - RNA, 15 nt, Human
ugccuauccugcugu

SEQ ID NO: 3544118 - RNA, 17 nt, Human
ugccuauccugcuguuc

SEQ ID NO: 3544119 - RNA, 21 nt, Human
ugccuauuaucugucagcugc

SEQ ID NO: 3544120 - RNA, 13 nt, Human
ugccuauucccac

SEQ ID NO: 3544121 - RNA, 17 nt, Human
ugccuauuuguguggac

SEQ ID NO: 3544122 - RNA, 15 nt, Human
ugccucaagaggaau

SEQ ID NO: 3544123 - RNA, 23 nt, Human
ugccucaaugugaaucagacccu

SEQ ID NO: 3544124 - RNA, 23 nt, Human
ugccucaaugugaccagggguga

SEQ ID NO: 3544125 - RNA, 23 nt, Human
ugccucacccacccuuuuuuaaa

SEQ ID NO: 3544126 - RNA, 15 nt, Human
ugccucaccccuugc

SEQ ID NO: 3544127 - RNA, 22 nt, Human
ugccucacuaauuuuuguauua

SEQ ID NO: 3544128 - RNA, 15 nt, Human
ugccucagagaccag

SEQ ID NO: 3544129 - RNA, 23 nt, Human
ugccucagccacuugccugugcu

SEQ ID NO: 3544130 - RNA, 15 nt, Human
ugccucagcccugac

SEQ ID NO: 3544131 - RNA, 18 nt, Human
ugccucagccucccgagu

SEQ ID NO: 3544132 - RNA, 17 nt, Human
ugccucagcuuccccag

SEQ ID NO: 3544133 - RNA, 18 nt, Human
ugccucagcuuccccagu

SEQ ID NO: 3544134 - RNA, 18 nt, Human
ugccucaggaggcaggac

SEQ ID NO: 3544135 - RNA, 21 nt, Human
ugccucaggaggcaggaccuu

SEQ ID NO: 3544136 - RNA, 14 nt, Human
ugccucagguuccu

SEQ ID NO: 3544137 - RNA, 14 nt, Human
ugccuccaccacca

SEQ ID NO: 3544138 - RNA, 21 nt, Human
ugccuccaccaccacuggcca

SEQ ID NO: 3544139 - RNA, 14 nt, Human
ugccuccacccucu

SEQ ID NO: 3544140 - RNA, 17 nt, Human
ugccuccaccgcugccu

SEQ ID NO: 3544141 - RNA, 20 nt, Human
ugccuccaccgcugccuaag

SEQ ID NO: 3544142 - RNA, 14 nt, Human
ugccuccacuccca

SEQ ID NO: 3544143 - RNA, 14 nt, Human
ugccuccaggaacc

SEQ ID NO: 3544144 - RNA, 15 nt, Human
ugccuccagggcugg

SEQ ID NO: 3544145 - RNA, 19 nt, Human
ugccuccagggcuggacug

SEQ ID NO: 3544146 - RNA, 23 nt, Human
ugccuccagggcuggacugaggc

SEQ ID NO: 3544147 - RNA, 14 nt, Human
ugccuccaggugca

SEQ ID NO: 3544148 - RNA, 15 nt, Human
ugccuccaggugcag

SEQ ID NO: 3544149 - RNA, 12 nt, Human
ugccuccauccu

SEQ ID NO: 3544150 - RNA, 15 nt, Human
ugccuccauggugcc

SEQ ID NO: 3544151 - RNA, 22 nt, Human
ugccucccaucacccgcuaaga

SEQ ID NO: 3544152 - RNA, 21 nt, Human
ugccuccccaacccugccccu

SEQ ID NO: 3544153 - RNA, 23 nt, Human
ugccuccccaacccugccccugc

SEQ ID NO: 3544154 - RNA, 23 nt, Human
ugccuccccauuucccaucugca

SEQ ID NO: 3544155 - RNA, 11 nt, Human
ugccuccccuc

SEQ ID NO: 3544156 - RNA, 12 nt, Human
ugccuccccucc

SEQ ID NO: 3544157 - RNA, 22 nt, Human
ugccuccccuccucugcuugcc

SEQ ID NO: 3544158 - RNA, 13 nt, Human
ugccuccccugug

SEQ ID NO: 3544159 - RNA, 17 nt, Human
ugccucccucacccuga

SEQ ID NO: 3544160 - RNA, 21 nt, Human
ugccucccucacccugagccc

SEQ ID NO: 3544161 - RNA, 18 nt, Human
ugccucccuccccagugc

SEQ ID NO: 3544162 - RNA, 19 nt, Human
gugcccugcucgguggcag

SEQ ID NO: 3544163 - RNA, 19 nt, Human
gugcccuggaugcccagga

SEQ ID NO: 3544164 - RNA, 20 nt, Human
gugcccuuccugcugcgcag

SEQ ID NO: 3544165 - RNA, 16 nt, Human
gugcccuuggaggcca

SEQ ID NO: 3544166 - RNA, 14 nt, Human
gugccgacagaagg

SEQ ID NO: 3544167 - RNA, 13 nt, Human
gugccgccugccc

SEQ ID NO: 3544168 - RNA, 14 nt, Human
gugccgccugcccg

SEQ ID NO: 3544169 - RNA, 14 nt, Human
gugccguggcacca

SEQ ID NO: 3544170 - RNA, 22 nt, Human
gugccguguccccugacagggc

SEQ ID NO: 3544171 - RNA, 15 nt, Human
gugccgugugagugu

SEQ ID NO: 3544172 - RNA, 20 nt, Human
gugccgugugagugugacag

SEQ ID NO: 3544173 - RNA, 15 nt, Human
gugccguuacucucc

SEQ ID NO: 3544174 - RNA, 22 nt, Human
gugccguuacucuccaaccugg

SEQ ID NO: 3544175 - RNA, 17 nt, Human
gugccuaaaauaagaau

SEQ ID NO: 3544176 - RNA, 21 nt, Human
gugccuaggauugugccugua

SEQ ID NO: 3544177 - RNA, 14 nt, Human
gugccuaggccugg

SEQ ID NO: 3544178 - RNA, 18 nt, Human
gugccuauagucccagcu

SEQ ID NO: 3544179 - RNA, 20 nt, Human
gugccuauugcuagagcucc

SEQ ID NO: 3544180 - RNA, 22 nt, Human
gugccucacauuuuuuucuacc

SEQ ID NO: 3544181 - RNA, 20 nt, Human
gugccucagagaccagggcu

SEQ ID NO: 3544182 - RNA, 14 nt, Human
gugccucauugcuu

SEQ ID NO: 3544183 - RNA, 20 nt, Human
gugccuccaccaccacuggc

SEQ ID NO: 3544184 - RNA, 20 nt, Human
gugccucccuccccagugca

SEQ ID NO: 3544185 - RNA, 15 nt, Human
gugccucccugguga

SEQ ID NO: 3544186 - RNA, 22 nt, Human
gugccuccugacacaccugcag

SEQ ID NO: 3544187 - RNA, 13 nt, Human
gugccuccuucca

SEQ ID NO: 3544188 - RNA, 21 nt, Human
gugccuccuuccaccucccuc

SEQ ID NO: 3544189 - RNA, 21 nt, Human
gugccucgcuccccacucugc

SEQ ID NO: 3544190 - RNA, 13 nt, Human
gugccucuagcug

SEQ ID NO: 3544191 - RNA, 14 nt, Human
gugccucucccugc

SEQ ID NO: 3544192 - RNA, 16 nt, Human
gugccucucccugcug

SEQ ID NO: 3544193 - RNA, 12 nt, Human
gugccucugccu

SEQ ID NO: 3544194 - RNA, 13 nt, Human
gugccucugggac

SEQ ID NO: 3544195 - RNA, 15 nt, Human
gugccucugggacug

SEQ ID NO: 3544196 - RNA, 14 nt, Human
gugccugagaggca

SEQ ID NO: 3544197 - RNA, 20 nt, Human
gugccugauccagccucucc

SEQ ID NO: 3544198 - RNA, 23 nt, Human
gugccugauccagccucuccccu

SEQ ID NO: 3544199 - RNA, 19 nt, Human
gugccugauucggcugucu

SEQ ID NO: 3544200 - RNA, 15 nt, Human
gugccugcaccagga

SEQ ID NO: 3544201 - RNA, 19 nt, Human
gugccugcaccaggagaca

SEQ ID NO: 3544202 - RNA, 23 nt, Human
gugccugcuucagccucccacag

SEQ ID NO: 3544203 - RNA, 19 nt, Human
gugccuggagcuccuggga

SEQ ID NO: 3544204 - RNA, 15 nt, Human
gugccuggccuggca

SEQ ID NO: 3544205 - RNA, 14 nt, Human
gugccuggcucaga

SEQ ID NO: 3544206 - RNA, 18 nt, Human
gugccuggcucagagcca

SEQ ID NO: 3544207 - RNA, 16 nt, Human
gugccugggggaguuu

SEQ ID NO: 3544208 - RNA, 18 nt, Human
gugccuggguggggcugc

SEQ ID NO: 3544209 - RNA, 21 nt, Human
gugccuguaugcaacaggcac

SEQ ID NO: 3544210 - RNA, 20 nt, Human
gugccugucccacccccacc

SEQ ID NO: 3544211 - RNA, 17 nt, Human
gugccugugaggcaggg

SEQ ID NO: 3544212 - RNA, 13 nt, Human
gugccugugucca

SEQ ID NO: 3544213 - RNA, 14 nt, Human
gugccuuaccuccu

SEQ ID NO: 3544214 - RNA, 18 nt, Human
gugccuuaccuccugccc

SEQ ID NO: 3544215 - RNA, 19 nt, Human
gugccuuaccuccugccca

SEQ ID NO: 3544216 - RNA, 11 nt, Human
gugccuucauu

SEQ ID NO: 3544217 - RNA, 20 nt, Human
gugccuucgcgguggaaggc

SEQ ID NO: 3544218 - RNA, 17 nt, Human
gugccuucuguggggac

SEQ ID NO: 3544219 - RNA, 19 nt, Human
gugccuucuuauucucacu

SEQ ID NO: 3544220 - RNA, 20 nt, Human
gugccuucuucagggccugg

SEQ ID NO: 3544221 - RNA, 19 nt, Human
gugccuugucacgccagac

SEQ ID NO: 3544222 - RNA, 13 nt, Human
gugccuuguuuuu

SEQ ID NO: 3544223 - RNA, 18 nt, Human
gugccuuuauguauuugc

SEQ ID NO: 3544224 - RNA, 18 nt, Human
gugccuuuauuuccacug

SEQ ID NO: 3544225 - RNA, 20 nt, Human
gugccuuuauuuccacugug

SEQ ID NO: 3544226 - RNA, 14 nt, Human
ugcuaccucacugg

SEQ ID NO: 3544227 - RNA, 15 nt, Human
ugcuaccucacuggg

SEQ ID NO: 3544228 - RNA, 16 nt, Human
ugcuaccucacugggg

SEQ ID NO: 3544229 - RNA, 15 nt, Human
ugcuaccucccuugc

SEQ ID NO: 3544230 - RNA, 18 nt, Human
ugcuaccugaucccacuc

SEQ ID NO: 3544231 - RNA, 23 nt, Human
ugcuaccugaucccacuccuagg

SEQ ID NO: 3544232 - RNA, 14 nt, Human
ugcuaccuugcccc

SEQ ID NO: 3544233 - RNA, 16 nt, Human
ugcuacgccugcaugu

SEQ ID NO: 3544234 - RNA, 14 nt, Human
ugcuacgugugauu

SEQ ID NO: 3544235 - RNA, 14 nt, Human
ugcuacuacaaaaa

SEQ ID NO: 3544236 - RNA, 15 nt, Human
ugcuacucuguuccu

SEQ ID NO: 3544237 - RNA, 20 nt, Human
ugcuacugauuguuucauug

SEQ ID NO: 3544238 - RNA, 18 nt, Human
ugcuacuggggaaacugg

SEQ ID NO: 3544239 - RNA, 22 nt, Human
ugcuacuggggaaacuggccau

SEQ ID NO: 3544240 - RNA, 16 nt, Human
ugcuacuuauauaauu

SEQ ID NO: 3544241 - RNA, 17 nt, Human
ugcuacuuugccuuuug

SEQ ID NO: 3544242 - RNA, 14 nt, Human
ugcuagaaauuuuc

SEQ ID NO: 3544243 - RNA, 14 nt, Human
ugcuagaacucccu

SEQ ID NO: 3544244 - RNA, 14 nt, Human
ugcuagaacuuuuu

SEQ ID NO: 3544245 - RNA, 15 nt, Human
ugcuagaagcuguaa

SEQ ID NO: 3544246 - RNA, 17 nt, Human
ugcuagacacauuuuua

SEQ ID NO: 3544247 - RNA, 19 nt, Human
ugcuagacucuagacaaga

SEQ ID NO: 3544248 - RNA, 19 nt, Human
ugcuaggccagagcccacu

SEQ ID NO: 3544249 - RNA, 17 nt, Human
ugcuaggcgagugccag

SEQ ID NO: 3544250 - RNA, 19 nt, Human
ugcuaggcgagugccagga

SEQ ID NO: 3544251 - RNA, 17 nt, Human
ugcuagggaaacuuccc

SEQ ID NO: 3544252 - RNA, 22 nt, Human
ugcuaggucucggacuaagccu

SEQ ID NO: 3544253 - RNA, 23 nt, Human
ugcuagguuaauuccaauuauau

SEQ ID NO: 3544254 - RNA, 12 nt, Human
ugcuaguauuug

SEQ ID NO: 3544255 - RNA, 23 nt, Human
ugcuaguauuugaauuaaaacuu

SEQ ID NO: 3544256 - RNA, 18 nt, Human
ugcuagugagcugggcau

SEQ ID NO: 3544257 - RNA, 17 nt, Human
ugcuauaaucuguuuuu

SEQ ID NO: 3544258 - RNA, 14 nt, Human
ugcuauagccuggg

SEQ ID NO: 3544259 - RNA, 13 nt, Human
ugcuauaguauuu

SEQ ID NO: 3544260 - RNA, 17 nt, Human
ugcuauauugcccaggc

SEQ ID NO: 3544261 - RNA, 23 nt, Human
ugcuaucaugauggaauuucaua

SEQ ID NO: 3544262 - RNA, 22 nt, Human
ugcuauccauuucucauguuuu

SEQ ID NO: 3544263 - RNA, 21 nt, Human
ugcuauccccaucucccugcc

SEQ ID NO: 3544264 - RNA, 22 nt, Human
ugcuauccccaucucccugccu

SEQ ID NO: 3544265 - RNA, 20 nt, Human
ugcuaucggggaagccagac

SEQ ID NO: 3544266 - RNA, 18 nt, Human
ugcuaucucccccagccc

SEQ ID NO: 3544267 - RNA, 20 nt, Human
ugcuaucucccccagcccca

SEQ ID NO: 3544268 - RNA, 16 nt, Human
ugcuaucuuaauuuug

SEQ ID NO: 3544269 - RNA, 16 nt, Human
ugcuaugagcugggga

SEQ ID NO: 3544270 - RNA, 21 nt, Human
ugcuaugauguuaguuuuccu

SEQ ID NO: 3544271 - RNA, 12 nt, Human
ugcuauggggag

SEQ ID NO: 3544272 - RNA, 17 nt, Human
ugcuaugguuuucucca

SEQ ID NO: 3544273 - RNA, 18 nt, Human
ugcuaugucauuucaugu

SEQ ID NO: 3544274 - RNA, 21 nt, Human
ugcuauuaauauuuguuuagu

SEQ ID NO: 3544275 - RNA, 18 nt, Human
ugcuauuacgaaguucaa

SEQ ID NO: 3544276 - RNA, 14 nt, Human
ugcuauuagacugu

SEQ ID NO: 3544277 - RNA, 14 nt, Human
ugcuauucuguccc

SEQ ID NO: 3544278 - RNA, 13 nt, Human
ugcuauugacaau

SEQ ID NO: 3544279 - RNA, 18 nt, Human
ugcuauugacaauaaaau

SEQ ID NO: 3544280 - RNA, 20 nt, Human
ugcuauugacaauaaaauau

SEQ ID NO: 3544281 - RNA, 20 nt, Human
ugcuauuggaggaucaguuu

SEQ ID NO: 3544282 - RNA, 13 nt, Human
ugcuauuguaaau

SEQ ID NO: 3544283 - RNA, 16 nt, Human
ugcuauuuauuuuccu

SEQ ID NO: 3544284 - RNA, 13 nt, Human
ugcuauuugaagu

SEQ ID NO: 3544285 - RNA, 12 nt, Human
ugcuauuuuacu

SEQ ID NO: 3544286 - RNA, 14 nt, Human
ugcuauuuuucauc

SEQ ID NO: 3544287 - RNA, 16 nt, Human
ugcuauuuuuguaaag

SEQ ID NO: 3544288 - RNA, 22 nt, Human
ugcuauuuuuguaaaguuuccg

SEQ ID NO: 3544289 - RNA, 15 nt, Human
ugcucaaaaagaaau

SEQ ID NO: 3544290 - RNA, 21 nt, Human
ugcucaaaauuugaagaauga

SEQ ID NO: 3544291 - RNA, 13 nt, Human
ugcucaaagaaau

SEQ ID NO: 3544292 - RNA, 15 nt, Human
ugcucaaagaaaucu

SEQ ID NO: 3544293 - RNA, 18 nt, Human
ugcucaaaucuauucaga

SEQ ID NO: 3544294 - RNA, 14 nt, Human
ugcucaagaagaca

SEQ ID NO: 3544295 - RNA, 15 nt, Human
ugcucaagaagacau

SEQ ID NO: 3544296 - RNA, 14 nt, Human
ugcucacaccccau

SEQ ID NO: 3544297 - RNA, 15 nt, Human
ugcucacaguaaccc

SEQ ID NO: 3544298 - RNA, 15 nt, Human
ugcucacauaucugu

SEQ ID NO: 3544299 - RNA, 19 nt, Human
ugcucaccgcccaucaggg

SEQ ID NO: 3544300 - RNA, 17 nt, Human
ugcucacuaccuccuca

SEQ ID NO: 3544301 - RNA, 13 nt, Human
ugcucagaacaca

SEQ ID NO: 3544302 - RNA, 17 nt, Human
ugcucagaacuugcugc

SEQ ID NO: 3544303 - RNA, 13 nt, Human
ugcucagacagaa

SEQ ID NO: 3544304 - RNA, 17 nt, Human
ugcucagagcaguguuu

SEQ ID NO: 3544305 - RNA, 20 nt, Human
ugcucagcaaggggcucugc

SEQ ID NO: 3544306 - RNA, 17 nt, Human
ugcucagcagugagagc

SEQ ID NO: 3544307 - RNA, 20 nt, Human
ugcucagcagugagagcaga

SEQ ID NO: 3544308 - RNA, 12 nt, Human
ugcucagccaag

SEQ ID NO: 3544309 - RNA, 14 nt, Human
ugcucagccaagcu

SEQ ID NO: 3544310 - RNA, 12 nt, Human
ugcucagcccug

SEQ ID NO: 3544311 - RNA, 13 nt, Human
ugcucagcccugc

SEQ ID NO: 3544312 - RNA, 14 nt, Human
ugcucagcccugga

SEQ ID NO: 3544313 - RNA, 20 nt, Human
ugcucagcccuggaggugcc

SEQ ID NO: 3544314 - RNA, 21 nt, Human
ugcucagcccuggaggugcca

SEQ ID NO: 3544315 - RNA, 17 nt, Human
ugcucagcucugggcca

SEQ ID NO: 3544316 - RNA, 17 nt, Human
ugcucagcuucuccaac

SEQ ID NO: 3544317 - RNA, 20 nt, Human
ugcucagcuucuccaacaau

SEQ ID NO: 3544318 - RNA, 15 nt, Human
ugcucagcuucuccu

SEQ ID NO: 3544319 - RNA, 21 nt, Human
ugcucagcuucuccuguguga

SEQ ID NO: 3544320 - RNA, 12 nt, Human
ugcucaggcugc

SEQ ID NO: 3544321 - RNA, 19 nt, Human
ugcucaggcuugaaaugca

SEQ ID NO: 3544322 - RNA, 19 nt, Human
ugcucagggaaaagcagcu

SEQ ID NO: 3544323 - RNA, 14 nt, Human
ugcucagggcugac

SEQ ID NO: 3544324 - RNA, 20 nt, Human
ugcucagggucaauuucuuu

SEQ ID NO: 3544325 - RNA, 13 nt, Human
ugcucagguacuu

SEQ ID NO: 3544326 - RNA, 17 nt, Human
ugcucagguacuuguaa

SEQ ID NO: 3544327 - RNA, 16 nt, Human
ugcucaguagucagac

SEQ ID NO: 3544328 - RNA, 14 nt, Human
ugcucagucucccu

SEQ ID NO: 3544329 - RNA, 21 nt, Human
ugcucaguggguaaaauuaga

SEQ ID NO: 3544330 - RNA, 23 nt, Human
ugcucaguggguaaaauuagaug

SEQ ID NO: 3544331 - RNA, 20 nt, Human
ugcucaguguuuuugugaau

SEQ ID NO: 3544332 - RNA, 12 nt, Human
ugcucaguugcu

SEQ ID NO: 3544333 - RNA, 19 nt, Human
ugcucaguugcuaaacacu

SEQ ID NO: 3544334 - RNA, 15 nt, Human
ugcucaguuguagaa

SEQ ID NO: 3544335 - RNA, 20 nt, Human
ugcucaguuguagaauguau

SEQ ID NO: 3544336 - RNA, 21 nt, Human
ugcucauauugugauucugcc

SEQ ID NO: 3544337 - RNA, 23 nt, Human
ugcucauauugugauucugccuu

SEQ ID NO: 3544338 - RNA, 15 nt, Human
ugcucauauuuccca

SEQ ID NO: 3544339 - RNA, 15 nt, Human
ugcucaucauucucu

SEQ ID NO: 3544340 - RNA, 20 nt, Human
ugcucaucauucucugucuc

SEQ ID NO: 3544341 - RNA, 20 nt, Human
ugcucaucucaguccucaaa

SEQ ID NO: 3544342 - RNA, 13 nt, Human
ugcucaucugcug

SEQ ID NO: 3544343 - RNA, 18 nt, Human
ugcucaucugcugguccg

SEQ ID NO: 3544344 - RNA, 16 nt, Human
ugcucaucuguuguag

SEQ ID NO: 3544345 - RNA, 19 nt, Human
ugcucaugggcugugugau

SEQ ID NO: 3544346 - RNA, 17 nt, Human
ugcucauuaugccacuu

SEQ ID NO: 3544347 - RNA, 21 nt, Human
ugcucauucuaaugauggccc

SEQ ID NO: 3544348 - RNA, 14 nt, Human
ugcuccaagauucu

SEQ ID NO: 3544349 - RNA, 16 nt, Human
ugcuccaagauucuag

SEQ ID NO: 3544350 - RNA, 18 nt, Human
ugcuccaagauucuagau

SEQ ID NO: 3544351 - RNA, 12 nt, Human
ugcuccacagug

SEQ ID NO: 3544352 - RNA, 22 nt, Human
ugcuccaccccacucacagaga

SEQ ID NO: 3544353 - RNA, 16 nt, Human
ugcuccacccuuggcc

SEQ ID NO: 3544354 - RNA, 17 nt, Human
ugcuccacccuuggccu

SEQ ID NO: 3544355 - RNA, 18 nt, Human
ugcuccacccuuggccug

SEQ ID NO: 3544356 - RNA, 19 nt, Human
ugcuccagaauuuggaaau

SEQ ID NO: 3544357 - RNA, 20 nt, Human
ugcuccagaauuuggaaauc

SEQ ID NO: 3544358 - RNA, 21 nt, Human
ugcuccagaauuuggaaaucc

SEQ ID NO: 3544359 - RNA, 19 nt, Human
ugcuccagccaaccccugu

SEQ ID NO: 3544360 - RNA, 17 nt, Human
ugcuccagccuggcucc

SEQ ID NO: 3544361 - RNA, 12 nt, Human
ugcuccagcucu

SEQ ID NO: 3544362 - RNA, 13 nt, Human
ugcuccagcucug

SEQ ID NO: 3544363 - RNA, 19 nt, Human
ugcuccagcucuggcaugg

SEQ ID NO: 3544364 - RNA, 16 nt, Human
ugcuccagcuguucag

SEQ ID NO: 3544365 - RNA, 21 nt, Human
ugcuccagcuguucagcuggu

SEQ ID NO: 3544366 - RNA, 13 nt, Human
ugcuccaggccug

SEQ ID NO: 3544367 - RNA, 14 nt, Human
ugcuccaggccugc

SEQ ID NO: 3544368 - RNA, 16 nt, Human
ugcuccaggccugcag

SEQ ID NO: 3544369 - RNA, 15 nt, Human
ugcuccauccuccug

SEQ ID NO: 3544370 - RNA, 21 nt, Human
ugcucccaaggggccugagca

SEQ ID NO: 3544371 - RNA, 13 nt, Human
guggcucuccagu

SEQ ID NO: 3544372 - RNA, 15 nt, Human
ugcugacagacacag

SEQ ID NO: 3544373 - RNA, 19 nt, Human
ugcugacagacacaggccc

SEQ ID NO: 3544374 - RNA, 23 nt, Human
ugcugacagacacaggcccggcu

SEQ ID NO: 3544375 - RNA, 18 nt, Human
ugcugacagcugcuccua

SEQ ID NO: 3544376 - RNA, 19 nt, Human
ugcugacccaugggcagga

SEQ ID NO: 3544377 - RNA, 23 nt, Human
ugcugacccaugggcaggagacu

SEQ ID NO: 3544378 - RNA, 13 nt, Human
ugcugacccuccc

SEQ ID NO: 3544379 - RNA, 23 nt, Human
ugcugaccugcugaccugugcac

SEQ ID NO: 3544380 - RNA, 14 nt, Human
ugcugacggccagg

SEQ ID NO: 3544381 - RNA, 12 nt, Human
ugggcugagccc

SEQ ID NO: 3544382 - RNA, 16 nt, Human
ugggcugagcccuggc

SEQ ID NO: 3544383 - RNA, 11 nt, Human
ugggcugaggg

SEQ ID NO: 3544384 - RNA, 18 nt, Human
ugggcugcacucugugcc

SEQ ID NO: 3544385 - RNA, 19 nt, Human
ugggcugcacucugugccc

SEQ ID NO: 3544386 - RNA, 21 nt, Human
ugggcugcacucugugcccau

SEQ ID NO: 3544387 - RNA, 15 nt, Human
ugggcugcccuggug

SEQ ID NO: 3544388 - RNA, 19 nt, Human
ugggcugcccuggugcugc

SEQ ID NO: 3544389 - RNA, 20 nt, Human
ugggcugcccuggugcugcc

SEQ ID NO: 3544390 - RNA, 23 nt, Human
ugggcugcccuggugcugccaca

SEQ ID NO: 3544391 - RNA, 12 nt, Human
ugggcuggacuu

SEQ ID NO: 3544392 - RNA, 19 nt, Human
ugggcuggcucccucuugg

SEQ ID NO: 3544393 - RNA, 21 nt, Human
ugggcugggcccucucuucuc

SEQ ID NO: 3544394 - RNA, 18 nt, Human
ugggcuggggccugaugg

SEQ ID NO: 3544395 - RNA, 19 nt, Human
ugggcuggguucuacccag

SEQ ID NO: 3544396 - RNA, 20 nt, Human
ugggcugguaucucagaaag

SEQ ID NO: 3544397 - RNA, 23 nt, Human
ugggcugguaucucagaaagugc

SEQ ID NO: 3544398 - RNA, 19 nt, Human
ugggcugguggcucccgga

SEQ ID NO: 3544399 - RNA, 20 nt, Human
ugggcuguaacguggcacug

SEQ ID NO: 3544400 - RNA, 22 nt, Human
ugggcugugaguguaaguguga

SEQ ID NO: 3544401 - RNA, 14 nt, Human
ugggcuuaagaaau

SEQ ID NO: 3544402 - RNA, 13 nt, Human
ugggcuuauaucu

SEQ ID NO: 3544403 - RNA, 20 nt, Human
ugggcuuauaucuggccucu

SEQ ID NO: 3544404 - RNA, 22 nt, Human
ugggcuucagccuaguggcuug

SEQ ID NO: 3544405 - RNA, 17 nt, Human
ugggcuucagcugccag

SEQ ID NO: 3544406 - RNA, 15 nt, Human
ugggcuucaguggca

SEQ ID NO: 3544407 - RNA, 18 nt, Human
ugggcuucaguggcagcu

SEQ ID NO: 3544408 - RNA, 19 nt, Human
ugggcuucaguggcagcug

SEQ ID NO: 3544409 - RNA, 22 nt, Human
ugggcuucaguggcagcugcuu

SEQ ID NO: 3544410 - RNA, 14 nt, Human
ugggcuucccaagg

SEQ ID NO: 3544411 - RNA, 21 nt, Human
ugggcuucccaguggcugcug

SEQ ID NO: 3544412 - RNA, 22 nt, Human
ugggcuucccaguggcugcugc

SEQ ID NO: 3544413 - RNA, 14 nt, Human
ugggcuugauucug

SEQ ID NO: 3544414 - RNA, 14 nt, Human
ugggcuugcugugg

SEQ ID NO: 3544415 - RNA, 16 nt, Human
ugggcuuggccugcug

SEQ ID NO: 3544416 - RNA, 22 nt, Human
ugggcuugggccuaggcugcau

SEQ ID NO: 3544417 - RNA, 21 nt, Human
ugggcuuggggaccagagcug

SEQ ID NO: 3544418 - RNA, 18 nt, Human
ugggcuuguggggccugg

SEQ ID NO: 3544419 - RNA, 19 nt, Human
ugggcuuguggggccuggg

SEQ ID NO: 3544420 - RNA, 14 nt, Human
ugggcuuguuuucu

SEQ ID NO: 3544421 - RNA, 16 nt, Human
ugggcuuugauuucca

SEQ ID NO: 3544422 - RNA, 22 nt, Human
ugggcuuuuuuuuucucuuucu

SEQ ID NO: 3544423 - RNA, 14 nt, Human
uggggaaaccuaga

SEQ ID NO: 3544424 - RNA, 18 nt, Human
uggggaaagacacugccu

SEQ ID NO: 3544425 - RNA, 20 nt, Human
uggggaaagacacugccugg

SEQ ID NO: 3544426 - RNA, 22 nt, Human
uggggaaagacacugccugggc

SEQ ID NO: 3544427 - RNA, 11 nt, Human
uggggaaaggg

SEQ ID NO: 3544428 - RNA, 15 nt, Human
uggggaacaagggug

SEQ ID NO: 3544429 - RNA, 17 nt, Human
uggggaagacaguggcc

SEQ ID NO: 3544430 - RNA, 24 nt, Human
uggggaagacuguggcugcuagca

SEQ ID NO: 3544431 - RNA, 11 nt, Human
uggggaagagu

SEQ ID NO: 3544432 - RNA, 20 nt, Human
uggggacaggggcaggagga

SEQ ID NO: 3544433 - RNA, 15 nt, Human
uggggaccagcagcc

SEQ ID NO: 3544434 - RNA, 14 nt, Human
uggggacccaggcu

SEQ ID NO: 3544435 - RNA, 17 nt, Human
uggggaccucaggccug

SEQ ID NO: 3544436 - RNA, 21 nt, Human
uggggacgcuccgcugccgug

SEQ ID NO: 3544437 - RNA, 22 nt, Human
uggggacggggggccccaguca

SEQ ID NO: 3544438 - RNA, 23 nt, Human
uggggacuccggcugugcuggga

SEQ ID NO: 3544439 - RNA, 17 nt, Human
uggggagacaccucaga

SEQ ID NO: 3544440 - RNA, 22 nt, Human
uggggagaggaacuccuuggcc

SEQ ID NO: 3544441 - RNA, 14 nt, Human
uggggagauuugcc

SEQ ID NO: 3544442 - RNA, 15 nt, Human
uggggagcagagaca

SEQ ID NO: 3544443 - RNA, 19 nt, Human
uggggagcccgucucagug

SEQ ID NO: 3544444 - RNA, 21 nt, Human
uggggagcccgucucaguguu

SEQ ID NO: 3544445 - RNA, 19 nt, Human
uggggagcgggucugcucc

SEQ ID NO: 3544446 - RNA, 20 nt, Human
uggggagcgggucugcuccc

SEQ ID NO: 3544447 - RNA, 12 nt, Human
uggggaggacaa

SEQ ID NO: 3544448 - RNA, 15 nt, Human
uggggaggacaaaac

SEQ ID NO: 3544449 - RNA, 13 nt, Human
uggggaggaccug

SEQ ID NO: 3544450 - RNA, 23 nt, Human
uggggaggcggacguuccagccg

SEQ ID NO: 3544451 - RNA, 18 nt, Human
uggggagggauucugguu

SEQ ID NO: 3544452 - RNA, 12 nt, Human
uggggaggggcg

SEQ ID NO: 3544453 - RNA, 21 nt, Human
uggggaggggcgcuggcccag

SEQ ID NO: 3544454 - RNA, 17 nt, Human
uggggaguggggguggg

SEQ ID NO: 3544455 - RNA, 17 nt, Human
uggggaguuaagaccug

SEQ ID NO: 3544456 - RNA, 20 nt, Human
uggggaguuaagaccuggca

SEQ ID NO: 3544457 - RNA, 20 nt, Human
uggggaguuuaggguggggg

SEQ ID NO: 3544458 - RNA, 17 nt, Human
uggggauaaaggagaag

SEQ ID NO: 3544459 - RNA, 17 nt, Human
uggggauagaugugugg

SEQ ID NO: 3544460 - RNA, 20 nt, Human
uggggauagauguguggaca

SEQ ID NO: 3544461 - RNA, 18 nt, Human
uggggaucaaaguucugc

SEQ ID NO: 3544462 - RNA, 15 nt, Human
uggggaucacagaga

SEQ ID NO: 3544463 - RNA, 14 nt, Human
uggggaucucaggg

SEQ ID NO: 3544464 - RNA, 18 nt, Human
uggggaucucaggggcug

SEQ ID NO: 3544465 - RNA, 15 nt, Human
uggggaugagaaagg

SEQ ID NO: 3544466 - RNA, 23 nt, Human
uggggaugagaaagguugaagca

SEQ ID NO: 3544467 - RNA, 14 nt, Human
uggggaugugggag

SEQ ID NO: 3544468 - RNA, 16 nt, Human
uggggaugugggaggg

SEQ ID NO: 3544469 - RNA, 20 nt, Human
uggggauucagauuucucuu

SEQ ID NO: 3544470 - RNA, 20 nt, Human
uggggauucuuaaaguugaa

SEQ ID NO: 3544471 - RNA, 19 nt, Human
uggggcaagucccugacuc

SEQ ID NO: 3544472 - RNA, 11 nt, Human
uggggcacagu

SEQ ID NO: 3544473 - RNA, 15 nt, Human
uggggcacaguccag

SEQ ID NO: 3544474 - RNA, 13 nt, Human
uggggcagcacag

SEQ ID NO: 3544475 - RNA, 16 nt, Human
uggggcagcacagaga

SEQ ID NO: 3544476 - RNA, 18 nt, Human
uggggcagcacagagagg

SEQ ID NO: 3544477 - RNA, 22 nt, Human
uggggcagcacagagagggggc

SEQ ID NO: 3544478 - RNA, 20 nt, Human
uggggcagcuccucugucuc

SEQ ID NO: 3544479 - RNA, 13 nt, Human
uggggcagcuuga

SEQ ID NO: 3544480 - RNA, 20 nt, Human
uggggcaggaguagcugagc

SEQ ID NO: 3544481 - RNA, 17 nt, Human
uggggcaggcuggcugg

SEQ ID NO: 3544482 - RNA, 15 nt, Human
uggggcaggcugggc

SEQ ID NO: 3544483 - RNA, 16 nt, Human
uggggcaggcugggcc

SEQ ID NO: 3544484 - RNA, 23 nt, Human
uggggcagugcuuggcccaggag

SEQ ID NO: 3544485 - RNA, 11 nt, Human
uggggcagugg

SEQ ID NO: 3544486 - RNA, 17 nt, Human
uggggcauccugugcca

SEQ ID NO: 3544487 - RNA, 17 nt, Human
uggggccacacagaaac

SEQ ID NO: 3544488 - RNA, 14 nt, Human
uggggccagaucca

SEQ ID NO: 3544489 - RNA, 16 nt, Human
uggggccagauccagc

SEQ ID NO: 3544490 - RNA, 20 nt, Human
uggggccagauccagccugg

SEQ ID NO: 3544491 - RNA, 20 nt, Human
uggggccaggcugggucgcc

SEQ ID NO: 3544492 - RNA, 19 nt, Human
uggggcccuaauucagcca

SEQ ID NO: 3544493 - RNA, 14 nt, Human
uggggcccugccuc

SEQ ID NO: 3544494 - RNA, 16 nt, Human
uggggcccugccuccu

SEQ ID NO: 3544495 - RNA, 21 nt, Human
uggggccuaauaaaacugaug

SEQ ID NO: 3544496 - RNA, 22 nt, Human
uggggccuaauaaaacugaugu

SEQ ID NO: 3544497 - RNA, 21 nt, Human
uggggccuagcgaucucuccu

SEQ ID NO: 3544498 - RNA, 20 nt, Human
uggggccuccagaacucacu

SEQ ID NO: 3544499 - RNA, 12 nt, Human
uggggccucugu

SEQ ID NO: 3544500 - RNA, 17 nt, Human
uggggccugacugcuca

SEQ ID NO: 3544501 - RNA, 14 nt, Human
uggggccugagaga

SEQ ID NO: 3544502 - RNA, 18 nt, Human
uggggccugagagaauug

SEQ ID NO: 3544503 - RNA, 11 nt, Human
uggggccuggc

SEQ ID NO: 3544504 - RNA, 14 nt, Human
uggggccugggaca

SEQ ID NO: 3544505 - RNA, 13 nt, Human
uggggccugggag

SEQ ID NO: 3544506 - RNA, 14 nt, Human
uggggccugguucc

SEQ ID NO: 3544507 - RNA, 20 nt, Human
uggggccuguacugccugcu

SEQ ID NO: 3544508 - RNA, 12 nt, Human
uggggccuuggu

SEQ ID NO: 3544509 - RNA, 14 nt, Human
uggggcgaggcaga

SEQ ID NO: 3544510 - RNA, 15 nt, Human
uggggcgcgugaggc

SEQ ID NO: 3544511 - RNA, 18 nt, Human
uggggcggugagagggga

SEQ ID NO: 3544512 - RNA, 20 nt, Human
uggggcucccagccaggccc

SEQ ID NO: 3544513 - RNA, 23 nt, Human
uggggcucuaggguugcuggagc

SEQ ID NO: 3544514 - RNA, 22 nt, Human
uggggcucucugaguccuggcc

SEQ ID NO: 3544515 - RNA, 13 nt, Human
uggggcucuggga

SEQ ID NO: 3544516 - RNA, 19 nt, Human
guguauuugcuaauuuuua

SEQ ID NO: 3544517 - RNA, 19 nt, Human
guguauuuggaaauaaagu

SEQ ID NO: 3544518 - RNA, 23 nt, Human
guguauuuguauuuuuuugcaag

SEQ ID NO: 3544519 - RNA, 20 nt, Human
guguauuuuauaaaauuaaa

SEQ ID NO: 3544520 - RNA, 16 nt, Human
gugucaaauaaacacu

SEQ ID NO: 3544521 - RNA, 17 nt, Human
gugucaaauaaacacug

SEQ ID NO: 3544522 - RNA, 15 nt, Human
gugucaaccagacag

SEQ ID NO: 3544523 - RNA, 15 nt, Human
gugucaacuucaaca

SEQ ID NO: 3544524 - RNA, 14 nt, Human
gugucaaguggcaa

SEQ ID NO: 3544525 - RNA, 17 nt, Human
gugucaccccagagcca

SEQ ID NO: 3544526 - RNA, 19 nt, Human
gugucaccccagagccaca

SEQ ID NO: 3544527 - RNA, 22 nt, Human
gugucaccccagagccacacau

SEQ ID NO: 3544528 - RNA, 14 nt, Human
gugucaccugaaga

SEQ ID NO: 3544529 - RNA, 22 nt, Human
gugucaccugaagacucauucu

SEQ ID NO: 3544530 - RNA, 22 nt, Human
gugucacucaaggcggugcuug

SEQ ID NO: 3544531 - RNA, 16 nt, Human
gugucacuggcugccu

SEQ ID NO: 3544532 - RNA, 23 nt, Human
gugucacuggcugccuccacucc

SEQ ID NO: 3544533 - RNA, 14 nt, Human
gugucacugucccu

SEQ ID NO: 3544534 - RNA, 17 nt, Human
gugucacugucccuccu

SEQ ID NO: 3544535 - RNA, 19 nt, Human
gugucaggcacugggcaug

SEQ ID NO: 3544536 - RNA, 22 nt, Human
gugucaggcacugggcaugagg

SEQ ID NO: 3544537 - RNA, 19 nt, Human
gugucagguggggcagcuu

SEQ ID NO: 3544538 - RNA, 20 nt, Human
gugucaguggggcucucuga

SEQ ID NO: 3544539 - RNA, 16 nt, Human
gugucauuucauucca

SEQ ID NO: 3544540 - RNA, 17 nt, Human
guguccaaaaccgccag

SEQ ID NO: 3544541 - RNA, 20 nt, Human
ugggggaaagcaaagcacag

SEQ ID NO: 3544542 - RNA, 15 nt, Human
ugggggaaagcacag

SEQ ID NO: 3544543 - RNA, 17 nt, Human
ugggggaagaccuggca

SEQ ID NO: 3544544 - RNA, 22 nt, Human
ugggggaagagcacagcccucc

SEQ ID NO: 3544545 - RNA, 14 nt, Human
ugggggaagcccug

SEQ ID NO: 3544546 - RNA, 16 nt, Human
ugggggaagcccugga

SEQ ID NO: 3544547 - RNA, 15 nt, Human
ugggggacagggcug

SEQ ID NO: 3544548 - RNA, 21 nt, Human
ugggggacuuacaugauucau

SEQ ID NO: 3544549 - RNA, 14 nt, Human
ugggggagagcagg

SEQ ID NO: 3544550 - RNA, 12 nt, Human
ugggggagugga

SEQ ID NO: 3544551 - RNA, 21 nt, Human
ugggggaucacagccucugaa

SEQ ID NO: 3544552 - RNA, 15 nt, Human
ugggggaugcuucau

SEQ ID NO: 3544553 - RNA, 13 nt, Human
ugggggcagaggg

SEQ ID NO: 3544554 - RNA, 16 nt, Human
ugggggcagagggcag

SEQ ID NO: 3544555 - RNA, 18 nt, Human
ugggggcagagggcagag

SEQ ID NO: 3544556 - RNA, 22 nt, Human
ugggggcagccugcguggcuga

SEQ ID NO: 3544557 - RNA, 15 nt, Human
ugggggcagggcugu

SEQ ID NO: 3544558 - RNA, 14 nt, Human
ugggggccaccugc

SEQ ID NO: 3544559 - RNA, 16 nt, Human
ugggggccaccugccu

SEQ ID NO: 3544560 - RNA, 18 nt, Human
ugggggccaccugccugc

SEQ ID NO: 3544561 - RNA, 18 nt, Human
ugggggccccgucucagg

SEQ ID NO: 3544562 - RNA, 22 nt, Human
ugggggccccgucucaggucug

SEQ ID NO: 3544563 - RNA, 21 nt, Human
ugggggccucacuccaggaag

SEQ ID NO: 3544564 - RNA, 16 nt, Human
ugggggccucagugcc

SEQ ID NO: 3544565 - RNA, 19 nt, Human
ugggggccuggcuggcuga

SEQ ID NO: 3544566 - RNA, 17 nt, Human
ugggggcugaggagcag

SEQ ID NO: 3544567 - RNA, 14 nt, Human
ugggggcugcagca

SEQ ID NO: 3544568 - RNA, 14 nt, Human
ugggggcuggccuc

SEQ ID NO: 3544569 - RNA, 18 nt, Human
ugggggcugggcagagga

SEQ ID NO: 3544570 - RNA, 17 nt, Human
uggggggacccagugca

SEQ ID NO: 3544571 - RNA, 16 nt, Human
uggggggagcacccug

SEQ ID NO: 3544572 - RNA, 17 nt, Human
uggggggccaacaccag

SEQ ID NO: 3544573 - RNA, 19 nt, Human
uggggggcugaggugggag

SEQ ID NO: 3544574 - RNA, 21 nt, Human
ugggggggccaaaaggaaaaa

SEQ ID NO: 3544575 - RNA, 23 nt, Human
ugggggggcucccguggccugua

SEQ ID NO: 3544576 - RNA, 24 nt, Human
uggggggugaugagggcagcagcc

SEQ ID NO: 3544577 - RNA, 17 nt, Human
uggggguagcagcugga

SEQ ID NO: 3544578 - RNA, 19 nt, Human
uggggguagggggcuggag

SEQ ID NO: 3544579 - RNA, 21 nt, Human
uggggguagggggcuggagga

SEQ ID NO: 3544580 - RNA, 15 nt, Human
ugggggucugugugu

SEQ ID NO: 3544581 - RNA, 12 nt, Human
ugggggugcauu

SEQ ID NO: 3544582 - RNA, 14 nt, Human
ugggggugccagga

SEQ ID NO: 3544583 - RNA, 15 nt, Human
uggggguggaauaaa

SEQ ID NO: 3544584 - RNA, 18 nt, Human
uggggguggaggcuuccu

SEQ ID NO: 3544585 - RNA, 19 nt, Human
uggggguggaggcuuccug

SEQ ID NO: 3544586 - RNA, 10 nt, Human
uggggguggg

SEQ ID NO: 3544587 - RNA, 16 nt, Human
uggggguggggguagg

SEQ ID NO: 3544588 - RNA, 14 nt, Human
ugggggugggucag

SEQ ID NO: 3544589 - RNA, 15 nt, Human
ugggggugggucaga

SEQ ID NO: 3544590 - RNA, 16 nt, Human
uggggguucaggcccg

SEQ ID NO: 3544591 - RNA, 15 nt, Human
uggggguucuuucuu

SEQ ID NO: 3544592 - RNA, 20 nt, Human
uggggguucuuucuuccucu

SEQ ID NO: 3544593 - RNA, 12 nt, Human
uggggguuuuuu

SEQ ID NO: 3544594 - RNA, 21 nt, Human
ugggguaccaagagacuccuu

SEQ ID NO: 3544595 - RNA, 15 nt, Human
ugggguacccacugc

SEQ ID NO: 3544596 - RNA, 19 nt, Human
ugggguacccacugcucug

SEQ ID NO: 3544597 - RNA, 20 nt, Human
ugggguagcuagaggaacca

SEQ ID NO: 3544598 - RNA, 13 nt, Human
ugggguagggcug

SEQ ID NO: 3544599 - RNA, 21 nt, Human
ugggguagguugggagaaugu

SEQ ID NO: 3544600 - RNA, 19 nt, Human
ugggguauggauucuaaaa

SEQ ID NO: 3544601 - RNA, 20 nt, Human
ugggguauggauucuaaaau

SEQ ID NO: 3544602 - RNA, 22 nt, Human
uggggucaagaaacagccagca

SEQ ID NO: 3544603 - RNA, 16 nt, Human
uggggucacucuggca

SEQ ID NO: 3544604 - RNA, 20 nt, Human
uggggucacucuggcagcuc

SEQ ID NO: 3544605 - RNA, 13 nt, Human
uggggucaugccc

SEQ ID NO: 3544606 - RNA, 16 nt, Human
ugggguccuggggccu

SEQ ID NO: 3544607 - RNA, 23 nt, Human
uggggucucaaaguuugacagga

SEQ ID NO: 3544608 - RNA, 22 nt, Human
uggggucucccucuccugccua

SEQ ID NO: 3544609 - RNA, 14 nt, Human
uggggucugacccc

SEQ ID NO: 3544610 - RNA, 13 nt, Human
uggggucuguaaa

SEQ ID NO: 3544611 - RNA, 16 nt, Human
uggggugacagucauc

SEQ ID NO: 3544612 - RNA, 17 nt, Human
uggggugaugcugggcu

SEQ ID NO: 3544613 - RNA, 11 nt, Human
uggggugcagg

SEQ ID NO: 3544614 - RNA, 13 nt, Human
ugggguggcugca

SEQ ID NO: 3544615 - RNA, 16 nt, Human
ugggguggcugcagcc

SEQ ID NO: 3544616 - RNA, 19 nt, Human
ugggguggcugcagccuca

SEQ ID NO: 3544617 - RNA, 20 nt, Human
uggggugggaggucuugcua

SEQ ID NO: 3544618 - RNA, 12 nt, Human
uggggugggccu

SEQ ID NO: 3544619 - RNA, 16 nt, Human
uggggugggccucugg

SEQ ID NO: 3544620 - RNA, 21 nt, Human
ugggguggggggggugcuggg

SEQ ID NO: 3544621 - RNA, 15 nt, Human
ugggguggguauaaa

SEQ ID NO: 3544622 - RNA, 19 nt, Human
ugggguggguauaaaagau

SEQ ID NO: 3544623 - RNA, 15 nt, Human
uggggugugcuggga

SEQ ID NO: 3544624 - RNA, 19 nt, Human
ugggguucagccccuccuc

SEQ ID NO: 3544625 - RNA, 21 nt, Human
ugggguucagccccuccucug

SEQ ID NO: 3544626 - RNA, 19 nt, Human
ugggguugcaucagaaaug

SEQ ID NO: 3544627 - RNA, 14 nt, Human
ugggguuguguugu

SEQ ID NO: 3544628 - RNA, 15 nt, Human
ugggguuucgcagcc

SEQ ID NO: 3544629 - RNA, 18 nt, Human
ugggguuucgcagccuga

SEQ ID NO: 3544630 - RNA, 19 nt, Human
uggguaaaauuagaugcau

SEQ ID NO: 3544631 - RNA, 15 nt, Human
uggguaaaugcagcg

SEQ ID NO: 3544632 - RNA, 17 nt, Human
uggguacuuguggacac

SEQ ID NO: 3544633 - RNA, 18 nt, Human
uggguacuuguggacaca

SEQ ID NO: 3544634 - RNA, 20 nt, Human
uggguacuuguggacacagc

SEQ ID NO: 3544635 - RNA, 21 nt, Human
uggguagaaagagauacagag

SEQ ID NO: 3544636 - RNA, 14 nt, Human
uggguagacacaca

SEQ ID NO: 3544637 - RNA, 16 nt, Human
uggguagacacacaug

SEQ ID NO: 3544638 - RNA, 16 nt, Human
uggguagccugggugu

SEQ ID NO: 3544639 - RNA, 13 nt, Human
uggguagcuguaa

SEQ ID NO: 3544640 - RNA, 22 nt, Human
uggguagcuguaaggcaugaag

SEQ ID NO: 3544641 - RNA, 23 nt, Human
uggguaggaaagaggaagcaaau

SEQ ID NO: 3544642 - RNA, 21 nt, Human
uggguagugagcagugagcag

SEQ ID NO: 3544643 - RNA, 17 nt, Human
uggguaguggggaagag

SEQ ID NO: 3544644 - RNA, 15 nt, Human
uggguauauucauuu

SEQ ID NO: 3544645 - RNA, 20 nt, Human
uggguaucaagacauagcau

SEQ ID NO: 3544646 - RNA, 21 nt, Human
uggguaucaccacuggagauc

SEQ ID NO: 3544647 - RNA, 21 nt, Human
uggguauuugcaauauuccuu

SEQ ID NO: 3544648 - RNA, 19 nt, Human
ugggucacacacggaggca

SEQ ID NO: 3544649 - RNA, 19 nt, Human
ugggucaccagacggggcu

SEQ ID NO: 3544650 - RNA, 20 nt, Human
ugggucaccagacggggcug

SEQ ID NO: 3544651 - RNA, 18 nt, Human
ugggucaccccuccagga

SEQ ID NO: 3544652 - RNA, 9 nt, Human
ugggucaga

SEQ ID NO: 3544653 - RNA, 17 nt, Human
ugggucagaacccugcc

SEQ ID NO: 3544654 - RNA, 18 nt, Human
ugggucagaacccugcca

SEQ ID NO: 3544655 - RNA, 12 nt, Human
ugggucagucug

SEQ ID NO: 3544656 - RNA, 14 nt, Human
ugggucauagaaau

SEQ ID NO: 3544657 - RNA, 16 nt, Human
ugggucauagaaauuc

SEQ ID NO: 3544658 - RNA, 14 nt, Human
uggguccaaauaaa

SEQ ID NO: 3544659 - RNA, 12 nt, Human
uggguccaggag

SEQ ID NO: 3544660 - RNA, 13 nt, Human
uggguccaggagg

SEQ ID NO: 3544661 - RNA, 14 nt, Human
guuaucgaaauaac

SEQ ID NO: 3544662 - RNA, 12 nt, Human
guuaucucugug

SEQ ID NO: 3544663 - RNA, 13 nt, Human
guuaucucugugu

SEQ ID NO: 3544664 - RNA, 22 nt, Human
guuaucuucucaaguucuaaga

SEQ ID NO: 3544665 - RNA, 17 nt, Human
guuaugaaagaauauau

SEQ ID NO: 3544666 - RNA, 20 nt, Human
guuaugaaauucacccccuu

SEQ ID NO: 3544667 - RNA, 15 nt, Human
guuaugauaaaaaau

SEQ ID NO: 3544668 - RNA, 16 nt, Human
guuaugauaaaaaauu

SEQ ID NO: 3544669 - RNA, 22 nt, Human
guuaugaugugcuuaacaggga

SEQ ID NO: 3544670 - RNA, 20 nt, Human
guuaugauuuuuuuuucaua

SEQ ID NO: 3544671 - RNA, 23 nt, Human
guuauggcagaugacaagauggu

SEQ ID NO: 3544672 - RNA, 20 nt, Human
guuaugguagaaaaauuuca

SEQ ID NO: 3544673 - RNA, 15 nt, Human
guuaugguguuucuc

SEQ ID NO: 3544674 - RNA, 17 nt, Human
guuauguacuaguguuc

SEQ ID NO: 3544675 - RNA, 12 nt, Human
guuauguauuuc

SEQ ID NO: 3544676 - RNA, 13 nt, Human
guuauguauuucc

SEQ ID NO: 3544677 - RNA, 18 nt, Human
guuauguguaugugccau

SEQ ID NO: 3544678 - RNA, 19 nt, Human
guuauguguaugugccauu

SEQ ID NO: 3544679 - RNA, 17 nt, Human
guuauguuuaauaagcu

SEQ ID NO: 3544680 - RNA, 17 nt, Human
guuauguuuuucugugu

SEQ ID NO: 3544681 - RNA, 22 nt, Human
guuauuaaacguaugcauguga

SEQ ID NO: 3544682 - RNA, 12 nt, Human
guuauuaaaugu

SEQ ID NO: 3544683 - RNA, 13 nt, Human
guuauuagauguu

SEQ ID NO: 3544684 - RNA, 19 nt, Human
guuauuagggugguauuua

SEQ ID NO: 3544685 - RNA, 16 nt, Human
guuauuauaauuguau

SEQ ID NO: 3544686 - RNA, 22 nt, Human
guuauucauucugugaucauuu

SEQ ID NO: 3544687 - RNA, 17 nt, Human
guuauuccuugaucauu

SEQ ID NO: 3544688 - RNA, 20 nt, Human
guuauucuaguacuagaaac

SEQ ID NO: 3544689 - RNA, 12 nt, Human
guuauucuuugc

SEQ ID NO: 3544690 - RNA, 13 nt, Human
guuauucuuugca

SEQ ID NO: 3544691 - RNA, 16 nt, Human
guuauugaagcagagu

SEQ ID NO: 3544692 - RNA, 16 nt, Human
guuauugacaaacucu

SEQ ID NO: 3544693 - RNA, 20 nt, Human
guuauugagagagaugugua

SEQ ID NO: 3544694 - RNA, 22 nt, Human
guuauugauaaguucauacauu

SEQ ID NO: 3544695 - RNA, 18 nt, Human
guuauugcaauaaaguau

SEQ ID NO: 3544696 - RNA, 14 nt, Human
guuauugcaguuua

SEQ ID NO: 3544697 - RNA, 16 nt, Human
guuauugcaguuuauc

SEQ ID NO: 3544698 - RNA, 22 nt, Human
guuauugguguaagguacuuuc

SEQ ID NO: 3544699 - RNA, 15 nt, Human
guuauuuaaagaaga

SEQ ID NO: 3544700 - RNA, 23 nt, Human
guuauuucccuacauuaaacaug

SEQ ID NO: 3544701 - RNA, 15 nt, Human
guuauuucugcaaac

SEQ ID NO: 3544702 - RNA, 13 nt, Human
guuauuuguacag

SEQ ID NO: 3544703 - RNA, 14 nt, Human
guuauuuguacagu

SEQ ID NO: 3544704 - RNA, 15 nt, Human
guuauuuuaguuucu

SEQ ID NO: 3544705 - RNA, 14 nt, Human
guuauuuucaguau

SEQ ID NO: 3544706 - RNA, 15 nt, Human
guuauuuucaguauu

SEQ ID NO: 3544707 - RNA, 17 nt, Human
guuauuuucaguauuuu

SEQ ID NO: 3544708 - RNA, 15 nt, Human
guuauuuucuacagu

SEQ ID NO: 3544709 - RNA, 15 nt, Human
guuauuuugauaaca

SEQ ID NO: 3544710 - RNA, 14 nt, Human
guucaaaaagucua

SEQ ID NO: 3544711 - RNA, 13 nt, Human
guucaaaaugucu

SEQ ID NO: 3544712 - RNA, 14 nt, Human
guucaaaaugucug

SEQ ID NO: 3544713 - RNA, 16 nt, Human
guucaaacaauaucau

SEQ ID NO: 3544714 - RNA, 15 nt, Human
guucaaacauuuacc

SEQ ID NO: 3544715 - RNA, 20 nt, Human
guucaaagauauuuugcuuu

SEQ ID NO: 3544716 - RNA, 18 nt, Human
guucaaagucaugauguu

SEQ ID NO: 3544717 - RNA, 13 nt, Human
guucaacaaagaa

SEQ ID NO: 3544718 - RNA, 23 nt, Human
guucaacaaagaaacaaagaugu

SEQ ID NO: 3544719 - RNA, 14 nt, Human
guucaacuauuuua

SEQ ID NO: 3544720 - RNA, 13 nt, Human
guucaagaaauga

SEQ ID NO: 3544721 - RNA, 20 nt, Human
guucaagaucaaaaaggcuu

SEQ ID NO: 3544722 - RNA, 20 nt, Human
guucaagcgauucuucugcu

SEQ ID NO: 3544723 - RNA, 18 nt, Human
guucaaggaaucauuguu

SEQ ID NO: 3544724 - RNA, 18 nt, Human
guucaaggccauccuucc

SEQ ID NO: 3544725 - RNA, 19 nt, Human
guucaaggccauccuuccc

SEQ ID NO: 3544726 - RNA, 21 nt, Human
guucaaggucacuguuuccug

SEQ ID NO: 3544727 - RNA, 12 nt, Human
guucaaguuuug

SEQ ID NO: 3544728 - RNA, 13 nt, Human
guucaaugaucua

SEQ ID NO: 3544729 - RNA, 19 nt, Human
guucaaugaucuagguuua

SEQ ID NO: 3544730 - RNA, 21 nt, Human
guucaaugaucuagguuuaac

SEQ ID NO: 3544731 - RNA, 16 nt, Human
guucaauucucauuug

SEQ ID NO: 3544732 - RNA, 16 nt, Human
guucacacccugcaag

SEQ ID NO: 3544733 - RNA, 11 nt, Human
guucaccagcc

SEQ ID NO: 3544734 - RNA, 19 nt, Human
guucacccaucuuaucaag

SEQ ID NO: 3544735 - RNA, 14 nt, Human
guucaccccuccac

SEQ ID NO: 3544736 - RNA, 16 nt, Human
guucaccccuccaccc

SEQ ID NO: 3544737 - RNA, 23 nt, Human
guucaccuuuguagcacucaggc

SEQ ID NO: 3544738 - RNA, 16 nt, Human
guucacggguggccug

SEQ ID NO: 3544739 - RNA, 15 nt, Human
guucacuaaacucug

SEQ ID NO: 3544740 - RNA, 18 nt, Human
guucacuaaacucugaau

SEQ ID NO: 3544741 - RNA, 20 nt, Human
guucacuaaacucugaauaa

SEQ ID NO: 3544742 - RNA, 13 nt, Human
guucacucuucuc

SEQ ID NO: 3544743 - RNA, 20 nt, Human
guucacucuucucagccacu

SEQ ID NO: 3544744 - RNA, 17 nt, Human
guucacucuuggagccu

SEQ ID NO: 3544745 - RNA, 19 nt, Human
guucacucuuggagccugc

SEQ ID NO: 3544746 - RNA, 12 nt, Human
guucagaaaaaa

SEQ ID NO: 3544747 - RNA, 18 nt, Human
guucagaaaugcugccug

SEQ ID NO: 3544748 - RNA, 19 nt, Human
guucagaaaugcugccugc

SEQ ID NO: 3544749 - RNA, 15 nt, Human
uggacacucagaccu

SEQ ID NO: 3544750 - RNA, 13 nt, Human
uggacacuccagg

SEQ ID NO: 3544751 - RNA, 14 nt, Human
uggacacuccaggg

SEQ ID NO: 3544752 - RNA, 19 nt, Human
uggacacuccagggacaca

SEQ ID NO: 3544753 - RNA, 24 nt, Human
uggacacuccagggacacacagcc

SEQ ID NO: 3544754 - RNA, 21 nt, Human
uggacacuccagugccagcaa

SEQ ID NO: 3544755 - RNA, 17 nt, Human
uggacacuuaauucugu

SEQ ID NO: 3544756 - RNA, 18 nt, Human
uggacacuuaauucuguu

SEQ ID NO: 3544757 - RNA, 23 nt, Human
uggacacuuugaaauguguuucu

SEQ ID NO: 3544758 - RNA, 19 nt, Human
uggacagaggggacucugg

SEQ ID NO: 3544759 - RNA, 22 nt, Human
uggacagauugccuguuucuga

SEQ ID NO: 3544760 - RNA, 20 nt, Human
uggacagcaaaaccauugcu

SEQ ID NO: 3544761 - RNA, 12 nt, Human
uggacagcccca

SEQ ID NO: 3544762 - RNA, 12 nt, Human
uggacagcuugu

SEQ ID NO: 3544763 - RNA, 16 nt, Human
uggacaggcauguucu

SEQ ID NO: 3544764 - RNA, 17 nt, Human
uggacaggucugggaga

SEQ ID NO: 3544765 - RNA, 20 nt, Human
uggacaggucugggagaggc

SEQ ID NO: 3544766 - RNA, 22 nt, Human
uggacaggucugggagaggcag

SEQ ID NO: 3544767 - RNA, 12 nt, Human
uggacaguccug

SEQ ID NO: 3544768 - RNA, 17 nt, Human
uggacaguccugggaga

SEQ ID NO: 3544769 - RNA, 17 nt, Human
uggacagucugcucuag

SEQ ID NO: 3544770 - RNA, 18 nt, Human
uggacaguucacacccug

SEQ ID NO: 3544771 - RNA, 22 nt, Human
uggacaguucacacccugcaag

SEQ ID NO: 3544772 - RNA, 19 nt, Human
uggacauagagagggagaa

SEQ ID NO: 3544773 - RNA, 23 nt, Human
uggacauagagagggagaagaag

SEQ ID NO: 3544774 - RNA, 19 nt, Human
uggacauagauauuuucac

SEQ ID NO: 3544775 - RNA, 14 nt, Human
uggacauccuccuc

SEQ ID NO: 3544776 - RNA, 18 nt, Human
uggacauccuccucccac

SEQ ID NO: 3544777 - RNA, 19 nt, Human
uggacauccucuucugcuu

SEQ ID NO: 3544778 - RNA, 13 nt, Human
uggacaugcacag

SEQ ID NO: 3544779 - RNA, 22 nt, Human
uggacauuguuggcagcauaaa

SEQ ID NO: 3544780 - RNA, 17 nt, Human
uggacauuuagaagaaa

SEQ ID NO: 3544781 - RNA, 22 nt, Human
uggacauuugccuugcuggacg

SEQ ID NO: 3544782 - RNA, 21 nt, Human
uggacauuuggguugguucca

SEQ ID NO: 3544783 - RNA, 17 nt, Human
uggacauuuuaugucuu

SEQ ID NO: 3544784 - RNA, 17 nt, Human
uggacauuuuuucaguc

SEQ ID NO: 3544785 - RNA, 22 nt, Human
uggaccaaaaaccaguauugua

SEQ ID NO: 3544786 - RNA, 21 nt, Human
uggaccaauagggcugagcuc

SEQ ID NO: 3544787 - RNA, 20 nt, Human
uggaccaauuauugauauau

SEQ ID NO: 3544788 - RNA, 15 nt, Human
uggaccacugggcaa

SEQ ID NO: 3544789 - RNA, 21 nt, Human
uggaccacuguuucuugcuug

SEQ ID NO: 3544790 - RNA, 22 nt, Human
uggaccacuguuucuugcuugu

SEQ ID NO: 3544791 - RNA, 18 nt, Human
uggaccaggacaggacca

SEQ ID NO: 3544792 - RNA, 20 nt, Human
uggaccauggaguggcagcc

SEQ ID NO: 3544793 - RNA, 14 nt, Human
uggaccauuuuccu

SEQ ID NO: 3544794 - RNA, 14 nt, Human
uggacccagacaca

SEQ ID NO: 3544795 - RNA, 13 nt, Human
uggaccccagaga

SEQ ID NO: 3544796 - RNA, 13 nt, Human
uggaccccagccu

SEQ ID NO: 3544797 - RNA, 15 nt, Human
uggaccccagcuggg

SEQ ID NO: 3544798 - RNA, 18 nt, Human
uggaccccagcugggagg

SEQ ID NO: 3544799 - RNA, 19 nt, Human
uggaccccagcugggaggc

SEQ ID NO: 3544800 - RNA, 23 nt, Human
uggaccccagcugggaggcaaga

SEQ ID NO: 3544801 - RNA, 22 nt, Human
uggaccccccuuucacaggcag

SEQ ID NO: 3544802 - RNA, 23 nt, Human
uggaccccccuuucacaggcagc

SEQ ID NO: 3544803 - RNA, 14 nt, Human
uggacccugaaaug

SEQ ID NO: 3544804 - RNA, 19 nt, Human
uggacccugaccagcuccc

SEQ ID NO: 3544805 - RNA, 12 nt, Human
uggacccugagg

SEQ ID NO: 3544806 - RNA, 19 nt, Human
uggagagggaaugugaaau

SEQ ID NO: 3544807 - RNA, 21 nt, Human
uggagagggaugaggugcugg

SEQ ID NO: 3544808 - RNA, 15 nt, Human
uggagaguaaaaacu

SEQ ID NO: 3544809 - RNA, 16 nt, Human
uggagagucagaucuu

SEQ ID NO: 3544810 - RNA, 16 nt, Human
uggagagugagcuaca

SEQ ID NO: 3544811 - RNA, 16 nt, Human
uggagauagggaaaga

SEQ ID NO: 3544812 - RNA, 19 nt, Human
uggagauauuuaugggggg

SEQ ID NO: 3544813 - RNA, 23 nt, Human
uggagauauuuauggggggagaa

SEQ ID NO: 3544814 - RNA, 16 nt, Human
uggagauccuccugca

SEQ ID NO: 3544815 - RNA, 14 nt, Human
uggagaugaggcca

SEQ ID NO: 3544816 - RNA, 18 nt, Human
uggagaugaggccagacc

SEQ ID NO: 3544817 - RNA, 15 nt, Human
uggagauggggagaa

SEQ ID NO: 3544818 - RNA, 14 nt, Human
uggagaugguggau

SEQ ID NO: 3544819 - RNA, 22 nt, Human
uggagaugucuucguacaguuc

SEQ ID NO: 3544820 - RNA, 13 nt, Human
uggagauguuuag

SEQ ID NO: 3544821 - RNA, 15 nt, Human
uggagauuauaauaa

SEQ ID NO: 3544822 - RNA, 22 nt, Human
uggagauuugaaggucugcaag

SEQ ID NO: 3544823 - RNA, 15 nt, Human
uggagcaaagcugau

SEQ ID NO: 3544824 - RNA, 18 nt, Human
uggagcaaucacagauga

SEQ ID NO: 3544825 - RNA, 15 nt, Human
uggagcacaaaauuc

SEQ ID NO: 3544826 - RNA, 16 nt, Human
uggagcacaaaauuca

SEQ ID NO: 3544827 - RNA, 17 nt, Human
uggagcacaaaauucaa

SEQ ID NO: 3544828 - RNA, 22 nt, Human
uggagcacaauaaauggcugua

SEQ ID NO: 3544829 - RNA, 21 nt, Human
uggagcacucugaguuuacca

SEQ ID NO: 3544830 - RNA, 12 nt, Human
uggagcacuggg

SEQ ID NO: 3544831 - RNA, 15 nt, Human
uggagcagaagcagc

SEQ ID NO: 3544832 - RNA, 20 nt, Human
uggagcagagcaagucugca

SEQ ID NO: 3544833 - RNA, 21 nt, Human
uggagcagagcaagucugcag

SEQ ID NO: 3544834 - RNA, 12 nt, Human
uggagcagaggg

SEQ ID NO: 3544835 - RNA, 17 nt, Human
uggagcagaggggcuga

SEQ ID NO: 3544836 - RNA, 19 nt, Human
uggagcagccuggagaccc

SEQ ID NO: 3544837 - RNA, 18 nt, Human
uggagcaggacucuauuu

SEQ ID NO: 3544838 - RNA, 22 nt, Human
uggagcaggcgguggggagaga

SEQ ID NO: 3544839 - RNA, 22 nt, Human
uggagcaguacaugggaaagga

SEQ ID NO: 3544840 - RNA, 17 nt, Human
uggagcaugggccuggc

SEQ ID NO: 3544841 - RNA, 18 nt, Human
uggagcaugggccuggcc

SEQ ID NO: 3544842 - RNA, 17 nt, Human
uggagcauuucucauca

SEQ ID NO: 3544843 - RNA, 21 nt, Human
uggagcauuucucaucaguag

SEQ ID NO: 3544844 - RNA, 15 nt, Human
uggagccaaguccag

SEQ ID NO: 3544845 - RNA, 16 nt, Human
uggagccacuaacuag

SEQ ID NO: 3544846 - RNA, 23 nt, Human
uggagcccagaggagggcagcag

SEQ ID NO: 3544847 - RNA, 18 nt, Human
uggagcccaggcgggagc

SEQ ID NO: 3544848 - RNA, 15 nt, Human
uggagcccagggagc

SEQ ID NO: 3544849 - RNA, 20 nt, Human
uggagcccagggagcggaaa

SEQ ID NO: 3544850 - RNA, 14 nt, Human
uggagcccagggca

SEQ ID NO: 3544851 - RNA, 14 nt, Human
uggagccccacacu

SEQ ID NO: 3544852 - RNA, 18 nt, Human
uggagccccacugcccuu

SEQ ID NO: 3544853 - RNA, 15 nt, Human
uggagccccagcccc

SEQ ID NO: 3544854 - RNA, 16 nt, Human
uggagcccgcaccccc

SEQ ID NO: 3544855 - RNA, 13 nt, Human
uggagcccuggag

SEQ ID NO: 3544856 - RNA, 14 nt, Human
uggagcccuggaga

SEQ ID NO: 3544857 - RNA, 15 nt, Human
uggagcccuuggguu

SEQ ID NO: 3544858 - RNA, 23 nt, Human
uggagccugcacggugaauggcu

SEQ ID NO: 3544859 - RNA, 16 nt, Human
uggagccugcagagcu

SEQ ID NO: 3544860 - RNA, 19 nt, Human
uggagccuggcacaggacu

SEQ ID NO: 3544861 - RNA, 21 nt, Human
uggagccuggcacaggacuga

SEQ ID NO: 3544862 - RNA, 12 nt, Human
uggagccugugu

SEQ ID NO: 3544863 - RNA, 14 nt, Human
uggagccuguguaa

SEQ ID NO: 3544864 - RNA, 16 nt, Human
uggagccuguguaaca

SEQ ID NO: 3544865 - RNA, 20 nt, Human
uggagccuguguaacagcuc

SEQ ID NO: 3544866 - RNA, 19 nt, Human
uggagccuuugaauaaaaa

SEQ ID NO: 3544867 - RNA, 16 nt, Human
uggagcgcaccugccc

SEQ ID NO: 3544868 - RNA, 15 nt, Human
uggagcguggacugg

SEQ ID NO: 3544869 - RNA, 22 nt, Human
uggagcucagccccgagcuguc

SEQ ID NO: 3544870 - RNA, 15 nt, Human
uggagcuccagccug

SEQ ID NO: 3544871 - RNA, 12 nt, Human
uggagcuccugg

SEQ ID NO: 3544872 - RNA, 20 nt, Human
uggagcuccugggaaggcua

SEQ ID NO: 3544873 - RNA, 14 nt, Human
uggagcucguggaa

SEQ ID NO: 3544874 - RNA, 21 nt, Human
uggagcugaggacucucacga

SEQ ID NO: 3544875 - RNA, 19 nt, Human
uggagcuuaagccacugcc

SEQ ID NO: 3544876 - RNA, 20 nt, Human
uggagcuuaagccacugccu

SEQ ID NO: 3544877 - RNA, 22 nt, Human
uggagcuuaagccacugccucu

SEQ ID NO: 3544878 - RNA, 23 nt, Human
uggagcuucucuuuaacucagga

SEQ ID NO: 3544879 - RNA, 19 nt, Human
uggaggaacacuugaugga

SEQ ID NO: 3544880 - RNA, 23 nt, Human
uggaggaaggaaacccagcucug

SEQ ID NO: 3544881 - RNA, 20 nt, Human
uggaggaaggauuguaaaaa

SEQ ID NO: 3544882 - RNA, 20 nt, Human
uggaggaccaaaaaaauaag

SEQ ID NO: 3544883 - RNA, 16 nt, Human
uggaggaccugagccu

SEQ ID NO: 3544884 - RNA, 17 nt, Human
uggaggaccugagccug

SEQ ID NO: 3544885 - RNA, 19 nt, Human
uggaggacuagaaccugga

SEQ ID NO: 3544886 - RNA, 20 nt, Human
uggaggacuagaaccuggag

SEQ ID NO: 3544887 - RNA, 15 nt, Human
uggaggagagccugg

SEQ ID NO: 3544888 - RNA, 13 nt, Human
uggaggagcagug

SEQ ID NO: 3544889 - RNA, 22 nt, Human
uggaggagcucaggacacuaau

SEQ ID NO: 3544890 - RNA, 13 nt, Human
uggaggaggaagg

SEQ ID NO: 3544891 - RNA, 15 nt, Human
uggaggaggaaggca

SEQ ID NO: 3544892 - RNA, 16 nt, Human
uggaggaggaaggcaa

SEQ ID NO: 3544893 - RNA, 16 nt, Human
uggaggaggagcaggg

SEQ ID NO: 3544894 - RNA, 14 nt, Human
uggaggaggaggca

SEQ ID NO: 3544895 - RNA, 15 nt, Human
uggaggaggaggcaa

SEQ ID NO: 3544896 - RNA, 23 nt, Human
uggaggaggccugggggcaggga

SEQ ID NO: 3544897 - RNA, 21 nt, Human
uggaggauccccuccaagccu

SEQ ID NO: 3544898 - RNA, 20 nt, Human
uggaggcaauccuaccuugc

SEQ ID NO: 3544899 - RNA, 17 nt, Human
uggaggcacacagcugc

SEQ ID NO: 3544900 - RNA, 18 nt, Human
uggaggcacacagcugca

SEQ ID NO: 3544901 - RNA, 22 nt, Human
uggaggcacacagcugcagaga

SEQ ID NO: 3544902 - RNA, 18 nt, Human
uggaggcagccagggcuu

SEQ ID NO: 3544903 - RNA, 22 nt, Human
uggaggcagggccuugcccaga

SEQ ID NO: 3544904 - RNA, 17 nt, Human
uggaggcaggggcuucc

SEQ ID NO: 3544905 - RNA, 18 nt, Human
uggaggcaggggcuuccu

SEQ ID NO: 3544906 - RNA, 20 nt, Human
uggaggcauugaugcaugcu

SEQ ID NO: 3544907 - RNA, 14 nt, Human
uggaggccagccag

SEQ ID NO: 3544908 - RNA, 15 nt, Human
uggaggcccaguuca

SEQ ID NO: 3544909 - RNA, 13 nt, Human
uggaggccccugg

SEQ ID NO: 3544910 - RNA, 16 nt, Human
uggaggccccuggagc

SEQ ID NO: 3544911 - RNA, 21 nt, Human
uggaggcccuccugugcuggg

SEQ ID NO: 3544912 - RNA, 21 nt, Human
uggaggccgggugcucagggc

SEQ ID NO: 3544913 - RNA, 18 nt, Human
uguaacuguuacaguaau

SEQ ID NO: 3544914 - RNA, 17 nt, Human
uguaacuuauguagaua

SEQ ID NO: 3544915 - RNA, 16 nt, Human
uguaacuugcuuaaau

SEQ ID NO: 3544916 - RNA, 17 nt, Human
uguaacuuucugaaaua

SEQ ID NO: 3544917 - RNA, 21 nt, Human
uguaacuuugguuaaaaucuc

SEQ ID NO: 3544918 - RNA, 15 nt, Human
uguaacuuuuguaag

SEQ ID NO: 3544919 - RNA, 16 nt, Human
uguaacuuuuguaaga

SEQ ID NO: 3544920 - RNA, 20 nt, Human
uguaacuuuuguaagacaaa

SEQ ID NO: 3544921 - RNA, 22 nt, Human
uguaagaaaccaaucaagauaa

SEQ ID NO: 3544922 - RNA, 24 nt, Human
uguaagaaaccaaucaagauaaag

SEQ ID NO: 3544923 - RNA, 15 nt, Human
uguaagaaauacaga

SEQ ID NO: 3544924 - RNA, 17 nt, Human
uguaagaaggcaauauu

SEQ ID NO: 3544925 - RNA, 12 nt, Human
uguaagaauaau

SEQ ID NO: 3544926 - RNA, 22 nt, Human
uguaagaauaggcauuaacaca

SEQ ID NO: 3544927 - RNA, 15 nt, Human
uguaagaaucauugu

SEQ ID NO: 3544928 - RNA, 18 nt, Human
uguaagacccuuauugcu

SEQ ID NO: 3544929 - RNA, 18 nt, Human
uguaagagcaccuuccuc

SEQ ID NO: 3544930 - RNA, 18 nt, Human
uguaagaguguagaagca

SEQ ID NO: 3544931 - RNA, 19 nt, Human
uguaagaguguagaagcau

SEQ ID NO: 3544932 - RNA, 20 nt, Human
uguaagaguguagaagcauu

SEQ ID NO: 3544933 - RNA, 21 nt, Human
uguaagaguguagaagcauuc

SEQ ID NO: 3544934 - RNA, 20 nt, Human
uguaagaucguucucugccu

SEQ ID NO: 3544935 - RNA, 21 nt, Human
uguaagauuauagauucuaaa

SEQ ID NO: 3544936 - RNA, 13 nt, Human
uguaagauuuguu

SEQ ID NO: 3544937 - RNA, 21 nt, Human
uguaagauuuguuuuuaaacu

SEQ ID NO: 3544938 - RNA, 23 nt, Human
uguaagauuuguuuuuaaacugu

SEQ ID NO: 3544939 - RNA, 17 nt, Human
uguaagcacucuggaug

SEQ ID NO: 3544940 - RNA, 19 nt, Human
uguaagcaggagagaaauu

SEQ ID NO: 3544941 - RNA, 20 nt, Human
uguaagccaaagaaaugaac

SEQ ID NO: 3544942 - RNA, 21 nt, Human
uguaagccaaagaaaugaaca

SEQ ID NO: 3544943 - RNA, 15 nt, Human
uguaagccugcaagc

SEQ ID NO: 3544944 - RNA, 15 nt, Human
uguaagcucuuugaa

SEQ ID NO: 3544945 - RNA, 14 nt, Human
uguaagcuguuuau

SEQ ID NO: 3544946 - RNA, 16 nt, Human
uguaagcuguuuauuu

SEQ ID NO: 3544947 - RNA, 13 nt, Human
uguaaggaaugau

SEQ ID NO: 3544948 - RNA, 15 nt, Human
uguaaggaaugcuug

SEQ ID NO: 3544949 - RNA, 21 nt, Human
uguaaggauccggaaagaaga

SEQ ID NO: 3544950 - RNA, 22 nt, Human
uggccguugauguuggcuggga

SEQ ID NO: 3544951 - RNA, 21 nt, Human
uggccuaaaacuggccugacu

SEQ ID NO: 3544952 - RNA, 22 nt, Human
uggccuaagaggcugcccuccu

SEQ ID NO: 3544953 - RNA, 18 nt, Human
uggccuagaccagcagac

SEQ ID NO: 3544954 - RNA, 21 nt, Human
uggccuagaccagcagacaga

SEQ ID NO: 3544955 - RNA, 18 nt, Human
uggccuagcccacccugc

SEQ ID NO: 3544956 - RNA, 19 nt, Human
uggccuagcccacccugcu

SEQ ID NO: 3544957 - RNA, 23 nt, Human
uggccuagcccacccugcugccu

SEQ ID NO: 3544958 - RNA, 21 nt, Human
uggccuaggagauaucugagg

SEQ ID NO: 3544959 - RNA, 18 nt, Human
uggccuauccgcugccag

SEQ ID NO: 3544960 - RNA, 15 nt, Human
uggccuaucuccuag

SEQ ID NO: 3544961 - RNA, 16 nt, Human
uggccuaucuccuagg

SEQ ID NO: 3544962 - RNA, 20 nt, Human
uggccuaugcacauauggac

SEQ ID NO: 3544963 - RNA, 20 nt, Human
uggccuauuauauuaaaaua

SEQ ID NO: 3544964 - RNA, 15 nt, Human
uggccucaaagcaag

SEQ ID NO: 3544965 - RNA, 21 nt, Human
uggccucaacccucccucagc

SEQ ID NO: 3544966 - RNA, 22 nt, Human
uggccucaacccucccucagcc

SEQ ID NO: 3544967 - RNA, 23 nt, Human
uggccucaacccucccucagccc

SEQ ID NO: 3544968 - RNA, 17 nt, Human
guuuaauauuuaaacag

SEQ ID NO: 3544969 - RNA, 19 nt, Human
guuuaaucauauaaauaga

SEQ ID NO: 3544970 - RNA, 21 nt, Human
guuuaauccccaguaaaauug

SEQ ID NO: 3544971 - RNA, 20 nt, Human
guuuaaugaagaucuaaaua

SEQ ID NO: 3544972 - RNA, 15 nt, Human
guuuaaugugaacuu

SEQ ID NO: 3544973 - RNA, 21 nt, Human
guuuaaugugaacuuguagcu

SEQ ID NO: 3544974 - RNA, 14 nt, Human
guuuaauuuaaagc

SEQ ID NO: 3544975 - RNA, 15 nt, Human
guuuaauuuaaagcc

SEQ ID NO: 3544976 - RNA, 19 nt, Human
guuuacaaaaucagguaac

SEQ ID NO: 3544977 - RNA, 20 nt, Human
guuuacaaauggacauagga

SEQ ID NO: 3544978 - RNA, 19 nt, Human
guuuacaagcccccccuuc

SEQ ID NO: 3544979 - RNA, 19 nt, Human
guuuacaaguguauaucag

SEQ ID NO: 3544980 - RNA, 23 nt, Human
guuuacaauuuacaaagugugua

SEQ ID NO: 3544981 - RNA, 16 nt, Human
guuuacacucuuugua

SEQ ID NO: 3544982 - RNA, 13 nt, Human
guuuacagaaaaa

SEQ ID NO: 3544983 - RNA, 19 nt, Human
guuuacagcucugacuuua

SEQ ID NO: 3544984 - RNA, 19 nt, Human
guuuacagggagccuccug

SEQ ID NO: 3544985 - RNA, 13 nt, Human
guuuacagugaag

SEQ ID NO: 3544986 - RNA, 15 nt, Human
guuuacaguguuccg

SEQ ID NO: 3544987 - RNA, 14 nt, Human
guuuacaugcuuau

SEQ ID NO: 3544988 - RNA, 11 nt, Human
guuuacaugua

SEQ ID NO: 3544989 - RNA, 18 nt, Human
guuuacauuuaaagcauu

SEQ ID NO: 3544990 - RNA, 17 nt, Human
guuuaccauuuguaaua

SEQ ID NO: 3544991 - RNA, 20 nt, Human
guuuaccauuuguaauaaag

SEQ ID NO: 3544992 - RNA, 17 nt, Human
guuuaccauuuuucauu

SEQ ID NO: 3544993 - RNA, 22 nt, Human
guuuaccugaauaaaugguagu

SEQ ID NO: 3544994 - RNA, 23 nt, Human
guuuaccuuuuaauuaaugaaau

SEQ ID NO: 3544995 - RNA, 16 nt, Human
guuuacuaugccugug

SEQ ID NO: 3544996 - RNA, 15 nt, Human
guuuacucacagcca

SEQ ID NO: 3544997 - RNA, 16 nt, Human
guuuacucacagccag

SEQ ID NO: 3544998 - RNA, 17 nt, Human
guuuacucacagccagc

SEQ ID NO: 3544999 - RNA, 16 nt, Human
guuuacuuaaagauuu

SEQ ID NO: 3545000 - RNA, 17 nt, Human
guuuacuuuucagggca

SEQ ID NO: 3545001 - RNA, 23 nt, Human
guuuagaauugaagguuuuugau

SEQ ID NO: 3545002 - RNA, 22 nt, Human
guuuagaccaaggaacaaaaaa

SEQ ID NO: 3545003 - RNA, 17 nt, Human
guuuagaugaaugucag

SEQ ID NO: 3545004 - RNA, 14 nt, Human
guuuagauuucaag

SEQ ID NO: 3545005 - RNA, 20 nt, Human
guuuagcugacaaaauacuu

SEQ ID NO: 3545006 - RNA, 18 nt, Human
guuuagucuugucucaga

SEQ ID NO: 3545007 - RNA, 18 nt, Human
guuuaguggcucaacauu

SEQ ID NO: 3545008 - RNA, 15 nt, Human
guuuaguguaaaaau

SEQ ID NO: 3545009 - RNA, 17 nt, Human
guuuaguguaaaaauga

SEQ ID NO: 3545010 - RNA, 21 nt, Human
guuuagugugguuuucuguuu

SEQ ID NO: 3545011 - RNA, 16 nt, Human
guuuaguuugcauuua

SEQ ID NO: 3545012 - RNA, 18 nt, Human
guuuauacaguuuuaaag

SEQ ID NO: 3545013 - RNA, 20 nt, Human
guuuauacuccaguguacau

SEQ ID NO: 3545014 - RNA, 21 nt, Human
guuuauagagggccaagacuu

SEQ ID NO: 3545015 - RNA, 15 nt, Human
guuuauaucuccuuu

SEQ ID NO: 3545016 - RNA, 19 nt, Human
guuuauaucucucaugcau

SEQ ID NO: 3545017 - RNA, 18 nt, Human
guuuauauguguugaaaa

SEQ ID NO: 3545018 - RNA, 21 nt, Human
guuuaucagaaagggcagaag

SEQ ID NO: 3545019 - RNA, 19 nt, Human
guuuaucagauacaucacu

SEQ ID NO: 3545020 - RNA, 15 nt, Human
guuuaucaugaagcc

SEQ ID NO: 3545021 - RNA, 15 nt, Human
guuuauccuuucaua

SEQ ID NO: 3545022 - RNA, 15 nt, Human
guuuaucuagaugua

SEQ ID NO: 3545023 - RNA, 13 nt, Human
guuuaugagccag

SEQ ID NO: 3545024 - RNA, 21 nt, Human
guuuaugauaauaaaggcacc

SEQ ID NO: 3545025 - RNA, 15 nt, Human
guuuaugcagugcug

SEQ ID NO: 3545026 - RNA, 18 nt, Human
guuuaugcagugcugcuu

SEQ ID NO: 3545027 - RNA, 18 nt, Human
guuuauggccacauuuaa

SEQ ID NO: 3545028 - RNA, 14 nt, Human
guuuauggccucag

SEQ ID NO: 3545029 - RNA, 19 nt, Human
guuuauguaaacaaaucuu

SEQ ID NO: 3545030 - RNA, 13 nt, Human
guuuaugugugug

SEQ ID NO: 3545031 - RNA, 15 nt, Human
guuuauuaaaugcuu

SEQ ID NO: 3545032 - RNA, 15 nt, Human
guuuauuaaauugca

SEQ ID NO: 3545033 - RNA, 13 nt, Human
guuuauuaacaaa

SEQ ID NO: 3545034 - RNA, 14 nt, Human
guuuauuaaucuua

SEQ ID NO: 3545035 - RNA, 21 nt, Human
guuuauuaaucuuaguguaug

SEQ ID NO: 3545036 - RNA, 20 nt, Human
guuuauuacuuccaugaauu

SEQ ID NO: 3545037 - RNA, 19 nt, Human
guuuauucaaacugaaaag

SEQ ID NO: 3545038 - RNA, 14 nt, Human
guuuauucauaugc

SEQ ID NO: 3545039 - RNA, 17 nt, Human
guuuauucauaugcaua

SEQ ID NO: 3545040 - RNA, 19 nt, Human
guuuauucauaugcauauu

SEQ ID NO: 3545041 - RNA, 15 nt, Human
guuuauucuucuaga

SEQ ID NO: 3545042 - RNA, 16 nt, Human
guuuauucuugaugaa

SEQ ID NO: 3545043 - RNA, 17 nt, Human
guuuauucuugaugaaa

SEQ ID NO: 3545044 - RNA, 21 nt, Human
guuuauugaguuuguagguaa

SEQ ID NO: 3545045 - RNA, 13 nt, Human
guuuauugucaaa

SEQ ID NO: 3545046 - RNA, 22 nt, Human
guuuauuuaacuuuuaguaaag

SEQ ID NO: 3545047 - RNA, 14 nt, Human
guuuauuuaucagu

SEQ ID NO: 3545048 - RNA, 17 nt, Human
guuuauuuauucugcau

SEQ ID NO: 3545049 - RNA, 12 nt, Human
guuuauuuccaa

SEQ ID NO: 3545050 - RNA, 16 nt, Human
guuuauuuuucauauu

SEQ ID NO: 3545051 - RNA, 20 nt, Human
guuucaaaaacacaguguuu

SEQ ID NO: 3545052 - RNA, 17 nt, Human
guuucaaaaacuguauu

SEQ ID NO: 3545053 - RNA, 15 nt, Human
guuucaaaaaucuga

SEQ ID NO: 3545054 - RNA, 23 nt, Human
guuucaaaauaaaaaccaagaag

SEQ ID NO: 3545055 - RNA, 13 nt, Human
guuucaaacuuua

SEQ ID NO: 3545056 - RNA, 14 nt, Human
guuucaaacuuuac

SEQ ID NO: 3545057 - RNA, 16 nt, Human
guuucaaacuuuacua

SEQ ID NO: 3545058 - RNA, 19 nt, Human
guuucaaggcacucuagau

SEQ ID NO: 3545059 - RNA, 12 nt, Human
guuucaauaaag

SEQ ID NO: 3545060 - RNA, 17 nt, Human
guuucaauaaaguuuga

SEQ ID NO: 3545061 - RNA, 14 nt, Human
guuucaaucacugu

SEQ ID NO: 3545062 - RNA, 13 nt, Human
guuucaaugugau

SEQ ID NO: 3545063 - RNA, 22 nt, Human
guuucaauuccaccugcaauca

SEQ ID NO: 3545064 - RNA, 19 nt, Human
guuucacaaggucuuuaaa

SEQ ID NO: 3545065 - RNA, 15 nt, Human
guuucacacaaacaa

SEQ ID NO: 3545066 - RNA, 18 nt, Human
guuucacaguuugaaaua

SEQ ID NO: 3545067 - RNA, 22 nt, Human
guuucaccaugauggccaggcu

SEQ ID NO: 3545068 - RNA, 22 nt, Human
guuucaccauguuggccaggcu

SEQ ID NO: 3545069 - RNA, 21 nt, Human
guuucacccuuaacccaagga

SEQ ID NO: 3545070 - RNA, 22 nt, Human
guuucacccuuaacccaaggag

SEQ ID NO: 3545071 - RNA, 18 nt, Human
guuucagaaauguguuau

SEQ ID NO: 3545072 - RNA, 21 nt, Human
guuucagauauauaucauauu

SEQ ID NO: 3545073 - RNA, 21 nt, Human
guuucagugucaaauaaacac

SEQ ID NO: 3545074 - RNA, 22 nt, Human
guuucagugucaaauaaacacu

SEQ ID NO: 3545075 - RNA, 23 nt, Human
guuucagugucaaauaaacacug

SEQ ID NO: 3545076 - RNA, 18 nt, Human
guuucaguuuguuggaaa

SEQ ID NO: 3545077 - RNA, 21 nt, Human
guuucaguuuguuggaaagua

SEQ ID NO: 3545078 - RNA, 18 nt, Human
guuucauaauuguguacu

SEQ ID NO: 3545079 - RNA, 17 nt, Human
guuucauaggagacaca

SEQ ID NO: 3545080 - RNA, 14 nt, Human
guuucauauuucuu

SEQ ID NO: 3545081 - RNA, 18 nt, Human
guuucauguaauccucaa

SEQ ID NO: 3545082 - RNA, 20 nt, Human
guuucauugcgaaucuuuuu

SEQ ID NO: 3545083 - RNA, 14 nt, Human
guuucauuuugguu

SEQ ID NO: 3545084 - RNA, 15 nt, Human
guuuccaaggagcug

SEQ ID NO: 3545085 - RNA, 14 nt, Human
guuuccacaugcuc

SEQ ID NO: 3545086 - RNA, 16 nt, Human
guuuccagcauuccca

SEQ ID NO: 3545087 - RNA, 14 nt, Human
guuuccauaguuua

SEQ ID NO: 3545088 - RNA, 13 nt, Human
guuucccauaauu

SEQ ID NO: 3545089 - RNA, 19 nt, Human
guuucccaucccacugcuc

SEQ ID NO: 3545090 - RNA, 21 nt, Human
guuuccccacaaaacaaagca

SEQ ID NO: 3545091 - RNA, 20 nt, Human
guuuccccaccagugaauga

SEQ ID NO: 3545092 - RNA, 22 nt, Human
guuuccuaaaauaucugggugg

SEQ ID NO: 3545093 - RNA, 15 nt, Human
guuuccuaaauccaa

SEQ ID NO: 3545094 - RNA, 14 nt, Human
ugucauuuucauua

SEQ ID NO: 3545095 - RNA, 13 nt, Human
ugucauuuuggua

SEQ ID NO: 3545096 - RNA, 19 nt, Human
uguccaaaaccgccagcuc

SEQ ID NO: 3545097 - RNA, 20 nt, Human
uguccaaaaccgccagcucu

SEQ ID NO: 3545098 - RNA, 21 nt, Human
uguccaaaaccgccagcucug

SEQ ID NO: 3545099 - RNA, 22 nt, Human
uguccaaaaccgccagcucugu

SEQ ID NO: 3545100 - RNA, 15 nt, Human
uguccaaaacugccu

SEQ ID NO: 3545101 - RNA, 23 nt, Human
uguccaaaccaaccgcacaugca

SEQ ID NO: 3545102 - RNA, 15 nt, Human
uguccaaacugccua

SEQ ID NO: 3545103 - RNA, 17 nt, Human
uguccaaagaggcugcc

SEQ ID NO: 3545104 - RNA, 18 nt, Human
uguccaaagcagggucug

SEQ ID NO: 3545105 - RNA, 15 nt, Human
uguccaaccuaaccc

SEQ ID NO: 3545106 - RNA, 22 nt, Human
uguccaaccuaaccccuuuccu

SEQ ID NO: 3545107 - RNA, 22 nt, Human
uguccaacuaaaaacaaacccu

SEQ ID NO: 3545108 - RNA, 13 nt, Human
uguccaacuccag

SEQ ID NO: 3545109 - RNA, 23 nt, Human
uguccaacugagaaguaccuuau

SEQ ID NO: 3545110 - RNA, 17 nt, Human
uguccacauagguuuag

SEQ ID NO: 3545111 - RNA, 21 nt, Human
uguccacccaccuaugugcca

SEQ ID NO: 3545112 - RNA, 11 nt, Human
uguccaccccc

SEQ ID NO: 3545113 - RNA, 11 nt, Human
uguccaccugg

SEQ ID NO: 3545114 - RNA, 20 nt, Human
uguccagaagaauauucagg

SEQ ID NO: 3545115 - RNA, 12 nt, Human
uguccagagaca

SEQ ID NO: 3545116 - RNA, 20 nt, Human
uguccagagcugcuuccccg

SEQ ID NO: 3545117 - RNA, 19 nt, Human
uguccagcaccuugugccu

SEQ ID NO: 3545118 - RNA, 20 nt, Human
uguccagcaccuugugccug

SEQ ID NO: 3545119 - RNA, 14 nt, Human
uguccagccugggc

SEQ ID NO: 3545120 - RNA, 16 nt, Human
uguccagcuccaaccu

SEQ ID NO: 3545121 - RNA, 20 nt, Human
uguccagcuccaaccugcaa

SEQ ID NO: 3545122 - RNA, 19 nt, Human
uguccaggcacugcugccc

SEQ ID NO: 3545123 - RNA, 20 nt, Human
uguccaggcacugcugccca

SEQ ID NO: 3545124 - RNA, 19 nt, Human
uguccagggcccugagcuc

SEQ ID NO: 3545125 - RNA, 17 nt, Human
uguccaguaagaucacu

SEQ ID NO: 3545126 - RNA, 20 nt, Human
uguccaguaagaucacuguu

SEQ ID NO: 3545127 - RNA, 13 nt, Human
guuucuauacaaa

SEQ ID NO: 3545128 - RNA, 15 nt, Human
guuucuauacaaaua

SEQ ID NO: 3545129 - RNA, 23 nt, Human
guuucuauacaaauauaaaucuu

SEQ ID NO: 3545130 - RNA, 22 nt, Human
guuucuaugacacaugcaaggu

SEQ ID NO: 3545131 - RNA, 18 nt, Human
guuucuaugcaaaguucu

SEQ ID NO: 3545132 - RNA, 13 nt, Human
guuucuauuuucu

SEQ ID NO: 3545133 - RNA, 19 nt, Human
guuucucagauccuuguuu

SEQ ID NO: 3545134 - RNA, 21 nt, Human
guuucucagauccuuguuuca

SEQ ID NO: 3545135 - RNA, 14 nt, Human
guuucucauucuug

SEQ ID NO: 3545136 - RNA, 15 nt, Human
guuucucauuuguuu

SEQ ID NO: 3545137 - RNA, 18 nt, Human
guuucuccaaacugaagc

SEQ ID NO: 3545138 - RNA, 14 nt, Human
guuucucccaguuc

SEQ ID NO: 3545139 - RNA, 15 nt, Human
guuucucccccuggg

SEQ ID NO: 3545140 - RNA, 23 nt, Human
guuucucugccgcuaccucccuc

SEQ ID NO: 3545141 - RNA, 21 nt, Human
guuucucuucuccccuuccau

SEQ ID NO: 3545142 - RNA, 20 nt, Human
guuucucuugagcuggccuc

SEQ ID NO: 3545143 - RNA, 21 nt, Human
guuucucuuuccuuggcuccc

SEQ ID NO: 3545144 - RNA, 22 nt, Human
guuucucuuugauuauuugcau

SEQ ID NO: 3545145 - RNA, 14 nt, Human
guuucugaaaagaa

SEQ ID NO: 3545146 - RNA, 16 nt, Human
guuucugaaaauucca

SEQ ID NO: 3545147 - RNA, 18 nt, Human
guuucugaaagggacgcu

SEQ ID NO: 3545148 - RNA, 12 nt, Human
guuucugacucu

SEQ ID NO: 3545149 - RNA, 13 nt, Human
guuucugacucug

SEQ ID NO: 3545150 - RNA, 13 nt, Human
guuucugagaaaa

SEQ ID NO: 3545151 - RNA, 17 nt, Human
guuucugagaaaagaac

SEQ ID NO: 3545152 - RNA, 16 nt, Human
guuucugaguuuuacc

SEQ ID NO: 3545153 - RNA, 17 nt, Human
guuucugaguuuuacca

SEQ ID NO: 3545154 - RNA, 20 nt, Human
guuucugcaguagucucugu

SEQ ID NO: 3545155 - RNA, 13 nt, Human
guuucugcccugc

SEQ ID NO: 3545156 - RNA, 14 nt, Human
guuucugccgcagc

SEQ ID NO: 3545157 - RNA, 15 nt, Human
guuucugccgcagcc

SEQ ID NO: 3545158 - RNA, 16 nt, Human
guuucugccucugagg

SEQ ID NO: 3545159 - RNA, 23 nt, Human
guuucuggguccugaagaauuaa

SEQ ID NO: 3545160 - RNA, 21 nt, Human
guuucugguggucuguuggca

SEQ ID NO: 3545161 - RNA, 10 nt, Human
guuucuguac

SEQ ID NO: 3545162 - RNA, 20 nt, Human
guuucuguacuuuuuggcau

SEQ ID NO: 3545163 - RNA, 17 nt, Human
guuucuguccugcuggu

SEQ ID NO: 3545164 - RNA, 22 nt, Human
guuucugucguuaaaaacagau

SEQ ID NO: 3545165 - RNA, 17 nt, Human
guuucugugcauggugg

SEQ ID NO: 3545166 - RNA, 14 nt, Human
guuucuguuauuaa

SEQ ID NO: 3545167 - RNA, 14 nt, Human
guuucuguuuaacu

SEQ ID NO: 3545168 - RNA, 19 nt, Human
guuucuguuuaacuucuua

SEQ ID NO: 3545169 - RNA, 16 nt, Human
guuucuuaauuuggaa

SEQ ID NO: 3545170 - RNA, 11 nt, Human
guuucuuagac

SEQ ID NO: 3545171 - RNA, 11 nt, Human
guuucuuccaa

SEQ ID NO: 3545172 - RNA, 20 nt, Human
guuucuucuaacugccccuc

SEQ ID NO: 3545173 - RNA, 17 nt, Human
guuucuugcaagcaugc

SEQ ID NO: 3545174 - RNA, 13 nt, Human
guuucuugccuca

SEQ ID NO: 3545175 - RNA, 14 nt, Human
guuucuugccucau

SEQ ID NO: 3545176 - RNA, 14 nt, Human
guuucuugcuugua

SEQ ID NO: 3545177 - RNA, 13 nt, Human
guuucuugguaaa

SEQ ID NO: 3545178 - RNA, 17 nt, Human
guuucuuuaagaaagua

SEQ ID NO: 3545179 - RNA, 16 nt, Human
guuucuuuaguuuuug

SEQ ID NO: 3545180 - RNA, 18 nt, Human
guuucuuucaaagaagcc

SEQ ID NO: 3545181 - RNA, 23 nt, Human
guuucuuucuaguggucuuugua

SEQ ID NO: 3545182 - RNA, 17 nt, Human
guuucuuugaauuuuca

SEQ ID NO: 3545183 - RNA, 21 nt, Human
guuucuuuuguauguaaaugu

SEQ ID NO: 3545184 - RNA, 20 nt, Human
guuugaaaacuucagaagca

SEQ ID NO: 3545185 - RNA, 21 nt, Human
guuugaaaacuucagaagcaa

SEQ ID NO: 3545186 - RNA, 15 nt, Human
guuugaaaagcaaua

SEQ ID NO: 3545187 - RNA, 20 nt, Human
guuugaaaagcaauauugua

SEQ ID NO: 3545188 - RNA, 13 nt, Human
guuugaaaauagu

SEQ ID NO: 3545189 - RNA, 16 nt, Human
guuugaaaauaguuua

SEQ ID NO: 3545190 - RNA, 20 nt, Human
guuugaaaugaggucuguuu

SEQ ID NO: 3545191 - RNA, 22 nt, Human
guuugaaauucugaauuugcaa

SEQ ID NO: 3545192 - RNA, 16 nt, Human
guuugaaccaagaacu

SEQ ID NO: 3545193 - RNA, 15 nt, Human
guuugaagccugccc

SEQ ID NO: 3545194 - RNA, 14 nt, Human
guuugaagccugga

SEQ ID NO: 3545195 - RNA, 17 nt, Human
guuugaaggaaacaguu

SEQ ID NO: 3545196 - RNA, 13 nt, Human
guuugaauauaaa

SEQ ID NO: 3545197 - RNA, 19 nt, Human
guuugaauauaaacacuau

SEQ ID NO: 3545198 - RNA, 14 nt, Human
guuugaauguuaaa

SEQ ID NO: 3545199 - RNA, 16 nt, Human
guuugaauguuaaaua

SEQ ID NO: 3545200 - RNA, 16 nt, Human
guuugacggcaagguu

SEQ ID NO: 3545201 - RNA, 16 nt, Human
guuugacuagaugaug

SEQ ID NO: 3545202 - RNA, 15 nt, Human
guuugagaagcacug

SEQ ID NO: 3545203 - RNA, 15 nt, Human
guuugagaugcugua

SEQ ID NO: 3545204 - RNA, 15 nt, Human
guuugagauucucaa

SEQ ID NO: 3545205 - RNA, 13 nt, Human
guuugagcucaga

SEQ ID NO: 3545206 - RNA, 15 nt, Human
guuugagcucagacc

SEQ ID NO: 3545207 - RNA, 16 nt, Human
guuugagcucagaccc

SEQ ID NO: 3545208 - RNA, 23 nt, Human
guuugaggauauauuuucacuuu

SEQ ID NO: 3545209 - RNA, 16 nt, Human
guuugagguuuuuaag

SEQ ID NO: 3545210 - RNA, 20 nt, Human
guuugaucacacuauuuuag

SEQ ID NO: 3545211 - RNA, 14 nt, Human
guuugauccuuguu

SEQ ID NO: 3545212 - RNA, 22 nt, Human
guuugaugcaggcacuuauugu

SEQ ID NO: 3545213 - RNA, 20 nt, Human
guuugaugcauuaaaagaaa

SEQ ID NO: 3545214 - RNA, 18 nt, Human
guuugcaaaaaauguuuu

SEQ ID NO: 3545215 - RNA, 15 nt, Human
guuugcacacuugug

SEQ ID NO: 3545216 - RNA, 15 nt, Human
guuugcaccuguccc

SEQ ID NO: 3545217 - RNA, 23 nt, Human
guuugcacucaaaucuuaagaaa

SEQ ID NO: 3545218 - RNA, 15 nt, Human
guuugcacuuccucu

SEQ ID NO: 3545219 - RNA, 20 nt, Human
guuugcagagcuugaacaca

SEQ ID NO: 3545220 - RNA, 16 nt, Human
guuugcaggggugacg

SEQ ID NO: 3545221 - RNA, 14 nt, Human
guuugccauacuuu

SEQ ID NO: 3545222 - RNA, 22 nt, Human
guuugccauacuuugucugaaa

SEQ ID NO: 3545223 - RNA, 14 nt, Human
guuugccccguucu

SEQ ID NO: 3545224 - RNA, 16 nt, Human
guuugccucugccucu

SEQ ID NO: 3545225 - RNA, 17 nt, Human
guuugccucugccucug

SEQ ID NO: 3545226 - RNA, 18 nt, Human
guuugccuuccuuucucc

SEQ ID NO: 3545227 - RNA, 16 nt, Human
guuugcuaucuuaauu

SEQ ID NO: 3545228 - RNA, 20 nt, Human
guuugcugaacauuggagaa

SEQ ID NO: 3545229 - RNA, 12 nt, Human
guuugcugcuau

SEQ ID NO: 3545230 - RNA, 14 nt, Human
guuugcuuauuguu

SEQ ID NO: 3545231 - RNA, 17 nt, Human
guuugcuuguuucuugg

SEQ ID NO: 3545232 - RNA, 21 nt, Human
guuugcuuucugaucaaggcc

SEQ ID NO: 3545233 - RNA, 17 nt, Human
guuuggaaaaguggcgu

SEQ ID NO: 3545234 - RNA, 18 nt, Human
guuuggaccaaaaaccag

SEQ ID NO: 3545235 - RNA, 18 nt, Human
guuuggaccccagcuggg

SEQ ID NO: 3545236 - RNA, 21 nt, Human
guuuggacugcagaagcaagg

SEQ ID NO: 3545237 - RNA, 13 nt, Human
guuuggagacauu

SEQ ID NO: 3545238 - RNA, 21 nt, Human
guuuggagagagcagacuggc

SEQ ID NO: 3545239 - RNA, 18 nt, Human
ugggauccaggccccucc

SEQ ID NO: 3545240 - RNA, 22 nt, Human
ugggaucccugucuuuccuaag

SEQ ID NO: 3545241 - RNA, 15 nt, Human
ugggauccuccaggu

SEQ ID NO: 3545242 - RNA, 14 nt, Human
ugggaucuaggaga

SEQ ID NO: 3545243 - RNA, 13 nt, Human
ugggaucugacug

SEQ ID NO: 3545244 - RNA, 16 nt, Human
ugggaucugacugcac

SEQ ID NO: 3545245 - RNA, 16 nt, Human
ugggaucugccccucc

SEQ ID NO: 3545246 - RNA, 19 nt, Human
ugggaucugccccucccug

SEQ ID NO: 3545247 - RNA, 16 nt, Human
ugggaugaaacuaaag

SEQ ID NO: 3545248 - RNA, 15 nt, Human
ugggaugaugccuca

SEQ ID NO: 3545249 - RNA, 18 nt, Human
ugggaugauugaagaaac

SEQ ID NO: 3545250 - RNA, 13 nt, Human
ugggauggaggag

SEQ ID NO: 3545251 - RNA, 18 nt, Human
ugggaugguggagggcca

SEQ ID NO: 3545252 - RNA, 21 nt, Human
ugggauucaggaaaaggccug

SEQ ID NO: 3545253 - RNA, 20 nt, Human
ugggauucccaccaaggucu

SEQ ID NO: 3545254 - RNA, 16 nt, Human
ugggauuccugaccca

SEQ ID NO: 3545255 - RNA, 17 nt, Human
ugggauuccugacccag

SEQ ID NO: 3545256 - RNA, 20 nt, Human
ugggauuccugacccaggcc

SEQ ID NO: 3545257 - RNA, 21 nt, Human
ugggauucuggacaggaugug

SEQ ID NO: 3545258 - RNA, 10 nt, Human
ugggauugcu

SEQ ID NO: 3545259 - RNA, 19 nt, Human
ugggauugggggcuggugc

SEQ ID NO: 3545260 - RNA, 22 nt, Human
ugggauuuccagaaccacacuu

SEQ ID NO: 3545261 - RNA, 16 nt, Human
ugggauuuggucaaca

SEQ ID NO: 3545262 - RNA, 18 nt, Human
ugggauuuuaaacuagau

SEQ ID NO: 3545263 - RNA, 14 nt, Human
ugggcaaacaggca

SEQ ID NO: 3545264 - RNA, 15 nt, Human
ugggcaaacaggcag

SEQ ID NO: 3545265 - RNA, 15 nt, Human
ugggcaaagccuagu

SEQ ID NO: 3545266 - RNA, 21 nt, Human
ugggcaacccccagccugcua

SEQ ID NO: 3545267 - RNA, 22 nt, Human
ugggcaauauaaccaauguuua

SEQ ID NO: 3545268 - RNA, 19 nt, Human
ugggcaaugauggcaauuu

SEQ ID NO: 3545269 - RNA, 15 nt, Human
ugggcaauugucuga

SEQ ID NO: 3545270 - RNA, 16 nt, Human
ugggcaauuuagaaaa

SEQ ID NO: 3545271 - RNA, 20 nt, Human
ugggcacaaagggcccagau

SEQ ID NO: 3545272 - RNA, 12 nt, Human
ugggcacacgcu

SEQ ID NO: 3545273 - RNA, 17 nt, Human
ugggcacacgcugcucu

SEQ ID NO: 3545274 - RNA, 21 nt, Human
ugggcacacgcugcucugccc

SEQ ID NO: 3545275 - RNA, 15 nt, Human
ugggcacaucauuuc

SEQ ID NO: 3545276 - RNA, 15 nt, Human
ugggcacaugcucag

SEQ ID NO: 3545277 - RNA, 16 nt, Human
ugggcacaugcucagg

SEQ ID NO: 3545278 - RNA, 16 nt, Human
ugggcaccccacugca

SEQ ID NO: 3545279 - RNA, 15 nt, Human
ugggcacccccagcc

SEQ ID NO: 3545280 - RNA, 17 nt, Human
ugggcaccuggggagug

SEQ ID NO: 3545281 - RNA, 22 nt, Human
ugggcacugcuggguggcccau

SEQ ID NO: 3545282 - RNA, 16 nt, Human
ugggcacuggcccagg

SEQ ID NO: 3545283 - RNA, 22 nt, Human
ugggcacugggaugagccgcug

SEQ ID NO: 3545284 - RNA, 20 nt, Human
ugggcacuucccugcugccu

SEQ ID NO: 3545285 - RNA, 13 nt, Human
ugggcacuugaga

SEQ ID NO: 3545286 - RNA, 15 nt, Human
ugggcacuuuuuaau

SEQ ID NO: 3545287 - RNA, 15 nt, Human
ugggcagaaggccaa

SEQ ID NO: 3545288 - RNA, 18 nt, Human
ugggcagaagggagaagg

SEQ ID NO: 3545289 - RNA, 19 nt, Human
ugggcagaagggagaagga

SEQ ID NO: 3545290 - RNA, 13 nt, Human
ugggcagagccca

SEQ ID NO: 3545291 - RNA, 18 nt, Human
ugggcagagcuggcucug

SEQ ID NO: 3545292 - RNA, 16 nt, Human
ugggcagaggaaagca

SEQ ID NO: 3545293 - RNA, 15 nt, Human
ugggcagaucuaccc

SEQ ID NO: 3545294 - RNA, 22 nt, Human
ugggcagaucucccacaugcca

SEQ ID NO: 3545295 - RNA, 15 nt, Human
ugggcagauuuucag

SEQ ID NO: 3545296 - RNA, 17 nt, Human
ugggcagauuuucagca

SEQ ID NO: 3545297 - RNA, 12 nt, Human
ugggcagcaauu

SEQ ID NO: 3545298 - RNA, 17 nt, Human
ugggcagcaauuuaaau

SEQ ID NO: 3545299 - RNA, 21 nt, Human
ugggcagcaauuuaaauguua

SEQ ID NO: 3545300 - RNA, 12 nt, Human
ugggcagccaga

SEQ ID NO: 3545301 - RNA, 13 nt, Human
ugggcagccagac

SEQ ID NO: 3545302 - RNA, 15 nt, Human
ugggcagccaggcug

SEQ ID NO: 3545303 - RNA, 12 nt, Human
ugggcagcccgc

SEQ ID NO: 3545304 - RNA, 19 nt, Human
ugggcagcucaucucuguc

SEQ ID NO: 3545305 - RNA, 17 nt, Human
ugggcagcugccucccc

SEQ ID NO: 3545306 - RNA, 23 nt, Human
ugggcagcugccuccccuccucu

SEQ ID NO: 3545307 - RNA, 17 nt, Human
ugggcaggacucagcuc

SEQ ID NO: 3545308 - RNA, 22 nt, Human
ugggcaggacucagcuccccag

SEQ ID NO: 3545309 - RNA, 14 nt, Human
ugggcaggagacug

SEQ ID NO: 3545310 - RNA, 15 nt, Human
ugggcaggugguggc

SEQ ID NO: 3545311 - RNA, 17 nt, Human
ugggcaggugguggcac

SEQ ID NO: 3545312 - RNA, 14 nt, Human
ugggcagucauuuu

SEQ ID NO: 3545313 - RNA, 16 nt, Human
ugggcauacuaauaaa

SEQ ID NO: 3545314 - RNA, 15 nt, Human
ugggcaucuuuugua

SEQ ID NO: 3545315 - RNA, 18 nt, Human
ugggcaucuuuuguauua

SEQ ID NO: 3545316 - RNA, 22 nt, Human
ugggcaugagggguuccucccc

SEQ ID NO: 3545317 - RNA, 22 nt, Human
ugggcauggggugggccucugg

SEQ ID NO: 3545318 - RNA, 19 nt, Human
ugggcauugacaaaucugu

SEQ ID NO: 3545319 - RNA, 17 nt, Human
ugggcauugauggggaa

SEQ ID NO: 3545320 - RNA, 13 nt, Human
ugggcauugcuuu

SEQ ID NO: 3545321 - RNA, 20 nt, Human
ugggcauugcuuuccacuga

SEQ ID NO: 3545322 - RNA, 16 nt, Human
ugggcauuugugaggc

SEQ ID NO: 3545323 - RNA, 23 nt, Human
ugggccaacaaagaacacuaacu

SEQ ID NO: 3545324 - RNA, 16 nt, Human
ugggccaacucaccug

SEQ ID NO: 3545325 - RNA, 20 nt, Human
ugggccagaaguaccagacu

SEQ ID NO: 3545326 - RNA, 19 nt, Human
ugggccagacaugccacaa

SEQ ID NO: 3545327 - RNA, 15 nt, Human
ugggccagccccucc

SEQ ID NO: 3545328 - RNA, 22 nt, Human
ugggccagccccucccaccaca

SEQ ID NO: 3545329 - RNA, 13 nt, Human
ugggccaggagcc

SEQ ID NO: 3545330 - RNA, 14 nt, Human
ugggccaggagccu

SEQ ID NO: 3545331 - RNA, 16 nt, Human
ugggccaggagccucc

SEQ ID NO: 3545332 - RNA, 18 nt, Human
ugggccaggagccuccug

SEQ ID NO: 3545333 - RNA, 22 nt, Human
ugggccagggcugcccugagaa

SEQ ID NO: 3545334 - RNA, 13 nt, Human
ugggccagggucu

SEQ ID NO: 3545335 - RNA, 24 nt, Human
ugggccauacuggccucgccuggc

SEQ ID NO: 3545336 - RNA, 16 nt, Human
uaaaaacccacaaaaa

SEQ ID NO: 3545337 - RNA, 17 nt, Human
uaaaaaccgaauaaaug

SEQ ID NO: 3545338 - RNA, 20 nt, Human
uaaaaaccgaauaaauguuu

SEQ ID NO: 3545339 - RNA, 15 nt, Human
uaaaaaccuguucaa

SEQ ID NO: 3545340 - RNA, 14 nt, Human
uaaaaacucaagga

SEQ ID NO: 3545341 - RNA, 23 nt, Human
uaaaaagaaaagauaaagaugau

SEQ ID NO: 3545342 - RNA, 13 nt, Human
uaaaaagaaaggc

SEQ ID NO: 3545343 - RNA, 16 nt, Human
uaaaaagaaaucuggu

SEQ ID NO: 3545344 - RNA, 21 nt, Human
uaaaaagacauucuuccaaaa

SEQ ID NO: 3545345 - RNA, 19 nt, Human
uaaaaagagagaaaacuua

SEQ ID NO: 3545346 - RNA, 14 nt, Human
uaaaaagaucacuu

SEQ ID NO: 3545347 - RNA, 18 nt, Human
uaaaaagauugaaguauu

SEQ ID NO: 3545348 - RNA, 20 nt, Human
uaaaaagauugaaguauuuu

SEQ ID NO: 3545349 - RNA, 11 nt, Human
uaaaaagcaac

SEQ ID NO: 3545350 - RNA, 19 nt, Human
uaaaaagccugcaauuuca

SEQ ID NO: 3545351 - RNA, 22 nt, Human
uaaaaagcuccaaaugcagcuu

SEQ ID NO: 3545352 - RNA, 11 nt, Human
uaaaaagcuga

SEQ ID NO: 3545353 - RNA, 18 nt, Human
uaaaaaggaauaugaaag

SEQ ID NO: 3545354 - RNA, 19 nt, Human
uaaaaaggacaucagcaaa

SEQ ID NO: 3545355 - RNA, 21 nt, Human
uaaaaaggacaucagcaaaca

SEQ ID NO: 3545356 - RNA, 17 nt, Human
uaaaaaggaguauacaa

SEQ ID NO: 3545357 - RNA, 19 nt, Human
uaaaaaggcaccuauaaaa

SEQ ID NO: 3545358 - RNA, 23 nt, Human
uaaaaagguccucacaggugucu

SEQ ID NO: 3545359 - RNA, 19 nt, Human
uaaaaaguaauaaaauuca

SEQ ID NO: 3545360 - RNA, 13 nt, Human
uaaaaaguauaaa

SEQ ID NO: 3545361 - RNA, 16 nt, Human
uaaaaaguauauguua

SEQ ID NO: 3545362 - RNA, 21 nt, Human
uaaaaaguauugccaaacauu

SEQ ID NO: 3545363 - RNA, 18 nt, Human
uaaaaaguauuuuuucaa

SEQ ID NO: 3545364 - RNA, 16 nt, Human
uaaaaagucaauguuu

SEQ ID NO: 3545365 - RNA, 19 nt, Human
uaaaaagucagauguuuga

SEQ ID NO: 3545366 - RNA, 16 nt, Human
uaaaaagucugcauua

SEQ ID NO: 3545367 - RNA, 17 nt, Human
uaaaaagugcuuuugug

SEQ ID NO: 3545368 - RNA, 15 nt, Human
uaaaaaguggaaaaa

SEQ ID NO: 3545369 - RNA, 9 nt, Human
uaaaaaguu

SEQ ID NO: 3545370 - RNA, 20 nt, Human
uaaaaaguuuuaguuuugau

SEQ ID NO: 3545371 - RNA, 18 nt, Human
uaaaaauaaaaaacacug

SEQ ID NO: 3545372 - RNA, 16 nt, Human
uaaaaauaaaaaagau

SEQ ID NO: 3545373 - RNA, 17 nt, Human
uaaaaauaaaaaagauc

SEQ ID NO: 3545374 - RNA, 19 nt, Human
uaaaaauaaaaaagauccc

SEQ ID NO: 3545375 - RNA, 19 nt, Human
uaaaaauaaagcacaaacc

SEQ ID NO: 3545376 - RNA, 15 nt, Human
uaaaaauaacuguaa

SEQ ID NO: 3545377 - RNA, 14 nt, Human
uaaaaauaaggucu

SEQ ID NO: 3545378 - RNA, 15 nt, Human
uaaaaauacaaacaa

SEQ ID NO: 3545379 - RNA, 10 nt, Human
uaaaaauaua

SEQ ID NO: 3545380 - RNA, 12 nt, Human
uaaaaauauaaa

SEQ ID NO: 3545381 - RNA, 15 nt, Human
uaaaaauauaaaacu

SEQ ID NO: 3545382 - RNA, 13 nt, Human
uaaaaauauacau

SEQ ID NO: 3545383 - RNA, 15 nt, Human
uaaaaauauacaugu

SEQ ID NO: 3545384 - RNA, 21 nt, Human
uaaaaauauacauguuuaugu

SEQ ID NO: 3545385 - RNA, 16 nt, Human
ugugucacuugugcuu

SEQ ID NO: 3545386 - RNA, 22 nt, Human
ugugucacuugugcuuugcucu

SEQ ID NO: 3545387 - RNA, 20 nt, Human
ugugucagguggggcagcuu

SEQ ID NO: 3545388 - RNA, 15 nt, Human
ugugucaguuuaugu

SEQ ID NO: 3545389 - RNA, 18 nt, Human
ugugucaguuuauguuuu

SEQ ID NO: 3545390 - RNA, 19 nt, Human
ugugucaguuuauguuuug

SEQ ID NO: 3545391 - RNA, 20 nt, Human
ugugucaucaauaguguccu

SEQ ID NO: 3545392 - RNA, 14 nt, Human
ugugucaugccagu

SEQ ID NO: 3545393 - RNA, 19 nt, Human
uguguccaaaaccgccagc

SEQ ID NO: 3545394 - RNA, 23 nt, Human
uguguccaaaaccgccagcucug

SEQ ID NO: 3545395 - RNA, 16 nt, Human
uguguccaaaacugcc

SEQ ID NO: 3545396 - RNA, 15 nt, Human
uguguccaccguugu

SEQ ID NO: 3545397 - RNA, 19 nt, Human
uguguccacgacugucucc

SEQ ID NO: 3545398 - RNA, 23 nt, Human
ugugucccagaagaugacugagg

SEQ ID NO: 3545399 - RNA, 15 nt, Human
ugugucccucucucu

SEQ ID NO: 3545400 - RNA, 16 nt, Human
ugugucccucucucug

SEQ ID NO: 3545401 - RNA, 21 nt, Human
uguguccuccaggagcuucuu

SEQ ID NO: 3545402 - RNA, 15 nt, Human
uguguccuggugcuc

SEQ ID NO: 3545403 - RNA, 16 nt, Human
uguguccuugugcaug

SEQ ID NO: 3545404 - RNA, 21 nt, Human
ugugucuaaacugcauuaccg

SEQ ID NO: 3545405 - RNA, 22 nt, Human
ugugucuaaauuugaauguuaa

SEQ ID NO: 3545406 - RNA, 15 nt, Human
ugugucuaagauucu

SEQ ID NO: 3545407 - RNA, 17 nt, Human
ugugucucuugguccug

SEQ ID NO: 3545408 - RNA, 20 nt, Human
ugugucucuugguccugcug

SEQ ID NO: 3545409 - RNA, 22 nt, Human
ugugucucuugguccugcugca

SEQ ID NO: 3545410 - RNA, 12 nt, Human
ugugucugagug

SEQ ID NO: 3545411 - RNA, 14 nt, Human
ugugucuguacacg

SEQ ID NO: 3545412 - RNA, 24 nt, Human
ugugucuguauuucauguggcugu

SEQ ID NO: 3545413 - RNA, 19 nt, Human
ugugucuuuaaaugcugcu

SEQ ID NO: 3545414 - RNA, 20 nt, Human
ugugucuuuggaggugcugc

SEQ ID NO: 3545415 - RNA, 16 nt, Human
ugugucuuuugcauga

SEQ ID NO: 3545416 - RNA, 21 nt, Human
ugugugaaagguacuucaaau

SEQ ID NO: 3545417 - RNA, 23 nt, Human
ugugugaagaucacguuccuucc

SEQ ID NO: 3545418 - RNA, 18 nt, Human
ugugugaauaccccaaga

SEQ ID NO: 3545419 - RNA, 12 nt, Human
ugugugaaugaa

SEQ ID NO: 3545420 - RNA, 17 nt, Human
ugugugaaugaacacuc

SEQ ID NO: 3545421 - RNA, 14 nt, Human
ugugugacaauucu

SEQ ID NO: 3545422 - RNA, 12 nt, Human
ugugugaccaac

SEQ ID NO: 3545423 - RNA, 18 nt, Human
ugugugaccccuccuggg

SEQ ID NO: 3545424 - RNA, 16 nt, Human
ugugugagacuacuaa

SEQ ID NO: 3545425 - RNA, 17 nt, Human
ugugugaugaacuuucu

SEQ ID NO: 3545426 - RNA, 16 nt, Human
ugugugauugaaucug

SEQ ID NO: 3545427 - RNA, 19 nt, Human
ugugugauugacagcuuug

SEQ ID NO: 3545428 - RNA, 22 nt, Human
ugugugcaacaggguauggacu

SEQ ID NO: 3545429 - RNA, 19 nt, Human
ugugugcagacucaauaaa

SEQ ID NO: 3545430 - RNA, 21 nt, Human
ugugugcagucucucuuaccc

SEQ ID NO: 3545431 - RNA, 14 nt, Human
ugugugcaugugug

SEQ ID NO: 3545432 - RNA, 19 nt, Human
ugugugcauguguguauaa

SEQ ID NO: 3545433 - RNA, 20 nt, Human
ugugugcaugugugugcuca

SEQ ID NO: 3545434 - RNA, 23 nt, Human
ugugugccauagaguuuaacaca

SEQ ID NO: 3545435 - RNA, 24 nt, Human
ugugugccauagaguuuaacacaa

SEQ ID NO: 3545436 - RNA, 14 nt, Human
ugugugcccucugg

SEQ ID NO: 3545437 - RNA, 20 nt, Human
ugugugcccucugggcucug

SEQ ID NO: 3545438 - RNA, 20 nt, Human
ugugugccgagcccuugccc

SEQ ID NO: 3545439 - RNA, 21 nt, Human
ugugugccgagcccuugccca

SEQ ID NO: 3545440 - RNA, 18 nt, Human
ugugugccucuagcugaa

SEQ ID NO: 3545441 - RNA, 17 nt, Human
ugugugcuaaacgugua

SEQ ID NO: 3545442 - RNA, 13 nt, Human
ugugugcucucca

SEQ ID NO: 3545443 - RNA, 16 nt, Human
uguguggacuguggca

SEQ ID NO: 3545444 - RNA, 23 nt, Human
uguguggacuguggcacuugccu

SEQ ID NO: 3545445 - RNA, 14 nt, Human
ugugugggacugua

SEQ ID NO: 3545446 - RNA, 16 nt, Human
ugugugggacuguaca

SEQ ID NO: 3545447 - RNA, 17 nt, Human
ugugugggacuguacac

SEQ ID NO: 3545448 - RNA, 14 nt, Human
ugugugggagugug

SEQ ID NO: 3545449 - RNA, 20 nt, Human
uguguggguggauauaaaua

SEQ ID NO: 3545450 - RNA, 23 nt, Human
uguguggguggauauaaauauau

SEQ ID NO: 3545451 - RNA, 16 nt, Human
ugugugguggccucag

SEQ ID NO: 3545452 - RNA, 11 nt, Human
uguguguacuc

SEQ ID NO: 3545453 - RNA, 21 nt, Human
uguguguacucacugaagccu

SEQ ID NO: 3545454 - RNA, 14 nt, Human
uguguguauauaug

SEQ ID NO: 3545455 - RNA, 12 nt, Human
uguguguaugca

SEQ ID NO: 3545456 - RNA, 14 nt, Human
uguguguaugcugc

SEQ ID NO: 3545457 - RNA, 16 nt, Human
uguguguaugcugcuu

SEQ ID NO: 3545458 - RNA, 20 nt, Human
uguguguauuugcuaauuuu

SEQ ID NO: 3545459 - RNA, 22 nt, Human
uguguguccacgacugucucca

SEQ ID NO: 3545460 - RNA, 22 nt, Human
ugugugucuaggcaggaccugu

SEQ ID NO: 3545461 - RNA, 16 nt, Human
ugugugugacaauucu

SEQ ID NO: 3545462 - RNA, 13 nt, Human
ugugugugaugug

SEQ ID NO: 3545463 - RNA, 15 nt, Human
ugugugugaugugac

SEQ ID NO: 3545464 - RNA, 20 nt, Human
ugugugugcuuauguaugag

SEQ ID NO: 3545465 - RNA, 12 nt, Human
ugugugugggag

SEQ ID NO: 3545466 - RNA, 20 nt, Human
ugugugugggaguguguaau

SEQ ID NO: 3545467 - RNA, 11 nt, Human
uguguguguau

SEQ ID NO: 3545468 - RNA, 14 nt, Human
ugugugugucagcu

SEQ ID NO: 3545469 - RNA, 11 nt, Human
uguguguguga

SEQ ID NO: 3545470 - RNA, 13 nt, Human
ugugugugugaga

SEQ ID NO: 3545471 - RNA, 12 nt, Human
ugugugugugca

SEQ ID NO: 3545472 - RNA, 13 nt, Human
ugugugugugcau

SEQ ID NO: 3545473 - RNA, 14 nt, Human
ugugugugugcaug

SEQ ID NO: 3545474 - RNA, 14 nt, Human
ugugugugugcgug

SEQ ID NO: 3545475 - RNA, 11 nt, Human
ugugugugugu

SEQ ID NO: 3545476 - RNA, 14 nt, Human
ugugugugugugcg

SEQ ID NO: 3545477 - RNA, 14 nt, Human
ugugugugugugua

SEQ ID NO: 3545478 - RNA, 16 nt, Human
ugugugugugugugcg

SEQ ID NO: 3545479 - RNA, 14 nt, Human
uguguguuacaaug

SEQ ID NO: 3545480 - RNA, 13 nt, Human
uguguguuccugg

SEQ ID NO: 3545481 - RNA, 16 nt, Human
uguguguugauacugu

SEQ ID NO: 3545482 - RNA, 12 nt, Human
uguguguugcuu

SEQ ID NO: 3545483 - RNA, 18 nt, Human
uguguguugcuuauguug

SEQ ID NO: 3545484 - RNA, 18 nt, Human
uguguguugucucuugag

SEQ ID NO: 3545485 - RNA, 14 nt, Human
uguguguugucuga

SEQ ID NO: 3545486 - RNA, 22 nt, Human
uguguguuuaaauaaaguauca

SEQ ID NO: 3545487 - RNA, 15 nt, Human
uguguguuucacuuu

SEQ ID NO: 3545488 - RNA, 15 nt, Human
uguguguuucugucc

SEQ ID NO: 3545489 - RNA, 16 nt, Human
uguguguuugugcuga

SEQ ID NO: 3545490 - RNA, 14 nt, Human
uguguuaauuuaag

SEQ ID NO: 3545491 - RNA, 13 nt, Human
uguguuauuuaaa

SEQ ID NO: 3545492 - RNA, 16 nt, Human
uguguuauuuaaauga

SEQ ID NO: 3545493 - RNA, 20 nt, Human
uguguucacuaaacucugaa

SEQ ID NO: 3545494 - RNA, 20 nt, Human
uguguuccaaacaugagguu

SEQ ID NO: 3545495 - RNA, 15 nt, Human
uguguuccaaccacu

SEQ ID NO: 3545496 - RNA, 16 nt, Human
uguguuccaaccacug

SEQ ID NO: 3545497 - RNA, 16 nt, Human
uguguuccaaguuucc

SEQ ID NO: 3545498 - RNA, 19 nt, Human
uguguucccauuucagcug

SEQ ID NO: 3545499 - RNA, 15 nt, Human
uguguuccccaaagg

SEQ ID NO: 3545500 - RNA, 11 nt, Human
uguguuccugg

SEQ ID NO: 3545501 - RNA, 20 nt, Human
uguguucuauccaaacaugu

SEQ ID NO: 3545502 - RNA, 17 nt, Human
uguguucugauuagaaa

SEQ ID NO: 3545503 - RNA, 17 nt, Human
uguguugaagagcagcu

SEQ ID NO: 3545504 - RNA, 15 nt, Human
uguguugacuuuaua

SEQ ID NO: 3545505 - RNA, 23 nt, Human
uguguugauacuguugcacgugu

SEQ ID NO: 3545506 - RNA, 18 nt, Human
uguguugccacaggacac

SEQ ID NO: 3545507 - RNA, 15 nt, Human
uguguugcuuauguu

SEQ ID NO: 3545508 - RNA, 15 nt, Human
uguguuggacagaga

SEQ ID NO: 3545509 - RNA, 12 nt, Human
uguguuggcugu

SEQ ID NO: 3545510 - RNA, 12 nt, Human
uguguuggcuug

SEQ ID NO: 3545511 - RNA, 13 nt, Human
uguguugucucua

SEQ ID NO: 3545512 - RNA, 19 nt, Human
uguguugucucuugaguuu

SEQ ID NO: 3545513 - RNA, 13 nt, Human
uguguugugauag

SEQ ID NO: 3545514 - RNA, 13 nt, Human
uguguugugcuuu

SEQ ID NO: 3545515 - RNA, 23 nt, Human
uguguugugugugggagugugua

SEQ ID NO: 3545516 - RNA, 14 nt, Human
uguguuguugcuuu

SEQ ID NO: 3545517 - RNA, 12 nt, Human
uguguuuaaaua

SEQ ID NO: 3545518 - RNA, 14 nt, Human
uguguuuaaauaaa

SEQ ID NO: 3545519 - RNA, 16 nt, Human
uguguuuaauuucuuc

SEQ ID NO: 3545520 - RNA, 17 nt, Human
uguguuuacagagaugu

SEQ ID NO: 3545521 - RNA, 20 nt, Human
uguguuuacuuuauguuacu

SEQ ID NO: 3545522 - RNA, 17 nt, Human
uguguuuagaauugaag

SEQ ID NO: 3545523 - RNA, 14 nt, Human
uguguuuauaaaau

SEQ ID NO: 3545524 - RNA, 12 nt, Human
uguguuuauaug

SEQ ID NO: 3545525 - RNA, 15 nt, Human
uguguuuauauggaa

SEQ ID NO: 3545526 - RNA, 13 nt, Human
uguguuuaugugu

SEQ ID NO: 3545527 - RNA, 15 nt, Human
uguguuuaugugugu

SEQ ID NO: 3545528 - RNA, 23 nt, Human
uguguuuauucaaacugaaaagc

SEQ ID NO: 3545529 - RNA, 23 nt, Human
uguguuuauucuugaugaaaagc

SEQ ID NO: 3545530 - RNA, 16 nt, Human
uguguuuauugucaaa

SEQ ID NO: 3545531 - RNA, 16 nt, Human
uaaauaaauuugacuu

SEQ ID NO: 3545532 - RNA, 21 nt, Human
uaaauaagaaacaacucuuug

SEQ ID NO: 3545533 - RNA, 22 nt, Human
uaaauaagaaacaacucuuuga

SEQ ID NO: 3545534 - RNA, 15 nt, Human
uaaauaagagauuug

SEQ ID NO: 3545535 - RNA, 13 nt, Human
uaaauaagauucu

SEQ ID NO: 3545536 - RNA, 14 nt, Human
uaaauaagauucua

SEQ ID NO: 3545537 - RNA, 20 nt, Human
uaaauaaguuugcaauuugg

SEQ ID NO: 3545538 - RNA, 13 nt, Human
uaaauaaugcuuu

SEQ ID NO: 3545539 - RNA, 16 nt, Human
uaaauaaugcuuugaa

SEQ ID NO: 3545540 - RNA, 19 nt, Human
uaaauaaugugaaacugga

SEQ ID NO: 3545541 - RNA, 12 nt, Human
uaaauaauucuu

SEQ ID NO: 3545542 - RNA, 14 nt, Human
uaaauaauuuaacu

SEQ ID NO: 3545543 - RNA, 15 nt, Human
uaaauacagacacua

SEQ ID NO: 3545544 - RNA, 18 nt, Human
uaaauacagacacuaagu

SEQ ID NO: 3545545 - RNA, 15 nt, Human
uaaauacaggaaaca

SEQ ID NO: 3545546 - RNA, 16 nt, Human
uaaauacaggaaacag

SEQ ID NO: 3545547 - RNA, 18 nt, Human
uaaauacaggaaacaguu

SEQ ID NO: 3545548 - RNA, 12 nt, Human
uaaauaccauug

SEQ ID NO: 3545549 - RNA, 13 nt, Human
uaaauacugcaaa

SEQ ID NO: 3545550 - RNA, 20 nt, Human
uaaauagaauguaaaugucu

SEQ ID NO: 3545551 - RNA, 17 nt, Human
uaaauagaccauuaauc

SEQ ID NO: 3545552 - RNA, 19 nt, Human
uaaauagaugacauugacu

SEQ ID NO: 3545553 - RNA, 15 nt, Human
uaaauagcauucucu

SEQ ID NO: 3545554 - RNA, 19 nt, Human
uaaauagcuagacugguga

SEQ ID NO: 3545555 - RNA, 17 nt, Human
uaaauagcuauauccau

SEQ ID NO: 3545556 - RNA, 20 nt, Human
uaaauagcuauauccaugua

SEQ ID NO: 3545557 - RNA, 22 nt, Human
uaaauagcuauauccauguacu

SEQ ID NO: 3545558 - RNA, 22 nt, Human
uaaauagguucuucuuguucug

SEQ ID NO: 3545559 - RNA, 18 nt, Human
uggucuacacugugcuga

SEQ ID NO: 3545560 - RNA, 15 nt, Human
uggucuauugucugu

SEQ ID NO: 3545561 - RNA, 23 nt, Human
uggucucaaacuccugaccucag

SEQ ID NO: 3545562 - RNA, 23 nt, Human
uggucucacccuggaggcaccug

SEQ ID NO: 3545563 - RNA, 22 nt, Human
uggucucagcagcgaccacccc

SEQ ID NO: 3545564 - RNA, 14 nt, Human
uggucuccacuggg

SEQ ID NO: 3545565 - RNA, 15 nt, Human
uggucucccuucucu

SEQ ID NO: 3545566 - RNA, 17 nt, Human
uggucuccugcccccac

SEQ ID NO: 3545567 - RNA, 14 nt, Human
uggucucuaggcug

SEQ ID NO: 3545568 - RNA, 18 nt, Human
uggucucuaggcugggga

SEQ ID NO: 3545569 - RNA, 22 nt, Human
uggucucugcugaagguuguaa

SEQ ID NO: 3545570 - RNA, 19 nt, Human
uggucucuucuuggggccc

SEQ ID NO: 3545571 - RNA, 15 nt, Human
uggucugaauguucu

SEQ ID NO: 3545572 - RNA, 17 nt, Human
uggucugaauguucuga

SEQ ID NO: 3545573 - RNA, 19 nt, Human
uggucugaauguucugaca

SEQ ID NO: 3545574 - RNA, 22 nt, Human
uggucugaggggcaacugaguc

SEQ ID NO: 3545575 - RNA, 17 nt, Human
uggucugcucgggccca

SEQ ID NO: 3545576 - RNA, 18 nt, Human
uggucugcucgggcccag

SEQ ID NO: 3545577 - RNA, 19 nt, Human
uggucugcucgggcccagg

SEQ ID NO: 3545578 - RNA, 21 nt, Human
uggucugcucgggcccaggcc

SEQ ID NO: 3545579 - RNA, 17 nt, Human
uggucugggacuuccuu

SEQ ID NO: 3545580 - RNA, 22 nt, Human
uggucuggguguagcucuuaga

SEQ ID NO: 3545581 - RNA, 12 nt, Human
uggucuguguga

SEQ ID NO: 3545582 - RNA, 23 nt, Human
uggucugugugugugugugugcg

SEQ ID NO: 3545583 - RNA, 15 nt, Human
uggucuuacagcagg

SEQ ID NO: 3545584 - RNA, 14 nt, Human
uggucuucagccuc

SEQ ID NO: 3545585 - RNA, 17 nt, Human
uggucuucccaggcugg

SEQ ID NO: 3545586 - RNA, 15 nt, Human
uggucuugaaguccu

SEQ ID NO: 3545587 - RNA, 19 nt, Human
uggucuugaaguccuggcu

SEQ ID NO: 3545588 - RNA, 17 nt, Human
uggucuuggcagcaccu

SEQ ID NO: 3545589 - RNA, 21 nt, Human
uggucuuguaagagcuauaca

SEQ ID NO: 3545590 - RNA, 16 nt, Human
uggucuuguggaauug

SEQ ID NO: 3545591 - RNA, 14 nt, Human
uggucuuuaaugaa

SEQ ID NO: 3545592 - RNA, 22 nt, Human
uggucuuuccuaucauggagug

SEQ ID NO: 3545593 - RNA, 15 nt, Human
uggucuuucuggaga

SEQ ID NO: 3545594 - RNA, 17 nt, Human
uggucuuucuggagagg

SEQ ID NO: 3545595 - RNA, 11 nt, Human
uggucuuugag

SEQ ID NO: 3545596 - RNA, 15 nt, Human
uggucuuuguaagag

SEQ ID NO: 3545597 - RNA, 23 nt, Human
uggucuuuguaagaguguagaag

SEQ ID NO: 3545598 - RNA, 16 nt, Human
uggucuuuuauaauuc

SEQ ID NO: 3545599 - RNA, 17 nt, Human
uggucuuuuccucgcuu

SEQ ID NO: 3545600 - RNA, 23 nt, Human
uggugaaagcugagaacuccuga

SEQ ID NO: 3545601 - RNA, 20 nt, Human
uggugaacauugcaauagaa

SEQ ID NO: 3545602 - RNA, 19 nt, Human
uggugaacuugguuuuaau

SEQ ID NO: 3545603 - RNA, 15 nt, Human
uggugaagugcuugg

SEQ ID NO: 3545604 - RNA, 13 nt, Human
uggugaauauugu

SEQ ID NO: 3545605 - RNA, 14 nt, Human
uggugaauuugaau

SEQ ID NO: 3545606 - RNA, 16 nt, Human
uggugacaccagccuu

SEQ ID NO: 3545607 - RNA, 18 nt, Human
uggugacaccagccuuuc

SEQ ID NO: 3545608 - RNA, 17 nt, Human
uggugacccagucagag

SEQ ID NO: 3545609 - RNA, 22 nt, Human
uggugaccucugccugaaguca

SEQ ID NO: 3545610 - RNA, 15 nt, Human
uggugacugauucuu

SEQ ID NO: 3545611 - RNA, 16 nt, Human
uggugacugauucuuc

SEQ ID NO: 3545612 - RNA, 12 nt, Human
uggugacuuccu

SEQ ID NO: 3545613 - RNA, 16 nt, Human
uggugacuuuggauaa

SEQ ID NO: 3545614 - RNA, 18 nt, Human
uggugacuuuggauaaua

SEQ ID NO: 3545615 - RNA, 14 nt, Human
uggugagaaaccug

SEQ ID NO: 3545616 - RNA, 19 nt, Human
uggugagaaauuucuguga

SEQ ID NO: 3545617 - RNA, 20 nt, Human
uggugagaugcagcuggaaa

SEQ ID NO: 3545618 - RNA, 14 nt, Human
uggugaggaagcuc

SEQ ID NO: 3545619 - RNA, 17 nt, Human
uggugagggaagacgcc

SEQ ID NO: 3545620 - RNA, 18 nt, Human
uggugagucuuggcggca

SEQ ID NO: 3545621 - RNA, 22 nt, Human
uggugagucuuggcggcagcag

SEQ ID NO: 3545622 - RNA, 15 nt, Human
uggugauaaggacau

SEQ ID NO: 3545623 - RNA, 15 nt, Human
uggugauauagaauu

SEQ ID NO: 3545624 - RNA, 17 nt, Human
uggugaucaauuaaaug

SEQ ID NO: 3545625 - RNA, 19 nt, Human
uggugauccaaacaaaaug

SEQ ID NO: 3545626 - RNA, 15 nt, Human
uggugaugaaaugua

SEQ ID NO: 3545627 - RNA, 20 nt, Human
uggugauggagguuucauac

SEQ ID NO: 3545628 - RNA, 22 nt, Human
uggugauuuagcaggaagcugu

SEQ ID NO: 3545629 - RNA, 14 nt, Human
uggugauuugaaaa

SEQ ID NO: 3545630 - RNA, 22 nt, Human
uggugauuugaaaaauauaaaa

SEQ ID NO: 3545631 - RNA, 16 nt, Human
uggugauuuuaaaugu

SEQ ID NO: 3545632 - RNA, 22 nt, Human
uggugcaaguugaggacuucuu

SEQ ID NO: 3545633 - RNA, 21 nt, Human
uggugcaaugaccuuucaaua

SEQ ID NO: 3545634 - RNA, 23 nt, Human
uggugcacagcacaaauuaguua

SEQ ID NO: 3545635 - RNA, 15 nt, Human
uggugcacagugauu

SEQ ID NO: 3545636 - RNA, 15 nt, Human
uggugcacuuuguaa

SEQ ID NO: 3545637 - RNA, 10 nt, Human
uggugcauua

SEQ ID NO: 3545638 - RNA, 13 nt, Human
uggugccagccuu

SEQ ID NO: 3545639 - RNA, 18 nt, Human
uggugccaucauugcugu

SEQ ID NO: 3545640 - RNA, 14 nt, Human
uggugccccaggac

SEQ ID NO: 3545641 - RNA, 16 nt, Human
uggugccccaggacca

SEQ ID NO: 3545642 - RNA, 17 nt, Human
uggugccccaggaccag

SEQ ID NO: 3545643 - RNA, 16 nt, Human
uggugccccccacccc

SEQ ID NO: 3545644 - RNA, 17 nt, Human
uggugcccuccucacuc

SEQ ID NO: 3545645 - RNA, 15 nt, Human
uggugccuaguauug

SEQ ID NO: 3545646 - RNA, 14 nt, Human
uggugccugagagg

SEQ ID NO: 3545647 - RNA, 18 nt, Human
uggugccugagaggcagg

SEQ ID NO: 3545648 - RNA, 20 nt, Human
uggugccugagaggcaggca

SEQ ID NO: 3545649 - RNA, 13 nt, Human
uggugccuggccu

SEQ ID NO: 3545650 - RNA, 14 nt, Human
uggugccuggccug

SEQ ID NO: 3545651 - RNA, 11 nt, Human
uggugccuuca

SEQ ID NO: 3545652 - RNA, 15 nt, Human
uggugccuuuccugu

SEQ ID NO: 3545653 - RNA, 20 nt, Human
uggugcgaucauggcucacu

SEQ ID NO: 3545654 - RNA, 18 nt, Human
uggugcgggcacaauaaa

SEQ ID NO: 3545655 - RNA, 18 nt, Human
uggugcuauaggcuggag

SEQ ID NO: 3545656 - RNA, 11 nt, Human
uggugcucagu

SEQ ID NO: 3545657 - RNA, 18 nt, Human
uggugcucauuuaaauau

SEQ ID NO: 3545658 - RNA, 13 nt, Human
uggugcugagaag

SEQ ID NO: 3545659 - RNA, 13 nt, Human
uggugcugggaac

SEQ ID NO: 3545660 - RNA, 15 nt, Human
uggugcugggacuga

SEQ ID NO: 3545661 - RNA, 21 nt, Human
uggugcugggacugagccagu

SEQ ID NO: 3545662 - RNA, 12 nt, Human
uggugcuguggc

SEQ ID NO: 3545663 - RNA, 13 nt, Human
uggugcuguggcc

SEQ ID NO: 3545664 - RNA, 20 nt, Human
uggugcuguggccaggguga

SEQ ID NO: 3545665 - RNA, 16 nt, Human
ugguggcaagagcccc

SEQ ID NO: 3545666 - RNA, 19 nt, Human
ugguggcacugagcccccc

SEQ ID NO: 3545667 - RNA, 20 nt, Human
ugguggcagcucaccucucc

SEQ ID NO: 3545668 - RNA, 23 nt, Human
ugguggcagcucaccucucccuu

SEQ ID NO: 3545669 - RNA, 12 nt, Human
ugguggcagcug

SEQ ID NO: 3545670 - RNA, 14 nt, Human
ugguggcagcugcg

SEQ ID NO: 3545671 - RNA, 21 nt, Human
ugguggcagugcagcaaccag

SEQ ID NO: 3545672 - RNA, 17 nt, Human
ugguggcaguggaggug

SEQ ID NO: 3545673 - RNA, 13 nt, Human
ugguggcaguggg

SEQ ID NO: 3545674 - RNA, 20 nt, Human
ugguggcagugggagcugcc

SEQ ID NO: 3545675 - RNA, 14 nt, Human
ugguggccaugcuc

SEQ ID NO: 3545676 - RNA, 21 nt, Human
ugguggcccucuccccugccc

SEQ ID NO: 3545677 - RNA, 15 nt, Human
uguuugccauacuuu

SEQ ID NO: 3545678 - RNA, 15 nt, Human
uguuugcuaagcauu

SEQ ID NO: 3545679 - RNA, 17 nt, Human
uguuugcucagaacaca

SEQ ID NO: 3545680 - RNA, 23 nt, Human
uguuugcucagaacacauucuuu

SEQ ID NO: 3545681 - RNA, 20 nt, Human
uguuugcucagcuucuccaa

SEQ ID NO: 3545682 - RNA, 14 nt, Human
uguuugcucucccg

SEQ ID NO: 3545683 - RNA, 24 nt, Human
uguuugcucucccgguucuuccag

SEQ ID NO: 3545684 - RNA, 14 nt, Human
uguuugcugugaac

SEQ ID NO: 3545685 - RNA, 15 nt, Human
uguuugcuuauuguu

SEQ ID NO: 3545686 - RNA, 20 nt, Human
uguuugcuuauuguuccaag

SEQ ID NO: 3545687 - RNA, 15 nt, Human
uguuugcuucaacug

SEQ ID NO: 3545688 - RNA, 18 nt, Human
uguuugcuucauaaauga

SEQ ID NO: 3545689 - RNA, 23 nt, Human
uguuugcuucaugugucccagaa

SEQ ID NO: 3545690 - RNA, 16 nt, Human
uguuuggaaaagacag

SEQ ID NO: 3545691 - RNA, 17 nt, Human
uguuuggaaaagacagu

SEQ ID NO: 3545692 - RNA, 14 nt, Human
uguuuggaaacauu

SEQ ID NO: 3545693 - RNA, 19 nt, Human
uguuuggaccaaaaaccag

SEQ ID NO: 3545694 - RNA, 17 nt, Human
uguuuggacuuuguaua

SEQ ID NO: 3545695 - RNA, 22 nt, Human
uguuuggauuuuuaauuaaaaa

SEQ ID NO: 3545696 - RNA, 15 nt, Human
uguuuggcaaggaaa

SEQ ID NO: 3545697 - RNA, 16 nt, Human
uguuuggcaaggaaag

SEQ ID NO: 3545698 - RNA, 17 nt, Human
uguuuggcaaggaaagg

SEQ ID NO: 3545699 - RNA, 11 nt, Human
uguuuggcugg

SEQ ID NO: 3545700 - RNA, 12 nt, Human
uguuuggcuggg

SEQ ID NO: 3545701 - RNA, 15 nt, Human
uguuuggggaugaga

SEQ ID NO: 3545702 - RNA, 18 nt, Human
uguuugggggacguuucu

SEQ ID NO: 3545703 - RNA, 21 nt, Human
uguuugggggacguuucucau

SEQ ID NO: 3545704 - RNA, 24 nt, Human
uguuugggggacguuucucauuug

SEQ ID NO: 3545705 - RNA, 18 nt, Human
uguuuggguauccugccc

SEQ ID NO: 3545706 - RNA, 17 nt, Human
uguuugguauuguauuu

SEQ ID NO: 3545707 - RNA, 20 nt, Human
uguuugguucuggggccccu

SEQ ID NO: 3545708 - RNA, 15 nt, Human
uguuugguuuacauu

SEQ ID NO: 3545709 - RNA, 16 nt, Human
uguuugguuuuaaaau

SEQ ID NO: 3545710 - RNA, 21 nt, Human
uguuugguuuuaaaauacugu

SEQ ID NO: 3545711 - RNA, 24 nt, Human
uguuugguuuuuuguucuugcgau

SEQ ID NO: 3545712 - RNA, 16 nt, Human
uguuuguaaauaagag

SEQ ID NO: 3545713 - RNA, 20 nt, Human
uguuuguacacaacaauccu

SEQ ID NO: 3545714 - RNA, 19 nt, Human
uguuuguauaaugaaugag

SEQ ID NO: 3545715 - RNA, 16 nt, Human
uguuugucagauauga

SEQ ID NO: 3545716 - RNA, 16 nt, Human
uguuugucucauccca

SEQ ID NO: 3545717 - RNA, 16 nt, Human
uguuugucucuccuuu

SEQ ID NO: 3545718 - RNA, 14 nt, Human
uguuugucucuucu

SEQ ID NO: 3545719 - RNA, 15 nt, Human
uguuugucucuucug

SEQ ID NO: 3545720 - RNA, 19 nt, Human
uguuugucugucuucauag

SEQ ID NO: 3545721 - RNA, 19 nt, Human
uguuugucuguuuguuuca

SEQ ID NO: 3545722 - RNA, 20 nt, Human
uguuugucuguuuguuucaa

SEQ ID NO: 3545723 - RNA, 19 nt, Human
uguuugucuuuuaaugcuu

SEQ ID NO: 3545724 - RNA, 15 nt, Human
uguuuguggccucag

SEQ ID NO: 3545725 - RNA, 16 nt, Human
uguaaaaucuugucau

SEQ ID NO: 3545726 - RNA, 19 nt, Human
uguaaaaucuugucaugug

SEQ ID NO: 3545727 - RNA, 22 nt, Human
uguaaaaucuugucauguguau

SEQ ID NO: 3545728 - RNA, 16 nt, Human
uguaaaaugacaauca

SEQ ID NO: 3545729 - RNA, 18 nt, Human
uguaaaaugcaaaaaauc

SEQ ID NO: 3545730 - RNA, 22 nt, Human
uguaaaauggaaaacuuaguuu

SEQ ID NO: 3545731 - RNA, 15 nt, Human
uguaaaauguauuau

SEQ ID NO: 3545732 - RNA, 14 nt, Human
uguaaaauuguaua

SEQ ID NO: 3545733 - RNA, 21 nt, Human
uguaaacaaaauuuaguuuuu

SEQ ID NO: 3545734 - RNA, 21 nt, Human
uguaaacaaacuguguaacug

SEQ ID NO: 3545735 - RNA, 16 nt, Human
uguaaacagugccugc

SEQ ID NO: 3545736 - RNA, 17 nt, Human
uguaaacagugccugcu

SEQ ID NO: 3545737 - RNA, 19 nt, Human
uguaaacauaccaacaugu

SEQ ID NO: 3545738 - RNA, 22 nt, Human
uguaaacucaucugaaauguua

SEQ ID NO: 3545739 - RNA, 13 nt, Human
uguaaacugccau

SEQ ID NO: 3545740 - RNA, 23 nt, Human
uguaaacuguacuagucugugug

SEQ ID NO: 3545741 - RNA, 22 nt, Human
uguaaacuguguauuccaagac

SEQ ID NO: 3545742 - RNA, 17 nt, Human
uguaaacuuuaucacuu

SEQ ID NO: 3545743 - RNA, 18 nt, Human
uguaaacuuuaucacuua

SEQ ID NO: 3545744 - RNA, 19 nt, Human
uguaaacuuuaucacuuaa

SEQ ID NO: 3545745 - RNA, 18 nt, Human
uguaaacuuugaaauaua

SEQ ID NO: 3545746 - RNA, 16 nt, Human
uguaaagaaaaauauu

SEQ ID NO: 3545747 - RNA, 18 nt, Human
uguaaagaaaaauauuua

SEQ ID NO: 3545748 - RNA, 17 nt, Human
uguaaagaaagagagaa

SEQ ID NO: 3545749 - RNA, 13 nt, Human
uguaaagaaaugu

SEQ ID NO: 3545750 - RNA, 18 nt, Human
uguaaagauauuuuuauc

SEQ ID NO: 3545751 - RNA, 15 nt, Human
uguaaagauuucugu

SEQ ID NO: 3545752 - RNA, 16 nt, Human
uguaaagauuucuguu

SEQ ID NO: 3545753 - RNA, 19 nt, Human
uguaaagauuucuguucag

SEQ ID NO: 3545754 - RNA, 18 nt, Human
uguaaagccaacacccug

SEQ ID NO: 3545755 - RNA, 20 nt, Human
uguaaagcuaaaauaaagaa

SEQ ID NO: 3545756 - RNA, 13 nt, Human
uguaaagcuuguc

SEQ ID NO: 3545757 - RNA, 16 nt, Human
uguaaaggaauuuaaa

SEQ ID NO: 3545758 - RNA, 19 nt, Human
uguaaaguauguauuauuu

SEQ ID NO: 3545759 - RNA, 13 nt, Human
uguaaagugaaga

SEQ ID NO: 3545760 - RNA, 20 nt, Human
uguaaagugaagaauccuuu

SEQ ID NO: 3545761 - RNA, 17 nt, Human
uguaaaguguaaauccu

SEQ ID NO: 3545762 - RNA, 12 nt, Human
uguaaaguuagu

SEQ ID NO: 3545763 - RNA, 21 nt, Human
uguaaaguuauucuugaaguc

SEQ ID NO: 3545764 - RNA, 14 nt, Human
uguaaauaaaaaga

SEQ ID NO: 3545765 - RNA, 17 nt, Human
uguaaauaaaggaacca

SEQ ID NO: 3545766 - RNA, 23 nt, Human
uguaaauaauacauuauauuucu

SEQ ID NO: 3545767 - RNA, 15 nt, Human
uguaaauaauucuuu

SEQ ID NO: 3545768 - RNA, 15 nt, Human
uguaaauacaauuuu

SEQ ID NO: 3545769 - RNA, 16 nt, Human
uguaaauacaauuuug

SEQ ID NO: 3545770 - RNA, 17 nt, Human
uguaaauacaauuuugu

SEQ ID NO: 3545771 - RNA, 19 nt, Human
uguaaauacaauuuuguuu

SEQ ID NO: 3545772 - RNA, 14 nt, Human
uguaaauaccagga

SEQ ID NO: 3545773 - RNA, 15 nt, Human
uguaaauacuguugg

SEQ ID NO: 3545774 - RNA, 17 nt, Human
uguaaauacuguuggug

SEQ ID NO: 3545775 - RNA, 15 nt, Human
uguaaauagcucagg

SEQ ID NO: 3545776 - RNA, 16 nt, Human
uguaaauagcucaggu

SEQ ID NO: 3545777 - RNA, 15 nt, Human
uguaaauauucuaua

SEQ ID NO: 3545778 - RNA, 14 nt, Human
uguaaauauugugu

SEQ ID NO: 3545779 - RNA, 14 nt, Human
uguaaauauuuuaa

SEQ ID NO: 3545780 - RNA, 20 nt, Human
uguaaauauuuuaaagaauu

SEQ ID NO: 3545781 - RNA, 16 nt, Human
uguaaaucccauuauu

SEQ ID NO: 3545782 - RNA, 19 nt, Human
uguaaaucccauuauucaa

SEQ ID NO: 3545783 - RNA, 22 nt, Human
uguaaaucccauuauucaaagu

SEQ ID NO: 3545784 - RNA, 15 nt, Human
uguaaaucuacacac

SEQ ID NO: 3545785 - RNA, 16 nt, Human
uguaaaucugcucagg

SEQ ID NO: 3545786 - RNA, 15 nt, Human
uguaaaugcaucugu

SEQ ID NO: 3545787 - RNA, 22 nt, Human
uguaaaugcugucaacuaugau

SEQ ID NO: 3545788 - RNA, 16 nt, Human
uguaaauguaaacuca

SEQ ID NO: 3545789 - RNA, 12 nt, Human
uguaaauguguu

SEQ ID NO: 3545790 - RNA, 11 nt, Human
uguaaauguua

SEQ ID NO: 3545791 - RNA, 16 nt, Human
uguaaauguuauuucu

SEQ ID NO: 3545792 - RNA, 21 nt, Human
uguaaauguuauuucugcaaa

SEQ ID NO: 3545793 - RNA, 10 nt, Human
uguaaauuau

SEQ ID NO: 3545794 - RNA, 22 nt, Human
uguaaauuauauuugugcuaua

SEQ ID NO: 3545795 - RNA, 12 nt, Human
uguaaauuaugu

SEQ ID NO: 3545796 - RNA, 16 nt, Human
uguaaauuauuuaugu

SEQ ID NO: 3545797 - RNA, 18 nt, Human
uguaaauuauuuuaaauu

SEQ ID NO: 3545798 - RNA, 12 nt, Human
uguaaauucuga

SEQ ID NO: 3545799 - RNA, 15 nt, Human
uguaaauucugauuu

SEQ ID NO: 3545800 - RNA, 15 nt, Human
uguaaauuuaguguu

SEQ ID NO: 3545801 - RNA, 17 nt, Human
uguaaauuuaugugaug

SEQ ID NO: 3545802 - RNA, 16 nt, Human
uguaaauuuggcuucu

SEQ ID NO: 3545803 - RNA, 14 nt, Human
uguaaauuuguacu

SEQ ID NO: 3545804 - RNA, 20 nt, Human
uguaaauuuuguaugaaaaa

SEQ ID NO: 3545805 - RNA, 14 nt, Human
uguaacaagaaagg

SEQ ID NO: 3545806 - RNA, 17 nt, Human
uguaacaagccacccca

SEQ ID NO: 3545807 - RNA, 11 nt, Human
uguaacacaag

SEQ ID NO: 3545808 - RNA, 16 nt, Human
uguaacacaagccaca

SEQ ID NO: 3545809 - RNA, 21 nt, Human
uguaacacagcugagagacuu

SEQ ID NO: 3545810 - RNA, 17 nt, Human
uguaacagaaagggcaa

SEQ ID NO: 3545811 - RNA, 18 nt, Human
uguaacagccaggagugu

SEQ ID NO: 3545812 - RNA, 17 nt, Human
uguaacagcuccuuggg

SEQ ID NO: 3545813 - RNA, 11 nt, Human
uguaacagcug

SEQ ID NO: 3545814 - RNA, 15 nt, Human
uguaacagcugaggu

SEQ ID NO: 3545815 - RNA, 15 nt, Human
uguaacauaugcaaa

SEQ ID NO: 3545816 - RNA, 20 nt, Human
uguaaccgauucaucucuca

SEQ ID NO: 3545817 - RNA, 15 nt, Human
uguaaccucagcucu

SEQ ID NO: 3545818 - RNA, 19 nt, Human
uguaaccucuucagaggcc

SEQ ID NO: 3545819 - RNA, 22 nt, Human
uguaaccugagauggcccucug

SEQ ID NO: 3545820 - RNA, 16 nt, Human
uguaacguggcacugg

SEQ ID NO: 3545821 - RNA, 19 nt, Human
uguaacgugugcuguguuu

SEQ ID NO: 3545822 - RNA, 22 nt, Human
uuaauaaagacgauuugucagu

SEQ ID NO: 3545823 - RNA, 20 nt, Human
uuaauaacauuaccuuacug

SEQ ID NO: 3545824 - RNA, 21 nt, Human
uuaauaacauuaccuuacugu

SEQ ID NO: 3545825 - RNA, 22 nt, Human
uuaauaagcuacuagcaaaaua

SEQ ID NO: 3545826 - RNA, 23 nt, Human
uuaauaauaaauucccuggccuu

SEQ ID NO: 3545827 - RNA, 18 nt, Human
uuaauaauauacuugugg

SEQ ID NO: 3545828 - RNA, 21 nt, Human
uuaauaauuagaaacaccaaa

SEQ ID NO: 3545829 - RNA, 18 nt, Human
uuaauaauuauaugcuau

SEQ ID NO: 3545830 - RNA, 19 nt, Human
uuaauacaagguauaauaa

SEQ ID NO: 3545831 - RNA, 22 nt, Human
uuaauacaagguauaauaaaau

SEQ ID NO: 3545832 - RNA, 21 nt, Human
uuaauacaaugaugcuauuug

SEQ ID NO: 3545833 - RNA, 17 nt, Human
uuaauacuaccuugaaa

SEQ ID NO: 3545834 - RNA, 18 nt, Human
uuaauacuguuauucuuu

SEQ ID NO: 3545835 - RNA, 20 nt, Human
uuaauagagaaggaaagcuu

SEQ ID NO: 3545836 - RNA, 17 nt, Human
uuaauagaucuuagggu

SEQ ID NO: 3545837 - RNA, 14 nt, Human
uuaauagcagccuu

SEQ ID NO: 3545838 - RNA, 16 nt, Human
uuaauagcagccuuuc

SEQ ID NO: 3545839 - RNA, 17 nt, Human
uuaauagggaauauauc

SEQ ID NO: 3545840 - RNA, 16 nt, Human
uuaauagguuuggaca

SEQ ID NO: 3545841 - RNA, 23 nt, Human
uuaauagucaucacauuucuaug

SEQ ID NO: 3545842 - RNA, 21 nt, Human
uuaauaguguuaaucaauuua

SEQ ID NO: 3545843 - RNA, 18 nt, Human
uuaauaguuugucuauuu

SEQ ID NO: 3545844 - RNA, 22 nt, Human
uuaauauaaaguuuuauauauu

SEQ ID NO: 3545845 - RNA, 15 nt, Human
uuaauauaaaugcaa

SEQ ID NO: 3545846 - RNA, 17 nt, Human
uuaauauaaaugcaaau

SEQ ID NO: 3545847 - RNA, 15 nt, Human
uuaauauaacugccu

SEQ ID NO: 3545848 - RNA, 17 nt, Human
uuaauauagcuauuuuu

SEQ ID NO: 3545849 - RNA, 19 nt, Human
uuaauauaucccagaaauu

SEQ ID NO: 3545850 - RNA, 20 nt, Human
uuaauauaucccagaaauua

SEQ ID NO: 3545851 - RNA, 20 nt, Human
uuaauauauuaaaauuccaa

SEQ ID NO: 3545852 - RNA, 14 nt, Human
uuaauauauuucca

SEQ ID NO: 3545853 - RNA, 15 nt, Human
uuaauaucacucauu

SEQ ID NO: 3545854 - RNA, 14 nt, Human
uuaauauccuaaac

SEQ ID NO: 3545855 - RNA, 17 nt, Human
uuaauauccuaaacauc

SEQ ID NO: 3545856 - RNA, 15 nt, Human
uuaauaugaaaacuu

SEQ ID NO: 3545857 - RNA, 16 nt, Human
uuaauaugaaaacuua

SEQ ID NO: 3545858 - RNA, 17 nt, Human
uuaauaugaaaacuuau

SEQ ID NO: 3545859 - RNA, 13 nt, Human
uuaauaugaaauu

SEQ ID NO: 3545860 - RNA, 20 nt, Human
uuaauaugcugcaacaaaau

SEQ ID NO: 3545861 - RNA, 13 nt, Human
uuaauauguauuu

SEQ ID NO: 3545862 - RNA, 23 nt, Human
uuaauauguauuuuauguauguu

SEQ ID NO: 3545863 - RNA, 11 nt, Human
uuaauauuaaa

SEQ ID NO: 3545864 - RNA, 19 nt, Human
uuaauauuaaagccauguu

SEQ ID NO: 3545865 - RNA, 14 nt, Human
uuaauauuacagau

SEQ ID NO: 3545866 - RNA, 16 nt, Human
uuaauauuauuacugu

SEQ ID NO: 3545867 - RNA, 12 nt, Human
uuaauauuuaaa

SEQ ID NO: 3545868 - RNA, 17 nt, Human
uuaauauuuaaacagca

SEQ ID NO: 3545869 - RNA, 18 nt, Human
uuaauauuuaaacagcag

SEQ ID NO: 3545870 - RNA, 22 nt, Human
uuaauauuuaaacagcaguguu

SEQ ID NO: 3545871 - RNA, 12 nt, Human
uuaauauuuaac

SEQ ID NO: 3545872 - RNA, 16 nt, Human
uuaauauuuaacauua

SEQ ID NO: 3545873 - RNA, 12 nt, Human
uuaauauuugcu

SEQ ID NO: 3545874 - RNA, 19 nt, Human
uuaauauuugcugacagcu

SEQ ID NO: 3545875 - RNA, 19 nt, Human
uuaauauuuuuucuuuucc

SEQ ID NO: 3545876 - RNA, 17 nt, Human
uuaaucaaguugaauug

SEQ ID NO: 3545877 - RNA, 20 nt, Human
uuaaucacaaauuucacuua

SEQ ID NO: 3545878 - RNA, 14 nt, Human
uuaaucacugugua

SEQ ID NO: 3545879 - RNA, 15 nt, Human
uuaaucacuguguau

SEQ ID NO: 3545880 - RNA, 20 nt, Human
uuaaucacuguguauauuug

SEQ ID NO: 3545881 - RNA, 15 nt, Human
uuaaucacuuaacau

SEQ ID NO: 3545882 - RNA, 16 nt, Human
uuaaucagacaaagua

SEQ ID NO: 3545883 - RNA, 17 nt, Human
uuaaucagauagauauu

SEQ ID NO: 3545884 - RNA, 23 nt, Human
uuaaucauaguuacuguguaaac

SEQ ID NO: 3545885 - RNA, 17 nt, Human
uuaaucauauaaauaga

SEQ ID NO: 3545886 - RNA, 18 nt, Human
uuaaucaucuauaaagaa

SEQ ID NO: 3545887 - RNA, 13 nt, Human
uuaaucaugaaau

SEQ ID NO: 3545888 - RNA, 18 nt, Human
uuaaucaugaauaugaug

SEQ ID NO: 3545889 - RNA, 22 nt, Human
uuaaucauuaggugugacugaa

SEQ ID NO: 3545890 - RNA, 19 nt, Human
uuaaucauuuucauuccua

SEQ ID NO: 3545891 - RNA, 20 nt, Human
uuaauccagaauaacuagca

SEQ ID NO: 3545892 - RNA, 23 nt, Human
uuaauccagaauaacuagcacca

SEQ ID NO: 3545893 - RNA, 18 nt, Human
uuaauccaguuauaagaa

SEQ ID NO: 3545894 - RNA, 20 nt, Human
uuaauccaguuauaagaaga

SEQ ID NO: 3545895 - RNA, 17 nt, Human
uuaauccccaguaaaau

SEQ ID NO: 3545896 - RNA, 21 nt, Human
uuaauccccaguaaaauugcc

SEQ ID NO: 3545897 - RNA, 20 nt, Human
uuaauccgccaauauuagua

SEQ ID NO: 3545898 - RNA, 19 nt, Human
uuaaucugaaauucuaaag

SEQ ID NO: 3545899 - RNA, 16 nt, Human
uuaaucuuaauguaua

SEQ ID NO: 3545900 - RNA, 19 nt, Human
uuaaucuuaguguaugauu

SEQ ID NO: 3545901 - RNA, 15 nt, Human
uuaaucuuaucaaga

SEQ ID NO: 3545902 - RNA, 15 nt, Human
uuaaucuucaguuuu

SEQ ID NO: 3545903 - RNA, 22 nt, Human
uuaaucuucaguuuuaucuuua

SEQ ID NO: 3545904 - RNA, 13 nt, Human
uuaaucuucaugg

SEQ ID NO: 3545905 - RNA, 13 nt, Human
uuaaucuuccaug

SEQ ID NO: 3545906 - RNA, 19 nt, Human
uuaaucuuggauagcuaau

SEQ ID NO: 3545907 - RNA, 16 nt, Human
uuaaucuuuucacaaa

SEQ ID NO: 3545908 - RNA, 17 nt, Human
uuaaucuuuucacaaau

SEQ ID NO: 3545909 - RNA, 14 nt, Human
uuaaugaaaaggaa

SEQ ID NO: 3545910 - RNA, 21 nt, Human
uuaaugaaauaucuguauuua

SEQ ID NO: 3545911 - RNA, 14 nt, Human
uuaaugaacaaaug

SEQ ID NO: 3545912 - RNA, 17 nt, Human
uuaaugaaguuugaaug

SEQ ID NO: 3545913 - RNA, 19 nt, Human
uuaaugagcaauaucugcu

SEQ ID NO: 3545914 - RNA, 16 nt, Human
uuaaugauaaguaaau

SEQ ID NO: 3545915 - RNA, 19 nt, Human
uuaaugauauacugaucuu

SEQ ID NO: 3545916 - RNA, 14 nt, Human
uuaaugcacuuucu

SEQ ID NO: 3545917 - RNA, 22 nt, Human
uuaaugcauuaaaccugucucc

SEQ ID NO: 3545918 - RNA, 13 nt, Human
uuaaugcuaaggg

SEQ ID NO: 3545919 - RNA, 18 nt, Human
uuaaugcuaaucuuguga

SEQ ID NO: 3545920 - RNA, 22 nt, Human
uuaaugcuaaucuugugaaaau

SEQ ID NO: 3545921 - RNA, 14 nt, Human
uuaaugcuacaugu

SEQ ID NO: 3545922 - RNA, 14 nt, Human
uuaaugcuauuuga

SEQ ID NO: 3545923 - RNA, 20 nt, Human
uuaaugcuauuugaacaagu

SEQ ID NO: 3545924 - RNA, 14 nt, Human
uuaaugcuucauuc

SEQ ID NO: 3545925 - RNA, 15 nt, Human
uuaaugcuucauuca

SEQ ID NO: 3545926 - RNA, 15 nt, Human
uuaaugcuucuuuca

SEQ ID NO: 3545927 - RNA, 14 nt, Human
uuaauggaaauguu

SEQ ID NO: 3545928 - RNA, 20 nt, Human
uuaauggaaguguauuuauu

SEQ ID NO: 3545929 - RNA, 22 nt, Human
uuaauggacaugagauaauguu

SEQ ID NO: 3545930 - RNA, 14 nt, Human
uuaauggauuguua

SEQ ID NO: 3545931 - RNA, 19 nt, Human
uuaaugguaguuuuacagu

SEQ ID NO: 3545932 - RNA, 15 nt, Human
uuaauggucuaaaaa

SEQ ID NO: 3545933 - RNA, 17 nt, Human
uuaauggugccuucauu

SEQ ID NO: 3545934 - RNA, 18 nt, Human
uuaauguaaucugauggc

SEQ ID NO: 3545935 - RNA, 15 nt, Human
uuaauguagauuuuu

SEQ ID NO: 3545936 - RNA, 19 nt, Human
uuaauguauaguaaaucac

SEQ ID NO: 3545937 - RNA, 18 nt, Human
uaagaagugaaaaucuac

SEQ ID NO: 3545938 - RNA, 16 nt, Human
uaagaauaaaauguug

SEQ ID NO: 3545939 - RNA, 19 nt, Human
uaagaauauguuuccuugu

SEQ ID NO: 3545940 - RNA, 21 nt, Human
uaagaauauguuuccuuguuu

SEQ ID NO: 3545941 - RNA, 15 nt, Human
uaagaauauuugaau

SEQ ID NO: 3545942 - RNA, 20 nt, Human
uaagaaucagaguagaaaua

SEQ ID NO: 3545943 - RNA, 14 nt, Human
uaagaauggaaaag

SEQ ID NO: 3545944 - RNA, 17 nt, Human
uaagaauggaaaagaga

SEQ ID NO: 3545945 - RNA, 12 nt, Human
uaagaauguucu

SEQ ID NO: 3545946 - RNA, 18 nt, Human
uaagaauguugguuuacu

SEQ ID NO: 3545947 - RNA, 18 nt, Human
uaagaauucugauugauu

SEQ ID NO: 3545948 - RNA, 19 nt, Human
uaagaauugaccaucugcu

SEQ ID NO: 3545949 - RNA, 19 nt, Human
uaagaauugaguaauggug

SEQ ID NO: 3545950 - RNA, 20 nt, Human
uaagaauugaguaauggugu

SEQ ID NO: 3545951 - RNA, 21 nt, Human
uaagaauugaguaauggugua

SEQ ID NO: 3545952 - RNA, 22 nt, Human
uaagaauugaguaaugguguag

SEQ ID NO: 3545953 - RNA, 16 nt, Human
uaagaauuuagggaga

SEQ ID NO: 3545954 - RNA, 14 nt, Human
uaagaauuugcaua

SEQ ID NO: 3545955 - RNA, 23 nt, Human
uaagacaaaaagcuacuuauugu

SEQ ID NO: 3545956 - RNA, 22 nt, Human
uaagacaauggacccuuuuugu

SEQ ID NO: 3545957 - RNA, 19 nt, Human
uaagacagucccaucaaaa

SEQ ID NO: 3545958 - RNA, 16 nt, Human
uaagacauaucucuaa

SEQ ID NO: 3545959 - RNA, 16 nt, Human
uaagacaugauuuccu

SEQ ID NO: 3545960 - RNA, 21 nt, Human
uaagacaugauuuccuugaau

SEQ ID NO: 3545961 - RNA, 19 nt, Human
uaagacauguaacgaaaca

SEQ ID NO: 3545962 - RNA, 17 nt, Human
uaagacauuuuuggaag

SEQ ID NO: 3545963 - RNA, 13 nt, Human
uaagaccagccug

SEQ ID NO: 3545964 - RNA, 20 nt, Human
uaagacgguuaaauacugug

SEQ ID NO: 3545965 - RNA, 23 nt, Human
uaagacuaaaucuguaagcucuu

SEQ ID NO: 3545966 - RNA, 19 nt, Human
ugucauuaaaauaaauaaa

SEQ ID NO: 3545967 - RNA, 15 nt, Human
ugucauuaaacauga

SEQ ID NO: 3545968 - RNA, 17 nt, Human
ugucauuaaagguauca

SEQ ID NO: 3545969 - RNA, 13 nt, Human
ugucauuagccug

SEQ ID NO: 3545970 - RNA, 14 nt, Human
ugucauuagccuga

SEQ ID NO: 3545971 - RNA, 24 nt, Human
ugucauuagugagacauauuuaca

SEQ ID NO: 3545972 - RNA, 19 nt, Human
ugucauucagagucagcca

SEQ ID NO: 3545973 - RNA, 17 nt, Human
ugucauugcacauaagc

SEQ ID NO: 3545974 - RNA, 21 nt, Human
ugucauugcacauaagcuucc

SEQ ID NO: 3545975 - RNA, 18 nt, Human
ugucauugcuguuguccc

SEQ ID NO: 3545976 - RNA, 14 nt, Human
ugucauugcuuuac

SEQ ID NO: 3545977 - RNA, 14 nt, Human
ugucauuguaaaca

SEQ ID NO: 3545978 - RNA, 18 nt, Human
ugucauuguaaacaaacu

SEQ ID NO: 3545979 - RNA, 14 nt, Human
ugucauuguuauau

SEQ ID NO: 3545980 - RNA, 22 nt, Human
ugucauuucauguccuguguca

SEQ ID NO: 3545981 - RNA, 20 nt, Human
ugucauuucauuccauugcc

SEQ ID NO: 3545982 - RNA, 19 nt, Human
ugucauuugagcagggcuc

SEQ ID NO: 3545983 - RNA, 16 nt, Human
ugucauuuguuaaaau

SEQ ID NO: 3545984 - RNA, 17 nt, Human
ugucauuuguugugaug

SEQ ID NO: 3545985 - RNA, 15 nt, Human
ugucauuuucuccau

SEQ ID NO: 3545986 - RNA, 12 nt, Human
ugucauuuugaa

SEQ ID NO: 3545987 - RNA, 15 nt, Human
ugucauuuugaagcu

SEQ ID NO: 3545988 - RNA, 19 nt, Human
ugucauuuugaagcuaauu

SEQ ID NO: 3545989 - RNA, 11 nt, Human
uguccaaagag

SEQ ID NO: 3545990 - RNA, 18 nt, Human
uguccaacccgaggcccg

SEQ ID NO: 3545991 - RNA, 14 nt, Human
uguccaacuccagu

SEQ ID NO: 3545992 - RNA, 15 nt, Human
uguccaacuccagua

SEQ ID NO: 3545993 - RNA, 23 nt, Human
uguccaacuccaguacuggagcu

SEQ ID NO: 3545994 - RNA, 15 nt, Human
uguccaagaagccca

SEQ ID NO: 3545995 - RNA, 16 nt, Human
uguccaagaagcccag

SEQ ID NO: 3545996 - RNA, 16 nt, Human
uguccaauucucuuua

SEQ ID NO: 3545997 - RNA, 23 nt, Human
uguccaauuguugacaguucuga

SEQ ID NO: 3545998 - RNA, 18 nt, Human
uguccacacccagcucag

SEQ ID NO: 3545999 - RNA, 14 nt, Human
uguccacagaugcc

SEQ ID NO: 3546000 - RNA, 18 nt, Human
uguccacagaugccucca

SEQ ID NO: 3546001 - RNA, 13 nt, Human
uguccacccccau

SEQ ID NO: 3546002 - RNA, 14 nt, Human
uguccaccuggccc

SEQ ID NO: 3546003 - RNA, 14 nt, Human
uguccaccuguggg

SEQ ID NO: 3546004 - RNA, 17 nt, Human
uguccacgacugucucc

SEQ ID NO: 3546005 - RNA, 13 nt, Human
uguccacugugua

SEQ ID NO: 3546006 - RNA, 12 nt, Human
uguccagacagc

SEQ ID NO: 3546007 - RNA, 14 nt, Human
uguccagacagccu

SEQ ID NO: 3546008 - RNA, 16 nt, Human
uguccagacagccugu

SEQ ID NO: 3546009 - RNA, 17 nt, Human
uguccagacagccugua

SEQ ID NO: 3546010 - RNA, 21 nt, Human
uguccagagagcaacucugag

SEQ ID NO: 3546011 - RNA, 15 nt, Human
uguccagcaccuugu

SEQ ID NO: 3546012 - RNA, 19 nt, Human
uguccagccugggcagcca

SEQ ID NO: 3546013 - RNA, 21 nt, Human
uguccagcugagcgccaggau

SEQ ID NO: 3546014 - RNA, 13 nt, Human
uguccagggcccu

SEQ ID NO: 3546015 - RNA, 16 nt, Human
uguccaguaagaucac

SEQ ID NO: 3546016 - RNA, 17 nt, Human
uguccagugcccauucc

SEQ ID NO: 3546017 - RNA, 18 nt, Human
uguccagugcccauuccu

SEQ ID NO: 3546018 - RNA, 23 nt, Human
uguccagugcccauuccucaccu

SEQ ID NO: 3546019 - RNA, 13 nt, Human
uguccauacacuu

SEQ ID NO: 3546020 - RNA, 20 nt, Human
uguccauacacuuuguugca

SEQ ID NO: 3546021 - RNA, 16 nt, Human
uguccauauuuucaca

SEQ ID NO: 3546022 - RNA, 14 nt, Human
uguccaucagauga

SEQ ID NO: 3546023 - RNA, 16 nt, Human
uguccaucagaugaca

SEQ ID NO: 3546024 - RNA, 17 nt, Human
uguccaucagaugacaa

SEQ ID NO: 3546025 - RNA, 18 nt, Human
uguccaucagaugacaag

SEQ ID NO: 3546026 - RNA, 20 nt, Human
uguccaugcgcucagggcca

SEQ ID NO: 3546027 - RNA, 15 nt, Human
uguccaugcuucuca

SEQ ID NO: 3546028 - RNA, 17 nt, Human
uguccaugcuucucauc

SEQ ID NO: 3546029 - RNA, 20 nt, Human
uguccaugugguucuucaaa

SEQ ID NO: 3546030 - RNA, 15 nt, Human
uguccaugugugugc

SEQ ID NO: 3546031 - RNA, 18 nt, Human
uguccauugacauguaca

SEQ ID NO: 3546032 - RNA, 14 nt, Human
uguccauuguccaa

SEQ ID NO: 3546033 - RNA, 21 nt, Human
uguccauuuauccacaggaaa

SEQ ID NO: 3546034 - RNA, 16 nt, Human
uguccauuuugugaag

SEQ ID NO: 3546035 - RNA, 19 nt, Human
uguccauuuugugaagccc

SEQ ID NO: 3546036 - RNA, 16 nt, Human
ugucccaacuuguaaa

SEQ ID NO: 3546037 - RNA, 13 nt, Human
ugucccaagugcc

SEQ ID NO: 3546038 - RNA, 17 nt, Human
ugucccacagcuugggg

SEQ ID NO: 3546039 - RNA, 22 nt, Human
ugucccacccccacccccagcu

SEQ ID NO: 3546040 - RNA, 20 nt, Human
ugucccacccccuuccccca

SEQ ID NO: 3546041 - RNA, 22 nt, Human
ugucccaccucuucucuuccug

SEQ ID NO: 3546042 - RNA, 17 nt, Human
ugucccacgugucuucc

SEQ ID NO: 3546043 - RNA, 22 nt, Human
ugucccacgugucuuccacuuu

SEQ ID NO: 3546044 - RNA, 17 nt, Human
ugucccacucaagccaa

SEQ ID NO: 3546045 - RNA, 20 nt, Human
ugucccacucaagccaagca

SEQ ID NO: 3546046 - RNA, 21 nt, Human
ugucccagaagaugacugagg

SEQ ID NO: 3546047 - RNA, 14 nt, Human
ugucccaggcaggg

SEQ ID NO: 3546048 - RNA, 14 nt, Human
ugucccagguccuc

SEQ ID NO: 3546049 - RNA, 16 nt, Human
ugucccagguccucac

SEQ ID NO: 3546050 - RNA, 18 nt, Human
ugucccauagucccugcc

SEQ ID NO: 3546051 - RNA, 21 nt, Human
ugucccaugacccaccccugu

SEQ ID NO: 3546052 - RNA, 16 nt, Human
ugucccaugaucccug

SEQ ID NO: 3546053 - RNA, 17 nt, Human
ugucccaugcaggcccu

SEQ ID NO: 3546054 - RNA, 19 nt, Human
ugucccauggacacuccag

SEQ ID NO: 3546055 - RNA, 15 nt, Human
ugucccauucccugg

SEQ ID NO: 3546056 - RNA, 17 nt, Human
ugucccauucccuggga

SEQ ID NO: 3546057 - RNA, 18 nt, Human
ugucccauucccugggau

SEQ ID NO: 3546058 - RNA, 20 nt, Human
ugucccauuucuaaaggccu

SEQ ID NO: 3546059 - RNA, 21 nt, Human
ugucccauuuucagacugcuu

SEQ ID NO: 3546060 - RNA, 18 nt, Human
uguccccaaaccugcaag

SEQ ID NO: 3546061 - RNA, 22 nt, Human
uguccccaaauccgaaccuccu

SEQ ID NO: 3546062 - RNA, 20 nt, Human
uguccccaacagcgcccaaa

SEQ ID NO: 3546063 - RNA, 11 nt, Human
uguccccacac

SEQ ID NO: 3546064 - RNA, 14 nt, Human
uguccccacacucc

SEQ ID NO: 3546065 - RNA, 14 nt, Human
uguccccaccaucu

SEQ ID NO: 3546066 - RNA, 12 nt, Human
uguccccagcag

SEQ ID NO: 3546067 - RNA, 13 nt, Human
uguccccagccca

SEQ ID NO: 3546068 - RNA, 13 nt, Human
uguccccaucugu

SEQ ID NO: 3546069 - RNA, 17 nt, Human
ugucccccagcucuggu

SEQ ID NO: 3546070 - RNA, 20 nt, Human
ugucccccagguuccgaaga

SEQ ID NO: 3546071 - RNA, 20 nt, Human
ugucccccugagaucagagu

SEQ ID NO: 3546072 - RNA, 21 nt, Human
ugucccccugagaucagaguc

SEQ ID NO: 3546073 - RNA, 21 nt, Human
ugucccccuuuagaucucuga

SEQ ID NO: 3546074 - RNA, 16 nt, Human
uguccccggccucagc

SEQ ID NO: 3546075 - RNA, 16 nt, Human
uguccccggggcccag

SEQ ID NO: 3546076 - RNA, 17 nt, Human
uguccccguguugcaug

SEQ ID NO: 3546077 - RNA, 15 nt, Human
uguccccucuugccc

SEQ ID NO: 3546078 - RNA, 16 nt, Human
uguccccugacagggc

SEQ ID NO: 3546079 - RNA, 18 nt, Human
uguccccugacagggcca

SEQ ID NO: 3546080 - RNA, 12 nt, Human
uguccccugcuu

SEQ ID NO: 3546081 - RNA, 11 nt, Human
uguccccuucu

SEQ ID NO: 3546082 - RNA, 22 nt, Human
uguccccuucucucaucucuua

SEQ ID NO: 3546083 - RNA, 16 nt, Human
ugucccgauuguaacu

SEQ ID NO: 3546084 - RNA, 16 nt, Human
ugucccgggguccugu

SEQ ID NO: 3546085 - RNA, 19 nt, Human
ugucccgggguccuguggc

SEQ ID NO: 3546086 - RNA, 12 nt, Human
ugucccuacacc

SEQ ID NO: 3546087 - RNA, 21 nt, Human
ugucccuaccgagucucuucu

SEQ ID NO: 3546088 - RNA, 14 nt, Human
ugucccuaggucag

SEQ ID NO: 3546089 - RNA, 17 nt, Human
ugucccuaugcauauca

SEQ ID NO: 3546090 - RNA, 21 nt, Human
ugucccucacuguugaauuuu

SEQ ID NO: 3546091 - RNA, 13 nt, Human
ugucccucccacc

SEQ ID NO: 3546092 - RNA, 17 nt, Human
ugucccucccaccucug

SEQ ID NO: 3546093 - RNA, 18 nt, Human
ugucccucccaccucugu

SEQ ID NO: 3546094 - RNA, 20 nt, Human
ugucccucccaccucuguga

SEQ ID NO: 3546095 - RNA, 14 nt, Human
ugucccucccccuu

SEQ ID NO: 3546096 - RNA, 12 nt, Human
ugucccuccggg

SEQ ID NO: 3546097 - RNA, 13 nt, Human
ugucccuccuggu

SEQ ID NO: 3546098 - RNA, 11 nt, Human
ugucccucuca

SEQ ID NO: 3546099 - RNA, 14 nt, Human
ugucccucucaggc

SEQ ID NO: 3546100 - RNA, 21 nt, Human
ugucccucucggaaggcuggc

SEQ ID NO: 3546101 - RNA, 18 nt, Human
ugucccugcgccuuuccu

SEQ ID NO: 3546102 - RNA, 20 nt, Human
uaagcauuccaacuaucuca

SEQ ID NO: 3546103 - RNA, 20 nt, Human
uaagcauugaaauuauaguu

SEQ ID NO: 3546104 - RNA, 19 nt, Human
uaagcauuguuugcuuauu

SEQ ID NO: 3546105 - RNA, 16 nt, Human
uaagccaaagaaauga

SEQ ID NO: 3546106 - RNA, 20 nt, Human
uaagccaaagaaaugaacau

SEQ ID NO: 3546107 - RNA, 21 nt, Human
uaagccaaagaaaugaacauu

SEQ ID NO: 3546108 - RNA, 15 nt, Human
uaagccaauuucaau

SEQ ID NO: 3546109 - RNA, 16 nt, Human
uaagccacaagaaauu

SEQ ID NO: 3546110 - RNA, 19 nt, Human
uaagccacugccucucccu

SEQ ID NO: 3546111 - RNA, 23 nt, Human
uaagccacugccucucccucugg

SEQ ID NO: 3546112 - RNA, 15 nt, Human
ugugcaaggcagccg

SEQ ID NO: 3546113 - RNA, 19 nt, Human
ugugcaaggcagccguggg

SEQ ID NO: 3546114 - RNA, 18 nt, Human
ugugcaaguaugugagug

SEQ ID NO: 3546115 - RNA, 17 nt, Human
ugugcaauguaaauauu

SEQ ID NO: 3546116 - RNA, 15 nt, Human
ugugcaauguguaua

SEQ ID NO: 3546117 - RNA, 20 nt, Human
ugugcaauguguauaaacaa

SEQ ID NO: 3546118 - RNA, 16 nt, Human
ugugcacaggcagagc

SEQ ID NO: 3546119 - RNA, 20 nt, Human
ugugcacaucucugcuugag

SEQ ID NO: 3546120 - RNA, 15 nt, Human
ugugcacaucuguuu

SEQ ID NO: 3546121 - RNA, 13 nt, Human
ugugcacaucuuc

SEQ ID NO: 3546122 - RNA, 14 nt, Human
ugugcaccaggguu

SEQ ID NO: 3546123 - RNA, 14 nt, Human
ugugcacccauggg

SEQ ID NO: 3546124 - RNA, 19 nt, Human
ugugcacguggcauguggc

SEQ ID NO: 3546125 - RNA, 12 nt, Human
ugugcacuaagg

SEQ ID NO: 3546126 - RNA, 16 nt, Human
ugugcacuaaggggcc

SEQ ID NO: 3546127 - RNA, 20 nt, Human
ugugcacuggcaccaagugc

SEQ ID NO: 3546128 - RNA, 15 nt, Human
ugugcagaaaacauu

SEQ ID NO: 3546129 - RNA, 16 nt, Human
ugugcagaaaacauug

SEQ ID NO: 3546130 - RNA, 17 nt, Human
ugugcagaaaacauugu

SEQ ID NO: 3546131 - RNA, 19 nt, Human
ugugcagaaaacauuguuc

SEQ ID NO: 3546132 - RNA, 18 nt, Human
ugugcagacucaauaaaa

SEQ ID NO: 3546133 - RNA, 22 nt, Human
ugugcagacucaauaaaaucau

SEQ ID NO: 3546134 - RNA, 23 nt, Human
ugugcagacucaauaaaaucaug

SEQ ID NO: 3546135 - RNA, 13 nt, Human
ugugcagacuuca

SEQ ID NO: 3546136 - RNA, 21 nt, Human
ugugcagagcugaagagcugg

SEQ ID NO: 3546137 - RNA, 13 nt, Human
ugugcagaugaag

SEQ ID NO: 3546138 - RNA, 13 nt, Human
ugugcagcagauu

SEQ ID NO: 3546139 - RNA, 16 nt, Human
ugugcagcauuucacu

SEQ ID NO: 3546140 - RNA, 20 nt, Human
ugugcagcgcagcuggacuc

SEQ ID NO: 3546141 - RNA, 16 nt, Human
ugugcagcuuuugguc

SEQ ID NO: 3546142 - RNA, 18 nt, Human
ugugcaggugcuauuguu

SEQ ID NO: 3546143 - RNA, 21 nt, Human
ugugcaggugcuauuguuacu

SEQ ID NO: 3546144 - RNA, 23 nt, Human
ugugcagguggggagacugggcu

SEQ ID NO: 3546145 - RNA, 19 nt, Human
ugugcaguacuuugugcau

SEQ ID NO: 3546146 - RNA, 17 nt, Human
ugugcagucacuggagg

SEQ ID NO: 3546147 - RNA, 18 nt, Human
ugugcagucacuggaggu

SEQ ID NO: 3546148 - RNA, 14 nt, Human
ugugcaguguagcc

SEQ ID NO: 3546149 - RNA, 16 nt, Human
ugugcaguugcuguuu

SEQ ID NO: 3546150 - RNA, 19 nt, Human
ugugcauagagccacguau

SEQ ID NO: 3546151 - RNA, 18 nt, Human
ugugcauagugcugggau

SEQ ID NO: 3546152 - RNA, 15 nt, Human
ugugcauauuguaca

SEQ ID NO: 3546153 - RNA, 17 nt, Human
ugugcauauuguacacu

SEQ ID NO: 3546154 - RNA, 23 nt, Human
ugugcauguaugucuuggacacu

SEQ ID NO: 3546155 - RNA, 22 nt, Human
ugugcaugugugcgagugugug

SEQ ID NO: 3546156 - RNA, 14 nt, Human
ugugcaugugugug

SEQ ID NO: 3546157 - RNA, 23 nt, Human
ugugcauuuggugguuucagaaa

SEQ ID NO: 3546158 - RNA, 14 nt, Human
uaaucccagcuacu

SEQ ID NO: 3546159 - RNA, 19 nt, Human
uaaucccagcuacuuggga

SEQ ID NO: 3546160 - RNA, 20 nt, Human
uaaucccagcuacuugggaa

SEQ ID NO: 3546161 - RNA, 18 nt, Human
uaauccccaguaaaauug

SEQ ID NO: 3546162 - RNA, 20 nt, Human
uaauccccaguaaaauugcc

SEQ ID NO: 3546163 - RNA, 21 nt, Human
uaauccccaguaaaauugcca

SEQ ID NO: 3546164 - RNA, 15 nt, Human
uaaucccccaggaga

SEQ ID NO: 3546165 - RNA, 17 nt, Human
uaauccccuucuccccu

SEQ ID NO: 3546166 - RNA, 21 nt, Human
uaauccccuucuccccugcac

SEQ ID NO: 3546167 - RNA, 20 nt, Human
uaaucccugggcauugcuuu

SEQ ID NO: 3546168 - RNA, 19 nt, Human
uaauccgaaucucuuuuug

SEQ ID NO: 3546169 - RNA, 14 nt, Human
uaauccuguaggaa

SEQ ID NO: 3546170 - RNA, 23 nt, Human
uaauccuguaggaagguacugua

SEQ ID NO: 3546171 - RNA, 21 nt, Human
uaauccuucuaguuucccaca

SEQ ID NO: 3546172 - RNA, 16 nt, Human
uaauccuuuguuuucu

SEQ ID NO: 3546173 - RNA, 20 nt, Human
uaauccuuuguuuucugacu

SEQ ID NO: 3546174 - RNA, 13 nt, Human
uaaucgaaagaaa

SEQ ID NO: 3546175 - RNA, 16 nt, Human
uaaucgaccugccucg

SEQ ID NO: 3546176 - RNA, 15 nt, Human
uaaucggcccacagc

SEQ ID NO: 3546177 - RNA, 16 nt, Human
uaaucguguccccuau

SEQ ID NO: 3546178 - RNA, 15 nt, Human
uaaucguuaugugug

SEQ ID NO: 3546179 - RNA, 17 nt, Human
uaaucguuaugugugua

SEQ ID NO: 3546180 - RNA, 18 nt, Human
uaaucguuauguguguau

SEQ ID NO: 3546181 - RNA, 14 nt, Human
uaaucuagaacaca

SEQ ID NO: 3546182 - RNA, 18 nt, Human
uaaucuauuggguucauu

SEQ ID NO: 3546183 - RNA, 19 nt, Human
uaaucuauuucuaugagaa

SEQ ID NO: 3546184 - RNA, 17 nt, Human
uaaucucauaccucuga

SEQ ID NO: 3546185 - RNA, 18 nt, Human
uaaucuccucuuuuaucu

SEQ ID NO: 3546186 - RNA, 17 nt, Human
uaaucucucugcagcug

SEQ ID NO: 3546187 - RNA, 18 nt, Human
uaaucucucugcagcugc

SEQ ID NO: 3546188 - RNA, 23 nt, Human
uaaucucugauucccugauuuaa

SEQ ID NO: 3546189 - RNA, 17 nt, Human
uaaucucuguaaagcua

SEQ ID NO: 3546190 - RNA, 12 nt, Human
uaaucucuguua

SEQ ID NO: 3546191 - RNA, 18 nt, Human
uaaucucuguuauguacu

SEQ ID NO: 3546192 - RNA, 22 nt, Human
uaaucucuguuauguacuguac

SEQ ID NO: 3546193 - RNA, 14 nt, Human
uaaucugaaauucu

SEQ ID NO: 3546194 - RNA, 15 nt, Human
uaaucugcuaugcuu

SEQ ID NO: 3546195 - RNA, 18 nt, Human
uaaucuggacuccucugu

SEQ ID NO: 3546196 - RNA, 20 nt, Human
uaaucuggacuccucugucc

SEQ ID NO: 3546197 - RNA, 22 nt, Human
uaaucuggacuccucuguccag

SEQ ID NO: 3546198 - RNA, 16 nt, Human
uaaucugucaaaacac

SEQ ID NO: 3546199 - RNA, 17 nt, Human
uaaucugucaaaacacu

SEQ ID NO: 3546200 - RNA, 18 nt, Human
uaaucugucaaaacacug

SEQ ID NO: 3546201 - RNA, 20 nt, Human
uaaucuuaggggagagcuuu

SEQ ID NO: 3546202 - RNA, 15 nt, Human
uaaucuuauaauugu

SEQ ID NO: 3546203 - RNA, 21 nt, Human
uaaucuuauucauuuucucua

SEQ ID NO: 3546204 - RNA, 15 nt, Human
uaaucuuauuuagga

SEQ ID NO: 3546205 - RNA, 16 nt, Human
uaaucuucaguuuuau

SEQ ID NO: 3546206 - RNA, 22 nt, Human
uaaucuugaauuguaacuguuc

SEQ ID NO: 3546207 - RNA, 16 nt, Human
uaaucuuuucacaaau

SEQ ID NO: 3546208 - RNA, 17 nt, Human
uaaucuuuucacaaaua

SEQ ID NO: 3546209 - RNA, 17 nt, Human
uaaugaaacaaagaguu

SEQ ID NO: 3546210 - RNA, 18 nt, Human
uaaugaaagacuguacaa

SEQ ID NO: 3546211 - RNA, 22 nt, Human
uaaugaaagacuguacaaagua

SEQ ID NO: 3546212 - RNA, 19 nt, Human
uaaugaaagugaugacaua

SEQ ID NO: 3546213 - RNA, 13 nt, Human
uaaugaaauggag

SEQ ID NO: 3546214 - RNA, 17 nt, Human
uaaugaacaaaauuauu

SEQ ID NO: 3546215 - RNA, 13 nt, Human
uaaugaacaaaug

SEQ ID NO: 3546216 - RNA, 22 nt, Human
uaaugaagaaaguggaaaacaa

SEQ ID NO: 3546217 - RNA, 17 nt, Human
uaaugaagaucuaaaua

SEQ ID NO: 3546218 - RNA, 22 nt, Human
uaaugaagggaaaggauauuuu

SEQ ID NO: 3546219 - RNA, 15 nt, Human
uaaugaaguuugaau

SEQ ID NO: 3546220 - RNA, 16 nt, Human
uaaugaaguuugaaug

SEQ ID NO: 3546221 - RNA, 18 nt, Human
uaaugaaguuugaauguu

SEQ ID NO: 3546222 - RNA, 19 nt, Human
uaaugaaguuugaauguua

SEQ ID NO: 3546223 - RNA, 20 nt, Human
uaaugaaguuugaauguuaa

SEQ ID NO: 3546224 - RNA, 17 nt, Human
uaaugaaugaaacauuu

SEQ ID NO: 3546225 - RNA, 13 nt, Human
uaaugaaugcuua

SEQ ID NO: 3546226 - RNA, 15 nt, Human
uaaugacacuugucc

SEQ ID NO: 3546227 - RNA, 15 nt, Human
uaaugacaggccugu

SEQ ID NO: 3546228 - RNA, 20 nt, Human
uaaugacaggccuguccaac

SEQ ID NO: 3546229 - RNA, 20 nt, Human
uaaugaccaugaaagacuuc

SEQ ID NO: 3546230 - RNA, 14 nt, Human
uaaugacgaggaac

SEQ ID NO: 3546231 - RNA, 21 nt, Human
uaaugacuuaagcacacuuga

SEQ ID NO: 3546232 - RNA, 21 nt, Human
uaaugagcaauaucugcuaga

SEQ ID NO: 3546233 - RNA, 21 nt, Human
uaaugagcuauuaaaacucag

SEQ ID NO: 3546234 - RNA, 16 nt, Human
uaaugaggaugauuau

SEQ ID NO: 3546235 - RNA, 19 nt, Human
uaaugauaaguaaaugcua

SEQ ID NO: 3546236 - RNA, 16 nt, Human
uaaugauaugcuugua

SEQ ID NO: 3546237 - RNA, 22 nt, Human
uaaugaugaugggaauugugug

SEQ ID NO: 3546238 - RNA, 22 nt, Human
uaaugauggcccauucuacuug

SEQ ID NO: 3546239 - RNA, 17 nt, Human
uaaugaugucguuugaa

SEQ ID NO: 3546240 - RNA, 12 nt, Human
uaaugcacuuuc

SEQ ID NO: 3546241 - RNA, 13 nt, Human
uaaugcacuuucu

SEQ ID NO: 3546242 - RNA, 17 nt, Human
uaaugcaguaugguaca

SEQ ID NO: 3546243 - RNA, 20 nt, Human
uaaugcaguaugguacauuu

SEQ ID NO: 3546244 - RNA, 21 nt, Human
uaaugcauguuaggaaaauuu

SEQ ID NO: 3546245 - RNA, 14 nt, Human
uaaugcgauuuuau

SEQ ID NO: 3546246 - RNA, 15 nt, Human
uaaugcgauuuuauu

SEQ ID NO: 3546247 - RNA, 15 nt, Human
uaaugcgugcauacc

SEQ ID NO: 3546248 - RNA, 23 nt, Human
uaaugcgugcauaccacuuuugu

SEQ ID NO: 3546249 - RNA, 22 nt, Human
uaaugcuaaauguaagaaucau

SEQ ID NO: 3546250 - RNA, 18 nt, Human
uaaugcuacgugugauuu

SEQ ID NO: 3546251 - RNA, 13 nt, Human
uaaugcuacuguc

SEQ ID NO: 3546252 - RNA, 13 nt, Human
uaaugcuccuugu

SEQ ID NO: 3546253 - RNA, 18 nt, Human
uaaugcuccuuguuccua

SEQ ID NO: 3546254 - RNA, 16 nt, Human
uaaugcugcacuuccu

SEQ ID NO: 3546255 - RNA, 12 nt, Human
uaaugcugccuu

SEQ ID NO: 3546256 - RNA, 21 nt, Human
uaauucagguuuuuccuuuuu

SEQ ID NO: 3546257 - RNA, 21 nt, Human
uaauucaguauguuuuacacu

SEQ ID NO: 3546258 - RNA, 20 nt, Human
uaauucaguguauuucaguu

SEQ ID NO: 3546259 - RNA, 15 nt, Human
uaauucauauucuuc

SEQ ID NO: 3546260 - RNA, 18 nt, Human
uaauuccaauaugaugac

SEQ ID NO: 3546261 - RNA, 19 nt, Human
uaauuccaauaugaugacu

SEQ ID NO: 3546262 - RNA, 14 nt, Human
uaauuccacagcug

SEQ ID NO: 3546263 - RNA, 15 nt, Human
uaauuccaugaaugu

SEQ ID NO: 3546264 - RNA, 16 nt, Human
uaauucccauuuugca

SEQ ID NO: 3546265 - RNA, 21 nt, Human
uaauucccauuuugcaaaauu

SEQ ID NO: 3546266 - RNA, 15 nt, Human
uaauucccuaucuuu

SEQ ID NO: 3546267 - RNA, 13 nt, Human
uaauuccuacagc

SEQ ID NO: 3546268 - RNA, 19 nt, Human
uaauuccucaacguauugu

SEQ ID NO: 3546269 - RNA, 19 nt, Human
uaauuccuuuccagguauu

SEQ ID NO: 3546270 - RNA, 16 nt, Human
uaauucuaaccagagc

SEQ ID NO: 3546271 - RNA, 20 nt, Human
uaauucucaugugauccuuu

SEQ ID NO: 3546272 - RNA, 14 nt, Human
uaauucugaaguua

SEQ ID NO: 3546273 - RNA, 17 nt, Human
uaauucugaaguuauau

SEQ ID NO: 3546274 - RNA, 19 nt, Human
uaauucugaaguuauauuu

SEQ ID NO: 3546275 - RNA, 12 nt, Human
uaauucuguaaa

SEQ ID NO: 3546276 - RNA, 21 nt, Human
uaauucuguacauagccuaua

SEQ ID NO: 3546277 - RNA, 14 nt, Human
uaauucuguacuga

SEQ ID NO: 3546278 - RNA, 20 nt, Human
uaauucuguucugauauuaa

SEQ ID NO: 3546279 - RNA, 16 nt, Human
uaauucuuauuccaua

SEQ ID NO: 3546280 - RNA, 15 nt, Human
uaauucuuccuuugu

SEQ ID NO: 3546281 - RNA, 15 nt, Human
uaauucuucuguccu

SEQ ID NO: 3546282 - RNA, 19 nt, Human
uaauucuuugaccuguugg

SEQ ID NO: 3546283 - RNA, 16 nt, Human
uaauucuuuuuuauua

SEQ ID NO: 3546284 - RNA, 17 nt, Human
uaauucuuuuuuauuaa

SEQ ID NO: 3546285 - RNA, 19 nt, Human
uaauucuuuuuuauuaauc

SEQ ID NO: 3546286 - RNA, 21 nt, Human
uaauucuuuuuuauuaaucac

SEQ ID NO: 3546287 - RNA, 14 nt, Human
uaauugaaggaaag

SEQ ID NO: 3546288 - RNA, 22 nt, Human
uaauugaaggaaagauuuguac

SEQ ID NO: 3546289 - RNA, 17 nt, Human
uaauugacgguuuuuua

SEQ ID NO: 3546290 - RNA, 17 nt, Human
uaauugaucaguuuuca

SEQ ID NO: 3546291 - RNA, 14 nt, Human
uaauugcacaacag

SEQ ID NO: 3546292 - RNA, 11 nt, Human
uaauugcacuc

SEQ ID NO: 3546293 - RNA, 18 nt, Human
uaauugcaucucaaaauu

SEQ ID NO: 3546294 - RNA, 12 nt, Human
uaauugcauuca

SEQ ID NO: 3546295 - RNA, 17 nt, Human
uaauugcauuugcuuuu

SEQ ID NO: 3546296 - RNA, 23 nt, Human
uaauugccaaaaagugaaauaau

SEQ ID NO: 3546297 - RNA, 18 nt, Human
uaauugccaccucuaaca

SEQ ID NO: 3546298 - RNA, 11 nt, Human
uaauugccaug

SEQ ID NO: 3546299 - RNA, 16 nt, Human
uaauugcugaggcaug

SEQ ID NO: 3546300 - RNA, 18 nt, Human
uaauugcuguugaaagca

SEQ ID NO: 3546301 - RNA, 20 nt, Human
uaauugcuguugaaagcaaa

SEQ ID NO: 3546302 - RNA, 13 nt, Human
uaauugcuuauuu

SEQ ID NO: 3546303 - RNA, 21 nt, Human
uaauugcuuauuuauuguauu

SEQ ID NO: 3546304 - RNA, 12 nt, Human
uaauugcuuuga

SEQ ID NO: 3546305 - RNA, 16 nt, Human
uaauuggauuuccuaa

SEQ ID NO: 3546306 - RNA, 14 nt, Human
uaauuggcagcaga

SEQ ID NO: 3546307 - RNA, 17 nt, Human
uaauugggcacuauuua

SEQ ID NO: 3546308 - RNA, 18 nt, Human
uaauugggucauagaaau

SEQ ID NO: 3546309 - RNA, 20 nt, Human
uaauugguuaucaugggaaa

SEQ ID NO: 3546310 - RNA, 14 nt, Human
uaauuguaaacugu

SEQ ID NO: 3546311 - RNA, 17 nt, Human
uaauuguacaaaauuaa

SEQ ID NO: 3546312 - RNA, 23 nt, Human
uaauuguacaaaauuaagcaaau

SEQ ID NO: 3546313 - RNA, 22 nt, Human
uaauuguacuaaagccaaacau

SEQ ID NO: 3546314 - RNA, 16 nt, Human
uaauuguauaacaggu

SEQ ID NO: 3546315 - RNA, 23 nt, Human
uaauuguaucguauagcuguauu

SEQ ID NO: 3546316 - RNA, 15 nt, Human
uaauuguauuuuugu

SEQ ID NO: 3546317 - RNA, 21 nt, Human
uaauugugaaaaaguuaaaca

SEQ ID NO: 3546318 - RNA, 22 nt, Human
uaauugugauuagacagaacac

SEQ ID NO: 3546319 - RNA, 12 nt, Human
uaauugugugaa

SEQ ID NO: 3546320 - RNA, 20 nt, Human
uaauugugugaacuuggaag

SEQ ID NO: 3546321 - RNA, 21 nt, Human
uaauugugugaacuuggaagc

SEQ ID NO: 3546322 - RNA, 15 nt, Human
uaauugugugauauu

SEQ ID NO: 3546323 - RNA, 18 nt, Human
uaauuguguuuacauuuu

SEQ ID NO: 3546324 - RNA, 22 nt, Human
uuauauggaugauucagaaauu

SEQ ID NO: 3546325 - RNA, 16 nt, Human
uuauauguacaugaga

SEQ ID NO: 3546326 - RNA, 19 nt, Human
uuauauguacaugagaagg

SEQ ID NO: 3546327 - RNA, 15 nt, Human
uuauauguauccagu

SEQ ID NO: 3546328 - RNA, 17 nt, Human
uuauaugugaucuuugu

SEQ ID NO: 3546329 - RNA, 20 nt, Human
uuauauuaauaguaauuugu

SEQ ID NO: 3546330 - RNA, 16 nt, Human
uuauauuaugaagcuu

SEQ ID NO: 3546331 - RNA, 14 nt, Human
uuauauuccauaua

SEQ ID NO: 3546332 - RNA, 16 nt, Human
uuauauuccauauauu

SEQ ID NO: 3546333 - RNA, 21 nt, Human
uuauauuccauauauuagcau

SEQ ID NO: 3546334 - RNA, 18 nt, Human
uuauauuccucuugcauu

SEQ ID NO: 3546335 - RNA, 16 nt, Human
uuauauucucagcaga

SEQ ID NO: 3546336 - RNA, 18 nt, Human
uuauauucucagcagagu

SEQ ID NO: 3546337 - RNA, 20 nt, Human
uuauauucucagcagagugc

SEQ ID NO: 3546338 - RNA, 12 nt, Human
uuauauugaaaa

SEQ ID NO: 3546339 - RNA, 15 nt, Human
uuauauugaagacaa

SEQ ID NO: 3546340 - RNA, 14 nt, Human
uuauauugagacaa

SEQ ID NO: 3546341 - RNA, 24 nt, Human
uuauauuguaagaaauacuguaca

SEQ ID NO: 3546342 - RNA, 11 nt, Human
uuauauuuaau

SEQ ID NO: 3546343 - RNA, 19 nt, Human
uuauauuuaguuauaguuu

SEQ ID NO: 3546344 - RNA, 22 nt, Human
uuauauuuaguuauaguuucag

SEQ ID NO: 3546345 - RNA, 20 nt, Human
uuauauuuauuacuguaaga

SEQ ID NO: 3546346 - RNA, 19 nt, Human
uuauauuucaaguacacug

SEQ ID NO: 3546347 - RNA, 11 nt, Human
uuauauuucag

SEQ ID NO: 3546348 - RNA, 21 nt, Human
uuauauuucagauguaauguu

SEQ ID NO: 3546349 - RNA, 22 nt, Human
uuauauuucagauguaauguuu

SEQ ID NO: 3546350 - RNA, 23 nt, Human
uuauauuucccuaaaauacauuu

SEQ ID NO: 3546351 - RNA, 12 nt, Human
uuauauuuccuu

SEQ ID NO: 3546352 - RNA, 13 nt, Human
uuauauuuccuuu

SEQ ID NO: 3546353 - RNA, 16 nt, Human
uuauauuuccuuuaug

SEQ ID NO: 3546354 - RNA, 21 nt, Human
uuauauuuccuuuaugugaau

SEQ ID NO: 3546355 - RNA, 15 nt, Human
uuauauuugaaauau

SEQ ID NO: 3546356 - RNA, 19 nt, Human
uuauauuugaaauauugac

SEQ ID NO: 3546357 - RNA, 22 nt, Human
uuauauuuggaugcagaguuca

SEQ ID NO: 3546358 - RNA, 15 nt, Human
uuauauuuguaggag

SEQ ID NO: 3546359 - RNA, 13 nt, Human
uuauauuuguauc

SEQ ID NO: 3546360 - RNA, 18 nt, Human
uuauauuuucguaugaaa

SEQ ID NO: 3546361 - RNA, 17 nt, Human
uuauauuuucuuuguaa

SEQ ID NO: 3546362 - RNA, 13 nt, Human
uuauauuuuuaaa

SEQ ID NO: 3546363 - RNA, 17 nt, Human
uuauauuuuuaauaaaa

SEQ ID NO: 3546364 - RNA, 15 nt, Human
uuaucaaaacuuucu

SEQ ID NO: 3546365 - RNA, 23 nt, Human
uuaucaaaauagucuaaggccau

SEQ ID NO: 3546366 - RNA, 19 nt, Human
uuaucaaacccuagccuug

SEQ ID NO: 3546367 - RNA, 13 nt, Human
uuaucaaagcaua

SEQ ID NO: 3546368 - RNA, 15 nt, Human
uuaucaaagcauaga

SEQ ID NO: 3546369 - RNA, 17 nt, Human
uuaucaauagcccagga

SEQ ID NO: 3546370 - RNA, 16 nt, Human
uuaucaauaucuaaua

SEQ ID NO: 3546371 - RNA, 20 nt, Human
uuaucaaugugucuuucuaa

SEQ ID NO: 3546372 - RNA, 15 nt, Human
uuaucaauuugucau

SEQ ID NO: 3546373 - RNA, 20 nt, Human
uuaucacaaaaaagaaaaug

SEQ ID NO: 3546374 - RNA, 13 nt, Human
uuaucacacaaag

SEQ ID NO: 3546375 - RNA, 23 nt, Human
uuaucacaccaucgcuggccccu

SEQ ID NO: 3546376 - RNA, 18 nt, Human
uuaucacauguauguuuu

SEQ ID NO: 3546377 - RNA, 22 nt, Human
uuaucaccacaguaaguuccua

SEQ ID NO: 3546378 - RNA, 19 nt, Human
uuaucaccuagcugaaugu

SEQ ID NO: 3546379 - RNA, 23 nt, Human
uuaucaccuagcugaauguuuuu

SEQ ID NO: 3546380 - RNA, 18 nt, Human
uuaucacugacacaaaaa

SEQ ID NO: 3546381 - RNA, 14 nt, Human
uuaucagauacauc

SEQ ID NO: 3546382 - RNA, 21 nt, Human
uuaucagauugcuuuugugca

SEQ ID NO: 3546383 - RNA, 20 nt, Human
uuaucaguaagaaaaagaag

SEQ ID NO: 3546384 - RNA, 15 nt, Human
uuaucagucaauauu

SEQ ID NO: 3546385 - RNA, 21 nt, Human
uuaucagucauaacuaaauaa

SEQ ID NO: 3546386 - RNA, 17 nt, Human
uuaucagugacagaguu

SEQ ID NO: 3546387 - RNA, 19 nt, Human
uuaucaguuugcuaauguu

SEQ ID NO: 3546388 - RNA, 20 nt, Human
uuaucaguuugcuaauguuu

SEQ ID NO: 3546389 - RNA, 16 nt, Human
uuaucaugcaaaugcu

SEQ ID NO: 3546390 - RNA, 19 nt, Human
uuaucauggucucagucau

SEQ ID NO: 3546391 - RNA, 18 nt, Human
uuaucaugugaaaucauu

SEQ ID NO: 3546392 - RNA, 12 nt, Human
uuaucaugugua

SEQ ID NO: 3546393 - RNA, 17 nt, Human
uuaucauguuaguaaua

SEQ ID NO: 3546394 - RNA, 17 nt, Human
uuauccaaaauguguau

SEQ ID NO: 3546395 - RNA, 14 nt, Human
uuauccaaucuugu

SEQ ID NO: 3546396 - RNA, 17 nt, Human
uuauccaaucuuguuuc

SEQ ID NO: 3546397 - RNA, 19 nt, Human
uuauccacagaaacauuuu

SEQ ID NO: 3546398 - RNA, 18 nt, Human
uuauccacaugaaaauaa

SEQ ID NO: 3546399 - RNA, 16 nt, Human
uuauccaccuccaucu

SEQ ID NO: 3546400 - RNA, 12 nt, Human
uuauccaggacu

SEQ ID NO: 3546401 - RNA, 21 nt, Human
uguucuccugcugcucccuca

SEQ ID NO: 3546402 - RNA, 21 nt, Human
uguucuccuuuuccucucucc

SEQ ID NO: 3546403 - RNA, 17 nt, Human
uguucucggagugugua

SEQ ID NO: 3546404 - RNA, 18 nt, Human
uguucucggaguguguau

SEQ ID NO: 3546405 - RNA, 16 nt, Human
uguucucucuucucca

SEQ ID NO: 3546406 - RNA, 13 nt, Human
uguucucugagga

SEQ ID NO: 3546407 - RNA, 18 nt, Human
uguucucugaggacacua

SEQ ID NO: 3546408 - RNA, 13 nt, Human
uguucugaacugu

SEQ ID NO: 3546409 - RNA, 20 nt, Human
uguucugacauuaacaguuu

SEQ ID NO: 3546410 - RNA, 14 nt, Human
uguucugacccugc

SEQ ID NO: 3546411 - RNA, 16 nt, Human
uguucugauuagaaau

SEQ ID NO: 3546412 - RNA, 12 nt, Human
uguucugcacug

SEQ ID NO: 3546413 - RNA, 15 nt, Human
uguucugcacugaaa

SEQ ID NO: 3546414 - RNA, 17 nt, Human
uguucugcacugaaaag

SEQ ID NO: 3546415 - RNA, 16 nt, Human
uguucugcccccagcc

SEQ ID NO: 3546416 - RNA, 18 nt, Human
uguucugcccccagccca

SEQ ID NO: 3546417 - RNA, 18 nt, Human
uguucugcuguucucuag

SEQ ID NO: 3546418 - RNA, 13 nt, Human
uguucuggcccuc

SEQ ID NO: 3546419 - RNA, 12 nt, Human
uguucugggaca

SEQ ID NO: 3546420 - RNA, 21 nt, Human
uguucuggugaggccuugcuc

SEQ ID NO: 3546421 - RNA, 15 nt, Human
uguucugugauauaa

SEQ ID NO: 3546422 - RNA, 18 nt, Human
uguucugugauauaagug

SEQ ID NO: 3546423 - RNA, 22 nt, Human
uguucuguggaaaguguaaagc

SEQ ID NO: 3546424 - RNA, 14 nt, Human
uguucugugucuuu

SEQ ID NO: 3546425 - RNA, 21 nt, Human
uguucuguuaacugaauacca

SEQ ID NO: 3546426 - RNA, 14 nt, Human
uguucuguuuguua

SEQ ID NO: 3546427 - RNA, 17 nt, Human
uguucuguuuguuaaaa

SEQ ID NO: 3546428 - RNA, 21 nt, Human
uguucuguuuguuaaaacugg

SEQ ID NO: 3546429 - RNA, 19 nt, Human
uguucuguuuguuauuguu

SEQ ID NO: 3546430 - RNA, 14 nt, Human
uguucuuacacaua

SEQ ID NO: 3546431 - RNA, 22 nt, Human
uguucuuaccuguaugucucca

SEQ ID NO: 3546432 - RNA, 18 nt, Human
uguucuuagcucaaugag

SEQ ID NO: 3546433 - RNA, 11 nt, Human
uguucuuccag

SEQ ID NO: 3546434 - RNA, 13 nt, Human
uguucuuccucca

SEQ ID NO: 3546435 - RNA, 12 nt, Human
uguucuuccugg

SEQ ID NO: 3546436 - RNA, 15 nt, Human
uguucuuccuggccg

SEQ ID NO: 3546437 - RNA, 13 nt, Human
uguucuugaauuu

SEQ ID NO: 3546438 - RNA, 23 nt, Human
uguucuugaauuuaauaaucugu

SEQ ID NO: 3546439 - RNA, 13 nt, Human
uguucuugcugcu

SEQ ID NO: 3546440 - RNA, 14 nt, Human
uguucuugcugcua

SEQ ID NO: 3546441 - RNA, 17 nt, Human
uguucuugcugcuagaa

SEQ ID NO: 3546442 - RNA, 20 nt, Human
uguucuuggcaauaaauuuu

SEQ ID NO: 3546443 - RNA, 20 nt, Human
uguucuugguuuguaaauua

SEQ ID NO: 3546444 - RNA, 18 nt, Human
uguucuuguuuuuaaguu

SEQ ID NO: 3546445 - RNA, 13 nt, Human
uguucuuuauaua

SEQ ID NO: 3546446 - RNA, 14 nt, Human
uguucuuuauauac

SEQ ID NO: 3546447 - RNA, 15 nt, Human
uguucuuuauauaca

SEQ ID NO: 3546448 - RNA, 15 nt, Human
uguucuuucagaaag

SEQ ID NO: 3546449 - RNA, 13 nt, Human
uguucuuuccaaa

SEQ ID NO: 3546450 - RNA, 21 nt, Human
uguucuuuucccccaaagugg

SEQ ID NO: 3546451 - RNA, 14 nt, Human
uguucuuuuuauug

SEQ ID NO: 3546452 - RNA, 13 nt, Human
uguugaaaaaauu

SEQ ID NO: 3546453 - RNA, 18 nt, Human
uguugaaaaccaaaauga

SEQ ID NO: 3546454 - RNA, 20 nt, Human
uguugaaaagaguaguacuu

SEQ ID NO: 3546455 - RNA, 21 nt, Human
uguugaaacggaugauuucua

SEQ ID NO: 3546456 - RNA, 12 nt, Human
uguugaacaaaa

SEQ ID NO: 3546457 - RNA, 15 nt, Human
uguugaacaaaauaa

SEQ ID NO: 3546458 - RNA, 15 nt, Human
uguugaacuguuaga

SEQ ID NO: 3546459 - RNA, 11 nt, Human
uguugaagagc

SEQ ID NO: 3546460 - RNA, 19 nt, Human
uguugaagagguuuuaaag

SEQ ID NO: 3546461 - RNA, 22 nt, Human
uguugaaugcccacaggcaaau

SEQ ID NO: 3546462 - RNA, 19 nt, Human
uguugacauccaagcuucc

SEQ ID NO: 3546463 - RNA, 14 nt, Human
uguugacaugugcu

SEQ ID NO: 3546464 - RNA, 12 nt, Human
uguugacauuag

SEQ ID NO: 3546465 - RNA, 23 nt, Human
uguugacauucugaaugcuucua

SEQ ID NO: 3546466 - RNA, 22 nt, Human
uguugaccaggcaccuccccuc

SEQ ID NO: 3546467 - RNA, 18 nt, Human
uguugaccaugucuauga

SEQ ID NO: 3546468 - RNA, 16 nt, Human
uguugacgcaccugug

SEQ ID NO: 3546469 - RNA, 22 nt, Human
uguugagaaucccaaauuugau

SEQ ID NO: 3546470 - RNA, 13 nt, Human
uguugagagguuc

SEQ ID NO: 3546471 - RNA, 16 nt, Human
uguugagccuuuuccc

SEQ ID NO: 3546472 - RNA, 21 nt, Human
uguugagcugguaacaucguu

SEQ ID NO: 3546473 - RNA, 13 nt, Human
uguugagcuguuu

SEQ ID NO: 3546474 - RNA, 22 nt, Human
uguugaggcuuauauuugugua

SEQ ID NO: 3546475 - RNA, 19 nt, Human
uguugauaaaaauacugac

SEQ ID NO: 3546476 - RNA, 22 nt, Human
uguugauaaauuccacuggacu

SEQ ID NO: 3546477 - RNA, 17 nt, Human
uguugaucauguacuuu

SEQ ID NO: 3546478 - RNA, 20 nt, Human
uguugaucauguacuuuuua

SEQ ID NO: 3546479 - RNA, 20 nt, Human
uguugauccauccagcuugc

SEQ ID NO: 3546480 - RNA, 20 nt, Human
uguugaugcaauccuuacaa

SEQ ID NO: 3546481 - RNA, 16 nt, Human
uguugaugcuguauuc

SEQ ID NO: 3546482 - RNA, 16 nt, Human
uguugaugcuuucguc

SEQ ID NO: 3546483 - RNA, 21 nt, Human
uguugaugggaugauugaaga

SEQ ID NO: 3546484 - RNA, 23 nt, Human
uguugaugggaugauugaagaaa

SEQ ID NO: 3546485 - RNA, 13 nt, Human
uguugauguaucu

SEQ ID NO: 3546486 - RNA, 13 nt, Human
uguugauuaaaac

SEQ ID NO: 3546487 - RNA, 11 nt, Human
uguugauuauu

SEQ ID NO: 3546488 - RNA, 16 nt, Human
uguugauuauuagcca

SEQ ID NO: 3546489 - RNA, 13 nt, Human
uguugauugcuaa

SEQ ID NO: 3546490 - RNA, 14 nt, Human
uguugauugcuaaa

SEQ ID NO: 3546491 - RNA, 16 nt, Human
uguugauugcuaaaug

SEQ ID NO: 3546492 - RNA, 17 nt, Human
uguugauugcuaaaugu

SEQ ID NO: 3546493 - RNA, 19 nt, Human
uguugauugcuaaauguaa

SEQ ID NO: 3546494 - RNA, 20 nt, Human
uguugauuuuuacuguguuu

SEQ ID NO: 3546495 - RNA, 16 nt, Human
uguugcaagaugugaa

SEQ ID NO: 3546496 - RNA, 19 nt, Human
uguugcaagaugugaauua

SEQ ID NO: 3546497 - RNA, 17 nt, Human
uguugcacccagcccug

SEQ ID NO: 3546498 - RNA, 19 nt, Human
uguugcacccagcccuggu

SEQ ID NO: 3546499 - RNA, 15 nt, Human
uguugcauagaauaa

SEQ ID NO: 3546500 - RNA, 14 nt, Human
uguugcauggaugu

SEQ ID NO: 3546501 - RNA, 15 nt, Human
uguugcauguuugaa

SEQ ID NO: 3546502 - RNA, 20 nt, Human
uguugccaaauauguccugg

SEQ ID NO: 3546503 - RNA, 22 nt, Human
uguugccaaauauguccugggg

SEQ ID NO: 3546504 - RNA, 20 nt, Human
uguugccaagcuccaagccc

SEQ ID NO: 3546505 - RNA, 14 nt, Human
uguugccacaggac

SEQ ID NO: 3546506 - RNA, 16 nt, Human
uguugccacuuuccaa

SEQ ID NO: 3546507 - RNA, 15 nt, Human
uguugccauguguuu

SEQ ID NO: 3546508 - RNA, 18 nt, Human
uguugcccaggcaggucu

SEQ ID NO: 3546509 - RNA, 19 nt, Human
uguugcccaggcaggucuu

SEQ ID NO: 3546510 - RNA, 20 nt, Human
uguugcccaggcuggcgugc

SEQ ID NO: 3546511 - RNA, 23 nt, Human
uguugcccaggcuggcgugcagu

SEQ ID NO: 3546512 - RNA, 17 nt, Human
uguugccccuuucucuu

SEQ ID NO: 3546513 - RNA, 12 nt, Human
uguugcccuggg

SEQ ID NO: 3546514 - RNA, 15 nt, Human
uguugcccuuucugu

SEQ ID NO: 3546515 - RNA, 22 nt, Human
uguugccuaaguauuaaaacau

SEQ ID NO: 3546516 - RNA, 18 nt, Human
uguugccuauaagccaaa

SEQ ID NO: 3546517 - RNA, 20 nt, Human
uguugccuugaaccacuucc

SEQ ID NO: 3546518 - RNA, 22 nt, Human
uguugccuuuuucauuuuccaa

SEQ ID NO: 3546519 - RNA, 19 nt, Human
uguugcucaaaaaaugagc

SEQ ID NO: 3546520 - RNA, 14 nt, Human
uguugcucagaagu

SEQ ID NO: 3546521 - RNA, 14 nt, Human
uguugcucagucuc

SEQ ID NO: 3546522 - RNA, 17 nt, Human
uguugcucuaggaagac

SEQ ID NO: 3546523 - RNA, 15 nt, Human
uguugcuuacaauuu

SEQ ID NO: 3546524 - RNA, 17 nt, Human
uguugcuucuugugaag

SEQ ID NO: 3546525 - RNA, 14 nt, Human
uguugcuuggacua

SEQ ID NO: 3546526 - RNA, 12 nt, Human
uguugcuuuguu

SEQ ID NO: 3546527 - RNA, 13 nt, Human
uguuggaaaaaau

SEQ ID NO: 3546528 - RNA, 14 nt, Human
uguuggaaaaaauu

SEQ ID NO: 3546529 - RNA, 15 nt, Human
uguuggaaaaaauuu

SEQ ID NO: 3546530 - RNA, 13 nt, Human
uguuggaaaagaa

SEQ ID NO: 3546531 - RNA, 20 nt, Human
uguuggacaaaugugaagau

SEQ ID NO: 3546532 - RNA, 20 nt, Human
uucaagucuaccaauuauaa

SEQ ID NO: 3546533 - RNA, 20 nt, Human
uucaagugauucuccugccu

SEQ ID NO: 3546534 - RNA, 18 nt, Human
uucaagugcuucuccagc

SEQ ID NO: 3546535 - RNA, 18 nt, Human
uucaaguggggcucgcca

SEQ ID NO: 3546536 - RNA, 19 nt, Human
uucaaguguaaaauauuuu

SEQ ID NO: 3546537 - RNA, 14 nt, Human
uucaaguuauugua

SEQ ID NO: 3546538 - RNA, 20 nt, Human
uucaaguuauuguacagcug

SEQ ID NO: 3546539 - RNA, 14 nt, Human
uucaaguucaaucc

SEQ ID NO: 3546540 - RNA, 23 nt, Human
uucaaguuccaaguugcuaauac

SEQ ID NO: 3546541 - RNA, 14 nt, Human
uucaaguuuuaaag

SEQ ID NO: 3546542 - RNA, 15 nt, Human
uucaaguuuuaaagu

SEQ ID NO: 3546543 - RNA, 14 nt, Human
uucaauaaaguauc

SEQ ID NO: 3546544 - RNA, 18 nt, Human
uucaauaaaguauuuaau

SEQ ID NO: 3546545 - RNA, 18 nt, Human
uucaauaaaguuugaucu

SEQ ID NO: 3546546 - RNA, 21 nt, Human
uucaauaaaguuugaucuucc

SEQ ID NO: 3546547 - RNA, 11 nt, Human
uucagaaaaaa

SEQ ID NO: 3546548 - RNA, 12 nt, Human
uucagaaaacag

SEQ ID NO: 3546549 - RNA, 18 nt, Human
uucagaaaacagaaaaaa

SEQ ID NO: 3546550 - RNA, 19 nt, Human
uucagaaaacagaaaaaaa

SEQ ID NO: 3546551 - RNA, 22 nt, Human
uucagaaaacagaaaaaaaaca

SEQ ID NO: 3546552 - RNA, 23 nt, Human
uucagaaaacagaaaaaaaacac

SEQ ID NO: 3546553 - RNA, 23 nt, Human
uucagaaaacccuuuucuacagu

SEQ ID NO: 3546554 - RNA, 20 nt, Human
uucagaaaauauuauguguu

SEQ ID NO: 3546555 - RNA, 22 nt, Human
uucagaaacaaagcauuugacu

SEQ ID NO: 3546556 - RNA, 15 nt, Human
uucagaaagaagugg

SEQ ID NO: 3546557 - RNA, 16 nt, Human
uucagaaagacuuggu

SEQ ID NO: 3546558 - RNA, 21 nt, Human
uucagaaagccuuucauuuug

SEQ ID NO: 3546559 - RNA, 15 nt, Human
uucagaaaugcugcc

SEQ ID NO: 3546560 - RNA, 16 nt, Human
uucagaaaugcugccu

SEQ ID NO: 3546561 - RNA, 13 nt, Human
uucagaaauugga

SEQ ID NO: 3546562 - RNA, 20 nt, Human
uucagaacaccaagacuuga

SEQ ID NO: 3546563 - RNA, 22 nt, Human
uucagaaccccaacuacugugu

SEQ ID NO: 3546564 - RNA, 16 nt, Human
uucagaaccucuuccc

SEQ ID NO: 3546565 - RNA, 18 nt, Human
uucagaaccucuucccca

SEQ ID NO: 3546566 - RNA, 14 nt, Human
uucagaagaaaaag

SEQ ID NO: 3546567 - RNA, 12 nt, Human
uucagaagagau

SEQ ID NO: 3546568 - RNA, 23 nt, Human
uucagaagugagcuuugcugcua

SEQ ID NO: 3546569 - RNA, 23 nt, Human
uucagaaguuuggcaauaguuug

SEQ ID NO: 3546570 - RNA, 15 nt, Human
uucagaaucacuucu

SEQ ID NO: 3546571 - RNA, 15 nt, Human
uucagaaucugaaug

SEQ ID NO: 3546572 - RNA, 23 nt, Human
uucagaaucugaauguaauuugu

SEQ ID NO: 3546573 - RNA, 16 nt, Human
uucagaaucuuuguua

SEQ ID NO: 3546574 - RNA, 15 nt, Human
uucagaauuuagugu

SEQ ID NO: 3546575 - RNA, 21 nt, Human
uucagacagcugccugggauc

SEQ ID NO: 3546576 - RNA, 20 nt, Human
uucagacauagaauuaacac

SEQ ID NO: 3546577 - RNA, 10 nt, Human
uucagacccc

SEQ ID NO: 3546578 - RNA, 13 nt, Human
uucagaccccagc

SEQ ID NO: 3546579 - RNA, 14 nt, Human
uucagacucagacu

SEQ ID NO: 3546580 - RNA, 21 nt, Human
uucagacucccauuccugaag

SEQ ID NO: 3546581 - RNA, 13 nt, Human
uucagacucucuc

SEQ ID NO: 3546582 - RNA, 15 nt, Human
uucagacuugucaag

SEQ ID NO: 3546583 - RNA, 20 nt, Human
uucagagacucagggcccca

SEQ ID NO: 3546584 - RNA, 21 nt, Human
uucagagacucagggccccag

SEQ ID NO: 3546585 - RNA, 15 nt, Human
uucagagacuccugc

SEQ ID NO: 3546586 - RNA, 13 nt, Human
uucagagagcagu

SEQ ID NO: 3546587 - RNA, 18 nt, Human
uucagagagcagugcuuu

SEQ ID NO: 3546588 - RNA, 19 nt, Human
uucagagagcuaaauuaca

SEQ ID NO: 3546589 - RNA, 14 nt, Human
uucagagagcuggu

SEQ ID NO: 3546590 - RNA, 15 nt, Human
uucagagagcuggua

SEQ ID NO: 3546591 - RNA, 13 nt, Human
uucagagcugccc

SEQ ID NO: 3546592 - RNA, 20 nt, Human
uucagagcugcccucuccug

SEQ ID NO: 3546593 - RNA, 22 nt, Human
uucagaggcucagauuguaaua

SEQ ID NO: 3546594 - RNA, 16 nt, Human
uucagaggcugaggug

SEQ ID NO: 3546595 - RNA, 19 nt, Human
uucagagguggcucuggaa

SEQ ID NO: 3546596 - RNA, 22 nt, Human
uucagaguucuuuuugaaguau

SEQ ID NO: 3546597 - RNA, 21 nt, Human
uucagaguugaugguuguaca

SEQ ID NO: 3546598 - RNA, 22 nt, Human
uucagaguugaugguuguacau

SEQ ID NO: 3546599 - RNA, 18 nt, Human
uucagauaacuguuauuu

SEQ ID NO: 3546600 - RNA, 20 nt, Human
uucagauaaucacaauacau

SEQ ID NO: 3546601 - RNA, 22 nt, Human
uucagauauaaaagacugacca

SEQ ID NO: 3546602 - RNA, 22 nt, Human
uucagauaucuuggacaaauca

SEQ ID NO: 3546603 - RNA, 16 nt, Human
uucagauaugauucaa

SEQ ID NO: 3546604 - RNA, 17 nt, Human
uucagauaugauucaaa

SEQ ID NO: 3546605 - RNA, 16 nt, Human
uucagaucacugaauu

SEQ ID NO: 3546606 - RNA, 17 nt, Human
uucagaucucuaacuuc

SEQ ID NO: 3546607 - RNA, 19 nt, Human
uucagaucuuaauauaaau

SEQ ID NO: 3546608 - RNA, 19 nt, Human
uucagaugcuucugggaga

SEQ ID NO: 3546609 - RNA, 15 nt, Human
uucagauguaauguu

SEQ ID NO: 3546610 - RNA, 16 nt, Human
uucagauguaauguuu

SEQ ID NO: 3546611 - RNA, 18 nt, Human
uucagaugucuucugccu

SEQ ID NO: 3546612 - RNA, 14 nt, Human
uucagauucccaga

SEQ ID NO: 3546613 - RNA, 15 nt, Human
uucagauuggacaua

SEQ ID NO: 3546614 - RNA, 16 nt, Human
uucagauuugcacaaa

SEQ ID NO: 3546615 - RNA, 23 nt, Human
uucagauuuugauaacuguuuau

SEQ ID NO: 3546616 - RNA, 21 nt, Human
uucagcaaaaauauuuuauga

SEQ ID NO: 3546617 - RNA, 22 nt, Human
uucagcaaacuuguugaauuua

SEQ ID NO: 3546618 - RNA, 13 nt, Human
uucagcaagacaa

SEQ ID NO: 3546619 - RNA, 18 nt, Human
uucagcaagauaaacauu

SEQ ID NO: 3546620 - RNA, 19 nt, Human
uucagcaagauaaacauua

SEQ ID NO: 3546621 - RNA, 21 nt, Human
uucagcaaggcgcuaacuugc

SEQ ID NO: 3546622 - RNA, 18 nt, Human
uucagcaauauuuaagga

SEQ ID NO: 3546623 - RNA, 10 nt, Human
uucagcacca

SEQ ID NO: 3546624 - RNA, 23 nt, Human
uucagcaccuacaguguacaguc

SEQ ID NO: 3546625 - RNA, 19 nt, Human
uucagcacuagccaaaccu

SEQ ID NO: 3546626 - RNA, 23 nt, Human
uucagcacuagccaaaccucacc

SEQ ID NO: 3546627 - RNA, 13 nt, Human
uucagcacugucc

SEQ ID NO: 3546628 - RNA, 15 nt, Human
uucagcacugucccu

SEQ ID NO: 3546629 - RNA, 15 nt, Human
uucagcacuugucuc

SEQ ID NO: 3546630 - RNA, 20 nt, Human
uucagcagcaaauuuucagc

SEQ ID NO: 3546631 - RNA, 12 nt, Human
uucagcaucuga

SEQ ID NO: 3546632 - RNA, 21 nt, Human
uucagcaucugaccucuaccu

SEQ ID NO: 3546633 - RNA, 12 nt, Human
uucagcaugcaa

SEQ ID NO: 3546634 - RNA, 19 nt, Human
uucagcauucuuagccugu

SEQ ID NO: 3546635 - RNA, 20 nt, Human
uucagcauucuuagccugug

SEQ ID NO: 3546636 - RNA, 11 nt, Human
uucagccaagg

SEQ ID NO: 3546637 - RNA, 21 nt, Human
uucagccacugagggacaaaa

SEQ ID NO: 3546638 - RNA, 12 nt, Human
uucagccaggag

SEQ ID NO: 3546639 - RNA, 17 nt, Human
uucagccaggagcuggg

SEQ ID NO: 3546640 - RNA, 16 nt, Human
uucagccauguacaga

SEQ ID NO: 3546641 - RNA, 20 nt, Human
uucagcccauauuucaucgu

SEQ ID NO: 3546642 - RNA, 13 nt, Human
uucagcccccagc

SEQ ID NO: 3546643 - RNA, 15 nt, Human
uucagcccccagccc

SEQ ID NO: 3546644 - RNA, 13 nt, Human
uucagccccuccu

SEQ ID NO: 3546645 - RNA, 18 nt, Human
uucagccccuccucugcc

SEQ ID NO: 3546646 - RNA, 20 nt, Human
uucagccccuccucugccac

SEQ ID NO: 3546647 - RNA, 23 nt, Human
uucagccuagccgaccucagccu

SEQ ID NO: 3546648 - RNA, 15 nt, Human
uucagccugccuucu

SEQ ID NO: 3546649 - RNA, 20 nt, Human
uucagccugccuucuuuucu

SEQ ID NO: 3546650 - RNA, 16 nt, Human
uucagcgauguaugca

SEQ ID NO: 3546651 - RNA, 24 nt, Human
uucagcgauguaugcagcuaucug

SEQ ID NO: 3546652 - RNA, 14 nt, Human
uucagcuaagcuag

SEQ ID NO: 3546653 - RNA, 23 nt, Human
uucagcuaagggaagacauuucu

SEQ ID NO: 3546654 - RNA, 14 nt, Human
uucagcucacgcuu

SEQ ID NO: 3546655 - RNA, 16 nt, Human
uucagcucacgcuuca

SEQ ID NO: 3546656 - RNA, 19 nt, Human
uucagcucacgcuucacag

SEQ ID NO: 3546657 - RNA, 14 nt, Human
uucagcuccagccc

SEQ ID NO: 3546658 - RNA, 22 nt, Human
uucagcuccagccccuuuccaa

SEQ ID NO: 3546659 - RNA, 13 nt, Human
uucagcuccugac

SEQ ID NO: 3546660 - RNA, 15 nt, Human
uucagcucucuguau

SEQ ID NO: 3546661 - RNA, 16 nt, Human
uucagcucucuguaua

SEQ ID NO: 3546662 - RNA, 19 nt, Human
uucagcuguccucccucca

SEQ ID NO: 3546663 - RNA, 23 nt, Human
uucagcugugaacauggacucuu

SEQ ID NO: 3546664 - RNA, 22 nt, Human
uucagcuucguuuauuuucaag

SEQ ID NO: 3546665 - RNA, 15 nt, Human
uucagcuucugcugg

SEQ ID NO: 3546666 - RNA, 18 nt, Human
uucagcuucugcugggcu

SEQ ID NO: 3546667 - RNA, 22 nt, Human
uucagcuuguaaauagcucagg

SEQ ID NO: 3546668 - RNA, 16 nt, Human
uucaggaacaccccca

SEQ ID NO: 3546669 - RNA, 11 nt, Human
uucaggaaccu

SEQ ID NO: 3546670 - RNA, 21 nt, Human
uucaggaaccucgaguacugu

SEQ ID NO: 3546671 - RNA, 16 nt, Human
uucaggaaccuggacc

SEQ ID NO: 3546672 - RNA, 22 nt, Human
uucaggaaccuggaccaaagcu

SEQ ID NO: 3546673 - RNA, 14 nt, Human
uucaggaagaugaa

SEQ ID NO: 3546674 - RNA, 15 nt, Human
uucaggaagcucagg

SEQ ID NO: 3546675 - RNA, 17 nt, Human
uucaggaagcucagggc

SEQ ID NO: 3546676 - RNA, 20 nt, Human
uucaggaagcucagggccug

SEQ ID NO: 3546677 - RNA, 14 nt, Human
uucaggagcgcaag

SEQ ID NO: 3546678 - RNA, 15 nt, Human
uucaggaggaauacu

SEQ ID NO: 3546679 - RNA, 14 nt, Human
uucaggaggcugga

SEQ ID NO: 3546680 - RNA, 22 nt, Human
uucaggaucuauuuuuggaggu

SEQ ID NO: 3546681 - RNA, 23 nt, Human
uucaggaucuauuuuuggagguu

SEQ ID NO: 3546682 - RNA, 13 nt, Human
uucaggcucuucu

SEQ ID NO: 3546683 - RNA, 16 nt, Human
uucaggcucuucuccu

SEQ ID NO: 3546684 - RNA, 19 nt, Human
uucaggcuuccugcaauuu

SEQ ID NO: 3546685 - RNA, 22 nt, Human
uucaggcuuuaggcauaugcuu

SEQ ID NO: 3546686 - RNA, 20 nt, Human
uucagggaagauaaguugga

SEQ ID NO: 3546687 - RNA, 23 nt, Human
uucagggaagauaaguuggaaac

SEQ ID NO: 3546688 - RNA, 20 nt, Human
uucagggaaggaggagccug

SEQ ID NO: 3546689 - RNA, 21 nt, Human
uucagggaaggaggagccugu

SEQ ID NO: 3546690 - RNA, 22 nt, Human
uucagggaaggaggagccuguc

SEQ ID NO: 3546691 - RNA, 23 nt, Human
uucccucaaagcuuccauuccac

SEQ ID NO: 3546692 - RNA, 13 nt, Human
uucccucaccccc

SEQ ID NO: 3546693 - RNA, 22 nt, Human
uucccucacccccucccacccc

SEQ ID NO: 3546694 - RNA, 15 nt, Human
uucccucaucucucc

SEQ ID NO: 3546695 - RNA, 23 nt, Human
uucccucccugcugucauugcuu

SEQ ID NO: 3546696 - RNA, 18 nt, Human
uucccucggaguucuucu

SEQ ID NO: 3546697 - RNA, 19 nt, Human
uucccucggaguucuucuu

SEQ ID NO: 3546698 - RNA, 17 nt, Human
uucccucgucuuuccca

SEQ ID NO: 3546699 - RNA, 14 nt, Human
uucccucucccagg

SEQ ID NO: 3546700 - RNA, 15 nt, Human
uucccucucccaggc

SEQ ID NO: 3546701 - RNA, 17 nt, Human
uucccucucccaggccc

SEQ ID NO: 3546702 - RNA, 14 nt, Human
uucccucucccugu

SEQ ID NO: 3546703 - RNA, 15 nt, Human
uucccucucucugac

SEQ ID NO: 3546704 - RNA, 23 nt, Human
uucccucugagaauuccaaggag

SEQ ID NO: 3546705 - RNA, 13 nt, Human
uucccucugccug

SEQ ID NO: 3546706 - RNA, 17 nt, Human
uucccucugccuguccc

SEQ ID NO: 3546707 - RNA, 14 nt, Human
uucccucugcucag

SEQ ID NO: 3546708 - RNA, 19 nt, Human
uucccucugcuccuggagc

SEQ ID NO: 3546709 - RNA, 20 nt, Human
uucccucuuucuuauaauac

SEQ ID NO: 3546710 - RNA, 16 nt, Human
uucccucuuuggcucc

SEQ ID NO: 3546711 - RNA, 14 nt, Human
uucccucuuuucuu

SEQ ID NO: 3546712 - RNA, 17 nt, Human
uucccucuuuucuuacu

SEQ ID NO: 3546713 - RNA, 17 nt, Human
uucccugaaaacccaga

SEQ ID NO: 3546714 - RNA, 19 nt, Human
uucccugaaaacccagaga

SEQ ID NO: 3546715 - RNA, 22 nt, Human
uucccugaaacacgaaacuugu

SEQ ID NO: 3546716 - RNA, 23 nt, Human
uucccugaaacacgaaacuuguu

SEQ ID NO: 3546717 - RNA, 16 nt, Human
uucccugaaggaacca

SEQ ID NO: 3546718 - RNA, 16 nt, Human
uucccugacucauucu

SEQ ID NO: 3546719 - RNA, 18 nt, Human
uucccugagucaccagga

SEQ ID NO: 3546720 - RNA, 12 nt, Human
uucccugaucaa

SEQ ID NO: 3546721 - RNA, 22 nt, Human
uucccugcugucgucuuagcaa

SEQ ID NO: 3546722 - RNA, 22 nt, Human
uucccugcugugaaagaaguaa

SEQ ID NO: 3546723 - RNA, 13 nt, Human
uucccugcuucca

SEQ ID NO: 3546724 - RNA, 19 nt, Human
uucccuggaccagaugcug

SEQ ID NO: 3546725 - RNA, 16 nt, Human
uucccugguaagaaaa

SEQ ID NO: 3546726 - RNA, 17 nt, Human
uucccugguaagaaaaa

SEQ ID NO: 3546727 - RNA, 18 nt, Human
uucccugguaagaaaaag

SEQ ID NO: 3546728 - RNA, 16 nt, Human
uucccuguauuuucuu

SEQ ID NO: 3546729 - RNA, 11 nt, Human
uucccugugcu

SEQ ID NO: 3546730 - RNA, 16 nt, Human
uucccuguucuuccuc

SEQ ID NO: 3546731 - RNA, 18 nt, Human
uucccuguucuuccucca

SEQ ID NO: 3546732 - RNA, 19 nt, Human
uucccuguucuuccuccag

SEQ ID NO: 3546733 - RNA, 12 nt, Human
uucccuuccucu

SEQ ID NO: 3546734 - RNA, 13 nt, Human
uucccuuccucuu

SEQ ID NO: 3546735 - RNA, 14 nt, Human
uucccuugaaacuu

SEQ ID NO: 3546736 - RNA, 23 nt, Human
uucccuugaaauuuuaaacuaua

SEQ ID NO: 3546737 - RNA, 19 nt, Human
uucccuugccacuuugcac

SEQ ID NO: 3546738 - RNA, 17 nt, Human
uucccuugcuuuucccu

SEQ ID NO: 3546739 - RNA, 19 nt, Human
uucccuugcuuuucccucu

SEQ ID NO: 3546740 - RNA, 12 nt, Human
uucccuuggccu

SEQ ID NO: 3546741 - RNA, 16 nt, Human
uucccuuggccucaga

SEQ ID NO: 3546742 - RNA, 15 nt, Human
uucccuuuagcugug

SEQ ID NO: 3546743 - RNA, 22 nt, Human
uucccuuugacgccaucccagc

SEQ ID NO: 3546744 - RNA, 12 nt, Human
uucccuuuguga

SEQ ID NO: 3546745 - RNA, 18 nt, Human
uucccuuuuuuggcugcu

SEQ ID NO: 3546746 - RNA, 13 nt, Human
uuccgcacuuucc

SEQ ID NO: 3546747 - RNA, 22 nt, Human
uuccgcacuuuccacuucuucc

SEQ ID NO: 3546748 - RNA, 18 nt, Human
uuccgccacuggggcuca

SEQ ID NO: 3546749 - RNA, 21 nt, Human
uuccggaauccuguccucagc

SEQ ID NO: 3546750 - RNA, 21 nt, Human
uuccggccccuccccuccaaa

SEQ ID NO: 3546751 - RNA, 17 nt, Human
uuccguaacccaacucu

SEQ ID NO: 3546752 - RNA, 18 nt, Human
uuccguagccagcugcuc

SEQ ID NO: 3546753 - RNA, 19 nt, Human
uuccgucaacguuguacug

SEQ ID NO: 3546754 - RNA, 20 nt, Human
uuaaauucuugcaaaguauc

SEQ ID NO: 3546755 - RNA, 16 nt, Human
uuaaauuggaaagcag

SEQ ID NO: 3546756 - RNA, 14 nt, Human
uuaaauuggguuca

SEQ ID NO: 3546757 - RNA, 19 nt, Human
uuaaauuucuuaugugaca

SEQ ID NO: 3546758 - RNA, 13 nt, Human
uuaaauuuguaag

SEQ ID NO: 3546759 - RNA, 14 nt, Human
uuaaauuuguaagu

SEQ ID NO: 3546760 - RNA, 15 nt, Human
uuaaauuuguaaguu

SEQ ID NO: 3546761 - RNA, 17 nt, Human
uuaaauuuucuucaguu

SEQ ID NO: 3546762 - RNA, 14 nt, Human
uuaaauuuuguaau

SEQ ID NO: 3546763 - RNA, 15 nt, Human
uuaaauuuuguaaug

SEQ ID NO: 3546764 - RNA, 12 nt, Human
uuaaauuuuucc

SEQ ID NO: 3546765 - RNA, 20 nt, Human
uuaaauuuuuuuguaugaaa

SEQ ID NO: 3546766 - RNA, 17 nt, Human
uuaaauuuuuuuuacau

SEQ ID NO: 3546767 - RNA, 19 nt, Human
uuaaauuuuuuuuacauuu

SEQ ID NO: 3546768 - RNA, 11 nt, Human
uuaacaaaagu

SEQ ID NO: 3546769 - RNA, 22 nt, Human
uuaacaaacaucacucugcugc

SEQ ID NO: 3546770 - RNA, 12 nt, Human
uuaacaaauaug

SEQ ID NO: 3546771 - RNA, 13 nt, Human
uuaacaaaugcua

SEQ ID NO: 3546772 - RNA, 14 nt, Human
uuaacaacagcugg

SEQ ID NO: 3546773 - RNA, 19 nt, Human
uuaacaauaacuacugugu

SEQ ID NO: 3546774 - RNA, 21 nt, Human
uuaacaauaacuacuguguuc

SEQ ID NO: 3546775 - RNA, 21 nt, Human
uuaacaaugucuuguaagcaa

SEQ ID NO: 3546776 - RNA, 16 nt, Human
uuaacaauuccaaagg

SEQ ID NO: 3546777 - RNA, 16 nt, Human
uuaacacaaguccugu

SEQ ID NO: 3546778 - RNA, 12 nt, Human
uuaacacacuac

SEQ ID NO: 3546779 - RNA, 12 nt, Human
uuaacacauuuu

SEQ ID NO: 3546780 - RNA, 15 nt, Human
uuaacaccugaugug

SEQ ID NO: 3546781 - RNA, 16 nt, Human
uuaacaccugaugugu

SEQ ID NO: 3546782 - RNA, 18 nt, Human
uuaacaccuuuaaagugu

SEQ ID NO: 3546783 - RNA, 14 nt, Human
uuaacagaaaugua

SEQ ID NO: 3546784 - RNA, 16 nt, Human
uuaacagaaauguaca

SEQ ID NO: 3546785 - RNA, 20 nt, Human
uuaacagaaauguacagcaa

SEQ ID NO: 3546786 - RNA, 16 nt, Human
uuaacagaaauuguau

SEQ ID NO: 3546787 - RNA, 21 nt, Human
uuaacagaaauuguauauugu

SEQ ID NO: 3546788 - RNA, 14 nt, Human
uuaacagagucuga

SEQ ID NO: 3546789 - RNA, 18 nt, Human
uuaacagcaguccuuugu

SEQ ID NO: 3546790 - RNA, 15 nt, Human
uuaacaguuguauuu

SEQ ID NO: 3546791 - RNA, 17 nt, Human
uuaacaguuuuccauga

SEQ ID NO: 3546792 - RNA, 19 nt, Human
uuaacaguuuuccaugaaa

SEQ ID NO: 3546793 - RNA, 20 nt, Human
uuaacauaguaaguucagca

SEQ ID NO: 3546794 - RNA, 22 nt, Human
uuaacauaguaaguucagcacu

SEQ ID NO: 3546795 - RNA, 17 nt, Human
uuaacauauuuacuaag

SEQ ID NO: 3546796 - RNA, 22 nt, Human
uuaacaucucagaaaacucugg

SEQ ID NO: 3546797 - RNA, 21 nt, Human
uuaacaugacauuuaccagca

SEQ ID NO: 3546798 - RNA, 23 nt, Human
uuaacaugcuguguaagcugugu

SEQ ID NO: 3546799 - RNA, 19 nt, Human
uuaacaugggcucuucacu

SEQ ID NO: 3546800 - RNA, 22 nt, Human
uuaacaugggcucuucacuagu

SEQ ID NO: 3546801 - RNA, 12 nt, Human
uuaacauguuaa

SEQ ID NO: 3546802 - RNA, 22 nt, Human
uuaacauuccuaaaaugcuuca

SEQ ID NO: 3546803 - RNA, 23 nt, Human
uuaacauuccucaugaauguaaa

SEQ ID NO: 3546804 - RNA, 13 nt, Human
uuaacauuugccu

SEQ ID NO: 3546805 - RNA, 17 nt, Human
uuaacauuuuguucuua

SEQ ID NO: 3546806 - RNA, 19 nt, Human
uuaaccaaaaagaccagac

SEQ ID NO: 3546807 - RNA, 17 nt, Human
uuaaccaaacaauuauu

SEQ ID NO: 3546808 - RNA, 21 nt, Human
uuaaccaaacaauuauuuaaa

SEQ ID NO: 3546809 - RNA, 14 nt, Human
uuaaccaaagguga

SEQ ID NO: 3546810 - RNA, 17 nt, Human
uuaaccacuucagcuga

SEQ ID NO: 3546811 - RNA, 13 nt, Human
uuaaccagaucua

SEQ ID NO: 3546812 - RNA, 21 nt, Human
uuaaccagucugaaguuucau

SEQ ID NO: 3546813 - RNA, 16 nt, Human
uuaaccaguuguggug

SEQ ID NO: 3546814 - RNA, 13 nt, Human
uuaacccaaggag

SEQ ID NO: 3546815 - RNA, 20 nt, Human
uuaaccccccuguacacaac

SEQ ID NO: 3546816 - RNA, 17 nt, Human
uuaaccccgucaacaaa

SEQ ID NO: 3546817 - RNA, 15 nt, Human
uuaacccuucaucuu

SEQ ID NO: 3546818 - RNA, 15 nt, Human
uuaaccucaguguca

SEQ ID NO: 3546819 - RNA, 12 nt, Human
uuaaccucugca

SEQ ID NO: 3546820 - RNA, 15 nt, Human
uuaaccucugcuuuu

SEQ ID NO: 3546821 - RNA, 15 nt, Human
uuaaccuuguauaaa

SEQ ID NO: 3546822 - RNA, 12 nt, Human
uuaaccuuugau

SEQ ID NO: 3546823 - RNA, 17 nt, Human
uuaacuaaauuuuaaag

SEQ ID NO: 3546824 - RNA, 20 nt, Human
uuaacuacuauauugauugu

SEQ ID NO: 3546825 - RNA, 15 nt, Human
uuaacuagaauuuau

SEQ ID NO: 3546826 - RNA, 17 nt, Human
uuaacuagacacagaua

SEQ ID NO: 3546827 - RNA, 23 nt, Human
uuaacuauguacaauauuuuaag

SEQ ID NO: 3546828 - RNA, 14 nt, Human
uuaacucagaucac

SEQ ID NO: 3546829 - RNA, 15 nt, Human
uuaacucagaucacu

SEQ ID NO: 3546830 - RNA, 17 nt, Human
uuaacucaggacuccag

SEQ ID NO: 3546831 - RNA, 18 nt, Human
uuaacucaggacuccagc

SEQ ID NO: 3546832 - RNA, 17 nt, Human
uuaacucauuagacugg

SEQ ID NO: 3546833 - RNA, 22 nt, Human
uuaacucccauuaccauguaau

SEQ ID NO: 3546834 - RNA, 17 nt, Human
uuaacucuacuguguaa

SEQ ID NO: 3546835 - RNA, 15 nt, Human
uuaacucucuuuaug

SEQ ID NO: 3546836 - RNA, 21 nt, Human
uuaaguauugcaucuguauaa

SEQ ID NO: 3546837 - RNA, 11 nt, Human
uuaaguauuua

SEQ ID NO: 3546838 - RNA, 19 nt, Human
uuaagucuaaauauuuccu

SEQ ID NO: 3546839 - RNA, 20 nt, Human
uuaagucuguuuuaugacuu

SEQ ID NO: 3546840 - RNA, 21 nt, Human
uuaagucuguuuuaugacuuc

SEQ ID NO: 3546841 - RNA, 17 nt, Human
uuaagugaaaauauagc

SEQ ID NO: 3546842 - RNA, 14 nt, Human
uuaagugaaauuua

SEQ ID NO: 3546843 - RNA, 18 nt, Human
uuaagugcguguguagag

SEQ ID NO: 3546844 - RNA, 15 nt, Human
uuaagugcugcauuu

SEQ ID NO: 3546845 - RNA, 19 nt, Human
uuaagugcugcauuuaaaa

SEQ ID NO: 3546846 - RNA, 22 nt, Human
uuaagugcugcauuuaaaagau

SEQ ID NO: 3546847 - RNA, 19 nt, Human
uuaaguguacuaauuaaca

SEQ ID NO: 3546848 - RNA, 18 nt, Human
uuaaguguuggaaaaaau

SEQ ID NO: 3546849 - RNA, 20 nt, Human
uuaaguguuggaaaaaauuu

SEQ ID NO: 3546850 - RNA, 12 nt, Human
uuaaguuacuuc

SEQ ID NO: 3546851 - RNA, 20 nt, Human
uuaaguuaguuccacugaga

SEQ ID NO: 3546852 - RNA, 11 nt, Human
uuaaguugaga

SEQ ID NO: 3546853 - RNA, 22 nt, Human
uuaaguugagauaguuuucauc

SEQ ID NO: 3546854 - RNA, 18 nt, Human
uuaaguugcugaugaacu

SEQ ID NO: 3546855 - RNA, 21 nt, Human
uuaaguuggcuucuguuucua

SEQ ID NO: 3546856 - RNA, 22 nt, Human
uuaaguuggcuucuguuucuag

SEQ ID NO: 3546857 - RNA, 20 nt, Human
uuaaguuuccuuccagccca

SEQ ID NO: 3546858 - RNA, 12 nt, Human
uuaaguuucuca

SEQ ID NO: 3546859 - RNA, 14 nt, Human
uuaauaaaaauaau

SEQ ID NO: 3546860 - RNA, 15 nt, Human
uuaauaaaaaugaca

SEQ ID NO: 3546861 - RNA, 16 nt, Human
uuaauaaaacacuauu

SEQ ID NO: 3546862 - RNA, 16 nt, Human
uuaauaaaauaauucu

SEQ ID NO: 3546863 - RNA, 13 nt, Human
uuaauaaacacuc

SEQ ID NO: 3546864 - RNA, 19 nt, Human
uuaauaaacuacucuuuga

SEQ ID NO: 3546865 - RNA, 22 nt, Human
uuaauaaacuuuuuuuugagaa

SEQ ID NO: 3546866 - RNA, 16 nt, Human
uuaauaaauagagcaa

SEQ ID NO: 3546867 - RNA, 18 nt, Human
uuaauaaauuauuuauua

SEQ ID NO: 3546868 - RNA, 20 nt, Human
uuaauaaauuauuuauuauu

SEQ ID NO: 3546869 - RNA, 13 nt, Human
uuaauaacauuac

SEQ ID NO: 3546870 - RNA, 15 nt, Human
uuaauaacauuaccu

SEQ ID NO: 3546871 - RNA, 16 nt, Human
uuaauaacauuaccuu

SEQ ID NO: 3546872 - RNA, 17 nt, Human
uuaauaacauuaccuua

SEQ ID NO: 3546873 - RNA, 20 nt, Human
uuaauaacccuugaaaguca

SEQ ID NO: 3546874 - RNA, 17 nt, Human
uuaauaaguuucacuga

SEQ ID NO: 3546875 - RNA, 13 nt, Human
uuaauaauaaucu

SEQ ID NO: 3546876 - RNA, 22 nt, Human
uuaauaauagauugugaauaau

SEQ ID NO: 3546877 - RNA, 20 nt, Human
uuaauaaucucacauauaca

SEQ ID NO: 3546878 - RNA, 23 nt, Human
uuaauacaagguauaauaaaauu

SEQ ID NO: 3546879 - RNA, 23 nt, Human
uuaauaccagauaccuuaucuua

SEQ ID NO: 3546880 - RNA, 15 nt, Human
uuaauacuaaaauau

SEQ ID NO: 3546881 - RNA, 19 nt, Human
uuaauacuauaaauaauau

SEQ ID NO: 3546882 - RNA, 21 nt, Human
uuaauacucauccuuguauaa

SEQ ID NO: 3546883 - RNA, 22 nt, Human
uuaauacucauccuuguauaaa

SEQ ID NO: 3546884 - RNA, 19 nt, Human
uuaauagaauauaauuauc

SEQ ID NO: 3546885 - RNA, 15 nt, Human
uuaauagcaaagaau

SEQ ID NO: 3546886 - RNA, 15 nt, Human
uuaauagcagccuuu

SEQ ID NO: 3546887 - RNA, 22 nt, Human
uuaauagcagccuuucucucuu

SEQ ID NO: 3546888 - RNA, 15 nt, Human
uuaauagucauucca

SEQ ID NO: 3546889 - RNA, 19 nt, Human
uuaauagucauuccaaaua

SEQ ID NO: 3546890 - RNA, 16 nt, Human
uuaauaguguuaauca

SEQ ID NO: 3546891 - RNA, 18 nt, Human
uuaauaguguuaaucaau

SEQ ID NO: 3546892 - RNA, 21 nt, Human
uuaauauaaaguuuuauauau

SEQ ID NO: 3546893 - RNA, 15 nt, Human
uuaauauagcuauuu

SEQ ID NO: 3546894 - RNA, 15 nt, Human
uuaauauauguauua

SEQ ID NO: 3546895 - RNA, 16 nt, Human
uuaauauauuaaaauu

SEQ ID NO: 3546896 - RNA, 18 nt, Human
uuaauauauuaaaauucc

SEQ ID NO: 3546897 - RNA, 18 nt, Human
uuaauauauuugaaaaaa

SEQ ID NO: 3546898 - RNA, 16 nt, Human
uuaauaucacucauua

SEQ ID NO: 3546899 - RNA, 15 nt, Human
uuaauaucaucagua

SEQ ID NO: 3546900 - RNA, 19 nt, Human
uuaauaucccuacauguau

SEQ ID NO: 3546901 - RNA, 14 nt, Human
uuaauaucuuucug

SEQ ID NO: 3546902 - RNA, 16 nt, Human
uuaauaucuuucugca

SEQ ID NO: 3546903 - RNA, 12 nt, Human
uuaauaugaaaa

SEQ ID NO: 3546904 - RNA, 14 nt, Human
uuaauaugaaauuu

SEQ ID NO: 3546905 - RNA, 13 nt, Human
uuaauauggcucu

SEQ ID NO: 3546906 - RNA, 16 nt, Human
uuaauauggggaugca

SEQ ID NO: 3546907 - RNA, 17 nt, Human
uuaauauguauuuuaug

SEQ ID NO: 3546908 - RNA, 23 nt, Human
uuaauauguuaaccucaguguca

SEQ ID NO: 3546909 - RNA, 17 nt, Human
uuaauauuaaagccaug

SEQ ID NO: 3546910 - RNA, 18 nt, Human
uuaauauuaaagccaugu

SEQ ID NO: 3546911 - RNA, 22 nt, Human
uuaauauucauuguauaaaaau

SEQ ID NO: 3546912 - RNA, 13 nt, Human
uuaauauugauuu

SEQ ID NO: 3546913 - RNA, 21 nt, Human
uuaauauuuaaacagcagugu

SEQ ID NO: 3546914 - RNA, 17 nt, Human
uuaauauuuaacauuau

SEQ ID NO: 3546915 - RNA, 12 nt, Human
uuaauauuucuu

SEQ ID NO: 3546916 - RNA, 17 nt, Human
uuaauauuuuuacaugc

SEQ ID NO: 3546917 - RNA, 19 nt, Human
uuaauauuuuuacaugcag

SEQ ID NO: 3546918 - RNA, 14 nt, Human
uuaaucaaguugaa

SEQ ID NO: 3546919 - RNA, 18 nt, Human
uuaaucaauuuaaaccca

SEQ ID NO: 3546920 - RNA, 23 nt, Human
uacuagucugugugggacuguac

SEQ ID NO: 3546921 - RNA, 15 nt, Human
uacuaguguucuguu

SEQ ID NO: 3546922 - RNA, 16 nt, Human
uacuaguguucuguuu

SEQ ID NO: 3546923 - RNA, 21 nt, Human
uacuaguugugaccuuagugu

SEQ ID NO: 3546924 - RNA, 13 nt, Human
uacuauaaagaga

SEQ ID NO: 3546925 - RNA, 14 nt, Human
uacuauaacauaug

SEQ ID NO: 3546926 - RNA, 17 nt, Human
uacuauagcaaaguagu

SEQ ID NO: 3546927 - RNA, 13 nt, Human
uacuauaguacca

SEQ ID NO: 3546928 - RNA, 16 nt, Human
uacuauaguaccagua

SEQ ID NO: 3546929 - RNA, 20 nt, Human
uacuaucaugucaaacguga

SEQ ID NO: 3546930 - RNA, 17 nt, Human
uacuaucuacucuccuc

SEQ ID NO: 3546931 - RNA, 21 nt, Human
uacuaucuuaucucagauauu

SEQ ID NO: 3546932 - RNA, 22 nt, Human
uacuaucuuaucucagauauuu

SEQ ID NO: 3546933 - RNA, 22 nt, Human
uacuaugaaauauguauaacuu

SEQ ID NO: 3546934 - RNA, 13 nt, Human
uacuaugccugug

SEQ ID NO: 3546935 - RNA, 15 nt, Human
uacuauggaguacca

SEQ ID NO: 3546936 - RNA, 13 nt, Human
uacuauguaucaa

SEQ ID NO: 3546937 - RNA, 22 nt, Human
uacuauuaagcaguaaaaacug

SEQ ID NO: 3546938 - RNA, 15 nt, Human
uacuauuguuacauu

SEQ ID NO: 3546939 - RNA, 19 nt, Human
uacuauuuaaagccuccuc

SEQ ID NO: 3546940 - RNA, 22 nt, Human
uacuauuuaaagccuccucauc

SEQ ID NO: 3546941 - RNA, 18 nt, Human
uacuauuuaagaugugaa

SEQ ID NO: 3546942 - RNA, 12 nt, Human
uacuauuucaca

SEQ ID NO: 3546943 - RNA, 19 nt, Human
uacuauuuuacuucuagag

SEQ ID NO: 3546944 - RNA, 18 nt, Human
uacuauuuucuacaauua

SEQ ID NO: 3546945 - RNA, 17 nt, Human
uacuauuuugacaguua

SEQ ID NO: 3546946 - RNA, 18 nt, Human
uacuauuuuuacugccac

SEQ ID NO: 3546947 - RNA, 19 nt, Human
uacuauuuuuacugccacu

SEQ ID NO: 3546948 - RNA, 14 nt, Human
uacucaacccucuc

SEQ ID NO: 3546949 - RNA, 22 nt, Human
uacucaagagugguaucuugca

SEQ ID NO: 3546950 - RNA, 21 nt, Human
uacucaaguagcauuuacugu

SEQ ID NO: 3546951 - RNA, 21 nt, Human
uacucacagucucuuuaaucu

SEQ ID NO: 3546952 - RNA, 12 nt, Human
uacucaccucac

SEQ ID NO: 3546953 - RNA, 23 nt, Human
uacucacucaaguucaaggacca

SEQ ID NO: 3546954 - RNA, 17 nt, Human
uacucacuuuucccacu

SEQ ID NO: 3546955 - RNA, 17 nt, Human
uacucagaagccugagg

SEQ ID NO: 3546956 - RNA, 19 nt, Human
uacucagaagccugaggcu

SEQ ID NO: 3546957 - RNA, 16 nt, Human
uacucagauaagguaa

SEQ ID NO: 3546958 - RNA, 23 nt, Human
uacucagauaagguaaaaugcca

SEQ ID NO: 3546959 - RNA, 17 nt, Human
uacucagcagcccuccu

SEQ ID NO: 3546960 - RNA, 18 nt, Human
uacucagcagcccuccuc

SEQ ID NO: 3546961 - RNA, 23 nt, Human
uacucagcagcccuccucacccc

SEQ ID NO: 3546962 - RNA, 15 nt, Human
uacucaggaggcuga

SEQ ID NO: 3546963 - RNA, 21 nt, Human
uacucagggaaagcauuuaaa

SEQ ID NO: 3546964 - RNA, 17 nt, Human
uacucagggcuccuccc

SEQ ID NO: 3546965 - RNA, 15 nt, Human
uacucauaaugugaa

SEQ ID NO: 3546966 - RNA, 19 nt, Human
uacucauaaugugaagugu

SEQ ID NO: 3546967 - RNA, 21 nt, Human
uacucauauauaucuaucuua

SEQ ID NO: 3546968 - RNA, 17 nt, Human
uacucauccuuguauaa

SEQ ID NO: 3546969 - RNA, 17 nt, Human
uacucaugaucuuguga

SEQ ID NO: 3546970 - RNA, 16 nt, Human
uacucauggaagagau

SEQ ID NO: 3546971 - RNA, 11 nt, Human
uacucaugugu

SEQ ID NO: 3546972 - RNA, 12 nt, Human
uacucaugugua

SEQ ID NO: 3546973 - RNA, 13 nt, Human
uacucauguguau

SEQ ID NO: 3546974 - RNA, 20 nt, Human
uacucauucauuuauucauu

SEQ ID NO: 3546975 - RNA, 13 nt, Human
uacucauugaaau

SEQ ID NO: 3546976 - RNA, 14 nt, Human
uacucauugaaaug

SEQ ID NO: 3546977 - RNA, 22 nt, Human
uacucauuucuaaaagaauauu

SEQ ID NO: 3546978 - RNA, 16 nt, Human
uacucauuuuucauga

SEQ ID NO: 3546979 - RNA, 13 nt, Human
uacuccacacugc

SEQ ID NO: 3546980 - RNA, 21 nt, Human
uacuccagugccaacaauccu

SEQ ID NO: 3546981 - RNA, 13 nt, Human
uagaaauuuucaa

SEQ ID NO: 3546982 - RNA, 13 nt, Human
uagaaauuuugua

SEQ ID NO: 3546983 - RNA, 17 nt, Human
uagaaauuuuguaagaa

SEQ ID NO: 3546984 - RNA, 12 nt, Human
uagaacacacac

SEQ ID NO: 3546985 - RNA, 14 nt, Human
uagaacacuauuuu

SEQ ID NO: 3546986 - RNA, 16 nt, Human
uagaacacuauuuuca

SEQ ID NO: 3546987 - RNA, 18 nt, Human
uagaacacuauuuucaga

SEQ ID NO: 3546988 - RNA, 19 nt, Human
uagaacacuauuuucagaa

SEQ ID NO: 3546989 - RNA, 18 nt, Human
uagaacauaaagcaaaua

SEQ ID NO: 3546990 - RNA, 22 nt, Human
uagaacaugguuaccaugucuu

SEQ ID NO: 3546991 - RNA, 13 nt, Human
uagaaccuagaag

SEQ ID NO: 3546992 - RNA, 16 nt, Human
uagaaccuggaagggc

SEQ ID NO: 3546993 - RNA, 17 nt, Human
uagaaccuggaagggcu

SEQ ID NO: 3546994 - RNA, 13 nt, Human
uagaaccuggagg

SEQ ID NO: 3546995 - RNA, 14 nt, Human
uagaacuagccaaa

SEQ ID NO: 3546996 - RNA, 22 nt, Human
uagaacucaguuuuaacuagaa

SEQ ID NO: 3546997 - RNA, 16 nt, Human
uagaacucccuuucaa

SEQ ID NO: 3546998 - RNA, 23 nt, Human
uagaacucuccaucuuauuuuca

SEQ ID NO: 3546999 - RNA, 19 nt, Human
uagaacucugaaaugaaga

SEQ ID NO: 3547000 - RNA, 13 nt, Human
uagaacuggguaa

SEQ ID NO: 3547001 - RNA, 19 nt, Human
uagaacuguaugucagaca

SEQ ID NO: 3547002 - RNA, 20 nt, Human
uagaacuguaugucagacau

SEQ ID NO: 3547003 - RNA, 18 nt, Human
uagaacuuacuauucauu

SEQ ID NO: 3547004 - RNA, 21 nt, Human
uagaacuucauggaucagauc

SEQ ID NO: 3547005 - RNA, 19 nt, Human
uagaacuuuaagcaacaag

SEQ ID NO: 3547006 - RNA, 13 nt, Human
uagaacuuuguau

SEQ ID NO: 3547007 - RNA, 16 nt, Human
uagaacuuuguauagu

SEQ ID NO: 3547008 - RNA, 15 nt, Human
uagaacuuuuuuaaa

SEQ ID NO: 3547009 - RNA, 16 nt, Human
uagaacuuuuuuaaau

SEQ ID NO: 3547010 - RNA, 23 nt, Human
uagaacuuuuuuaaauaaacuuu

SEQ ID NO: 3547011 - RNA, 14 nt, Human
uagaagaaaugaaa

SEQ ID NO: 3547012 - RNA, 16 nt, Human
uagaagaaaugaaauu

SEQ ID NO: 3547013 - RNA, 19 nt, Human
uagaagaaaugaaauuuua

SEQ ID NO: 3547014 - RNA, 20 nt, Human
uagaagaaaugaaauuuuac

SEQ ID NO: 3547015 - RNA, 22 nt, Human
uagaagaaaugaaauuuuacca

SEQ ID NO: 3547016 - RNA, 18 nt, Human
uagaagaacauccaagga

SEQ ID NO: 3547017 - RNA, 18 nt, Human
uagaagacaaaauguuca

SEQ ID NO: 3547018 - RNA, 13 nt, Human
uagaagacauuua

SEQ ID NO: 3547019 - RNA, 15 nt, Human
uagaagacauuuaua

SEQ ID NO: 3547020 - RNA, 20 nt, Human
uagaagacucuaccagacug

SEQ ID NO: 3547021 - RNA, 19 nt, Human
uagaagaggguuuuaggua

SEQ ID NO: 3547022 - RNA, 16 nt, Human
uagaagauccuacccc

SEQ ID NO: 3547023 - RNA, 14 nt, Human
uagaagcauuccuu

SEQ ID NO: 3547024 - RNA, 21 nt, Human
uagaagcauuccuucuuugau

SEQ ID NO: 3547025 - RNA, 15 nt, Human
uagaagccaagggaa

SEQ ID NO: 3547026 - RNA, 19 nt, Human
uagaagccaagggaaaggg

SEQ ID NO: 3547027 - RNA, 22 nt, Human
uagaagccccguuauaacuccu

SEQ ID NO: 3547028 - RNA, 16 nt, Human
uagaagcugcaguggu

SEQ ID NO: 3547029 - RNA, 14 nt, Human
uagaagcuggagga

SEQ ID NO: 3547030 - RNA, 17 nt, Human
uagaaggagacagagcu

SEQ ID NO: 3547031 - RNA, 11 nt, Human
uagaaggccac

SEQ ID NO: 3547032 - RNA, 19 nt, Human
uagaaggccacaugucacc

SEQ ID NO: 3547033 - RNA, 19 nt, Human
uagaagggccaguccugcc

SEQ ID NO: 3547034 - RNA, 14 nt, Human
uagaaguagaauug

SEQ ID NO: 3547035 - RNA, 19 nt, Human
uagaagucuuagauguaua

SEQ ID NO: 3547036 - RNA, 22 nt, Human
uagaagucuucaugaaaugcua

SEQ ID NO: 3547037 - RNA, 16 nt, Human
uagaagugcauuucug

SEQ ID NO: 3547038 - RNA, 23 nt, Human
uagaagugcauuucugaauagaa

SEQ ID NO: 3547039 - RNA, 18 nt, Human
uagaaguggaccaggaca

SEQ ID NO: 3547040 - RNA, 16 nt, Human
uagaagugucauguuu

SEQ ID NO: 3547041 - RNA, 15 nt, Human
uagaaguuacugaau

SEQ ID NO: 3547042 - RNA, 16 nt, Human
uagaaguuacugaaug

SEQ ID NO: 3547043 - RNA, 20 nt, Human
uagaaguuacugaaugcacc

SEQ ID NO: 3547044 - RNA, 22 nt, Human
uagaaguucuaguguuuucaau

SEQ ID NO: 3547045 - RNA, 23 nt, Human
uagaaguuuguccauuuguaaaa

SEQ ID NO: 3547046 - RNA, 22 nt, Human
uagaauaaaggcaguuuucuaa

SEQ ID NO: 3547047 - RNA, 19 nt, Human
uagaauaagaauuugcaua

SEQ ID NO: 3547048 - RNA, 16 nt, Human
uagaauaauaaauauu

SEQ ID NO: 3547049 - RNA, 17 nt, Human
uagaauaauaaauauuu

SEQ ID NO: 3547050 - RNA, 23 nt, Human
uagaauacaguuuugaguagagu

SEQ ID NO: 3547051 - RNA, 17 nt, Human
uagaauagcauguugua

SEQ ID NO: 3547052 - RNA, 22 nt, Human
uagaauaggcacuuuaaaacac

SEQ ID NO: 3547053 - RNA, 23 nt, Human
uagaauaguguucugcaaaaaua

SEQ ID NO: 3547054 - RNA, 15 nt, Human
uagaauauaggucuc

SEQ ID NO: 3547055 - RNA, 15 nt, Human
uagaauauauuuccu

SEQ ID NO: 3547056 - RNA, 12 nt, Human
uagaauauuuau

SEQ ID NO: 3547057 - RNA, 15 nt, Human
uagaauauuuauuac

SEQ ID NO: 3547058 - RNA, 21 nt, Human
uagaaucaaacauuuugaaag

SEQ ID NO: 3547059 - RNA, 22 nt, Human
uagaaucaaacauuuugaaagu

SEQ ID NO: 3547060 - RNA, 20 nt, Human
uagaauccacguauuccccu

SEQ ID NO: 3547061 - RNA, 18 nt, Human
uagaaucccagcccccug

SEQ ID NO: 3547062 - RNA, 15 nt, Human
uagaaucuauuuucu

SEQ ID NO: 3547063 - RNA, 17 nt, Human
uagaaucuauuuucuau

SEQ ID NO: 3547064 - RNA, 19 nt, Human
uagaaucuauuuucuaugu

SEQ ID NO: 3547065 - RNA, 20 nt, Human
uagaaucuauuuucuaugua

SEQ ID NO: 3547066 - RNA, 12 nt, Human
uagaaugaaaau

SEQ ID NO: 3547067 - RNA, 17 nt, Human
uagaaugaccuuguaau

SEQ ID NO: 3547068 - RNA, 20 nt, Human
uagaaugaccuuguaaugua

SEQ ID NO: 3547069 - RNA, 21 nt, Human
uagaaugauuucaugcuaucu

SEQ ID NO: 3547070 - RNA, 21 nt, Human
uagaauggauaaaauaaugcu

SEQ ID NO: 3547071 - RNA, 22 nt, Human
uagaauggauaaaauaaugcug

SEQ ID NO: 3547072 - RNA, 18 nt, Human
uagaauggugauuuuaaa

SEQ ID NO: 3547073 - RNA, 14 nt, Human
uagaauguaaaugu

SEQ ID NO: 3547074 - RNA, 16 nt, Human
uagaauguaaaugucu

SEQ ID NO: 3547075 - RNA, 12 nt, Human
uagaauguaguu

SEQ ID NO: 3547076 - RNA, 21 nt, Human
uagaauguaguuugaggaaau

SEQ ID NO: 3547077 - RNA, 22 nt, Human
uagaauguauuguaccuuuuaa

SEQ ID NO: 3547078 - RNA, 13 nt, Human
uagaauguguuuu

SEQ ID NO: 3547079 - RNA, 20 nt, Human
uagaauguguuuucugaaua

SEQ ID NO: 3547080 - RNA, 18 nt, Human
uagaauguuuucaaaugu

SEQ ID NO: 3547081 - RNA, 14 nt, Human
uagaauuaaaaaag

SEQ ID NO: 3547082 - RNA, 17 nt, Human
uagaauuaccauuuguu

SEQ ID NO: 3547083 - RNA, 16 nt, Human
uagaauuaucuaauuu

SEQ ID NO: 3547084 - RNA, 22 nt, Human
uagaauuaucuaauuuauaaaa

SEQ ID NO: 3547085 - RNA, 15 nt, Human
uagaauuauuuaaac

SEQ ID NO: 3547086 - RNA, 20 nt, Human
uagaauucccucucucugac

SEQ ID NO: 3547087 - RNA, 21 nt, Human
uagaauucccucucucugacu

SEQ ID NO: 3547088 - RNA, 16 nt, Human
uagaauuccuucaggg

SEQ ID NO: 3547089 - RNA, 18 nt, Human
uagaauucuagugcugcu

SEQ ID NO: 3547090 - RNA, 19 nt, Human
uagaauucuagugcugcug

SEQ ID NO: 3547091 - RNA, 13 nt, Human
uagaauucuguau

SEQ ID NO: 3547092 - RNA, 17 nt, Human
uagaauugaguguuuaa

SEQ ID NO: 3547093 - RNA, 19 nt, Human
uagaauugaguguuuaaag

SEQ ID NO: 3547094 - RNA, 23 nt, Human
uagaauuuauucaauuccucugg

SEQ ID NO: 3547095 - RNA, 19 nt, Human
uagaauuugauaugugaac

SEQ ID NO: 3547096 - RNA, 23 nt, Human
uagaauuuuaagccuuuguugaa

SEQ ID NO: 3547097 - RNA, 14 nt, Human
uagacaaaaaguau

SEQ ID NO: 3547098 - RNA, 16 nt, Human
uagacaaaaaguauau

SEQ ID NO: 3547099 - RNA, 16 nt, Human
uagacaaauacucaug

SEQ ID NO: 3547100 - RNA, 18 nt, Human
uagacaaauacucaugug

SEQ ID NO: 3547101 - RNA, 19 nt, Human
uagacaaauauuuggaggg

SEQ ID NO: 3547102 - RNA, 15 nt, Human
uagacaaaucuaagg

SEQ ID NO: 3547103 - RNA, 20 nt, Human
uagacaagauauuguacaua

SEQ ID NO: 3547104 - RNA, 22 nt, Human
uagacaaguccagccuggcaag

SEQ ID NO: 3547105 - RNA, 14 nt, Human
uagacaauauacaa

SEQ ID NO: 3547106 - RNA, 23 nt, Human
uagacaaucauuguuuugaauau

SEQ ID NO: 3547107 - RNA, 15 nt, Human
uagacaauugaggua

SEQ ID NO: 3547108 - RNA, 12 nt, Human
uagacacacaaa

SEQ ID NO: 3547109 - RNA, 13 nt, Human
uagacacacauga

SEQ ID NO: 3547110 - RNA, 13 nt, Human
uagacacagauaa

SEQ ID NO: 3547111 - RNA, 20 nt, Human
uagacacaugaagguaaaua

SEQ ID NO: 3547112 - RNA, 20 nt, Human
uagacaccaaaguucuaaua

SEQ ID NO: 3547113 - RNA, 16 nt, Human
uagacacgcacggcag

SEQ ID NO: 3547114 - RNA, 21 nt, Human
uagacacuccccgaagucuuu

SEQ ID NO: 3547115 - RNA, 22 nt, Human
uagacacuggcugccagcuauu

SEQ ID NO: 3547116 - RNA, 19 nt, Human
uagacagaggcccucaagu

SEQ ID NO: 3547117 - RNA, 18 nt, Human
uagacagccaaaggcugg

SEQ ID NO: 3547118 - RNA, 23 nt, Human
uagacagcuuuucucaacugggu

SEQ ID NO: 3547119 - RNA, 22 nt, Human
uagacaggaaaagcaugucuua

SEQ ID NO: 3547120 - RNA, 18 nt, Human
uagacaggagaagaaaga

SEQ ID NO: 3547121 - RNA, 12 nt, Human
uagacagucccu

SEQ ID NO: 3547122 - RNA, 16 nt, Human
uagacagucccugcca

SEQ ID NO: 3547123 - RNA, 21 nt, Human
uagacagucccugccaaugga

SEQ ID NO: 3547124 - RNA, 15 nt, Human
uagacaguuuguaaa

SEQ ID NO: 3547125 - RNA, 15 nt, Human
uagaguuuacagcuc

SEQ ID NO: 3547126 - RNA, 18 nt, Human
uagaguuuagcuggaaaa

SEQ ID NO: 3547127 - RNA, 20 nt, Human
uagaguuucuguuugauucu

SEQ ID NO: 3547128 - RNA, 23 nt, Human
uagaguuucuguuugauucuuuu

SEQ ID NO: 3547129 - RNA, 18 nt, Human
uagaguuuuuaaacauca

SEQ ID NO: 3547130 - RNA, 23 nt, Human
uagauaaaacaucuuugaaauua

SEQ ID NO: 3547131 - RNA, 14 nt, Human
uagauaacucuuug

SEQ ID NO: 3547132 - RNA, 18 nt, Human
uagauaauacaccacuac

SEQ ID NO: 3547133 - RNA, 13 nt, Human
uagauacaauaaa

SEQ ID NO: 3547134 - RNA, 16 nt, Human
uagauacaauaaauug

SEQ ID NO: 3547135 - RNA, 17 nt, Human
uagauacaauaaauugc

SEQ ID NO: 3547136 - RNA, 13 nt, Human
uagauacaaucag

SEQ ID NO: 3547137 - RNA, 14 nt, Human
uagauacaaucagc

SEQ ID NO: 3547138 - RNA, 16 nt, Human
uagauacucucuucuu

SEQ ID NO: 3547139 - RNA, 16 nt, Human
uagauacuguaucaug

SEQ ID NO: 3547140 - RNA, 16 nt, Human
uuaguauuugcauauu

SEQ ID NO: 3547141 - RNA, 23 nt, Human
uuagucacugccugcagaggucu

SEQ ID NO: 3547142 - RNA, 22 nt, Human
uuagucacuuuuuuuuuccaaa

SEQ ID NO: 3547143 - RNA, 13 nt, Human
uuagucaugugac

SEQ ID NO: 3547144 - RNA, 14 nt, Human
uuagucaugugacc

SEQ ID NO: 3547145 - RNA, 22 nt, Human
uuagucccccaacucugagccc

SEQ ID NO: 3547146 - RNA, 22 nt, Human
uuaguccuguuauagacgagaa

SEQ ID NO: 3547147 - RNA, 19 nt, Human
uuagucgugagcucuugug

SEQ ID NO: 3547148 - RNA, 19 nt, Human
uuagucuacucuuaagcca

SEQ ID NO: 3547149 - RNA, 22 nt, Human
uuagucuacucuuaagccaucu

SEQ ID NO: 3547150 - RNA, 12 nt, Human
uuagucucaguu

SEQ ID NO: 3547151 - RNA, 20 nt, Human
uuagucucaguucucuuaau

SEQ ID NO: 3547152 - RNA, 21 nt, Human
uuagucucaguuugugugucu

SEQ ID NO: 3547153 - RNA, 14 nt, Human
uuagucucuuuauu

SEQ ID NO: 3547154 - RNA, 14 nt, Human
uuagucuucucaua

SEQ ID NO: 3547155 - RNA, 23 nt, Human
uuagugacuaaaccauugugcau

SEQ ID NO: 3547156 - RNA, 17 nt, Human
uuagugauauuucucua

SEQ ID NO: 3547157 - RNA, 18 nt, Human
uuagugauauuucucuag

SEQ ID NO: 3547158 - RNA, 17 nt, Human
uuagugaucuuagcaua

SEQ ID NO: 3547159 - RNA, 14 nt, Human
uuagugcaucuuug

SEQ ID NO: 3547160 - RNA, 19 nt, Human
uuagugccacuuaauguau

SEQ ID NO: 3547161 - RNA, 14 nt, Human
uuagugccugugug

SEQ ID NO: 3547162 - RNA, 12 nt, Human
uuagugcuaagu

SEQ ID NO: 3547163 - RNA, 17 nt, Human
uuagugcuaagugugaa

SEQ ID NO: 3547164 - RNA, 20 nt, Human
uuaguggcucaacauugugu

SEQ ID NO: 3547165 - RNA, 12 nt, Human
uuaguggcuuuu

SEQ ID NO: 3547166 - RNA, 16 nt, Human
uuagugggccagggcu

SEQ ID NO: 3547167 - RNA, 15 nt, Human
uuaguguaauaagac

SEQ ID NO: 3547168 - RNA, 14 nt, Human
uuagugucacuuac

SEQ ID NO: 3547169 - RNA, 19 nt, Human
uuagugugguuuucuguuu

SEQ ID NO: 3547170 - RNA, 14 nt, Human
uuaguguucauaaa

SEQ ID NO: 3547171 - RNA, 16 nt, Human
uuaguguuucugugca

SEQ ID NO: 3547172 - RNA, 17 nt, Human
uuaguguuucugugcau

SEQ ID NO: 3547173 - RNA, 18 nt, Human
uuaguuaccuuauaguua

SEQ ID NO: 3547174 - RNA, 21 nt, Human
uuaguuaccuuauaguuacug

SEQ ID NO: 3547175 - RNA, 16 nt, Human
uuaguuauagaugucu

SEQ ID NO: 3547176 - RNA, 13 nt, Human
uuaguuauaguuu

SEQ ID NO: 3547177 - RNA, 15 nt, Human
uuaguuauaguuuca

SEQ ID NO: 3547178 - RNA, 15 nt, Human
uuaguuccacugaga

SEQ ID NO: 3547179 - RNA, 23 nt, Human
uuaguuccccaaauacaaaguua

SEQ ID NO: 3547180 - RNA, 16 nt, Human
uuaguuccucauuagc

SEQ ID NO: 3547181 - RNA, 14 nt, Human
uuaguuccuugagu

SEQ ID NO: 3547182 - RNA, 12 nt, Human
uuaguucuauuu

SEQ ID NO: 3547183 - RNA, 16 nt, Human
uuaguucuuuggaaau

SEQ ID NO: 3547184 - RNA, 22 nt, Human
uuaguugccuaagcauugccug

SEQ ID NO: 3547185 - RNA, 17 nt, Human
uuaguuuacaaucagcc

SEQ ID NO: 3547186 - RNA, 22 nt, Human
uuaguuucaguagauugcagaa

SEQ ID NO: 3547187 - RNA, 15 nt, Human
uuaguuucuguucug

SEQ ID NO: 3547188 - RNA, 20 nt, Human
uuaguuucuguucuguggaa

SEQ ID NO: 3547189 - RNA, 14 nt, Human
uuaguuuucuuguu

SEQ ID NO: 3547190 - RNA, 16 nt, Human
uuaguuuugaugaguu

SEQ ID NO: 3547191 - RNA, 20 nt, Human
uuaguuuuuaaaauaucuuu

SEQ ID NO: 3547192 - RNA, 16 nt, Human
uuaguuuuucauuaaa

SEQ ID NO: 3547193 - RNA, 18 nt, Human
uuaguuuuugguugggaa

SEQ ID NO: 3547194 - RNA, 21 nt, Human
uuaguuuuugugaaguuuaau

SEQ ID NO: 3547195 - RNA, 14 nt, Human
uuauaaaaaauggu

SEQ ID NO: 3547196 - RNA, 14 nt, Human
uuauaaaaagauaa

SEQ ID NO: 3547197 - RNA, 21 nt, Human
uuauaaaaauaaaaaacacug

SEQ ID NO: 3547198 - RNA, 13 nt, Human
uuauaaaaauauu

SEQ ID NO: 3547199 - RNA, 22 nt, Human
uuauaaaacagaguaaucuugu

SEQ ID NO: 3547200 - RNA, 22 nt, Human
uuauaaaacguguuuguauugu

SEQ ID NO: 3547201 - RNA, 13 nt, Human
uuauaaaacuucu

SEQ ID NO: 3547202 - RNA, 23 nt, Human
uuauaaaagaauaaaauugcacu

SEQ ID NO: 3547203 - RNA, 13 nt, Human
uuauaaaagugau

SEQ ID NO: 3547204 - RNA, 12 nt, Human
uuauaaaagugu

SEQ ID NO: 3547205 - RNA, 18 nt, Human
uuauaaaauauaaacaaa

SEQ ID NO: 3547206 - RNA, 16 nt, Human
uuauaaaaucaaguuu

SEQ ID NO: 3547207 - RNA, 18 nt, Human
uuauaaaauccugugcaa

SEQ ID NO: 3547208 - RNA, 10 nt, Human
uuauaaaauu

SEQ ID NO: 3547209 - RNA, 18 nt, Human
uuauaaaauuuugcuuuu

SEQ ID NO: 3547210 - RNA, 17 nt, Human
uuauaaaccucuaauuu

SEQ ID NO: 3547211 - RNA, 22 nt, Human
uuauaaacuuuuuucuuacugu

SEQ ID NO: 3547212 - RNA, 19 nt, Human
uuauaaagaauguuucuua

SEQ ID NO: 3547213 - RNA, 12 nt, Human
uuauaaauauga

SEQ ID NO: 3547214 - RNA, 23 nt, Human
uuauaaaucauauugaugaaaag

SEQ ID NO: 3547215 - RNA, 14 nt, Human
uuauaaaucgcuuu

SEQ ID NO: 3547216 - RNA, 18 nt, Human
uuauaaaucgcuuuugau

SEQ ID NO: 3547217 - RNA, 15 nt, Human
uuauaaaugagcaaa

SEQ ID NO: 3547218 - RNA, 14 nt, Human
uuauaaauuauguu

SEQ ID NO: 3547219 - RNA, 15 nt, Human
uuauaaauuauguuu

SEQ ID NO: 3547220 - RNA, 16 nt, Human
uuauaaauuauguuua

SEQ ID NO: 3547221 - RNA, 17 nt, Human
uuauaaauuauguuuau

SEQ ID NO: 3547222 - RNA, 23 nt, Human
uuauaaccuaguuaaagaaagga

SEQ ID NO: 3547223 - RNA, 16 nt, Human
uuauaaccuuaauuua

SEQ ID NO: 3547224 - RNA, 19 nt, Human
uuauaacuaacauguccug

SEQ ID NO: 3547225 - RNA, 22 nt, Human
uuauaacuacuccggagacagg

SEQ ID NO: 3547226 - RNA, 16 nt, Human
uuauaacuauucaguu

SEQ ID NO: 3547227 - RNA, 21 nt, Human
uuauaacucaucauaaaauaa

SEQ ID NO: 3547228 - RNA, 16 nt, Human
uuauaacucugcacua

SEQ ID NO: 3547229 - RNA, 21 nt, Human
uuauaacuuaaugaaaacaau

SEQ ID NO: 3547230 - RNA, 17 nt, Human
uuauaagaaaaacuuuu

SEQ ID NO: 3547231 - RNA, 13 nt, Human
uuauaagaaaaau

SEQ ID NO: 3547232 - RNA, 16 nt, Human
uuauaagaaagccuga

SEQ ID NO: 3547233 - RNA, 21 nt, Human
uuauaagaagaaguucauguc

SEQ ID NO: 3547234 - RNA, 13 nt, Human
uuauaagacucuc

SEQ ID NO: 3547235 - RNA, 17 nt, Human
uuauaagcaucauuauu

SEQ ID NO: 3547236 - RNA, 13 nt, Human
uuauaagcauuga

SEQ ID NO: 3547237 - RNA, 15 nt, Human
uuauaaggacugcau

SEQ ID NO: 3547238 - RNA, 18 nt, Human
uuauaagggcaaauugga

SEQ ID NO: 3547239 - RNA, 18 nt, Human
uuauaaguagcaggccaa

SEQ ID NO: 3547240 - RNA, 18 nt, Human
uuauaagucauuguaugu

SEQ ID NO: 3547241 - RNA, 17 nt, Human
uuauaagugaagugaua

SEQ ID NO: 3547242 - RNA, 15 nt, Human
uuauaaguucacaaa

SEQ ID NO: 3547243 - RNA, 17 nt, Human
uuauaauaaaaggaaaa

SEQ ID NO: 3547244 - RNA, 22 nt, Human
uuauaauaaaaggaaaagcaaa

SEQ ID NO: 3547245 - RNA, 19 nt, Human
uuauaauaaaggacuguaa

SEQ ID NO: 3547246 - RNA, 21 nt, Human
uuauaauaaaggacuguaauc

SEQ ID NO: 3547247 - RNA, 15 nt, Human
uuauaauaaauauau

SEQ ID NO: 3547248 - RNA, 18 nt, Human
uuauaauauuuuaaugua

SEQ ID NO: 3547249 - RNA, 20 nt, Human
uuauaaucuuccauacuucu

SEQ ID NO: 3547250 - RNA, 19 nt, Human
uuauaaugaggaugauuau

SEQ ID NO: 3547251 - RNA, 19 nt, Human
uuauaauguauucauauuu

SEQ ID NO: 3547252 - RNA, 14 nt, Human
uuauaauucuuuca

SEQ ID NO: 3547253 - RNA, 21 nt, Human
uuauaauucuuucaauacaga

SEQ ID NO: 3547254 - RNA, 14 nt, Human
uuauaauuguauca

SEQ ID NO: 3547255 - RNA, 22 nt, Human
uuauaauuguaucagaggccua

SEQ ID NO: 3547256 - RNA, 14 nt, Human
uuauaauuguugca

SEQ ID NO: 3547257 - RNA, 17 nt, Human
uuauaauuuuaaauguu

SEQ ID NO: 3547258 - RNA, 18 nt, Human
uuauaauuuuaagauucc

SEQ ID NO: 3547259 - RNA, 14 nt, Human
uuauaauuuuccua

SEQ ID NO: 3547260 - RNA, 12 nt, Human
uuauaauuuucu

SEQ ID NO: 3547261 - RNA, 15 nt, Human
uuauaauuuucugaa

SEQ ID NO: 3547262 - RNA, 14 nt, Human
uuauaauuuuguga

SEQ ID NO: 3547263 - RNA, 17 nt, Human
uuauaauuuugugaagc

SEQ ID NO: 3547264 - RNA, 18 nt, Human
uuauaauuuugugaagca

SEQ ID NO: 3547265 - RNA, 21 nt, Human
uuauaauuuuuuuauuacuga

SEQ ID NO: 3547266 - RNA, 21 nt, Human
uuauacaaaccuaccaaaaug

SEQ ID NO: 3547267 - RNA, 15 nt, Human
uuauacaaaugucuu

SEQ ID NO: 3547268 - RNA, 18 nt, Human
uuauacaaauuaaaaaga

SEQ ID NO: 3547269 - RNA, 23 nt, Human
uuauacaacagugcuaaaaaugg

SEQ ID NO: 3547270 - RNA, 15 nt, Human
uagcuucaggaaccu

SEQ ID NO: 3547271 - RNA, 22 nt, Human
uagcuucccuccccucuaguuu

SEQ ID NO: 3547272 - RNA, 18 nt, Human
uagcuucugaccucagca

SEQ ID NO: 3547273 - RNA, 19 nt, Human
uagcuucugaccucagcau

SEQ ID NO: 3547274 - RNA, 13 nt, Human
uagcuucugcuuu

SEQ ID NO: 3547275 - RNA, 17 nt, Human
uagcuugcgcauucuca

SEQ ID NO: 3547276 - RNA, 18 nt, Human
uagcuugggacaaaucaa

SEQ ID NO: 3547277 - RNA, 15 nt, Human
uagcuuguucccugu

SEQ ID NO: 3547278 - RNA, 22 nt, Human
uagcuuuaacuuaaauaguauu

SEQ ID NO: 3547279 - RNA, 17 nt, Human
uagcuuuagacccuggg

SEQ ID NO: 3547280 - RNA, 18 nt, Human
uagcuuuagacccugggu

SEQ ID NO: 3547281 - RNA, 14 nt, Human
uagcuuuauucuuc

SEQ ID NO: 3547282 - RNA, 15 nt, Human
uagcuuucaauuccg

SEQ ID NO: 3547283 - RNA, 17 nt, Human
uagcuuucaauuccgua

SEQ ID NO: 3547284 - RNA, 23 nt, Human
uagcuuucaauuccguagccagc

SEQ ID NO: 3547285 - RNA, 19 nt, Human
uagcuuucccaaauaaacu

SEQ ID NO: 3547286 - RNA, 21 nt, Human
uagcuuucugagcaagaggau

SEQ ID NO: 3547287 - RNA, 14 nt, Human
uagcuuugcucugc

SEQ ID NO: 3547288 - RNA, 16 nt, Human
uagcuuugcucugcca

SEQ ID NO: 3547289 - RNA, 18 nt, Human
uagcuuuuauuguauaaa

SEQ ID NO: 3547290 - RNA, 14 nt, Human
uagcuuuucaccuu

SEQ ID NO: 3547291 - RNA, 20 nt, Human
uagcuuuugugggggacugu

SEQ ID NO: 3547292 - RNA, 17 nt, Human
uagcuuuuuaaaacauu

SEQ ID NO: 3547293 - RNA, 14 nt, Human
uagcuuuuuaauug

SEQ ID NO: 3547294 - RNA, 16 nt, Human
uagcuuuuuaauuguu

SEQ ID NO: 3547295 - RNA, 20 nt, Human
uagcuuuuucauccccuuac

SEQ ID NO: 3547296 - RNA, 13 nt, Human
uagcuuuuuucuc

SEQ ID NO: 3547297 - RNA, 22 nt, Human
uaggaaaaaaacuauuaaggau

SEQ ID NO: 3547298 - RNA, 15 nt, Human
uaggaaaagaaaucu

SEQ ID NO: 3547299 - RNA, 19 nt, Human
uaggaaaaguacauuuaau

SEQ ID NO: 3547300 - RNA, 21 nt, Human
uaggaaaaucacuuugucuaa

SEQ ID NO: 3547301 - RNA, 21 nt, Human
uaggaaacaaagcuuagcagg

SEQ ID NO: 3547302 - RNA, 19 nt, Human
uaggaaagccucacugaua

SEQ ID NO: 3547303 - RNA, 17 nt, Human
uaggaaauaaaaccuuu

SEQ ID NO: 3547304 - RNA, 19 nt, Human
uaggaaauauuuauuuuaa

SEQ ID NO: 3547305 - RNA, 16 nt, Human
uaggaaauccagggug

SEQ ID NO: 3547306 - RNA, 22 nt, Human
uaggaaauggcuuugugauuca

SEQ ID NO: 3547307 - RNA, 16 nt, Human
uaggaacaaaucuucc

SEQ ID NO: 3547308 - RNA, 17 nt, Human
uaggaacacuccuucac

SEQ ID NO: 3547309 - RNA, 18 nt, Human
uaggaagaauuuuaaaaa

SEQ ID NO: 3547310 - RNA, 21 nt, Human
uaggaagaauuuuaaaaauga

SEQ ID NO: 3547311 - RNA, 22 nt, Human
uaggaagaauuuuaaaaaugaa

SEQ ID NO: 3547312 - RNA, 21 nt, Human
uaggaagacacauuaucuucu

SEQ ID NO: 3547313 - RNA, 14 nt, Human
uaggaagagaaacc

SEQ ID NO: 3547314 - RNA, 15 nt, Human
uaggaagagaaacca

SEQ ID NO: 3547315 - RNA, 18 nt, Human
uaggaagggaccaaggca

SEQ ID NO: 3547316 - RNA, 18 nt, Human
uaggaagguacuguauga

SEQ ID NO: 3547317 - RNA, 14 nt, Human
uaggaaggucauuu

SEQ ID NO: 3547318 - RNA, 16 nt, Human
uaggaaggucauuucc

SEQ ID NO: 3547319 - RNA, 18 nt, Human
uaggaaggucauuuccau

SEQ ID NO: 3547320 - RNA, 19 nt, Human
uaggaaggucauuuccaug

SEQ ID NO: 3547321 - RNA, 18 nt, Human
uaggaaggucucauucuu

SEQ ID NO: 3547322 - RNA, 19 nt, Human
uaggaaguguaacagcuga

SEQ ID NO: 3547323 - RNA, 22 nt, Human
uaggaaguguaacagcugaggu

SEQ ID NO: 3547324 - RNA, 22 nt, Human
uaggaaguuuucuguagucauu

SEQ ID NO: 3547325 - RNA, 15 nt, Human
uaggaauagcauguc

SEQ ID NO: 3547326 - RNA, 13 nt, Human
uaggaauauuaua

SEQ ID NO: 3547327 - RNA, 20 nt, Human
uaggaauauuauauuuggau

SEQ ID NO: 3547328 - RNA, 20 nt, Human
uaggaaucauucagaaaugu

SEQ ID NO: 3547329 - RNA, 18 nt, Human
uaggaauuaaguuaucuu

SEQ ID NO: 3547330 - RNA, 18 nt, Human
uaggaauucaucuuuuga

SEQ ID NO: 3547331 - RNA, 23 nt, Human
uaggaauugacccacaagaaaug

SEQ ID NO: 3547332 - RNA, 16 nt, Human
uaggaccacucagccc

SEQ ID NO: 3547333 - RNA, 17 nt, Human
uaggaccacucagcccc

SEQ ID NO: 3547334 - RNA, 18 nt, Human
uaggaccacucagccccu

SEQ ID NO: 3547335 - RNA, 21 nt, Human
uaggaccacucagccccuagg

SEQ ID NO: 3547336 - RNA, 16 nt, Human
uaggaccaggauccag

SEQ ID NO: 3547337 - RNA, 13 nt, Human
uaggaccuugggc

SEQ ID NO: 3547338 - RNA, 14 nt, Human
uaggaccuugggcc

SEQ ID NO: 3547339 - RNA, 16 nt, Human
uaggacgccacccagc

SEQ ID NO: 3547340 - RNA, 19 nt, Human
uaggacucaaaguuucaga

SEQ ID NO: 3547341 - RNA, 16 nt, Human
uaggacucugaggcuc

SEQ ID NO: 3547342 - RNA, 21 nt, Human
uaggacuuuggugguuuaaaa

SEQ ID NO: 3547343 - RNA, 17 nt, Human
uaggagaaccaaaucug

SEQ ID NO: 3547344 - RNA, 15 nt, Human
uaggagaagccagga

SEQ ID NO: 3547345 - RNA, 19 nt, Human
uugcaauggcuauauggca

SEQ ID NO: 3547346 - RNA, 19 nt, Human
uugcacaauauugaacuuu

SEQ ID NO: 3547347 - RNA, 18 nt, Human
uugcacacacucagugca

SEQ ID NO: 3547348 - RNA, 15 nt, Human
uugcacacaucaucu

SEQ ID NO: 3547349 - RNA, 17 nt, Human
uugcacacuccccugca

SEQ ID NO: 3547350 - RNA, 21 nt, Human
uugcacagaaguccuguaugu

SEQ ID NO: 3547351 - RNA, 18 nt, Human
uugcacagccaaauuuaa

SEQ ID NO: 3547352 - RNA, 19 nt, Human
uugcacagggauucucaca

SEQ ID NO: 3547353 - RNA, 16 nt, Human
uugcacaguuagcaaa

SEQ ID NO: 3547354 - RNA, 15 nt, Human
uugcacaugucuuaa

SEQ ID NO: 3547355 - RNA, 16 nt, Human
uugcacaugucuuaau

SEQ ID NO: 3547356 - RNA, 17 nt, Human
uugcacaugucuuaaug

SEQ ID NO: 3547357 - RNA, 23 nt, Human
uugcacauuaaaugacucuuccc

SEQ ID NO: 3547358 - RNA, 13 nt, Human
uugcacauuguuc

SEQ ID NO: 3547359 - RNA, 14 nt, Human
uugcacauuguuca

SEQ ID NO: 3547360 - RNA, 20 nt, Human
uugcaccaaauuaucuugau

SEQ ID NO: 3547361 - RNA, 15 nt, Human
uugcaccacugcacu

SEQ ID NO: 3547362 - RNA, 16 nt, Human
uugcaccacugcacuc

SEQ ID NO: 3547363 - RNA, 13 nt, Human
uugcacccagccc

SEQ ID NO: 3547364 - RNA, 15 nt, Human
uugcacccagcccag

SEQ ID NO: 3547365 - RNA, 19 nt, Human
uugcacccagcccuggucu

SEQ ID NO: 3547366 - RNA, 13 nt, Human
uugcaccccucac

SEQ ID NO: 3547367 - RNA, 13 nt, Human
uugcaccccuccc

SEQ ID NO: 3547368 - RNA, 17 nt, Human
uugcaccuaccucacag

SEQ ID NO: 3547369 - RNA, 16 nt, Human
uugcaccuguccccac

SEQ ID NO: 3547370 - RNA, 17 nt, Human
uugcacgacgcccucuc

SEQ ID NO: 3547371 - RNA, 21 nt, Human
uugcacgacgcccucucccca

SEQ ID NO: 3547372 - RNA, 17 nt, Human
uugcacgcccaugugug

SEQ ID NO: 3547373 - RNA, 20 nt, Human
uugcacgcccaugugugagu

SEQ ID NO: 3547374 - RNA, 18 nt, Human
uugcacgcgcccuuucua

SEQ ID NO: 3547375 - RNA, 15 nt, Human
uugcacggcugcuga

SEQ ID NO: 3547376 - RNA, 18 nt, Human
uugcacguguguuuuucu

SEQ ID NO: 3547377 - RNA, 21 nt, Human
uugcacguguguuuuucuauu

SEQ ID NO: 3547378 - RNA, 22 nt, Human
uugcacguguguuuuucuauua

SEQ ID NO: 3547379 - RNA, 19 nt, Human
uugcacuaaaguauguaaa

SEQ ID NO: 3547380 - RNA, 17 nt, Human
uugcacucaaaucuuaa

SEQ ID NO: 3547381 - RNA, 21 nt, Human
uugcacucaaaucuuaagaaa

SEQ ID NO: 3547382 - RNA, 14 nt, Human
uugcacuccagccu

SEQ ID NO: 3547383 - RNA, 13 nt, Human
uugcacugaaguu

SEQ ID NO: 3547384 - RNA, 16 nt, Human
uugcacugaaguuuga

SEQ ID NO: 3547385 - RNA, 13 nt, Human
uugcacugagggc

SEQ ID NO: 3547386 - RNA, 16 nt, Human
uugcacuguuuaauca

SEQ ID NO: 3547387 - RNA, 22 nt, Human
uugcacuucuaagacuuuacuu

SEQ ID NO: 3547388 - RNA, 15 nt, Human
uugcacuuucagacu

SEQ ID NO: 3547389 - RNA, 21 nt, Human
uugcacuuucagacucucucu

SEQ ID NO: 3547390 - RNA, 13 nt, Human
uugcacuuuguag

SEQ ID NO: 3547391 - RNA, 21 nt, Human
uugcagaaaagcaccugccga

SEQ ID NO: 3547392 - RNA, 16 nt, Human
uugcagaaaauucugu

SEQ ID NO: 3547393 - RNA, 19 nt, Human
uugcagaacuaaacucauu

SEQ ID NO: 3547394 - RNA, 21 nt, Human
uugcagaacuaaacucauuua

SEQ ID NO: 3547395 - RNA, 14 nt, Human
uugcagaacugcca

SEQ ID NO: 3547396 - RNA, 16 nt, Human
uugcagacaggaaucu

SEQ ID NO: 3547397 - RNA, 22 nt, Human
uugcagacaggcaagcaccucc

SEQ ID NO: 3547398 - RNA, 23 nt, Human
uugcagacaggcaagcaccuccu

SEQ ID NO: 3547399 - RNA, 14 nt, Human
uugcagcagugagu

SEQ ID NO: 3547400 - RNA, 23 nt, Human
uugcagcagugagucucuucaga

SEQ ID NO: 3547401 - RNA, 21 nt, Human
uugcagcccuugugaugugau

SEQ ID NO: 3547402 - RNA, 18 nt, Human
uugcagccggcacagggu

SEQ ID NO: 3547403 - RNA, 15 nt, Human
uugcagccugcucua

SEQ ID NO: 3547404 - RNA, 15 nt, Human
uugcagcgacuggca

SEQ ID NO: 3547405 - RNA, 23 nt, Human
uugcagcuaaggaggggaaaaaa

SEQ ID NO: 3547406 - RNA, 23 nt, Human
uugcagcucccauucuauguguc

SEQ ID NO: 3547407 - RNA, 17 nt, Human
uugcagcugggagaagg

SEQ ID NO: 3547408 - RNA, 14 nt, Human
uugcagcuuuaugu

SEQ ID NO: 3547409 - RNA, 18 nt, Human
uugcagggagcauggcug

SEQ ID NO: 3547410 - RNA, 21 nt, Human
uugcagggcagccccacaacu

SEQ ID NO: 3547411 - RNA, 18 nt, Human
uugcagguggaacucagu

SEQ ID NO: 3547412 - RNA, 23 nt, Human
uugcagguggccaaguuccucua

SEQ ID NO: 3547413 - RNA, 23 nt, Human
uugcagguggggguugcuguaua

SEQ ID NO: 3547414 - RNA, 18 nt, Human
uaggccuggccagaugca

SEQ ID NO: 3547415 - RNA, 13 nt, Human
uaggccugggugc

SEQ ID NO: 3547416 - RNA, 21 nt, Human
uaggccuuccucucuccagau

SEQ ID NO: 3547417 - RNA, 18 nt, Human
uaggcgagugccaggacu

SEQ ID NO: 3547418 - RNA, 23 nt, Human
uaggcgaucacaacgugcauugu

SEQ ID NO: 3547419 - RNA, 16 nt, Human
uaggcgggaaggaggg

SEQ ID NO: 3547420 - RNA, 21 nt, Human
uaggcgggcggucagggguuc

SEQ ID NO: 3547421 - RNA, 19 nt, Human
uaggcggggcuugccuucu

SEQ ID NO: 3547422 - RNA, 22 nt, Human
uaggcggggcuugccuucuggu

SEQ ID NO: 3547423 - RNA, 17 nt, Human
uaggcuacagagaagcc

SEQ ID NO: 3547424 - RNA, 19 nt, Human
uaggcuacagagaagccuu

SEQ ID NO: 3547425 - RNA, 13 nt, Human
uaggcuagggugg

SEQ ID NO: 3547426 - RNA, 16 nt, Human
uaggcuagggugggga

SEQ ID NO: 3547427 - RNA, 15 nt, Human
uaggcuauuccugag

SEQ ID NO: 3547428 - RNA, 17 nt, Human
uaggcuauuccugagag

SEQ ID NO: 3547429 - RNA, 16 nt, Human
uaggcuauuuguaaau

SEQ ID NO: 3547430 - RNA, 16 nt, Human
uaggcucauuuacugu

SEQ ID NO: 3547431 - RNA, 22 nt, Human
uaggcuccugccaguguggaac

SEQ ID NO: 3547432 - RNA, 17 nt, Human
uaggcucgccuucccuc

SEQ ID NO: 3547433 - RNA, 19 nt, Human
uaggcugacaccuaacucu

SEQ ID NO: 3547434 - RNA, 17 nt, Human
uaggcuggagaagcuca

SEQ ID NO: 3547435 - RNA, 20 nt, Human
uaggcuggaguuagggacug

SEQ ID NO: 3547436 - RNA, 17 nt, Human
uaggcugggcccagagg

SEQ ID NO: 3547437 - RNA, 18 nt, Human
uaggcugggcccagaggc

SEQ ID NO: 3547438 - RNA, 18 nt, Human
uaggcuuaguuugugugu

SEQ ID NO: 3547439 - RNA, 20 nt, Human
uagggaaaaaccagcgugug

SEQ ID NO: 3547440 - RNA, 13 nt, Human
uagggaaaacauu

SEQ ID NO: 3547441 - RNA, 13 nt, Human
uagggaaaugaaa

SEQ ID NO: 3547442 - RNA, 16 nt, Human
uagggaaaugaaagaa

SEQ ID NO: 3547443 - RNA, 15 nt, Human
uagggaacaauuugg

SEQ ID NO: 3547444 - RNA, 15 nt, Human
uagggaacuggggaa

SEQ ID NO: 3547445 - RNA, 13 nt, Human
uagggaagauaau

SEQ ID NO: 3547446 - RNA, 21 nt, Human
uagggaaggauacaaaagcau

SEQ ID NO: 3547447 - RNA, 14 nt, Human
uagggaagggccug

SEQ ID NO: 3547448 - RNA, 14 nt, Human
uagggaaguaacag

SEQ ID NO: 3547449 - RNA, 22 nt, Human
uagggacaauacagaacccauu

SEQ ID NO: 3547450 - RNA, 19 nt, Human
uagggacaggaccccagcu

SEQ ID NO: 3547451 - RNA, 14 nt, Human
uagggaccccuccu

SEQ ID NO: 3547452 - RNA, 23 nt, Human
uagggaggaccacaggugugagc

SEQ ID NO: 3547453 - RNA, 22 nt, Human
uagggaggaccuuaucugugcg

SEQ ID NO: 3547454 - RNA, 17 nt, Human
uagggauagucaccuuu

SEQ ID NO: 3547455 - RNA, 20 nt, Human
uagggauagucaccuuuuaa

SEQ ID NO: 3547456 - RNA, 18 nt, Human
uagggauguucuggcccu

SEQ ID NO: 3547457 - RNA, 15 nt, Human
uagggauucaggcug

SEQ ID NO: 3547458 - RNA, 16 nt, Human
uagggauucaggcugc

SEQ ID NO: 3547459 - RNA, 23 nt, Human
uagggcaauuaauuccuucagca

SEQ ID NO: 3547460 - RNA, 20 nt, Human
uagggcaccagggguuucuc

SEQ ID NO: 3547461 - RNA, 13 nt, Human
uagggcacugggc

SEQ ID NO: 3547462 - RNA, 11 nt, Human
uagggcagcuu

SEQ ID NO: 3547463 - RNA, 13 nt, Human
uagggcagcuugc

SEQ ID NO: 3547464 - RNA, 24 nt, Human
uagggcauuguaucugucuuucca

SEQ ID NO: 3547465 - RNA, 18 nt, Human
uagggcauuugagaaaug

SEQ ID NO: 3547466 - RNA, 14 nt, Human
uagggccaggcagg

SEQ ID NO: 3547467 - RNA, 17 nt, Human
uagggcucuaauuuccu

SEQ ID NO: 3547468 - RNA, 16 nt, Human
uagggcugggaaacac

SEQ ID NO: 3547469 - RNA, 17 nt, Human
uaggggaagaauaauuu

SEQ ID NO: 3547470 - RNA, 18 nt, Human
uaggggaaggagaaguaa

SEQ ID NO: 3547471 - RNA, 17 nt, Human
uaggggaaugagggggc

SEQ ID NO: 3547472 - RNA, 19 nt, Human
uaggggccccucucagccc

SEQ ID NO: 3547473 - RNA, 23 nt, Human
uaggggccccucucagcccucac

SEQ ID NO: 3547474 - RNA, 14 nt, Human
uaggggcugggaac

SEQ ID NO: 3547475 - RNA, 16 nt, Human
uagggggaacucuagc

SEQ ID NO: 3547476 - RNA, 23 nt, Human
uagggguaauauauugcugcugg

SEQ ID NO: 3547477 - RNA, 14 nt, Human
uaggggucacugua

SEQ ID NO: 3547478 - RNA, 14 nt, Human
uaggguacuaaauu

SEQ ID NO: 3547479 - RNA, 15 nt, Human
uagggucucuucagg

SEQ ID NO: 3547480 - RNA, 13 nt, Human
uagggugcagcca

SEQ ID NO: 3547481 - RNA, 15 nt, Human
uaggguuauaauaau

SEQ ID NO: 3547482 - RNA, 18 nt, Human
uaggguugcuggagccug

SEQ ID NO: 3547483 - RNA, 20 nt, Human
uagguaaucaaugaauauug

SEQ ID NO: 3547484 - RNA, 16 nt, Human
uagguagaaaaagggu

SEQ ID NO: 3547485 - RNA, 15 nt, Human
uagguagauguucag

SEQ ID NO: 3547486 - RNA, 11 nt, Human
uagguauuuug

SEQ ID NO: 3547487 - RNA, 12 nt, Human
uaggucacuggc

SEQ ID NO: 3547488 - RNA, 14 nt, Human
uaggucagugaggc

SEQ ID NO: 3547489 - RNA, 16 nt, Human
uaggucagugcaaaua

SEQ ID NO: 3547490 - RNA, 16 nt, Human
uagguccuuuagaaac

SEQ ID NO: 3547491 - RNA, 20 nt, Human
uaggucuagccuauguggau

SEQ ID NO: 3547492 - RNA, 18 nt, Human
uaggucucuucucccaga

SEQ ID NO: 3547493 - RNA, 12 nt, Human
uaggucugaaau

SEQ ID NO: 3547494 - RNA, 19 nt, Human
uaggucugaaauuuuucuu

SEQ ID NO: 3547495 - RNA, 14 nt, Human
uaggucuuuguaag

SEQ ID NO: 3547496 - RNA, 11 nt, Human
uaggugacaga

SEQ ID NO: 3547497 - RNA, 23 nt, Human
uaggugaucccguuuuccccaug

SEQ ID NO: 3547498 - RNA, 14 nt, Human
uaggugauuugaag

SEQ ID NO: 3547499 - RNA, 22 nt, Human
uaggugcaauuucaagguucua

SEQ ID NO: 3547500 - RNA, 15 nt, Human
uagguggcaaggcug

SEQ ID NO: 3547501 - RNA, 16 nt, Human
uaggugggccagcccc

SEQ ID NO: 3547502 - RNA, 21 nt, Human
uaggugggccagccccuccca

SEQ ID NO: 3547503 - RNA, 22 nt, Human
uagguuauuuugauguaaagau

SEQ ID NO: 3547504 - RNA, 14 nt, Human
uagguucagccaag

SEQ ID NO: 3547505 - RNA, 17 nt, Human
uugccaccaccucugug

SEQ ID NO: 3547506 - RNA, 14 nt, Human
uugccaccaggaga

SEQ ID NO: 3547507 - RNA, 15 nt, Human
uugccaccaggagaa

SEQ ID NO: 3547508 - RNA, 12 nt, Human
uugccaccccac

SEQ ID NO: 3547509 - RNA, 21 nt, Human
uugccaccccacccucccugg

SEQ ID NO: 3547510 - RNA, 18 nt, Human
uugccaccucuaacagca

SEQ ID NO: 3547511 - RNA, 12 nt, Human
uugccacuaauu

SEQ ID NO: 3547512 - RNA, 18 nt, Human
uugccacugauauucaga

SEQ ID NO: 3547513 - RNA, 19 nt, Human
uugccacugauauucagaa

SEQ ID NO: 3547514 - RNA, 14 nt, Human
uugccacugccucu

SEQ ID NO: 3547515 - RNA, 15 nt, Human
uugccacugccucuu

SEQ ID NO: 3547516 - RNA, 16 nt, Human
uugccacuuugcacga

SEQ ID NO: 3547517 - RNA, 15 nt, Human
uugccagaaagcaua

SEQ ID NO: 3547518 - RNA, 17 nt, Human
uugccagaaagcauaaa

SEQ ID NO: 3547519 - RNA, 15 nt, Human
uugccagaaguugug

SEQ ID NO: 3547520 - RNA, 22 nt, Human
uugccagacauguggugggaca

SEQ ID NO: 3547521 - RNA, 18 nt, Human
uugccagaugcugcagag

SEQ ID NO: 3547522 - RNA, 12 nt, Human
uugccagcccau

SEQ ID NO: 3547523 - RNA, 20 nt, Human
uugccagcuuuuccucccuu

SEQ ID NO: 3547524 - RNA, 22 nt, Human
uugccaggaaaggagaguacuu

SEQ ID NO: 3547525 - RNA, 15 nt, Human
uugccaggacaugca

SEQ ID NO: 3547526 - RNA, 17 nt, Human
uugccaggacaugcaau

SEQ ID NO: 3547527 - RNA, 20 nt, Human
uugccaggugacugucuggg

SEQ ID NO: 3547528 - RNA, 18 nt, Human
uugccagucaccccggcc

SEQ ID NO: 3547529 - RNA, 15 nt, Human
uugccagugucuuuc

SEQ ID NO: 3547530 - RNA, 16 nt, Human
uugccagugucuuucu

SEQ ID NO: 3547531 - RNA, 15 nt, Human
uugccaguuguccuc

SEQ ID NO: 3547532 - RNA, 17 nt, Human
uugccaguuguccuccu

SEQ ID NO: 3547533 - RNA, 19 nt, Human
uugccaguuguccuccuuc

SEQ ID NO: 3547534 - RNA, 18 nt, Human
uugccauacuuugucuga

SEQ ID NO: 3547535 - RNA, 19 nt, Human
uugccauauuuucaccauu

SEQ ID NO: 3547536 - RNA, 17 nt, Human
uugccaucucugcucca

SEQ ID NO: 3547537 - RNA, 23 nt, Human
uugccaucugcgugacaauaaaa

SEQ ID NO: 3547538 - RNA, 20 nt, Human
uugccaugggcuucacugua

SEQ ID NO: 3547539 - RNA, 18 nt, Human
uugccauguuggccaggc

SEQ ID NO: 3547540 - RNA, 19 nt, Human
uugccauguuggccaggcu

SEQ ID NO: 3547541 - RNA, 20 nt, Human
uugccauguuggccaggcug

SEQ ID NO: 3547542 - RNA, 13 nt, Human
uugccauuuagcg

SEQ ID NO: 3547543 - RNA, 13 nt, Human
uugccauuugaua

SEQ ID NO: 3547544 - RNA, 18 nt, Human
uugccauuugauaccccu

SEQ ID NO: 3547545 - RNA, 13 nt, Human
uugcccaacacca

SEQ ID NO: 3547546 - RNA, 13 nt, Human
uugcccaaccuca

SEQ ID NO: 3547547 - RNA, 16 nt, Human
uugcccaaccucagca

SEQ ID NO: 3547548 - RNA, 17 nt, Human
uugcccaaccucagcaa

SEQ ID NO: 3547549 - RNA, 16 nt, Human
uugcccacuccugcuc

SEQ ID NO: 3547550 - RNA, 21 nt, Human
uugcccacuccugcucugcuc

SEQ ID NO: 3547551 - RNA, 11 nt, Human
uugcccaggcu

SEQ ID NO: 3547552 - RNA, 12 nt, Human
uugcccaggcug

SEQ ID NO: 3547553 - RNA, 23 nt, Human
uugcccaggcuggcgugcagugg

SEQ ID NO: 3547554 - RNA, 18 nt, Human
uugcccaggcuggucuca

SEQ ID NO: 3547555 - RNA, 20 nt, Human
uugcccaguacauuuaaauu

SEQ ID NO: 3547556 - RNA, 14 nt, Human
uugcccauccaucu

SEQ ID NO: 3547557 - RNA, 14 nt, Human
uugcccauccugac

SEQ ID NO: 3547558 - RNA, 15 nt, Human
uugcccauuuacacu

SEQ ID NO: 3547559 - RNA, 15 nt, Human
uugccccaaccccca

SEQ ID NO: 3547560 - RNA, 13 nt, Human
uauaauaaaagga

SEQ ID NO: 3547561 - RNA, 23 nt, Human
uuguacacccaugaaagaaaacu

SEQ ID NO: 3547562 - RNA, 11 nt, Human
uuguacacuuu

SEQ ID NO: 3547563 - RNA, 21 nt, Human
uuguacagaauauuucuauug

SEQ ID NO: 3547564 - RNA, 20 nt, Human
uuguacagaaucauugcuua

SEQ ID NO: 3547565 - RNA, 18 nt, Human
uuguacagaauuuuggaa

SEQ ID NO: 3547566 - RNA, 13 nt, Human
uuguacagacaac

SEQ ID NO: 3547567 - RNA, 15 nt, Human
uuguacagcccagag

SEQ ID NO: 3547568 - RNA, 16 nt, Human
uuguacaguucaguuc

SEQ ID NO: 3547569 - RNA, 12 nt, Human
uuguacaguuuu

SEQ ID NO: 3547570 - RNA, 13 nt, Human
uuguacaguuuuu

SEQ ID NO: 3547571 - RNA, 19 nt, Human
uuguacauacgauuuaagg

SEQ ID NO: 3547572 - RNA, 22 nt, Human
uuguacauacgauuuaagguau

SEQ ID NO: 3547573 - RNA, 21 nt, Human
uuguacauauuuguggaauaa

SEQ ID NO: 3547574 - RNA, 17 nt, Human
uuguacaucuggcuuau

SEQ ID NO: 3547575 - RNA, 23 nt, Human
uuguacaucuggcuuauuuuaau

SEQ ID NO: 3547576 - RNA, 13 nt, Human
uuguacaugaaca

SEQ ID NO: 3547577 - RNA, 21 nt, Human
uuguacauguguagccugugc

SEQ ID NO: 3547578 - RNA, 23 nt, Human
uuguacauuuaugauuuaauaaa

SEQ ID NO: 3547579 - RNA, 20 nt, Human
uuguaccacuuuugcaaaua

SEQ ID NO: 3547580 - RNA, 20 nt, Human
uuguaccccccaaccccuga

SEQ ID NO: 3547581 - RNA, 18 nt, Human
uuguacguuuaaagugua

SEQ ID NO: 3547582 - RNA, 23 nt, Human
uuguacuaaagccaaacauauau

SEQ ID NO: 3547583 - RNA, 22 nt, Human
uuguacuauuuaacugacuauu

SEQ ID NO: 3547584 - RNA, 22 nt, Human
uuguacugaauuuuuuuguaau

SEQ ID NO: 3547585 - RNA, 15 nt, Human
uuguacuuaaauggu

SEQ ID NO: 3547586 - RNA, 23 nt, Human
uuguacuuaaaugguaauaagca

SEQ ID NO: 3547587 - RNA, 17 nt, Human
uuguagaacucacucug

SEQ ID NO: 3547588 - RNA, 16 nt, Human
uuguagaauguauugu

SEQ ID NO: 3547589 - RNA, 21 nt, Human
uuguagagaaaacaugcagaa

SEQ ID NO: 3547590 - RNA, 23 nt, Human
uuguagagaacacgcguauuuac

SEQ ID NO: 3547591 - RNA, 14 nt, Human
uuguagagccaggg

SEQ ID NO: 3547592 - RNA, 19 nt, Human
uuguagaugaaaaagcaug

SEQ ID NO: 3547593 - RNA, 21 nt, Human
uuguagaugaaaaagcaugua

SEQ ID NO: 3547594 - RNA, 15 nt, Human
uuguagauugauugu

SEQ ID NO: 3547595 - RNA, 19 nt, Human
uuguagauugauuguauug

SEQ ID NO: 3547596 - RNA, 15 nt, Human
uuguagauuuagugu

SEQ ID NO: 3547597 - RNA, 16 nt, Human
uuguagcacugacaga

SEQ ID NO: 3547598 - RNA, 17 nt, Human
uuguagcacugacagau

SEQ ID NO: 3547599 - RNA, 22 nt, Human
uuguagcagauuguuuccucuu

SEQ ID NO: 3547600 - RNA, 21 nt, Human
uuguagcggaugauucuucaa

SEQ ID NO: 3547601 - RNA, 21 nt, Human
uuguagcgucuuucuuuuuug

SEQ ID NO: 3547602 - RNA, 19 nt, Human
uuguagcuggggcuuugau

SEQ ID NO: 3547603 - RNA, 16 nt, Human
uuguagcuuuaucaaa

SEQ ID NO: 3547604 - RNA, 15 nt, Human
uuguaggagacuugc

SEQ ID NO: 3547605 - RNA, 16 nt, Human
uuguaggguuacagag

SEQ ID NO: 3547606 - RNA, 13 nt, Human
uuguagguaaaau

SEQ ID NO: 3547607 - RNA, 19 nt, Human
uuguaggugcaagauggaa

SEQ ID NO: 3547608 - RNA, 22 nt, Human
uuguaguagcguuuuuuaaaug

SEQ ID NO: 3547609 - RNA, 17 nt, Human
uuguagugcuuugagag

SEQ ID NO: 3547610 - RNA, 14 nt, Human
uuguauaaaauaga

SEQ ID NO: 3547611 - RNA, 23 nt, Human
uuguauaaauuuauuuacugcua

SEQ ID NO: 3547612 - RNA, 16 nt, Human
uuguauaacagguuau

SEQ ID NO: 3547613 - RNA, 14 nt, Human
uuguauaacuucuu

SEQ ID NO: 3547614 - RNA, 11 nt, Human
uuguauaauug

SEQ ID NO: 3547615 - RNA, 12 nt, Human
uuguauaauugg

SEQ ID NO: 3547616 - RNA, 21 nt, Human
uuguauaauuggauuuccuaa

SEQ ID NO: 3547617 - RNA, 16 nt, Human
uuguauaauuguaucg

SEQ ID NO: 3547618 - RNA, 22 nt, Human
uuguauaauuucgagauuugua

SEQ ID NO: 3547619 - RNA, 14 nt, Human
uuguauacaaauau

SEQ ID NO: 3547620 - RNA, 20 nt, Human
uuguauacaccauauacugu

SEQ ID NO: 3547621 - RNA, 19 nt, Human
uuguauacuuuaaauaauu

SEQ ID NO: 3547622 - RNA, 22 nt, Human
uuguauagcaugaaauaaaaua

SEQ ID NO: 3547623 - RNA, 18 nt, Human
uuguauagguagauguuc

SEQ ID NO: 3547624 - RNA, 16 nt, Human
uuguauaguuauguaa

SEQ ID NO: 3547625 - RNA, 22 nt, Human
uuguauaguuauguaaauaauu

SEQ ID NO: 3547626 - RNA, 14 nt, Human
uuguauaguugcuu

SEQ ID NO: 3547627 - RNA, 15 nt, Human
uuguauaguugcuug

SEQ ID NO: 3547628 - RNA, 19 nt, Human
uuguauaguugcuugccug

SEQ ID NO: 3547629 - RNA, 16 nt, Human
uuguauauaugugugu

SEQ ID NO: 3547630 - RNA, 21 nt, Human
uuguauauauguguguuuaaa

SEQ ID NO: 3547631 - RNA, 20 nt, Human
uuguauauuacacauuugua

SEQ ID NO: 3547632 - RNA, 20 nt, Human
uuguauauuauggaagauuu

SEQ ID NO: 3547633 - RNA, 13 nt, Human
uuguauauucacu

SEQ ID NO: 3547634 - RNA, 14 nt, Human
uuguauauucuauu

SEQ ID NO: 3547635 - RNA, 14 nt, Human
uuguauauugguuu

SEQ ID NO: 3547636 - RNA, 22 nt, Human
uuguauauugguuuuaugauga

SEQ ID NO: 3547637 - RNA, 15 nt, Human
uuguauauuguguuu

SEQ ID NO: 3547638 - RNA, 19 nt, Human
uuguauauuguguuugugu

SEQ ID NO: 3547639 - RNA, 13 nt, Human
uuguauauuugua

SEQ ID NO: 3547640 - RNA, 14 nt, Human
uuguauauuuguac

SEQ ID NO: 3547641 - RNA, 19 nt, Human
uuguaucauuugaacaacu

SEQ ID NO: 3547642 - RNA, 18 nt, Human
uuguaucgauguuaugua

SEQ ID NO: 3547643 - RNA, 21 nt, Human
uuguaucgauguuauguaaaa

SEQ ID NO: 3547644 - RNA, 18 nt, Human
uuguaucuagugcagcug

SEQ ID NO: 3547645 - RNA, 20 nt, Human
uuguaucucugaagcauguu

SEQ ID NO: 3547646 - RNA, 20 nt, Human
uuguaucucuuuugaaucca

SEQ ID NO: 3547647 - RNA, 14 nt, Human
uuguaucugucuuu

SEQ ID NO: 3547648 - RNA, 14 nt, Human
uuguaucuuaaauu

SEQ ID NO: 3547649 - RNA, 16 nt, Human
uuguaugaaacuaaag

SEQ ID NO: 3547650 - RNA, 22 nt, Human
uuguaugaaagauggcugugcc

SEQ ID NO: 3547651 - RNA, 17 nt, Human
uuguaugaaauauaugu

SEQ ID NO: 3547652 - RNA, 22 nt, Human
uuguaugaaauauaugugaaag

SEQ ID NO: 3547653 - RNA, 14 nt, Human
uuguaugauguguu

SEQ ID NO: 3547654 - RNA, 20 nt, Human
uuguaugauguguugugaua

SEQ ID NO: 3547655 - RNA, 19 nt, Human
uuguaugcaagcaguuuca

SEQ ID NO: 3547656 - RNA, 21 nt, Human
uuguaugccuuuaaaucugug

SEQ ID NO: 3547657 - RNA, 22 nt, Human
uuguaugccuuuaaaucuguga

SEQ ID NO: 3547658 - RNA, 23 nt, Human
uuguaugccuuuaaaucugugau

SEQ ID NO: 3547659 - RNA, 15 nt, Human
uuguauguaucuauu

SEQ ID NO: 3547660 - RNA, 17 nt, Human
uuguauguguguagaca

SEQ ID NO: 3547661 - RNA, 19 nt, Human
uuguauguuaaguuacuuc

SEQ ID NO: 3547662 - RNA, 12 nt, Human
uuguauuaagaa

SEQ ID NO: 3547663 - RNA, 13 nt, Human
uuguauuaagaau

SEQ ID NO: 3547664 - RNA, 18 nt, Human
uuguauuaagaaugaaau

SEQ ID NO: 3547665 - RNA, 17 nt, Human
uuguauuagauguucuc

SEQ ID NO: 3547666 - RNA, 14 nt, Human
uuguauuauugcug

SEQ ID NO: 3547667 - RNA, 19 nt, Human
uuguauuauugcuguugcu

SEQ ID NO: 3547668 - RNA, 18 nt, Human
uuguauucaauuaaagaa

SEQ ID NO: 3547669 - RNA, 21 nt, Human
uuguauucagaguugaugguu

SEQ ID NO: 3547670 - RNA, 17 nt, Human
uuguauuccaagcauau

SEQ ID NO: 3547671 - RNA, 16 nt, Human
uuguauucucuccugu

SEQ ID NO: 3547672 - RNA, 21 nt, Human
uuguauucucuccuguaccuc

SEQ ID NO: 3547673 - RNA, 14 nt, Human
uuguauucucugag

SEQ ID NO: 3547674 - RNA, 15 nt, Human
uuguauucucugagc

SEQ ID NO: 3547675 - RNA, 22 nt, Human
uuguauucucugagcugugcag

SEQ ID NO: 3547676 - RNA, 18 nt, Human
uuguauuguauauuacaa

SEQ ID NO: 3547677 - RNA, 16 nt, Human
uuguauuguccuauua

SEQ ID NO: 3547678 - RNA, 16 nt, Human
uuguauuguuucaauu

SEQ ID NO: 3547679 - RNA, 20 nt, Human
uuguauuuauucaauaaagu

SEQ ID NO: 3547680 - RNA, 14 nt, Human
uuguauuuuaacuc

SEQ ID NO: 3547681 - RNA, 20 nt, Human
uuguauuuuauuuuuuucuc

SEQ ID NO: 3547682 - RNA, 16 nt, Human
uuguauuuucaugaaa

SEQ ID NO: 3547683 - RNA, 21 nt, Human
uuguauuuuccaagugugcau

SEQ ID NO: 3547684 - RNA, 15 nt, Human
uuguauuuuuccaga

SEQ ID NO: 3547685 - RNA, 20 nt, Human
uuguauuuuuuugcaaguga

SEQ ID NO: 3547686 - RNA, 21 nt, Human
uuguauuuuuuugcaagugaa

SEQ ID NO: 3547687 - RNA, 13 nt, Human
uugucaaacugua

SEQ ID NO: 3547688 - RNA, 13 nt, Human
uugucaaagagag

SEQ ID NO: 3547689 - RNA, 19 nt, Human
uugucaauuuaugaauaua

SEQ ID NO: 3547690 - RNA, 14 nt, Human
uugucacaauaaau

SEQ ID NO: 3547691 - RNA, 19 nt, Human
uugucaccugcuucucugc

SEQ ID NO: 3547692 - RNA, 17 nt, Human
uugucaccuucaccucc

SEQ ID NO: 3547693 - RNA, 20 nt, Human
uugucacgccagacuuccca

SEQ ID NO: 3547694 - RNA, 19 nt, Human
uugucacgcuucuucuuuu

SEQ ID NO: 3547695 - RNA, 22 nt, Human
uugucacucaacaaaagugcuu

SEQ ID NO: 3547696 - RNA, 22 nt, Human
uugucacugacacaaaggaagu

SEQ ID NO: 3547697 - RNA, 17 nt, Human
uugucacugcuuuuggc

SEQ ID NO: 3547698 - RNA, 16 nt, Human
uugucacuugcauguc

SEQ ID NO: 3547699 - RNA, 14 nt, Human
uugucacuuuuuau

SEQ ID NO: 3547700 - RNA, 14 nt, Human
uugucacuuuuucu

SEQ ID NO: 3547701 - RNA, 12 nt, Human
uugucagacuuu

SEQ ID NO: 3547702 - RNA, 14 nt, Human
uugucagacuuuaa

SEQ ID NO: 3547703 - RNA, 13 nt, Human
uugucagagcugg

SEQ ID NO: 3547704 - RNA, 22 nt, Human
uauacuguacuuaauaaauuca

SEQ ID NO: 3547705 - RNA, 14 nt, Human
uauacuguguguga

SEQ ID NO: 3547706 - RNA, 14 nt, Human
uauacuugaacaaa

SEQ ID NO: 3547707 - RNA, 15 nt, Human
uauacuugaacaaaa

SEQ ID NO: 3547708 - RNA, 16 nt, Human
uauacuugaacaaaag

SEQ ID NO: 3547709 - RNA, 14 nt, Human
uauacuugaaugaa

SEQ ID NO: 3547710 - RNA, 16 nt, Human
uauacuugaaugaaaa

SEQ ID NO: 3547711 - RNA, 23 nt, Human
uauacuugcuuuguguucuuugu

SEQ ID NO: 3547712 - RNA, 13 nt, Human
uauacuuguaauu

SEQ ID NO: 3547713 - RNA, 18 nt, Human
uauacuuguaauuaugga

SEQ ID NO: 3547714 - RNA, 22 nt, Human
uauacuuguaauuauggaguca

SEQ ID NO: 3547715 - RNA, 21 nt, Human
uauacuuguggacuaaaagau

SEQ ID NO: 3547716 - RNA, 23 nt, Human
uauacuuguggacuaaaagauau

SEQ ID NO: 3547717 - RNA, 19 nt, Human
uauacuugugguuuucaaa

SEQ ID NO: 3547718 - RNA, 20 nt, Human
uauacuuguuuuuguaaaga

SEQ ID NO: 3547719 - RNA, 22 nt, Human
uauacuuguuuuuguaaagaaa

SEQ ID NO: 3547720 - RNA, 15 nt, Human
uauacuuuaaauaau

SEQ ID NO: 3547721 - RNA, 12 nt, Human
uauacuuuagua

SEQ ID NO: 3547722 - RNA, 12 nt, Human
uauacuuucccu

SEQ ID NO: 3547723 - RNA, 17 nt, Human
uauacuuucccuacccu

SEQ ID NO: 3547724 - RNA, 22 nt, Human
uauagaaaaauaaaaaucucuu

SEQ ID NO: 3547725 - RNA, 22 nt, Human
uuccauaauuaugacaguuaua

SEQ ID NO: 3547726 - RNA, 15 nt, Human
uuccauagcaacagg

SEQ ID NO: 3547727 - RNA, 17 nt, Human
uuccauagcugcugccc

SEQ ID NO: 3547728 - RNA, 17 nt, Human
uuccauaguauauuaaa

SEQ ID NO: 3547729 - RNA, 18 nt, Human
uuccauaguauauuaaaa

SEQ ID NO: 3547730 - RNA, 16 nt, Human
uuccauaguuaaagaa

SEQ ID NO: 3547731 - RNA, 15 nt, Human
uuccauauauccuuu

SEQ ID NO: 3547732 - RNA, 18 nt, Human
uuccauauauuagcauuu

SEQ ID NO: 3547733 - RNA, 15 nt, Human
uuccauauccuggug

SEQ ID NO: 3547734 - RNA, 15 nt, Human
uuccauaugaccuca

SEQ ID NO: 3547735 - RNA, 18 nt, Human
uuccauauggauccacug

SEQ ID NO: 3547736 - RNA, 19 nt, Human
uuccauauggauccacugg

SEQ ID NO: 3547737 - RNA, 22 nt, Human
uuccauauggauccacuggcug

SEQ ID NO: 3547738 - RNA, 15 nt, Human
uuccauauggauuuu

SEQ ID NO: 3547739 - RNA, 20 nt, Human
uuccauauggauuuucuauu

SEQ ID NO: 3547740 - RNA, 14 nt, Human
uuccauauucaugu

SEQ ID NO: 3547741 - RNA, 14 nt, Human
uuccauauuuggaa

SEQ ID NO: 3547742 - RNA, 17 nt, Human
uuccauccauggccagc

SEQ ID NO: 3547743 - RNA, 21 nt, Human
uuccauccuagucacuaccuu

SEQ ID NO: 3547744 - RNA, 12 nt, Human
uuccaucugaaa

SEQ ID NO: 3547745 - RNA, 12 nt, Human
uuccaucugauu

SEQ ID NO: 3547746 - RNA, 17 nt, Human
uuccaucugauuccagc

SEQ ID NO: 3547747 - RNA, 15 nt, Human
uuccaugaaaacguu

SEQ ID NO: 3547748 - RNA, 18 nt, Human
uuccaugaagaccacauc

SEQ ID NO: 3547749 - RNA, 15 nt, Human
uuccaugaaucgcuu

SEQ ID NO: 3547750 - RNA, 20 nt, Human
uuccaugaaucgcuucucuu

SEQ ID NO: 3547751 - RNA, 17 nt, Human
uuccaugaguccccugu

SEQ ID NO: 3547752 - RNA, 13 nt, Human
uuccaugaugcug

SEQ ID NO: 3547753 - RNA, 17 nt, Human
uuccaugauucuauuua

SEQ ID NO: 3547754 - RNA, 14 nt, Human
uuccaugccugagg

SEQ ID NO: 3547755 - RNA, 16 nt, Human
uuccaugccugagggu

SEQ ID NO: 3547756 - RNA, 18 nt, Human
uuccaugccugagggugg

SEQ ID NO: 3547757 - RNA, 16 nt, Human
uuccaugcuaagcaag

SEQ ID NO: 3547758 - RNA, 14 nt, Human
uuccaugcugugcg

SEQ ID NO: 3547759 - RNA, 15 nt, Human
uuccauggacuuugu

SEQ ID NO: 3547760 - RNA, 15 nt, Human
uuccauggcccucau

SEQ ID NO: 3547761 - RNA, 16 nt, Human
uuccauggccucuuca

SEQ ID NO: 3547762 - RNA, 14 nt, Human
uuccauguaugcau

SEQ ID NO: 3547763 - RNA, 21 nt, Human
uuccaugucaagauucagcua

SEQ ID NO: 3547764 - RNA, 19 nt, Human
uuccaugucgccucugcau

SEQ ID NO: 3547765 - RNA, 20 nt, Human
uuccaugucgccucugcauu

SEQ ID NO: 3547766 - RNA, 23 nt, Human
uuccaugugaggguuuucagcau

SEQ ID NO: 3547767 - RNA, 16 nt, Human
uuccaugugcccaguu

SEQ ID NO: 3547768 - RNA, 16 nt, Human
uuccauguugcugcca

SEQ ID NO: 3547769 - RNA, 23 nt, Human
uuccauuaaacgauuuuuaaaau

SEQ ID NO: 3547770 - RNA, 14 nt, Human
uuccauuaugauuc

SEQ ID NO: 3547771 - RNA, 16 nt, Human
uuccauuaugauucuu

SEQ ID NO: 3547772 - RNA, 13 nt, Human
uuccauuccagaa

SEQ ID NO: 3547773 - RNA, 16 nt, Human
uuccauuccauuguuu

SEQ ID NO: 3547774 - RNA, 13 nt, Human
uuccauucucacc

SEQ ID NO: 3547775 - RNA, 20 nt, Human
uuccauucuggauuuuguca

SEQ ID NO: 3547776 - RNA, 16 nt, Human
uuccauugguccaaga

SEQ ID NO: 3547777 - RNA, 20 nt, Human
uuccauugguccaagauucc

SEQ ID NO: 3547778 - RNA, 15 nt, Human
uuccauuucucucuc

SEQ ID NO: 3547779 - RNA, 17 nt, Human
uuccauuugcaagggaa

SEQ ID NO: 3547780 - RNA, 15 nt, Human
uuccauuugcauuug

SEQ ID NO: 3547781 - RNA, 17 nt, Human
uuccauuugcauuuguu

SEQ ID NO: 3547782 - RNA, 14 nt, Human
uuccauuuuccccc

SEQ ID NO: 3547783 - RNA, 16 nt, Human
uuccauuuucccccac

SEQ ID NO: 3547784 - RNA, 23 nt, Human
uuccauuuuggcgcuauuacaaa

SEQ ID NO: 3547785 - RNA, 11 nt, Human
uucccaaaagc

SEQ ID NO: 3547786 - RNA, 21 nt, Human
uucccaaaagcccauucauuc

SEQ ID NO: 3547787 - RNA, 19 nt, Human
uucccaaaauguugaaaua

SEQ ID NO: 3547788 - RNA, 22 nt, Human
uucccaaaauguugaaauauga

SEQ ID NO: 3547789 - RNA, 23 nt, Human
uucccaaagcagugcaugcuguc

SEQ ID NO: 3547790 - RNA, 20 nt, Human
uucccaaaugugugcccagc

SEQ ID NO: 3547791 - RNA, 16 nt, Human
uucccaaccugcucau

SEQ ID NO: 3547792 - RNA, 18 nt, Human
uucccaacuccagaaagu

SEQ ID NO: 3547793 - RNA, 17 nt, Human
uucccaacucuagcugg

SEQ ID NO: 3547794 - RNA, 21 nt, Human
uucccaagagcaucaugccuc

SEQ ID NO: 3547795 - RNA, 23 nt, Human
uucccaagccuucgggcgucugu

SEQ ID NO: 3547796 - RNA, 17 nt, Human
uucccaaggccuuaagc

SEQ ID NO: 3547797 - RNA, 20 nt, Human
uucccaaguaagaggcugga

SEQ ID NO: 3547798 - RNA, 17 nt, Human
uucccaaucagcacuga

SEQ ID NO: 3547799 - RNA, 18 nt, Human
uucccaaucagcacugaa

SEQ ID NO: 3547800 - RNA, 19 nt, Human
uucccaaucagcacugaaa

SEQ ID NO: 3547801 - RNA, 20 nt, Human
uucccaaucagcacugaaaa

SEQ ID NO: 3547802 - RNA, 14 nt, Human
uucccaauuaggaa

SEQ ID NO: 3547803 - RNA, 14 nt, Human
uucccaauucacau

SEQ ID NO: 3547804 - RNA, 18 nt, Human
uucccaccaggcugcuca

SEQ ID NO: 3547805 - RNA, 15 nt, Human
uucccacccagccug

SEQ ID NO: 3547806 - RNA, 15 nt, Human
uucccacccaucgcu

SEQ ID NO: 3547807 - RNA, 21 nt, Human
uucccaccccaaccugcucuc

SEQ ID NO: 3547808 - RNA, 14 nt, Human
uucccaccucccug

SEQ ID NO: 3547809 - RNA, 16 nt, Human
uucccaccucccugcc

SEQ ID NO: 3547810 - RNA, 18 nt, Human
uucccacucuagggcagu

SEQ ID NO: 3547811 - RNA, 13 nt, Human
uucccacugcacc

SEQ ID NO: 3547812 - RNA, 15 nt, Human
uucccacuguuuaag

SEQ ID NO: 3547813 - RNA, 18 nt, Human
uucccacuucccacccug

SEQ ID NO: 3547814 - RNA, 17 nt, Human
uucccacuuucccaccc

SEQ ID NO: 3547815 - RNA, 23 nt, Human
uucccagaaggcauaucagucuc

SEQ ID NO: 3547816 - RNA, 15 nt, Human
uucccagagacagga

SEQ ID NO: 3547817 - RNA, 22 nt, Human
uucccagagacaggaaaauccu

SEQ ID NO: 3547818 - RNA, 14 nt, Human
uucccagauacuuc

SEQ ID NO: 3547819 - RNA, 21 nt, Human
uucccagcacuaugcuuuccu

SEQ ID NO: 3547820 - RNA, 22 nt, Human
uucccagcacuaugcuuuccuu

SEQ ID NO: 3547821 - RNA, 23 nt, Human
uucccagcacuaugcuuuccuuc

SEQ ID NO: 3547822 - RNA, 17 nt, Human
uucccagcucucccucu

SEQ ID NO: 3547823 - RNA, 15 nt, Human
uucccagcugccccu

SEQ ID NO: 3547824 - RNA, 13 nt, Human
uucccagcugucu

SEQ ID NO: 3547825 - RNA, 18 nt, Human
uucccagcuucugccaca

SEQ ID NO: 3547826 - RNA, 19 nt, Human
uucccaggaaagaagcauu

SEQ ID NO: 3547827 - RNA, 19 nt, Human
uucccaggacccugaaggg

SEQ ID NO: 3547828 - RNA, 20 nt, Human
uucccaggaguucugcucau

SEQ ID NO: 3547829 - RNA, 20 nt, Human
uucccaggcaaauaaaauuc

SEQ ID NO: 3547830 - RNA, 12 nt, Human
uucccaggccca

SEQ ID NO: 3547831 - RNA, 18 nt, Human
uucccagguucuguuuau

SEQ ID NO: 3547832 - RNA, 23 nt, Human
uucccagugacacuucagagagc

SEQ ID NO: 3547833 - RNA, 18 nt, Human
uucccaguuggagcucca

SEQ ID NO: 3547834 - RNA, 11 nt, Human
uucccauaauu

SEQ ID NO: 3547835 - RNA, 16 nt, Human
uucccauaauuuucuu

SEQ ID NO: 3547836 - RNA, 14 nt, Human
uucccaucgcuguc

SEQ ID NO: 3547837 - RNA, 13 nt, Human
uucccaugauuuc

SEQ ID NO: 3547838 - RNA, 18 nt, Human
uucccaugauuucaugua

SEQ ID NO: 3547839 - RNA, 21 nt, Human
uucccaugauuucauguacug

SEQ ID NO: 3547840 - RNA, 15 nt, Human
uucccauggggaggg

SEQ ID NO: 3547841 - RNA, 17 nt, Human
uucccauguagcccccu

SEQ ID NO: 3547842 - RNA, 14 nt, Human
uucccauuuagaau

SEQ ID NO: 3547843 - RNA, 22 nt, Human
uucccauuuagaauggugauuu

SEQ ID NO: 3547844 - RNA, 15 nt, Human
uucccauuucagcug

SEQ ID NO: 3547845 - RNA, 17 nt, Human
uucccauuugugccaga

SEQ ID NO: 3547846 - RNA, 15 nt, Human
uuccccaaagucuua

SEQ ID NO: 3547847 - RNA, 14 nt, Human
uuccccaaauacaa

SEQ ID NO: 3547848 - RNA, 13 nt, Human
uuccccaacagug

SEQ ID NO: 3547849 - RNA, 15 nt, Human
uucuaauugccaugu

SEQ ID NO: 3547850 - RNA, 16 nt, Human
uucuaauugcuuauuu

SEQ ID NO: 3547851 - RNA, 18 nt, Human
uucuaauuggcuuuacua

SEQ ID NO: 3547852 - RNA, 17 nt, Human
uucuaauuugcugcuga

SEQ ID NO: 3547853 - RNA, 15 nt, Human
uucuaauuuuuaaga

SEQ ID NO: 3547854 - RNA, 18 nt, Human
uucuacaaaauccugaug

SEQ ID NO: 3547855 - RNA, 21 nt, Human
uucuacaacucauacacucgu

SEQ ID NO: 3547856 - RNA, 16 nt, Human
uucuacaaucuauuua

SEQ ID NO: 3547857 - RNA, 16 nt, Human
uucuacaaugugaacu

SEQ ID NO: 3547858 - RNA, 17 nt, Human
uucuacaauuaauaguu

SEQ ID NO: 3547859 - RNA, 15 nt, Human
uucuacacagagcag

SEQ ID NO: 3547860 - RNA, 17 nt, Human
uucuacagaaaaacaau

SEQ ID NO: 3547861 - RNA, 17 nt, Human
uucuacagcaaauuuau

SEQ ID NO: 3547862 - RNA, 15 nt, Human
uucuacauacuaugg

SEQ ID NO: 3547863 - RNA, 15 nt, Human
uucuacauagaugcu

SEQ ID NO: 3547864 - RNA, 18 nt, Human
uucuacauuauugcuuau

SEQ ID NO: 3547865 - RNA, 16 nt, Human
uucuacauuucuuaga

SEQ ID NO: 3547866 - RNA, 19 nt, Human
uucuaccaaggucuucuua

SEQ ID NO: 3547867 - RNA, 22 nt, Human
uucuaccaugaacagaaaacau

SEQ ID NO: 3547868 - RNA, 14 nt, Human
uucuaccauuucag

SEQ ID NO: 3547869 - RNA, 12 nt, Human
uucuacccagcg

SEQ ID NO: 3547870 - RNA, 21 nt, Human
uucuacccagcgagcccuggu

SEQ ID NO: 3547871 - RNA, 15 nt, Human
uucuacccuagccau

SEQ ID NO: 3547872 - RNA, 23 nt, Human
uucuaccggagagagaauguauu

SEQ ID NO: 3547873 - RNA, 14 nt, Human
uucuaccucccaga

SEQ ID NO: 3547874 - RNA, 12 nt, Human
uucuaccugcca

SEQ ID NO: 3547875 - RNA, 13 nt, Human
uucuacgccaggg

SEQ ID NO: 3547876 - RNA, 19 nt, Human
uucuacggaucaucaacaa

SEQ ID NO: 3547877 - RNA, 20 nt, Human
uucuacggaucaucaacaag

SEQ ID NO: 3547878 - RNA, 13 nt, Human
uucuacguuucuu

SEQ ID NO: 3547879 - RNA, 20 nt, Human
uucuacucacuuuucccacu

SEQ ID NO: 3547880 - RNA, 21 nt, Human
uucuacucacuuuucccacuc

SEQ ID NO: 3547881 - RNA, 12 nt, Human
uucuacuguaug

SEQ ID NO: 3547882 - RNA, 19 nt, Human
uucuacugucaaaugaugu

SEQ ID NO: 3547883 - RNA, 18 nt, Human
uucuacuuuaagcacuac

SEQ ID NO: 3547884 - RNA, 22 nt, Human
uucuagaacaucccugccagcu

SEQ ID NO: 3547885 - RNA, 22 nt, Human
uucuagacauggagguucuaag

SEQ ID NO: 3547886 - RNA, 23 nt, Human
uucuagacauggagguucuaagg

SEQ ID NO: 3547887 - RNA, 14 nt, Human
uucuagacuauaaa

SEQ ID NO: 3547888 - RNA, 22 nt, Human
uucuagagaagaggcuggugcu

SEQ ID NO: 3547889 - RNA, 20 nt, Human
uucuagagccugcuggaucu

SEQ ID NO: 3547890 - RNA, 14 nt, Human
uucuagaguucaga

SEQ ID NO: 3547891 - RNA, 18 nt, Human
uucuagauacaauaaauu

SEQ ID NO: 3547892 - RNA, 23 nt, Human
uucuagaucagaugcuccaagau

SEQ ID NO: 3547893 - RNA, 12 nt, Human
uucuagaugauu

SEQ ID NO: 3547894 - RNA, 19 nt, Human
uucuagaugcaagucucuu

SEQ ID NO: 3547895 - RNA, 15 nt, Human
uucuagcacuggccu

SEQ ID NO: 3547896 - RNA, 17 nt, Human
uucuagcacuggccugc

SEQ ID NO: 3547897 - RNA, 20 nt, Human
uucuagcauggcauauuuuu

SEQ ID NO: 3547898 - RNA, 18 nt, Human
uucuagcccgaauacaaa

SEQ ID NO: 3547899 - RNA, 17 nt, Human
uucuagcuaauguaaua

SEQ ID NO: 3547900 - RNA, 12 nt, Human
uucuaggaaaau

SEQ ID NO: 3547901 - RNA, 14 nt, Human
uucuaggaagaauu

SEQ ID NO: 3547902 - RNA, 18 nt, Human
uucuaggaagaauuuuaa

SEQ ID NO: 3547903 - RNA, 19 nt, Human
uucuaggaagaauuuuaaa

SEQ ID NO: 3547904 - RNA, 16 nt, Human
uucuaggacugaauua

SEQ ID NO: 3547905 - RNA, 19 nt, Human
uucuaggcaucucuguacu

SEQ ID NO: 3547906 - RNA, 14 nt, Human
uucuagggcuggga

SEQ ID NO: 3547907 - RNA, 19 nt, Human
uucuagggcugggaaacac

SEQ ID NO: 3547908 - RNA, 20 nt, Human
uucuagggcugggaaacacu

SEQ ID NO: 3547909 - RNA, 21 nt, Human
uucuaggucaaggccuguccc

SEQ ID NO: 3547910 - RNA, 15 nt, Human
uucuagguucuaaaa

SEQ ID NO: 3547911 - RNA, 17 nt, Human
uucuagguuucaaagau

SEQ ID NO: 3547912 - RNA, 20 nt, Human
uucuaguaauaaagacucua

SEQ ID NO: 3547913 - RNA, 23 nt, Human
uucuagugaugaugguucacguu

SEQ ID NO: 3547914 - RNA, 14 nt, Human
uucuagugcugcug

SEQ ID NO: 3547915 - RNA, 16 nt, Human
uucuagugcugcugaa

SEQ ID NO: 3547916 - RNA, 18 nt, Human
uucuagugcugcugaaga

SEQ ID NO: 3547917 - RNA, 19 nt, Human
uucuaguggucuuuguaag

SEQ ID NO: 3547918 - RNA, 17 nt, Human
uucuaguugaggaguuu

SEQ ID NO: 3547919 - RNA, 14 nt, Human
uucuaguuucucuu

SEQ ID NO: 3547920 - RNA, 15 nt, Human
uucuaguuugcauuc

SEQ ID NO: 3547921 - RNA, 14 nt, Human
uucuaguuuucagu

SEQ ID NO: 3547922 - RNA, 23 nt, Human
uucuaguuuucaguuuguauaua

SEQ ID NO: 3547923 - RNA, 14 nt, Human
uucuauaacagaua

SEQ ID NO: 3547924 - RNA, 13 nt, Human
uucuauaaggcca

SEQ ID NO: 3547925 - RNA, 21 nt, Human
uucuauaaguuuuauguuaaa

SEQ ID NO: 3547926 - RNA, 20 nt, Human
uuuaagcugcaaaucugaug

SEQ ID NO: 3547927 - RNA, 22 nt, Human
uuuaagcuguggucaaggcuac

SEQ ID NO: 3547928 - RNA, 13 nt, Human
uuuaagcuguuuc

SEQ ID NO: 3547929 - RNA, 18 nt, Human
uuuaagcuguuuccauag

SEQ ID NO: 3547930 - RNA, 22 nt, Human
uuuaagcuuauuuaauuaaaaa

SEQ ID NO: 3547931 - RNA, 15 nt, Human
uuuaaggaaaggcaa

SEQ ID NO: 3547932 - RNA, 19 nt, Human
uuuaaggacugacugaggc

SEQ ID NO: 3547933 - RNA, 22 nt, Human
uuuaaggcuucaauuuauugca

SEQ ID NO: 3547934 - RNA, 20 nt, Human
uuuaagggcaugccuugugc

SEQ ID NO: 3547935 - RNA, 18 nt, Human
uuuaagggcccuuuuuca

SEQ ID NO: 3547936 - RNA, 21 nt, Human
uuuaagggcccuuuuucaaua

SEQ ID NO: 3547937 - RNA, 14 nt, Human
uuuaaguaaugugg

SEQ ID NO: 3547938 - RNA, 16 nt, Human
uuuaaguaauguggaa

SEQ ID NO: 3547939 - RNA, 14 nt, Human
uuuaaguagauuuc

SEQ ID NO: 3547940 - RNA, 12 nt, Human
uuuaaguauuua

SEQ ID NO: 3547941 - RNA, 14 nt, Human
uuuaaguauuuaua

SEQ ID NO: 3547942 - RNA, 18 nt, Human
uuuaaguauuuauauauu

SEQ ID NO: 3547943 - RNA, 15 nt, Human
uuuaagucccuguca

SEQ ID NO: 3547944 - RNA, 19 nt, Human
uuuaagugaaagugaggaa

SEQ ID NO: 3547945 - RNA, 20 nt, Human
uuuaagugcguguguagagu

SEQ ID NO: 3547946 - RNA, 14 nt, Human
uuuaaguguaacug

SEQ ID NO: 3547947 - RNA, 17 nt, Human
uuuaaguguuggaaaaa

SEQ ID NO: 3547948 - RNA, 16 nt, Human
uuuaaguuauuaagag

SEQ ID NO: 3547949 - RNA, 15 nt, Human
uuuaaguuguuugca

SEQ ID NO: 3547950 - RNA, 21 nt, Human
uuuaaguuguuugcaugugaa

SEQ ID NO: 3547951 - RNA, 18 nt, Human
uuuaaguuugcacucaaa

SEQ ID NO: 3547952 - RNA, 16 nt, Human
uuuaauaaaauaauaa

SEQ ID NO: 3547953 - RNA, 14 nt, Human
uuuaauaaacacuc

SEQ ID NO: 3547954 - RNA, 13 nt, Human
uuuaauaaaccau

SEQ ID NO: 3547955 - RNA, 13 nt, Human
uuuaauaaacuuu

SEQ ID NO: 3547956 - RNA, 14 nt, Human
uuuaauaacaauug

SEQ ID NO: 3547957 - RNA, 19 nt, Human
uuuaauaacauaacaaaua

SEQ ID NO: 3547958 - RNA, 12 nt, Human
uuuaauaacauu

SEQ ID NO: 3547959 - RNA, 18 nt, Human
uuuaauaacauuaccuua

SEQ ID NO: 3547960 - RNA, 13 nt, Human
uuuaauaauguuu

SEQ ID NO: 3547961 - RNA, 15 nt, Human
uuuaauaauguuuca

SEQ ID NO: 3547962 - RNA, 21 nt, Human
uuuaauaauuauaugcuauuu

SEQ ID NO: 3547963 - RNA, 16 nt, Human
uuuaauaauuuuuaau

SEQ ID NO: 3547964 - RNA, 14 nt, Human
uuuaauacagggua

SEQ ID NO: 3547965 - RNA, 17 nt, Human
uuuaauagaaccauguu

SEQ ID NO: 3547966 - RNA, 18 nt, Human
uuuaauagcaaagaauug

SEQ ID NO: 3547967 - RNA, 19 nt, Human
uuuaauagcuauggaauca

SEQ ID NO: 3547968 - RNA, 17 nt, Human
uuuaauagucauuccaa

SEQ ID NO: 3547969 - RNA, 18 nt, Human
uuuaauaguguuaaucaa

SEQ ID NO: 3547970 - RNA, 13 nt, Human
uuuaauauaaagu

SEQ ID NO: 3547971 - RNA, 22 nt, Human
uuuaauauaaaguuuuauauau

SEQ ID NO: 3547972 - RNA, 16 nt, Human
uuuaauaugcaaaguc

SEQ ID NO: 3547973 - RNA, 14 nt, Human
uuuaauauguauuu

SEQ ID NO: 3547974 - RNA, 17 nt, Human
uuuaauauuaaagccau

SEQ ID NO: 3547975 - RNA, 20 nt, Human
uuuaauauuaaagccauguu

SEQ ID NO: 3547976 - RNA, 18 nt, Human
uuuaauauuuaaacagca

SEQ ID NO: 3547977 - RNA, 13 nt, Human
uuuaaucaaauuu

SEQ ID NO: 3547978 - RNA, 19 nt, Human
uuuaaucaaguuguaacuu

SEQ ID NO: 3547979 - RNA, 19 nt, Human
uuuaaucauaguuacugug

SEQ ID NO: 3547980 - RNA, 23 nt, Human
uuuaaucauaguuacuguguaaa

SEQ ID NO: 3547981 - RNA, 13 nt, Human
uuuaaucauauaa

SEQ ID NO: 3547982 - RNA, 22 nt, Human
uuuaaucauauaaauagaaugu

SEQ ID NO: 3547983 - RNA, 20 nt, Human
uuuaaucaugaauaugauga

SEQ ID NO: 3547984 - RNA, 15 nt, Human
uuuaauccccaguaa

SEQ ID NO: 3547985 - RNA, 18 nt, Human
uuuaaucuacugcauuua

SEQ ID NO: 3547986 - RNA, 21 nt, Human
uuuaaugaaagacuguacaaa

SEQ ID NO: 3547987 - RNA, 23 nt, Human
uuuaaugaaagacuguacaaagu

SEQ ID NO: 3547988 - RNA, 16 nt, Human
uuuaaugaacaaaugg

SEQ ID NO: 3547989 - RNA, 22 nt, Human
uuuaaugaaugcuuaaagaauu

SEQ ID NO: 3547990 - RNA, 20 nt, Human
uuuaaugcauuaaaccuguc

SEQ ID NO: 3547991 - RNA, 17 nt, Human
uuuaaugcuucauucaa

SEQ ID NO: 3547992 - RNA, 21 nt, Human
uuuaauggacacuuuucaccu

SEQ ID NO: 3547993 - RNA, 22 nt, Human
uuuaauggacuuauuucuucaa

SEQ ID NO: 3547994 - RNA, 20 nt, Human
uuuacuucuaagucauucau

SEQ ID NO: 3547995 - RNA, 19 nt, Human
uuuacuucuuauacauuug

SEQ ID NO: 3547996 - RNA, 18 nt, Human
uuuacuugaauaguauug

SEQ ID NO: 3547997 - RNA, 18 nt, Human
uuuacuugcauugaauau

SEQ ID NO: 3547998 - RNA, 21 nt, Human
uuuacuugcauugaauauauu

SEQ ID NO: 3547999 - RNA, 15 nt, Human
uuuacuuguuucaga

SEQ ID NO: 3548000 - RNA, 17 nt, Human
uuuacuuguuucagagu

SEQ ID NO: 3548001 - RNA, 16 nt, Human
uuuacuuuaaacuugu

SEQ ID NO: 3548002 - RNA, 18 nt, Human
uuuacuuuagaagccugc

SEQ ID NO: 3548003 - RNA, 16 nt, Human
uuuacuuucccuugcu

SEQ ID NO: 3548004 - RNA, 17 nt, Human
uuuacuuucccuugcuu

SEQ ID NO: 3548005 - RNA, 14 nt, Human
uuuacuuuucuucu

SEQ ID NO: 3548006 - RNA, 23 nt, Human
uuuacuuuuuggaaaagaauaaa

SEQ ID NO: 3548007 - RNA, 23 nt, Human
uuuacuuuuuuuaguaaguuaau

SEQ ID NO: 3548008 - RNA, 22 nt, Human
uuuagaaaaagaacaugcaguu

SEQ ID NO: 3548009 - RNA, 13 nt, Human
uuuagaaaacuuu

SEQ ID NO: 3548010 - RNA, 16 nt, Human
uuuagaaaacuuuaaa

SEQ ID NO: 3548011 - RNA, 11 nt, Human
uuuagaaaaua

SEQ ID NO: 3548012 - RNA, 22 nt, Human
uuuagaaacagugcaacacugg

SEQ ID NO: 3548013 - RNA, 20 nt, Human
uuuagaaacuuaucuuacaa

SEQ ID NO: 3548014 - RNA, 21 nt, Human
uuuagaaagauaauucacugu

SEQ ID NO: 3548015 - RNA, 14 nt, Human
uuuagaaagcauuu

SEQ ID NO: 3548016 - RNA, 16 nt, Human
uuuagaaagcauuuga

SEQ ID NO: 3548017 - RNA, 18 nt, Human
uuuagaaagcauuugaau

SEQ ID NO: 3548018 - RNA, 19 nt, Human
uuuagaaagcauuugaaug

SEQ ID NO: 3548019 - RNA, 20 nt, Human
uuuagaaauacugcaagaaa

SEQ ID NO: 3548020 - RNA, 19 nt, Human
uuuagaacaauuuucuugu

SEQ ID NO: 3548021 - RNA, 15 nt, Human
uuuagaacagaaaac

SEQ ID NO: 3548022 - RNA, 17 nt, Human
uuuagaacagaaaacaa

SEQ ID NO: 3548023 - RNA, 15 nt, Human
uuuagaagacucuac

SEQ ID NO: 3548024 - RNA, 19 nt, Human
uuuagaagugcauuucuga

SEQ ID NO: 3548025 - RNA, 14 nt, Human
uuuagaagugucau

SEQ ID NO: 3548026 - RNA, 18 nt, Human
uuuagacaaauacucaug

SEQ ID NO: 3548027 - RNA, 19 nt, Human
uuuagacaaauacucaugu

SEQ ID NO: 3548028 - RNA, 20 nt, Human
uuuagacaaauacucaugug

SEQ ID NO: 3548029 - RNA, 14 nt, Human
uuuagacaccuuca

SEQ ID NO: 3548030 - RNA, 14 nt, Human
uuuagacacuggcu

SEQ ID NO: 3548031 - RNA, 11 nt, Human
uuuagacagua

SEQ ID NO: 3548032 - RNA, 14 nt, Human
uuuagaccaaggaa

SEQ ID NO: 3548033 - RNA, 15 nt, Human
uuuagacuucaagca

SEQ ID NO: 3548034 - RNA, 23 nt, Human
uuuagacuugaaaagagacaggc

SEQ ID NO: 3548035 - RNA, 15 nt, Human
uuuagacuuuaacau

SEQ ID NO: 3548036 - RNA, 15 nt, Human
uuuagagaacugaaa

SEQ ID NO: 3548037 - RNA, 18 nt, Human
uuuagagaacuguggccg

SEQ ID NO: 3548038 - RNA, 16 nt, Human
uuuagagcauugccau

SEQ ID NO: 3548039 - RNA, 13 nt, Human
uuuagaugcugau

SEQ ID NO: 3548040 - RNA, 12 nt, Human
uuuagauuucaa

SEQ ID NO: 3548041 - RNA, 20 nt, Human
uuuagauuuuaaucaaauuu

SEQ ID NO: 3548042 - RNA, 23 nt, Human
uuuagcaaagcggguuauaauga

SEQ ID NO: 3548043 - RNA, 22 nt, Human
uuuagcagcagccuuuaaugca

SEQ ID NO: 3548044 - RNA, 15 nt, Human
uuuagcaguucugca

SEQ ID NO: 3548045 - RNA, 14 nt, Human
uuuagcauaaaauu

SEQ ID NO: 3548046 - RNA, 15 nt, Human
uuuagccaccaucuu

SEQ ID NO: 3548047 - RNA, 20 nt, Human
uuuagcuaggauuugaacac

SEQ ID NO: 3548048 - RNA, 20 nt, Human
uuuagcucaaacguggcuuu

SEQ ID NO: 3548049 - RNA, 13 nt, Human
uuuagcucugaga

SEQ ID NO: 3548050 - RNA, 14 nt, Human
uuuagcucugagaa

SEQ ID NO: 3548051 - RNA, 18 nt, Human
uuuaggaagauaaaaguu

SEQ ID NO: 3548052 - RNA, 18 nt, Human
uuuaggaagcaagcuuaa

SEQ ID NO: 3548053 - RNA, 17 nt, Human
uuuaggacaugaaaaua

SEQ ID NO: 3548054 - RNA, 13 nt, Human
uuuaggagauuuu

SEQ ID NO: 3548055 - RNA, 17 nt, Human
uuuaggagauuuuaggu

SEQ ID NO: 3548056 - RNA, 20 nt, Human
uuuaggagggaguuaucuaa

SEQ ID NO: 3548057 - RNA, 19 nt, Human
uuuaggcagggauuugagg

SEQ ID NO: 3548058 - RNA, 21 nt, Human
uuuaggcauaugcuucuuuaa

SEQ ID NO: 3548059 - RNA, 19 nt, Human
uuuaggccaaucagaagcu

SEQ ID NO: 3548060 - RNA, 17 nt, Human
uuuagggaacaauuugg

SEQ ID NO: 3548061 - RNA, 19 nt, Human
uuuagggagagucauauuu

SEQ ID NO: 3548062 - RNA, 18 nt, Human
uuuagggaguauucuaau

SEQ ID NO: 3548063 - RNA, 14 nt, Human
uuuagggccaggca

SEQ ID NO: 3548064 - RNA, 17 nt, Human
uuuagggguagcauuug

SEQ ID NO: 3548065 - RNA, 14 nt, Human
uuuaggguacuaaa

SEQ ID NO: 3548066 - RNA, 15 nt, Human
uuuagguaagaaguu

SEQ ID NO: 3548067 - RNA, 17 nt, Human
uuuaggucuuuguaaga

SEQ ID NO: 3548068 - RNA, 14 nt, Human
uuuaggugaaaaua

SEQ ID NO: 3548069 - RNA, 15 nt, Human
uuuagguucuaaagu

SEQ ID NO: 3548070 - RNA, 12 nt, Human
uuuaguaaaugu

SEQ ID NO: 3548071 - RNA, 16 nt, Human
uuuaguaaggcugugu

SEQ ID NO: 3548072 - RNA, 15 nt, Human
uuuaguaauuucuuu

SEQ ID NO: 3548073 - RNA, 19 nt, Human
uuuaguacccaccugagcu

SEQ ID NO: 3548074 - RNA, 21 nt, Human
uuuaguaccugaaaaguaacu

SEQ ID NO: 3548075 - RNA, 21 nt, Human
uuuaguagauauuaccaguuu

SEQ ID NO: 3548076 - RNA, 21 nt, Human
uuuaguagcagugauugucuu

SEQ ID NO: 3548077 - RNA, 20 nt, Human
uuuaguaugacgcugauaca

SEQ ID NO: 3548078 - RNA, 12 nt, Human
uuuagucacuuu

SEQ ID NO: 3548079 - RNA, 15 nt, Human
uuuagucaugugacc

SEQ ID NO: 3548080 - RNA, 13 nt, Human
uuuagucucuuua

SEQ ID NO: 3548081 - RNA, 17 nt, Human
uuuagucuuuagcuauu

SEQ ID NO: 3548082 - RNA, 23 nt, Human
uuuagugacuaaaccauugugca

SEQ ID NO: 3548083 - RNA, 19 nt, Human
uuuagugaucacagcagcu

SEQ ID NO: 3548084 - RNA, 20 nt, Human
uuuaguggccaucauuucug

SEQ ID NO: 3548085 - RNA, 18 nt, Human
uuuaguguuuuuuuauuu

SEQ ID NO: 3548086 - RNA, 21 nt, Human
uuuaguguuuuuuuauuucua

SEQ ID NO: 3548087 - RNA, 16 nt, Human
uuuaguuacuuuagau

SEQ ID NO: 3548088 - RNA, 14 nt, Human
uuuaguuauaguuu

SEQ ID NO: 3548089 - RNA, 23 nt, Human
uuuaguugaauuuuuuuuaacau

SEQ ID NO: 3548090 - RNA, 17 nt, Human
uuuaguugcaacuuugu

SEQ ID NO: 3548091 - RNA, 12 nt, Human
uucuccuuugua

SEQ ID NO: 3548092 - RNA, 13 nt, Human
uucuccuuuuccu

SEQ ID NO: 3548093 - RNA, 18 nt, Human
uucuccuuuuccucucuc

SEQ ID NO: 3548094 - RNA, 23 nt, Human
uucucgcaaaaacguaucuccua

SEQ ID NO: 3548095 - RNA, 21 nt, Human
uucucuaacuucaaggcccau

SEQ ID NO: 3548096 - RNA, 18 nt, Human
uucucuaaguuccacuga

SEQ ID NO: 3548097 - RNA, 15 nt, Human
uucucuaauaauaaa

SEQ ID NO: 3548098 - RNA, 17 nt, Human
uucucuaauaauaaaua

SEQ ID NO: 3548099 - RNA, 19 nt, Human
uucucuaauaauaaauagu

SEQ ID NO: 3548100 - RNA, 21 nt, Human
uucucuaauauggcaaccauu

SEQ ID NO: 3548101 - RNA, 20 nt, Human
uucucuacagacuucuccag

SEQ ID NO: 3548102 - RNA, 19 nt, Human
uucucuacuuugaggaaac

SEQ ID NO: 3548103 - RNA, 20 nt, Human
uucucuagcucucuaggccu

SEQ ID NO: 3548104 - RNA, 22 nt, Human
uucucuagcucucuaggccucu

SEQ ID NO: 3548105 - RNA, 15 nt, Human
uucucuaguuugauu

SEQ ID NO: 3548106 - RNA, 18 nt, Human
uucucuauaaaaaauaug

SEQ ID NO: 3548107 - RNA, 23 nt, Human
uucucucagaccgucuuccucca

SEQ ID NO: 3548108 - RNA, 17 nt, Human
uucucucaucucuuagc

SEQ ID NO: 3548109 - RNA, 20 nt, Human
uucucucaucucuuagcucc

SEQ ID NO: 3548110 - RNA, 16 nt, Human
uucucuccaauuuaac

SEQ ID NO: 3548111 - RNA, 21 nt, Human
uucucucccaggggcuggcuu

SEQ ID NO: 3548112 - RNA, 22 nt, Human
uucucuccccaacccccauucu

SEQ ID NO: 3548113 - RNA, 20 nt, Human
uucucuccugauuauuuauc

SEQ ID NO: 3548114 - RNA, 19 nt, Human
uucucuccuguaccucuug

SEQ ID NO: 3548115 - RNA, 20 nt, Human
uucucucggaguaucuggga

SEQ ID NO: 3548116 - RNA, 17 nt, Human
uucucucggcuccccau

SEQ ID NO: 3548117 - RNA, 22 nt, Human
uucucucuaugguaaagauauu

SEQ ID NO: 3548118 - RNA, 21 nt, Human
uucucucucucucaaaauuau

SEQ ID NO: 3548119 - RNA, 24 nt, Human
uucucugaacacaggcagcuuucu

SEQ ID NO: 3548120 - RNA, 17 nt, Human
uucucugagcugugcag

SEQ ID NO: 3548121 - RNA, 22 nt, Human
uucucugaguaucuccucgcaa

SEQ ID NO: 3548122 - RNA, 15 nt, Human
uucucugauacagaa

SEQ ID NO: 3548123 - RNA, 12 nt, Human
uucucugccagu

SEQ ID NO: 3548124 - RNA, 20 nt, Human
uucucugcccagcuuuucau

SEQ ID NO: 3548125 - RNA, 16 nt, Human
uucucugcccauuccc

SEQ ID NO: 3548126 - RNA, 12 nt, Human
uucucugcccuc

SEQ ID NO: 3548127 - RNA, 17 nt, Human
uucucugcccuccaaga

SEQ ID NO: 3548128 - RNA, 22 nt, Human
uucucugccgcuaccucccucc

SEQ ID NO: 3548129 - RNA, 11 nt, Human
uucucugcucc

SEQ ID NO: 3548130 - RNA, 15 nt, Human
uucucugcuucagcu

SEQ ID NO: 3548131 - RNA, 18 nt, Human
uucucuguacauauuagc

SEQ ID NO: 3548132 - RNA, 17 nt, Human
uucucuguagggaacuc

SEQ ID NO: 3548133 - RNA, 11 nt, Human
uucucugucca

SEQ ID NO: 3548134 - RNA, 12 nt, Human
uucucugucuca

SEQ ID NO: 3548135 - RNA, 20 nt, Human
uucucugugaacgauuuaga

SEQ ID NO: 3548136 - RNA, 18 nt, Human
uucucugugucuaagauu

SEQ ID NO: 3548137 - RNA, 23 nt, Human
uucucugugucuaagauucuaga

SEQ ID NO: 3548138 - RNA, 21 nt, Human
uuucccccuuuucugcauuuu

SEQ ID NO: 3548139 - RNA, 20 nt, Human
uuuccccugcccccagaccu

SEQ ID NO: 3548140 - RNA, 14 nt, Human
uuuccccuguccug

SEQ ID NO: 3548141 - RNA, 13 nt, Human
uuuccccuuuccu

SEQ ID NO: 3548142 - RNA, 21 nt, Human
uuucccgagcaaagucuaaag

SEQ ID NO: 3548143 - RNA, 16 nt, Human
uuucccguggccccag

SEQ ID NO: 3548144 - RNA, 23 nt, Human
uuucccuacugaagcccuuguga

SEQ ID NO: 3548145 - RNA, 16 nt, Human
uugaaaagccauguuu

SEQ ID NO: 3548146 - RNA, 23 nt, Human
uugaaaagccauguuuaagauuu

SEQ ID NO: 3548147 - RNA, 19 nt, Human
uugaaaagcuucuuaauua

SEQ ID NO: 3548148 - RNA, 21 nt, Human
uugaaaagcuucuuaauuaau

SEQ ID NO: 3548149 - RNA, 22 nt, Human
uugaaaagcuucuuaauuaauu

SEQ ID NO: 3548150 - RNA, 17 nt, Human
uugaaaaguaauauuua

SEQ ID NO: 3548151 - RNA, 23 nt, Human
uugaaaauaguuuauuuuaaaac

SEQ ID NO: 3548152 - RNA, 23 nt, Human
uugaaaauauuaucuuuguaauu

SEQ ID NO: 3548153 - RNA, 19 nt, Human
uugaaaauuauuuuaaaca

SEQ ID NO: 3548154 - RNA, 22 nt, Human
uugaaaauuauuuuaaacaaaa

SEQ ID NO: 3548155 - RNA, 23 nt, Human
uugaaacaauacucauaauguga

SEQ ID NO: 3548156 - RNA, 13 nt, Human
uugaaacagaacc

SEQ ID NO: 3548157 - RNA, 14 nt, Human
uugaaacauugcuu

SEQ ID NO: 3548158 - RNA, 19 nt, Human
uugaaacauugcuuuuaaa

SEQ ID NO: 3548159 - RNA, 19 nt, Human
uugaaacggaugauuucua

SEQ ID NO: 3548160 - RNA, 16 nt, Human
uugaaacuuugagauc

SEQ ID NO: 3548161 - RNA, 20 nt, Human
uugaaacuuugggaaaacau

SEQ ID NO: 3548162 - RNA, 22 nt, Human
uugaaacuuugggaaaacaugu

SEQ ID NO: 3548163 - RNA, 15 nt, Human
uugaaagaaaauaug

SEQ ID NO: 3548164 - RNA, 17 nt, Human
uugaaagagaaccaguu

SEQ ID NO: 3548165 - RNA, 20 nt, Human
uugaaagagaaccaguuuca

SEQ ID NO: 3548166 - RNA, 14 nt, Human
uugaaagaguccua

SEQ ID NO: 3548167 - RNA, 22 nt, Human
uugaaagauucagguauguugc

SEQ ID NO: 3548168 - RNA, 16 nt, Human
uugaaagcauccaugu

SEQ ID NO: 3548169 - RNA, 22 nt, Human
uugaaagguuuuuuuucaguug

SEQ ID NO: 3548170 - RNA, 19 nt, Human
uugaaagugggcaaaagcu

SEQ ID NO: 3548171 - RNA, 16 nt, Human
uugaaaguuuacagga

SEQ ID NO: 3548172 - RNA, 14 nt, Human
uugaaauaaagcua

SEQ ID NO: 3548173 - RNA, 16 nt, Human
uugaaauaagaauuca

SEQ ID NO: 3548174 - RNA, 14 nt, Human
uugaaauaccucau

SEQ ID NO: 3548175 - RNA, 17 nt, Human
uugaaauaccucauguu

SEQ ID NO: 3548176 - RNA, 18 nt, Human
uugaaauaccucauguuu

SEQ ID NO: 3548177 - RNA, 22 nt, Human
uugaaauaccucauguuuauga

SEQ ID NO: 3548178 - RNA, 13 nt, Human
uugaaaugaaauu

SEQ ID NO: 3548179 - RNA, 19 nt, Human
uugaaaugaaauuuaaaca

SEQ ID NO: 3548180 - RNA, 20 nt, Human
uugaaaugaaauuuaaacau

SEQ ID NO: 3548181 - RNA, 18 nt, Human
uugaaaugaggucuguuu

SEQ ID NO: 3548182 - RNA, 21 nt, Human
uugaaaugaggucuguuuaaa

SEQ ID NO: 3548183 - RNA, 13 nt, Human
uugaaaugcugaa

SEQ ID NO: 3548184 - RNA, 17 nt, Human
uugaaaugcugaaaauu

SEQ ID NO: 3548185 - RNA, 17 nt, Human
uugaaauguaaggcugu

SEQ ID NO: 3548186 - RNA, 14 nt, Human
uugaaauuauaucu

SEQ ID NO: 3548187 - RNA, 16 nt, Human
uugaaauuauaucugu

SEQ ID NO: 3548188 - RNA, 14 nt, Human
uugaaauucuauuu

SEQ ID NO: 3548189 - RNA, 14 nt, Human
uugaaauucugaau

SEQ ID NO: 3548190 - RNA, 20 nt, Human
uugaaauucugaauuugcaa

SEQ ID NO: 3548191 - RNA, 21 nt, Human
uugaaauucugaauuugcaaa

SEQ ID NO: 3548192 - RNA, 17 nt, Human
uugaaauuguaauuaua

SEQ ID NO: 3548193 - RNA, 13 nt, Human
uugaaauugugaa

SEQ ID NO: 3548194 - RNA, 19 nt, Human
uugaaauuguuuaaguguu

SEQ ID NO: 3548195 - RNA, 18 nt, Human
uugaaauuuugcaaauau

SEQ ID NO: 3548196 - RNA, 22 nt, Human
uugaaauuuugcaaauauaaac

SEQ ID NO: 3548197 - RNA, 12 nt, Human
uugaacaaaaua

SEQ ID NO: 3548198 - RNA, 14 nt, Human
uugaacaaaauaaa

SEQ ID NO: 3548199 - RNA, 17 nt, Human
uugaacaaaaucuguug

SEQ ID NO: 3548200 - RNA, 20 nt, Human
uugaacaaguuguuucauug

SEQ ID NO: 3548201 - RNA, 20 nt, Human
uugaacacaguauuuuccca

SEQ ID NO: 3548202 - RNA, 19 nt, Human
uugaacacucaugcugaaa

SEQ ID NO: 3548203 - RNA, 11 nt, Human
uugaacacugg

SEQ ID NO: 3548204 - RNA, 20 nt, Human
uugaacacuuggugcuggga

SEQ ID NO: 3548205 - RNA, 23 nt, Human
uugaacauuuggguuacuauuuc

SEQ ID NO: 3548206 - RNA, 12 nt, Human
uugaaccaauaa

SEQ ID NO: 3548207 - RNA, 16 nt, Human
uugaaccacuucccuc

SEQ ID NO: 3548208 - RNA, 14 nt, Human
uugaaccauaaaau

SEQ ID NO: 3548209 - RNA, 21 nt, Human
uugaaccauaaaauguccagu

SEQ ID NO: 3548210 - RNA, 15 nt, Human
uugaaccuauuucuc

SEQ ID NO: 3548211 - RNA, 19 nt, Human
uugaaccuauuucucuuuc

SEQ ID NO: 3548212 - RNA, 18 nt, Human
uugaaccugaugaaaaua

SEQ ID NO: 3548213 - RNA, 13 nt, Human
uugaaccugggag

SEQ ID NO: 3548214 - RNA, 18 nt, Human
uugaacguuuucuaauug

SEQ ID NO: 3548215 - RNA, 19 nt, Human
uugaacguuuucuaauugc

SEQ ID NO: 3548216 - RNA, 13 nt, Human
uugaacuccaaga

SEQ ID NO: 3548217 - RNA, 20 nt, Human
uugaacucuucucauuacuu

SEQ ID NO: 3548218 - RNA, 15 nt, Human
uugaacugauaguua

SEQ ID NO: 3548219 - RNA, 19 nt, Human
uugaacugauaguuacugu

SEQ ID NO: 3548220 - RNA, 20 nt, Human
uugaacugauaguuacuguu

SEQ ID NO: 3548221 - RNA, 22 nt, Human
uugaacugauaguuacuguugu

SEQ ID NO: 3548222 - RNA, 23 nt, Human
uugaacuggcaauugucuauuua

SEQ ID NO: 3548223 - RNA, 14 nt, Human
uugaacuguuagaa

SEQ ID NO: 3548224 - RNA, 18 nt, Human
uugaacuguuagaaugua

SEQ ID NO: 3548225 - RNA, 18 nt, Human
uugaacuuaaauaaaugu

SEQ ID NO: 3548226 - RNA, 19 nt, Human
uugaagaacugcaggcccu

SEQ ID NO: 3548227 - RNA, 14 nt, Human
uugaagaaggugga

SEQ ID NO: 3548228 - RNA, 13 nt, Human
uugaagaaugaac

SEQ ID NO: 3548229 - RNA, 15 nt, Human
uugaagaaugaacaa

SEQ ID NO: 3548230 - RNA, 19 nt, Human
uugaagaauguuaagacuu

SEQ ID NO: 3548231 - RNA, 19 nt, Human
uugaagacaauuugauaca

SEQ ID NO: 3548232 - RNA, 23 nt, Human
uugaagacaauuugauacauaau

SEQ ID NO: 3548233 - RNA, 17 nt, Human
uugaagacagagcuaca

SEQ ID NO: 3548234 - RNA, 20 nt, Human
uugaagacccgcuacaaaac

SEQ ID NO: 3548235 - RNA, 16 nt, Human
uugaagacuucaaaau

SEQ ID NO: 3548236 - RNA, 14 nt, Human
uugaagagacagag

SEQ ID NO: 3548237 - RNA, 20 nt, Human
uugaagagacagagacaagu

SEQ ID NO: 3548238 - RNA, 18 nt, Human
uugaagagagauauaucu

SEQ ID NO: 3548239 - RNA, 19 nt, Human
uugaagaggggagcucagu

SEQ ID NO: 3548240 - RNA, 14 nt, Human
uugaagagugaaau

SEQ ID NO: 3548241 - RNA, 20 nt, Human
uugaagaucguuaguaucua

SEQ ID NO: 3548242 - RNA, 16 nt, Human
uugaagcaaacaguug

SEQ ID NO: 3548243 - RNA, 14 nt, Human
uugaagcagagugg

SEQ ID NO: 3548244 - RNA, 11 nt, Human
uugaagcauag

SEQ ID NO: 3548245 - RNA, 23 nt, Human
uugaagcauuuuauaaaucgcuu

SEQ ID NO: 3548246 - RNA, 11 nt, Human
uugaagccaaa

SEQ ID NO: 3548247 - RNA, 14 nt, Human
uugaagccaaagaa

SEQ ID NO: 3548248 - RNA, 15 nt, Human
uugaagccaaagaaa

SEQ ID NO: 3548249 - RNA, 23 nt, Human
uugaagccaagucagcuuugccu

SEQ ID NO: 3548250 - RNA, 17 nt, Human
uugaagccacugaagcu

SEQ ID NO: 3548251 - RNA, 18 nt, Human
uugaagccgacucuggcc

SEQ ID NO: 3548252 - RNA, 19 nt, Human
uugaagccugcuccuuccc

SEQ ID NO: 3548253 - RNA, 14 nt, Human
uugaagcuaagauu

SEQ ID NO: 3548254 - RNA, 13 nt, Human
uugaagcucuggu

SEQ ID NO: 3548255 - RNA, 18 nt, Human
uugaagcugaaaauauaa

SEQ ID NO: 3548256 - RNA, 17 nt, Human
uugaaggaaaaugauac

SEQ ID NO: 3548257 - RNA, 12 nt, Human
uugaaggcuuaa

SEQ ID NO: 3548258 - RNA, 15 nt, Human
uugaagggaggggcu

SEQ ID NO: 3548259 - RNA, 17 nt, Human
uugaagggccagagcca

SEQ ID NO: 3548260 - RNA, 18 nt, Human
uugaaggguaaagaaguu

SEQ ID NO: 3548261 - RNA, 16 nt, Human
uugaagguagaauguu

SEQ ID NO: 3548262 - RNA, 19 nt, Human
uugaaggucuugauuuguu

SEQ ID NO: 3548263 - RNA, 14 nt, Human
uugaaguaaaaugu

SEQ ID NO: 3548264 - RNA, 15 nt, Human
uugaaguaaacugca

SEQ ID NO: 3548265 - RNA, 17 nt, Human
uugaaguaaugaauuuu

SEQ ID NO: 3548266 - RNA, 16 nt, Human
uugaaguagcucuuuu

SEQ ID NO: 3548267 - RNA, 15 nt, Human
uugaagucaccuugu

SEQ ID NO: 3548268 - RNA, 13 nt, Human
uugaagucuugua

SEQ ID NO: 3548269 - RNA, 14 nt, Human
uugaagucuuguau

SEQ ID NO: 3548270 - RNA, 20 nt, Human
uugaagugagaaaaugaaca

SEQ ID NO: 3548271 - RNA, 16 nt, Human
uugaaguguauaauau

SEQ ID NO: 3548272 - RNA, 19 nt, Human
uugaaguuguuacuaacua

SEQ ID NO: 3548273 - RNA, 13 nt, Human
uugaaguuuacau

SEQ ID NO: 3548274 - RNA, 19 nt, Human
uugaaguuucaaguuuuaa

SEQ ID NO: 3548275 - RNA, 16 nt, Human
uugaauaaaaaugcac

SEQ ID NO: 3548276 - RNA, 12 nt, Human
uugaauaaagaa

SEQ ID NO: 3548277 - RNA, 18 nt, Human
uugaauaaagaauacuug

SEQ ID NO: 3548278 - RNA, 22 nt, Human
uugaauaaagaauacuugaacu

SEQ ID NO: 3548279 - RNA, 20 nt, Human
uugaauaauaagcaggaugu

SEQ ID NO: 3548280 - RNA, 18 nt, Human
uugaauacucugcccucu

SEQ ID NO: 3548281 - RNA, 15 nt, Human
uugaauacuuacauu

SEQ ID NO: 3548282 - RNA, 16 nt, Human
uugaauacuugaacca

SEQ ID NO: 3548283 - RNA, 13 nt, Human
uugacucuggguc

SEQ ID NO: 3548284 - RNA, 18 nt, Human
uugacucuggguccuucc

SEQ ID NO: 3548285 - RNA, 21 nt, Human
uugacucuggguccuuccuga

SEQ ID NO: 3548286 - RNA, 15 nt, Human
uugacucuuuugcca

SEQ ID NO: 3548287 - RNA, 23 nt, Human
uugacuggguuucucuguauagu

SEQ ID NO: 3548288 - RNA, 16 nt, Human
uugacuugcaugaaga

SEQ ID NO: 3548289 - RNA, 21 nt, Human
uugacuuucagguacuaaaua

SEQ ID NO: 3548290 - RNA, 13 nt, Human
uugacuuucccca

SEQ ID NO: 3548291 - RNA, 14 nt, Human
uugacuuugcuccu

SEQ ID NO: 3548292 - RNA, 16 nt, Human
uugacuuuuuagaugu

SEQ ID NO: 3548293 - RNA, 21 nt, Human
uugagaaaaaaagaauaguug

SEQ ID NO: 3548294 - RNA, 17 nt, Human
uugagaaaauaaagcua

SEQ ID NO: 3548295 - RNA, 21 nt, Human
uugagaaauauggacacuuaa

SEQ ID NO: 3548296 - RNA, 22 nt, Human
uugagaaaugaauaauuuccca

SEQ ID NO: 3548297 - RNA, 16 nt, Human
uugagaaaugcauauu

SEQ ID NO: 3548298 - RNA, 15 nt, Human
uugagaacguaaaga

SEQ ID NO: 3548299 - RNA, 19 nt, Human
uugagaagccuucagcucc

SEQ ID NO: 3548300 - RNA, 21 nt, Human
uugagaagccuucagcuccag

SEQ ID NO: 3548301 - RNA, 16 nt, Human
uugagaaguuuuguac

SEQ ID NO: 3548302 - RNA, 16 nt, Human
uugagaauauugaagu

SEQ ID NO: 3548303 - RNA, 17 nt, Human
uugagaauggaaaccac

SEQ ID NO: 3548304 - RNA, 18 nt, Human
uugagaaugguuacaaag

SEQ ID NO: 3548305 - RNA, 16 nt, Human
uugagacaaaaauuau

SEQ ID NO: 3548306 - RNA, 10 nt, Human
uugagacaga

SEQ ID NO: 3548307 - RNA, 12 nt, Human
uugagacagagu

SEQ ID NO: 3548308 - RNA, 20 nt, Human
uugagacagugcacaugaac

SEQ ID NO: 3548309 - RNA, 17 nt, Human
uugagacaguuucuuag

SEQ ID NO: 3548310 - RNA, 19 nt, Human
uugagacaguuucuuagcu

SEQ ID NO: 3548311 - RNA, 22 nt, Human
uuucuauguacuaguacugugu

SEQ ID NO: 3548312 - RNA, 23 nt, Human
uuucuauuaaaagacucauccgu

SEQ ID NO: 3548313 - RNA, 14 nt, Human
uuucuauuccaaag

SEQ ID NO: 3548314 - RNA, 17 nt, Human
uuucuauugaaaaauca

SEQ ID NO: 3548315 - RNA, 14 nt, Human
uuucuauuguuacu

SEQ ID NO: 3548316 - RNA, 17 nt, Human
uuucuauuucuccucca

SEQ ID NO: 3548317 - RNA, 14 nt, Human
uuucuauuugacuu

SEQ ID NO: 3548318 - RNA, 15 nt, Human
uuucuauuuuuaucu

SEQ ID NO: 3548319 - RNA, 15 nt, Human
uuucucaaagaaauu

SEQ ID NO: 3548320 - RNA, 21 nt, Human
uuucucaacuggguccagaag

SEQ ID NO: 3548321 - RNA, 22 nt, Human
uuucucacagaagaugaagcac

SEQ ID NO: 3548322 - RNA, 16 nt, Human
uuucucaguuuguaua

SEQ ID NO: 3548323 - RNA, 16 nt, Human
uuucucaguuuucaua

SEQ ID NO: 3548324 - RNA, 14 nt, Human
uuucucauucuugu

SEQ ID NO: 3548325 - RNA, 15 nt, Human
uuucuccaagagcua

SEQ ID NO: 3548326 - RNA, 17 nt, Human
uuucuccaauaucagug

SEQ ID NO: 3548327 - RNA, 23 nt, Human
uuucuccauauuagauuuaccca

SEQ ID NO: 3548328 - RNA, 20 nt, Human
uuucucccaggccaggcucc

SEQ ID NO: 3548329 - RNA, 17 nt, Human
uuucucccagucauuua

SEQ ID NO: 3548330 - RNA, 10 nt, Human
uuucuccccc

SEQ ID NO: 3548331 - RNA, 21 nt, Human
uuucucccccauguucugucc

SEQ ID NO: 3548332 - RNA, 15 nt, Human
uuucucccccugggc

SEQ ID NO: 3548333 - RNA, 13 nt, Human
uuucuccccugcc

SEQ ID NO: 3548334 - RNA, 14 nt, Human
uuucuccccugccc

SEQ ID NO: 3548335 - RNA, 17 nt, Human
uuucuccccugccccca

SEQ ID NO: 3548336 - RNA, 22 nt, Human
uuucuccccugcccccaggacu

SEQ ID NO: 3548337 - RNA, 24 nt, Human
uuucuccccugcccccaggacugg

SEQ ID NO: 3548338 - RNA, 13 nt, Human
uuucucccucugg

SEQ ID NO: 3548339 - RNA, 12 nt, Human
uuucucccugga

SEQ ID NO: 3548340 - RNA, 13 nt, Human
uuucuccuaucuu

SEQ ID NO: 3548341 - RNA, 23 nt, Human
uuucuccuugaauaucuuucgau

SEQ ID NO: 3548342 - RNA, 16 nt, Human
uuucuccuuuguacuu

SEQ ID NO: 3548343 - RNA, 17 nt, Human
uuucucgauuuuaucuu

SEQ ID NO: 3548344 - RNA, 22 nt, Human
uuucucuaacuucaaggcccau

SEQ ID NO: 3548345 - RNA, 17 nt, Human
uuucucuaauaauaaau

SEQ ID NO: 3548346 - RNA, 22 nt, Human
uuucucuacagaugucccauuu

SEQ ID NO: 3548347 - RNA, 21 nt, Human
uuucucucagccuuacauuug

SEQ ID NO: 3548348 - RNA, 15 nt, Human
uuucucuccuguccu

SEQ ID NO: 3548349 - RNA, 18 nt, Human
uuucucucuacagugcca

SEQ ID NO: 3548350 - RNA, 12 nt, Human
uuucucucucua

SEQ ID NO: 3548351 - RNA, 14 nt, Human
uuucucucuucccu

SEQ ID NO: 3548352 - RNA, 20 nt, Human
uuucucucuuuauacagcug

SEQ ID NO: 3548353 - RNA, 15 nt, Human
uuucucugaaagugu

SEQ ID NO: 3548354 - RNA, 15 nt, Human
uuucucugaacacau

SEQ ID NO: 3548355 - RNA, 15 nt, Human
uuucucugauacaga

SEQ ID NO: 3548356 - RNA, 22 nt, Human
uuucucugcauuuaaaaaaauc

SEQ ID NO: 3548357 - RNA, 17 nt, Human
uuucucuguauaguacu

SEQ ID NO: 3548358 - RNA, 16 nt, Human
uuucucuguggcucca

SEQ ID NO: 3548359 - RNA, 16 nt, Human
uuucucuucuccccuu

SEQ ID NO: 3548360 - RNA, 20 nt, Human
uuucucuucuccccuuccau

SEQ ID NO: 3548361 - RNA, 15 nt, Human
uuucucuugagcugg

SEQ ID NO: 3548362 - RNA, 16 nt, Human
uuucucuugagcuggc

SEQ ID NO: 3548363 - RNA, 21 nt, Human
uuucucuugggcugagacugg

SEQ ID NO: 3548364 - RNA, 20 nt, Human
uuucucuuucccuggucccu

SEQ ID NO: 3548365 - RNA, 20 nt, Human
uuucucuuugaaacaugcuu

SEQ ID NO: 3548366 - RNA, 21 nt, Human
uuucucuuugauuauuugcau

SEQ ID NO: 3548367 - RNA, 23 nt, Human
uuucucuuuguggggcuuggcgu

SEQ ID NO: 3548368 - RNA, 22 nt, Human
uuucucuuuuccccuuuccugu

SEQ ID NO: 3548369 - RNA, 15 nt, Human
uuucucuuuucuaaa

SEQ ID NO: 3548370 - RNA, 13 nt, Human
uuucugaaaagau

SEQ ID NO: 3548371 - RNA, 14 nt, Human
uuucugaaauaaca

SEQ ID NO: 3548372 - RNA, 12 nt, Human
uuucugaaauuu

SEQ ID NO: 3548373 - RNA, 19 nt, Human
uuucugaaauuuccuggga

SEQ ID NO: 3548374 - RNA, 13 nt, Human
uuucugaacagcu

SEQ ID NO: 3548375 - RNA, 15 nt, Human
uuucugaacagcugg

SEQ ID NO: 3548376 - RNA, 14 nt, Human
uuucugaaggcuuu

SEQ ID NO: 3548377 - RNA, 15 nt, Human
uuucugaaguggacu

SEQ ID NO: 3548378 - RNA, 15 nt, Human
uuucugaauagaaau

SEQ ID NO: 3548379 - RNA, 16 nt, Human
uuucugagcacacuuu

SEQ ID NO: 3548380 - RNA, 18 nt, Human
uuucugaguuuuaccaaa

SEQ ID NO: 3548381 - RNA, 14 nt, Human
uuucugauauagaa

SEQ ID NO: 3548382 - RNA, 17 nt, Human
uuucugaucaaggccuu

SEQ ID NO: 3548383 - RNA, 13 nt, Human
uuucugauccagu

SEQ ID NO: 3548384 - RNA, 15 nt, Human
uuucugauccaguuu

SEQ ID NO: 3548385 - RNA, 22 nt, Human
uuucugauccaguuuuguuugg

SEQ ID NO: 3548386 - RNA, 19 nt, Human
uuucugauuagcuuugugu

SEQ ID NO: 3548387 - RNA, 17 nt, Human
uuucugauuugcugcuc

SEQ ID NO: 3548388 - RNA, 14 nt, Human
uuucugcaaaauag

SEQ ID NO: 3548389 - RNA, 14 nt, Human
uuucugcaaacaaa

SEQ ID NO: 3548390 - RNA, 19 nt, Human
uuucugcagccacuauugu

SEQ ID NO: 3548391 - RNA, 19 nt, Human
uuucugcaguagucucugu

SEQ ID NO: 3548392 - RNA, 16 nt, Human
uuucugcaucuccacu

SEQ ID NO: 3548393 - RNA, 15 nt, Human
uuucugccuccuuua

SEQ ID NO: 3548394 - RNA, 14 nt, Human
uuucugccucucaa

SEQ ID NO: 3548395 - RNA, 14 nt, Human
uuucugccuggagu

SEQ ID NO: 3548396 - RNA, 18 nt, Human
uuucugcucagcuucucc

SEQ ID NO: 3548397 - RNA, 21 nt, Human
uuucugcugaauuuucacaug

SEQ ID NO: 3548398 - RNA, 17 nt, Human
uuucugcuuuagacuug

SEQ ID NO: 3548399 - RNA, 20 nt, Human
uuucugcuuuagacuugaaa

SEQ ID NO: 3548400 - RNA, 22 nt, Human
uuucugcuuucuuugauucucc

SEQ ID NO: 3548401 - RNA, 21 nt, Human
uuucuggacugaagccugcag

SEQ ID NO: 3548402 - RNA, 21 nt, Human
uuucuggagguugauaacuuu

SEQ ID NO: 3548403 - RNA, 22 nt, Human
uuucuggagguugauaacuuug

SEQ ID NO: 3548404 - RNA, 23 nt, Human
uuucuggauuccccaucucaggc

SEQ ID NO: 3548405 - RNA, 21 nt, Human
uuucuggcagguccuccccuc

SEQ ID NO: 3548406 - RNA, 17 nt, Human
uuucuggccaaaagcag

SEQ ID NO: 3548407 - RNA, 11 nt, Human
uuucuggccag

SEQ ID NO: 3548408 - RNA, 15 nt, Human
uuucuggcuaugcau

SEQ ID NO: 3548409 - RNA, 18 nt, Human
uuucuggcuaugcauuug

SEQ ID NO: 3548410 - RNA, 19 nt, Human
uuucuggcuaugcauuuga

SEQ ID NO: 3548411 - RNA, 23 nt, Human
uuucugggcaccggggccucgga

SEQ ID NO: 3548412 - RNA, 22 nt, Human
uuucuggggccuaauaaaacug

SEQ ID NO: 3548413 - RNA, 19 nt, Human
uuucugggguuuuucuguu

SEQ ID NO: 3548414 - RNA, 15 nt, Human
uuucugggucuuuug

SEQ ID NO: 3548415 - RNA, 15 nt, Human
uuucugguucuaaca

SEQ ID NO: 3548416 - RNA, 21 nt, Human
uuucugguuguuaugugauca

SEQ ID NO: 3548417 - RNA, 19 nt, Human
uuucuguagucauuuacua

SEQ ID NO: 3548418 - RNA, 14 nt, Human
uuucuguauagaca

SEQ ID NO: 3548419 - RNA, 15 nt, Human
uuucugucaagaaga

SEQ ID NO: 3548420 - RNA, 15 nt, Human
uuucugucagaaugc

SEQ ID NO: 3548421 - RNA, 23 nt, Human
uuucugucagaugagaacaaagc

SEQ ID NO: 3548422 - RNA, 14 nt, Human
uuucuguccuguaa

SEQ ID NO: 3548423 - RNA, 14 nt, Human
uuucugucuucucu

SEQ ID NO: 3548424 - RNA, 18 nt, Human
uuucugugcccuacucau

SEQ ID NO: 3548425 - RNA, 10 nt, Human
uuucugugug

SEQ ID NO: 3548426 - RNA, 22 nt, Human
uuucugugugucaguuuucaua

SEQ ID NO: 3548427 - RNA, 13 nt, Human
uuucuguguguuc

SEQ ID NO: 3548428 - RNA, 14 nt, Human
uuuguaaagcuauu

SEQ ID NO: 3548429 - RNA, 15 nt, Human
uuuguaaaguuuccg

SEQ ID NO: 3548430 - RNA, 15 nt, Human
uuuguaaauaagaga

SEQ ID NO: 3548431 - RNA, 14 nt, Human
uuuguaaauaggau

SEQ ID NO: 3548432 - RNA, 20 nt, Human
uuuguaaauaggauuuuuag

SEQ ID NO: 3548433 - RNA, 16 nt, Human
uuuguaaauuaacuuu

SEQ ID NO: 3548434 - RNA, 17 nt, Human
uuuguaaauuaacuuuu

SEQ ID NO: 3548435 - RNA, 11 nt, Human
uuuguaaauuc

SEQ ID NO: 3548436 - RNA, 21 nt, Human
uuuguaacccagauuuugcug

SEQ ID NO: 3548437 - RNA, 16 nt, Human
uuuguaaccucagcuc

SEQ ID NO: 3548438 - RNA, 16 nt, Human
uuuguaagaguguaga

SEQ ID NO: 3548439 - RNA, 19 nt, Human
uuuguaagaguguagaagc

SEQ ID NO: 3548440 - RNA, 19 nt, Human
uuuguaagauauuugcagu

SEQ ID NO: 3548441 - RNA, 18 nt, Human
uuuguaagguuuuuguag

SEQ ID NO: 3548442 - RNA, 22 nt, Human
uuuguaagucaguguugagaug

SEQ ID NO: 3548443 - RNA, 22 nt, Human
uuuguaaguuagguaacuguau

SEQ ID NO: 3548444 - RNA, 20 nt, Human
uuuguaaguugaagcaaauc

SEQ ID NO: 3548445 - RNA, 18 nt, Human
uuuguaaucguuaugugu

SEQ ID NO: 3548446 - RNA, 21 nt, Human
uuuguaaucguuaugugugua

SEQ ID NO: 3548447 - RNA, 13 nt, Human
uuuguaaugaaaa

SEQ ID NO: 3548448 - RNA, 14 nt, Human
uuuguaaugaaaac

SEQ ID NO: 3548449 - RNA, 20 nt, Human
uuuguaaugaauuccuagaa

SEQ ID NO: 3548450 - RNA, 23 nt, Human
uuuguaaugucuugagcucuauu

SEQ ID NO: 3548451 - RNA, 14 nt, Human
uuuguaauuaaaag

SEQ ID NO: 3548452 - RNA, 22 nt, Human
uuuguaauuaaauuaugguauu

SEQ ID NO: 3548453 - RNA, 12 nt, Human
uuuguaauuauu

SEQ ID NO: 3548454 - RNA, 13 nt, Human
uuuguaauuuaag

SEQ ID NO: 3548455 - RNA, 16 nt, Human
uuuguaauuuuuuuau

SEQ ID NO: 3548456 - RNA, 21 nt, Human
uuuguacaauugaacuuaaau

SEQ ID NO: 3548457 - RNA, 18 nt, Human
uuuguacagacguaugcu

SEQ ID NO: 3548458 - RNA, 19 nt, Human
uuuguacagacguaugcuu

SEQ ID NO: 3548459 - RNA, 16 nt, Human
uuuguacauagauuua

SEQ ID NO: 3548460 - RNA, 19 nt, Human
uuuguacauaguuauuuau

SEQ ID NO: 3548461 - RNA, 17 nt, Human
uuuguaccagugaauuu

SEQ ID NO: 3548462 - RNA, 14 nt, Human
uuuguaccauuuca

SEQ ID NO: 3548463 - RNA, 18 nt, Human
uuuguaccccccaacccc

SEQ ID NO: 3548464 - RNA, 15 nt, Human
uuuguacugaauuuu

SEQ ID NO: 3548465 - RNA, 22 nt, Human
uuuguacugaauuuuuuuguaa

SEQ ID NO: 3548466 - RNA, 15 nt, Human
uuuguacuguaaaga

SEQ ID NO: 3548467 - RNA, 20 nt, Human
uuuguacuguaaagagaccu

SEQ ID NO: 3548468 - RNA, 14 nt, Human
uuuguacuguuuaa

SEQ ID NO: 3548469 - RNA, 18 nt, Human
uuuguacuuucuguuaaa

SEQ ID NO: 3548470 - RNA, 19 nt, Human
uuuguagcacugacagauu

SEQ ID NO: 3548471 - RNA, 20 nt, Human
uuuguagcuggggcuuugau

SEQ ID NO: 3548472 - RNA, 23 nt, Human
uuuguaggaaggucucauucuuc

SEQ ID NO: 3548473 - RNA, 20 nt, Human
uuuguaggggucaaagaaau

SEQ ID NO: 3548474 - RNA, 21 nt, Human
uuuguaggggucaaagaaaug

SEQ ID NO: 3548475 - RNA, 15 nt, Human
uuuguaguagcguuu

SEQ ID NO: 3548476 - RNA, 16 nt, Human
uuuguagugaaauaau

SEQ ID NO: 3548477 - RNA, 15 nt, Human
uuuguagugauuuuu

SEQ ID NO: 3548478 - RNA, 17 nt, Human
uuuguaguguuggagaa

SEQ ID NO: 3548479 - RNA, 21 nt, Human
uuuguaguguuggagaagaac

SEQ ID NO: 3548480 - RNA, 12 nt, Human
uuuguauaaaag

SEQ ID NO: 3548481 - RNA, 13 nt, Human
uuuguauaaaaua

SEQ ID NO: 3548482 - RNA, 16 nt, Human
uuuguauaaaauaauu

SEQ ID NO: 3548483 - RNA, 21 nt, Human
uuuguauaaaauaauuuuuau

SEQ ID NO: 3548484 - RNA, 16 nt, Human
uuuguauaguaaagug

SEQ ID NO: 3548485 - RNA, 17 nt, Human
uuuguauaguaaaguga

SEQ ID NO: 3548486 - RNA, 21 nt, Human
uuuguauaguuauguaaauaa

SEQ ID NO: 3548487 - RNA, 19 nt, Human
uuuguauauauacauaaca

SEQ ID NO: 3548488 - RNA, 20 nt, Human
uuuguauauugguuuuauga

SEQ ID NO: 3548489 - RNA, 12 nt, Human
uuuguauauugu

SEQ ID NO: 3548490 - RNA, 13 nt, Human
uuuguaucugaag

SEQ ID NO: 3548491 - RNA, 21 nt, Human
uuuguaucugcaggcagacac

SEQ ID NO: 3548492 - RNA, 17 nt, Human
uuuguaucuuaaauuug

SEQ ID NO: 3548493 - RNA, 14 nt, Human
uuuguaucuugaug

SEQ ID NO: 3548494 - RNA, 23 nt, Human
uuuguaugaaaacauggaacagu

SEQ ID NO: 3548495 - RNA, 20 nt, Human
uuuguaugaaauauauguga

SEQ ID NO: 3548496 - RNA, 12 nt, Human
uuuguaugauau

SEQ ID NO: 3548497 - RNA, 12 nt, Human
uuuguauguaaa

SEQ ID NO: 3548498 - RNA, 10 nt, Human
uuuguauguu

SEQ ID NO: 3548499 - RNA, 14 nt, Human
uuuguauuauugcu

SEQ ID NO: 3548500 - RNA, 13 nt, Human
uuuguauucaaaa

SEQ ID NO: 3548501 - RNA, 12 nt, Human
uuuguauucugu

SEQ ID NO: 3548502 - RNA, 13 nt, Human
uuuguauuguccu

SEQ ID NO: 3548503 - RNA, 15 nt, Human
uuuguauuguccuau

SEQ ID NO: 3548504 - RNA, 21 nt, Human
uuuguauuguuucaauugcau

SEQ ID NO: 3548505 - RNA, 10 nt, Human
uuuguauuuu

SEQ ID NO: 3548506 - RNA, 23 nt, Human
uuuguauuuuauuuuuuucucuc

SEQ ID NO: 3548507 - RNA, 15 nt, Human
uuuguauuuucauga

SEQ ID NO: 3548508 - RNA, 16 nt, Human
uuuguauuuuguguga

SEQ ID NO: 3548509 - RNA, 14 nt, Human
uuugucaaacugua

SEQ ID NO: 3548510 - RNA, 23 nt, Human
uuugucaaacuguagaaaugaug

SEQ ID NO: 3548511 - RNA, 11 nt, Human
uuugucaauga

SEQ ID NO: 3548512 - RNA, 17 nt, Human
uuugucaaugacaguuu

SEQ ID NO: 3548513 - RNA, 19 nt, Human
uuugucaauuuaugaauau

SEQ ID NO: 3548514 - RNA, 23 nt, Human
uuugucacaauccuaacacauua

SEQ ID NO: 3548515 - RNA, 21 nt, Human
uuugucagggaguguucccua

SEQ ID NO: 3548516 - RNA, 19 nt, Human
uuugucaucagauggaaau

SEQ ID NO: 3548517 - RNA, 15 nt, Human
uauuucccaugauuu

SEQ ID NO: 3548518 - RNA, 16 nt, Human
uauuucccaugauuuc

SEQ ID NO: 3548519 - RNA, 15 nt, Human
uauuucccccuuucu

SEQ ID NO: 3548520 - RNA, 22 nt, Human
uauuucccuacauuaaacauga

SEQ ID NO: 3548521 - RNA, 22 nt, Human
uauuucccugaaggaaccaaag

SEQ ID NO: 3548522 - RNA, 16 nt, Human
uauuucccuuuagcug

SEQ ID NO: 3548523 - RNA, 13 nt, Human
uauuuccucccuc

SEQ ID NO: 3548524 - RNA, 15 nt, Human
uauuuccuuaaacug

SEQ ID NO: 3548525 - RNA, 16 nt, Human
uauuucuacugucaaa

SEQ ID NO: 3548526 - RNA, 18 nt, Human
uauuucuacugucaaaug

SEQ ID NO: 3548527 - RNA, 20 nt, Human
uauuucuagacacuuuuucu

SEQ ID NO: 3548528 - RNA, 19 nt, Human
uauuucuaggaagaauuuu

SEQ ID NO: 3548529 - RNA, 22 nt, Human
uauuucuaggaagaauuuuaaa

SEQ ID NO: 3548530 - RNA, 17 nt, Human
uauuucuaguccaaaau

SEQ ID NO: 3548531 - RNA, 21 nt, Human
uauuucuaguccaaaauuaca

SEQ ID NO: 3548532 - RNA, 18 nt, Human
uauuucuauauuuucauu

SEQ ID NO: 3548533 - RNA, 15 nt, Human
uauuucuaugaaaua

SEQ ID NO: 3548534 - RNA, 21 nt, Human
uauuucuauuauuaauugcaa

SEQ ID NO: 3548535 - RNA, 21 nt, Human
uauuucucaacaaagcacagu

SEQ ID NO: 3548536 - RNA, 22 nt, Human
uauuucucagacuuuggaaaau

SEQ ID NO: 3548537 - RNA, 21 nt, Human
uauuucugaagguagcauucu

SEQ ID NO: 3548538 - RNA, 16 nt, Human
uauuucugagaagguc

SEQ ID NO: 3548539 - RNA, 23 nt, Human
uauuucugaggagccugcaacau

SEQ ID NO: 3548540 - RNA, 16 nt, Human
uauuucugcugaauuu

SEQ ID NO: 3548541 - RNA, 18 nt, Human
uauuucugggucuuuugc

SEQ ID NO: 3548542 - RNA, 17 nt, Human
uauuucuguuucucaua

SEQ ID NO: 3548543 - RNA, 20 nt, Human
uauuucuuaaacaaauguau

SEQ ID NO: 3548544 - RNA, 19 nt, Human
uauuucuuaaaucuaguaa

SEQ ID NO: 3548545 - RNA, 14 nt, Human
uauuucuucaaaua

SEQ ID NO: 3548546 - RNA, 20 nt, Human
uauuucuugugguuauaacu

SEQ ID NO: 3548547 - RNA, 23 nt, Human
uauuucuugugguuauaacuuaa

SEQ ID NO: 3548548 - RNA, 22 nt, Human
uauuucuuuauauuuauccacu

SEQ ID NO: 3548549 - RNA, 19 nt, Human
uauuugaaacugaauguuu

SEQ ID NO: 3548550 - RNA, 20 nt, Human
uauuugaacaaugaaguuga

SEQ ID NO: 3548551 - RNA, 16 nt, Human
uauuugaaccaauaaa

SEQ ID NO: 3548552 - RNA, 14 nt, Human
uauuugaacuuuuu

SEQ ID NO: 3548553 - RNA, 14 nt, Human
uauuugaaggccag

SEQ ID NO: 3548554 - RNA, 12 nt, Human
uauuugaaucuu

SEQ ID NO: 3548555 - RNA, 20 nt, Human
uauuugaaucuugucucaau

SEQ ID NO: 3548556 - RNA, 14 nt, Human
uauuugaauuaaaa

SEQ ID NO: 3548557 - RNA, 16 nt, Human
uauuugaauuaaaacu

SEQ ID NO: 3548558 - RNA, 21 nt, Human
uauuugaauuaaaacuucuua

SEQ ID NO: 3548559 - RNA, 19 nt, Human
uauuugaauuuuaaaucua

SEQ ID NO: 3548560 - RNA, 19 nt, Human
uauuugagaagcugcucaa

SEQ ID NO: 3548561 - RNA, 15 nt, Human
uauuugagaguucua

SEQ ID NO: 3548562 - RNA, 16 nt, Human
uauuugagaguucuaa

SEQ ID NO: 3548563 - RNA, 19 nt, Human
uauuugagaguucuaaauu

SEQ ID NO: 3548564 - RNA, 16 nt, Human
uauuugauuuauuaac

SEQ ID NO: 3548565 - RNA, 17 nt, Human
uauuugcaacauuuaca

SEQ ID NO: 3548566 - RNA, 16 nt, Human
uauuugcacuguagcc

SEQ ID NO: 3548567 - RNA, 17 nt, Human
uauuugcagucauggag

SEQ ID NO: 3548568 - RNA, 18 nt, Human
uauuugcagucauggaga

SEQ ID NO: 3548569 - RNA, 12 nt, Human
uauuugcauguu

SEQ ID NO: 3548570 - RNA, 18 nt, Human
uauuugcauguuauguuu

SEQ ID NO: 3548571 - RNA, 21 nt, Human
uauuugcuaaucaaagccagg

SEQ ID NO: 3548572 - RNA, 15 nt, Human
uauuugcuaauuaaa

SEQ ID NO: 3548573 - RNA, 17 nt, Human
uauuuugugcucauuua

SEQ ID NO: 3548574 - RNA, 13 nt, Human
uauuuuguguaaa

SEQ ID NO: 3548575 - RNA, 16 nt, Human
uauuuuguguaaaaaa

SEQ ID NO: 3548576 - RNA, 17 nt, Human
uauuuugugugaaauug

SEQ ID NO: 3548577 - RNA, 13 nt, Human
uauuuugugugac

SEQ ID NO: 3548578 - RNA, 22 nt, Human
uauuuugugugaccaacugugu

SEQ ID NO: 3548579 - RNA, 17 nt, Human
uauuuuguguuuaggaa

SEQ ID NO: 3548580 - RNA, 20 nt, Human
uauuuuguguuuaggaacua

SEQ ID NO: 3548581 - RNA, 21 nt, Human
uauuuuguuuugugcagagau

SEQ ID NO: 3548582 - RNA, 15 nt, Human
uauuuuuaaaaagaa

SEQ ID NO: 3548583 - RNA, 19 nt, Human
uauuuuuaaaaagaaaucu

SEQ ID NO: 3548584 - RNA, 15 nt, Human
uauuuuuaaagauag

SEQ ID NO: 3548585 - RNA, 17 nt, Human
uauuuuuaauuaaauaa

SEQ ID NO: 3548586 - RNA, 12 nt, Human
uauuuuuacugc

SEQ ID NO: 3548587 - RNA, 20 nt, Human
uauuuuuagaauaagaauuu

SEQ ID NO: 3548588 - RNA, 23 nt, Human
uauuuuuauauagcuugaaacau

SEQ ID NO: 3548589 - RNA, 20 nt, Human
uauuuuuauaucaugcaaaa

SEQ ID NO: 3548590 - RNA, 16 nt, Human
uauuuuuauauuuccu

SEQ ID NO: 3548591 - RNA, 21 nt, Human
uauuuuuauauuuccuuuaug

SEQ ID NO: 3548592 - RNA, 12 nt, Human
uauuuuuaucua

SEQ ID NO: 3548593 - RNA, 12 nt, Human
uauuuuuaucuu

SEQ ID NO: 3548594 - RNA, 12 nt, Human
uauuuuucacau

SEQ ID NO: 3548595 - RNA, 14 nt, Human
uauuuuucaguucc

SEQ ID NO: 3548596 - RNA, 17 nt, Human
uauuuuucaguuccaag

SEQ ID NO: 3548597 - RNA, 11 nt, Human
uauuuuucaua

SEQ ID NO: 3548598 - RNA, 13 nt, Human
uauuuuucauauu

SEQ ID NO: 3548599 - RNA, 16 nt, Human
uauuuuucuaacuaca

SEQ ID NO: 3548600 - RNA, 15 nt, Human
uauuuuucucuccug

SEQ ID NO: 3548601 - RNA, 14 nt, Human
uauuuuucuguuac

SEQ ID NO: 3548602 - RNA, 14 nt, Human
uauuuuugacagaa

SEQ ID NO: 3548603 - RNA, 19 nt, Human
uauuuuugacagaauaugu

SEQ ID NO: 3548604 - RNA, 18 nt, Human
uauuuuugacauggaaau

SEQ ID NO: 3548605 - RNA, 12 nt, Human
uauuuuugcaug

SEQ ID NO: 3548606 - RNA, 18 nt, Human
uauuuuugguugucaaua

SEQ ID NO: 3548607 - RNA, 12 nt, Human
uauuuuuguaaa

SEQ ID NO: 3548608 - RNA, 13 nt, Human
uauuuuuguaaac

SEQ ID NO: 3548609 - RNA, 16 nt, Human
uauuuuuguaaaguuu

SEQ ID NO: 3548610 - RNA, 20 nt, Human
uauuuuuguaauuuuaaaua

SEQ ID NO: 3548611 - RNA, 17 nt, Human
uauuuuuguagagccag

SEQ ID NO: 3548612 - RNA, 14 nt, Human
uauuuuuguaguga

SEQ ID NO: 3548613 - RNA, 14 nt, Human
uauuuuuguuuguu

SEQ ID NO: 3548614 - RNA, 18 nt, Human
uauuuuuguuuguuuugu

SEQ ID NO: 3548615 - RNA, 15 nt, Human
uauuuuuuaaguauu

SEQ ID NO: 3548616 - RNA, 16 nt, Human
uauuuuuuaauuauug

SEQ ID NO: 3548617 - RNA, 13 nt, Human
uauuuuuuauaca

SEQ ID NO: 3548618 - RNA, 12 nt, Human
uauuuuuuauga

SEQ ID NO: 3548619 - RNA, 13 nt, Human
uauuuuuuauugu

SEQ ID NO: 3548620 - RNA, 17 nt, Human
uauuuuuuauuguuuuc

SEQ ID NO: 3548621 - RNA, 13 nt, Human
uauuuuuucagac

SEQ ID NO: 3548622 - RNA, 11 nt, Human
uauuuuuuccu

SEQ ID NO: 3548623 - RNA, 14 nt, Human
uauuuuuuguauaa

SEQ ID NO: 3548624 - RNA, 23 nt, Human
uauuuuuuuaaaaucacuaacau

SEQ ID NO: 3548625 - RNA, 15 nt, Human
uauuuuuuuaacuuu

SEQ ID NO: 3548626 - RNA, 20 nt, Human
uauuuuuuuaacuuuaccau

SEQ ID NO: 3548627 - RNA, 20 nt, Human
uauuuuuuuaagcuguaaaa

SEQ ID NO: 3548628 - RNA, 16 nt, Human
uauuuuuuuaauuuaa

SEQ ID NO: 3548629 - RNA, 18 nt, Human
uauuuuuuuaauuuaaca

SEQ ID NO: 3548630 - RNA, 15 nt, Human
uauuuuuuuacuaau

SEQ ID NO: 3548631 - RNA, 14 nt, Human
uauuuuuuucuaau

SEQ ID NO: 3548632 - RNA, 22 nt, Human
uauuuuuuucugaauuauuuuc

SEQ ID NO: 3548633 - RNA, 18 nt, Human
uauuuuuuucugauugua

SEQ ID NO: 3548634 - RNA, 17 nt, Human
uauuuuuuucuuuucuu

SEQ ID NO: 3548635 - RNA, 18 nt, Human
uauuuuuuuuaauauuau

SEQ ID NO: 3548636 - RNA, 16 nt, Human
uauuuuuuuuaauugu

SEQ ID NO: 3548637 - RNA, 14 nt, Human
uauuuuuuuucugu

SEQ ID NO: 3548638 - RNA, 16 nt, Human
uauuuuuuuuucuaag

SEQ ID NO: 3548639 - RNA, 16 nt, Human
uauuuuuuuuuucuuc

SEQ ID NO: 3548640 - RNA, 19 nt, Human
uauuuuuuuuuucuucuug

SEQ ID NO: 3548641 - RNA, 21 nt, Human
uauuuuuuuuuucuucuuggg

SEQ ID NO: 3548642 - RNA, 14 nt, Human
ucaaaaaaagaaaa

SEQ ID NO: 3548643 - RNA, 14 nt, Human
ucaaaaaacaaaaa

SEQ ID NO: 3548644 - RNA, 13 nt, Human
ucaaaaaaugagc

SEQ ID NO: 3548645 - RNA, 13 nt, Human
ucaaaaaauugca

SEQ ID NO: 3548646 - RNA, 23 nt, Human
ucaaaaacacaguguuuuuguaa

SEQ ID NO: 3548647 - RNA, 17 nt, Human
ucaaaaacuuuggaguc

SEQ ID NO: 3548648 - RNA, 19 nt, Human
ucaaaaaguguuuauuuuu

SEQ ID NO: 3548649 - RNA, 23 nt, Human
ucaaaaaguguuuauuuuucaua

SEQ ID NO: 3548650 - RNA, 16 nt, Human
ucaaaaauauaacuua

SEQ ID NO: 3548651 - RNA, 18 nt, Human
ucaaaaaucaauaugcag

SEQ ID NO: 3548652 - RNA, 11 nt, Human
ucaaaaaucug

SEQ ID NO: 3548653 - RNA, 13 nt, Human
ucaaaaaucugaa

SEQ ID NO: 3548654 - RNA, 15 nt, Human
ucaaaaaucugaaga

SEQ ID NO: 3548655 - RNA, 18 nt, Human
ucaaaaaucugaagauug

SEQ ID NO: 3548656 - RNA, 23 nt, Human
ucaaaaauuaaaccggaccaucu

SEQ ID NO: 3548657 - RNA, 20 nt, Human
ucaaaaauuaucuauagcua

SEQ ID NO: 3548658 - RNA, 21 nt, Human
ucaaaaauugaagagagauau

SEQ ID NO: 3548659 - RNA, 16 nt, Human
ucaaaacaaaggccua

SEQ ID NO: 3548660 - RNA, 13 nt, Human
ucaaaacacugug

SEQ ID NO: 3548661 - RNA, 14 nt, Human
ucaaaacacuugua

SEQ ID NO: 3548662 - RNA, 14 nt, Human
ucaaaacagauugu

SEQ ID NO: 3548663 - RNA, 19 nt, Human
ucaaaacagauuguuugca

SEQ ID NO: 3548664 - RNA, 12 nt, Human
ucaaaacauugu

SEQ ID NO: 3548665 - RNA, 22 nt, Human
ucaaaaccagguccaaugagcu

SEQ ID NO: 3548666 - RNA, 18 nt, Human
ucaaaacggggcagccaa

SEQ ID NO: 3548667 - RNA, 22 nt, Human
ucaaaacgguuuuacugcagcu

SEQ ID NO: 3548668 - RNA, 17 nt, Human
ucaaaacuugguauuuu

SEQ ID NO: 3548669 - RNA, 19 nt, Human
ucaaaagaaucagaaacag

SEQ ID NO: 3548670 - RNA, 21 nt, Human
ucaaaagacauguuguaaauu

SEQ ID NO: 3548671 - RNA, 22 nt, Human
ucaaaagcuauuuaaagcaucu

SEQ ID NO: 3548672 - RNA, 16 nt, Human
ucaaaagcugggcagg

SEQ ID NO: 3548673 - RNA, 23 nt, Human
ucaaaaggugccugugaggcagg

SEQ ID NO: 3548674 - RNA, 17 nt, Human
ucaaaaguagaacuuug

SEQ ID NO: 3548675 - RNA, 18 nt, Human
ucaaaaguagaacuuugu

SEQ ID NO: 3548676 - RNA, 16 nt, Human
ucaaaagugccucaag

SEQ ID NO: 3548677 - RNA, 21 nt, Human
ucaaaaguuccaagagucuaa

SEQ ID NO: 3548678 - RNA, 18 nt, Human
ucaaaaguuggacuaaau

SEQ ID NO: 3548679 - RNA, 13 nt, Human
ucaaaaguuuguu

SEQ ID NO: 3548680 - RNA, 17 nt, Human
ucaaaauaaagaaguau

SEQ ID NO: 3548681 - RNA, 14 nt, Human
ucaaaauaaauuga

SEQ ID NO: 3548682 - RNA, 16 nt, Human
ucaaaauaaauugaaa

SEQ ID NO: 3548683 - RNA, 19 nt, Human
uuggagcucgugggacagu

SEQ ID NO: 3548684 - RNA, 20 nt, Human
uuggagcuuacauaguuuua

SEQ ID NO: 3548685 - RNA, 15 nt, Human
uuggaggggggagcc

SEQ ID NO: 3548686 - RNA, 19 nt, Human
uuggagggguuuaugcuca

SEQ ID NO: 3548687 - RNA, 23 nt, Human
uuggagggucccaagcugggccc

SEQ ID NO: 3548688 - RNA, 22 nt, Human
uuggagggugggagagcccagc

SEQ ID NO: 3548689 - RNA, 23 nt, Human
uuggaggugcuuaagcagaagca

SEQ ID NO: 3548690 - RNA, 17 nt, Human
uuggaguagaauguagu

SEQ ID NO: 3548691 - RNA, 22 nt, Human
uuggagugaguguggcuccccu

SEQ ID NO: 3548692 - RNA, 18 nt, Human
uuggaguguuauguauuu

SEQ ID NO: 3548693 - RNA, 14 nt, Human
uuggaguucauuca

SEQ ID NO: 3548694 - RNA, 16 nt, Human
uuggaguucauucaua

SEQ ID NO: 3548695 - RNA, 21 nt, Human
uuggauaauaaggaaaaguuu

SEQ ID NO: 3548696 - RNA, 22 nt, Human
uuggauaaugcuguugccucau

SEQ ID NO: 3548697 - RNA, 19 nt, Human
uuggauauuuuuuacuuua

SEQ ID NO: 3548698 - RNA, 15 nt, Human
uuggaucaaguauua

SEQ ID NO: 3548699 - RNA, 19 nt, Human
uuggaucuucaauggcuuu

SEQ ID NO: 3548700 - RNA, 18 nt, Human
uuggaugaguuuugggaa

SEQ ID NO: 3548701 - RNA, 22 nt, Human
uuggaugggacuagagcuuucu

SEQ ID NO: 3548702 - RNA, 16 nt, Human
uuggauuaaauacaua

SEQ ID NO: 3548703 - RNA, 23 nt, Human
uuggauuaaauacauauggaugu

SEQ ID NO: 3548704 - RNA, 15 nt, Human
uuggauuaaauuagu

SEQ ID NO: 3548705 - RNA, 18 nt, Human
uuggauuauucauuuaaa

SEQ ID NO: 3548706 - RNA, 23 nt, Human
uuggauuauucauuuaaaaugau

SEQ ID NO: 3548707 - RNA, 20 nt, Human
uuggauuauuuaauaacauu

SEQ ID NO: 3548708 - RNA, 17 nt, Human
uuggauucugagagcug

SEQ ID NO: 3548709 - RNA, 15 nt, Human
uuggauugacaguaa

SEQ ID NO: 3548710 - RNA, 18 nt, Human
uuggauugacaguaacuu

SEQ ID NO: 3548711 - RNA, 21 nt, Human
uuggauuuccuaauacuguca

SEQ ID NO: 3548712 - RNA, 14 nt, Human
uuggauuugacauu

SEQ ID NO: 3548713 - RNA, 19 nt, Human
uuggauuuggagagaaaua

SEQ ID NO: 3548714 - RNA, 18 nt, Human
uuggauuuguuuaaaagg

SEQ ID NO: 3548715 - RNA, 17 nt, Human
uuggauuuuauguugac

SEQ ID NO: 3548716 - RNA, 18 nt, Human
uuggauuuuauguugaca

SEQ ID NO: 3548717 - RNA, 18 nt, Human
uuggauuuuugucuugug

SEQ ID NO: 3548718 - RNA, 13 nt, Human
ucaauaucuaaua

SEQ ID NO: 3548719 - RNA, 15 nt, Human
ucaauaucuaauaua

SEQ ID NO: 3548720 - RNA, 16 nt, Human
ucaauauuaaauacag

SEQ ID NO: 3548721 - RNA, 21 nt, Human
ucaauauuaaauacagacacu

SEQ ID NO: 3548722 - RNA, 22 nt, Human
ucaauauuaaauacagacacua

SEQ ID NO: 3548723 - RNA, 15 nt, Human
ucaauauucaauaaa

SEQ ID NO: 3548724 - RNA, 17 nt, Human
ucaauauucaauaaagc

SEQ ID NO: 3548725 - RNA, 14 nt, Human
ucaauauuccugaa

SEQ ID NO: 3548726 - RNA, 22 nt, Human
ucaauauuccugaaugaaauau

SEQ ID NO: 3548727 - RNA, 15 nt, Human
ucaauauugaauuuu

SEQ ID NO: 3548728 - RNA, 16 nt, Human
ucaauauugacauuug

SEQ ID NO: 3548729 - RNA, 19 nt, Human
ucaauauugacauuuguag

SEQ ID NO: 3548730 - RNA, 12 nt, Human
ucaauauuuauu

SEQ ID NO: 3548731 - RNA, 20 nt, Human
ucaauauuuauuauuuucac

SEQ ID NO: 3548732 - RNA, 15 nt, Human
ucaauauuucagaua

SEQ ID NO: 3548733 - RNA, 17 nt, Human
ucaauauuuucuuuucc

SEQ ID NO: 3548734 - RNA, 16 nt, Human
ucaauauuuuuauauc

SEQ ID NO: 3548735 - RNA, 22 nt, Human
ucaaucaguauaauucuguacu

SEQ ID NO: 3548736 - RNA, 21 nt, Human
ucaaucagucucagaauguca

SEQ ID NO: 3548737 - RNA, 18 nt, Human
ucaaucauuguacaguuu

SEQ ID NO: 3548738 - RNA, 15 nt, Human
ucaaucauuucucac

SEQ ID NO: 3548739 - RNA, 19 nt, Human
ucaauccagcgguucucaa

SEQ ID NO: 3548740 - RNA, 19 nt, Human
ucaaucccaaaagucacca

SEQ ID NO: 3548741 - RNA, 13 nt, Human
uuguccuccugcu

SEQ ID NO: 3548742 - RNA, 23 nt, Human
uuguccugaugcuuuugucuaau

SEQ ID NO: 3548743 - RNA, 15 nt, Human
uuguccuuucccuuc

SEQ ID NO: 3548744 - RNA, 14 nt, Human
uuguccuuuucaua

SEQ ID NO: 3548745 - RNA, 19 nt, Human
uuguccuuuugcaaagaaa

SEQ ID NO: 3548746 - RNA, 14 nt, Human
uugucgcucaugug

SEQ ID NO: 3548747 - RNA, 17 nt, Human
uugucguaaagauuugg

SEQ ID NO: 3548748 - RNA, 22 nt, Human
uugucguugacuuuagggacuc

SEQ ID NO: 3548749 - RNA, 18 nt, Human
uugucuaaaacaauaaaa

SEQ ID NO: 3548750 - RNA, 19 nt, Human
uugucuaacucagaauuau

SEQ ID NO: 3548751 - RNA, 16 nt, Human
uugucuaagaaacauu

SEQ ID NO: 3548752 - RNA, 18 nt, Human
uugucuaagaaacauugg

SEQ ID NO: 3548753 - RNA, 21 nt, Human
uugucuaagaaauugaauacu

SEQ ID NO: 3548754 - RNA, 20 nt, Human
uugucuacaccauuaugugc

SEQ ID NO: 3548755 - RNA, 15 nt, Human
uugucuagugaaacu

SEQ ID NO: 3548756 - RNA, 18 nt, Human
uugucuauuaccuguuag

SEQ ID NO: 3548757 - RNA, 12 nt, Human
uugucuauuuau

SEQ ID NO: 3548758 - RNA, 16 nt, Human
uugucuauuuuaaaau

SEQ ID NO: 3548759 - RNA, 17 nt, Human
uugucucaaugcucaua

SEQ ID NO: 3548760 - RNA, 16 nt, Human
uugucucagauuuuau

SEQ ID NO: 3548761 - RNA, 19 nt, Human
uugucucccuggcccucaa

SEQ ID NO: 3548762 - RNA, 21 nt, Human
uugucucuccuuuucuuuugu

SEQ ID NO: 3548763 - RNA, 22 nt, Human
uugucucuccuuuucuuuuguu

SEQ ID NO: 3548764 - RNA, 15 nt, Human
uugucucucuucaga

SEQ ID NO: 3548765 - RNA, 19 nt, Human
uugucucucuucagacucu

SEQ ID NO: 3548766 - RNA, 20 nt, Human
uugucucugcaaacugccuu

SEQ ID NO: 3548767 - RNA, 22 nt, Human
uugucucugcaaacugccuucu

SEQ ID NO: 3548768 - RNA, 12 nt, Human
uugucucuguuu

SEQ ID NO: 3548769 - RNA, 15 nt, Human
uugucugaacuugca

SEQ ID NO: 3548770 - RNA, 17 nt, Human
uugucugaagucacugc

SEQ ID NO: 3548771 - RNA, 20 nt, Human
uugucugaagucacugcaca

SEQ ID NO: 3548772 - RNA, 16 nt, Human
uugucugauuucuuag

SEQ ID NO: 3548773 - RNA, 18 nt, Human
uugucugccccaaguuuu

SEQ ID NO: 3548774 - RNA, 20 nt, Human
uugucugccccaaguuuugu

SEQ ID NO: 3548775 - RNA, 21 nt, Human
uugucugccccaaguuuugug

SEQ ID NO: 3548776 - RNA, 17 nt, Human
uugucuguuuguuucaa

SEQ ID NO: 3548777 - RNA, 22 nt, Human
uugucuuaaaaaguggaaaaau

SEQ ID NO: 3548778 - RNA, 17 nt, Human
uugucuuaaauaaaaga

SEQ ID NO: 3548779 - RNA, 12 nt, Human
uugucuuaauau

SEQ ID NO: 3548780 - RNA, 15 nt, Human
uugucuuauauauau

SEQ ID NO: 3548781 - RNA, 17 nt, Human
uugucuucaaacuguga

SEQ ID NO: 3548782 - RNA, 14 nt, Human
uugucuuguucugu

SEQ ID NO: 3548783 - RNA, 14 nt, Human
uugucuuuauauga

SEQ ID NO: 3548784 - RNA, 16 nt, Human
uugucuuuauaugaac

SEQ ID NO: 3548785 - RNA, 12 nt, Human
uugucuuucugg

SEQ ID NO: 3548786 - RNA, 14 nt, Human
uugucuuucugggg

SEQ ID NO: 3548787 - RNA, 20 nt, Human
uugucuuuggacccugaggc

SEQ ID NO: 3548788 - RNA, 18 nt, Human
uugucuuuucaaaauauu

SEQ ID NO: 3548789 - RNA, 16 nt, Human
uugugaaaauaauuga

SEQ ID NO: 3548790 - RNA, 20 nt, Human
uugugaaaggaaagaggcuc

SEQ ID NO: 3548791 - RNA, 17 nt, Human
uugugaaauuuuucaua

SEQ ID NO: 3548792 - RNA, 21 nt, Human
uugugaaauuuuucauauuuu

SEQ ID NO: 3548793 - RNA, 13 nt, Human
uugugaacucauu

SEQ ID NO: 3548794 - RNA, 18 nt, Human
uugugaagacugggaagu

SEQ ID NO: 3548795 - RNA, 18 nt, Human
uugugaagguggaaauaa

SEQ ID NO: 3548796 - RNA, 13 nt, Human
uugugaauaauua

SEQ ID NO: 3548797 - RNA, 21 nt, Human
uugugaauaauuacagugccu

SEQ ID NO: 3548798 - RNA, 21 nt, Human
uugugaaucaagggucaggcc

SEQ ID NO: 3548799 - RNA, 23 nt, Human
uugugaaucaagggucaggccuu

SEQ ID NO: 3548800 - RNA, 22 nt, Human
uugugaaugauucauguuauau

SEQ ID NO: 3548801 - RNA, 22 nt, Human
uugugaaugcagguuuuaucag

SEQ ID NO: 3548802 - RNA, 23 nt, Human
uugugaauuaggcuguaacuacu

SEQ ID NO: 3548803 - RNA, 16 nt, Human
uugugaccaaguuaua

SEQ ID NO: 3548804 - RNA, 16 nt, Human
uugugaccugaaguuc

SEQ ID NO: 3548805 - RNA, 20 nt, Human
uugugaccugaaguucacca

SEQ ID NO: 3548806 - RNA, 20 nt, Human
uugugaccuuaguguuucug

SEQ ID NO: 3548807 - RNA, 20 nt, Human
uugugacuaauuguauaaca

SEQ ID NO: 3548808 - RNA, 23 nt, Human
uugugacuaauuguauaacaggu

SEQ ID NO: 3548809 - RNA, 23 nt, Human
uugugacuagugcugaagcuuau

SEQ ID NO: 3548810 - RNA, 22 nt, Human
uugugacuguauauaaaggaaa

SEQ ID NO: 3548811 - RNA, 15 nt, Human
uugugagagcgaggc

SEQ ID NO: 3548812 - RNA, 18 nt, Human
uugugagccaccacgucc

SEQ ID NO: 3548813 - RNA, 17 nt, Human
uugugaggaagccgcug

SEQ ID NO: 3548814 - RNA, 22 nt, Human
uugugaguuuaguaaggcugug

SEQ ID NO: 3548815 - RNA, 17 nt, Human
uugugauauggagcccu

SEQ ID NO: 3548816 - RNA, 15 nt, Human
uugugaucuugcucu

SEQ ID NO: 3548817 - RNA, 19 nt, Human
uugugauguauauuccuuu

SEQ ID NO: 3548818 - RNA, 20 nt, Human
uugugauguauauuccuuug

SEQ ID NO: 3548819 - RNA, 20 nt, Human
uugugaugucauacagagaa

SEQ ID NO: 3548820 - RNA, 19 nt, Human
uugugauuagacagaacac

SEQ ID NO: 3548821 - RNA, 22 nt, Human
uugugauuauuucacuuuagau

SEQ ID NO: 3548822 - RNA, 15 nt, Human
uugugauuggccugu

SEQ ID NO: 3548823 - RNA, 16 nt, Human
uugugauuggccugua

SEQ ID NO: 3548824 - RNA, 23 nt, Human
uugugauuucuuuaaaagaauga

SEQ ID NO: 3548825 - RNA, 17 nt, Human
uugugauuugacuguuu

SEQ ID NO: 3548826 - RNA, 20 nt, Human
uugugcaauguguauaaaca

SEQ ID NO: 3548827 - RNA, 21 nt, Human
uugugcaauguguauaaacaa

SEQ ID NO: 3548828 - RNA, 16 nt, Human
uugugcacauuuauuu

SEQ ID NO: 3548829 - RNA, 18 nt, Human
uugugcacauuuauuucc

SEQ ID NO: 3548830 - RNA, 15 nt, Human
uugugcagaaaacau

SEQ ID NO: 3548831 - RNA, 16 nt, Human
uugugcagucaucaga

SEQ ID NO: 3548832 - RNA, 15 nt, Human
uugugcauuuguaaa

SEQ ID NO: 3548833 - RNA, 17 nt, Human
uugugccaauauguauu

SEQ ID NO: 3548834 - RNA, 16 nt, Human
uugugccagaaugcuu

SEQ ID NO: 3548835 - RNA, 21 nt, Human
uugugccagaaugcuuuagga

SEQ ID NO: 3548836 - RNA, 21 nt, Human
uugugccagaggaauccuggc

SEQ ID NO: 3548837 - RNA, 22 nt, Human
uugugccauagucacauggccu

SEQ ID NO: 3548838 - RNA, 15 nt, Human
uugugccuggcucag

SEQ ID NO: 3548839 - RNA, 22 nt, Human
uugugcgcuaaacuuuucugau

SEQ ID NO: 3548840 - RNA, 16 nt, Human
uugugcuagaaauuuu

SEQ ID NO: 3548841 - RNA, 14 nt, Human
uugugcuauaguau

SEQ ID NO: 3548842 - RNA, 16 nt, Human
uugugcucagagacac

SEQ ID NO: 3548843 - RNA, 22 nt, Human
uugugcugaucgugcuaaauuu

SEQ ID NO: 3548844 - RNA, 14 nt, Human
uugugcugaugaga

SEQ ID NO: 3548845 - RNA, 18 nt, Human
uugugcuggauggagccc

SEQ ID NO: 3548846 - RNA, 19 nt, Human
uugugcugggguuaucuga

SEQ ID NO: 3548847 - RNA, 16 nt, Human
uugugcuucacaguag

SEQ ID NO: 3548848 - RNA, 21 nt, Human
uugugcuucacaguagagcca

SEQ ID NO: 3548849 - RNA, 11 nt, Human
uugugcuucua

SEQ ID NO: 3548850 - RNA, 12 nt, Human
uugugcuucucc

SEQ ID NO: 3548851 - RNA, 18 nt, Human
uugugcuucuccccagaa

SEQ ID NO: 3548852 - RNA, 19 nt, Human
uugugcuucuccccagaau

SEQ ID NO: 3548853 - RNA, 14 nt, Human
uugugcuuguuuac

SEQ ID NO: 3548854 - RNA, 19 nt, Human
uugugcuuugcucuugucc

SEQ ID NO: 3548855 - RNA, 16 nt, Human
uugugcuuuuccuauu

SEQ ID NO: 3548856 - RNA, 14 nt, Human
uugugcuuuuccug

SEQ ID NO: 3548857 - RNA, 21 nt, Human
uuguggaaaaugaaaauuagg

SEQ ID NO: 3548858 - RNA, 22 nt, Human
uuguggaagcaaaaaucugaaa

SEQ ID NO: 3548859 - RNA, 16 nt, Human
uuguggacacagcucu

SEQ ID NO: 3548860 - RNA, 17 nt, Human
uuguggacacagcucuu

SEQ ID NO: 3548861 - RNA, 16 nt, Human
uuguggacuaaaagau

SEQ ID NO: 3548862 - RNA, 20 nt, Human
ucacaacgugcauugugcuu

SEQ ID NO: 3548863 - RNA, 20 nt, Human
ucacaagaacacacacauau

SEQ ID NO: 3548864 - RNA, 14 nt, Human
ucacaagaagacca

SEQ ID NO: 3548865 - RNA, 13 nt, Human
ucacaagacccaa

SEQ ID NO: 3548866 - RNA, 20 nt, Human
ucacaagcugccucccuguc

SEQ ID NO: 3548867 - RNA, 23 nt, Human
ucacaaggcagcaaggcccgagc

SEQ ID NO: 3548868 - RNA, 22 nt, Human
ucacaaggcauucaaguguaca

SEQ ID NO: 3548869 - RNA, 16 nt, Human
ucacaagugaaaaaca

SEQ ID NO: 3548870 - RNA, 22 nt, Human
ucacaagugaaaaacauccaga

SEQ ID NO: 3548871 - RNA, 20 nt, Human
ucacaauacagauaacauua

SEQ ID NO: 3548872 - RNA, 16 nt, Human
ucacaauagaaacuca

SEQ ID NO: 3548873 - RNA, 22 nt, Human
ucacaaugaaaugcucuccuuu

SEQ ID NO: 3548874 - RNA, 23 nt, Human
ucacaaugaaaugcucuccuuuc

SEQ ID NO: 3548875 - RNA, 15 nt, Human
ucacaauguucuuua

SEQ ID NO: 3548876 - RNA, 14 nt, Human
ucacacaaagcaga

SEQ ID NO: 3548877 - RNA, 20 nt, Human
ucacacagccaggugccuug

SEQ ID NO: 3548878 - RNA, 21 nt, Human
ucacacaggacccccuucccc

SEQ ID NO: 3548879 - RNA, 22 nt, Human
ucacacaggacccccuuccccu

SEQ ID NO: 3548880 - RNA, 12 nt, Human
ucacacaggcau

SEQ ID NO: 3548881 - RNA, 20 nt, Human
ucacacaggcauuuccuggg

SEQ ID NO: 3548882 - RNA, 21 nt, Human
ucacacaggcauuuccugggu

SEQ ID NO: 3548883 - RNA, 21 nt, Human
ucacacaguauuacuucugcu

SEQ ID NO: 3548884 - RNA, 13 nt, Human
ucacacagugagu

SEQ ID NO: 3548885 - RNA, 22 nt, Human
ucacacagugagucgaggacag

SEQ ID NO: 3548886 - RNA, 23 nt, Human
ucacacagugagucgaggacagg

SEQ ID NO: 3548887 - RNA, 22 nt, Human
ucacacauccagacaucaugaa

SEQ ID NO: 3548888 - RNA, 23 nt, Human
ucacacaugagcaucaggccagg

SEQ ID NO: 3548889 - RNA, 15 nt, Human
ucacaccacuagccu

SEQ ID NO: 3548890 - RNA, 12 nt, Human
ucacaccagcca

SEQ ID NO: 3548891 - RNA, 23 nt, Human
ucacaccaggcuugccugcaggc

SEQ ID NO: 3548892 - RNA, 18 nt, Human
ucacaccauaacuaggua

SEQ ID NO: 3548893 - RNA, 22 nt, Human
ucacacccaccguccgcccugc

SEQ ID NO: 3548894 - RNA, 12 nt, Human
ucacaccccacc

SEQ ID NO: 3548895 - RNA, 13 nt, Human
ucacaccccaccu

SEQ ID NO: 3548896 - RNA, 14 nt, Human
ucacaccccaccug

SEQ ID NO: 3548897 - RNA, 17 nt, Human
ucacaccccaccugcgc

SEQ ID NO: 3548898 - RNA, 23 nt, Human
ucacaccccagacgaugucuuca

SEQ ID NO: 3548899 - RNA, 20 nt, Human
ucacacccugcaaggcccac

SEQ ID NO: 3548900 - RNA, 23 nt, Human
ucacacccugcaaggcccacagg

SEQ ID NO: 3548901 - RNA, 15 nt, Human
ucacaccuagcguca

SEQ ID NO: 3548902 - RNA, 12 nt, Human
ucacaccugacu

SEQ ID NO: 3548903 - RNA, 17 nt, Human
ucacaccugacucugaa

SEQ ID NO: 3548904 - RNA, 23 nt, Human
ucacaccugacucugaaaucuga

SEQ ID NO: 3548905 - RNA, 22 nt, Human
uuguuucgcucuuugagaaaua

SEQ ID NO: 3548906 - RNA, 16 nt, Human
uuguuucguggggagg

SEQ ID NO: 3548907 - RNA, 17 nt, Human
uuguuucuaccucccag

SEQ ID NO: 3548908 - RNA, 15 nt, Human
uuguuucuauacaaa

SEQ ID NO: 3548909 - RNA, 17 nt, Human
uuguuucucuguuguaa

SEQ ID NO: 3548910 - RNA, 21 nt, Human
uuguuucugaaaauuccagaa

SEQ ID NO: 3548911 - RNA, 14 nt, Human
uuguuucugaucua

SEQ ID NO: 3548912 - RNA, 16 nt, Human
uuguuucuguuccaaa

SEQ ID NO: 3548913 - RNA, 11 nt, Human
uuguuucuucc

SEQ ID NO: 3548914 - RNA, 12 nt, Human
uuguuucuucca

SEQ ID NO: 3548915 - RNA, 15 nt, Human
uuguuugagaaauua

SEQ ID NO: 3548916 - RNA, 16 nt, Human
uuguuugcuaucuuaa

SEQ ID NO: 3548917 - RNA, 12 nt, Human
uuguuugcugcu

SEQ ID NO: 3548918 - RNA, 13 nt, Human
uuguuugcuuauu

SEQ ID NO: 3548919 - RNA, 21 nt, Human
uuguuuggagacguuuauaaa

SEQ ID NO: 3548920 - RNA, 18 nt, Human
uuguuuggauguaauuua

SEQ ID NO: 3548921 - RNA, 11 nt, Human
uuguuuggauu

SEQ ID NO: 3548922 - RNA, 16 nt, Human
uuguuuggguauccug

SEQ ID NO: 3548923 - RNA, 19 nt, Human
uuguuugguaaauguuucu

SEQ ID NO: 3548924 - RNA, 15 nt, Human
uuguuugguauugua

SEQ ID NO: 3548925 - RNA, 13 nt, Human
uuguuuguaaaua

SEQ ID NO: 3548926 - RNA, 16 nt, Human
uuguuugucucuccuu

SEQ ID NO: 3548927 - RNA, 18 nt, Human
uuguuugucucuccuuuu

SEQ ID NO: 3548928 - RNA, 19 nt, Human
uuguuugucucuccuuuuc

SEQ ID NO: 3548929 - RNA, 12 nt, Human
uuguuugucugu

SEQ ID NO: 3548930 - RNA, 15 nt, Human
uuguuugucuguuug

SEQ ID NO: 3548931 - RNA, 12 nt, Human
uuguuugugcuu

SEQ ID NO: 3548932 - RNA, 14 nt, Human
uuguuuguuucuuu

SEQ ID NO: 3548933 - RNA, 23 nt, Human
uuguuuguuuuguuuuuuaguuc

SEQ ID NO: 3548934 - RNA, 13 nt, Human
uuguuuucagugu

SEQ ID NO: 3548935 - RNA, 14 nt, Human
uuguuuucauuauc

SEQ ID NO: 3548936 - RNA, 15 nt, Human
uuguuuucugacuaa

SEQ ID NO: 3548937 - RNA, 22 nt, Human
uuguuuucuuucuuuaaauguu

SEQ ID NO: 3548938 - RNA, 13 nt, Human
uuguuuugcuucc

SEQ ID NO: 3548939 - RNA, 19 nt, Human
uuguuuugcuuuuucugac

SEQ ID NO: 3548940 - RNA, 17 nt, Human
uuguuuuggauggcuug

SEQ ID NO: 3548941 - RNA, 13 nt, Human
uuguuuuguacag

SEQ ID NO: 3548942 - RNA, 10 nt, Human
uuguuuuguu

SEQ ID NO: 3548943 - RNA, 13 nt, Human
uuguuuuguuuua

SEQ ID NO: 3548944 - RNA, 12 nt, Human
uuguuuuucauu

SEQ ID NO: 3548945 - RNA, 19 nt, Human
uuguuuuucauucagucuu

SEQ ID NO: 3548946 - RNA, 22 nt, Human
uuguuuuuccuuguauuuaaau

SEQ ID NO: 3548947 - RNA, 14 nt, Human
uuguuuuucuuucu

SEQ ID NO: 3548948 - RNA, 15 nt, Human
uuguuuuucuuucua

SEQ ID NO: 3548949 - RNA, 14 nt, Human
uuguuuuuugaagu

SEQ ID NO: 3548950 - RNA, 14 nt, Human
uuguuuuuuugcca

SEQ ID NO: 3548951 - RNA, 18 nt, Human
uuguuuuuuuuuuccacu

SEQ ID NO: 3548952 - RNA, 17 nt, Human
uuuaaaaaaaaaauugg

SEQ ID NO: 3548953 - RNA, 18 nt, Human
uuuaaaaaaaaagucaga

SEQ ID NO: 3548954 - RNA, 15 nt, Human
uuuaaaaaaagaaaa

SEQ ID NO: 3548955 - RNA, 17 nt, Human
uuuaaaaaaauaaaaca

SEQ ID NO: 3548956 - RNA, 21 nt, Human
uuuaaaaaacuaaaaacuaga

SEQ ID NO: 3548957 - RNA, 14 nt, Human
uuuaaaaaacuuuc

SEQ ID NO: 3548958 - RNA, 16 nt, Human
uuuaaaaaacuuucua

SEQ ID NO: 3548959 - RNA, 18 nt, Human
uuuaaaaaacuuucuacu

SEQ ID NO: 3548960 - RNA, 19 nt, Human
uuuaaaaaacuuucuacuc

SEQ ID NO: 3548961 - RNA, 20 nt, Human
uuuaaaaaagcuuaaaacuu

SEQ ID NO: 3548962 - RNA, 14 nt, Human
uuuaaaaaaguuua

SEQ ID NO: 3548963 - RNA, 19 nt, Human
uuuaaaaaauagcagcuuu

SEQ ID NO: 3548964 - RNA, 17 nt, Human
uuuaaaaaauauuuucu

SEQ ID NO: 3548965 - RNA, 19 nt, Human
uuuaaaaaaugaaaauaag

SEQ ID NO: 3548966 - RNA, 13 nt, Human
uuuaaaaaaugua

SEQ ID NO: 3548967 - RNA, 18 nt, Human
uuuaaaaacaaaaggcaa

SEQ ID NO: 3548968 - RNA, 14 nt, Human
uuuaaaaacuauuu

SEQ ID NO: 3548969 - RNA, 17 nt, Human
uuuaaaaagaaaucugg

SEQ ID NO: 3548970 - RNA, 17 nt, Human
uuuaaaaagggaagaaa

SEQ ID NO: 3548971 - RNA, 20 nt, Human
uuuaaaaagggaagaaacug

SEQ ID NO: 3548972 - RNA, 17 nt, Human
uuuaaaaaguauugcca

SEQ ID NO: 3548973 - RNA, 16 nt, Human
uuuaaaaaguguuuaa

SEQ ID NO: 3548974 - RNA, 18 nt, Human
uuuaaaaauaagucaaca

SEQ ID NO: 3548975 - RNA, 20 nt, Human
uuuaaaaauaagucaacagu

SEQ ID NO: 3548976 - RNA, 13 nt, Human
uuuaaaaauagaa

SEQ ID NO: 3548977 - RNA, 17 nt, Human
uuuaaaaauagacacuc

SEQ ID NO: 3548978 - RNA, 11 nt, Human
uuuaaaaauau

SEQ ID NO: 3548979 - RNA, 14 nt, Human
uuuaaaaauauuuu

SEQ ID NO: 3548980 - RNA, 23 nt, Human
uuuaaaaaucaacuuuuuauugc

SEQ ID NO: 3548981 - RNA, 12 nt, Human
uuuaaaaaucau

SEQ ID NO: 3548982 - RNA, 13 nt, Human
uuuaaaaaucaua

SEQ ID NO: 3548983 - RNA, 16 nt, Human
uuuaaaaaucauaaac

SEQ ID NO: 3548984 - RNA, 20 nt, Human
uuuaaaaaucauuguaugga

SEQ ID NO: 3548985 - RNA, 11 nt, Human
uuuaaaaaugg

SEQ ID NO: 3548986 - RNA, 20 nt, Human
uuuaaaaaugguaucaaaau

SEQ ID NO: 3548987 - RNA, 17 nt, Human
uuuaaaaaugucuugcu

SEQ ID NO: 3548988 - RNA, 22 nt, Human
uuuaaaacaagaaaguuucccc

SEQ ID NO: 3548989 - RNA, 16 nt, Human
uuuaaaacacauguuu

SEQ ID NO: 3548990 - RNA, 18 nt, Human
uuuaaaacaccuucuaua

SEQ ID NO: 3548991 - RNA, 15 nt, Human
uuuaaaacagacacu

SEQ ID NO: 3548992 - RNA, 21 nt, Human
uuuaaaacccauuuaaauuuu

SEQ ID NO: 3548993 - RNA, 13 nt, Human
uuuaaaacuacuu

SEQ ID NO: 3548994 - RNA, 15 nt, Human
uuuaaaacuguugga

SEQ ID NO: 3548995 - RNA, 18 nt, Human
uuuaaaagaaugggcagu

SEQ ID NO: 3548996 - RNA, 12 nt, Human
uuuaaaagacac

SEQ ID NO: 3548997 - RNA, 14 nt, Human
uuuaaaagagacaa

SEQ ID NO: 3548998 - RNA, 22 nt, Human
uuuaaaagagagagagagaaaa

SEQ ID NO: 3548999 - RNA, 23 nt, Human
uuuaaaagagagagagagaaaaa

SEQ ID NO: 3549000 - RNA, 13 nt, Human
uuuaaaagauaca

SEQ ID NO: 3549001 - RNA, 13 nt, Human
uuuaaaagaucuu

SEQ ID NO: 3549002 - RNA, 17 nt, Human
uuuaaaagaugcuuuua

SEQ ID NO: 3549003 - RNA, 16 nt, Human
uuuaaaagauucauuu

SEQ ID NO: 3549004 - RNA, 13 nt, Human
uuuaaaagcacga

SEQ ID NO: 3549005 - RNA, 20 nt, Human
uuuaaaaggauuuuuaucuu

SEQ ID NO: 3549006 - RNA, 13 nt, Human
uuuaaaaguaaaa

SEQ ID NO: 3549007 - RNA, 20 nt, Human
uuuaaaaguauauaauaaaa

SEQ ID NO: 3549008 - RNA, 15 nt, Human
aaaaagaaaugacua

SEQ ID NO: 3549009 - RNA, 12 nt, Human
aaaaagaagaag

SEQ ID NO: 3549010 - RNA, 18 nt, Human
aaaaagaagcaaccucag

SEQ ID NO: 3549011 - RNA, 13 nt, Human
aaaaagaauguca

SEQ ID NO: 3549012 - RNA, 13 nt, Human
aaaaagacaaaca

SEQ ID NO: 3549013 - RNA, 19 nt, Human
aaaaagagaaguauuauaa

SEQ ID NO: 3549014 - RNA, 12 nt, Human
aaaaagaggcua

SEQ ID NO: 3549015 - RNA, 13 nt, Human
aaaaagauaaaca

SEQ ID NO: 3549016 - RNA, 22 nt, Human
aaaaagauauauuaaaaauaua

SEQ ID NO: 3549017 - RNA, 11 nt, Human
aaaaagauccc

SEQ ID NO: 3549018 - RNA, 14 nt, Human
aaaaagaucccaaa

SEQ ID NO: 3549019 - RNA, 14 nt, Human
aaaaagauuagcaa

SEQ ID NO: 3549020 - RNA, 13 nt, Human
aaaaagauucuuu

SEQ ID NO: 3549021 - RNA, 13 nt, Human
aaaaagcacaaga

SEQ ID NO: 3549022 - RNA, 14 nt, Human
aaaaagcacaagaa

SEQ ID NO: 3549023 - RNA, 13 nt, Human
aaaaagcagacag

SEQ ID NO: 3549024 - RNA, 13 nt, Human
aaaaagcagcuac

SEQ ID NO: 3549025 - RNA, 17 nt, Human
aaaaagcauguacagug

SEQ ID NO: 3549026 - RNA, 21 nt, Human
aaaaagcauguacaguguucu

SEQ ID NO: 3549027 - RNA, 15 nt, Human
aaaaagcauguguca

SEQ ID NO: 3549028 - RNA, 23 nt, Human
aaaaagccaguuuggguaaaaua

SEQ ID NO: 3549029 - RNA, 17 nt, Human
aaaaagcccaccauuug

SEQ ID NO: 3549030 - RNA, 9 nt, Human
aaaaagcuc

SEQ ID NO: 3549031 - RNA, 12 nt, Human
aaaaagcuuaaa

SEQ ID NO: 3549032 - RNA, 19 nt, Human
aaaaagcuuccaugauucu

SEQ ID NO: 3549033 - RNA, 14 nt, Human
aaaaagcuuuuaug

SEQ ID NO: 3549034 - RNA, 17 nt, Human
aaaaaggaaaaaaagac

SEQ ID NO: 3549035 - RNA, 17 nt, Human
aaaaaggaacugcagca

SEQ ID NO: 3549036 - RNA, 22 nt, Human
aaaaagggcagggcaucuccug

SEQ ID NO: 3549037 - RNA, 15 nt, Human
aaaaaguauuauuuu

SEQ ID NO: 3549038 - RNA, 19 nt, Human
aaaaaguauuauuuuccaa

SEQ ID NO: 3549039 - RNA, 21 nt, Human
aaaaaguauugccaaacauua

SEQ ID NO: 3549040 - RNA, 20 nt, Human
aaaaagucagacugcuggga

SEQ ID NO: 3549041 - RNA, 18 nt, Human
aaaaagucagagacagau

SEQ ID NO: 3549042 - RNA, 16 nt, Human
aaaaaguccaauuuua

SEQ ID NO: 3549043 - RNA, 23 nt, Human
aaaaaguccaauuuuaauuuagu

SEQ ID NO: 3549044 - RNA, 17 nt, Human
aaaaagucucuauuuaa

SEQ ID NO: 3549045 - RNA, 14 nt, Human
aaaaagucuuuuaa

SEQ ID NO: 3549046 - RNA, 15 nt, Human
aaaaagucuuuuaaa

SEQ ID NO: 3549047 - RNA, 23 nt, Human
aaaaaguguuuauuuuucauauu

SEQ ID NO: 3549048 - RNA, 13 nt, Human
aaaaaguuccuuc

SEQ ID NO: 3549049 - RNA, 22 nt, Human
aaaaaguugcagcuguuuuguu

SEQ ID NO: 3549050 - RNA, 23 nt, Human
aaaaaguugcagcuguuuuguug

SEQ ID NO: 3549051 - RNA, 21 nt, Human
aaaaaguuguaugaucugugc

SEQ ID NO: 3549052 - RNA, 14 nt, Human
aaaaaguuguucaa

SEQ ID NO: 3549053 - RNA, 16 nt, Human
aaaaaguuuaaaaugu

SEQ ID NO: 3549054 - RNA, 14 nt, Human
aaaaaguuuccaua

SEQ ID NO: 3549055 - RNA, 19 nt, Human
aaaaauaaccccaaaauga

SEQ ID NO: 3549056 - RNA, 14 nt, Human
aaaaauaagaagaa

SEQ ID NO: 3549057 - RNA, 19 nt, Human
aaaaauaaucuauuucuau

SEQ ID NO: 3549058 - RNA, 19 nt, Human
aaaaauacucuaauucuaa

SEQ ID NO: 3549059 - RNA, 13 nt, Human
aaaaauagaaaca

SEQ ID NO: 3549060 - RNA, 18 nt, Human
aaaaauagaugucuuuua

SEQ ID NO: 3549061 - RNA, 12 nt, Human
aaaaauauacau

SEQ ID NO: 3549062 - RNA, 16 nt, Human
aaaaauauacauguuu

SEQ ID NO: 3549063 - RNA, 11 nt, Human
aaaaauauauu

SEQ ID NO: 3549064 - RNA, 15 nt, Human
aaaaauauauuuaau

SEQ ID NO: 3549065 - RNA, 15 nt, Human
ucaggccauggcucc

SEQ ID NO: 3549066 - RNA, 21 nt, Human
ucaggcccggcagggcgggca

SEQ ID NO: 3549067 - RNA, 13 nt, Human
ucaggcccuggaa

SEQ ID NO: 3549068 - RNA, 22 nt, Human
ucaggccggcagccccagccug

SEQ ID NO: 3549069 - RNA, 18 nt, Human
ucaggccucccucucucu

SEQ ID NO: 3549070 - RNA, 20 nt, Human
ucaggcgauccaccugucuc

SEQ ID NO: 3549071 - RNA, 23 nt, Human
ucaggcguagaucaccagaauaa

SEQ ID NO: 3549072 - RNA, 22 nt, Human
ucaggcuacuauagguccagaa

SEQ ID NO: 3549073 - RNA, 21 nt, Human
uuucuaguguaucaaaaugcu

SEQ ID NO: 3549074 - RNA, 15 nt, Human
uuucuaguuauuuau

SEQ ID NO: 3549075 - RNA, 18 nt, Human
uuucuauaauuuuacaag

SEQ ID NO: 3549076 - RNA, 14 nt, Human
uuucuauacaaaua

SEQ ID NO: 3549077 - RNA, 18 nt, Human
uuucuauagccaaaaaua

SEQ ID NO: 3549078 - RNA, 15 nt, Human
uuucuaugacacaug

SEQ ID NO: 3549079 - RNA, 18 nt, Human
uuucuauguacuaguacu

SEQ ID NO: 3549080 - RNA, 17 nt, Human
uuucuauuaaaagacuc

SEQ ID NO: 3549081 - RNA, 20 nt, Human
uuucuauuaaauaguuauau

SEQ ID NO: 3549082 - RNA, 13 nt, Human
uuucuauuguaca

SEQ ID NO: 3549083 - RNA, 19 nt, Human
uuucuauuucacuggagca

SEQ ID NO: 3549084 - RNA, 15 nt, Human
uuucuauuuuaagac

SEQ ID NO: 3549085 - RNA, 14 nt, Human
uuucuauuuucucu

SEQ ID NO: 3549086 - RNA, 22 nt, Human
uuucucaaaagcauuuaucauu

SEQ ID NO: 3549087 - RNA, 13 nt, Human
uuucucaaaguuu

SEQ ID NO: 3549088 - RNA, 13 nt, Human
uuucucaaaucuu

SEQ ID NO: 3549089 - RNA, 22 nt, Human
uuucucaacaaagcacaguguu

SEQ ID NO: 3549090 - RNA, 19 nt, Human
uuucucacacucuaacugu

SEQ ID NO: 3549091 - RNA, 22 nt, Human
uuucucacacucuaacuguaua

SEQ ID NO: 3549092 - RNA, 15 nt, Human
uuucucagcucccau

SEQ ID NO: 3549093 - RNA, 17 nt, Human
uuucucaguguugguau

SEQ ID NO: 3549094 - RNA, 20 nt, Human
uuucucaguguugguauauu

SEQ ID NO: 3549095 - RNA, 18 nt, Human
uuucucaugaaucugcaa

SEQ ID NO: 3549096 - RNA, 13 nt, Human
uuucucauguuga

SEQ ID NO: 3549097 - RNA, 20 nt, Human
uuucucauuuguuuuucuca

SEQ ID NO: 3549098 - RNA, 21 nt, Human
uuucuccaagagcuacauaau

SEQ ID NO: 3549099 - RNA, 18 nt, Human
uuucuccagccagcaaug

SEQ ID NO: 3549100 - RNA, 18 nt, Human
uuucucccagucauuuaa

SEQ ID NO: 3549101 - RNA, 20 nt, Human
uuucuccccugcccccagga

SEQ ID NO: 3549102 - RNA, 23 nt, Human
uuucuccccugcccccaggacug

SEQ ID NO: 3549103 - RNA, 17 nt, Human
uuucucccuaaacugua

SEQ ID NO: 3549104 - RNA, 20 nt, Human
uuucucccucucacugucug

SEQ ID NO: 3549105 - RNA, 21 nt, Human
uuucucccuggauuuuuacca

SEQ ID NO: 3549106 - RNA, 17 nt, Human
uuucuccguaugcacau

SEQ ID NO: 3549107 - RNA, 21 nt, Human
uuucuccuguuuauucccauc

SEQ ID NO: 3549108 - RNA, 19 nt, Human
uuucuccuuagucuucuca

SEQ ID NO: 3549109 - RNA, 19 nt, Human
uuucuccuuuaauuguaaa

SEQ ID NO: 3549110 - RNA, 22 nt, Human
uuucuccuuuaauuguaaagua

SEQ ID NO: 3549111 - RNA, 16 nt, Human
uuucuccuuuuguguu

SEQ ID NO: 3549112 - RNA, 12 nt, Human
uuucucuaggaa

SEQ ID NO: 3549113 - RNA, 20 nt, Human
uuucucuccagccugacuug

SEQ ID NO: 3549114 - RNA, 14 nt, Human
uuucucucuccagu

SEQ ID NO: 3549115 - RNA, 16 nt, Human
uuucucucuucccuca

SEQ ID NO: 3549116 - RNA, 17 nt, Human
uuucucucuucccucag

SEQ ID NO: 3549117 - RNA, 14 nt, Human
uuucucugcuucag

SEQ ID NO: 3549118 - RNA, 20 nt, Human
uuucucugggguauuugggg

SEQ ID NO: 3549119 - RNA, 16 nt, Human
uuucucuguacuuuuc

SEQ ID NO: 3549120 - RNA, 18 nt, Human
uuucucuguacuuuucau

SEQ ID NO: 3549121 - RNA, 17 nt, Human
uuucucuguguuuguuc

SEQ ID NO: 3549122 - RNA, 14 nt, Human
uuucucuguuguaa

SEQ ID NO: 3549123 - RNA, 17 nt, Human
uuucucuuacugcaaau

SEQ ID NO: 3549124 - RNA, 18 nt, Human
uuucucuugagcuggccu

SEQ ID NO: 3549125 - RNA, 13 nt, Human
uuucucuugggcu

SEQ ID NO: 3549126 - RNA, 12 nt, Human
uuucucuuucuc

SEQ ID NO: 3549127 - RNA, 13 nt, Human
uuucucuuucucu

SEQ ID NO: 3549128 - RNA, 16 nt, Human
uuucucuuucucuccu

SEQ ID NO: 3549129 - RNA, 20 nt, Human
uuucucuuucuuccuuuacu

SEQ ID NO: 3549130 - RNA, 15 nt, Human
uuucucuuugaaaca

SEQ ID NO: 3549131 - RNA, 15 nt, Human
uuucucuuugauuau

SEQ ID NO: 3549132 - RNA, 21 nt, Human
uuucucuuuuccccuuuccug

SEQ ID NO: 3549133 - RNA, 17 nt, Human
uuucucuuuucuaguuu

SEQ ID NO: 3549134 - RNA, 22 nt, Human
uuucugaaaauuccagaaagga

SEQ ID NO: 3549135 - RNA, 19 nt, Human
uuucugaaacuaaugaaag

SEQ ID NO: 3549136 - RNA, 14 nt, Human
uuucugaccaaaga

SEQ ID NO: 3549137 - RNA, 16 nt, Human
uuucugagaagguccu

SEQ ID NO: 3549138 - RNA, 10 nt, Human
uuucugagcg

SEQ ID NO: 3549139 - RNA, 15 nt, Human
uuucugagcugcucu

SEQ ID NO: 3549140 - RNA, 16 nt, Human
uuucugaggagaaaca

SEQ ID NO: 3549141 - RNA, 17 nt, Human
uuucugaggcuuuauga

SEQ ID NO: 3549142 - RNA, 21 nt, Human
uuucugaggugcacugggagg

SEQ ID NO: 3549143 - RNA, 17 nt, Human
uuucugagugccuucug

SEQ ID NO: 3549144 - RNA, 16 nt, Human
uuucugaguuccugca

SEQ ID NO: 3549145 - RNA, 16 nt, Human
uuucugaguuuuacca

SEQ ID NO: 3549146 - RNA, 14 nt, Human
uuucugauuagcuu

SEQ ID NO: 3549147 - RNA, 16 nt, Human
uuucugauuagcuuug

SEQ ID NO: 3549148 - RNA, 22 nt, Human
uuucugauuguaacguugcugu

SEQ ID NO: 3549149 - RNA, 19 nt, Human
uuucugcaaacaaacaccu

SEQ ID NO: 3549150 - RNA, 20 nt, Human
uuucugcaaacaaacaccuu

SEQ ID NO: 3549151 - RNA, 14 nt, Human
uuucugcacuauau

SEQ ID NO: 3549152 - RNA, 17 nt, Human
uuucugcacuauaugca

SEQ ID NO: 3549153 - RNA, 13 nt, Human
uuucugcacugag

SEQ ID NO: 3549154 - RNA, 17 nt, Human
uuucugcacugagcaga

SEQ ID NO: 3549155 - RNA, 14 nt, Human
uuucugcagaaaca

SEQ ID NO: 3549156 - RNA, 17 nt, Human
uuucugcauauguugaa

SEQ ID NO: 3549157 - RNA, 22 nt, Human
uuucugcaugaauaucauacaa

SEQ ID NO: 3549158 - RNA, 18 nt, Human
uuucugcauuuugcuauu

SEQ ID NO: 3549159 - RNA, 12 nt, Human
uuucugcccugg

SEQ ID NO: 3549160 - RNA, 15 nt, Human
uuucugcccuggcug

SEQ ID NO: 3549161 - RNA, 15 nt, Human
uuucugccuuccuug

SEQ ID NO: 3549162 - RNA, 15 nt, Human
uuucugcucagcuuc

SEQ ID NO: 3549163 - RNA, 18 nt, Human
uuucugcuuuaaaaaugu

SEQ ID NO: 3549164 - RNA, 18 nt, Human
uuucuggaauacaugaaa

SEQ ID NO: 3549165 - RNA, 21 nt, Human
uuucuggaauacaugaaauau

SEQ ID NO: 3549166 - RNA, 12 nt, Human
uuucuggcaccg

SEQ ID NO: 3549167 - RNA, 16 nt, Human
uuucuggccugccuuc

SEQ ID NO: 3549168 - RNA, 16 nt, Human
uuucuggcuaugcauu

SEQ ID NO: 3549169 - RNA, 19 nt, Human
uuucuggcuggagccuaga

SEQ ID NO: 3549170 - RNA, 14 nt, Human
uuucuggggccuag

SEQ ID NO: 3549171 - RNA, 16 nt, Human
uuucugggguuuuucu

SEQ ID NO: 3549172 - RNA, 15 nt, Human
uuucuggguccugaa

SEQ ID NO: 3549173 - RNA, 15 nt, Human
uuucugguagauaga

SEQ ID NO: 3549174 - RNA, 19 nt, Human
uuucugguagauagaaaua

SEQ ID NO: 3549175 - RNA, 20 nt, Human
uuucugguggucuguuggca

SEQ ID NO: 3549176 - RNA, 22 nt, Human
uuucugguucuuguguuggcug

SEQ ID NO: 3549177 - RNA, 15 nt, Human
uuucuguaaacucug

SEQ ID NO: 3549178 - RNA, 13 nt, Human
uuucuguaccauu

SEQ ID NO: 3549179 - RNA, 17 nt, Human
uuucuguauauacuuuu

SEQ ID NO: 3549180 - RNA, 17 nt, Human
uuucugucagaugagaa

SEQ ID NO: 3549181 - RNA, 19 nt, Human
uuucugucagaugagaaca

SEQ ID NO: 3549182 - RNA, 13 nt, Human
uuucugucauuca

SEQ ID NO: 3549183 - RNA, 23 nt, Human
uuucuguccuuuuggcacugaga

SEQ ID NO: 3549184 - RNA, 13 nt, Human
uuucugugcccuc

SEQ ID NO: 3549185 - RNA, 20 nt, Human
uuucugugugcaccuuacca

SEQ ID NO: 3549186 - RNA, 15 nt, Human
uuucugugugucagu

SEQ ID NO: 3549187 - RNA, 18 nt, Human
uuucugugugucaguuuu

SEQ ID NO: 3549188 - RNA, 21 nt, Human
uuucugugugucaguuuucau

SEQ ID NO: 3549189 - RNA, 16 nt, Human
uuucuguguguuccug

SEQ ID NO: 3549190 - RNA, 18 nt, Human
uuucuguguguuccuggc

SEQ ID NO: 3549191 - RNA, 9 nt, Human
uuucuguuc

SEQ ID NO: 3549192 - RNA, 22 nt, Human
uuucuguucagcguuuugcaag

SEQ ID NO: 3549193 - RNA, 12 nt, Human
uuucuguuccaa

SEQ ID NO: 3549194 - RNA, 22 nt, Human
uuucuguuccaaauucaguuuc

SEQ ID NO: 3549195 - RNA, 15 nt, Human
uuucuguucugugga

SEQ ID NO: 3549196 - RNA, 17 nt, Human
uuucuguucuguggaaa

SEQ ID NO: 3549197 - RNA, 19 nt, Human
uuucuguucuguggaaagu

SEQ ID NO: 3549198 - RNA, 22 nt, Human
uuucuguucuguggaaagugua

SEQ ID NO: 3549199 - RNA, 14 nt, Human
uuucuguuguaacu

SEQ ID NO: 3549200 - RNA, 17 nt, Human
uuucuguuguaacuuau

SEQ ID NO: 3549201 - RNA, 19 nt, Human
uuucuguuguaacuuaugu

SEQ ID NO: 3549202 - RNA, 13 nt, Human
uuucuguuucuca

SEQ ID NO: 3549203 - RNA, 12 nt, Human
uuucuguuuucu

SEQ ID NO: 3549204 - RNA, 21 nt, Human
uuucuuaaagugccaguauuu

SEQ ID NO: 3549205 - RNA, 18 nt, Human
uuucuuaaauaagaaacu

SEQ ID NO: 3549206 - RNA, 17 nt, Human
uuucuuaaccaguugug

SEQ ID NO: 3549207 - RNA, 14 nt, Human
uuucuuaaccaucu

SEQ ID NO: 3549208 - RNA, 13 nt, Human
uuucuuaacuucu

SEQ ID NO: 3549209 - RNA, 17 nt, Human
uuucuuaacuucuugcu

SEQ ID NO: 3549210 - RNA, 18 nt, Human
uuucuuaacuucuugcuu

SEQ ID NO: 3549211 - RNA, 16 nt, Human
uuucuuaaggugaggc

SEQ ID NO: 3549212 - RNA, 20 nt, Human
uuucuuaauauauagcauuu

SEQ ID NO: 3549213 - RNA, 14 nt, Human
uuucuuaauuugga

SEQ ID NO: 3549214 - RNA, 17 nt, Human
uuucuuacauaauuuuu

SEQ ID NO: 3549215 - RNA, 18 nt, Human
uuucuuacccaauuuccc

SEQ ID NO: 3549216 - RNA, 20 nt, Human
uuucuuagcuuuuuaauugu

SEQ ID NO: 3549217 - RNA, 17 nt, Human
uuucuuauuucauuucu

SEQ ID NO: 3549218 - RNA, 12 nt, Human
uuucuucaaaau

SEQ ID NO: 3549219 - RNA, 22 nt, Human
uuucuucaaaauauaaaaugcc

SEQ ID NO: 3549220 - RNA, 17 nt, Human
uuucuucacugcaacau

SEQ ID NO: 3549221 - RNA, 19 nt, Human
uuucuucacugcaacauga

SEQ ID NO: 3549222 - RNA, 22 nt, Human
uuucuucacugcaacaugauga

SEQ ID NO: 3549223 - RNA, 21 nt, Human
uuucuucacuguugaaaauua

SEQ ID NO: 3549224 - RNA, 20 nt, Human
ucaggcuacugcuucaaucu

SEQ ID NO: 3549225 - RNA, 17 nt, Human
ucaggcuagauguaugu

SEQ ID NO: 3549226 - RNA, 14 nt, Human
ucaggcucugcccu

SEQ ID NO: 3549227 - RNA, 15 nt, Human
ucaggcucugccuca

SEQ ID NO: 3549228 - RNA, 15 nt, Human
ucaggcucuucuccu

SEQ ID NO: 3549229 - RNA, 15 nt, Human
ucaggcugaaaacaa

SEQ ID NO: 3549230 - RNA, 13 nt, Human
ucaggcugccuga

SEQ ID NO: 3549231 - RNA, 15 nt, Human
ucaggcugccugagu

SEQ ID NO: 3549232 - RNA, 13 nt, Human
ucaggcugcuggc

SEQ ID NO: 3549233 - RNA, 21 nt, Human
ucaggcugcuggcgccucugc

SEQ ID NO: 3549234 - RNA, 24 nt, Human
ucaggcugcuggggccucagacga

SEQ ID NO: 3549235 - RNA, 15 nt, Human
ucaggcugcuuggga

SEQ ID NO: 3549236 - RNA, 14 nt, Human
ucaggcugguggga

SEQ ID NO: 3549237 - RNA, 16 nt, Human
ucaggcuggugggagg

SEQ ID NO: 3549238 - RNA, 16 nt, Human
ucaggcuugaaaugca

SEQ ID NO: 3549239 - RNA, 16 nt, Human
ucagggaaaagcagcu

SEQ ID NO: 3549240 - RNA, 18 nt, Human
ucagggaaaagcagcucu

SEQ ID NO: 3549241 - RNA, 23 nt, Human
ucagggaaaagcagcucuccccu

SEQ ID NO: 3549242 - RNA, 21 nt, Human
ucagggaaacuaagauucuuu

SEQ ID NO: 3549243 - RNA, 22 nt, Human
ucagggaaagcauuuaaagggu

SEQ ID NO: 3549244 - RNA, 16 nt, Human
ucagggaaaggccagu

SEQ ID NO: 3549245 - RNA, 20 nt, Human
ucagggaagauaaguuggaa

SEQ ID NO: 3549246 - RNA, 20 nt, Human
ucagggaagcccagcuccag

SEQ ID NO: 3549247 - RNA, 19 nt, Human
ucagggaaggaggagccug

SEQ ID NO: 3549248 - RNA, 22 nt, Human
ucagggaaggaggagccugucc

SEQ ID NO: 3549249 - RNA, 22 nt, Human
ucagggaauuucaggaacuaga

SEQ ID NO: 3549250 - RNA, 21 nt, Human
ucagggacagagacaccugca

SEQ ID NO: 3549251 - RNA, 23 nt, Human
ucagggacagagacaccugcacc

SEQ ID NO: 3549252 - RNA, 23 nt, Human
ucagggaccaaggaccccucacc

SEQ ID NO: 3549253 - RNA, 13 nt, Human
ucagggaccacag

SEQ ID NO: 3549254 - RNA, 14 nt, Human
ucagggaccacagc

SEQ ID NO: 3549255 - RNA, 15 nt, Human
ucagggaccacagca

SEQ ID NO: 3549256 - RNA, 17 nt, Human
ucagggaccaccagagg

SEQ ID NO: 3549257 - RNA, 14 nt, Human
ucagggaccccugc

SEQ ID NO: 3549258 - RNA, 16 nt, Human
ucagggaccccugccc

SEQ ID NO: 3549259 - RNA, 19 nt, Human
ucagggaggcccugugccc

SEQ ID NO: 3549260 - RNA, 15 nt, Human
ucagggaggucauuu

SEQ ID NO: 3549261 - RNA, 19 nt, Human
ucagggagugcuggcucac

SEQ ID NO: 3549262 - RNA, 21 nt, Human
ucagggauggccguuggccac

SEQ ID NO: 3549263 - RNA, 15 nt, Human
ucagggcaaagccag

SEQ ID NO: 3549264 - RNA, 20 nt, Human
ucagggcaaagccagguccc

SEQ ID NO: 3549265 - RNA, 22 nt, Human
ucagggcacugcugcugccuuu

SEQ ID NO: 3549266 - RNA, 17 nt, Human
ucagggccaugccugcc

SEQ ID NO: 3549267 - RNA, 14 nt, Human
ucagggccaugcug

SEQ ID NO: 3549268 - RNA, 12 nt, Human
ucagggcccaga

SEQ ID NO: 3549269 - RNA, 19 nt, Human
ucagggcccagaggcugag

SEQ ID NO: 3549270 - RNA, 14 nt, Human
ucagggccccagca

SEQ ID NO: 3549271 - RNA, 16 nt, Human
ucagggccccagcacu

SEQ ID NO: 3549272 - RNA, 23 nt, Human
ucagggccccagcacuaaagcag

SEQ ID NO: 3549273 - RNA, 16 nt, Human
ucagggccuggcucag

SEQ ID NO: 3549274 - RNA, 18 nt, Human
ucagggccuggggccuga

SEQ ID NO: 3549275 - RNA, 22 nt, Human
ucagggccuggggccugagaga

SEQ ID NO: 3549276 - RNA, 15 nt, Human
ucagggccugguuga

SEQ ID NO: 3549277 - RNA, 14 nt, Human
ucagggcucccagg

SEQ ID NO: 3549278 - RNA, 14 nt, Human
ucagggcuccugcc

SEQ ID NO: 3549279 - RNA, 22 nt, Human
ucagggcugacacguccacccc

SEQ ID NO: 3549280 - RNA, 16 nt, Human
ucagggcuucuaguuu

SEQ ID NO: 3549281 - RNA, 17 nt, Human
ucaggggaaaacuguua

SEQ ID NO: 3549282 - RNA, 16 nt, Human
ucaggggagucccguc

SEQ ID NO: 3549283 - RNA, 14 nt, Human
ucaggggccagagg

SEQ ID NO: 3549284 - RNA, 14 nt, Human
ucaggggcugcccg

SEQ ID NO: 3549285 - RNA, 21 nt, Human
ucaggggcugcccgcucccag

SEQ ID NO: 3549286 - RNA, 23 nt, Human
ucaggggucgucaccaccucucc

SEQ ID NO: 3549287 - RNA, 14 nt, Human
ucaggggugacaca

SEQ ID NO: 3549288 - RNA, 12 nt, Human
ucaggggugugc

SEQ ID NO: 3549289 - RNA, 15 nt, Human
ucagggucauagcau

SEQ ID NO: 3549290 - RNA, 17 nt, Human
ucagggucucugcugcc

SEQ ID NO: 3549291 - RNA, 23 nt, Human
ucaggguggucucuucuuggggc

SEQ ID NO: 3549292 - RNA, 16 nt, Human
ucagggugucccagac

SEQ ID NO: 3549293 - RNA, 15 nt, Human
ucagguaauacaaac

SEQ ID NO: 3549294 - RNA, 21 nt, Human
ucagguaaucgaccugccucg

SEQ ID NO: 3549295 - RNA, 14 nt, Human
ucagguacuuguaa

SEQ ID NO: 3549296 - RNA, 13 nt, Human
ucagguagcugcc

SEQ ID NO: 3549297 - RNA, 15 nt, Human
ucagguauaccucac

SEQ ID NO: 3549298 - RNA, 17 nt, Human
ucagguauaccucacuu

SEQ ID NO: 3549299 - RNA, 16 nt, Human
ucagguauguugccuu

SEQ ID NO: 3549300 - RNA, 17 nt, Human
ucagguauuaagaaaau

SEQ ID NO: 3549301 - RNA, 18 nt, Human
ucaggucacauaaaacuu

SEQ ID NO: 3549302 - RNA, 16 nt, Human
ucaggucaggaguucg

SEQ ID NO: 3549303 - RNA, 14 nt, Human
ucagguccugcuca

SEQ ID NO: 3549304 - RNA, 13 nt, Human
ucaggugaaaaug

SEQ ID NO: 3549305 - RNA, 16 nt, Human
ucaggugagaagcaga

SEQ ID NO: 3549306 - RNA, 15 nt, Human
ucaggugcagaggaa

SEQ ID NO: 3549307 - RNA, 23 nt, Human
ucaggugccucaagagaaggcaa

SEQ ID NO: 3549308 - RNA, 13 nt, Human
ucaggugcugcca

SEQ ID NO: 3549309 - RNA, 15 nt, Human
ucaggugcugccauc

SEQ ID NO: 3549310 - RNA, 18 nt, Human
ucaggugcugccauccag

SEQ ID NO: 3549311 - RNA, 23 nt, Human
ucaggugcuggggccugguuccc

SEQ ID NO: 3549312 - RNA, 13 nt, Human
ucaggugcugucc

SEQ ID NO: 3549313 - RNA, 13 nt, Human
ucagguggccaug

SEQ ID NO: 3549314 - RNA, 17 nt, Human
ucaggugggcgugguca

SEQ ID NO: 3549315 - RNA, 14 nt, Human
ucagguggggcagc

SEQ ID NO: 3549316 - RNA, 17 nt, Human
ucagguggggcagcuug

SEQ ID NO: 3549317 - RNA, 17 nt, Human
ucagguggggucacucu

SEQ ID NO: 3549318 - RNA, 22 nt, Human
ucagguggggucacucuggcag

SEQ ID NO: 3549319 - RNA, 22 nt, Human
ucaggugucccugcacuugcag

SEQ ID NO: 3549320 - RNA, 23 nt, Human
ucagguuaggcaguauaaagaau

SEQ ID NO: 3549321 - RNA, 15 nt, Human
ucagguuauacuccu

SEQ ID NO: 3549322 - RNA, 18 nt, Human
ucagguuaucgaaauaac

SEQ ID NO: 3549323 - RNA, 19 nt, Human
ucagguuaucgaaauaaca

SEQ ID NO: 3549324 - RNA, 20 nt, Human
ucagguuaucgaaauaacaa

SEQ ID NO: 3549325 - RNA, 21 nt, Human
ucagguuaucgaaauaacaau

SEQ ID NO: 3549326 - RNA, 14 nt, Human
ucagguuccauccc

SEQ ID NO: 3549327 - RNA, 17 nt, Human
ucagguugacaggaggu

SEQ ID NO: 3549328 - RNA, 19 nt, Human
ucagguugcugguugcugu

SEQ ID NO: 3549329 - RNA, 20 nt, Human
ucagguugcugguugcugug

SEQ ID NO: 3549330 - RNA, 23 nt, Human
ucagguugcugguugcugugugg

SEQ ID NO: 3549331 - RNA, 20 nt, Human
ucagguuguaguaaagaaau

SEQ ID NO: 3549332 - RNA, 19 nt, Human
ucagguuuaacauuugccu

SEQ ID NO: 3549333 - RNA, 23 nt, Human
ucagguuuaacauuugccuugca

SEQ ID NO: 3549334 - RNA, 18 nt, Human
ucagguuugccugagggc

SEQ ID NO: 3549335 - RNA, 15 nt, Human
ucaguaaacacugug

SEQ ID NO: 3549336 - RNA, 18 nt, Human
ucaguaaauaacuggaaa

SEQ ID NO: 3549337 - RNA, 17 nt, Human
ucaguaagaaaaagaag

SEQ ID NO: 3549338 - RNA, 19 nt, Human
ucaguaagaaaaagaagaa

SEQ ID NO: 3549339 - RNA, 13 nt, Human
ucaguaagccgug

SEQ ID NO: 3549340 - RNA, 17 nt, Human
ucaguaaguaucuggag

SEQ ID NO: 3549341 - RNA, 13 nt, Human
ucaguaauaacuc

SEQ ID NO: 3549342 - RNA, 14 nt, Human
ucaguaauauuuau

SEQ ID NO: 3549343 - RNA, 18 nt, Human
ucaguaauuuguuuaaaa

SEQ ID NO: 3549344 - RNA, 16 nt, Human
ucaguaccuggaggag

SEQ ID NO: 3549345 - RNA, 15 nt, Human
ucaguacuuguuucu

SEQ ID NO: 3549346 - RNA, 14 nt, Human
ucaguacuuuuuua

SEQ ID NO: 3549347 - RNA, 23 nt, Human
ucaguagaaacucuacauaauuu

SEQ ID NO: 3549348 - RNA, 17 nt, Human
ucaguagauugcagaaa

SEQ ID NO: 3549349 - RNA, 17 nt, Human
ucaguagcuuaagaaaa

SEQ ID NO: 3549350 - RNA, 19 nt, Human
ucaguagcuuaagaaaaaa

SEQ ID NO: 3549351 - RNA, 13 nt, Human
ucaguaggcuaau

SEQ ID NO: 3549352 - RNA, 13 nt, Human
ucaguagucagac

SEQ ID NO: 3549353 - RNA, 22 nt, Human
ucaguaguuugcauuucagaaa

SEQ ID NO: 3549354 - RNA, 15 nt, Human
ucaguauaauuuuuu

SEQ ID NO: 3549355 - RNA, 20 nt, Human
ucaguauccaugcucuugac

SEQ ID NO: 3549356 - RNA, 20 nt, Human
ucaguaucuguaucucucuc

SEQ ID NO: 3549357 - RNA, 13 nt, Human
ucaguaugaauua

SEQ ID NO: 3549358 - RNA, 16 nt, Human
ucaguauguggaagug

SEQ ID NO: 3549359 - RNA, 18 nt, Human
ucaguauguugucaaaga

SEQ ID NO: 3549360 - RNA, 20 nt, Human
ucaguauguuuuacacugua

SEQ ID NO: 3549361 - RNA, 22 nt, Human
ucaguauuaaaggggggagggg

SEQ ID NO: 3549362 - RNA, 20 nt, Human
ucaguauuagaugcacuuaa

SEQ ID NO: 3549363 - RNA, 15 nt, Human
ucaguauuauaugua

SEQ ID NO: 3549364 - RNA, 15 nt, Human
ucaguauugaagcau

SEQ ID NO: 3549365 - RNA, 16 nt, Human
ucaguauugaagcauu

SEQ ID NO: 3549366 - RNA, 17 nt, Human
ucaguauugaagcauuu

SEQ ID NO: 3549367 - RNA, 22 nt, Human
ucaguauugaagcauuuuauaa

SEQ ID NO: 3549368 - RNA, 23 nt, Human
ucaguauugaagcauuuuauaaa

SEQ ID NO: 3549369 - RNA, 15 nt, Human
ucaguauuguuuugg

SEQ ID NO: 3549370 - RNA, 22 nt, Human
ucaguauuguuuugguuugcua

SEQ ID NO: 3549371 - RNA, 19 nt, Human
ucaguauuuuggagaaauu

SEQ ID NO: 3549372 - RNA, 15 nt, Human
ucagucaaaacuuua

SEQ ID NO: 3549373 - RNA, 16 nt, Human
ucagucaaaacuuuaa

SEQ ID NO: 3549374 - RNA, 15 nt, Human
uuucuucauccaacu

SEQ ID NO: 3549375 - RNA, 23 nt, Human
uuucuuccuaccaagucaaacuu

SEQ ID NO: 3549376 - RNA, 13 nt, Human
uuucuuccucugc

SEQ ID NO: 3549377 - RNA, 14 nt, Human
uuucuuccucugcu

SEQ ID NO: 3549378 - RNA, 17 nt, Human
uuucuucuauugccucu

SEQ ID NO: 3549379 - RNA, 19 nt, Human
uuucuucuauugccucuga

SEQ ID NO: 3549380 - RNA, 12 nt, Human
uuucuucuuccc

SEQ ID NO: 3549381 - RNA, 14 nt, Human
uuucuugauaauuu

SEQ ID NO: 3549382 - RNA, 12 nt, Human
uuucuugccucu

SEQ ID NO: 3549383 - RNA, 18 nt, Human
uuucuugccucugucccc

SEQ ID NO: 3549384 - RNA, 21 nt, Human
uuucuugccucuguccccuuc

SEQ ID NO: 3549385 - RNA, 18 nt, Human
uuucuugcucccugacug

SEQ ID NO: 3549386 - RNA, 14 nt, Human
uuucuugcuuguac

SEQ ID NO: 3549387 - RNA, 22 nt, Human
uuucuugcuuguaccucuggcu

SEQ ID NO: 3549388 - RNA, 23 nt, Human
uuucuuggacacuuaauucuguu

SEQ ID NO: 3549389 - RNA, 19 nt, Human
uuucuugguucauaaauga

SEQ ID NO: 3549390 - RNA, 23 nt, Human
uuucuugguucauaaaugaauuu

SEQ ID NO: 3549391 - RNA, 13 nt, Human
uuucuugucuaua

SEQ ID NO: 3549392 - RNA, 23 nt, Human
uuucuuguuuaucagcaguuguu

SEQ ID NO: 3549393 - RNA, 13 nt, Human
uuucuuuaaaaga

SEQ ID NO: 3549394 - RNA, 20 nt, Human
uuucuuuaagauaauaguuu

SEQ ID NO: 3549395 - RNA, 15 nt, Human
uuucuuuagagaacu

SEQ ID NO: 3549396 - RNA, 20 nt, Human
uuucuuuagagcauugccau

SEQ ID NO: 3549397 - RNA, 14 nt, Human
uuucuuucaaaauu

SEQ ID NO: 3549398 - RNA, 19 nt, Human
uuucuuucaacuugcaucc

SEQ ID NO: 3549399 - RNA, 18 nt, Human
uuucuuuccuccuuuccu

SEQ ID NO: 3549400 - RNA, 13 nt, Human
uuucuuucuagug

SEQ ID NO: 3549401 - RNA, 11 nt, Human
uuucuuugaaa

SEQ ID NO: 3549402 - RNA, 20 nt, Human
uuucuuugaaaaaaaauaaa

SEQ ID NO: 3549403 - RNA, 21 nt, Human
uuucuuugaaaaaaaauaaau

SEQ ID NO: 3549404 - RNA, 14 nt, Human
uuucuuugaauaaa

SEQ ID NO: 3549405 - RNA, 16 nt, Human
uuucuuugaaugcuuu

SEQ ID NO: 3549406 - RNA, 17 nt, Human
uuucuuugaauuuucau

SEQ ID NO: 3549407 - RNA, 16 nt, Human
uuucuuuggugccuuu

SEQ ID NO: 3549408 - RNA, 17 nt, Human
uuucuuuggugccuuuc

SEQ ID NO: 3549409 - RNA, 16 nt, Human
uuucuuuguuaucaaa

SEQ ID NO: 3549410 - RNA, 19 nt, Human
uuucuuuguuucuuucuuu

SEQ ID NO: 3549411 - RNA, 14 nt, Human
uuucuuuucacaua

SEQ ID NO: 3549412 - RNA, 21 nt, Human
uuucuuuucuacccuagccau

SEQ ID NO: 3549413 - RNA, 13 nt, Human
uuucuuuucuuug

SEQ ID NO: 3549414 - RNA, 22 nt, Human
uuucuuuugcccuucacagugu

SEQ ID NO: 3549415 - RNA, 14 nt, Human
uuucuuuuguuacu

SEQ ID NO: 3549416 - RNA, 16 nt, Human
uuucuuuuguuacugu

SEQ ID NO: 3549417 - RNA, 17 nt, Human
uuucuuuuguuacuguu

SEQ ID NO: 3549418 - RNA, 20 nt, Human
uuucuuuuguuuuuugaagu

SEQ ID NO: 3549419 - RNA, 23 nt, Human
uuucuuuuuacccauuuguucau

SEQ ID NO: 3549420 - RNA, 14 nt, Human
uuucuuuuucuucu

SEQ ID NO: 3549421 - RNA, 17 nt, Human
uuucuuuuuuuuuaagu

SEQ ID NO: 3549422 - RNA, 21 nt, Human
uuugaaaaaagcucauuucau

SEQ ID NO: 3549423 - RNA, 20 nt, Human
uuugaaaaagaaaacacuua

SEQ ID NO: 3549424 - RNA, 20 nt, Human
uuugaaaaagcgaaaaaauc

SEQ ID NO: 3549425 - RNA, 23 nt, Human
uuugaaaagcaauauuguauauu

SEQ ID NO: 3549426 - RNA, 13 nt, Human
uuugaaaagcaga

SEQ ID NO: 3549427 - RNA, 13 nt, Human
uuugaaaagcuuc

SEQ ID NO: 3549428 - RNA, 16 nt, Human
uuugaaaagcuucuua

SEQ ID NO: 3549429 - RNA, 11 nt, Human
uuugaaaagua

SEQ ID NO: 3549430 - RNA, 17 nt, Human
uuugaaaaguaauauuu

SEQ ID NO: 3549431 - RNA, 22 nt, Human
uuugaaaaguaauauuuauuaa

SEQ ID NO: 3549432 - RNA, 11 nt, Human
uuugaaaauag

SEQ ID NO: 3549433 - RNA, 24 nt, Human
uuugaaacaacuuucucuuguaaa

SEQ ID NO: 3549434 - RNA, 12 nt, Human
uuugaaacauug

SEQ ID NO: 3549435 - RNA, 20 nt, Human
uuugaaagccccagaaauca

SEQ ID NO: 3549436 - RNA, 18 nt, Human
uuugaaagugccuuugca

SEQ ID NO: 3549437 - RNA, 12 nt, Human
uuugaaauaagc

SEQ ID NO: 3549438 - RNA, 15 nt, Human
uuugaaauaccucau

SEQ ID NO: 3549439 - RNA, 20 nt, Human
uuugaaauaccucauguuua

SEQ ID NO: 3549440 - RNA, 19 nt, Human
uuugaaauagucuguguga

SEQ ID NO: 3549441 - RNA, 22 nt, Human
uuugaaauauauggucuaaugu

SEQ ID NO: 3549442 - RNA, 15 nt, Human
uuugaaaucaguaaa

SEQ ID NO: 3549443 - RNA, 14 nt, Human
uuugaaaugaaauu

SEQ ID NO: 3549444 - RNA, 16 nt, Human
uuugaaaugaaauuua

SEQ ID NO: 3549445 - RNA, 12 nt, Human
uuugaaaugcug

SEQ ID NO: 3549446 - RNA, 20 nt, Human
uuugaaaugcugaaaauugc

SEQ ID NO: 3549447 - RNA, 13 nt, Human
uuugaaauggaaa

SEQ ID NO: 3549448 - RNA, 18 nt, Human
uuugaaauuaaccucuca

SEQ ID NO: 3549449 - RNA, 16 nt, Human
uuugaaauuauguaaa

SEQ ID NO: 3549450 - RNA, 20 nt, Human
uuugaaauucugaauuugca

SEQ ID NO: 3549451 - RNA, 22 nt, Human
uuugaaauucugaauuugcaaa

SEQ ID NO: 3549452 - RNA, 22 nt, Human
uuugaaauuguuccuuggagaa

SEQ ID NO: 3549453 - RNA, 23 nt, Human
uuugaacacuggcuaaagauaau

SEQ ID NO: 3549454 - RNA, 17 nt, Human
uuugaacuaagaaacuu

SEQ ID NO: 3549455 - RNA, 19 nt, Human
uuugaacuaagaaacuuuu

SEQ ID NO: 3549456 - RNA, 16 nt, Human
uuugaacucagaucug

SEQ ID NO: 3549457 - RNA, 21 nt, Human
uuugaacucagaucugucuga

SEQ ID NO: 3549458 - RNA, 17 nt, Human
uuugaacugauaaagau

SEQ ID NO: 3549459 - RNA, 21 nt, Human
uuugaagaagguggaccuuuu

SEQ ID NO: 3549460 - RNA, 23 nt, Human
uuugaagacccgcuacaaaacgc

SEQ ID NO: 3549461 - RNA, 23 nt, Human
uuugaagacuucaaaauauugag

SEQ ID NO: 3549462 - RNA, 15 nt, Human
uuugaagaggaaaau

SEQ ID NO: 3549463 - RNA, 22 nt, Human
uuugaagaugccgcauuuggau

SEQ ID NO: 3549464 - RNA, 16 nt, Human
uuugaagauucuaugu

SEQ ID NO: 3549465 - RNA, 16 nt, Human
uuugaagcaguugugu

SEQ ID NO: 3549466 - RNA, 15 nt, Human
uuugaagccugcccu

SEQ ID NO: 3549467 - RNA, 23 nt, Human
uuugaagcuaauuauuuuaauua

SEQ ID NO: 3549468 - RNA, 21 nt, Human
uuugaaggaauacaauauaua

SEQ ID NO: 3549469 - RNA, 19 nt, Human
uuugaaggaggugagggau

SEQ ID NO: 3549470 - RNA, 14 nt, Human
uuugaagucuugua

SEQ ID NO: 3549471 - RNA, 20 nt, Human
uuugaagugcuguuuauuaa

SEQ ID NO: 3549472 - RNA, 11 nt, Human
uuugaagugua

SEQ ID NO: 3549473 - RNA, 20 nt, Human
uuugaaguguaccuguguac

SEQ ID NO: 3549474 - RNA, 23 nt, Human
uuugaaguuagcuuuaacuuaaa

SEQ ID NO: 3549475 - RNA, 15 nt, Human
uuugaaguuuacauu

SEQ ID NO: 3549476 - RNA, 16 nt, Human
uuugaaguuuacauuu

SEQ ID NO: 3549477 - RNA, 19 nt, Human
uuugaaguuuacauuuuua

SEQ ID NO: 3549478 - RNA, 16 nt, Human
uuugaauaaagaauac

SEQ ID NO: 3549479 - RNA, 15 nt, Human
uuugaauaaaugugu

SEQ ID NO: 3549480 - RNA, 19 nt, Human
uuugaaucaauaauauauu

SEQ ID NO: 3549481 - RNA, 12 nt, Human
uuugaaucuugu

SEQ ID NO: 3549482 - RNA, 16 nt, Human
uuugaaucuugucuca

SEQ ID NO: 3549483 - RNA, 18 nt, Human
uuugaaucuugucucaau

SEQ ID NO: 3549484 - RNA, 19 nt, Human
uuugaaucuuuaauuaaaa

SEQ ID NO: 3549485 - RNA, 13 nt, Human
uuugaaugaaaaa

SEQ ID NO: 3549486 - RNA, 18 nt, Human
uuugaaugcugcaaguua

SEQ ID NO: 3549487 - RNA, 11 nt, Human
uuugaauguua

SEQ ID NO: 3549488 - RNA, 12 nt, Human
uuugaauguuaa

SEQ ID NO: 3549489 - RNA, 13 nt, Human
uuugaauguuaaa

SEQ ID NO: 3549490 - RNA, 18 nt, Human
uuugaauguuaaauaaau

SEQ ID NO: 3549491 - RNA, 19 nt, Human
uuugaauguuaauuuuuug

SEQ ID NO: 3549492 - RNA, 20 nt, Human
uuugaauguuauuuguuauu

SEQ ID NO: 3549493 - RNA, 13 nt, Human
uuugaauuaaaac

SEQ ID NO: 3549494 - RNA, 15 nt, Human
uuugaauuaaaacuu

SEQ ID NO: 3549495 - RNA, 14 nt, Human
uuugaauuguuaca

SEQ ID NO: 3549496 - RNA, 15 nt, Human
uuugaauuguuacau

SEQ ID NO: 3549497 - RNA, 17 nt, Human
uuugaauuuuaaaucua

SEQ ID NO: 3549498 - RNA, 23 nt, Human
uuugaauuuucauuuuacaguua

SEQ ID NO: 3549499 - RNA, 23 nt, Human
uuugacaagcuggcuuacacugg

SEQ ID NO: 3549500 - RNA, 17 nt, Human
uuugacacuauaucugu

SEQ ID NO: 3549501 - RNA, 18 nt, Human
uuugacacuauaucugua

SEQ ID NO: 3549502 - RNA, 22 nt, Human
uuugacacugaaaguuuuguaa

SEQ ID NO: 3549503 - RNA, 19 nt, Human
uuugacagcgcacagcugc

SEQ ID NO: 3549504 - RNA, 13 nt, Human
uuugacaguguuu

SEQ ID NO: 3549505 - RNA, 19 nt, Human
uuugacaucagccagcugc

SEQ ID NO: 3549506 - RNA, 20 nt, Human
uuugacauugcguuugaccu

SEQ ID NO: 3549507 - RNA, 22 nt, Human
uuugacauuguauguaucuauu

SEQ ID NO: 3549508 - RNA, 23 nt, Human
uuugaccuguugggagugaggau

SEQ ID NO: 3549509 - RNA, 19 nt, Human
uuugacgggaaacaaaacu

SEQ ID NO: 3549510 - RNA, 17 nt, Human
uuugacuaauuuuacau

SEQ ID NO: 3549511 - RNA, 21 nt, Human
uuugacuaauuuuacauguuu

SEQ ID NO: 3549512 - RNA, 20 nt, Human
uuugacucuggcaaagcuuu

SEQ ID NO: 3549513 - RNA, 12 nt, Human
uuugacucuuuu

SEQ ID NO: 3549514 - RNA, 16 nt, Human
uuugacuguuuuuacc

SEQ ID NO: 3549515 - RNA, 15 nt, Human
uuugacuuuaauuua

SEQ ID NO: 3549516 - RNA, 14 nt, Human
uuugacuuucauug

SEQ ID NO: 3549517 - RNA, 18 nt, Human
uuugacuuucuucugaau

SEQ ID NO: 3549518 - RNA, 20 nt, Human
uuugagaaaugaaauauugu

SEQ ID NO: 3549519 - RNA, 13 nt, Human
uuugagacaggag

SEQ ID NO: 3549520 - RNA, 15 nt, Human
uuugagacaguuucu

SEQ ID NO: 3549521 - RNA, 17 nt, Human
uuugagacaguuucuua

SEQ ID NO: 3549522 - RNA, 18 nt, Human
uuugagacaguuucuuag

SEQ ID NO: 3549523 - RNA, 20 nt, Human
uuugagacaguuucuuagcu

SEQ ID NO: 3549524 - RNA, 20 nt, Human
ucacugggccaauucaauac

SEQ ID NO: 3549525 - RNA, 17 nt, Human
ucacugggguccugggg

SEQ ID NO: 3549526 - RNA, 17 nt, Human
ucacugguacucugcca

SEQ ID NO: 3549527 - RNA, 14 nt, Human
ucacuguauaaaua

SEQ ID NO: 3549528 - RNA, 15 nt, Human
ucacuguauaaauag

SEQ ID NO: 3549529 - RNA, 16 nt, Human
ucacuguauaaauagg

SEQ ID NO: 3549530 - RNA, 17 nt, Human
ucacuguauaaauagga

SEQ ID NO: 3549531 - RNA, 19 nt, Human
ucacuguauaaauaggaga

SEQ ID NO: 3549532 - RNA, 18 nt, Human
ucacuguaucauuuucuu

SEQ ID NO: 3549533 - RNA, 18 nt, Human
ucacugucaggaagaaau

SEQ ID NO: 3549534 - RNA, 20 nt, Human
ucacugucaggaagaaauca

SEQ ID NO: 3549535 - RNA, 19 nt, Human
ucacugucccuccuggugu

SEQ ID NO: 3549536 - RNA, 16 nt, Human
ucacuguccuccaagc

SEQ ID NO: 3549537 - RNA, 20 nt, Human
ucacugucugagaguuuagu

SEQ ID NO: 3549538 - RNA, 14 nt, Human
ucacugucugucug

SEQ ID NO: 3549539 - RNA, 15 nt, Human
ucacugucuuuccua

SEQ ID NO: 3549540 - RNA, 12 nt, Human
ucacugugauca

SEQ ID NO: 3549541 - RNA, 12 nt, Human
ucacuguggcug

SEQ ID NO: 3549542 - RNA, 18 nt, Human
ucacuguggcugucugga

SEQ ID NO: 3549543 - RNA, 17 nt, Human
ucacugugguccuaugc

SEQ ID NO: 3549544 - RNA, 15 nt, Human
ucacuguguacauaa

SEQ ID NO: 3549545 - RNA, 16 nt, Human
ucacuguguacauaau

SEQ ID NO: 3549546 - RNA, 17 nt, Human
ucacuguguacauaaug

SEQ ID NO: 3549547 - RNA, 12 nt, Human
ucacuguguaua

SEQ ID NO: 3549548 - RNA, 17 nt, Human
ucacuguguauauuuga

SEQ ID NO: 3549549 - RNA, 15 nt, Human
ucacuguguccaggu

SEQ ID NO: 3549550 - RNA, 23 nt, Human
ucacuguuagcuuuuuaaaacau

SEQ ID NO: 3549551 - RNA, 15 nt, Human
ucacuguucccucug

SEQ ID NO: 3549552 - RNA, 18 nt, Human
ucacuguugaaaauuauu

SEQ ID NO: 3549553 - RNA, 17 nt, Human
ucacuguugcccaggcu

SEQ ID NO: 3549554 - RNA, 18 nt, Human
ucacuguugcccaggcug

SEQ ID NO: 3549555 - RNA, 13 nt, Human
ucacuguuuagau

SEQ ID NO: 3549556 - RNA, 21 nt, Human
ucacuguuuagauuugccaua

SEQ ID NO: 3549557 - RNA, 14 nt, Human
ucacuguuucaucu

SEQ ID NO: 3549558 - RNA, 16 nt, Human
ucacuguuuguuuuua

SEQ ID NO: 3549559 - RNA, 14 nt, Human
ucacuguuuuuaga

SEQ ID NO: 3549560 - RNA, 15 nt, Human
ucacuuaaaacacgu

SEQ ID NO: 3549561 - RNA, 17 nt, Human
ucacuuaaauguuacca

SEQ ID NO: 3549562 - RNA, 22 nt, Human
ucacuuaaguuaguuccacuga

SEQ ID NO: 3549563 - RNA, 18 nt, Human
ucacuuacuauuguugcu

SEQ ID NO: 3549564 - RNA, 19 nt, Human
ucacuuacuguuucuguca

SEQ ID NO: 3549565 - RNA, 13 nt, Human
ucacuuagccaug

SEQ ID NO: 3549566 - RNA, 20 nt, Human
ucacuuauuuagauucacuu

SEQ ID NO: 3549567 - RNA, 12 nt, Human
ucacuucacugu

SEQ ID NO: 3549568 - RNA, 14 nt, Human
ucacuucacugugc

SEQ ID NO: 3549569 - RNA, 22 nt, Human
ucacuuccauacagcucuacgu

SEQ ID NO: 3549570 - RNA, 23 nt, Human
ucacuucgcgugcccucgcugcu

SEQ ID NO: 3549571 - RNA, 23 nt, Human
ucacuucgggcuguguaaacaca

SEQ ID NO: 3549572 - RNA, 13 nt, Human
ucacuucuaaaug

SEQ ID NO: 3549573 - RNA, 12 nt, Human
ucacuucuccca

SEQ ID NO: 3549574 - RNA, 17 nt, Human
ucacuucugaccacacu

SEQ ID NO: 3549575 - RNA, 12 nt, Human
uuuauuaaauuu

SEQ ID NO: 3549576 - RNA, 13 nt, Human
uuuauuaaauuug

SEQ ID NO: 3549577 - RNA, 21 nt, Human
uuuauuaaauuuguugacaaa

SEQ ID NO: 3549578 - RNA, 13 nt, Human
uuuauuaaauuuu

SEQ ID NO: 3549579 - RNA, 20 nt, Human
uuuauuaacuuaauaaucaa

SEQ ID NO: 3549580 - RNA, 22 nt, Human
uuuauuaagauggauucucaga

SEQ ID NO: 3549581 - RNA, 23 nt, Human
uuuauuaagauuauuuuauuaug

SEQ ID NO: 3549582 - RNA, 20 nt, Human
uuuauuaagcuuuuuggaau

SEQ ID NO: 3549583 - RNA, 15 nt, Human
uuuauuaaucacugu

SEQ ID NO: 3549584 - RNA, 18 nt, Human
uuuauuaauguuuucaaa

SEQ ID NO: 3549585 - RNA, 16 nt, Human
uuuauuaauuuauaug

SEQ ID NO: 3549586 - RNA, 23 nt, Human
uuuauuacaguauaauuaacaug

SEQ ID NO: 3549587 - RNA, 16 nt, Human
uuuauuacaucuuuca

SEQ ID NO: 3549588 - RNA, 12 nt, Human
uuuauuaccccc

SEQ ID NO: 3549589 - RNA, 23 nt, Human
uuuauuacccccuccuucagaca

SEQ ID NO: 3549590 - RNA, 15 nt, Human
uuuauuacccuucuu

SEQ ID NO: 3549591 - RNA, 20 nt, Human
uuuauuaccucugauaccuc

SEQ ID NO: 3549592 - RNA, 14 nt, Human
uuuauuacguaugu

SEQ ID NO: 3549593 - RNA, 15 nt, Human
uuuauuacuguuuau

SEQ ID NO: 3549594 - RNA, 14 nt, Human
uuuauuacuuauuu

SEQ ID NO: 3549595 - RNA, 16 nt, Human
uuuauuacuuccauga

SEQ ID NO: 3549596 - RNA, 20 nt, Human
uuuauuacuuccaugaauuu

SEQ ID NO: 3549597 - RNA, 20 nt, Human
uuuauuaguauuguuguccu

SEQ ID NO: 3549598 - RNA, 13 nt, Human
uuuauuauggcac

SEQ ID NO: 3549599 - RNA, 16 nt, Human
uuuauuauuacuguuu

SEQ ID NO: 3549600 - RNA, 23 nt, Human
uuuauuauuuauuuuuuuuaauu

SEQ ID NO: 3549601 - RNA, 17 nt, Human
uuuauucaagaaaagua

SEQ ID NO: 3549602 - RNA, 17 nt, Human
uuuauucagcuucauuu

SEQ ID NO: 3549603 - RNA, 16 nt, Human
uuuauuccuguauguu

SEQ ID NO: 3549604 - RNA, 14 nt, Human
uuuauuccuuguga

SEQ ID NO: 3549605 - RNA, 16 nt, Human
uuuauucuucuagagu

SEQ ID NO: 3549606 - RNA, 13 nt, Human
uuuauucuuguga

SEQ ID NO: 3549607 - RNA, 16 nt, Human
uuuauugacucuugag

SEQ ID NO: 3549608 - RNA, 18 nt, Human
uuuauugaugugcaaaaa

SEQ ID NO: 3549609 - RNA, 13 nt, Human
uuuauugcacaaa

SEQ ID NO: 3549610 - RNA, 21 nt, Human
uuuauugcacaaaauauaaag

SEQ ID NO: 3549611 - RNA, 24 nt, Human
uuuauugcaucuggguagcuguaa

SEQ ID NO: 3549612 - RNA, 12 nt, Human
uuuauugccuuc

SEQ ID NO: 3549613 - RNA, 17 nt, Human
uuuauugcuaguauuug

SEQ ID NO: 3549614 - RNA, 19 nt, Human
uuuauugcuaguauuugaa

SEQ ID NO: 3549615 - RNA, 13 nt, Human
uuuauugcuuguu

SEQ ID NO: 3549616 - RNA, 23 nt, Human
uuuauugguuuugcagaagaagg

SEQ ID NO: 3549617 - RNA, 21 nt, Human
uuuauuguguuugucauuagc

SEQ ID NO: 3549618 - RNA, 19 nt, Human
uuuauuguuaauacaaggu

SEQ ID NO: 3549619 - RNA, 14 nt, Human
uuuauuuaaaagau

SEQ ID NO: 3549620 - RNA, 22 nt, Human
uuuauuuaaaagauucauuuuu

SEQ ID NO: 3549621 - RNA, 19 nt, Human
uuuauuuaaauuacaauuu

SEQ ID NO: 3549622 - RNA, 14 nt, Human
uuuauuuacaaaug

SEQ ID NO: 3549623 - RNA, 20 nt, Human
uuuauuuacagaugaaugua

SEQ ID NO: 3549624 - RNA, 19 nt, Human
uuuauuuaguuccuugagu

SEQ ID NO: 3549625 - RNA, 17 nt, Human
uuuauuuauacacuguc

SEQ ID NO: 3549626 - RNA, 17 nt, Human
uuuauuuauauuuauug

SEQ ID NO: 3549627 - RNA, 14 nt, Human
uuuauuuaucagug

SEQ ID NO: 3549628 - RNA, 21 nt, Human
uuuauuuauccagaaaacugu

SEQ ID NO: 3549629 - RNA, 13 nt, Human
uuuauuuaugaag

SEQ ID NO: 3549630 - RNA, 14 nt, Human
uuuauuuauuuaca

SEQ ID NO: 3549631 - RNA, 19 nt, Human
uuuauuucagcaaacuugu

SEQ ID NO: 3549632 - RNA, 11 nt, Human
uuuauuucauu

SEQ ID NO: 3549633 - RNA, 20 nt, Human
uuuauuuccaauguuucaag

SEQ ID NO: 3549634 - RNA, 17 nt, Human
uuuauuuccuaugaugu

SEQ ID NO: 3549635 - RNA, 16 nt, Human
uuuauuucuacuguca

SEQ ID NO: 3549636 - RNA, 20 nt, Human
uuuauuugaacaaugaaguu

SEQ ID NO: 3549637 - RNA, 13 nt, Human
uuuauuugguucc

SEQ ID NO: 3549638 - RNA, 14 nt, Human
uuuauuuguuuuuc

SEQ ID NO: 3549639 - RNA, 20 nt, Human
uuuauuuuaaaauuucauag

SEQ ID NO: 3549640 - RNA, 16 nt, Human
uuuauuuuaauaaugu

SEQ ID NO: 3549641 - RNA, 18 nt, Human
uuuauuuuacacagaaac

SEQ ID NO: 3549642 - RNA, 21 nt, Human
uuuauuuuauauaauaaagua

SEQ ID NO: 3549643 - RNA, 15 nt, Human
uuuauuuuccuaaag

SEQ ID NO: 3549644 - RNA, 19 nt, Human
uuuauuuugaaaagcuucu

SEQ ID NO: 3549645 - RNA, 18 nt, Human
uuuauuuuguaauuauug

SEQ ID NO: 3549646 - RNA, 12 nt, Human
uuuauuuugugg

SEQ ID NO: 3549647 - RNA, 14 nt, Human
uuuauuuuguggga

SEQ ID NO: 3549648 - RNA, 15 nt, Human
uuuauuuuguguaaa

SEQ ID NO: 3549649 - RNA, 20 nt, Human
uuuauuuuguuaaaaucucu

SEQ ID NO: 3549650 - RNA, 17 nt, Human
uuuauuuuuaagaaaga

SEQ ID NO: 3549651 - RNA, 23 nt, Human
uuuauuuuuacaagaaguuuauu

SEQ ID NO: 3549652 - RNA, 19 nt, Human
uuuauuuuuagaauuuugu

SEQ ID NO: 3549653 - RNA, 15 nt, Human
uuuauuuuucauauu

SEQ ID NO: 3549654 - RNA, 16 nt, Human
uuuauuuuucauauug

SEQ ID NO: 3549655 - RNA, 17 nt, Human
uuuauuuuucauauugu

SEQ ID NO: 3549656 - RNA, 20 nt, Human
uuuauuuuucauauugugcc

SEQ ID NO: 3549657 - RNA, 17 nt, Human
uuuauuuuucauuuagu

SEQ ID NO: 3549658 - RNA, 22 nt, Human
uuuauuuuuccauuuacaacaa

SEQ ID NO: 3549659 - RNA, 17 nt, Human
uuuauuuuuuaaguauu

SEQ ID NO: 3549660 - RNA, 15 nt, Human
uuuauuuuuuacauu

SEQ ID NO: 3549661 - RNA, 14 nt, Human
uuuauuuuuuagug

SEQ ID NO: 3549662 - RNA, 17 nt, Human
uuuauuuuuuggacuuc

SEQ ID NO: 3549663 - RNA, 14 nt, Human
uuuauuuuuuucua

SEQ ID NO: 3549664 - RNA, 18 nt, Human
uuuauuuuuuuuaaagaa

SEQ ID NO: 3549665 - RNA, 16 nt, Human
uuucaaaaauauaacu

SEQ ID NO: 3549666 - RNA, 19 nt, Human
uuucaaaaaucugaagauu

SEQ ID NO: 3549667 - RNA, 24 nt, Human
uuucaaaaaucugaagauuguuua

SEQ ID NO: 3549668 - RNA, 15 nt, Human
uuucaaaaauuugga

SEQ ID NO: 3549669 - RNA, 13 nt, Human
uuucaaaaccagg

SEQ ID NO: 3549670 - RNA, 21 nt, Human
uuucaaaaccagguccaauga

SEQ ID NO: 3549671 - RNA, 18 nt, Human
uuucaaaaccuuuugaaa

SEQ ID NO: 3549672 - RNA, 20 nt, Human
uuucaaaacucauuuccuau

SEQ ID NO: 3549673 - RNA, 12 nt, Human
uuucaaaagaca

SEQ ID NO: 3549674 - RNA, 21 nt, Human
uuucaaaauagaaaaguuauu

SEQ ID NO: 3549675 - RNA, 16 nt, Human
uuucaaacacaaaugc

SEQ ID NO: 3549676 - RNA, 24 nt, Human
uuucaaaccaguauacaagauaag

SEQ ID NO: 3549677 - RNA, 20 nt, Human
uuucaaacuccugacuuugu

SEQ ID NO: 3549678 - RNA, 14 nt, Human
uuucaaacuguaaa

SEQ ID NO: 3549679 - RNA, 22 nt, Human
uuucaaacuuacuauuuugaca

SEQ ID NO: 3549680 - RNA, 12 nt, Human
uuucaaacuuua

SEQ ID NO: 3549681 - RNA, 16 nt, Human
uuucaaacuuuacuau

SEQ ID NO: 3549682 - RNA, 14 nt, Human
uuucaaacuuugga

SEQ ID NO: 3549683 - RNA, 13 nt, Human
uuucaaagaugcu

SEQ ID NO: 3549684 - RNA, 17 nt, Human
uuucaaagcuuuuucca

SEQ ID NO: 3549685 - RNA, 12 nt, Human
uuucaaaguuuu

SEQ ID NO: 3549686 - RNA, 14 nt, Human
uuucaaaugugcug

SEQ ID NO: 3549687 - RNA, 21 nt, Human
uuucaaauuggacuuucaaaa

SEQ ID NO: 3549688 - RNA, 16 nt, Human
ucagucacacacacau

SEQ ID NO: 3549689 - RNA, 13 nt, Human
ucagucacagcca

SEQ ID NO: 3549690 - RNA, 15 nt, Human
ucagucacagccacc

SEQ ID NO: 3549691 - RNA, 17 nt, Human
ucagucacauggcaugg

SEQ ID NO: 3549692 - RNA, 17 nt, Human
ucagucagaaaacuuua

SEQ ID NO: 3549693 - RNA, 14 nt, Human
ucagucaugcauaa

SEQ ID NO: 3549694 - RNA, 16 nt, Human
ucagucaugcauaaau

SEQ ID NO: 3549695 - RNA, 17 nt, Human
ucagucaugcauaaaua

SEQ ID NO: 3549696 - RNA, 14 nt, Human
ucagucauguguaa

SEQ ID NO: 3549697 - RNA, 21 nt, Human
ucagucauuagacuccuccuc

SEQ ID NO: 3549698 - RNA, 18 nt, Human
ucaguccccgugaaggag

SEQ ID NO: 3549699 - RNA, 14 nt, Human
ucaguccccuccca

SEQ ID NO: 3549700 - RNA, 18 nt, Human
ucagucccuuccccaugc

SEQ ID NO: 3549701 - RNA, 13 nt, Human
ucaguccuccccu

SEQ ID NO: 3549702 - RNA, 17 nt, Human
ucaguccuccccucaca

SEQ ID NO: 3549703 - RNA, 18 nt, Human
ucaguccuccccucacag

SEQ ID NO: 3549704 - RNA, 21 nt, Human
ucaguccuccccucacagccu

SEQ ID NO: 3549705 - RNA, 15 nt, Human
ucaguccuuugauca

SEQ ID NO: 3549706 - RNA, 16 nt, Human
ucagucuauccacaga

SEQ ID NO: 3549707 - RNA, 19 nt, Human
ucagucucagaaugucauu

SEQ ID NO: 3549708 - RNA, 23 nt, Human
ucagucucccuucucccaugagg

SEQ ID NO: 3549709 - RNA, 20 nt, Human
ucagucucccuuucccuucu

SEQ ID NO: 3549710 - RNA, 23 nt, Human
ucagucucuauaccaauaaagug

SEQ ID NO: 3549711 - RNA, 15 nt, Human
ucagucucugagcag

SEQ ID NO: 3549712 - RNA, 20 nt, Human
ucagucucugagcagugaau

SEQ ID NO: 3549713 - RNA, 17 nt, Human
ucagucugauucccaag

SEQ ID NO: 3549714 - RNA, 22 nt, Human
ucagucugauucccaagcucug

SEQ ID NO: 3549715 - RNA, 17 nt, Human
ucagucugcacuuaaau

SEQ ID NO: 3549716 - RNA, 20 nt, Human
ucagucugcacuuaaauauc

SEQ ID NO: 3549717 - RNA, 23 nt, Human
ucagucugcacuuaaauaucaau

SEQ ID NO: 3549718 - RNA, 15 nt, Human
ucagucuuuuucugu

SEQ ID NO: 3549719 - RNA, 20 nt, Human
ucagugaaguugcugcuucu

SEQ ID NO: 3549720 - RNA, 21 nt, Human
ucagugaauaugccuguaauu

SEQ ID NO: 3549721 - RNA, 18 nt, Human
ucagugacccuggcuccu

SEQ ID NO: 3549722 - RNA, 22 nt, Human
ucagugaccuacuacgcagagg

SEQ ID NO: 3549723 - RNA, 18 nt, Human
ucagugaggcccagggag

SEQ ID NO: 3549724 - RNA, 14 nt, Human
ucagugcaaagauu

SEQ ID NO: 3549725 - RNA, 16 nt, Human
ucagugccaaaaacaa

SEQ ID NO: 3549726 - RNA, 18 nt, Human
ucagugccaacuguggcu

SEQ ID NO: 3549727 - RNA, 19 nt, Human
ucagugccaacuguggcug

SEQ ID NO: 3549728 - RNA, 12 nt, Human
ucagugccacua

SEQ ID NO: 3549729 - RNA, 22 nt, Human
ucagugcccaccaacaucccau

SEQ ID NO: 3549730 - RNA, 14 nt, Human
ucagugcccuccag

SEQ ID NO: 3549731 - RNA, 20 nt, Human
ucagugccgccgccucgccc

SEQ ID NO: 3549732 - RNA, 14 nt, Human
ucagugccuuaugg

SEQ ID NO: 3549733 - RNA, 18 nt, Human
ucagugccuuauggaaca

SEQ ID NO: 3549734 - RNA, 19 nt, Human
ucagugccuuauggaacac

SEQ ID NO: 3549735 - RNA, 17 nt, Human
ucagugcuagcuuauuu

SEQ ID NO: 3549736 - RNA, 19 nt, Human
ucagugcucccucacaugu

SEQ ID NO: 3549737 - RNA, 18 nt, Human
ucagugcucgagacacag

SEQ ID NO: 3549738 - RNA, 13 nt, Human
ucagugcugccug

SEQ ID NO: 3549739 - RNA, 14 nt, Human
ucagugcugccugu

SEQ ID NO: 3549740 - RNA, 13 nt, Human
ucagugcugugcu

SEQ ID NO: 3549741 - RNA, 12 nt, Human
ucagugcugugg

SEQ ID NO: 3549742 - RNA, 14 nt, Human
ucagugcuguggcc

SEQ ID NO: 3549743 - RNA, 15 nt, Human
ucagugcuucgcaga

SEQ ID NO: 3549744 - RNA, 12 nt, Human
ucagugcuucuu

SEQ ID NO: 3549745 - RNA, 15 nt, Human
ucaguggauuuccca

SEQ ID NO: 3549746 - RNA, 16 nt, Human
ucaguggcagggcuca

SEQ ID NO: 3549747 - RNA, 20 nt, Human
ucaguggcauggcuccaguc

SEQ ID NO: 3549748 - RNA, 17 nt, Human
ucaguggcgagaaauaa

SEQ ID NO: 3549749 - RNA, 23 nt, Human
ucagugggaacgugacugcccca

SEQ ID NO: 3549750 - RNA, 12 nt, Human
ucagugggagaa

SEQ ID NO: 3549751 - RNA, 13 nt, Human
ucagugggagaaa

SEQ ID NO: 3549752 - RNA, 17 nt, Human
ucagugggcaggauaaa

SEQ ID NO: 3549753 - RNA, 19 nt, Human
ucagugggcaggauaaacu

SEQ ID NO: 3549754 - RNA, 19 nt, Human
ucaguggggcucucugagu

SEQ ID NO: 3549755 - RNA, 20 nt, Human
ucagugguuauuuagggaac

SEQ ID NO: 3549756 - RNA, 23 nt, Human
ucaguguaaauaguuacuccagu

SEQ ID NO: 3549757 - RNA, 16 nt, Human
ucaguguaagcccugc

SEQ ID NO: 3549758 - RNA, 14 nt, Human
ucaguguaauuucu

SEQ ID NO: 3549759 - RNA, 15 nt, Human
ucaguguaauuucuu

SEQ ID NO: 3549760 - RNA, 18 nt, Human
ucaguguacacucugagu

SEQ ID NO: 3549761 - RNA, 20 nt, Human
ucaguguacccccgcccagg

SEQ ID NO: 3549762 - RNA, 22 nt, Human
ucaguguacccccgcccaggcu

SEQ ID NO: 3549763 - RNA, 23 nt, Human
ucaguguacccccgcccaggcug

SEQ ID NO: 3549764 - RNA, 22 nt, Human
ucaguguagaaccuaauucaau

SEQ ID NO: 3549765 - RNA, 15 nt, Human
ucaguguaguuaauu

SEQ ID NO: 3549766 - RNA, 21 nt, Human
ucaguguauggaaauaaaugu

SEQ ID NO: 3549767 - RNA, 22 nt, Human
ucaguguauggaaauaaaugua

SEQ ID NO: 3549768 - RNA, 14 nt, Human
ucaguguauuugua

SEQ ID NO: 3549769 - RNA, 14 nt, Human
ucagugucaaauaa

SEQ ID NO: 3549770 - RNA, 17 nt, Human
ucagugucaaauaaaca

SEQ ID NO: 3549771 - RNA, 19 nt, Human
ucagugucaaauaaacacu

SEQ ID NO: 3549772 - RNA, 13 nt, Human
ucagugucucaca

SEQ ID NO: 3549773 - RNA, 21 nt, Human
ucagugucucacacuggcgua

SEQ ID NO: 3549774 - RNA, 17 nt, Human
ucagugugacugaucuc

SEQ ID NO: 3549775 - RNA, 13 nt, Human
ucagugugccccc

SEQ ID NO: 3549776 - RNA, 20 nt, Human
ucagugugccccccauccug

SEQ ID NO: 3549777 - RNA, 13 nt, Human
ucaguguuaaaaa

SEQ ID NO: 3549778 - RNA, 15 nt, Human
ucaguguuaaaugug

SEQ ID NO: 3549779 - RNA, 21 nt, Human
ucaguguuaaaugugaugaau

SEQ ID NO: 3549780 - RNA, 20 nt, Human
ucaguguucccuuuccuacu

SEQ ID NO: 3549781 - RNA, 15 nt, Human
ucaguguugagaugg

SEQ ID NO: 3549782 - RNA, 12 nt, Human
ucaguguuucau

SEQ ID NO: 3549783 - RNA, 15 nt, Human
ucaguguuuggugca

SEQ ID NO: 3549784 - RNA, 15 nt, Human
ucaguguuuuaaauu

SEQ ID NO: 3549785 - RNA, 17 nt, Human
ucaguguuuuaaauucu

SEQ ID NO: 3549786 - RNA, 15 nt, Human
ucaguguuuuggacu

SEQ ID NO: 3549787 - RNA, 17 nt, Human
ucaguguuuuugugaau

SEQ ID NO: 3549788 - RNA, 16 nt, Human
ucaguuaacuauugca

SEQ ID NO: 3549789 - RNA, 15 nt, Human
ucaguuaagaaaaaa

SEQ ID NO: 3549790 - RNA, 15 nt, Human
ucaguuacagaaagu

SEQ ID NO: 3549791 - RNA, 16 nt, Human
ucaguuacccacucgg

SEQ ID NO: 3549792 - RNA, 20 nt, Human
ucaguuacuaagaagaaaau

SEQ ID NO: 3549793 - RNA, 14 nt, Human
ucaguuacucagcc

SEQ ID NO: 3549794 - RNA, 17 nt, Human
ucaguuacucugaaggg

SEQ ID NO: 3549795 - RNA, 18 nt, Human
ucaguuagagcugacaca

SEQ ID NO: 3549796 - RNA, 20 nt, Human
ucaguuauacaguuauaaaa

SEQ ID NO: 3549797 - RNA, 19 nt, Human
ucaguuaugacauccacaa

SEQ ID NO: 3549798 - RNA, 12 nt, Human
ucaguuccaaga

SEQ ID NO: 3549799 - RNA, 18 nt, Human
ucaucuuucccuccuugg

SEQ ID NO: 3549800 - RNA, 17 nt, Human
ucaucuuucuuccaaac

SEQ ID NO: 3549801 - RNA, 22 nt, Human
ucaucuuucuugaucaacaucu

SEQ ID NO: 3549802 - RNA, 16 nt, Human
ucaugaaaauaccauu

SEQ ID NO: 3549803 - RNA, 17 nt, Human
ucaugaaacuuguuuca

SEQ ID NO: 3549804 - RNA, 15 nt, Human
ucaugaaauaugcau

SEQ ID NO: 3549805 - RNA, 18 nt, Human
ucaugaaaugcuauguca

SEQ ID NO: 3549806 - RNA, 20 nt, Human
ucaugaaaugcuaugucauu

SEQ ID NO: 3549807 - RNA, 11 nt, Human
ucaugaagccu

SEQ ID NO: 3549808 - RNA, 13 nt, Human
ucaugaagccugu

SEQ ID NO: 3549809 - RNA, 21 nt, Human
ucaugaaugcuuuuagugugu

SEQ ID NO: 3549810 - RNA, 12 nt, Human
ucaugaauguaa

SEQ ID NO: 3549811 - RNA, 14 nt, Human
ucaugaauguaaau

SEQ ID NO: 3549812 - RNA, 16 nt, Human
ucaugaauuaguuuua

SEQ ID NO: 3549813 - RNA, 22 nt, Human
ucaugaauuuauugcacauugu

SEQ ID NO: 3549814 - RNA, 23 nt, Human
ucaugaauuuauugcacauuguu

SEQ ID NO: 3549815 - RNA, 12 nt, Human
ucaugaauuuua

SEQ ID NO: 3549816 - RNA, 16 nt, Human
ucaugacaagcauuuu

SEQ ID NO: 3549817 - RNA, 14 nt, Human
ucaugacauguuau

SEQ ID NO: 3549818 - RNA, 21 nt, Human
ucaugacauguuauauauuuu

SEQ ID NO: 3549819 - RNA, 15 nt, Human
ucaugaccagcaaau

SEQ ID NO: 3549820 - RNA, 14 nt, Human
ucaugaccaguaaa

SEQ ID NO: 3549821 - RNA, 14 nt, Human
ucaugaggggagag

SEQ ID NO: 3549822 - RNA, 22 nt, Human
ucaugauagaaggcuaugggga

SEQ ID NO: 3549823 - RNA, 16 nt, Human
ucaugauccaacuaau

SEQ ID NO: 3549824 - RNA, 17 nt, Human
ucaugaucucccugccg

SEQ ID NO: 3549825 - RNA, 19 nt, Human
ucaugaucucccugccgcc

SEQ ID NO: 3549826 - RNA, 16 nt, Human
ucaugaucuugugaca

SEQ ID NO: 3549827 - RNA, 17 nt, Human
ucaugaucuugugacau

SEQ ID NO: 3549828 - RNA, 23 nt, Human
ucaugaugcucuuucccacccag

SEQ ID NO: 3549829 - RNA, 19 nt, Human
ucaugauguuuuuaaaauc

SEQ ID NO: 3549830 - RNA, 20 nt, Human
ucaugauguuuuuaaaaucu

SEQ ID NO: 3549831 - RNA, 21 nt, Human
ucaugauguuuuuaaaaucuu

SEQ ID NO: 3549832 - RNA, 14 nt, Human
ucaugauuagcaag

SEQ ID NO: 3549833 - RNA, 22 nt, Human
ucaugauucacccccaaacagu

SEQ ID NO: 3549834 - RNA, 14 nt, Human
ucaugauuuugaaa

SEQ ID NO: 3549835 - RNA, 14 nt, Human
ucaugcaaacucuu

SEQ ID NO: 3549836 - RNA, 20 nt, Human
ucaugcaaaugcuguauucu

SEQ ID NO: 3549837 - RNA, 16 nt, Human
ucaugcaaugacaucu

SEQ ID NO: 3549838 - RNA, 21 nt, Human
ucaugcagaguauuucuaaag

SEQ ID NO: 3549839 - RNA, 19 nt, Human
ucaugcagcucaacuuucu

SEQ ID NO: 3549840 - RNA, 12 nt, Human
ucaugcagcugu

SEQ ID NO: 3549841 - RNA, 14 nt, Human
ucaugcagcugugg

SEQ ID NO: 3549842 - RNA, 16 nt, Human
ucaugcagguuagaaa

SEQ ID NO: 3549843 - RNA, 14 nt, Human
ucaugcauaaauau

SEQ ID NO: 3549844 - RNA, 19 nt, Human
ucaugcauaaauaugcagu

SEQ ID NO: 3549845 - RNA, 17 nt, Human
ucaugcauagucccagc

SEQ ID NO: 3549846 - RNA, 14 nt, Human
ucaugcauggaaau

SEQ ID NO: 3549847 - RNA, 16 nt, Human
ucaugcauuguccucu

SEQ ID NO: 3549848 - RNA, 19 nt, Human
ucaugccaccauggccagc

SEQ ID NO: 3549849 - RNA, 23 nt, Human
ucaugccagcuacuuccuccucc

SEQ ID NO: 3549850 - RNA, 15 nt, Human
ucaugccaguauuuu

SEQ ID NO: 3549851 - RNA, 17 nt, Human
ucaugcccaagcccuga

SEQ ID NO: 3549852 - RNA, 15 nt, Human
ucaugcccacccccu

SEQ ID NO: 3549853 - RNA, 21 nt, Human
ucaugcccacccccugcccug

SEQ ID NO: 3549854 - RNA, 18 nt, Human
ucaugcccccuuucagau

SEQ ID NO: 3549855 - RNA, 15 nt, Human
ucaugcccuccucuc

SEQ ID NO: 3549856 - RNA, 16 nt, Human
ucaugccucugaggcc

SEQ ID NO: 3549857 - RNA, 22 nt, Human
ucaugccucugaggccagccug

SEQ ID NO: 3549858 - RNA, 13 nt, Human
ucaugccuggcuu

SEQ ID NO: 3549859 - RNA, 18 nt, Human
ucaugccuggcuucgcaa

SEQ ID NO: 3549860 - RNA, 15 nt, Human
ucaugcuaucucugu

SEQ ID NO: 3549861 - RNA, 19 nt, Human
ucaugcuccccugugccag

SEQ ID NO: 3549862 - RNA, 18 nt, Human
ucaugcucugcaaaagga

SEQ ID NO: 3549863 - RNA, 13 nt, Human
ucaugcugaaagc

SEQ ID NO: 3549864 - RNA, 17 nt, Human
ucaugcugccaauaucc

SEQ ID NO: 3549865 - RNA, 20 nt, Human
ucaugcugccaauauccuaa

SEQ ID NO: 3549866 - RNA, 21 nt, Human
ucaugcugccaauauccuaau

SEQ ID NO: 3549867 - RNA, 18 nt, Human
ucaugcugggauuuccaa

SEQ ID NO: 3549868 - RNA, 13 nt, Human
ucauggaaauauu

SEQ ID NO: 3549869 - RNA, 21 nt, Human
ucauggaacgcguugaaauug

SEQ ID NO: 3549870 - RNA, 22 nt, Human
ucauggaacgcguugaaauugu

SEQ ID NO: 3549871 - RNA, 17 nt, Human
ucauggaauggacaucc

SEQ ID NO: 3549872 - RNA, 19 nt, Human
ucauggaauuggagcucgu

SEQ ID NO: 3549873 - RNA, 14 nt, Human
ucauggacacuuug

SEQ ID NO: 3549874 - RNA, 18 nt, Human
ucauggaccacuguuucu

SEQ ID NO: 3549875 - RNA, 23 nt, Human
ucauggaccacuguuucuugcuu

SEQ ID NO: 3549876 - RNA, 23 nt, Human
ucauggaugggggaacucagauc

SEQ ID NO: 3549877 - RNA, 22 nt, Human
ucauggauuacuucucuauaaa

SEQ ID NO: 3549878 - RNA, 21 nt, Human
ucauggccacacugugacaca

SEQ ID NO: 3549879 - RNA, 14 nt, Human
ucauggccccucug

SEQ ID NO: 3549880 - RNA, 20 nt, Human
ucauggccuauuauauuaaa

SEQ ID NO: 3549881 - RNA, 16 nt, Human
ucauggcucacugcag

SEQ ID NO: 3549882 - RNA, 17 nt, Human
ucaugggauagcacgug

SEQ ID NO: 3549883 - RNA, 18 nt, Human
uuuuacaauaaauaaucu

SEQ ID NO: 3549884 - RNA, 17 nt, Human
uuuuacacagaaacacu

SEQ ID NO: 3549885 - RNA, 18 nt, Human
uuuuacacagaaacacug

SEQ ID NO: 3549886 - RNA, 19 nt, Human
uuuuacagcuuuacacaca

SEQ ID NO: 3549887 - RNA, 11 nt, Human
uuuuacaugaa

SEQ ID NO: 3549888 - RNA, 15 nt, Human
uuuuacauggagaaa

SEQ ID NO: 3549889 - RNA, 13 nt, Human
uuuuacauuaaau

SEQ ID NO: 3549890 - RNA, 21 nt, Human
uuuuaccaaguuauauaaaga

SEQ ID NO: 3549891 - RNA, 22 nt, Human
uuuuaccaugccccugagcaau

SEQ ID NO: 3549892 - RNA, 22 nt, Human
uuuuacccuggccccucucccu

SEQ ID NO: 3549893 - RNA, 18 nt, Human
uuuuaccuaccacagugu

SEQ ID NO: 3549894 - RNA, 14 nt, Human
uuuuaccugcugcu

SEQ ID NO: 3549895 - RNA, 20 nt, Human
uuuuaccugucacauugcau

SEQ ID NO: 3549896 - RNA, 14 nt, Human
uuuuaccuucacug

SEQ ID NO: 3549897 - RNA, 22 nt, Human
uuuuacuaaagaaagauuacuu

SEQ ID NO: 3549898 - RNA, 17 nt, Human
uuuuacuauuguuacau

SEQ ID NO: 3549899 - RNA, 12 nt, Human
uuuuacucugcc

SEQ ID NO: 3549900 - RNA, 15 nt, Human
uuuuacugaagccuu

SEQ ID NO: 3549901 - RNA, 19 nt, Human
uuuuacugaagccuuucuu

SEQ ID NO: 3549902 - RNA, 14 nt, Human
uuuuacugccacuc

SEQ ID NO: 3549903 - RNA, 15 nt, Human
uuuuacuguguuuua

SEQ ID NO: 3549904 - RNA, 14 nt, Human
uuuuacuuagcaau

SEQ ID NO: 3549905 - RNA, 17 nt, Human
uuuuacuuuuuuuagua

SEQ ID NO: 3549906 - RNA, 14 nt, Human
uuuuagaaaacagc

SEQ ID NO: 3549907 - RNA, 18 nt, Human
uuuuagaaacaauaugga

SEQ ID NO: 3549908 - RNA, 17 nt, Human
uuuuagaaauauucaca

SEQ ID NO: 3549909 - RNA, 13 nt, Human
uuuuagaauaaga

SEQ ID NO: 3549910 - RNA, 17 nt, Human
uuuuagaauaagaauuu

SEQ ID NO: 3549911 - RNA, 22 nt, Human
uuuuagaauaagaauuugcaua

SEQ ID NO: 3549912 - RNA, 18 nt, Human
uuuuagacaaauacucau

SEQ ID NO: 3549913 - RNA, 20 nt, Human
uuuuagacaaauacucaugu

SEQ ID NO: 3549914 - RNA, 21 nt, Human
uuuuagacaaauacucaugug

SEQ ID NO: 3549915 - RNA, 19 nt, Human
uuuuagaugugcugcuuug

SEQ ID NO: 3549916 - RNA, 22 nt, Human
uuuuagauuuucugguucuaac

SEQ ID NO: 3549917 - RNA, 23 nt, Human
uuuuagcaaagauaucucaucuc

SEQ ID NO: 3549918 - RNA, 11 nt, Human
uuuuagcaugu

SEQ ID NO: 3549919 - RNA, 19 nt, Human
uuuuagcuccuugacuccu

SEQ ID NO: 3549920 - RNA, 13 nt, Human
uuuuagcuuuugu

SEQ ID NO: 3549921 - RNA, 15 nt, Human
uuuuaggcacucuua

SEQ ID NO: 3549922 - RNA, 18 nt, Human
uuuuaggucucuuccccu

SEQ ID NO: 3549923 - RNA, 14 nt, Human
uuuuagguucuaaa

SEQ ID NO: 3549924 - RNA, 17 nt, Human
uuuuagguuuaucuuuu

SEQ ID NO: 3549925 - RNA, 14 nt, Human
uuuuaguaaguuaa

SEQ ID NO: 3549926 - RNA, 15 nt, Human
uuuuaguacccaccu

SEQ ID NO: 3549927 - RNA, 21 nt, Human
uuuuaguacccaccugagcuu

SEQ ID NO: 3549928 - RNA, 20 nt, Human
uuuuaguauuuauuuaugua

SEQ ID NO: 3549929 - RNA, 23 nt, Human
uuuuaguauuuauuuauguacuu

SEQ ID NO: 3549930 - RNA, 13 nt, Human
uuuuagucacuuu

SEQ ID NO: 3549931 - RNA, 21 nt, Human
uuuuaguggacccugaaaugu

SEQ ID NO: 3549932 - RNA, 18 nt, Human
uuuuaguuaaauuucugg

SEQ ID NO: 3549933 - RNA, 18 nt, Human
uuuuaguuucuguucugu

SEQ ID NO: 3549934 - RNA, 22 nt, Human
uuuuaguuucuguucuguggaa

SEQ ID NO: 3549935 - RNA, 13 nt, Human
uuuuaguuuuagu

SEQ ID NO: 3549936 - RNA, 16 nt, Human
uuuuaguuuuucuguc

SEQ ID NO: 3549937 - RNA, 19 nt, Human
uuuuauaaaaaaaaugaaa

SEQ ID NO: 3549938 - RNA, 14 nt, Human
uuuuauaaaaagau

SEQ ID NO: 3549939 - RNA, 19 nt, Human
uuuuauaaacuuuaccuuu

SEQ ID NO: 3549940 - RNA, 20 nt, Human
uuuuauaaaucgcuuuugau

SEQ ID NO: 3549941 - RNA, 13 nt, Human
uuuuauaaauuaa

SEQ ID NO: 3549942 - RNA, 16 nt, Human
uuuuauaaauuaaaua

SEQ ID NO: 3549943 - RNA, 21 nt, Human
uuuuauaacaucuuuauugaa

SEQ ID NO: 3549944 - RNA, 20 nt, Human
uuuuauaaggacuuccugau

SEQ ID NO: 3549945 - RNA, 19 nt, Human
uuuuauaaguucacaaaau

SEQ ID NO: 3549946 - RNA, 16 nt, Human
uuuuauaauuguacaa

SEQ ID NO: 3549947 - RNA, 19 nt, Human
uuuuauacacauaauuaaa

SEQ ID NO: 3549948 - RNA, 17 nt, Human
uuuuauacaguagugag

SEQ ID NO: 3549949 - RNA, 23 nt, Human
uuuuauacaguagugagaagaau

SEQ ID NO: 3549950 - RNA, 16 nt, Human
uuuuauaccuguuuaa

SEQ ID NO: 3549951 - RNA, 13 nt, Human
uuuuauacucuuu

SEQ ID NO: 3549952 - RNA, 15 nt, Human
uuuuauacuguacuu

SEQ ID NO: 3549953 - RNA, 14 nt, Human
uuuuauaguggaaa

SEQ ID NO: 3549954 - RNA, 15 nt, Human
uuuuauaguggaaaa

SEQ ID NO: 3549955 - RNA, 17 nt, Human
uuuuauauaauaaagua

SEQ ID NO: 3549956 - RNA, 13 nt, Human
uuuuauaucccau

SEQ ID NO: 3549957 - RNA, 14 nt, Human
uuuuauaucuguau

SEQ ID NO: 3549958 - RNA, 15 nt, Human
uuuuauaugcuucug

SEQ ID NO: 3549959 - RNA, 14 nt, Human
uuuuauaugucaaa

SEQ ID NO: 3549960 - RNA, 23 nt, Human
uuuuauauuaaaauaagcacugu

SEQ ID NO: 3549961 - RNA, 20 nt, Human
uuuuauauuaaccagauaua

SEQ ID NO: 3549962 - RNA, 21 nt, Human
uuuuauauuaaccagauauau

SEQ ID NO: 3549963 - RNA, 15 nt, Human
uuuuauauucucagc

SEQ ID NO: 3549964 - RNA, 13 nt, Human
uuuuauauuuagu

SEQ ID NO: 3549965 - RNA, 15 nt, Human
uuuuauauuucaagu

SEQ ID NO: 3549966 - RNA, 14 nt, Human
uuuuauauuuccuu

SEQ ID NO: 3549967 - RNA, 13 nt, Human
uuuuauauuugaa

SEQ ID NO: 3549968 - RNA, 12 nt, Human
uuuuauauuugu

SEQ ID NO: 3549969 - RNA, 14 nt, Human
uuuuauauuuguag

SEQ ID NO: 3549970 - RNA, 17 nt, Human
uuuuauauuuguaucga

SEQ ID NO: 3549971 - RNA, 22 nt, Human
uuuuaucagaacuauguuuuug

SEQ ID NO: 3549972 - RNA, 19 nt, Human
uuuuaucaugacauguuau

SEQ ID NO: 3549973 - RNA, 16 nt, Human
uuuuaucaugcauguc

SEQ ID NO: 3549974 - RNA, 16 nt, Human
uuuuauccaaucuugu

SEQ ID NO: 3549975 - RNA, 22 nt, Human
uuuuaucuauucugagaaaaca

SEQ ID NO: 3549976 - RNA, 12 nt, Human
uuuuuaaccaaa

SEQ ID NO: 3549977 - RNA, 22 nt, Human
uuuuuaacucuacuguguaaua

SEQ ID NO: 3549978 - RNA, 23 nt, Human
uuuuuaagaaaaaggaugcacag

SEQ ID NO: 3549979 - RNA, 17 nt, Human
uuuuuaagaauaucugu

SEQ ID NO: 3549980 - RNA, 18 nt, Human
uuuuuaagaauaucugua

SEQ ID NO: 3549981 - RNA, 15 nt, Human
uuuuuaagauagugu

SEQ ID NO: 3549982 - RNA, 20 nt, Human
uuuuuaagauaguguaacuu

SEQ ID NO: 3549983 - RNA, 20 nt, Human
uuuuuaagcucugagcuguc

SEQ ID NO: 3549984 - RNA, 14 nt, Human
uuuuuaagcuguaa

SEQ ID NO: 3549985 - RNA, 20 nt, Human
uuuuuaagggcccuuuuuca

SEQ ID NO: 3549986 - RNA, 23 nt, Human
uuuuuaaggguuaucuuagaugu

SEQ ID NO: 3549987 - RNA, 13 nt, Human
uuuuuaagugaaa

SEQ ID NO: 3549988 - RNA, 16 nt, Human
uuuuuaagugaaauuu

SEQ ID NO: 3549989 - RNA, 12 nt, Human
uuuuuaauaaac

SEQ ID NO: 3549990 - RNA, 16 nt, Human
uuuuuaauaaauuuca

SEQ ID NO: 3549991 - RNA, 21 nt, Human
uuuuuaauauguaaggaaugc

SEQ ID NO: 3549992 - RNA, 17 nt, Human
uuuuuaaucaugaaauu

SEQ ID NO: 3549993 - RNA, 19 nt, Human
uuuuuaauccgccaauauu

SEQ ID NO: 3549994 - RNA, 22 nt, Human
uuuuuaaucuacugcauuuagg

SEQ ID NO: 3549995 - RNA, 22 nt, Human
uuuuuaaucuagacaauauaca

SEQ ID NO: 3549996 - RNA, 12 nt, Human
uuuuuaaugugc

SEQ ID NO: 3549997 - RNA, 21 nt, Human
uuuuuaaugugcuguguaaag

SEQ ID NO: 3549998 - RNA, 16 nt, Human
uuuuuaauuaaaaacu

SEQ ID NO: 3549999 - RNA, 16 nt, Human
uuuuuaauuuacuugu

SEQ ID NO: 3550000 - RNA, 16 nt, Human
uuuuuaauuuauuuau

SEQ ID NO: 3550001 - RNA, 22 nt, Human
uuuuuacaaauguuaaaaugug

SEQ ID NO: 3550002 - RNA, 13 nt, Human
uuuuuacagcugu

SEQ ID NO: 3550003 - RNA, 22 nt, Human
uuuuuaccuaccacagugucug

SEQ ID NO: 3550004 - RNA, 16 nt, Human
uuuuuacuacaguugu

SEQ ID NO: 3550005 - RNA, 18 nt, Human
uuuuuacucauugaaaug

SEQ ID NO: 3550006 - RNA, 23 nt, Human
uuuuuacucauugaaaugucacg

SEQ ID NO: 3550007 - RNA, 12 nt, Human
uuuuuacugcca

SEQ ID NO: 3550008 - RNA, 13 nt, Human
uuuuuacugccac

SEQ ID NO: 3550009 - RNA, 15 nt, Human
uuuuuacugcucuga

SEQ ID NO: 3550010 - RNA, 11 nt, Human
uuuuuacugug

SEQ ID NO: 3550011 - RNA, 14 nt, Human
uuuuuagaacagaa

SEQ ID NO: 3550012 - RNA, 17 nt, Human
uuuuuagaacagaaaac

SEQ ID NO: 3550013 - RNA, 18 nt, Human
uuuuuagaauaagaauuu

SEQ ID NO: 3550014 - RNA, 23 nt, Human
uuuuuagaauaagaauuugcaua

SEQ ID NO: 3550015 - RNA, 14 nt, Human
uuuuuagacaccuu

SEQ ID NO: 3550016 - RNA, 14 nt, Human
uuuuuagaucaaau

SEQ ID NO: 3550017 - RNA, 20 nt, Human
uuuuuagaugugcugcuuug

SEQ ID NO: 3550018 - RNA, 12 nt, Human
uuuuuaggaaau

SEQ ID NO: 3550019 - RNA, 22 nt, Human
uuuuuaguaaguuaauguauau

SEQ ID NO: 3550020 - RNA, 16 nt, Human
uuuuuaguaaucugua

SEQ ID NO: 3550021 - RNA, 21 nt, Human
uuuuuagugcauccaguuaac

SEQ ID NO: 3550022 - RNA, 12 nt, Human
uuuuuaguugaa

SEQ ID NO: 3550023 - RNA, 20 nt, Human
uuuuuauaaaaauaaauaga

SEQ ID NO: 3550024 - RNA, 12 nt, Human
uuuuuauacagu

SEQ ID NO: 3550025 - RNA, 15 nt, Human
uuuuuauauuaaugu

SEQ ID NO: 3550026 - RNA, 20 nt, Human
uuuuuauauuuacuaaaaug

SEQ ID NO: 3550027 - RNA, 15 nt, Human
uuuuuauauuuaguu

SEQ ID NO: 3550028 - RNA, 21 nt, Human
uuuuuauauuucaaguacacu

SEQ ID NO: 3550029 - RNA, 19 nt, Human
uuuuuauauuugaaauauu

SEQ ID NO: 3550030 - RNA, 20 nt, Human
uuuuuaucgucacugcuuaa

SEQ ID NO: 3550031 - RNA, 18 nt, Human
uuuuuaucuauauaaaau

SEQ ID NO: 3550032 - RNA, 11 nt, Human
uuuuuaucuuu

SEQ ID NO: 3550033 - RNA, 17 nt, Human
uuuuuaucuuuucuaca

SEQ ID NO: 3550034 - RNA, 20 nt, Human
uuuuuaugaggcaaccugau

SEQ ID NO: 3550035 - RNA, 12 nt, Human
uuuuuauggcuu

SEQ ID NO: 3550036 - RNA, 20 nt, Human
uuuuuauggcuuuugugcau

SEQ ID NO: 3550037 - RNA, 14 nt, Human
uuuuuauuaaaaua

SEQ ID NO: 3550038 - RNA, 13 nt, Human
uuuuuauuaugca

SEQ ID NO: 3550039 - RNA, 14 nt, Human
uuuuuauuauuugu

SEQ ID NO: 3550040 - RNA, 13 nt, Human
uuuuuauucauaa

SEQ ID NO: 3550041 - RNA, 11 nt, Human
uuuuuauucuu

SEQ ID NO: 3550042 - RNA, 23 nt, Human
uuuuuauugaaucuauuuaagua

SEQ ID NO: 3550043 - RNA, 18 nt, Human
uuuuuauugaugugcaaa

SEQ ID NO: 3550044 - RNA, 12 nt, Human
uuuuuauugcua

SEQ ID NO: 3550045 - RNA, 17 nt, Human
uuuuuauuuauauguau

SEQ ID NO: 3550046 - RNA, 15 nt, Human
uuuuuauuucuccuu

SEQ ID NO: 3550047 - RNA, 12 nt, Human
uuuuuauuucuu

SEQ ID NO: 3550048 - RNA, 20 nt, Human
uuuuucaaaauagaaaaguu

SEQ ID NO: 3550049 - RNA, 15 nt, Human
uuuuucaaagcaauu

SEQ ID NO: 3550050 - RNA, 17 nt, Human
uuuuucaaguuguaaau

SEQ ID NO: 3550051 - RNA, 21 nt, Human
uuuuucaaguuguaaauaauu

SEQ ID NO: 3550052 - RNA, 17 nt, Human
uuuuucaauauauugaa

SEQ ID NO: 3550053 - RNA, 16 nt, Human
uuuuucaauauuuauu

SEQ ID NO: 3550054 - RNA, 11 nt, Human
uuuuucaaugu

SEQ ID NO: 3550055 - RNA, 12 nt, Human
uuuuucaaugug

SEQ ID NO: 3550056 - RNA, 14 nt, Human
uuuuucaauuaaac

SEQ ID NO: 3550057 - RNA, 15 nt, Human
uuuuucaauuaaacg

SEQ ID NO: 3550058 - RNA, 22 nt, Human
uuuuucacauaaagggaacaaa

SEQ ID NO: 3550059 - RNA, 13 nt, Human
uuuuucacauuuu

SEQ ID NO: 3550060 - RNA, 22 nt, Human
uuuuucacggaaguuuucaaug

SEQ ID NO: 3550061 - RNA, 21 nt, Human
uuuuucagcagacuaugaaua

SEQ ID NO: 3550062 - RNA, 13 nt, Human
uuuuucaguucaa

SEQ ID NO: 3550063 - RNA, 11 nt, Human
uuuuucaguug

SEQ ID NO: 3550064 - RNA, 20 nt, Human
uuuuucaguuguucuuuuua

SEQ ID NO: 3550065 - RNA, 12 nt, Human
uuuuucaguuuu

SEQ ID NO: 3550066 - RNA, 13 nt, Human
uuuuucauaaaca

SEQ ID NO: 3550067 - RNA, 13 nt, Human
uuuuucauauugu

SEQ ID NO: 3550068 - RNA, 15 nt, Human
uuuuucaucuucagu

SEQ ID NO: 3550069 - RNA, 16 nt, Human
uuuuucaugauaauga

SEQ ID NO: 3550070 - RNA, 11 nt, Human
uuuuucauguu

SEQ ID NO: 3550071 - RNA, 22 nt, Human
uuuuucauuaaauaaauuugac

SEQ ID NO: 3550072 - RNA, 20 nt, Human
uuuuuccacuuuguucuuua

SEQ ID NO: 3550073 - RNA, 21 nt, Human
uuuuuccaucauaauucuaau

SEQ ID NO: 3550074 - RNA, 23 nt, Human
uuuuucccaggcaaauaaaauuc

SEQ ID NO: 3550075 - RNA, 14 nt, Human
uuuuuccccaaagu

SEQ ID NO: 3550076 - RNA, 15 nt, Human
uuuuuccccaaaguc

SEQ ID NO: 3550077 - RNA, 16 nt, Human
uuuuuccccaaagucu

SEQ ID NO: 3550078 - RNA, 21 nt, Human
uuuuuccccagacuuguuggc

SEQ ID NO: 3550079 - RNA, 14 nt, Human
uuuuuccguaaaaa

SEQ ID NO: 3550080 - RNA, 16 nt, Human
uuuuuccguaaaaaug

SEQ ID NO: 3550081 - RNA, 19 nt, Human
uuuuuccuagccuguuucu

SEQ ID NO: 3550082 - RNA, 21 nt, Human
uuuuuccuagccuguuucuuc

SEQ ID NO: 3550083 - RNA, 13 nt, Human
uuuuuccucucca

SEQ ID NO: 3550084 - RNA, 19 nt, Human
uuuuuccugugaacacaua

SEQ ID NO: 3550085 - RNA, 15 nt, Human
uuuuuccuuaaucca

SEQ ID NO: 3550086 - RNA, 20 nt, Human
uuuuuccuuaauccagcuga

SEQ ID NO: 3550087 - RNA, 20 nt, Human
uuuuuccuuacauaaacauc

SEQ ID NO: 3550088 - RNA, 18 nt, Human
uuuuuccuucaaaguuua

SEQ ID NO: 3550089 - RNA, 19 nt, Human
uuuuuccuucaaaguuuaa

SEQ ID NO: 3550090 - RNA, 22 nt, Human
uuuuuccuuguccccacacucc

SEQ ID NO: 3550091 - RNA, 10 nt, Human
uuuuuccuuu

SEQ ID NO: 3550092 - RNA, 11 nt, Human
uuuuuccuuuu

SEQ ID NO: 3550093 - RNA, 16 nt, Human
uuuuucguuuguuugu

SEQ ID NO: 3550094 - RNA, 17 nt, Human
uuuuucguuuguuuguu

SEQ ID NO: 3550095 - RNA, 14 nt, Human
uuuuucuaguacac

SEQ ID NO: 3550096 - RNA, 13 nt, Human
uuuuucuauuaaa

SEQ ID NO: 3550097 - RNA, 19 nt, Human
uuuuucuauuaaaagacuc

SEQ ID NO: 3550098 - RNA, 18 nt, Human
uuuuucucaaaguuuuga

SEQ ID NO: 3550099 - RNA, 21 nt, Human
uuuuucucgcuguccuuucua

SEQ ID NO: 3550100 - RNA, 23 nt, Human
uuuuucucugauacagaaaaguu

SEQ ID NO: 3550101 - RNA, 13 nt, Human
uuuuucugauaaa

SEQ ID NO: 3550102 - RNA, 11 nt, Human
uuuuucugauu

SEQ ID NO: 3550103 - RNA, 18 nt, Human
uuuuucugcacuauaugc

SEQ ID NO: 3550104 - RNA, 17 nt, Human
uuuuucugcacugagca

SEQ ID NO: 3550105 - RNA, 11 nt, Human
uuuuucuggac

SEQ ID NO: 3550106 - RNA, 14 nt, Human
uuuuucuguaccag

SEQ ID NO: 3550107 - RNA, 16 nt, Human
uuuuucuguaccaguu

SEQ ID NO: 3550108 - RNA, 11 nt, Human
uuuuucuguau

SEQ ID NO: 3550109 - RNA, 18 nt, Human
uuuuucugugugucaguu

SEQ ID NO: 3550110 - RNA, 23 nt, Human
uuuuucuuguaaauguguuggac

SEQ ID NO: 3550111 - RNA, 19 nt, Human
uuuuucuuuauaagaaagc

SEQ ID NO: 3550112 - RNA, 21 nt, Human
uuuuucuuuucggaaaucuua

SEQ ID NO: 3550113 - RNA, 10 nt, Human
uuuuugaaaa

SEQ ID NO: 3550114 - RNA, 23 nt, Human
uuuuugaaaaagcgaaaaaauca

SEQ ID NO: 3550115 - RNA, 23 nt, Human
uuuuugaaggcagaaagcaaaau

SEQ ID NO: 3550116 - RNA, 19 nt, Human
uuuuugaagucuuguauaa

SEQ ID NO: 3550117 - RNA, 18 nt, Human
uccagaccccuggcuuuu

SEQ ID NO: 3550118 - RNA, 14 nt, Human
uccagacccggcug

SEQ ID NO: 3550119 - RNA, 19 nt, Human
uccagacccggcugcgugg

SEQ ID NO: 3550120 - RNA, 11 nt, Human
uccagaccuga

SEQ ID NO: 3550121 - RNA, 22 nt, Human
uccagacugcuuccaauuuucu

SEQ ID NO: 3550122 - RNA, 12 nt, Human
uuuuugaagugu

SEQ ID NO: 3550123 - RNA, 24 nt, Human
uuuuugaaguguaggcagacacag

SEQ ID NO: 3550124 - RNA, 13 nt, Human
uuuuugacacuga

SEQ ID NO: 3550125 - RNA, 15 nt, Human
uuuuugacacugaaa

SEQ ID NO: 3550126 - RNA, 18 nt, Human
uuuuugacacugaaaguu

SEQ ID NO: 3550127 - RNA, 23 nt, Human
uuuuugacuuuuuuuguaugugu

SEQ ID NO: 3550128 - RNA, 20 nt, Human
uuuuugaggcuaugaauaua

SEQ ID NO: 3550129 - RNA, 15 nt, Human
uuuuugauacuaagc

SEQ ID NO: 3550130 - RNA, 14 nt, Human
uuuuugauagcauu

SEQ ID NO: 3550131 - RNA, 12 nt, Human
uuuuugcaauaa

SEQ ID NO: 3550132 - RNA, 20 nt, Human
uuuuugcaccccaugcuguu

SEQ ID NO: 3550133 - RNA, 22 nt, Human
uuuuugcaccccaugcuguuga

SEQ ID NO: 3550134 - RNA, 22 nt, Human
uuuuuggaagaggacuccuuaa

SEQ ID NO: 3550135 - RNA, 15 nt, Human
uuuuuggaagugaaa

SEQ ID NO: 3550136 - RNA, 19 nt, Human
uuuuuggaagugaaaacuu

SEQ ID NO: 3550137 - RNA, 22 nt, Human
uuuuuggagggguuuaugcuca

SEQ ID NO: 3550138 - RNA, 20 nt, Human
uuuuuggaggugcuuaagca

SEQ ID NO: 3550139 - RNA, 20 nt, Human
uuuuuggaguguuauguauu

SEQ ID NO: 3550140 - RNA, 17 nt, Human
uuuuuggauugacagua

SEQ ID NO: 3550141 - RNA, 19 nt, Human
uuuuuggugauucaaaugg

SEQ ID NO: 3550142 - RNA, 17 nt, Human
uuuuugguggauguaaa

SEQ ID NO: 3550143 - RNA, 19 nt, Human
uuuuugguggauguaaaua

SEQ ID NO: 3550144 - RNA, 21 nt, Human
uuuuugguuaaaaaaaagaau

SEQ ID NO: 3550145 - RNA, 23 nt, Human
uuuuuguaaacuggaauuaaaag

SEQ ID NO: 3550146 - RNA, 20 nt, Human
uuuuuguaaauguguacaua

SEQ ID NO: 3550147 - RNA, 12 nt, Human
uuuuuguaauaa

SEQ ID NO: 3550148 - RNA, 18 nt, Human
uuuuuguacaguuugcug

SEQ ID NO: 3550149 - RNA, 14 nt, Human
uuuuuguaccauuu

SEQ ID NO: 3550150 - RNA, 23 nt, Human
uuuuuguaccauuuuaaaguuag

SEQ ID NO: 3550151 - RNA, 12 nt, Human
uuuuuguacugu

SEQ ID NO: 3550152 - RNA, 14 nt, Human
uuuuuguacuguaa

SEQ ID NO: 3550153 - RNA, 20 nt, Human
uuuuuguagagccagggucu

SEQ ID NO: 3550154 - RNA, 20 nt, Human
uuuuuguagcacugacagau

SEQ ID NO: 3550155 - RNA, 21 nt, Human
uuuuuguagcacugacagauu

SEQ ID NO: 3550156 - RNA, 22 nt, Human
uuuuuguauauugguuuuauga

SEQ ID NO: 3550157 - RNA, 14 nt, Human
uuuuuguaugugug

SEQ ID NO: 3550158 - RNA, 11 nt, Human
uuuuuguauuc

SEQ ID NO: 3550159 - RNA, 11 nt, Human
uuuuuguauuu

SEQ ID NO: 3550160 - RNA, 13 nt, Human
uuuuugugaagac

SEQ ID NO: 3550161 - RNA, 16 nt, Human
uuuuuguuauuaaaca

SEQ ID NO: 3550162 - RNA, 20 nt, Human
uuuuuguucugguccuuuuu

SEQ ID NO: 3550163 - RNA, 22 nt, Human
uuuuuguucuuaauugcacucu

SEQ ID NO: 3550164 - RNA, 20 nt, Human
uuuuuguuucugagaaaaga

SEQ ID NO: 3550165 - RNA, 16 nt, Human
uuuuuguuuguuuugu

SEQ ID NO: 3550166 - RNA, 16 nt, Human
uuuuuguuuuucugcu

SEQ ID NO: 3550167 - RNA, 12 nt, Human
uuuuuuaaaaaa

SEQ ID NO: 3550168 - RNA, 18 nt, Human
uuuuuuaaaaaaagaaaa

SEQ ID NO: 3550169 - RNA, 12 nt, Human
uuuuuuaaagaa

SEQ ID NO: 3550170 - RNA, 10 nt, Human
uuuuuuaaga

SEQ ID NO: 3550171 - RNA, 11 nt, Human
uuuuuuaagau

SEQ ID NO: 3550172 - RNA, 12 nt, Human
uuuuuuaagauu

SEQ ID NO: 3550173 - RNA, 18 nt, Human
uuuuuuaaguucuuauga

SEQ ID NO: 3550174 - RNA, 19 nt, Human
uuuuuuaauccgccaauau

SEQ ID NO: 3550175 - RNA, 12 nt, Human
uuuuuuaaucua

SEQ ID NO: 3550176 - RNA, 12 nt, Human
uuuuuuaauuuu

SEQ ID NO: 3550177 - RNA, 15 nt, Human
uuuuuuauguuuugu

SEQ ID NO: 3550178 - RNA, 11 nt, Human
uuuuuuauucu

SEQ ID NO: 3550179 - RNA, 18 nt, Human
uuuuuucaaaauagaaaa

SEQ ID NO: 3550180 - RNA, 13 nt, Human
uuuuuucaaugug

SEQ ID NO: 3550181 - RNA, 12 nt, Human
uuuuuucagacc

SEQ ID NO: 3550182 - RNA, 11 nt, Human
uuuuuucaucu

SEQ ID NO: 3550183 - RNA, 15 nt, Human
uuuuuucuaccuaua

SEQ ID NO: 3550184 - RNA, 11 nt, Human
uuuuuucugag

SEQ ID NO: 3550185 - RNA, 13 nt, Human
uuuuuugaagugu

SEQ ID NO: 3550186 - RNA, 10 nt, Human
uuuuuugaga

SEQ ID NO: 3550187 - RNA, 17 nt, Human
uuuuuugagagagaguc

SEQ ID NO: 3550188 - RNA, 15 nt, Human
uuuuuugcaagugaa

SEQ ID NO: 3550189 - RNA, 10 nt, Human
uuuuuugcag

SEQ ID NO: 3550190 - RNA, 13 nt, Human
uuuuuugguacaa

SEQ ID NO: 3550191 - RNA, 16 nt, Human
uuuuuugguacaaaaa

SEQ ID NO: 3550192 - RNA, 14 nt, Human
uuuuuuguaccauu

SEQ ID NO: 3550193 - RNA, 12 nt, Human
uuuuuuguaguu

SEQ ID NO: 3550194 - RNA, 12 nt, Human
uuuuuuguugac

SEQ ID NO: 3550195 - RNA, 12 nt, Human
uuuuuuguuuca

SEQ ID NO: 3550196 - RNA, 16 nt, Human
uuuuuuguuuguuugu

SEQ ID NO: 3550197 - RNA, 13 nt, Human
uuuuuuuaaaauc

SEQ ID NO: 3550198 - RNA, 21 nt, Human
uuuuuuuaauagucauuccaa

SEQ ID NO: 3550199 - RNA, 12 nt, Human
uuuuuuuacauu

SEQ ID NO: 3550200 - RNA, 12 nt, Human
uuuuuuuccauu

SEQ ID NO: 3550201 - RNA, 10 nt, Human
uuuuuuuccu

SEQ ID NO: 3550202 - RNA, 11 nt, Human
uuuuuuuccuu

SEQ ID NO: 3550203 - RNA, 13 nt, Human
uuuuuuuccuuuu

SEQ ID NO: 3550204 - RNA, 10 nt, Human
uuuuuuugca

SEQ ID NO: 3550205 - RNA, 13 nt, Human
uuuuuuuguaaua

SEQ ID NO: 3550206 - RNA, 12 nt, Human
uuuuuuugugug

SEQ ID NO: 3550207 - RNA, 14 nt, Human
uuuuuuuguuauua

SEQ ID NO: 3550208 - RNA, 14 nt, Human
uuuuuuuuaaacaa

SEQ ID NO: 3550209 - RNA, 11 nt, Human
uuuuuuuucca

SEQ ID NO: 3550210 - RNA, 13 nt, Human
uuuuuuuucccau

SEQ ID NO: 3550211 - RNA, 13 nt, Human
uuuuuuuugaaaa

SEQ ID NO: 3550212 - RNA, 12 nt, Human
ucccccaacaga

SEQ ID NO: 3550213 - RNA, 16 nt, Human
ucccccaacccccacc

SEQ ID NO: 3550214 - RNA, 21 nt, Human
ucccccacccccuccccaggg

SEQ ID NO: 3550215 - RNA, 21 nt, Human
ucccccaccgguccagcuggc

SEQ ID NO: 3550216 - RNA, 24 nt, Human
ucccccacuacugcagcaccucca

SEQ ID NO: 3550217 - RNA, 12 nt, Human
ucccccacuuuc

SEQ ID NO: 3550218 - RNA, 14 nt, Human
ucccccagccacuc

SEQ ID NO: 3550219 - RNA, 22 nt, Human
ucccccagccaugccagcuggc

SEQ ID NO: 3550220 - RNA, 11 nt, Human
ucccccagccc

SEQ ID NO: 3550221 - RNA, 13 nt, Human
ucccccagcccca

SEQ ID NO: 3550222 - RNA, 15 nt, Human
ucccccagccccauc

SEQ ID NO: 3550223 - RNA, 16 nt, Human
ucccccagccccaucc

SEQ ID NO: 3550224 - RNA, 17 nt, Human
ucccccagccccauccu

SEQ ID NO: 3550225 - RNA, 18 nt, Human
ucccccagcucuggugag

SEQ ID NO: 3550226 - RNA, 14 nt, Human
ucccccauagccac

SEQ ID NO: 3550227 - RNA, 15 nt, Human
ucccccauagccacc

SEQ ID NO: 3550228 - RNA, 23 nt, Human
ucccccaucucgcucccucccag

SEQ ID NO: 3550229 - RNA, 18 nt, Human
uccccccacucccucaca

SEQ ID NO: 3550230 - RNA, 18 nt, Human
uccccccacugcaggccc

SEQ ID NO: 3550231 - RNA, 13 nt, Human
ucccccccaugca

SEQ ID NO: 3550232 - RNA, 18 nt, Human
uccccccccaaccuuucc

SEQ ID NO: 3550233 - RNA, 17 nt, Human
uccccccccuguauagu

SEQ ID NO: 3550234 - RNA, 12 nt, Human
uccccccucacc

SEQ ID NO: 3550235 - RNA, 13 nt, Human
uccccccucccac

SEQ ID NO: 3550236 - RNA, 19 nt, Human
uccccccuccucugaaaca

SEQ ID NO: 3550237 - RNA, 22 nt, Human
uccccccuccucugaaacagcu

SEQ ID NO: 3550238 - RNA, 20 nt, Human
ucccccgcaaugugccccca

SEQ ID NO: 3550239 - RNA, 21 nt, Human
ucccccguagaaaucccccuu

SEQ ID NO: 3550240 - RNA, 14 nt, Human
ucccccuagccauu

SEQ ID NO: 3550241 - RNA, 15 nt, Human
ucccccuagccauuu

SEQ ID NO: 3550242 - RNA, 16 nt, Human
ucccccuagccauuuu

SEQ ID NO: 3550243 - RNA, 16 nt, Human
ucccccuccaccugcu

SEQ ID NO: 3550244 - RNA, 17 nt, Human
ucccccucccagggcca

SEQ ID NO: 3550245 - RNA, 18 nt, Human
ucccccucccagggccag

SEQ ID NO: 3550246 - RNA, 20 nt, Human
ucccccucccccacugccau

SEQ ID NO: 3550247 - RNA, 20 nt, Human
ucccccucccccuucuccca

SEQ ID NO: 3550248 - RNA, 20 nt, Human
ucccccuccuucccagcugc

SEQ ID NO: 3550249 - RNA, 13 nt, Human
ucccccugcccca

SEQ ID NO: 3550250 - RNA, 12 nt, Human
ucccccugcccu

SEQ ID NO: 3550251 - RNA, 22 nt, Human
ucccccugcccucguggccagc

SEQ ID NO: 3550252 - RNA, 19 nt, Human
ucccccugcuuccaccuca

SEQ ID NO: 3550253 - RNA, 23 nt, Human
ucccccuggccaccaccccccac

SEQ ID NO: 3550254 - RNA, 10 nt, Human
ucccccuggg

SEQ ID NO: 3550255 - RNA, 14 nt, Human
ucccccugggcucu

SEQ ID NO: 3550256 - RNA, 15 nt, Human
ucccccugggcucug

SEQ ID NO: 3550257 - RNA, 10 nt, Human
ucccccuucu

SEQ ID NO: 3550258 - RNA, 12 nt, Human
ucccccuugcca

SEQ ID NO: 3550259 - RNA, 16 nt, Human
ucccccuuucuuccuc

SEQ ID NO: 3550260 - RNA, 21 nt, Human
ucccccuuucuuccucauucc

SEQ ID NO: 3550261 - RNA, 19 nt, Human
ucccccuuuucugcauuuu

SEQ ID NO: 3550262 - RNA, 21 nt, Human
ucccccuuuuuugucccccaa

SEQ ID NO: 3550263 - RNA, 17 nt, Human
uccccgacuggggcagg

SEQ ID NO: 3550264 - RNA, 21 nt, Human
uccccgagggaugaugccaca

SEQ ID NO: 3550265 - RNA, 22 nt, Human
uccccgagggaugaugccacac

SEQ ID NO: 3550266 - RNA, 23 nt, Human
uccccgauaccaugcuguaagga

SEQ ID NO: 3550267 - RNA, 14 nt, Human
uccccgcacccccc

SEQ ID NO: 3550268 - RNA, 18 nt, Human
uccccgcagcccuggcag

SEQ ID NO: 3550269 - RNA, 14 nt, Human
uccccgccuggcca

SEQ ID NO: 3550270 - RNA, 15 nt, Human
uccccgccuggccag

SEQ ID NO: 3550271 - RNA, 17 nt, Human
uccccgccuggccagga

SEQ ID NO: 3550272 - RNA, 22 nt, Human
uccccgccuuccgccccuuccc

SEQ ID NO: 3550273 - RNA, 15 nt, Human
uccccgcuaaggaag

SEQ ID NO: 3550274 - RNA, 16 nt, Human
uccccgcugcugugca

SEQ ID NO: 3550275 - RNA, 17 nt, Human
uccccgcugcugugcaa

SEQ ID NO: 3550276 - RNA, 15 nt, Human
uccccggaguucagu

SEQ ID NO: 3550277 - RNA, 14 nt, Human
uccccggcacccuc

SEQ ID NO: 3550278 - RNA, 18 nt, Human
uccccggcacccucuggc

SEQ ID NO: 3550279 - RNA, 19 nt, Human
uccccggcacccucuggcc

SEQ ID NO: 3550280 - RNA, 17 nt, Human
uccccgggcaucuuugg

SEQ ID NO: 3550281 - RNA, 21 nt, Human
uccccgggcaucuuuggggag

SEQ ID NO: 3550282 - RNA, 16 nt, Human
uccccggggcccaggg

SEQ ID NO: 3550283 - RNA, 15 nt, Human
uccccgucucauucc

SEQ ID NO: 3550284 - RNA, 20 nt, Human
uccccuaagcagaccacuga

SEQ ID NO: 3550285 - RNA, 15 nt, Human
uccccuagaguccca

SEQ ID NO: 3550286 - RNA, 16 nt, Human
uccccuagagucccag

SEQ ID NO: 3550287 - RNA, 22 nt, Human
uccccuaguaagugccuuccau

SEQ ID NO: 3550288 - RNA, 18 nt, Human
uccccuauccacccagcc

SEQ ID NO: 3550289 - RNA, 20 nt, Human
uccccuauccacccagccca

SEQ ID NO: 3550290 - RNA, 21 nt, Human
uccccuauggaauuuauaauu

SEQ ID NO: 3550291 - RNA, 23 nt, Human
uccccuauguggaaguggggcgg

SEQ ID NO: 3550292 - RNA, 17 nt, Human
uccccucaaagucugca

SEQ ID NO: 3550293 - RNA, 20 nt, Human
uccccucacagccucugacc

SEQ ID NO: 3550294 - RNA, 15 nt, Human
uccccucaccuccuc

SEQ ID NO: 3550295 - RNA, 17 nt, Human
uccccucaccuccucua

SEQ ID NO: 3550296 - RNA, 13 nt, Human
uccccucacugga

SEQ ID NO: 3550297 - RNA, 13 nt, Human
uccccuccaaccu

SEQ ID NO: 3550298 - RNA, 16 nt, Human
uccccuccaagguaug

SEQ ID NO: 3550299 - RNA, 14 nt, Human
uccccuccaggagu

SEQ ID NO: 3550300 - RNA, 18 nt, Human
uccccuccaucccuggcc

SEQ ID NO: 3550301 - RNA, 13 nt, Human
uccccucccagag

SEQ ID NO: 3550302 - RNA, 19 nt, Human
uccccucccccaccccugc

SEQ ID NO: 3550303 - RNA, 20 nt, Human
uccccucccccaccccugcu

SEQ ID NO: 3550304 - RNA, 17 nt, Human
uccccuccccugcugca

SEQ ID NO: 3550305 - RNA, 12 nt, Human
uccccucccugg

SEQ ID NO: 3550306 - RNA, 16 nt, Human
uccccucccuggcucc

SEQ ID NO: 3550307 - RNA, 16 nt, Human
uccccucccuggguuc

SEQ ID NO: 3550308 - RNA, 13 nt, Human
uccccucccuguc

SEQ ID NO: 3550309 - RNA, 17 nt, Human
uccccuccgccaggcga

SEQ ID NO: 3550310 - RNA, 20 nt, Human
uccccuccgccaggcgagau

SEQ ID NO: 3550311 - RNA, 19 nt, Human
uccccuccggacuggugcc

SEQ ID NO: 3550312 - RNA, 20 nt, Human
uccccuccggacuggugccc

SEQ ID NO: 3550313 - RNA, 17 nt, Human
uccccuccuaccccucc

SEQ ID NO: 3550314 - RNA, 20 nt, Human
uccccuccuaccccucccag

SEQ ID NO: 3550315 - RNA, 16 nt, Human
uccuuggucuuuguau

SEQ ID NO: 3550316 - RNA, 22 nt, Human
uccuuggugucgggcaugacac

SEQ ID NO: 3550317 - RNA, 19 nt, Human
uccuuguagccuuuugacu

SEQ ID NO: 3550318 - RNA, 20 nt, Human
uccuuguagccuuuugacuu

SEQ ID NO: 3550319 - RNA, 14 nt, Human
uccuuguccccaca

SEQ ID NO: 3550320 - RNA, 22 nt, Human
uccuuguccccacacuccuaca

SEQ ID NO: 3550321 - RNA, 21 nt, Human
uccuugucuuggcagccuacu

SEQ ID NO: 3550322 - RNA, 19 nt, Human
uccuugugaugugcacgua

SEQ ID NO: 3550323 - RNA, 16 nt, Human
uccuugugccagagaa

SEQ ID NO: 3550324 - RNA, 16 nt, Human
uccuuguggcacauuu

SEQ ID NO: 3550325 - RNA, 13 nt, Human
uccuuguggcaga

SEQ ID NO: 3550326 - RNA, 19 nt, Human
uccuuguggccugggccuc

SEQ ID NO: 3550327 - RNA, 18 nt, Human
uccuugugggccugggcu

SEQ ID NO: 3550328 - RNA, 14 nt, Human
uccuuguuccuaga

SEQ ID NO: 3550329 - RNA, 14 nt, Human
uccuuguuguuggu

SEQ ID NO: 3550330 - RNA, 20 nt, Human
uccuuguuuaucagauacau

SEQ ID NO: 3550331 - RNA, 21 nt, Human
uccuuguuuaucagauacauc

SEQ ID NO: 3550332 - RNA, 15 nt, Human
uccuuuaaaaaagaa

SEQ ID NO: 3550333 - RNA, 13 nt, Human
uccuuuaauugua

SEQ ID NO: 3550334 - RNA, 15 nt, Human
uccuuuaauuguaaa

SEQ ID NO: 3550335 - RNA, 21 nt, Human
uccuuuaauuuuuuacuauuu

SEQ ID NO: 3550336 - RNA, 15 nt, Human
uccuuuacaaaagaa

SEQ ID NO: 3550337 - RNA, 19 nt, Human
uccuuuacacucaggcuuu

SEQ ID NO: 3550338 - RNA, 14 nt, Human
uccuuuacguguuu

SEQ ID NO: 3550339 - RNA, 15 nt, Human
uccuuuacuuucccu

SEQ ID NO: 3550340 - RNA, 17 nt, Human
uccuuuacuuucccuug

SEQ ID NO: 3550341 - RNA, 22 nt, Human
uccuuuagauagcagccuggcu

SEQ ID NO: 3550342 - RNA, 13 nt, Human
uccuuuaugugaa

SEQ ID NO: 3550343 - RNA, 21 nt, Human
uccuuuauguggaaaacagaa

SEQ ID NO: 3550344 - RNA, 20 nt, Human
uccuuucacaaccuucugug

SEQ ID NO: 3550345 - RNA, 13 nt, Human
uccuuucacuucu

SEQ ID NO: 3550346 - RNA, 22 nt, Human
uccuuucagggaauuucaggaa

SEQ ID NO: 3550347 - RNA, 14 nt, Human
uccuuuccaccuuc

SEQ ID NO: 3550348 - RNA, 19 nt, Human
uccuuuccaccuucucaca

SEQ ID NO: 3550349 - RNA, 14 nt, Human
uccuuuccagguau

SEQ ID NO: 3550350 - RNA, 21 nt, Human
uccuuuccaguggccuggcuc

SEQ ID NO: 3550351 - RNA, 16 nt, Human
uccuuuccccagccca

SEQ ID NO: 3550352 - RNA, 20 nt, Human
uccuuuccccagcccagggu

SEQ ID NO: 3550353 - RNA, 18 nt, Human
uccuuucccuuccucuuc

SEQ ID NO: 3550354 - RNA, 13 nt, Human
uccuuucccuuua

SEQ ID NO: 3550355 - RNA, 15 nt, Human
uccuuucuauugaaa

SEQ ID NO: 3550356 - RNA, 16 nt, Human
uccuuucuccagccag

SEQ ID NO: 3550357 - RNA, 17 nt, Human
uccuuucuccagccagc

SEQ ID NO: 3550358 - RNA, 18 nt, Human
uccuuucuccagccagca

SEQ ID NO: 3550359 - RNA, 23 nt, Human
uccuuucucuuucucucuucccu

SEQ ID NO: 3550360 - RNA, 12 nt, Human
uccuuucuugau

SEQ ID NO: 3550361 - RNA, 22 nt, Human
uccuuucuugguucauaaauga

SEQ ID NO: 3550362 - RNA, 15 nt, Human
uccuuucuuucuaac

SEQ ID NO: 3550363 - RNA, 20 nt, Human
uccuuugaagaggaaaauga

SEQ ID NO: 3550364 - RNA, 22 nt, Human
uccuuugaagauaguaacugua

SEQ ID NO: 3550365 - RNA, 20 nt, Human
uccuuugaauccucucucug

SEQ ID NO: 3550366 - RNA, 22 nt, Human
uccuuugaucaguauaauuuuu

SEQ ID NO: 3550367 - RNA, 17 nt, Human
uccuuugcacugagggc

SEQ ID NO: 3550368 - RNA, 20 nt, Human
uccuuugcacugagggccac

SEQ ID NO: 3550369 - RNA, 14 nt, Human
uccuuugcagggca

SEQ ID NO: 3550370 - RNA, 17 nt, Human
uccuuugcagggcagcc

SEQ ID NO: 3550371 - RNA, 17 nt, Human
uccuuugcgccugugac

SEQ ID NO: 3550372 - RNA, 23 nt, Human
uccuuuguauauuauuucuagga

SEQ ID NO: 3550373 - RNA, 15 nt, Human
uccuuuguauucugu

SEQ ID NO: 3550374 - RNA, 18 nt, Human
uccuuuguauucugucuu

SEQ ID NO: 3550375 - RNA, 18 nt, Human
uccuuuguguguguguca

SEQ ID NO: 3550376 - RNA, 13 nt, Human
uccuuuguuacuu

SEQ ID NO: 3550377 - RNA, 15 nt, Human
uccuuuguucccggc

SEQ ID NO: 3550378 - RNA, 24 nt, Human
uccuuuguucuuaccuguaugucu

SEQ ID NO: 3550379 - RNA, 23 nt, Human
uccuuuuaaagaaaaaaauugaa

SEQ ID NO: 3550380 - RNA, 20 nt, Human
uccuuuuaaaucuugauacc

SEQ ID NO: 3550381 - RNA, 12 nt, Human
uccuuuuaacug

SEQ ID NO: 3550382 - RNA, 17 nt, Human
uccuuuuaauuuuccug

SEQ ID NO: 3550383 - RNA, 15 nt, Human
uccuuuuauagguga

SEQ ID NO: 3550384 - RNA, 12 nt, Human
uccuuuuauguu

SEQ ID NO: 3550385 - RNA, 23 nt, Human
uccuuuucacaguucucuccuuc

SEQ ID NO: 3550386 - RNA, 12 nt, Human
uccuuuucacug

SEQ ID NO: 3550387 - RNA, 21 nt, Human
uccuuuucauaggucugaaau

SEQ ID NO: 3550388 - RNA, 13 nt, Human
uccuuuuccagag

SEQ ID NO: 3550389 - RNA, 14 nt, Human
uccuuuucccugcu

SEQ ID NO: 3550390 - RNA, 10 nt, Human
uccuuuucuu

SEQ ID NO: 3550391 - RNA, 10 nt, Human
ucgaggccug

SEQ ID NO: 3550392 - RNA, 12 nt, Human
ucgaggccugaa

SEQ ID NO: 3550393 - RNA, 20 nt, Human
ucgaggccugaagccagcug

SEQ ID NO: 3550394 - RNA, 17 nt, Human
ucgaggcggaucuuugg

SEQ ID NO: 3550395 - RNA, 23 nt, Human
ucgagguagguggaucaccugag

SEQ ID NO: 3550396 - RNA, 20 nt, Human
ucgaggugccuucuucaggg

SEQ ID NO: 3550397 - RNA, 13 nt, Human
ucgaguacugugg

SEQ ID NO: 3550398 - RNA, 14 nt, Human
ucgaguacuguggg

SEQ ID NO: 3550399 - RNA, 20 nt, Human
ucgagugccgcaucucacag

SEQ ID NO: 3550400 - RNA, 16 nt, Human
ucgaguggcccaacag

SEQ ID NO: 3550401 - RNA, 17 nt, Human
ucgaguuacagacaaag

SEQ ID NO: 3550402 - RNA, 17 nt, Human
ucgaguuacagccuggg

SEQ ID NO: 3550403 - RNA, 15 nt, Human
ucgaguucccagggu

SEQ ID NO: 3550404 - RNA, 14 nt, Human
ucgauacugcgacu

SEQ ID NO: 3550405 - RNA, 19 nt, Human
ucgauacugcgacuuucug

SEQ ID NO: 3550406 - RNA, 21 nt, Human
ucgauccaaauugugcuucuc

SEQ ID NO: 3550407 - RNA, 20 nt, Human
ucgaucucauucaguauuaa

SEQ ID NO: 3550408 - RNA, 16 nt, Human
ucgauguuauguaaaa

SEQ ID NO: 3550409 - RNA, 18 nt, Human
ucgauuagacuggacagc

SEQ ID NO: 3550410 - RNA, 13 nt, Human
ucgauuuuguauc

SEQ ID NO: 3550411 - RNA, 12 nt, Human
ucgcaccuacca

SEQ ID NO: 3550412 - RNA, 18 nt, Human
ucgcaccuaccaucaggg

SEQ ID NO: 3550413 - RNA, 19 nt, Human
ucgcacucuggcagcaccg

SEQ ID NO: 3550414 - RNA, 12 nt, Human
ucgcagagaggc

SEQ ID NO: 3550415 - RNA, 19 nt, Human
ucgcagagcuuuucagauu

SEQ ID NO: 3550416 - RNA, 19 nt, Human
ucgcagccacccugaggag

SEQ ID NO: 3550417 - RNA, 21 nt, Human
ucgcaggauucuuccucccuc

SEQ ID NO: 3550418 - RNA, 14 nt, Human
ucgcaucaaaagac

SEQ ID NO: 3550419 - RNA, 17 nt, Human
ucgcaucaaaagacaau

SEQ ID NO: 3550420 - RNA, 15 nt, Human
ucgcaucauugcaga

SEQ ID NO: 3550421 - RNA, 14 nt, Human
ucgcaucuucccaa

SEQ ID NO: 3550422 - RNA, 13 nt, Human
ucgcauuugucaa

SEQ ID NO: 3550423 - RNA, 16 nt, Human
ucgccaacauggugaa

SEQ ID NO: 3550424 - RNA, 18 nt, Human
ucgccaccuggcauuccu

SEQ ID NO: 3550425 - RNA, 20 nt, Human
ucgccagcugaugacucaag

SEQ ID NO: 3550426 - RNA, 13 nt, Human
ucgccaugccggg

SEQ ID NO: 3550427 - RNA, 14 nt, Human
ucgccaugccgggg

SEQ ID NO: 3550428 - RNA, 14 nt, Human
ucgcccaccgcaug

SEQ ID NO: 3550429 - RNA, 11 nt, Human
ucgcccaggag

SEQ ID NO: 3550430 - RNA, 14 nt, Human
ucgcccaggcugga

SEQ ID NO: 3550431 - RNA, 19 nt, Human
ucgcccaggcuggagugca

SEQ ID NO: 3550432 - RNA, 17 nt, Human
ucgcccagucccagcag

SEQ ID NO: 3550433 - RNA, 13 nt, Human
ucgcccccaccuc

SEQ ID NO: 3550434 - RNA, 22 nt, Human
ucgcccgagcuguuuauguuuu

SEQ ID NO: 3550435 - RNA, 15 nt, Human
ucgcccgcccacugu

SEQ ID NO: 3550436 - RNA, 17 nt, Human
ucgcccgcccacugucc

SEQ ID NO: 3550437 - RNA, 18 nt, Human
ucgcccgcccacuguccu

SEQ ID NO: 3550438 - RNA, 20 nt, Human
ucgcccgcccacuguccugg

SEQ ID NO: 3550439 - RNA, 13 nt, Human
ucgcccucccagg

SEQ ID NO: 3550440 - RNA, 14 nt, Human
ucgcccuccuuucu

SEQ ID NO: 3550441 - RNA, 16 nt, Human
ucgcccuccuuucugu

SEQ ID NO: 3550442 - RNA, 18 nt, Human
ucgcccuggacugugugc

SEQ ID NO: 3550443 - RNA, 13 nt, Human
ucgcccuggcagg

SEQ ID NO: 3550444 - RNA, 17 nt, Human
ucgcccuggcaggcagg

SEQ ID NO: 3550445 - RNA, 23 nt, Human
ucgcccuuacuucuugcccuggg

SEQ ID NO: 3550446 - RNA, 17 nt, Human
ucgccggaucugaggga

SEQ ID NO: 3550447 - RNA, 15 nt, Human
ucgccgucugugaau

SEQ ID NO: 3550448 - RNA, 11 nt, Human
ucgccugacaa

SEQ ID NO: 3550449 - RNA, 22 nt, Human
ucgccugacaaccacuggucug

SEQ ID NO: 3550450 - RNA, 14 nt, Human
ucgccuggagcccu

SEQ ID NO: 3550451 - RNA, 18 nt, Human
ucgccuguggagcucagc

SEQ ID NO: 3550452 - RNA, 19 nt, Human
ucgccuguggagcucagcc

SEQ ID NO: 3550453 - RNA, 19 nt, Human
ucgccuuccaccucuggga

SEQ ID NO: 3550454 - RNA, 15 nt, Human
ucgccuucccuccug

SEQ ID NO: 3550455 - RNA, 16 nt, Human
ucgccuucccuccugc

SEQ ID NO: 3550456 - RNA, 14 nt, Human
ucgccuuucagcag

SEQ ID NO: 3550457 - RNA, 12 nt, Human
ucgccuuuccuc

SEQ ID NO: 3550458 - RNA, 13 nt, Human
ucgccuuuccucu

SEQ ID NO: 3550459 - RNA, 21 nt, Human
ucgccuuuccucucuauauuu

SEQ ID NO: 3550460 - RNA, 17 nt, Human
ucgcgcccgccccugca

SEQ ID NO: 3550461 - RNA, 19 nt, Human
ucgcgcccgccccugcagc

SEQ ID NO: 3550462 - RNA, 16 nt, Human
ucgcgcugccugugug

SEQ ID NO: 3550463 - RNA, 22 nt, Human
ucgcggcccucaguagucccug

SEQ ID NO: 3550464 - RNA, 14 nt, Human
ucgcuccccacucu

SEQ ID NO: 3550465 - RNA, 17 nt, Human
ucgcucccucccaggac

SEQ ID NO: 3550466 - RNA, 18 nt, Human
ucgcuccucaaccccucc

SEQ ID NO: 3550467 - RNA, 15 nt, Human
ucgcuccugcagccc

SEQ ID NO: 3550468 - RNA, 14 nt, Human
ucgcuccugugucu

SEQ ID NO: 3550469 - RNA, 14 nt, Human
ucgcucucaguucu

SEQ ID NO: 3550470 - RNA, 15 nt, Human
ucgcucugcuggccu

SEQ ID NO: 3550471 - RNA, 17 nt, Human
ucgcucugcuggccugg

SEQ ID NO: 3550472 - RNA, 19 nt, Human
ucgcucuguuacccagggu

SEQ ID NO: 3550473 - RNA, 18 nt, Human
ucgcugacuucauggaau

SEQ ID NO: 3550474 - RNA, 22 nt, Human
ucgcugauauauguguuuuuca

SEQ ID NO: 3550475 - RNA, 16 nt, Human
ucgcugaugcugggcu

SEQ ID NO: 3550476 - RNA, 22 nt, Human
ucgcugaugcugggcugggugc

SEQ ID NO: 3550477 - RNA, 18 nt, Human
ucgcuggcccccacuggc

SEQ ID NO: 3550478 - RNA, 11 nt, Human
ucgcuguccuu

SEQ ID NO: 3550479 - RNA, 16 nt, Human
ucgcugugccacaggc

SEQ ID NO: 3550480 - RNA, 16 nt, Human
ucgcugugguuguuuu

SEQ ID NO: 3550481 - RNA, 15 nt, Human
ucgcuguugcugaau

SEQ ID NO: 3550482 - RNA, 15 nt, Human
ucuaaugucuucauu

SEQ ID NO: 3550483 - RNA, 17 nt, Human
ucuaaugucuucauuuc

SEQ ID NO: 3550484 - RNA, 12 nt, Human
ucuaauguuuaa

SEQ ID NO: 3550485 - RNA, 14 nt, Human
ucuaauguuugcau

SEQ ID NO: 3550486 - RNA, 15 nt, Human
ucuaauguuugcaua

SEQ ID NO: 3550487 - RNA, 16 nt, Human
ucuaauuaaaacacuu

SEQ ID NO: 3550488 - RNA, 18 nt, Human
ucuaauuauguagcucuu

SEQ ID NO: 3550489 - RNA, 21 nt, Human
ucuaauuauguagcucuuugu

SEQ ID NO: 3550490 - RNA, 13 nt, Human
ucuaauucuaacc

SEQ ID NO: 3550491 - RNA, 21 nt, Human
ucuaauucuaaccagagcaag

SEQ ID NO: 3550492 - RNA, 15 nt, Human
ucuaauucucugugg

SEQ ID NO: 3550493 - RNA, 12 nt, Human
ucuaauucugau

SEQ ID NO: 3550494 - RNA, 14 nt, Human
ucuaauucugauuc

SEQ ID NO: 3550495 - RNA, 18 nt, Human
ucuaauucuuccuuugua

SEQ ID NO: 3550496 - RNA, 21 nt, Human
ucuaauugaauuuucaagcau

SEQ ID NO: 3550497 - RNA, 17 nt, Human
ucuaauugcaucucaaa

SEQ ID NO: 3550498 - RNA, 15 nt, Human
ucuaauugccaugua

SEQ ID NO: 3550499 - RNA, 15 nt, Human
ucuaauugcuuauuu

SEQ ID NO: 3550500 - RNA, 22 nt, Human
ucuaauuggaagaaauuccugu

SEQ ID NO: 3550501 - RNA, 23 nt, Human
ucuaauuuaucuugucucugggc

SEQ ID NO: 3550502 - RNA, 20 nt, Human
ucuaauuucaaaaauauaac

SEQ ID NO: 3550503 - RNA, 22 nt, Human
ucuaauuucaaaaauauaacuu

SEQ ID NO: 3550504 - RNA, 19 nt, Human
ucuaauuuuauuuugugaa

SEQ ID NO: 3550505 - RNA, 16 nt, Human
ucuaauuuuggaugga

SEQ ID NO: 3550506 - RNA, 16 nt, Human
ucuaauuuuuaagcaa

SEQ ID NO: 3550507 - RNA, 18 nt, Human
ucuacaaaauccugauga

SEQ ID NO: 3550508 - RNA, 13 nt, Human
ucuacaaauaauu

SEQ ID NO: 3550509 - RNA, 18 nt, Human
ucuacaaauauaagauuu

SEQ ID NO: 3550510 - RNA, 19 nt, Human
ucuacaaauauaagauuuu

SEQ ID NO: 3550511 - RNA, 16 nt, Human
ucuacaaugacacaca

SEQ ID NO: 3550512 - RNA, 21 nt, Human
ucuacacauauaaauugucuu

SEQ ID NO: 3550513 - RNA, 21 nt, Human
ucuacaccuugcuuuuuuacu

SEQ ID NO: 3550514 - RNA, 21 nt, Human
ucuacacuaagagagaaugag

SEQ ID NO: 3550515 - RNA, 17 nt, Human
ucuacacucuccugggc

SEQ ID NO: 3550516 - RNA, 14 nt, Human
ucuacacugugcug

SEQ ID NO: 3550517 - RNA, 13 nt, Human
ucuacagaaaaac

SEQ ID NO: 3550518 - RNA, 16 nt, Human
ucuacagacuucucca

SEQ ID NO: 3550519 - RNA, 17 nt, Human
ucuacagacuucuccag

SEQ ID NO: 3550520 - RNA, 19 nt, Human
ucuacagagcuucccugac

SEQ ID NO: 3550521 - RNA, 16 nt, Human
ucuacagaggccaugg

SEQ ID NO: 3550522 - RNA, 17 nt, Human
ucuacagaugucccauu

SEQ ID NO: 3550523 - RNA, 16 nt, Human
ucuacagcaaauuuau

SEQ ID NO: 3550524 - RNA, 17 nt, Human
ucuacagcaaauuuaua

SEQ ID NO: 3550525 - RNA, 20 nt, Human
ucuacagcuaaucagcauuc

SEQ ID NO: 3550526 - RNA, 23 nt, Human
ucuacagcuaaucagcauucuca

SEQ ID NO: 3550527 - RNA, 16 nt, Human
ucuacagcucccccag

SEQ ID NO: 3550528 - RNA, 23 nt, Human
ucuacagguuuggguacaagugg

SEQ ID NO: 3550529 - RNA, 18 nt, Human
ucuacagucucgucucuu

SEQ ID NO: 3550530 - RNA, 13 nt, Human
ucuacaguguccu

SEQ ID NO: 3550531 - RNA, 22 nt, Human
ucuacauaaguaauucaagaaa

SEQ ID NO: 3550532 - RNA, 16 nt, Human
ucuacauaugaucugu

SEQ ID NO: 3550533 - RNA, 16 nt, Human
ucuacaucuucugccu

SEQ ID NO: 3550534 - RNA, 14 nt, Human
ucuacauuauugcu

SEQ ID NO: 3550535 - RNA, 22 nt, Human
ucuacauuucacauuauucugg

SEQ ID NO: 3550536 - RNA, 17 nt, Human
ucuaccaaaaaucucaa

SEQ ID NO: 3550537 - RNA, 17 nt, Human
ucuaccaaccuguucaa

SEQ ID NO: 3550538 - RNA, 16 nt, Human
ucuaccaacuggaagc

SEQ ID NO: 3550539 - RNA, 21 nt, Human
ucuaccagacuguguauucau

SEQ ID NO: 3550540 - RNA, 23 nt, Human
ucuaccagugcaggcuggccagc

SEQ ID NO: 3550541 - RNA, 15 nt, Human
ucuaccaucucccuc

SEQ ID NO: 3550542 - RNA, 17 nt, Human
ucuaccauuuucugguu

SEQ ID NO: 3550543 - RNA, 16 nt, Human
ucuacccaaacccuag

SEQ ID NO: 3550544 - RNA, 22 nt, Human
ucuacccaaacccuagguuccc

SEQ ID NO: 3550545 - RNA, 16 nt, Human
ucuacccagcccaucu

SEQ ID NO: 3550546 - RNA, 19 nt, Human
ucuacccagcgagcccugg

SEQ ID NO: 3550547 - RNA, 20 nt, Human
ucuacccagcgagcccuggu

SEQ ID NO: 3550548 - RNA, 18 nt, Human
ucuaccccagacuagaug

SEQ ID NO: 3550549 - RNA, 23 nt, Human
ucuaccccagacuagauguagua

SEQ ID NO: 3550550 - RNA, 14 nt, Human
ucuacccuggcacu

SEQ ID NO: 3550551 - RNA, 13 nt, Human
ucuacccugggau

SEQ ID NO: 3550552 - RNA, 18 nt, Human
ucuaccggagagagaaug

SEQ ID NO: 3550553 - RNA, 21 nt, Human
ucuaccuagauuuaauauaaa

SEQ ID NO: 3550554 - RNA, 22 nt, Human
ucuaccuagauuuaauauaaag

SEQ ID NO: 3550555 - RNA, 15 nt, Human
ucuaccugccacuca

SEQ ID NO: 3550556 - RNA, 12 nt, Human
ucuaccuggagg

SEQ ID NO: 3550557 - RNA, 13 nt, Human
ucuaccuggaggg

SEQ ID NO: 3550558 - RNA, 15 nt, Human
ucuaccuggucuggu

SEQ ID NO: 3550559 - RNA, 14 nt, Human
ucuaccuucauaag

SEQ ID NO: 3550560 - RNA, 20 nt, Human
ucuaccuucuccccagcucc

SEQ ID NO: 3550561 - RNA, 16 nt, Human
ucuaccuugaggucuu

SEQ ID NO: 3550562 - RNA, 17 nt, Human
ucuaccuugaggucuuu

SEQ ID NO: 3550563 - RNA, 21 nt, Human
ucuacggaucaucaacaagau

SEQ ID NO: 3550564 - RNA, 19 nt, Human
ucuacuaaugccucuucau

SEQ ID NO: 3550565 - RNA, 18 nt, Human
ucuacuaauuccacaccu

SEQ ID NO: 3550566 - RNA, 20 nt, Human
ucuacucacuuuucccacuc

SEQ ID NO: 3550567 - RNA, 14 nt, Human
ucuacucagaaauu

SEQ ID NO: 3550568 - RNA, 14 nt, Human
ucuacucauauaua

SEQ ID NO: 3550569 - RNA, 18 nt, Human
ucuacucauuccccgggg

SEQ ID NO: 3550570 - RNA, 22 nt, Human
ucuacucauuuaaaguauuuua

SEQ ID NO: 3550571 - RNA, 17 nt, Human
ucuacuccuaccucagc

SEQ ID NO: 3550572 - RNA, 19 nt, Human
ucuacuccuaccucagccu

SEQ ID NO: 3550573 - RNA, 22 nt, Human
ucuacuccuaccucagccuaga

SEQ ID NO: 3550574 - RNA, 19 nt, Human
ucuacuccuuguaaagacu

SEQ ID NO: 3550575 - RNA, 13 nt, Human
ucuacucucccau

SEQ ID NO: 3550576 - RNA, 18 nt, Human
ucuacucucuuuuaauau

SEQ ID NO: 3550577 - RNA, 16 nt, Human
ucuacucuuaagccau

SEQ ID NO: 3550578 - RNA, 21 nt, Human
ucuacucuuaaguuucucagc

SEQ ID NO: 3550579 - RNA, 15 nt, Human
ucuacucuuuuuguu

SEQ ID NO: 3550580 - RNA, 19 nt, Human
ucuacugggaaggcuacuu

SEQ ID NO: 3550581 - RNA, 20 nt, Human
ucuacugggaaggcuacuuc

SEQ ID NO: 3550582 - RNA, 16 nt, Human
ucuacuggucuugugg

SEQ ID NO: 3550583 - RNA, 20 nt, Human
ucuacuggucuuguggaauu

SEQ ID NO: 3550584 - RNA, 22 nt, Human
ucuacugucaaaugaugugcaa

SEQ ID NO: 3550585 - RNA, 19 nt, Human
ucuacuuacacaucuucca

SEQ ID NO: 3550586 - RNA, 20 nt, Human
ucuacuugccagaaccaaau

SEQ ID NO: 3550587 - RNA, 17 nt, Human
ucuacuugcucuggacc

SEQ ID NO: 3550588 - RNA, 18 nt, Human
ucuacuugcucuggaccu

SEQ ID NO: 3550589 - RNA, 19 nt, Human
ucuacuugcucuggaccug

SEQ ID NO: 3550590 - RNA, 21 nt, Human
ucuacuuuauuaauuguuuug

SEQ ID NO: 3550591 - RNA, 16 nt, Human
ucuacuuugaggaaac

SEQ ID NO: 3550592 - RNA, 16 nt, Human
ucuagaaaaacaggca

SEQ ID NO: 3550593 - RNA, 17 nt, Human
ucuagaaaaacaggcac

SEQ ID NO: 3550594 - RNA, 13 nt, Human
ucuagaaagaaua

SEQ ID NO: 3550595 - RNA, 19 nt, Human
ucuagaaagagaaacaguu

SEQ ID NO: 3550596 - RNA, 15 nt, Human
ucuagaacacaggca

SEQ ID NO: 3550597 - RNA, 16 nt, Human
ucuagaagaaaugaaa

SEQ ID NO: 3550598 - RNA, 20 nt, Human
ucuagaagacugucagcuuc

SEQ ID NO: 3550599 - RNA, 20 nt, Human
ucuagaagagucuauugucu

SEQ ID NO: 3550600 - RNA, 21 nt, Human
ucuagaagagucuauugucuc

SEQ ID NO: 3550601 - RNA, 21 nt, Human
ucuagaagccaagggaaaggg

SEQ ID NO: 3550602 - RNA, 18 nt, Human
ucuagaaguuucccuucc

SEQ ID NO: 3550603 - RNA, 19 nt, Human
ucuagaauuuaucacacuu

SEQ ID NO: 3550604 - RNA, 13 nt, Human
ucuagacaacccu

SEQ ID NO: 3550605 - RNA, 17 nt, Human
ucuagacaacccugcaa

SEQ ID NO: 3550606 - RNA, 14 nt, Human
ucuagacaagauau

SEQ ID NO: 3550607 - RNA, 18 nt, Human
ucuagacaagauauugua

SEQ ID NO: 3550608 - RNA, 20 nt, Human
ucuagacaagauauuguaca

SEQ ID NO: 3550609 - RNA, 23 nt, Human
ucuagacaauauacaagccaaag

SEQ ID NO: 3550610 - RNA, 14 nt, Human
ucuagacacugcca

SEQ ID NO: 3550611 - RNA, 18 nt, Human
ucuagaccaggaccuccc

SEQ ID NO: 3550612 - RNA, 14 nt, Human
ucuagacuaaaaga

SEQ ID NO: 3550613 - RNA, 15 nt, Human
ucuagacuuucuguu

SEQ ID NO: 3550614 - RNA, 16 nt, Human
ucuagagauaguacau

SEQ ID NO: 3550615 - RNA, 16 nt, Human
ucuagagauauauaua

SEQ ID NO: 3550616 - RNA, 20 nt, Human
ucuagagccgugaugccucc

SEQ ID NO: 3550617 - RNA, 13 nt, Human
ucuagagccuuca

SEQ ID NO: 3550618 - RNA, 9 nt, Human
ucuagaggc

SEQ ID NO: 3550619 - RNA, 19 nt, Human
ucuagaggccugaaauccu

SEQ ID NO: 3550620 - RNA, 21 nt, Human
ucuagaggccugaaauccugg

SEQ ID NO: 3550621 - RNA, 22 nt, Human
ucuagaguagagguauaauugu

SEQ ID NO: 3550622 - RNA, 17 nt, Human
ucuagauaccuaaaaca

SEQ ID NO: 3550623 - RNA, 18 nt, Human
ucuagauaccuaaaacau

SEQ ID NO: 3550624 - RNA, 19 nt, Human
ucuagauaccuaaaacaua

SEQ ID NO: 3550625 - RNA, 13 nt, Human
ucuagauacugua

SEQ ID NO: 3550626 - RNA, 20 nt, Human
ucuagaucagaugcuccaag

SEQ ID NO: 3550627 - RNA, 21 nt, Human
ucuagaugaaguuuuacauug

SEQ ID NO: 3550628 - RNA, 22 nt, Human
ucuagaugaaguuuuacauugu

SEQ ID NO: 3550629 - RNA, 20 nt, Human
ucuagauggcuccucucagu

SEQ ID NO: 3550630 - RNA, 20 nt, Human
ucuagauuaauacucuauuu

SEQ ID NO: 3550631 - RNA, 18 nt, Human
ucugcacucccaccugac

SEQ ID NO: 3550632 - RNA, 14 nt, Human
ucugcacuccccug

SEQ ID NO: 3550633 - RNA, 15 nt, Human
ucugcacuccccugc

SEQ ID NO: 3550634 - RNA, 18 nt, Human
ucugcacuccccugcugg

SEQ ID NO: 3550635 - RNA, 19 nt, Human
ucugcacuccccugcuggg

SEQ ID NO: 3550636 - RNA, 15 nt, Human
ucugcacugagcaga

SEQ ID NO: 3550637 - RNA, 15 nt, Human
ucugcagaagaggag

SEQ ID NO: 3550638 - RNA, 21 nt, Human
ucugcagaaggaaaaaugugu

SEQ ID NO: 3550639 - RNA, 22 nt, Human
ucugcagaaggaaaaaugugua

SEQ ID NO: 3550640 - RNA, 23 nt, Human
ucugcagacacgccuuccccuca

SEQ ID NO: 3550641 - RNA, 12 nt, Human
ucugcagagcag

SEQ ID NO: 3550642 - RNA, 19 nt, Human
ucugcagauagaaagcauu

SEQ ID NO: 3550643 - RNA, 17 nt, Human
ucugcagcaauaaagca

SEQ ID NO: 3550644 - RNA, 18 nt, Human
ucugcagcaauaaagcag

SEQ ID NO: 3550645 - RNA, 14 nt, Human
ucugcagccagccc

SEQ ID NO: 3550646 - RNA, 18 nt, Human
ucugcagccagcccagcc

SEQ ID NO: 3550647 - RNA, 19 nt, Human
ucugcagccagcccagccc

SEQ ID NO: 3550648 - RNA, 13 nt, Human
ucugcagccuuga

SEQ ID NO: 3550649 - RNA, 13 nt, Human
ucugcagcugacc

SEQ ID NO: 3550650 - RNA, 14 nt, Human
ucugcagcugaccu

SEQ ID NO: 3550651 - RNA, 13 nt, Human
ucugcagcugccg

SEQ ID NO: 3550652 - RNA, 14 nt, Human
ucugcagcugccgg

SEQ ID NO: 3550653 - RNA, 14 nt, Human
ucugcaggcagggc

SEQ ID NO: 3550654 - RNA, 19 nt, Human
ucugcaggcuuaauaaaaa

SEQ ID NO: 3550655 - RNA, 20 nt, Human
ucugcagggccgccagggag

SEQ ID NO: 3550656 - RNA, 19 nt, Human
ucugcagggggugugucug

SEQ ID NO: 3550657 - RNA, 13 nt, Human
ucugcaggucccu

SEQ ID NO: 3550658 - RNA, 14 nt, Human
ucugcaggucccua

SEQ ID NO: 3550659 - RNA, 22 nt, Human
ucugcaggucccuaauaaagcu

SEQ ID NO: 3550660 - RNA, 16 nt, Human
ucugcaguaaaucuuu

SEQ ID NO: 3550661 - RNA, 16 nt, Human
ucugcaguagucucug

SEQ ID NO: 3550662 - RNA, 19 nt, Human
ucugcaguagucucugugc

SEQ ID NO: 3550663 - RNA, 18 nt, Human
ucugcagucucuauacca

SEQ ID NO: 3550664 - RNA, 13 nt, Human
ucugcagugccuu

SEQ ID NO: 3550665 - RNA, 15 nt, Human
ucugcagugccuugg

SEQ ID NO: 3550666 - RNA, 18 nt, Human
ucugcauauguugaauac

SEQ ID NO: 3550667 - RNA, 16 nt, Human
ucugcaucaucuguag

SEQ ID NO: 3550668 - RNA, 19 nt, Human
ucugcaucaucuguagaua

SEQ ID NO: 3550669 - RNA, 21 nt, Human
ucugcauccagagauucauuu

SEQ ID NO: 3550670 - RNA, 19 nt, Human
ucugcauccucuggagcca

SEQ ID NO: 3550671 - RNA, 21 nt, Human
ucugcauccucuggagccagc

SEQ ID NO: 3550672 - RNA, 11 nt, Human
ucugcaucucc

SEQ ID NO: 3550673 - RNA, 17 nt, Human
ucugcaucuccugucuu

SEQ ID NO: 3550674 - RNA, 13 nt, Human
ucugcaucugacc

SEQ ID NO: 3550675 - RNA, 19 nt, Human
ucugcaugcggcccagccc

SEQ ID NO: 3550676 - RNA, 21 nt, Human
ucugcauucauuuuuauagca

SEQ ID NO: 3550677 - RNA, 14 nt, Human
ucugcauuuagcac

SEQ ID NO: 3550678 - RNA, 19 nt, Human
ucugcauuucgguggcuag

SEQ ID NO: 3550679 - RNA, 14 nt, Human
ucugcauuugucua

SEQ ID NO: 3550680 - RNA, 22 nt, Human
ucugcauuuugcuauuguaaau

SEQ ID NO: 3550681 - RNA, 14 nt, Human
ucugccaaccuaaa

SEQ ID NO: 3550682 - RNA, 18 nt, Human
ucugccaaccuaaaacuc

SEQ ID NO: 3550683 - RNA, 22 nt, Human
ucugccaauuuuugccuucauu

SEQ ID NO: 3550684 - RNA, 10 nt, Human
ucugccacca

SEQ ID NO: 3550685 - RNA, 15 nt, Human
ucugccaccagagac

SEQ ID NO: 3550686 - RNA, 15 nt, Human
ucugccacccaggau

SEQ ID NO: 3550687 - RNA, 22 nt, Human
ucugccaccccuaaacuccagg

SEQ ID NO: 3550688 - RNA, 21 nt, Human
ucugccacccuaccuguucag

SEQ ID NO: 3550689 - RNA, 20 nt, Human
ucugccagaagauccccuca

SEQ ID NO: 3550690 - RNA, 23 nt, Human
ucugccagauguccuaaugguga

SEQ ID NO: 3550691 - RNA, 17 nt, Human
ucugccagccagcagcc

SEQ ID NO: 3550692 - RNA, 19 nt, Human
ucugccagccagcagccag

SEQ ID NO: 3550693 - RNA, 15 nt, Human
ucugccaggagacag

SEQ ID NO: 3550694 - RNA, 12 nt, Human
ucugccagggag

SEQ ID NO: 3550695 - RNA, 14 nt, Human
ucugccagggagcu

SEQ ID NO: 3550696 - RNA, 19 nt, Human
ucugccagggagcuugaaa

SEQ ID NO: 3550697 - RNA, 13 nt, Human
ucugccagggcag

SEQ ID NO: 3550698 - RNA, 20 nt, Human
ucugccagggccccucuccc

SEQ ID NO: 3550699 - RNA, 24 nt, Human
ucugccagggccccucuccccagg

SEQ ID NO: 3550700 - RNA, 14 nt, Human
ucugccaguccugu

SEQ ID NO: 3550701 - RNA, 17 nt, Human
ucugccaguccuguccu

SEQ ID NO: 3550702 - RNA, 13 nt, Human
ucugccagugaca

SEQ ID NO: 3550703 - RNA, 21 nt, Human
ucugccagugacagacaggcu

SEQ ID NO: 3550704 - RNA, 23 nt, Human
ucugccagugacagacaggcucu

SEQ ID NO: 3550705 - RNA, 13 nt, Human
ucugccaucaacu

SEQ ID NO: 3550706 - RNA, 18 nt, Human
ucugccaucuagccagcc

SEQ ID NO: 3550707 - RNA, 19 nt, Human
ucugccaugaacuggaggc

SEQ ID NO: 3550708 - RNA, 19 nt, Human
ucugccauguugccccuuu

SEQ ID NO: 3550709 - RNA, 12 nt, Human
ucugcccaaccc

SEQ ID NO: 3550710 - RNA, 13 nt, Human
ucugcccacuccc

SEQ ID NO: 3550711 - RNA, 17 nt, Human
ucugcccacucccugca

SEQ ID NO: 3550712 - RNA, 21 nt, Human
ucugcccacucccugcaaccu

SEQ ID NO: 3550713 - RNA, 12 nt, Human
ucugcccagcuu

SEQ ID NO: 3550714 - RNA, 17 nt, Human
ucugcccagcuuuucau

SEQ ID NO: 3550715 - RNA, 18 nt, Human
ucugcccagcuuuucauu

SEQ ID NO: 3550716 - RNA, 23 nt, Human
ucugcccaggacggggccggcca

SEQ ID NO: 3550717 - RNA, 20 nt, Human
ucugcccaggggugcccccu

SEQ ID NO: 3550718 - RNA, 20 nt, Human
ucugcccauccugccccuga

SEQ ID NO: 3550719 - RNA, 16 nt, Human
ucugcccauuccccag

SEQ ID NO: 3550720 - RNA, 15 nt, Human
ucugccccaaguuuu

SEQ ID NO: 3550721 - RNA, 16 nt, Human
ucugccccaaguuuug

SEQ ID NO: 3550722 - RNA, 22 nt, Human
ucugccccaaguuuugugaaau

SEQ ID NO: 3550723 - RNA, 15 nt, Human
ucugccccagaggcc

SEQ ID NO: 3550724 - RNA, 20 nt, Human
ucugccccagcccagauucc

SEQ ID NO: 3550725 - RNA, 16 nt, Human
ucugccccagcucugg

SEQ ID NO: 3550726 - RNA, 14 nt, Human
ucugccccagcuug

SEQ ID NO: 3550727 - RNA, 15 nt, Human
ucugccccauccucc

SEQ ID NO: 3550728 - RNA, 13 nt, Human
ucugcccccagcc

SEQ ID NO: 3550729 - RNA, 16 nt, Human
ucugcccccagcccaa

SEQ ID NO: 3550730 - RNA, 15 nt, Human
ucugccccucccugc

SEQ ID NO: 3550731 - RNA, 19 nt, Human
ucugcccgccugcccaccu

SEQ ID NO: 3550732 - RNA, 20 nt, Human
ucugcccgccugcccaccug

SEQ ID NO: 3550733 - RNA, 21 nt, Human
ucugcccgccugcccaccugc

SEQ ID NO: 3550734 - RNA, 22 nt, Human
ucugcccgccugcccaccugcc

SEQ ID NO: 3550735 - RNA, 23 nt, Human
ucugcccgggaaggucaccagca

SEQ ID NO: 3550736 - RNA, 19 nt, Human
ucugcccucuagagccuuc

SEQ ID NO: 3550737 - RNA, 18 nt, Human
ucugcccugcccuagcuc

SEQ ID NO: 3550738 - RNA, 12 nt, Human
ucugcccugcgg

SEQ ID NO: 3550739 - RNA, 13 nt, Human
ucugcccuggcug

SEQ ID NO: 3550740 - RNA, 23 nt, Human
ucugcccuugguuaggcauugug

SEQ ID NO: 3550741 - RNA, 15 nt, Human
ucugccgcagcccug

SEQ ID NO: 3550742 - RNA, 22 nt, Human
ucugccgcagcccugcagaggg

SEQ ID NO: 3550743 - RNA, 17 nt, Human
ucugccggcccuggggc

SEQ ID NO: 3550744 - RNA, 13 nt, Human
ucugccggcucuu

SEQ ID NO: 3550745 - RNA, 21 nt, Human
ucugccggugcucggagaaga

SEQ ID NO: 3550746 - RNA, 13 nt, Human
ucugccuaaggac

SEQ ID NO: 3550747 - RNA, 23 nt, Human
ucugccuaaggacuucuuuaauu

SEQ ID NO: 3550748 - RNA, 15 nt, Human
ucugccuauccuggc

SEQ ID NO: 3550749 - RNA, 16 nt, Human
ucugccucccaucacc

SEQ ID NO: 3550750 - RNA, 17 nt, Human
ucugccucccaucaccc

SEQ ID NO: 3550751 - RNA, 15 nt, Human
ucugccucccucacc

SEQ ID NO: 3550752 - RNA, 18 nt, Human
ucugccucuccaggcauu

SEQ ID NO: 3550753 - RNA, 15 nt, Human
ucugccucugaggga

SEQ ID NO: 3550754 - RNA, 14 nt, Human
ucugccucugaugu

SEQ ID NO: 3550755 - RNA, 20 nt, Human
ucugccucugauguauuuug

SEQ ID NO: 3550756 - RNA, 16 nt, Human
ucugccucugccugca

SEQ ID NO: 3550757 - RNA, 14 nt, Human
ucugccucuucugg

SEQ ID NO: 3550758 - RNA, 17 nt, Human
ucugccucuucugggag

SEQ ID NO: 3550759 - RNA, 12 nt, Human
ucugccugagcu

SEQ ID NO: 3550760 - RNA, 23 nt, Human
ucugccugaggggcagccugccu

SEQ ID NO: 3550761 - RNA, 17 nt, Human
ucugccugccagcugca

SEQ ID NO: 3550762 - RNA, 13 nt, Human
ucugccugcccag

SEQ ID NO: 3550763 - RNA, 14 nt, Human
ucugccugcccagg

SEQ ID NO: 3550764 - RNA, 21 nt, Human
ucugccugcccaggccccugc

SEQ ID NO: 3550765 - RNA, 14 nt, Human
ucugccugccccgc

SEQ ID NO: 3550766 - RNA, 12 nt, Human
ucugccugcccu

SEQ ID NO: 3550767 - RNA, 23 nt, Human
ucugccuggagacuuagggcacc

SEQ ID NO: 3550768 - RNA, 12 nt, Human
ucugccuggagu

SEQ ID NO: 3550769 - RNA, 21 nt, Human
ucugccuggguuuuguucccu

SEQ ID NO: 3550770 - RNA, 12 nt, Human
ucugccuguccc

SEQ ID NO: 3550771 - RNA, 19 nt, Human
ucuucuggguuccuuccuc

SEQ ID NO: 3550772 - RNA, 23 nt, Human
ucuucuguacgucugacaggcaa

SEQ ID NO: 3550773 - RNA, 19 nt, Human
ucuucuguauacuguggag

SEQ ID NO: 3550774 - RNA, 17 nt, Human
ucuucuguauauaaaug

SEQ ID NO: 3550775 - RNA, 22 nt, Human
ucuucuguauauaaaugggaac

SEQ ID NO: 3550776 - RNA, 18 nt, Human
ucuucuguuuucuguuuc

SEQ ID NO: 3550777 - RNA, 17 nt, Human
ucuucuuaauguacaua

SEQ ID NO: 3550778 - RNA, 22 nt, Human
ucuucuuauacagauaaaacau

SEQ ID NO: 3550779 - RNA, 12 nt, Human
ucuucuuaugca

SEQ ID NO: 3550780 - RNA, 13 nt, Human
ucuucuucaaacc

SEQ ID NO: 3550781 - RNA, 15 nt, Human
ucuucuucaaaccuu

SEQ ID NO: 3550782 - RNA, 22 nt, Human
ucuucuucccucccuaucuaac

SEQ ID NO: 3550783 - RNA, 21 nt, Human
ucuucuugaacacucaugcug

SEQ ID NO: 3550784 - RNA, 14 nt, Human
ucuucuuguuucuc

SEQ ID NO: 3550785 - RNA, 21 nt, Human
ucuucuuuuaaaccauuuucu

SEQ ID NO: 3550786 - RNA, 22 nt, Human
ucuucuuuuaaaccauuuucuu

SEQ ID NO: 3550787 - RNA, 16 nt, Human
ucuucuuuuggcuucc

SEQ ID NO: 3550788 - RNA, 15 nt, Human
ucuucuuuugugaag

SEQ ID NO: 3550789 - RNA, 17 nt, Human
ucuucuuuuugcuguug

SEQ ID NO: 3550790 - RNA, 20 nt, Human
ucuucuuuuugcuguuguuu

SEQ ID NO: 3550791 - RNA, 13 nt, Human
ucuugaaaaaugc

SEQ ID NO: 3550792 - RNA, 23 nt, Human
ucuugaaaugaaaguauaacuga

SEQ ID NO: 3550793 - RNA, 22 nt, Human
ucuugaaauuaagaaggcaaaa

SEQ ID NO: 3550794 - RNA, 21 nt, Human
ucuugaacacucaugcugaaa

SEQ ID NO: 3550795 - RNA, 15 nt, Human
ucuugaacuccuggc

SEQ ID NO: 3550796 - RNA, 16 nt, Human
ucuuuuaaaagacaag

SEQ ID NO: 3550797 - RNA, 18 nt, Human
ucuuuuaaaguguuacuu

SEQ ID NO: 3550798 - RNA, 12 nt, Human
ucuuuuaagaau

SEQ ID NO: 3550799 - RNA, 14 nt, Human
ucuuuuaagaauca

SEQ ID NO: 3550800 - RNA, 15 nt, Human
ucugggggcugagga

SEQ ID NO: 3550801 - RNA, 21 nt, Human
ucuggggggacccagugcaga

SEQ ID NO: 3550802 - RNA, 13 nt, Human
ucugggggguggc

SEQ ID NO: 3550803 - RNA, 19 nt, Human
ucuggggugcugccugaau

SEQ ID NO: 3550804 - RNA, 17 nt, Human
ucuggggugggcaguuu

SEQ ID NO: 3550805 - RNA, 18 nt, Human
ucugggguucagccccuc

SEQ ID NO: 3550806 - RNA, 16 nt, Human
ucuggguccuuccuga

SEQ ID NO: 3550807 - RNA, 19 nt, Human
ucugggugcuacuggggaa

SEQ ID NO: 3550808 - RNA, 14 nt, Human
ucuggguggcucac

SEQ ID NO: 3550809 - RNA, 22 nt, Human
ucuggguuccuuccucugagcc

SEQ ID NO: 3550810 - RNA, 13 nt, Human
ucuggguucuggg

SEQ ID NO: 3550811 - RNA, 15 nt, Human
ucuggguugccuuua

SEQ ID NO: 3550812 - RNA, 15 nt, Human
ucugguacuuucugu

SEQ ID NO: 3550813 - RNA, 13 nt, Human
ucugguagacaca

SEQ ID NO: 3550814 - RNA, 20 nt, Human
ucugguagacacaggauaga

SEQ ID NO: 3550815 - RNA, 17 nt, Human
ucugguauuaaaugcca

SEQ ID NO: 3550816 - RNA, 17 nt, Human
ucuggucaaccuccugg

SEQ ID NO: 3550817 - RNA, 22 nt, Human
ucuggucccacaaaugggcgcc

SEQ ID NO: 3550818 - RNA, 20 nt, Human
ucuggucuauaccuuaagaa

SEQ ID NO: 3550819 - RNA, 18 nt, Human
ucuggugacaccagccuu

SEQ ID NO: 3550820 - RNA, 14 nt, Human
ucugguggccccgu

SEQ ID NO: 3550821 - RNA, 20 nt, Human
ucugguggucagcccuagga

SEQ ID NO: 3550822 - RNA, 21 nt, Human
ucugguguuggacaagcuucu

SEQ ID NO: 3550823 - RNA, 17 nt, Human
ucugguuaggauggcag

SEQ ID NO: 3550824 - RNA, 12 nt, Human
ucugguuccagg

SEQ ID NO: 3550825 - RNA, 13 nt, Human
ucugguuccaggg

SEQ ID NO: 3550826 - RNA, 14 nt, Human
ucugguuccagggu

SEQ ID NO: 3550827 - RNA, 17 nt, Human
ucugguucucaauucca

SEQ ID NO: 3550828 - RNA, 13 nt, Human
ucugguucugaug

SEQ ID NO: 3550829 - RNA, 14 nt, Human
ucugguucugaugc

SEQ ID NO: 3550830 - RNA, 15 nt, Human
ucugguugaacucug

SEQ ID NO: 3550831 - RNA, 17 nt, Human
ucugguuguuucuguuc

SEQ ID NO: 3550832 - RNA, 13 nt, Human
ucugguuuuaaca

SEQ ID NO: 3550833 - RNA, 15 nt, Human
ucugguuuuaacaau

SEQ ID NO: 3550834 - RNA, 12 nt, Human
ucuguaaaaucu

SEQ ID NO: 3550835 - RNA, 22 nt, Human
ucuguaaaaucuuucuuucuua

SEQ ID NO: 3550836 - RNA, 12 nt, Human
ucuguaaacugu

SEQ ID NO: 3550837 - RNA, 13 nt, Human
ucuguaaagcuaa

SEQ ID NO: 3550838 - RNA, 19 nt, Human
ucuguaaagcuaaaauaaa

SEQ ID NO: 3550839 - RNA, 12 nt, Human
ucuguaaauaug

SEQ ID NO: 3550840 - RNA, 22 nt, Human
ucuguaacucuaaaagauccuu

SEQ ID NO: 3550841 - RNA, 18 nt, Human
ucuguaagcauaagcuua

SEQ ID NO: 3550842 - RNA, 21 nt, Human
ucuguaagcucuuugaaacaa

SEQ ID NO: 3550843 - RNA, 19 nt, Human
ucuguaauaaacucauuuc

SEQ ID NO: 3550844 - RNA, 23 nt, Human
ucuguaauaaacucauuucuagc

SEQ ID NO: 3550845 - RNA, 13 nt, Human
ucuguaauaauag

SEQ ID NO: 3550846 - RNA, 17 nt, Human
ucuguaauauuuacaau

SEQ ID NO: 3550847 - RNA, 18 nt, Human
ucuguaauauuuacaaug

SEQ ID NO: 3550848 - RNA, 19 nt, Human
ucuguaauauuuacaaugu

SEQ ID NO: 3550849 - RNA, 23 nt, Human
ucuguaauauuuacaauguauua

SEQ ID NO: 3550850 - RNA, 18 nt, Human
ucuguaauuauaucuaaa

SEQ ID NO: 3550851 - RNA, 14 nt, Human
ucuguaauugcaaa

SEQ ID NO: 3550852 - RNA, 15 nt, Human
ucuguaauuuuucag

SEQ ID NO: 3550853 - RNA, 14 nt, Human
ucuguacauagccu

SEQ ID NO: 3550854 - RNA, 18 nt, Human
ucuguacaucucuacuua

SEQ ID NO: 3550855 - RNA, 21 nt, Human
ucuguacauuuuguuguaaaa

SEQ ID NO: 3550856 - RNA, 22 nt, Human
ucuguaccauagcgcugcucuu

SEQ ID NO: 3550857 - RNA, 18 nt, Human
ugaaaagaugguaucaua

SEQ ID NO: 3550858 - RNA, 12 nt, Human
ugaaaagaugua

SEQ ID NO: 3550859 - RNA, 16 nt, Human
ugaaaagauguaccug

SEQ ID NO: 3550860 - RNA, 16 nt, Human
ugaaaagauguugugu

SEQ ID NO: 3550861 - RNA, 19 nt, Human
ugaaaagcaauauuguaua

SEQ ID NO: 3550862 - RNA, 15 nt, Human
ugaaaagccauguuu

SEQ ID NO: 3550863 - RNA, 23 nt, Human
ugaaaagccauguuuaagauuua

SEQ ID NO: 3550864 - RNA, 15 nt, Human
ugaaaagcuucuuaa

SEQ ID NO: 3550865 - RNA, 23 nt, Human
ugaaaagcuucuuaauuaauuug

SEQ ID NO: 3550866 - RNA, 12 nt, Human
ugaaaaggaaga

SEQ ID NO: 3550867 - RNA, 12 nt, Human
ugaaaaggaauc

SEQ ID NO: 3550868 - RNA, 16 nt, Human
ugaaaaggugaccuug

SEQ ID NO: 3550869 - RNA, 19 nt, Human
ugaaaagguuuaugaaaaa

SEQ ID NO: 3550870 - RNA, 21 nt, Human
ugaaaagguuuaugaaaaaga

SEQ ID NO: 3550871 - RNA, 18 nt, Human
ugaaaaguaauauuuauu

SEQ ID NO: 3550872 - RNA, 19 nt, Human
ugaaaaguaauauuuauua

SEQ ID NO: 3550873 - RNA, 20 nt, Human
ugaaaaguagcaauuaugga

SEQ ID NO: 3550874 - RNA, 21 nt, Human
ugaaaaguauauugauaaccu

SEQ ID NO: 3550875 - RNA, 20 nt, Human
ugacugaugcuuucagauua

SEQ ID NO: 3550876 - RNA, 20 nt, Human
ugacugauguuaggcugggc

SEQ ID NO: 3550877 - RNA, 17 nt, Human
ugacugauucuucagca

SEQ ID NO: 3550878 - RNA, 21 nt, Human
ugacugccaagacugcugugg

SEQ ID NO: 3550879 - RNA, 14 nt, Human
ugacugccaagcca

SEQ ID NO: 3550880 - RNA, 17 nt, Human
ugacugccaagccaugg

SEQ ID NO: 3550881 - RNA, 14 nt, Human
ugacugcccagcau

SEQ ID NO: 3550882 - RNA, 18 nt, Human
ugacugcccauucaccaa

SEQ ID NO: 3550883 - RNA, 17 nt, Human
ugacugccccaacuccu

SEQ ID NO: 3550884 - RNA, 16 nt, Human
ugacugcucagaacuu

SEQ ID NO: 3550885 - RNA, 15 nt, Human
ugacugcugauucuc

SEQ ID NO: 3550886 - RNA, 14 nt, Human
ugacugcuugcccu

SEQ ID NO: 3550887 - RNA, 14 nt, Human
ugacuggaauuuuu

SEQ ID NO: 3550888 - RNA, 17 nt, Human
ugacuggcauuuuauag

SEQ ID NO: 3550889 - RNA, 17 nt, Human
ugacuggcuucagcaag

SEQ ID NO: 3550890 - RNA, 16 nt, Human
ugacugggcccugccu

SEQ ID NO: 3550891 - RNA, 21 nt, Human
ugacugggcccugccucuguu

SEQ ID NO: 3550892 - RNA, 16 nt, Human
ugacuguaucugugua

SEQ ID NO: 3550893 - RNA, 17 nt, Human
ugacuguaucuguguag

SEQ ID NO: 3550894 - RNA, 19 nt, Human
ugacuguaucuguguagac

SEQ ID NO: 3550895 - RNA, 24 nt, Human
ugacuguucaagagcacacuuggc

SEQ ID NO: 3550896 - RNA, 21 nt, Human
ugacuguuuucucuugagagg

SEQ ID NO: 3550897 - RNA, 11 nt, Human
ugacuguuuuu

SEQ ID NO: 3550898 - RNA, 16 nt, Human
ugacuguuuuuaccca

SEQ ID NO: 3550899 - RNA, 18 nt, Human
ugacuguuuuuacccaua

SEQ ID NO: 3550900 - RNA, 20 nt, Human
ugacuguuuuucggacaguu

SEQ ID NO: 3550901 - RNA, 17 nt, Human
ugacuguuuuuguagug

SEQ ID NO: 3550902 - RNA, 20 nt, Human
ugacuuagaaucccuguguu

SEQ ID NO: 3550903 - RNA, 23 nt, Human
ugacuuagaaucccuguguuaau

SEQ ID NO: 3550904 - RNA, 16 nt, Human
ugacuuagcagaugcu

SEQ ID NO: 3550905 - RNA, 13 nt, Human
ugacuuauaguac

SEQ ID NO: 3550906 - RNA, 21 nt, Human
ugacuuauuuauauaaauuuu

SEQ ID NO: 3550907 - RNA, 19 nt, Human
ugacuucauggaauggaca

SEQ ID NO: 3550908 - RNA, 14 nt, Human
ugacuuccacaccu

SEQ ID NO: 3550909 - RNA, 23 nt, Human
ugacuuccccgcauuccaggcuc

SEQ ID NO: 3550910 - RNA, 19 nt, Human
ugacuuccucgccucuccc

SEQ ID NO: 3550911 - RNA, 23 nt, Human
ugacuucuaaguaaaaccacagc

SEQ ID NO: 3550912 - RNA, 23 nt, Human
ugacuucuccaggucucacgggc

SEQ ID NO: 3550913 - RNA, 13 nt, Human
ugacuucugccug

SEQ ID NO: 3550914 - RNA, 16 nt, Human
ugacuugcaugaagag

SEQ ID NO: 3550915 - RNA, 19 nt, Human
ugacuugcaugaagagaag

SEQ ID NO: 3550916 - RNA, 13 nt, Human
ugacuugcccagu

SEQ ID NO: 3550917 - RNA, 15 nt, Human
ugacuuggcuggugu

SEQ ID NO: 3550918 - RNA, 16 nt, Human
ugacuuggcuggugug

SEQ ID NO: 3550919 - RNA, 19 nt, Human
ugacuugggcacccccagc

SEQ ID NO: 3550920 - RNA, 23 nt, Human
ugacuugggcacccccagccugg

SEQ ID NO: 3550921 - RNA, 18 nt, Human
ugacuuggggagauggag

SEQ ID NO: 3550922 - RNA, 19 nt, Human
ugacuuguuugucuuccau

SEQ ID NO: 3550923 - RNA, 18 nt, Human
ugacuuuacgcccaucuc

SEQ ID NO: 3550924 - RNA, 14 nt, Human
ugacuuuauaaauu

SEQ ID NO: 3550925 - RNA, 18 nt, Human
ugacuuuauauggaugau

SEQ ID NO: 3550926 - RNA, 17 nt, Human
ugacuuuauuauuuauu

SEQ ID NO: 3550927 - RNA, 12 nt, Human
ugacuuucaggu

SEQ ID NO: 3550928 - RNA, 13 nt, Human
ugacuuucaggua

SEQ ID NO: 3550929 - RNA, 17 nt, Human
ugacuuucauuggaaau

SEQ ID NO: 3550930 - RNA, 23 nt, Human
ugacuuuccccaccagaugcuga

SEQ ID NO: 3550931 - RNA, 13 nt, Human
ugacuuuggauaa

SEQ ID NO: 3550932 - RNA, 16 nt, Human
ugacuuuggauaauaa

SEQ ID NO: 3550933 - RNA, 11 nt, Human
ugacuuugucu

SEQ ID NO: 3550934 - RNA, 17 nt, Human
ugacuuuuauaaagcau

SEQ ID NO: 3550935 - RNA, 18 nt, Human
ugacuuuuccauguaucu

SEQ ID NO: 3550936 - RNA, 22 nt, Human
ugacuuuucuguccgagcuuug

SEQ ID NO: 3550937 - RNA, 13 nt, Human
ugacuuuugcuuu

SEQ ID NO: 3550938 - RNA, 19 nt, Human
ugacuuuuuauaaaauggc

SEQ ID NO: 3550939 - RNA, 17 nt, Human
ugacuuuuuuuguaugu

SEQ ID NO: 3550940 - RNA, 14 nt, Human
ugagaaaaaaagaa

SEQ ID NO: 3550941 - RNA, 21 nt, Human
ugagaaaacgaaacugcucua

SEQ ID NO: 3550942 - RNA, 20 nt, Human
ugagaaacaacaauuucuac

SEQ ID NO: 3550943 - RNA, 19 nt, Human
ugagaaacuuaaauguuau

SEQ ID NO: 3550944 - RNA, 17 nt, Human
ugagaaagacuauucaa

SEQ ID NO: 3550945 - RNA, 21 nt, Human
ugagaaagagcacuuaagaga

SEQ ID NO: 3550946 - RNA, 17 nt, Human
ugagaaaucuaaaaaac

SEQ ID NO: 3550947 - RNA, 20 nt, Human
ugagaaaugaauaauuuccc

SEQ ID NO: 3550948 - RNA, 14 nt, Human
ugagaaauguaaug

SEQ ID NO: 3550949 - RNA, 14 nt, Human
ugagaaauguuaaa

SEQ ID NO: 3550950 - RNA, 22 nt, Human
ugagaaauucaacguuaauaau

SEQ ID NO: 3550951 - RNA, 17 nt, Human
ugagaaauuuaaacuau

SEQ ID NO: 3550952 - RNA, 17 nt, Human
ugagaacagauaaagau

SEQ ID NO: 3550953 - RNA, 18 nt, Human
ugagaacagauaaagauu

SEQ ID NO: 3550954 - RNA, 22 nt, Human
ugagaacccugcguggggacag

SEQ ID NO: 3550955 - RNA, 22 nt, Human
ugagaaccuggguugcagacag

SEQ ID NO: 3550956 - RNA, 23 nt, Human
ugagaaccuggguugcagacagg

SEQ ID NO: 3550957 - RNA, 19 nt, Human
ugagaacuacucagggaau

SEQ ID NO: 3550958 - RNA, 15 nt, Human
ugagaacuugacaag

SEQ ID NO: 3550959 - RNA, 18 nt, Human
ugagaagagagaucaaau

SEQ ID NO: 3550960 - RNA, 15 nt, Human
ugagaagaggagccc

SEQ ID NO: 3550961 - RNA, 21 nt, Human
ugagaagagggccugugggag

SEQ ID NO: 3550962 - RNA, 23 nt, Human
ugagaagagggccugugggagcc

SEQ ID NO: 3550963 - RNA, 20 nt, Human
ugagaagcagaggaaggaga

SEQ ID NO: 3550964 - RNA, 16 nt, Human
ugagaagccgugggug

SEQ ID NO: 3550965 - RNA, 13 nt, Human
ugagaagcugcuc

SEQ ID NO: 3550966 - RNA, 21 nt, Human
ugagaagcugcucaacuugca

SEQ ID NO: 3550967 - RNA, 20 nt, Human
ugagaagcuuugcccuccua

SEQ ID NO: 3550968 - RNA, 12 nt, Human
ugagaaggagag

SEQ ID NO: 3550969 - RNA, 16 nt, Human
ugagaaggagagaaag

SEQ ID NO: 3550970 - RNA, 20 nt, Human
ugagaaggcagccaccagcg

SEQ ID NO: 3550971 - RNA, 16 nt, Human
ugagaaggguguugua

SEQ ID NO: 3550972 - RNA, 20 nt, Human
ugagaagguuuauuguuaau

SEQ ID NO: 3550973 - RNA, 17 nt, Human
ugagaaguagccacagu

SEQ ID NO: 3550974 - RNA, 18 nt, Human
ugagaaguccccuuccau

SEQ ID NO: 3550975 - RNA, 19 nt, Human
ugagaaguccccuuccauc

SEQ ID NO: 3550976 - RNA, 19 nt, Human
ugagaauaagagagucaua

SEQ ID NO: 3550977 - RNA, 14 nt, Human
ugagaaucauuuag

SEQ ID NO: 3550978 - RNA, 19 nt, Human
ugagaaucauuuagcaugu

SEQ ID NO: 3550979 - RNA, 21 nt, Human
ugagaaucccaaauuugauug

SEQ ID NO: 3550980 - RNA, 19 nt, Human
ugagaaucuuuauugagaa

SEQ ID NO: 3550981 - RNA, 13 nt, Human
ugagaaugaacaa

SEQ ID NO: 3550982 - RNA, 16 nt, Human
ugagaauguaucccca

SEQ ID NO: 3550983 - RNA, 23 nt, Human
ugagaauucagcugcccccgcuc

SEQ ID NO: 3550984 - RNA, 19 nt, Human
ugagaauuuaaaaauaaga

SEQ ID NO: 3550985 - RNA, 13 nt, Human
ugagaauuucuaa

SEQ ID NO: 3550986 - RNA, 14 nt, Human
ugagacaaaaauua

SEQ ID NO: 3550987 - RNA, 15 nt, Human
ugagacaaaaauuau

SEQ ID NO: 3550988 - RNA, 16 nt, Human
ugagacaaaauuuuag

SEQ ID NO: 3550989 - RNA, 19 nt, Human
ugagacagaaucucagucu

SEQ ID NO: 3550990 - RNA, 15 nt, Human
ugagacagcagucuu

SEQ ID NO: 3550991 - RNA, 18 nt, Human
ugagacagcccgggcucu

SEQ ID NO: 3550992 - RNA, 16 nt, Human
ugagacagcucugcau

SEQ ID NO: 3550993 - RNA, 15 nt, Human
ugagacagucuugcu

SEQ ID NO: 3550994 - RNA, 16 nt, Human
ugagacagugcacaug

SEQ ID NO: 3550995 - RNA, 17 nt, Human
ugagacagugcacauga

SEQ ID NO: 3550996 - RNA, 18 nt, Human
ugagacagugcacaugaa

SEQ ID NO: 3550997 - RNA, 15 nt, Human
ugagacagugggaaa

SEQ ID NO: 3550998 - RNA, 16 nt, Human
ugagacagugggaaau

SEQ ID NO: 3550999 - RNA, 19 nt, Human
ugagacaguuucuuagcuu

SEQ ID NO: 3551000 - RNA, 13 nt, Human
ugagacauccagc

SEQ ID NO: 3551001 - RNA, 18 nt, Human
ugagacauuccaaaacga

SEQ ID NO: 3551002 - RNA, 14 nt, Human
ugagaccaaccugg

SEQ ID NO: 3551003 - RNA, 21 nt, Human
ugagaccacagagagagggga

SEQ ID NO: 3551004 - RNA, 16 nt, Human
ugagacccaggacucc

SEQ ID NO: 3551005 - RNA, 22 nt, Human
ugagacccccacaccucaguuc

SEQ ID NO: 3551006 - RNA, 22 nt, Human
ugagaccccuggccuccggcgu

SEQ ID NO: 3551007 - RNA, 14 nt, Human
ugagacccugucuc

SEQ ID NO: 3551008 - RNA, 15 nt, Human
ugagacccugucucu

SEQ ID NO: 3551009 - RNA, 17 nt, Human
ugagaccucagccauga

SEQ ID NO: 3551010 - RNA, 15 nt, Human
ugagaccugccccuc

SEQ ID NO: 3551011 - RNA, 14 nt, Human
ugaucaaugacaga

SEQ ID NO: 3551012 - RNA, 15 nt, Human
ugaucaauuaaaugu

SEQ ID NO: 3551013 - RNA, 17 nt, Human
ugaucaauuaaauguag

SEQ ID NO: 3551014 - RNA, 20 nt, Human
ugaucaauuauaguuucuga

SEQ ID NO: 3551015 - RNA, 12 nt, Human
ugaucacacucu

SEQ ID NO: 3551016 - RNA, 13 nt, Human
ugaucacacucug

SEQ ID NO: 3551017 - RNA, 14 nt, Human
ugaucaccugcccu

SEQ ID NO: 3551018 - RNA, 16 nt, Human
ugaucacgccuggcua

SEQ ID NO: 3551019 - RNA, 20 nt, Human
ugaucacggcucacugcagc

SEQ ID NO: 3551020 - RNA, 16 nt, Human
ugaucacuuaucaguu

SEQ ID NO: 3551021 - RNA, 24 nt, Human
ugaucacuuucugaaauucacaaa

SEQ ID NO: 3551022 - RNA, 18 nt, Human
ugaucagaccauaauguu

SEQ ID NO: 3551023 - RNA, 16 nt, Human
ugaucagaucugacau

SEQ ID NO: 3551024 - RNA, 23 nt, Human
ugaucagaucugacaugauuccu

SEQ ID NO: 3551025 - RNA, 19 nt, Human
ugaucagcuuucaaagcau

SEQ ID NO: 3551026 - RNA, 21 nt, Human
ugaucagcuuucaaagcauuu

SEQ ID NO: 3551027 - RNA, 12 nt, Human
ugaucaggaccu

SEQ ID NO: 3551028 - RNA, 17 nt, Human
ugaucaguaguuugcau

SEQ ID NO: 3551029 - RNA, 19 nt, Human
ugaucaguaguuugcauuu

SEQ ID NO: 3551030 - RNA, 13 nt, Human
ugaucaugcauug

SEQ ID NO: 3551031 - RNA, 15 nt, Human
ugaucauguacuuuu

SEQ ID NO: 3551032 - RNA, 22 nt, Human
ugaucauguguggaaguuauua

SEQ ID NO: 3551033 - RNA, 23 nt, Human
ugaucauuuauuuuaagcacucu

SEQ ID NO: 3551034 - RNA, 17 nt, Human
ugaucauuuucccccca

SEQ ID NO: 3551035 - RNA, 19 nt, Human
ugaucauuuuccccccacu

SEQ ID NO: 3551036 - RNA, 21 nt, Human
ugaucauuuuccccccacucu

SEQ ID NO: 3551037 - RNA, 14 nt, Human
ugauccaagcuggu

SEQ ID NO: 3551038 - RNA, 17 nt, Human
ugauccaagcugguccc

SEQ ID NO: 3551039 - RNA, 15 nt, Human
ugauccacccaaccc

SEQ ID NO: 3551040 - RNA, 15 nt, Human
ugauccacccaccuc

SEQ ID NO: 3551041 - RNA, 19 nt, Human
ugauccacccaccucagcc

SEQ ID NO: 3551042 - RNA, 20 nt, Human
ugauccacccaccucagccu

SEQ ID NO: 3551043 - RNA, 14 nt, Human
ugauccacucgccu

SEQ ID NO: 3551044 - RNA, 18 nt, Human
ugauccacucgccuucau

SEQ ID NO: 3551045 - RNA, 19 nt, Human
ugauccauccagcuugcca

SEQ ID NO: 3551046 - RNA, 17 nt, Human
ugauccauguaacugcc

SEQ ID NO: 3551047 - RNA, 18 nt, Human
ugauccauguaacugccu

SEQ ID NO: 3551048 - RNA, 19 nt, Human
ugauccauguaacugccua

SEQ ID NO: 3551049 - RNA, 20 nt, Human
ugauccauguaacugccuag

SEQ ID NO: 3551050 - RNA, 14 nt, Human
ugauccauuucuaa

SEQ ID NO: 3551051 - RNA, 17 nt, Human
ugauccauuucuaauua

SEQ ID NO: 3551052 - RNA, 18 nt, Human
ugauccauuucuaauuau

SEQ ID NO: 3551053 - RNA, 12 nt, Human
ugaucccagcac

SEQ ID NO: 3551054 - RNA, 20 nt, Human
ugauccccaaguggugaaug

SEQ ID NO: 3551055 - RNA, 18 nt, Human
ugauccccaagugugaac

SEQ ID NO: 3551056 - RNA, 21 nt, Human
ugaucccuguuacccagagaa

SEQ ID NO: 3551057 - RNA, 22 nt, Human
ugauccuaaugaaugcauaaaa

SEQ ID NO: 3551058 - RNA, 19 nt, Human
ugauccucccaccucagcc

SEQ ID NO: 3551059 - RNA, 20 nt, Human
ugauccucccaccucagccu

SEQ ID NO: 3551060 - RNA, 13 nt, Human
ugauccugcggag

SEQ ID NO: 3551061 - RNA, 13 nt, Human
ugauccugugaag

SEQ ID NO: 3551062 - RNA, 21 nt, Human
ugaucgaugauucaggugcag

SEQ ID NO: 3551063 - RNA, 13 nt, Human
ugaucgccuuccc

SEQ ID NO: 3551064 - RNA, 18 nt, Human
ugaucggagccuccucuc

SEQ ID NO: 3551065 - RNA, 20 nt, Human
ugaucgugacgcugaauaaa

SEQ ID NO: 3551066 - RNA, 22 nt, Human
ugaucgugcuaaauuuucagua

SEQ ID NO: 3551067 - RNA, 15 nt, Human
ugaucuaauauccca

SEQ ID NO: 3551068 - RNA, 18 nt, Human
ugaucuacuucuguaauu

SEQ ID NO: 3551069 - RNA, 14 nt, Human
ugaucuaggaagac

SEQ ID NO: 3551070 - RNA, 16 nt, Human
ugaucuagguuuaacu

SEQ ID NO: 3551071 - RNA, 21 nt, Human
ugaucuagguuuaacucagau

SEQ ID NO: 3551072 - RNA, 22 nt, Human
ugaucucagggaagcccagcuc

SEQ ID NO: 3551073 - RNA, 14 nt, Human
ugaucucagguucu

SEQ ID NO: 3551074 - RNA, 15 nt, Human
ugaucucauuuaauc

SEQ ID NO: 3551075 - RNA, 16 nt, Human
ugaucuccauauguua

SEQ ID NO: 3551076 - RNA, 19 nt, Human
ugaucuccauauguuacac

SEQ ID NO: 3551077 - RNA, 17 nt, Human
ugaucuccauggcuucc

SEQ ID NO: 3551078 - RNA, 17 nt, Human
ugaucucucgugauuga

SEQ ID NO: 3551079 - RNA, 14 nt, Human
ugaucugaaaaaua

SEQ ID NO: 3551080 - RNA, 22 nt, Human
ugaucugauaggguuugugaca

SEQ ID NO: 3551081 - RNA, 14 nt, Human
ugaucugcucagcc

SEQ ID NO: 3551082 - RNA, 19 nt, Human
ugaucugcucagcccugga

SEQ ID NO: 3551083 - RNA, 18 nt, Human
ugaucuggaacccagacu

SEQ ID NO: 3551084 - RNA, 16 nt, Human
ugaucugggaacuccc

SEQ ID NO: 3551085 - RNA, 22 nt, Human
ugaucugggaacucccaagaac

SEQ ID NO: 3551086 - RNA, 17 nt, Human
ugaucugguuugacucc

SEQ ID NO: 3551087 - RNA, 14 nt, Human
ugaucugucuugua

SEQ ID NO: 3551088 - RNA, 17 nt, Human
ugaucugucuuguaaua

SEQ ID NO: 3551089 - RNA, 19 nt, Human
ugaucugucuuguaauauu

SEQ ID NO: 3551090 - RNA, 20 nt, Human
ugaucugugauaguucaccc

SEQ ID NO: 3551091 - RNA, 21 nt, Human
ugaucugugauaguucacccc

SEQ ID NO: 3551092 - RNA, 14 nt, Human
ugaucugugccuuu

SEQ ID NO: 3551093 - RNA, 23 nt, Human
ugaucugugccuuuuuuauaucu

SEQ ID NO: 3551094 - RNA, 19 nt, Human
ugaucugugcuuuccagcu

SEQ ID NO: 3551095 - RNA, 22 nt, Human
ugaucugugcuuuccagcucac

SEQ ID NO: 3551096 - RNA, 15 nt, Human
ugaucuucaacaaau

SEQ ID NO: 3551097 - RNA, 17 nt, Human
ugaucuuccucugcuaa

SEQ ID NO: 3551098 - RNA, 17 nt, Human
ugaucuuuaaaauacac

SEQ ID NO: 3551099 - RNA, 16 nt, Human
ugaucuuugcagacag

SEQ ID NO: 3551100 - RNA, 18 nt, Human
ugaucuuugcagacaggc

SEQ ID NO: 3551101 - RNA, 14 nt, Human
ugaucuuuuaaagu

SEQ ID NO: 3551102 - RNA, 15 nt, Human
ugaucuuuuaaagug

SEQ ID NO: 3551103 - RNA, 19 nt, Human
ugaucuuuuaaaguguuac

SEQ ID NO: 3551104 - RNA, 15 nt, Human
ugaugaaaaauagca

SEQ ID NO: 3551105 - RNA, 19 nt, Human
ugaugaaaaauugcugacu

SEQ ID NO: 3551106 - RNA, 21 nt, Human
ugaugaaaaauugcugacugu

SEQ ID NO: 3551107 - RNA, 14 nt, Human
ugaugaaaagauuu

SEQ ID NO: 3551108 - RNA, 23 nt, Human
ugaugaaaagcuuuguuuguucu

SEQ ID NO: 3551109 - RNA, 13 nt, Human
ugaugaaaauaaa

SEQ ID NO: 3551110 - RNA, 15 nt, Human
ugaugaaaauaaaga

SEQ ID NO: 3551111 - RNA, 16 nt, Human
ugaugaaaauaaagaa

SEQ ID NO: 3551112 - RNA, 19 nt, Human
ugaugaaaauaaagaaugg

SEQ ID NO: 3551113 - RNA, 14 nt, Human
ugaugaaaauauuu

SEQ ID NO: 3551114 - RNA, 15 nt, Human
ugaugaaaauauuua

SEQ ID NO: 3551115 - RNA, 13 nt, Human
ugaugaaagcuga

SEQ ID NO: 3551116 - RNA, 15 nt, Human
ugaugaaagcugauu

SEQ ID NO: 3551117 - RNA, 23 nt, Human
ugaugaaaugaggucagagccug

SEQ ID NO: 3551118 - RNA, 18 nt, Human
ugaugaagaaaagugggc

SEQ ID NO: 3551119 - RNA, 20 nt, Human
ugaugaagaaaagugggcca

SEQ ID NO: 3551120 - RNA, 13 nt, Human
ugaugaagaggag

SEQ ID NO: 3551121 - RNA, 22 nt, Human
ugaugaaucaguccuagaaugu

SEQ ID NO: 3551122 - RNA, 20 nt, Human
ugaugacaacuacagaaaaa

SEQ ID NO: 3551123 - RNA, 21 nt, Human
ugaugacaacuggaauaguuu

SEQ ID NO: 3551124 - RNA, 18 nt, Human
ugaugacaauaaagcuug

SEQ ID NO: 3551125 - RNA, 15 nt, Human
ugaugacagagcgag

SEQ ID NO: 3551126 - RNA, 17 nt, Human
ugaugacaguaguacca

SEQ ID NO: 3551127 - RNA, 15 nt, Human
ugaugacauucccug

SEQ ID NO: 3551128 - RNA, 16 nt, Human
ugaugaccaauuuuaa

SEQ ID NO: 3551129 - RNA, 18 nt, Human
ugaugaccaauuuuaacu

SEQ ID NO: 3551130 - RNA, 15 nt, Human
ugaugacccuuuuca

SEQ ID NO: 3551131 - RNA, 22 nt, Human
ugaugacguacaaguaguucug

SEQ ID NO: 3551132 - RNA, 22 nt, Human
ugaugacuaugcuuugcuauca

SEQ ID NO: 3551133 - RNA, 20 nt, Human
ugaugacuggaauuuuuauu

SEQ ID NO: 3551134 - RNA, 13 nt, Human
ugaugacuguuuu

SEQ ID NO: 3551135 - RNA, 23 nt, Human
ugaugacuuucuuuuuguagcug

SEQ ID NO: 3551136 - RNA, 15 nt, Human
ugaugagaggaaauc

SEQ ID NO: 3551137 - RNA, 14 nt, Human
ugaugagauuuuua

SEQ ID NO: 3551138 - RNA, 19 nt, Human
ugaugagcugugcacaaag

SEQ ID NO: 3551139 - RNA, 22 nt, Human
ugaugaggccucuuggaccucu

SEQ ID NO: 3551140 - RNA, 16 nt, Human
ugaugagggcagcagc

SEQ ID NO: 3551141 - RNA, 19 nt, Human
ugaugagggcagcagccag

SEQ ID NO: 3551142 - RNA, 24 nt, Human
ugaugagggcagcagccagcccug

SEQ ID NO: 3551143 - RNA, 16 nt, Human
ugaugagguauuuuuu

SEQ ID NO: 3551144 - RNA, 22 nt, Human
ugaugagguauuuuuuccuuuu

SEQ ID NO: 3551145 - RNA, 17 nt, Human
ugaugaguguaacaaga

SEQ ID NO: 3551146 - RNA, 19 nt, Human
ugaugaguguaacaagaaa

SEQ ID NO: 3551147 - RNA, 14 nt, Human
ugaugauaaugaug

SEQ ID NO: 3551148 - RNA, 17 nt, Human
ugaugauacaaugaaca

SEQ ID NO: 3551149 - RNA, 21 nt, Human
ugaugaugggaauugugugau

SEQ ID NO: 3551150 - RNA, 23 nt, Human
ugaugcaauccuuacaaaugauu

SEQ ID NO: 3551151 - RNA, 17 nt, Human
ugaugcacagagaagcu

SEQ ID NO: 3551152 - RNA, 17 nt, Human
ugaugcacauuucaugu

SEQ ID NO: 3551153 - RNA, 12 nt, Human
ugaugcagcauu

SEQ ID NO: 3551154 - RNA, 13 nt, Human
ugaugcagcauuu

SEQ ID NO: 3551155 - RNA, 19 nt, Human
ugaugcagcauuugauaau

SEQ ID NO: 3551156 - RNA, 23 nt, Human
ugaugcagcauuugauaaugaua

SEQ ID NO: 3551157 - RNA, 21 nt, Human
ugaugcagcuuauacgaaaua

SEQ ID NO: 3551158 - RNA, 21 nt, Human
ugaugcaggcacuuauuguaa

SEQ ID NO: 3551159 - RNA, 23 nt, Human
ugaugcaugcacuguucccccug

SEQ ID NO: 3551160 - RNA, 11 nt, Human
aaaaaaugucc

SEQ ID NO: 3551161 - RNA, 12 nt, Human
aaaaaauuuaaa

SEQ ID NO: 3551162 - RNA, 14 nt, Human
aaaaaauuuaagug

SEQ ID NO: 3551163 - RNA, 16 nt, Human
aaaaaauuuccaguga

SEQ ID NO: 3551164 - RNA, 11 nt, Human
aaaaaauuuug

SEQ ID NO: 3551165 - RNA, 19 nt, Human
aaaaaauuuuguaauuuuc

SEQ ID NO: 3551166 - RNA, 15 nt, Human
aaaaacaaauaauau

SEQ ID NO: 3551167 - RNA, 18 nt, Human
aaaaacaauauuuauugu

SEQ ID NO: 3551168 - RNA, 14 nt, Human
aaaaacacaaaagu

SEQ ID NO: 3551169 - RNA, 18 nt, Human
aaaaacaccuagcuuuau

SEQ ID NO: 3551170 - RNA, 18 nt, Human
aaaaacagauuuggaaag

SEQ ID NO: 3551171 - RNA, 11 nt, Human
aaaaacagcuu

SEQ ID NO: 3551172 - RNA, 13 nt, Human
aaaaacauaacau

SEQ ID NO: 3551173 - RNA, 16 nt, Human
aaaaacauguaugugc

SEQ ID NO: 3551174 - RNA, 20 nt, Human
aaaaacauguaugugcauuu

SEQ ID NO: 3551175 - RNA, 23 nt, Human
aaaaacauucuaucuacugauuu

SEQ ID NO: 3551176 - RNA, 22 nt, Human
aaaaaccguguuugucucuucu

SEQ ID NO: 3551177 - RNA, 12 nt, Human
aaaaaccuuggg

SEQ ID NO: 3551178 - RNA, 17 nt, Human
aaaaacuaaaaacuaga

SEQ ID NO: 3551179 - RNA, 19 nt, Human
aaaaacuacaaccaaugga

SEQ ID NO: 3551180 - RNA, 15 nt, Human
aaaaacuaguaguuc

SEQ ID NO: 3551181 - RNA, 23 nt, Human
aaaaacuauuaaggauguagcuu

SEQ ID NO: 3551182 - RNA, 20 nt, Human
aaaaacucuuuaacuuguaa

SEQ ID NO: 3551183 - RNA, 14 nt, Human
aaaaacucuuuauu

SEQ ID NO: 3551184 - RNA, 15 nt, Human
aaaaacucuuuauuu

SEQ ID NO: 3551185 - RNA, 14 nt, Human
aaaaacugaaaaau

SEQ ID NO: 3551186 - RNA, 22 nt, Human
aaaaacuucauguaauuuuauu

SEQ ID NO: 3551187 - RNA, 19 nt, Human
aaaaacuuugccagccauu

SEQ ID NO: 3551188 - RNA, 20 nt, Human
aaaaacuuuggaaccagacu

SEQ ID NO: 3551189 - RNA, 23 nt, Human
aaaaacuuuuauaaauuaaauau

SEQ ID NO: 3551190 - RNA, 14 nt, Human
aaaaagaaaaugaa

SEQ ID NO: 3551191 - RNA, 18 nt, Human
aaaaagaaagaaagagga

SEQ ID NO: 3551192 - RNA, 13 nt, Human
aaaaagaacuucc

SEQ ID NO: 3551193 - RNA, 21 nt, Human
aaaaagaaucugcauuuagca

SEQ ID NO: 3551194 - RNA, 14 nt, Human
aaaaagacagggcu

SEQ ID NO: 3551195 - RNA, 13 nt, Human
aaaaagaccagac

SEQ ID NO: 3551196 - RNA, 13 nt, Human
aaaaagauauauu

SEQ ID NO: 3551197 - RNA, 22 nt, Human
aaaaagauggccuuugcuuaug

SEQ ID NO: 3551198 - RNA, 20 nt, Human
aaaaagauguucagucauuu

SEQ ID NO: 3551199 - RNA, 18 nt, Human
aaaaagauuguauugcug

SEQ ID NO: 3551200 - RNA, 15 nt, Human
aaaaagcacaagaag

SEQ ID NO: 3551201 - RNA, 21 nt, Human
aaaaagcagacagaagucacu

SEQ ID NO: 3551202 - RNA, 14 nt, Human
aaaaagcaguucuu

SEQ ID NO: 3551203 - RNA, 20 nt, Human
aaaaagcauaaaaacauuuu

SEQ ID NO: 3551204 - RNA, 14 nt, Human
aaaaagcauguaca

SEQ ID NO: 3551205 - RNA, 20 nt, Human
aaaaagcauguacaguguuc

SEQ ID NO: 3551206 - RNA, 17 nt, Human
aaaaagccagggcugga

SEQ ID NO: 3551207 - RNA, 17 nt, Human
aaaaagccuccagucca

SEQ ID NO: 3551208 - RNA, 18 nt, Human
aaaaagcgaaaaaaucag

SEQ ID NO: 3551209 - RNA, 19 nt, Human
aaaaagcuagucaacagua

SEQ ID NO: 3551210 - RNA, 17 nt, Human
aaaaagcucauuucaug

SEQ ID NO: 3551211 - RNA, 21 nt, Human
aaaaagcucauuucaugcucu

SEQ ID NO: 3551212 - RNA, 20 nt, Human
aaaaagcuccaaaugcagcu

SEQ ID NO: 3551213 - RNA, 13 nt, Human
aaaaagcuggugg

SEQ ID NO: 3551214 - RNA, 17 nt, Human
aaaaagcuuaaaacuuu

SEQ ID NO: 3551215 - RNA, 20 nt, Human
aaaaagcuuaaaacuuugaa

SEQ ID NO: 3551216 - RNA, 13 nt, Human
aaaaagcuucccc

SEQ ID NO: 3551217 - RNA, 23 nt, Human
aaaaagcuuuaugauuuucauaa

SEQ ID NO: 3551218 - RNA, 16 nt, Human
aaaaaggacaucagca

SEQ ID NO: 3551219 - RNA, 14 nt, Human
aaaaaggaggaaga

SEQ ID NO: 3551220 - RNA, 17 nt, Human
aaaaaggauacauaaug

SEQ ID NO: 3551221 - RNA, 19 nt, Human
aaaaaggcauauugcuuuu

SEQ ID NO: 3551222 - RNA, 21 nt, Human
aaaaaggccaguggaaauuca

SEQ ID NO: 3551223 - RNA, 19 nt, Human
aaaaauauauuuaaugaua

SEQ ID NO: 3551224 - RNA, 12 nt, Human
aaaaauauguau

SEQ ID NO: 3551225 - RNA, 23 nt, Human
aaaaauaugugaaggaccuucac

SEQ ID NO: 3551226 - RNA, 16 nt, Human
aaaaauauuauaacuu

SEQ ID NO: 3551227 - RNA, 12 nt, Human
aaaaauauuguu

SEQ ID NO: 3551228 - RNA, 13 nt, Human
aaaaauauuuucu

SEQ ID NO: 3551229 - RNA, 17 nt, Human
aaaaaucacaaaaauuu

SEQ ID NO: 3551230 - RNA, 20 nt, Human
aaaaaucacaauuuuuaaug

SEQ ID NO: 3551231 - RNA, 15 nt, Human
aaaaaucacauccug

SEQ ID NO: 3551232 - RNA, 21 nt, Human
aaaaaucaugccaguauuuuu

SEQ ID NO: 3551233 - RNA, 16 nt, Human
aaaaauccagaaagaa

SEQ ID NO: 3551234 - RNA, 15 nt, Human
aaaaauccucuuccu

SEQ ID NO: 3551235 - RNA, 19 nt, Human
aaaaauccuucuaaucugc

SEQ ID NO: 3551236 - RNA, 22 nt, Human
aaaaaucuaccuucuguaguuu

SEQ ID NO: 3551237 - RNA, 14 nt, Human
aaaaaucucaaauu

SEQ ID NO: 3551238 - RNA, 19 nt, Human
aaaaaucucaaauuucuaa

SEQ ID NO: 3551239 - RNA, 14 nt, Human
aaaaaucugaagau

SEQ ID NO: 3551240 - RNA, 10 nt, Human
aaaaaugaaa

SEQ ID NO: 3551241 - RNA, 14 nt, Human
aaaaaugaaagaug

SEQ ID NO: 3551242 - RNA, 20 nt, Human
aaaaaugaaugucuaaaauu

SEQ ID NO: 3551243 - RNA, 17 nt, Human
aaaaaugacagauguug

SEQ ID NO: 3551244 - RNA, 20 nt, Human
aaaaaugacuaaaaauauua

SEQ ID NO: 3551245 - RNA, 21 nt, Human
aaaaaugagaacauguuggua

SEQ ID NO: 3551246 - RNA, 15 nt, Human
aaaaaugauguucau

SEQ ID NO: 3551247 - RNA, 20 nt, Human
aaaaaugauuucaguagcac

SEQ ID NO: 3551248 - RNA, 15 nt, Human
aaaaaugccauaaua

SEQ ID NO: 3551249 - RNA, 19 nt, Human
aaaaaugccuuugagacag

SEQ ID NO: 3551250 - RNA, 20 nt, Human
aaaaaugccuuugagacagu

SEQ ID NO: 3551251 - RNA, 22 nt, Human
aaaaaugccuuugagacaguuu

SEQ ID NO: 3551252 - RNA, 17 nt, Human
aaaaaugcuaauauuaa

SEQ ID NO: 3551253 - RNA, 16 nt, Human
aaaaaugcugaacauu

SEQ ID NO: 3551254 - RNA, 14 nt, Human
aaaaaugcuuugcu

SEQ ID NO: 3551255 - RNA, 15 nt, Human
aaaaauggaacugug

SEQ ID NO: 3551256 - RNA, 14 nt, Human
aaaaauggcucaga

SEQ ID NO: 3551257 - RNA, 23 nt, Human
aaaaaugggacuucuuuucacau

SEQ ID NO: 3551258 - RNA, 19 nt, Human
aaaaaugguaaaauugcau

SEQ ID NO: 3551259 - RNA, 22 nt, Human
aaaaaugguggcuucagcucca

SEQ ID NO: 3551260 - RNA, 11 nt, Human
aaaaauguagg

SEQ ID NO: 3551261 - RNA, 12 nt, Human
aaaaauguagga

SEQ ID NO: 3551262 - RNA, 18 nt, Human
aaaaauguccugccuuuu

SEQ ID NO: 3551263 - RNA, 21 nt, Human
aaaaaugucuugcuguugaca

SEQ ID NO: 3551264 - RNA, 22 nt, Human
aaaaaugucuuggguaggcggg

SEQ ID NO: 3551265 - RNA, 20 nt, Human
aaaaauguucuauuuuaauu

SEQ ID NO: 3551266 - RNA, 13 nt, Human
aaaaauuaaaaug

SEQ ID NO: 3551267 - RNA, 21 nt, Human
aaaaauuaaaccggaccaucu

SEQ ID NO: 3551268 - RNA, 22 nt, Human
aaaaauuaggacagaaauaaua

SEQ ID NO: 3551269 - RNA, 20 nt, Human
aaaaauucagcaaagugguu

SEQ ID NO: 3551270 - RNA, 22 nt, Human
aaaaauugaaauguaaggcugu

SEQ ID NO: 3551271 - RNA, 15 nt, Human
aaaaauugcugacug

SEQ ID NO: 3551272 - RNA, 21 nt, Human
aaaaauugcugacuguagcuu

SEQ ID NO: 3551273 - RNA, 23 nt, Human
aaaaauugcugacuguagcuuug

SEQ ID NO: 3551274 - RNA, 18 nt, Human
aaaaauuggggauucuua

SEQ ID NO: 3551275 - RNA, 19 nt, Human
aaaaauuggggauucuuaa

SEQ ID NO: 3551276 - RNA, 20 nt, Human
aaaaauuggggauucuuaaa

SEQ ID NO: 3551277 - RNA, 18 nt, Human
aaaaauugguucuuuauu

SEQ ID NO: 3551278 - RNA, 14 nt, Human
aaaaauuuaagcau

SEQ ID NO: 3551279 - RNA, 15 nt, Human
aaaaauuuaagcauu

SEQ ID NO: 3551280 - RNA, 13 nt, Human
aaaaauuuaagug

SEQ ID NO: 3551281 - RNA, 13 nt, Human
aaaaauuuacuuu

SEQ ID NO: 3551282 - RNA, 20 nt, Human
aaaaauuugaaccaaaacau

SEQ ID NO: 3551283 - RNA, 23 nt, Human
aaaaauuugucugaaacauuuca

SEQ ID NO: 3551284 - RNA, 13 nt, Human
aaaaauuuuuguu

SEQ ID NO: 3551285 - RNA, 14 nt, Human
aaaaauuuuuguuu

SEQ ID NO: 3551286 - RNA, 10 nt, Human
aaaacaaaaa

SEQ ID NO: 3551287 - RNA, 15 nt, Human
aaaacaaaaaacaau

SEQ ID NO: 3551288 - RNA, 13 nt, Human
aaaacaaaaggca

SEQ ID NO: 3551289 - RNA, 15 nt, Human
aaaacaaacucauuc

SEQ ID NO: 3551290 - RNA, 12 nt, Human
aaaacaaagaag

SEQ ID NO: 3551291 - RNA, 20 nt, Human
aaaacaaagcaauucuuuca

SEQ ID NO: 3551292 - RNA, 15 nt, Human
aaaacaaaugccaca

SEQ ID NO: 3551293 - RNA, 12 nt, Human
aaaacaacaaaa

SEQ ID NO: 3551294 - RNA, 14 nt, Human
aaaacaaccaagcg

SEQ ID NO: 3551295 - RNA, 12 nt, Human
aaaacaagugaa

SEQ ID NO: 3551296 - RNA, 15 nt, Human
aaaacaagugaaaua

SEQ ID NO: 3551297 - RNA, 15 nt, Human
aaaacaauauuguuu

SEQ ID NO: 3551298 - RNA, 18 nt, Human
aaaacaauauuguuucua

SEQ ID NO: 3551299 - RNA, 14 nt, Human
aaaacaauauuuau

SEQ ID NO: 3551300 - RNA, 19 nt, Human
aaaacaaucauuugcuuuu

SEQ ID NO: 3551301 - RNA, 13 nt, Human
aaaacaaugaaga

SEQ ID NO: 3551302 - RNA, 14 nt, Human
aaaacaauuguaau

SEQ ID NO: 3551303 - RNA, 15 nt, Human
aaaacacaagcaaaa

SEQ ID NO: 3551304 - RNA, 13 nt, Human
aaaacacacaggu

SEQ ID NO: 3551305 - RNA, 12 nt, Human
aaaacacagcaa

SEQ ID NO: 3551306 - RNA, 13 nt, Human
aaaauauuuucug

SEQ ID NO: 3551307 - RNA, 15 nt, Human
aaaauauuuucugug

SEQ ID NO: 3551308 - RNA, 16 nt, Human
aaaauauuuucugugu

SEQ ID NO: 3551309 - RNA, 18 nt, Human
aaaauauuuucugugugu

SEQ ID NO: 3551310 - RNA, 23 nt, Human
aaaauauuuuuuauauauacagu

SEQ ID NO: 3551311 - RNA, 18 nt, Human
aaaaucaaaacaaaaaaa

SEQ ID NO: 3551312 - RNA, 11 nt, Human
aaaaucaacuu

SEQ ID NO: 3551313 - RNA, 13 nt, Human
aaaaucaacuuuu

SEQ ID NO: 3551314 - RNA, 14 nt, Human
aaaaucacaauuuu

SEQ ID NO: 3551315 - RNA, 20 nt, Human
aaaaucacaauuuuuaaugg

SEQ ID NO: 3551316 - RNA, 15 nt, Human
aaaaucacuuucaua

SEQ ID NO: 3551317 - RNA, 18 nt, Human
aaaaucagccaauuaugu

SEQ ID NO: 3551318 - RNA, 17 nt, Human
aaaaucaguuguacagu

SEQ ID NO: 3551319 - RNA, 22 nt, Human
aaaaucauaaacugugugcaga

SEQ ID NO: 3551320 - RNA, 18 nt, Human
aaaaucauauugcuucuu

SEQ ID NO: 3551321 - RNA, 20 nt, Human
aaaaucaucaagaagggcug

SEQ ID NO: 3551322 - RNA, 18 nt, Human
aaaaucaugccaguauuu

SEQ ID NO: 3551323 - RNA, 17 nt, Human
aaaaucauggaaugguu

SEQ ID NO: 3551324 - RNA, 15 nt, Human
aaaaucauguacauu

SEQ ID NO: 3551325 - RNA, 16 nt, Human
aaaaucauguacauuu

SEQ ID NO: 3551326 - RNA, 17 nt, Human
aaaaucauguacauuuc

SEQ ID NO: 3551327 - RNA, 18 nt, Human
aaaaucauguacauuucu

SEQ ID NO: 3551328 - RNA, 19 nt, Human
aaaaucauuuuauauguca

SEQ ID NO: 3551329 - RNA, 14 nt, Human
aaaauccaaaaaga

SEQ ID NO: 3551330 - RNA, 22 nt, Human
aaaauccagaaacuuguucuuc

SEQ ID NO: 3551331 - RNA, 18 nt, Human
aaaauccccaugccugug

SEQ ID NO: 3551332 - RNA, 22 nt, Human
aaaauccuaagacacaaaugca

SEQ ID NO: 3551333 - RNA, 16 nt, Human
aaaauccucuuccucu

SEQ ID NO: 3551334 - RNA, 15 nt, Human
aaaauccuucuaauc

SEQ ID NO: 3551335 - RNA, 16 nt, Human
aaaauccuucuaaucu

SEQ ID NO: 3551336 - RNA, 20 nt, Human
aaaauccuugcuuaugacau

SEQ ID NO: 3551337 - RNA, 22 nt, Human
aaaaucuaagcagcuuauuguu

SEQ ID NO: 3551338 - RNA, 18 nt, Human
aaaaucuaccuucuguag

SEQ ID NO: 3551339 - RNA, 22 nt, Human
aaaaucucaaauuucuaaaucu

SEQ ID NO: 3551340 - RNA, 19 nt, Human
aaaaucucccauuuuggaa

SEQ ID NO: 3551341 - RNA, 19 nt, Human
aaaaucucucauuugugug

SEQ ID NO: 3551342 - RNA, 16 nt, Human
aaaaucucuccacuuu

SEQ ID NO: 3551343 - RNA, 16 nt, Human
aaaaucucucucuguu

SEQ ID NO: 3551344 - RNA, 13 nt, Human
aaaaucugaaaau

SEQ ID NO: 3551345 - RNA, 16 nt, Human
aaaaucugagggaaau

SEQ ID NO: 3551346 - RNA, 13 nt, Human
aaaaucugccugg

SEQ ID NO: 3551347 - RNA, 18 nt, Human
aaaaucuguagagcaggg

SEQ ID NO: 3551348 - RNA, 16 nt, Human
aaaaucuguggugguc

SEQ ID NO: 3551349 - RNA, 20 nt, Human
aaaaucuguugauaaaucca

SEQ ID NO: 3551350 - RNA, 16 nt, Human
aaaaucuuaauacugu

SEQ ID NO: 3551351 - RNA, 22 nt, Human
aaaaucuuaauacuguuauucu

SEQ ID NO: 3551352 - RNA, 12 nt, Human
aaaaucuuauua

SEQ ID NO: 3551353 - RNA, 23 nt, Human
aaaaucuuauuaaaguuucaaaa

SEQ ID NO: 3551354 - RNA, 17 nt, Human
aaaaucuucauggaauu

SEQ ID NO: 3551355 - RNA, 13 nt, Human
aaaaucuugucau

SEQ ID NO: 3551356 - RNA, 21 nt, Human
aaaaucuuucuuucuuagaaa

SEQ ID NO: 3551357 - RNA, 17 nt, Human
aaaaugaaaauaaguga

SEQ ID NO: 3551358 - RNA, 15 nt, Human
aaaaugaaaauugua

SEQ ID NO: 3551359 - RNA, 15 nt, Human
aaaaugaaagaugau

SEQ ID NO: 3551360 - RNA, 14 nt, Human
aaaaugaaaugcau

SEQ ID NO: 3551361 - RNA, 15 nt, Human
aaaaugaauccuaca

SEQ ID NO: 3551362 - RNA, 20 nt, Human
aaaaugacaaucaugugugu

SEQ ID NO: 3551363 - RNA, 13 nt, Human
aaaaugacaauga

SEQ ID NO: 3551364 - RNA, 19 nt, Human
aaaaugacaccaucuuuua

SEQ ID NO: 3551365 - RNA, 13 nt, Human
aaaaugacagaug

SEQ ID NO: 3551366 - RNA, 15 nt, Human
aaaaugacagauguu

SEQ ID NO: 3551367 - RNA, 19 nt, Human
aaaaugaccaguaauugug

SEQ ID NO: 3551368 - RNA, 20 nt, Human
aaaaugaccaguaauuguga

SEQ ID NO: 3551369 - RNA, 14 nt, Human
aaaaugacuacuua

SEQ ID NO: 3551370 - RNA, 12 nt, Human
aaaaugagaaau

SEQ ID NO: 3551371 - RNA, 20 nt, Human
aaaaugagaacauguuggua

SEQ ID NO: 3551372 - RNA, 23 nt, Human
aaaaugagaacauguugguauuu

SEQ ID NO: 3551373 - RNA, 22 nt, Human
aaaaugagacuaugcguuuuua

SEQ ID NO: 3551374 - RNA, 23 nt, Human
aaaaugagagggcaguguuuccu

SEQ ID NO: 3551375 - RNA, 14 nt, Human
aaaaugagccuggc

SEQ ID NO: 3551376 - RNA, 19 nt, Human
aaaaugaggaauguauaug

SEQ ID NO: 3551377 - RNA, 16 nt, Human
aaaaugaggacauguu

SEQ ID NO: 3551378 - RNA, 19 nt, Human
aaaaugauauuguuauaua

SEQ ID NO: 3551379 - RNA, 17 nt, Human
aaaaugcaaaaaaucuu

SEQ ID NO: 3551380 - RNA, 14 nt, Human
aaaaugcaaauccu

SEQ ID NO: 3551381 - RNA, 12 nt, Human
aaaaugcaauau

SEQ ID NO: 3551382 - RNA, 20 nt, Human
aaaaugcacaaacaaugcaa

SEQ ID NO: 3551383 - RNA, 14 nt, Human
aaaaugcacguagc

SEQ ID NO: 3551384 - RNA, 16 nt, Human
aaaaugcauguaauca

SEQ ID NO: 3551385 - RNA, 17 nt, Human
aaaaugccaucaaauga

SEQ ID NO: 3551386 - RNA, 23 nt, Human
aaaaugccaugaugccucugucu

SEQ ID NO: 3551387 - RNA, 11 nt, Human
aaaaugccuuu

SEQ ID NO: 3551388 - RNA, 15 nt, Human
aaaaugccuuugaga

SEQ ID NO: 3551389 - RNA, 17 nt, Human
aaaaugccuuugagaca

SEQ ID NO: 3551390 - RNA, 22 nt, Human
aaaaugccuuugagacaguuuc

SEQ ID NO: 3551391 - RNA, 23 nt, Human
aaaaugccuuugagacaguuucu

SEQ ID NO: 3551392 - RNA, 18 nt, Human
aaaaugcgguuauaaaaa

SEQ ID NO: 3551393 - RNA, 22 nt, Human
aaaaugcgguuauaaaaaaugg

SEQ ID NO: 3551394 - RNA, 18 nt, Human
aaaaugcuccccacagcg

SEQ ID NO: 3551395 - RNA, 20 nt, Human
aaaaugcugaacauugcaua

SEQ ID NO: 3551396 - RNA, 19 nt, Human
aaaaugcuggcuauagaug

SEQ ID NO: 3551397 - RNA, 16 nt, Human
aaaaugcuuacauuug

SEQ ID NO: 3551398 - RNA, 14 nt, Human
aaaauggaaagaau

SEQ ID NO: 3551399 - RNA, 20 nt, Human
aaaauggaagacagcucuua

SEQ ID NO: 3551400 - RNA, 14 nt, Human
aaaauggaauaaaa

SEQ ID NO: 3551401 - RNA, 22 nt, Human
aaaauggaggccauugugugag

SEQ ID NO: 3551402 - RNA, 19 nt, Human
aaaauggcaacaaacugca

SEQ ID NO: 3551403 - RNA, 19 nt, Human
aaaauggccauuugcuuuu

SEQ ID NO: 3551404 - RNA, 16 nt, Human
aaaaugggcacuuaaa

SEQ ID NO: 3551405 - RNA, 16 nt, Human
aaaaugguaaaauugc

SEQ ID NO: 3551406 - RNA, 18 nt, Human
aaaaugguauaaguaacu

SEQ ID NO: 3551407 - RNA, 23 nt, Human
aaaaugguauaaguaacuuuauu

SEQ ID NO: 3551408 - RNA, 15 nt, Human
aaaaugguggcuuca

SEQ ID NO: 3551409 - RNA, 17 nt, Human
aaaaugguguuuucaug

SEQ ID NO: 3551410 - RNA, 18 nt, Human
aaaaugguuuauuuugua

SEQ ID NO: 3551411 - RNA, 11 nt, Human
aaaauguaaau

SEQ ID NO: 3551412 - RNA, 23 nt, Human
aaaauguaagauuauagauucua

SEQ ID NO: 3551413 - RNA, 14 nt, Human
aaaauguaauuuaa

SEQ ID NO: 3551414 - RNA, 19 nt, Human
aaaauguaauuuaaaugaa

SEQ ID NO: 3551415 - RNA, 12 nt, Human
aaaauguacaaa

SEQ ID NO: 3551416 - RNA, 17 nt, Human
aaaauguaggagacugu

SEQ ID NO: 3551417 - RNA, 21 nt, Human
aaaauguaggcuuaguuugug

SEQ ID NO: 3551418 - RNA, 17 nt, Human
aaaauguaggguuauaa

SEQ ID NO: 3551419 - RNA, 23 nt, Human
aaaauguauaaguugaggcauuu

SEQ ID NO: 3551420 - RNA, 20 nt, Human
aaaaguuggacuaaaugccu

SEQ ID NO: 3551421 - RNA, 16 nt, Human
aaaaguuguaugaucu

SEQ ID NO: 3551422 - RNA, 12 nt, Human
aaaaguuguuca

SEQ ID NO: 3551423 - RNA, 13 nt, Human
aaaaguuguucaa

SEQ ID NO: 3551424 - RNA, 16 nt, Human
aaaaguuuaauauuaa

SEQ ID NO: 3551425 - RNA, 13 nt, Human
aaaaguuuacaac

SEQ ID NO: 3551426 - RNA, 16 nt, Human
aaaaguuuuuguuugg

SEQ ID NO: 3551427 - RNA, 16 nt, Human
aaaauaaaaaaaagaa

SEQ ID NO: 3551428 - RNA, 22 nt, Human
aaaauaaaaagugacacagcag

SEQ ID NO: 3551429 - RNA, 14 nt, Human
aaaauaaaacaaag

SEQ ID NO: 3551430 - RNA, 17 nt, Human
aaaauaaaacauagcaa

SEQ ID NO: 3551431 - RNA, 15 nt, Human
aaaauaaaacauuuu

SEQ ID NO: 3551432 - RNA, 13 nt, Human
aaaauaaaauaua

SEQ ID NO: 3551433 - RNA, 13 nt, Human
aaaauaaaaugaa

SEQ ID NO: 3551434 - RNA, 16 nt, Human
aaaauaaaauuaagaa

SEQ ID NO: 3551435 - RNA, 14 nt, Human
aaaauaaacaaaua

SEQ ID NO: 3551436 - RNA, 15 nt, Human
aaaauaaacacuaca

SEQ ID NO: 3551437 - RNA, 20 nt, Human
aaaauaaaccaaaggacauu

SEQ ID NO: 3551438 - RNA, 22 nt, Human
aaaauaaacuuucuuaauauuu

SEQ ID NO: 3551439 - RNA, 21 nt, Human
aaaauaaagaaaagaugcacu

SEQ ID NO: 3551440 - RNA, 13 nt, Human
aaaauaaagaaug

SEQ ID NO: 3551441 - RNA, 22 nt, Human
aaaauaaagacaaccauauuua

SEQ ID NO: 3551442 - RNA, 11 nt, Human
aaaauaaagca

SEQ ID NO: 3551443 - RNA, 13 nt, Human
aaaauaaagcaag

SEQ ID NO: 3551444 - RNA, 13 nt, Human
aaaauaaaguugg

SEQ ID NO: 3551445 - RNA, 16 nt, Human
aaaauaaauaaaagcc

SEQ ID NO: 3551446 - RNA, 14 nt, Human
aaaauaaauauauc

SEQ ID NO: 3551447 - RNA, 17 nt, Human
aaaauaaauauaucuac

SEQ ID NO: 3551448 - RNA, 23 nt, Human
aaaauaaauauugucuuuuugua

SEQ ID NO: 3551449 - RNA, 14 nt, Human
aaaauaaauuuaua

SEQ ID NO: 3551450 - RNA, 18 nt, Human
aaaauaaccuaauuaaua

SEQ ID NO: 3551451 - RNA, 13 nt, Human
aaaacuuuucuca

SEQ ID NO: 3551452 - RNA, 9 nt, Human
aaaagaaaa

SEQ ID NO: 3551453 - RNA, 16 nt, Human
aaaagaaaaaaaaaga

SEQ ID NO: 3551454 - RNA, 14 nt, Human
aaaagaaaaacugu

SEQ ID NO: 3551455 - RNA, 13 nt, Human
aaaagaaaaagau

SEQ ID NO: 3551456 - RNA, 16 nt, Human
aaaagaaaagucaagg

SEQ ID NO: 3551457 - RNA, 13 nt, Human
aaaagaaaaguuu

SEQ ID NO: 3551458 - RNA, 19 nt, Human
aaaagaaaaugaaaaacaa

SEQ ID NO: 3551459 - RNA, 10 nt, Human
aaaagaaaga

SEQ ID NO: 3551460 - RNA, 11 nt, Human
aaaagaaagca

SEQ ID NO: 3551461 - RNA, 15 nt, Human
aaaagaaauaauaau

SEQ ID NO: 3551462 - RNA, 19 nt, Human
aaaagaaaucauguccaua

SEQ ID NO: 3551463 - RNA, 14 nt, Human
aaaagaaaugaaca

SEQ ID NO: 3551464 - RNA, 14 nt, Human
aaaagaagaaguuu

SEQ ID NO: 3551465 - RNA, 19 nt, Human
aaaagaagcccggcuccug

SEQ ID NO: 3551466 - RNA, 21 nt, Human
aaaagaauauucagagaauau

SEQ ID NO: 3551467 - RNA, 21 nt, Human
aaaagaaucugcauuuagcac

SEQ ID NO: 3551468 - RNA, 16 nt, Human
aaaagaaugggcaguu

SEQ ID NO: 3551469 - RNA, 21 nt, Human
aaaagaaugucagaaaaacaa

SEQ ID NO: 3551470 - RNA, 22 nt, Human
aaaagaauuguuggggguuuuu

SEQ ID NO: 3551471 - RNA, 20 nt, Human
aaaagacaaggaaaaaauaa

SEQ ID NO: 3551472 - RNA, 14 nt, Human
aaaagacaauucuu

SEQ ID NO: 3551473 - RNA, 18 nt, Human
aaaagacacuugauacuu

SEQ ID NO: 3551474 - RNA, 12 nt, Human
aaaagacauguu

SEQ ID NO: 3551475 - RNA, 13 nt, Human
aaaagaccagacu

SEQ ID NO: 3551476 - RNA, 13 nt, Human
aaaagacucaucc

SEQ ID NO: 3551477 - RNA, 13 nt, Human
aaaagagaaaaga

SEQ ID NO: 3551478 - RNA, 16 nt, Human
aaaagagaaaagaaaa

SEQ ID NO: 3551479 - RNA, 12 nt, Human
aaaagagaagaa

SEQ ID NO: 3551480 - RNA, 18 nt, Human
aaaagagaagaagaaaaa

SEQ ID NO: 3551481 - RNA, 14 nt, Human
aaaagagaauuaga

SEQ ID NO: 3551482 - RNA, 18 nt, Human
aaaagagaauuagauuau

SEQ ID NO: 3551483 - RNA, 19 nt, Human
aaaagagagaaaacuuauu

SEQ ID NO: 3551484 - RNA, 14 nt, Human
aaaagagauauuuu

SEQ ID NO: 3551485 - RNA, 19 nt, Human
aaaagagaugaugaaaaua

SEQ ID NO: 3551486 - RNA, 19 nt, Human
aaaagagauggccugagaa

SEQ ID NO: 3551487 - RNA, 12 nt, Human
aaaagaggaaaa

SEQ ID NO: 3551488 - RNA, 12 nt, Human
aaaagagggggg

SEQ ID NO: 3551489 - RNA, 22 nt, Human
aaaagagguuuuucuuaaauaa

SEQ ID NO: 3551490 - RNA, 15 nt, Human
aaaagaguuaaggca

SEQ ID NO: 3551491 - RNA, 21 nt, Human
aaaagauaaaaaaacagcuuu

SEQ ID NO: 3551492 - RNA, 12 nt, Human
aaaagauaaaca

SEQ ID NO: 3551493 - RNA, 14 nt, Human
aaaagauaaagaug

SEQ ID NO: 3551494 - RNA, 20 nt, Human
aaaagauaaagaugaucuac

SEQ ID NO: 3551495 - RNA, 19 nt, Human
aaaagauaauauuuuacau

SEQ ID NO: 3551496 - RNA, 22 nt, Human
aaaagauaauauuuuacauaca

SEQ ID NO: 3551497 - RNA, 19 nt, Human
aaaagauauaagugcugua

SEQ ID NO: 3551498 - RNA, 16 nt, Human
aaaagauauauuaaaa

SEQ ID NO: 3551499 - RNA, 16 nt, Human
aaaagauccuuuuuaa

SEQ ID NO: 3551500 - RNA, 10 nt, Human
aaaagaugaa

SEQ ID NO: 3551501 - RNA, 17 nt, Human
aaaagaugaaaauauuu

SEQ ID NO: 3551502 - RNA, 22 nt, Human
aaaagauguagauuuauuucau

SEQ ID NO: 3551503 - RNA, 11 nt, Human
aaaagauucau

SEQ ID NO: 3551504 - RNA, 15 nt, Human
aaaagauuuuaauca

SEQ ID NO: 3551505 - RNA, 14 nt, Human
aaaagcaaaucauu

SEQ ID NO: 3551506 - RNA, 14 nt, Human
aaaagcaagacugu

SEQ ID NO: 3551507 - RNA, 20 nt, Human
aaaagcaaguacucuggagc

SEQ ID NO: 3551508 - RNA, 15 nt, Human
aaaagcaauauugua

SEQ ID NO: 3551509 - RNA, 21 nt, Human
aaaagcacacucauccccuca

SEQ ID NO: 3551510 - RNA, 18 nt, Human
aaaagcagguugauaaau

SEQ ID NO: 3551511 - RNA, 22 nt, Human
aaaagcagguugauaaaucauu

SEQ ID NO: 3551512 - RNA, 15 nt, Human
aaaagcauaaaugca

SEQ ID NO: 3551513 - RNA, 13 nt, Human
aaaagcauguaca

SEQ ID NO: 3551514 - RNA, 16 nt, Human
aaaagcauuuuguaau

SEQ ID NO: 3551515 - RNA, 12 nt, Human
aaaagcauuuuu

SEQ ID NO: 3551516 - RNA, 17 nt, Human
aaaagcauuuuucaaua

SEQ ID NO: 3551517 - RNA, 22 nt, Human
aaaagccagccaagcuuuaaau

SEQ ID NO: 3551518 - RNA, 18 nt, Human
aaaagccagggcuggaga

SEQ ID NO: 3551519 - RNA, 13 nt, Human
aaaagcccaaccu

SEQ ID NO: 3551520 - RNA, 15 nt, Human
aaaagcccaaccucu

SEQ ID NO: 3551521 - RNA, 19 nt, Human
aaaagcccaccauuuggca

SEQ ID NO: 3551522 - RNA, 20 nt, Human
aaaagccucuguuuugauau

SEQ ID NO: 3551523 - RNA, 11 nt, Human
aaaagccuugg

SEQ ID NO: 3551524 - RNA, 11 nt, Human
aaaagccuugu

SEQ ID NO: 3551525 - RNA, 13 nt, Human
aaaagccuugugu

SEQ ID NO: 3551526 - RNA, 17 nt, Human
aaaagccuuguguauau

SEQ ID NO: 3551527 - RNA, 18 nt, Human
aaaagccuuguguauauu

SEQ ID NO: 3551528 - RNA, 16 nt, Human
aaaagcgcuuuuccuu

SEQ ID NO: 3551529 - RNA, 16 nt, Human
aaaagcuaauaccagu

SEQ ID NO: 3551530 - RNA, 17 nt, Human
aaaagcuagaacacugc

SEQ ID NO: 3551531 - RNA, 20 nt, Human
aaaagcuauggugagaugca

SEQ ID NO: 3551532 - RNA, 15 nt, Human
aaaagcuccuggggc

SEQ ID NO: 3551533 - RNA, 20 nt, Human
aaaagcucuuacacuacauu

SEQ ID NO: 3551534 - RNA, 15 nt, Human
aaaagcucuuuuaau

SEQ ID NO: 3551535 - RNA, 16 nt, Human
aaaagcugaacacauu

SEQ ID NO: 3551536 - RNA, 14 nt, Human
aaaagcugggcagg

SEQ ID NO: 3551537 - RNA, 18 nt, Human
aaaagcuguauuuugaaa

SEQ ID NO: 3551538 - RNA, 15 nt, Human
aaaagcuuacaaaua

SEQ ID NO: 3551539 - RNA, 23 nt, Human
aaaagcuuagcuuuagaaacagu

SEQ ID NO: 3551540 - RNA, 14 nt, Human
aaaagcuucaaauu

SEQ ID NO: 3551541 - RNA, 16 nt, Human
aaaagcuucuuaauua

SEQ ID NO: 3551542 - RNA, 22 nt, Human
aaaagcuucuuaauuaauuuga

SEQ ID NO: 3551543 - RNA, 11 nt, Human
aaaagcuuuau

SEQ ID NO: 3551544 - RNA, 21 nt, Human
aaaagcuuugaacccugggac

SEQ ID NO: 3551545 - RNA, 19 nt, Human
aaaagcuuuguuuguucuu

SEQ ID NO: 3551546 - RNA, 13 nt, Human
aaaaggaaaaaaa

SEQ ID NO: 3551547 - RNA, 14 nt, Human
aaaaggaaaaagcu

SEQ ID NO: 3551548 - RNA, 12 nt, Human
aaaaggaaaaga

SEQ ID NO: 3551549 - RNA, 14 nt, Human
aaaaggaaaagcaa

SEQ ID NO: 3551550 - RNA, 14 nt, Human
aaaaggaaagaaaa

SEQ ID NO: 3551551 - RNA, 13 nt, Human
aaaaggaaagcug

SEQ ID NO: 3551552 - RNA, 18 nt, Human
aaaaggaagccaaagagu

SEQ ID NO: 3551553 - RNA, 21 nt, Human
aaaaggaagcuuacaugccua

SEQ ID NO: 3551554 - RNA, 16 nt, Human
aaaaggacaccuuuua

SEQ ID NO: 3551555 - RNA, 19 nt, Human
aaaaggacaggcagaaaga

SEQ ID NO: 3551556 - RNA, 20 nt, Human
aaaaggacaggcagaaagag

SEQ ID NO: 3551557 - RNA, 14 nt, Human
aaaaggauaaguga

SEQ ID NO: 3551558 - RNA, 20 nt, Human
aaaaggaucuuuguggccaa

SEQ ID NO: 3551559 - RNA, 18 nt, Human
aaaaggauuuuuaucuuu

SEQ ID NO: 3551560 - RNA, 16 nt, Human
aaaaggcaaaugugua

SEQ ID NO: 3551561 - RNA, 19 nt, Human
aaaaggccaaaccucuguu

SEQ ID NO: 3551562 - RNA, 23 nt, Human
aaaaggccaaaccucuguucagu

SEQ ID NO: 3551563 - RNA, 21 nt, Human
aaaaggccucuuguaaagacu

SEQ ID NO: 3551564 - RNA, 11 nt, Human
aaaaggccugg

SEQ ID NO: 3551565 - RNA, 15 nt, Human
aaaaggcgcaucuaa

SEQ ID NO: 3551566 - RNA, 20 nt, Human
aaaaggcuagguacacagcu

SEQ ID NO: 3551567 - RNA, 16 nt, Human
aaaaggcugugcugcc

SEQ ID NO: 3551568 - RNA, 15 nt, Human
aaaagggaacaggaa

SEQ ID NO: 3551569 - RNA, 18 nt, Human
aaaagggaaguaguccuu

SEQ ID NO: 3551570 - RNA, 19 nt, Human
aaaagggcucuuuagccag

SEQ ID NO: 3551571 - RNA, 22 nt, Human
aaaagggguaggguuuaaagau

SEQ ID NO: 3551572 - RNA, 12 nt, Human
aaaagggucaga

SEQ ID NO: 3551573 - RNA, 15 nt, Human
aaaaggucuuuaaaa

SEQ ID NO: 3551574 - RNA, 16 nt, Human
aaaagguuaauaaagu

SEQ ID NO: 3551575 - RNA, 17 nt, Human
aaaagguuaauaaagua

SEQ ID NO: 3551576 - RNA, 14 nt, Human
aaaagguuuaugaa

SEQ ID NO: 3551577 - RNA, 20 nt, Human
aaaagguuuaugaaaaagaa

SEQ ID NO: 3551578 - RNA, 15 nt, Human
aaaagguuuuauuuu

SEQ ID NO: 3551579 - RNA, 16 nt, Human
aaaauguauauauuua

SEQ ID NO: 3551580 - RNA, 17 nt, Human
aaaauguauaugcacuu

SEQ ID NO: 3551581 - RNA, 13 nt, Human
aaaauguaucuaa

SEQ ID NO: 3551582 - RNA, 12 nt, Human
aaaauguauuuu

SEQ ID NO: 3551583 - RNA, 18 nt, Human
aaaauguauuuuauguua

SEQ ID NO: 3551584 - RNA, 13 nt, Human
aaaauguauuuuu

SEQ ID NO: 3551585 - RNA, 22 nt, Human
aaaaugucaaaaguagaacuuu

SEQ ID NO: 3551586 - RNA, 16 nt, Human
aaaauguccugccuuu

SEQ ID NO: 3551587 - RNA, 17 nt, Human
aaaauguccugccuuuu

SEQ ID NO: 3551588 - RNA, 13 nt, Human
aaaaugucuuuau

SEQ ID NO: 3551589 - RNA, 23 nt, Human
aaaaugugaauugcaugacuugu

SEQ ID NO: 3551590 - RNA, 20 nt, Human
aaaaugugagugguugaaua

SEQ ID NO: 3551591 - RNA, 15 nt, Human
aaaaugugauaugua

SEQ ID NO: 3551592 - RNA, 15 nt, Human
aaaaugugauguucu

SEQ ID NO: 3551593 - RNA, 19 nt, Human
aaaaugugauguucuaagg

SEQ ID NO: 3551594 - RNA, 21 nt, Human
aaaaugugauguucuaaggcu

SEQ ID NO: 3551595 - RNA, 13 nt, Human
aaaaugugauuuu

SEQ ID NO: 3551596 - RNA, 17 nt, Human
aaaaugugcaaaacagc

SEQ ID NO: 3551597 - RNA, 19 nt, Human
aaaaugugcaaaacagcgu

SEQ ID NO: 3551598 - RNA, 18 nt, Human
aaaaucuuauaguucuag

SEQ ID NO: 3551599 - RNA, 20 nt, Human
aaaaucuuauaguucuaggc

SEQ ID NO: 3551600 - RNA, 16 nt, Human
aaaaucuucauggaau

SEQ ID NO: 3551601 - RNA, 23 nt, Human
aaaaucuucauggaauucacaaa

SEQ ID NO: 3551602 - RNA, 15 nt, Human
aaaaucuugaucagu

SEQ ID NO: 3551603 - RNA, 14 nt, Human
aaaaucuuggaagu

SEQ ID NO: 3551604 - RNA, 17 nt, Human
aaaaucuuggcacagaa

SEQ ID NO: 3551605 - RNA, 22 nt, Human
aaaaucuugugcuagaauacuu

SEQ ID NO: 3551606 - RNA, 20 nt, Human
aaaaucuuucuuucuuagaa

SEQ ID NO: 3551607 - RNA, 16 nt, Human
aaaaucuuuugaagca

SEQ ID NO: 3551608 - RNA, 14 nt, Human
aaaaugaaagauga

SEQ ID NO: 3551609 - RNA, 15 nt, Human
aaaaugaaauccuuu

SEQ ID NO: 3551610 - RNA, 16 nt, Human
aaaaugaaaugcauau

SEQ ID NO: 3551611 - RNA, 16 nt, Human
aaaaugaaauguuuua

SEQ ID NO: 3551612 - RNA, 11 nt, Human
aaaaugaagaa

SEQ ID NO: 3551613 - RNA, 16 nt, Human
aaaaugaauccuacac

SEQ ID NO: 3551614 - RNA, 17 nt, Human
aaaaugacaaucaugug

SEQ ID NO: 3551615 - RNA, 18 nt, Human
aaaaugacaaucaugugu

SEQ ID NO: 3551616 - RNA, 17 nt, Human
aaaaugacaucuuuuua

SEQ ID NO: 3551617 - RNA, 18 nt, Human
aaaaugacuacuuagcau

SEQ ID NO: 3551618 - RNA, 15 nt, Human
aaaaugaggaaugua

SEQ ID NO: 3551619 - RNA, 14 nt, Human
aaaaugauacagca

SEQ ID NO: 3551620 - RNA, 16 nt, Human
aaaaugauuguaaaau

SEQ ID NO: 3551621 - RNA, 20 nt, Human
aaaaugauuguaaaauagcu

SEQ ID NO: 3551622 - RNA, 14 nt, Human
aaaaugauuuuacu

SEQ ID NO: 3551623 - RNA, 23 nt, Human
aaaaugauuuuacuuagcaaugu

SEQ ID NO: 3551624 - RNA, 14 nt, Human
aaaaugauuuuauc

SEQ ID NO: 3551625 - RNA, 16 nt, Human
aaaaugcaaaaaaucu

SEQ ID NO: 3551626 - RNA, 20 nt, Human
aaaaugcaaauccuauguga

SEQ ID NO: 3551627 - RNA, 15 nt, Human
aaaaugcaauauuug

SEQ ID NO: 3551628 - RNA, 16 nt, Human
aaaaugcaugauugca

SEQ ID NO: 3551629 - RNA, 15 nt, Human
aaaaugcccauuugc

SEQ ID NO: 3551630 - RNA, 18 nt, Human
aaaaugccucaguguauu

SEQ ID NO: 3551631 - RNA, 22 nt, Human
aaaaugccucaguguauuugua

SEQ ID NO: 3551632 - RNA, 15 nt, Human
aaaaugcuagguucu

SEQ ID NO: 3551633 - RNA, 18 nt, Human
aaaaugcucuuauuucau

SEQ ID NO: 3551634 - RNA, 21 nt, Human
aaaaugcuguauuagucacag

SEQ ID NO: 3551635 - RNA, 23 nt, Human
aaaaugcuguauuagucacagag

SEQ ID NO: 3551636 - RNA, 18 nt, Human
aaaaugcuuuuuauuucu

SEQ ID NO: 3551637 - RNA, 19 nt, Human
aaaaugcuuuuuauuucug

SEQ ID NO: 3551638 - RNA, 22 nt, Human
aaaaugcuuuuuauuucugcau

SEQ ID NO: 3551639 - RNA, 13 nt, Human
aaaauggaaagaa

SEQ ID NO: 3551640 - RNA, 13 nt, Human
aaaauggaaauuu

SEQ ID NO: 3551641 - RNA, 22 nt, Human
aaaauggacuguggugacuuug

SEQ ID NO: 3551642 - RNA, 13 nt, Human
aaaauggauacau

SEQ ID NO: 3551643 - RNA, 20 nt, Human
aaaauggauauuauuagaaa

SEQ ID NO: 3551644 - RNA, 21 nt, Human
aaaauggauauuauuagaaau

SEQ ID NO: 3551645 - RNA, 22 nt, Human
aaaauggauauuauuagaaauu

SEQ ID NO: 3551646 - RNA, 21 nt, Human
aaaauggaugccuugaauaau

SEQ ID NO: 3551647 - RNA, 23 nt, Human
aaaauggaugccuugaauaauaa

SEQ ID NO: 3551648 - RNA, 21 nt, Human
aaaauggcaggggguggaauu

SEQ ID NO: 3551649 - RNA, 20 nt, Human
aaaauggcagugaugaauuu

SEQ ID NO: 3551650 - RNA, 23 nt, Human
aaaauggcuucagaauuaaaacu

SEQ ID NO: 3551651 - RNA, 22 nt, Human
aaaaugggacuucuuuucacau

SEQ ID NO: 3551652 - RNA, 22 nt, Human
aaaaugguagcauuuuaaacaa

SEQ ID NO: 3551653 - RNA, 15 nt, Human
aaaaugguauaagua

SEQ ID NO: 3551654 - RNA, 13 nt, Human
aaaaugguaucaa

SEQ ID NO: 3551655 - RNA, 22 nt, Human
aaaaugguccaauuaguuuccu

SEQ ID NO: 3551656 - RNA, 19 nt, Human
aaaaugguggcuucagcuc

SEQ ID NO: 3551657 - RNA, 22 nt, Human
aaaaugguuuauuuuguauugu

SEQ ID NO: 3551658 - RNA, 12 nt, Human
aaaauguaacug

SEQ ID NO: 3551659 - RNA, 13 nt, Human
aaaauguaacugu

SEQ ID NO: 3551660 - RNA, 16 nt, Human
aaaauguaacuguuac

SEQ ID NO: 3551661 - RNA, 18 nt, Human
aaaauguaacuguuacca

SEQ ID NO: 3551662 - RNA, 23 nt, Human
aaaauguaaguaaaugucugugg

SEQ ID NO: 3551663 - RNA, 19 nt, Human
aaaauguacaaaauaaagu

SEQ ID NO: 3551664 - RNA, 21 nt, Human
aaaauguacaaaauaaaguua

SEQ ID NO: 3551665 - RNA, 21 nt, Human
aaaauguacauguauuaaauu

SEQ ID NO: 3551666 - RNA, 10 nt, Human
aaaauguacu

SEQ ID NO: 3551667 - RNA, 16 nt, Human
aaaauguagaauauuc

SEQ ID NO: 3551668 - RNA, 12 nt, Human
aaaauguaggag

SEQ ID NO: 3551669 - RNA, 21 nt, Human
aaaauguaggguuauaauaau

SEQ ID NO: 3551670 - RNA, 17 nt, Human
aaaauguauaaguugag

SEQ ID NO: 3551671 - RNA, 21 nt, Human
aaaauguauaaguugaggcau

SEQ ID NO: 3551672 - RNA, 15 nt, Human
aaaauguauuuuaug

SEQ ID NO: 3551673 - RNA, 22 nt, Human
aaaauguauuuuauguuauaua

SEQ ID NO: 3551674 - RNA, 21 nt, Human
aaaaugucuguagcuccucaa

SEQ ID NO: 3551675 - RNA, 18 nt, Human
aaaaugucuguuaacuua

SEQ ID NO: 3551676 - RNA, 12 nt, Human
aaaaugugaagu

SEQ ID NO: 3551677 - RNA, 16 nt, Human
aaaaugugacccagau

SEQ ID NO: 3551678 - RNA, 13 nt, Human
aaaaugugacccu

SEQ ID NO: 3551679 - RNA, 15 nt, Human
aaaaugugacccucc

SEQ ID NO: 3551680 - RNA, 17 nt, Human
aaaaugugauguucuaa

SEQ ID NO: 3551681 - RNA, 20 nt, Human
aaaaugugauguucuaaggc

SEQ ID NO: 3551682 - RNA, 18 nt, Human
aaaaugugauuuuucuga

SEQ ID NO: 3551683 - RNA, 16 nt, Human
aaaauguguaauuuug

SEQ ID NO: 3551684 - RNA, 17 nt, Human
aaaauguguaauuuugu

SEQ ID NO: 3551685 - RNA, 11 nt, Human
aaaauguguuc

SEQ ID NO: 3551686 - RNA, 14 nt, Human
aaaauguuaggaca

SEQ ID NO: 3551687 - RNA, 16 nt, Human
aaaauguucagaaggu

SEQ ID NO: 3551688 - RNA, 12 nt, Human
aaaauguucauc

SEQ ID NO: 3551689 - RNA, 22 nt, Human
aaaauguucaucaauucccauu

SEQ ID NO: 3551690 - RNA, 15 nt, Human
aaaauguucuguuug

SEQ ID NO: 3551691 - RNA, 13 nt, Human
aaaauguugaaau

SEQ ID NO: 3551692 - RNA, 17 nt, Human
aaaauguugaaauauga

SEQ ID NO: 3551693 - RNA, 17 nt, Human
aaaauguugcugaaaaa

SEQ ID NO: 3551694 - RNA, 15 nt, Human
aaaauguuggauuua

SEQ ID NO: 3551695 - RNA, 14 nt, Human
aaaauguuuucagc

SEQ ID NO: 3551696 - RNA, 16 nt, Human
aaaauuaaagaaaaua

SEQ ID NO: 3551697 - RNA, 11 nt, Human
aaaauuaaagc

SEQ ID NO: 3551698 - RNA, 22 nt, Human
aaaauuaacaugaauauuuagu

SEQ ID NO: 3551699 - RNA, 17 nt, Human
aaaauuaagguguuuga

SEQ ID NO: 3551700 - RNA, 18 nt, Human
aaaauuaagguguuugaa

SEQ ID NO: 3551701 - RNA, 12 nt, Human
aaaauuacuaau

SEQ ID NO: 3551702 - RNA, 14 nt, Human
aaaauuacuguuua

SEQ ID NO: 3551703 - RNA, 21 nt, Human
aaaauuacuuaguauugcaaa

SEQ ID NO: 3551704 - RNA, 23 nt, Human
aaaauuacuuaguauugcaaagu

SEQ ID NO: 3551705 - RNA, 21 nt, Human
aaaauuagccaguaauccugu

SEQ ID NO: 3551706 - RNA, 18 nt, Human
aaaauuagccgggcgugg

SEQ ID NO: 3551707 - RNA, 22 nt, Human
aaaauuauagaugggaaugaag

SEQ ID NO: 3551708 - RNA, 19 nt, Human
aaaauuauagcucuaaugu

SEQ ID NO: 3551709 - RNA, 24 nt, Human
aaaauuauagcucuaauguuugca

SEQ ID NO: 3551710 - RNA, 14 nt, Human
aaaauuaucuauuu

SEQ ID NO: 3551711 - RNA, 17 nt, Human
aaaauuaucuauuugua

SEQ ID NO: 3551712 - RNA, 13 nt, Human
aaaauuaugaauc

SEQ ID NO: 3551713 - RNA, 14 nt, Human
aaaauuaugaaucu

SEQ ID NO: 3551714 - RNA, 15 nt, Human
aaaauuauggaaaca

SEQ ID NO: 3551715 - RNA, 13 nt, Human
aaaauuauuuaaa

SEQ ID NO: 3551716 - RNA, 13 nt, Human
aaaauuauuugca

SEQ ID NO: 3551717 - RNA, 21 nt, Human
aaaauuauuuuguucauacau

SEQ ID NO: 3551718 - RNA, 17 nt, Human
aaaauucaaaaaguguu

SEQ ID NO: 3551719 - RNA, 15 nt, Human
aaaauucaaagcaug

SEQ ID NO: 3551720 - RNA, 17 nt, Human
aaaauucaauuguaaau

SEQ ID NO: 3551721 - RNA, 16 nt, Human
aaaauucagcaaacca

SEQ ID NO: 3551722 - RNA, 12 nt, Human
aaaauucauuuu

SEQ ID NO: 3551723 - RNA, 14 nt, Human
aaaauuccacucaa

SEQ ID NO: 3551724 - RNA, 20 nt, Human
aaaauuccagaaaggauauu

SEQ ID NO: 3551725 - RNA, 17 nt, Human
aaaauuccagaaugaag

SEQ ID NO: 3551726 - RNA, 22 nt, Human
aaaauuccuuuguguuucuauu

SEQ ID NO: 3551727 - RNA, 20 nt, Human
aaaauucgcccgagcuguuu

SEQ ID NO: 3551728 - RNA, 20 nt, Human
aaaauucuaaauaaaauaua

SEQ ID NO: 3551729 - RNA, 15 nt, Human
aaaauucuaaaugua

SEQ ID NO: 3551730 - RNA, 16 nt, Human
aaaauucuacuguaug

SEQ ID NO: 3551731 - RNA, 15 nt, Human
aaaauucugaauuuu

SEQ ID NO: 3551732 - RNA, 21 nt, Human
aaaauucugaauuuuggggau

SEQ ID NO: 3551733 - RNA, 20 nt, Human
aaaauucuguagguucugug

SEQ ID NO: 3551734 - RNA, 14 nt, Human
aaaauucugugccu

SEQ ID NO: 3551735 - RNA, 18 nt, Human
aaacaacuuucucuugua

SEQ ID NO: 3551736 - RNA, 20 nt, Human
aaacaagaaaaauaaagaaa

SEQ ID NO: 3551737 - RNA, 18 nt, Human
aaacaagaaaguuucccc

SEQ ID NO: 3551738 - RNA, 15 nt, Human
aaacaagaaugaagg

SEQ ID NO: 3551739 - RNA, 18 nt, Human
aaacaagaccacguuucu

SEQ ID NO: 3551740 - RNA, 19 nt, Human
aaacaagaugcuggauguc

SEQ ID NO: 3551741 - RNA, 19 nt, Human
aaacaagcaaguucugaga

SEQ ID NO: 3551742 - RNA, 16 nt, Human
aaacaagguuuucagu

SEQ ID NO: 3551743 - RNA, 13 nt, Human
aaaaguaauguaa

SEQ ID NO: 3551744 - RNA, 15 nt, Human
aaaaguacaauuuac

SEQ ID NO: 3551745 - RNA, 17 nt, Human
aaaaguacauuuaauac

SEQ ID NO: 3551746 - RNA, 21 nt, Human
aaaaguacauuuaauacagca

SEQ ID NO: 3551747 - RNA, 13 nt, Human
aaaaguagaacuu

SEQ ID NO: 3551748 - RNA, 16 nt, Human
aaaaguauaaaauagu

SEQ ID NO: 3551749 - RNA, 13 nt, Human
aaaaguauauguu

SEQ ID NO: 3551750 - RNA, 14 nt, Human
aaaaguauauguua

SEQ ID NO: 3551751 - RNA, 17 nt, Human
aaaaguauauuaaacaa

SEQ ID NO: 3551752 - RNA, 22 nt, Human
aaaaguauauuaaacaaaguuu

SEQ ID NO: 3551753 - RNA, 22 nt, Human
aaaaguaucgggggcuggggca

SEQ ID NO: 3551754 - RNA, 22 nt, Human
aaaaguauuauuuuccaaaagu

SEQ ID NO: 3551755 - RNA, 11 nt, Human
aaaaguauuuu

SEQ ID NO: 3551756 - RNA, 12 nt, Human
aaaaguauuuuc

SEQ ID NO: 3551757 - RNA, 14 nt, Human
aaaaguauuuugaa

SEQ ID NO: 3551758 - RNA, 16 nt, Human
aaaaguauuuugaagu

SEQ ID NO: 3551759 - RNA, 16 nt, Human
aaaagucacaauguuc

SEQ ID NO: 3551760 - RNA, 13 nt, Human
aaaagucacaguu

SEQ ID NO: 3551761 - RNA, 23 nt, Human
aaaagucguuuuccaaacugacu

SEQ ID NO: 3551762 - RNA, 13 nt, Human
aaaagucucuauu

SEQ ID NO: 3551763 - RNA, 15 nt, Human
aaaagucucuauuua

SEQ ID NO: 3551764 - RNA, 21 nt, Human
aaaagucucuauuuaaauucu

SEQ ID NO: 3551765 - RNA, 17 nt, Human
aaaagucugcauuacau

SEQ ID NO: 3551766 - RNA, 18 nt, Human
aaaagucugcauuacauu

SEQ ID NO: 3551767 - RNA, 23 nt, Human
aaaagucuucaagggcugcuuca

SEQ ID NO: 3551768 - RNA, 17 nt, Human
aaaagugaaugaaagau

SEQ ID NO: 3551769 - RNA, 17 nt, Human
aaaagugacacagcagc

SEQ ID NO: 3551770 - RNA, 23 nt, Human
aaaagugaucaauaaaaugugau

SEQ ID NO: 3551771 - RNA, 14 nt, Human
aaaagugccucaag

SEQ ID NO: 3551772 - RNA, 15 nt, Human
aaaagugcuucauuc

SEQ ID NO: 3551773 - RNA, 17 nt, Human
aaaaguggccucuuugu

SEQ ID NO: 3551774 - RNA, 21 nt, Human
aaaagugggccagugugggaa

SEQ ID NO: 3551775 - RNA, 17 nt, Human
aaaagugggcuugauuc

SEQ ID NO: 3551776 - RNA, 18 nt, Human
aaaaguggggcagagccu

SEQ ID NO: 3551777 - RNA, 19 nt, Human
aaaaguguguauauauuuu

SEQ ID NO: 3551778 - RNA, 13 nt, Human
aaaaguguuuauu

SEQ ID NO: 3551779 - RNA, 14 nt, Human
aaaaguuaaaaagu

SEQ ID NO: 3551780 - RNA, 15 nt, Human
aaaaguuauuaaaau

SEQ ID NO: 3551781 - RNA, 12 nt, Human
aaaaguugaaau

SEQ ID NO: 3551782 - RNA, 18 nt, Human
aaaaguugaauuuuacau

SEQ ID NO: 3551783 - RNA, 21 nt, Human
aaaaguugcagcuguuuuguu

SEQ ID NO: 3551784 - RNA, 14 nt, Human
aaaaguugcuauuu

SEQ ID NO: 3551785 - RNA, 16 nt, Human
aaaaguuggacuaaau

SEQ ID NO: 3551786 - RNA, 15 nt, Human
aaaaguuguaugauc

SEQ ID NO: 3551787 - RNA, 18 nt, Human
aaaaguuguucaacuauu

SEQ ID NO: 3551788 - RNA, 15 nt, Human
aaaaguuuaaaaugu

SEQ ID NO: 3551789 - RNA, 20 nt, Human
aaaaguuuaaaauguauaag

SEQ ID NO: 3551790 - RNA, 14 nt, Human
aaaaguuuaauauu

SEQ ID NO: 3551791 - RNA, 20 nt, Human
aaaaguuuaauauuaaagcc

SEQ ID NO: 3551792 - RNA, 16 nt, Human
aaaaguuuacaagugu

SEQ ID NO: 3551793 - RNA, 17 nt, Human
aaaaguuugaaaagcaa

SEQ ID NO: 3551794 - RNA, 18 nt, Human
aaaaguuugaaaagcaau

SEQ ID NO: 3551795 - RNA, 12 nt, Human
aaaaguuuguuu

SEQ ID NO: 3551796 - RNA, 18 nt, Human
aaaauaaaaaaaagaaaa

SEQ ID NO: 3551797 - RNA, 21 nt, Human
aaaauaaaaaaaagaaaaaag

SEQ ID NO: 3551798 - RNA, 15 nt, Human
aaaauaaaaaaugug

SEQ ID NO: 3551799 - RNA, 16 nt, Human
aaaauaaaaacuauuc

SEQ ID NO: 3551800 - RNA, 21 nt, Human
aaaauaaaaagugacacagca

SEQ ID NO: 3551801 - RNA, 14 nt, Human
aaaauaaaaaguua

SEQ ID NO: 3551802 - RNA, 15 nt, Human
aaaauaaaaaguuaa

SEQ ID NO: 3551803 - RNA, 19 nt, Human
aaaauaaaaaguuaaaaag

SEQ ID NO: 3551804 - RNA, 18 nt, Human
aaaauaaaaauaaauuca

SEQ ID NO: 3551805 - RNA, 12 nt, Human
aaaauaaaacau

SEQ ID NO: 3551806 - RNA, 16 nt, Human
aaaauaaaacauagca

SEQ ID NO: 3551807 - RNA, 14 nt, Human
aaaauaaaacauuu

SEQ ID NO: 3551808 - RNA, 14 nt, Human
aaaauaaaacuguc

SEQ ID NO: 3551809 - RNA, 16 nt, Human
aaaauaaaacuuuuua

SEQ ID NO: 3551810 - RNA, 15 nt, Human
aaaauaaaauaaaua

SEQ ID NO: 3551811 - RNA, 17 nt, Human
aaaauaaaauacuuuga

SEQ ID NO: 3551812 - RNA, 21 nt, Human
aaaauaaaaugaaaauuguau

SEQ ID NO: 3551813 - RNA, 12 nt, Human
aaaauaaaauua

SEQ ID NO: 3551814 - RNA, 19 nt, Human
aaaauaaaauuaaagcuga

SEQ ID NO: 3551815 - RNA, 12 nt, Human
aaaauaaacaaa

SEQ ID NO: 3551816 - RNA, 14 nt, Human
aaaauaaagaaaua

SEQ ID NO: 3551817 - RNA, 14 nt, Human
aaaauaaagaagua

SEQ ID NO: 3551818 - RNA, 16 nt, Human
aaaauaaagaauggaa

SEQ ID NO: 3551819 - RNA, 12 nt, Human
aaaauaaagaca

SEQ ID NO: 3551820 - RNA, 20 nt, Human
aaaauaaauaaaaacuaauu

SEQ ID NO: 3551821 - RNA, 15 nt, Human
aaaauaaauaaaagc

SEQ ID NO: 3551822 - RNA, 15 nt, Human
aaaauaaauagaaaa

SEQ ID NO: 3551823 - RNA, 21 nt, Human
aaaauaaauauugucuuuuug

SEQ ID NO: 3551824 - RNA, 11 nt, Human
aaaauaaaugg

SEQ ID NO: 3551825 - RNA, 23 nt, Human
aaaauaaaugucaccagguacuu

SEQ ID NO: 3551826 - RNA, 20 nt, Human
aaaauaaauuuauaugaaaa

SEQ ID NO: 3551827 - RNA, 13 nt, Human
aaaauaacaguau

SEQ ID NO: 3551828 - RNA, 16 nt, Human
aaaauaaccccaaaau

SEQ ID NO: 3551829 - RNA, 17 nt, Human
aaaauaaccuaauuaau

SEQ ID NO: 3551830 - RNA, 15 nt, Human
aaaauaacuguaauu

SEQ ID NO: 3551831 - RNA, 15 nt, Human
aaaauaacuuauauc

SEQ ID NO: 3551832 - RNA, 16 nt, Human
aaaauaacuucaagca

SEQ ID NO: 3551833 - RNA, 19 nt, Human
aaaauaagcagguggaucu

SEQ ID NO: 3551834 - RNA, 14 nt, Human
aaaauaagucaaca

SEQ ID NO: 3551835 - RNA, 13 nt, Human
aaaauaagucuga

SEQ ID NO: 3551836 - RNA, 16 nt, Human
aaaauaauaaaaaaag

SEQ ID NO: 3551837 - RNA, 16 nt, Human
aaaauaauacugcuga

SEQ ID NO: 3551838 - RNA, 23 nt, Human
aaaauaauacugcugagauacau

SEQ ID NO: 3551839 - RNA, 12 nt, Human
aaaauaauguaa

SEQ ID NO: 3551840 - RNA, 20 nt, Human
aaaauaaugucuuguuaaua

SEQ ID NO: 3551841 - RNA, 19 nt, Human
aaaauaauuuuaaacaaag

SEQ ID NO: 3551842 - RNA, 20 nt, Human
aaaauaauuuuaaacaaagg

SEQ ID NO: 3551843 - RNA, 18 nt, Human
aaaauacaaaaaucagcc

SEQ ID NO: 3551844 - RNA, 13 nt, Human
aaaauacaaacaa

SEQ ID NO: 3551845 - RNA, 16 nt, Human
aaaauacaaacacaug

SEQ ID NO: 3551846 - RNA, 17 nt, Human
aaaauacaagacugcca

SEQ ID NO: 3551847 - RNA, 15 nt, Human
aaaauacaauuuuua

SEQ ID NO: 3551848 - RNA, 16 nt, Human
aaaauacauagugaaa

SEQ ID NO: 3551849 - RNA, 10 nt, Human
aaaauacaug

SEQ ID NO: 3551850 - RNA, 13 nt, Human
aaaauacaugaag

SEQ ID NO: 3551851 - RNA, 18 nt, Human
aaaauacauuuaaaacuu

SEQ ID NO: 3551852 - RNA, 14 nt, Human
aaaauacauuuuau

SEQ ID NO: 3551853 - RNA, 14 nt, Human
aaaauaccaaggaa

SEQ ID NO: 3551854 - RNA, 16 nt, Human
aaaauacggugggggu

SEQ ID NO: 3551855 - RNA, 18 nt, Human
aaaauacuauuuaagaug

SEQ ID NO: 3551856 - RNA, 23 nt, Human
aaaauacuauuuaagaugugaaa

SEQ ID NO: 3551857 - RNA, 22 nt, Human
aaaauacuauuuuuacugccac

SEQ ID NO: 3551858 - RNA, 13 nt, Human
aaaauacucuaau

SEQ ID NO: 3551859 - RNA, 14 nt, Human
aaaauacucuaauu

SEQ ID NO: 3551860 - RNA, 15 nt, Human
aaaauacucuaauuc

SEQ ID NO: 3551861 - RNA, 22 nt, Human
aaaauacugacuccaaccauuc

SEQ ID NO: 3551862 - RNA, 18 nt, Human
aaaauacugccagaugcu

SEQ ID NO: 3551863 - RNA, 19 nt, Human
aaaauacugccagaugcug

SEQ ID NO: 3551864 - RNA, 20 nt, Human
aaaauacugccagaugcuga

SEQ ID NO: 3551865 - RNA, 11 nt, Human
aaaauacugua

SEQ ID NO: 3551866 - RNA, 9 nt, Human
aaaauacuu

SEQ ID NO: 3551867 - RNA, 20 nt, Human
aaaauacuuaaauguuaugu

SEQ ID NO: 3551868 - RNA, 16 nt, Human
aaaauacuuuuacucu

SEQ ID NO: 3551869 - RNA, 12 nt, Human
aaaauagaaaca

SEQ ID NO: 3551870 - RNA, 13 nt, Human
aaaauagaaaguu

SEQ ID NO: 3551871 - RNA, 17 nt, Human
aaaauagaaauuuugua

SEQ ID NO: 3551872 - RNA, 21 nt, Human
aaaauagcaacacucuauauu

SEQ ID NO: 3551873 - RNA, 22 nt, Human
aaaauagcaacacucuauauuu

SEQ ID NO: 3551874 - RNA, 23 nt, Human
aaaauagcaaccuuuuuaucucc

SEQ ID NO: 3551875 - RNA, 15 nt, Human
aaaauagcaaugccu

SEQ ID NO: 3551876 - RNA, 18 nt, Human
aaaauagcguucuuguaa

SEQ ID NO: 3551877 - RNA, 19 nt, Human
aaaauagcguucuuguaau

SEQ ID NO: 3551878 - RNA, 19 nt, Human
aaaauagcuuguauagugu

SEQ ID NO: 3551879 - RNA, 21 nt, Human
aaaauaggguauauuuuccua

SEQ ID NO: 3551880 - RNA, 18 nt, Human
aaaauagguauacagugg

SEQ ID NO: 3551881 - RNA, 18 nt, Human
aaaauaguaaaugcuuug

SEQ ID NO: 3551882 - RNA, 13 nt, Human
aaaauagugaauu

SEQ ID NO: 3551883 - RNA, 16 nt, Human
aaaauaguuguccaua

SEQ ID NO: 3551884 - RNA, 16 nt, Human
aaaauaguuuggauau

SEQ ID NO: 3551885 - RNA, 17 nt, Human
aaaauauaaaacugcgu

SEQ ID NO: 3551886 - RNA, 13 nt, Human
aaaauauaaaaua

SEQ ID NO: 3551887 - RNA, 22 nt, Human
aaaauauaaaauaguuguccau

SEQ ID NO: 3551888 - RNA, 15 nt, Human
aaaauauaaacaaag

SEQ ID NO: 3551889 - RNA, 16 nt, Human
aaaauauaaguaaagu

SEQ ID NO: 3551890 - RNA, 23 nt, Human
aaacaggcacuuggcagccuugu

SEQ ID NO: 3551891 - RNA, 11 nt, Human
aaacaggcagu

SEQ ID NO: 3551892 - RNA, 17 nt, Human
aaacagggccacauaga

SEQ ID NO: 3551893 - RNA, 22 nt, Human
aaacagggcugccuucuggccu

SEQ ID NO: 3551894 - RNA, 20 nt, Human
aaacaggguaacuaacuaaa

SEQ ID NO: 3551895 - RNA, 21 nt, Human
aaacaggguguugucagcauc

SEQ ID NO: 3551896 - RNA, 23 nt, Human
aaacaggguguugucagcaucuu

SEQ ID NO: 3551897 - RNA, 23 nt, Human
aaacagguauauacuuugaaagg

SEQ ID NO: 3551898 - RNA, 14 nt, Human
aaacaguagugaua

SEQ ID NO: 3551899 - RNA, 14 nt, Human
aaacaguauuuauu

SEQ ID NO: 3551900 - RNA, 15 nt, Human
aaacagucucaggaa

SEQ ID NO: 3551901 - RNA, 20 nt, Human
aaacagucucaggaaaucaa

SEQ ID NO: 3551902 - RNA, 16 nt, Human
aaacagucucccuucc

SEQ ID NO: 3551903 - RNA, 18 nt, Human
aaacagugccugcugaau

SEQ ID NO: 3551904 - RNA, 21 nt, Human
aaacaguugcacagcaucuca

SEQ ID NO: 3551905 - RNA, 20 nt, Human
aaacaguugcauguaguaac

SEQ ID NO: 3551906 - RNA, 13 nt, Human
aaacauaaauaaa

SEQ ID NO: 3551907 - RNA, 17 nt, Human
aaacauaaauaaaauga

SEQ ID NO: 3551908 - RNA, 18 nt, Human
aaacauaaugaaaauauu

SEQ ID NO: 3551909 - RNA, 21 nt, Human
aaacauaauucuuguauauua

SEQ ID NO: 3551910 - RNA, 16 nt, Human
aaacauacgugugcau

SEQ ID NO: 3551911 - RNA, 14 nt, Human
aaacauagaaaugg

SEQ ID NO: 3551912 - RNA, 21 nt, Human
aaacauagaaauggaaauuuu

SEQ ID NO: 3551913 - RNA, 18 nt, Human
aaacauagagggagagag

SEQ ID NO: 3551914 - RNA, 21 nt, Human
aaacauauauaacaaugcugu

SEQ ID NO: 3551915 - RNA, 22 nt, Human
aaacauauuuguuaaauauuua

SEQ ID NO: 3551916 - RNA, 22 nt, Human
aaacaucacacacacagacaga

SEQ ID NO: 3551917 - RNA, 22 nt, Human
aaacaucaguuacucugaaggg

SEQ ID NO: 3551918 - RNA, 19 nt, Human
aaacaucauuccuuuuuau

SEQ ID NO: 3551919 - RNA, 19 nt, Human
aaacauccaauauuuucuu

SEQ ID NO: 3551920 - RNA, 20 nt, Human
aaacauccuucaagaacucu

SEQ ID NO: 3551921 - RNA, 15 nt, Human
aaacaucuauucucu

SEQ ID NO: 3551922 - RNA, 18 nt, Human
aaacaucucaucaugucu

SEQ ID NO: 3551923 - RNA, 21 nt, Human
aaacaucuggaaaauaaaagg

SEQ ID NO: 3551924 - RNA, 17 nt, Human
aaacaucuuugaaauua

SEQ ID NO: 3551925 - RNA, 12 nt, Human
aaacaugaagug

SEQ ID NO: 3551926 - RNA, 21 nt, Human
aaacaugacccuaaaucuuga

SEQ ID NO: 3551927 - RNA, 20 nt, Human
aaacaugacucuuuauuguc

SEQ ID NO: 3551928 - RNA, 16 nt, Human
aaacaugcuguacaua

SEQ ID NO: 3551929 - RNA, 21 nt, Human
aaacaugcuguacauacuuuu

SEQ ID NO: 3551930 - RNA, 23 nt, Human
aaacaugcuguacauacuuuuug

SEQ ID NO: 3551931 - RNA, 21 nt, Human
aaacaugguagaauuggagag

SEQ ID NO: 3551932 - RNA, 16 nt, Human
aaacauguuaaugaca

SEQ ID NO: 3551933 - RNA, 22 nt, Human
aaacauguugccaaaauggugg

SEQ ID NO: 3551934 - RNA, 19 nt, Human
aaacauguuuccacuauug

SEQ ID NO: 3551935 - RNA, 19 nt, Human
aaacauguuucuuuguaau

SEQ ID NO: 3551936 - RNA, 14 nt, Human
aaacauuaaaauau

SEQ ID NO: 3551937 - RNA, 20 nt, Human
aaacauuaaaugucuuauau

SEQ ID NO: 3551938 - RNA, 12 nt, Human
aaacauuaagaa

SEQ ID NO: 3551939 - RNA, 15 nt, Human
aaacauuaauguuga

SEQ ID NO: 3551940 - RNA, 20 nt, Human
aaacauuaauguugauuucu

SEQ ID NO: 3551941 - RNA, 21 nt, Human
aaacauuaguacuuuauagaa

SEQ ID NO: 3551942 - RNA, 12 nt, Human
aaacauucuauc

SEQ ID NO: 3551943 - RNA, 19 nt, Human
aaacauucuaucuacugau

SEQ ID NO: 3551944 - RNA, 16 nt, Human
aaagacaguguaugua

SEQ ID NO: 3551945 - RNA, 18 nt, Human
aaagacauccauaaagaa

SEQ ID NO: 3551946 - RNA, 19 nt, Human
aaagacauccauaaagaag

SEQ ID NO: 3551947 - RNA, 14 nt, Human
aaagacaugaaauu

SEQ ID NO: 3551948 - RNA, 19 nt, Human
aaagacauucaggacugcu

SEQ ID NO: 3551949 - RNA, 13 nt, Human
aaagaccaaacuu

SEQ ID NO: 3551950 - RNA, 14 nt, Human
aaagaccaaacuuc

SEQ ID NO: 3551951 - RNA, 22 nt, Human
aaagaccaaacuucacucuggg

SEQ ID NO: 3551952 - RNA, 13 nt, Human
aaagaccagacua

SEQ ID NO: 3551953 - RNA, 16 nt, Human
aaagacccagggggag

SEQ ID NO: 3551954 - RNA, 22 nt, Human
aaagacccuccuauucuauaaa

SEQ ID NO: 3551955 - RNA, 22 nt, Human
aaagaccuggggcugcugugaa

SEQ ID NO: 3551956 - RNA, 17 nt, Human
aaagaccuuguguguau

SEQ ID NO: 3551957 - RNA, 20 nt, Human
aaagaccuuguguguaugug

SEQ ID NO: 3551958 - RNA, 15 nt, Human
aaagacguuuuauaa

SEQ ID NO: 3551959 - RNA, 13 nt, Human
aaagacuaagauc

SEQ ID NO: 3551960 - RNA, 23 nt, Human
aaagacuaauuuaaaaaauaacu

SEQ ID NO: 3551961 - RNA, 15 nt, Human
aaagacuauucaaac

SEQ ID NO: 3551962 - RNA, 22 nt, Human
aaagacuauucaaacagucuca

SEQ ID NO: 3551963 - RNA, 23 nt, Human
aaagacuauucaaacagucucag

SEQ ID NO: 3551964 - RNA, 15 nt, Human
aaagacucaguguuc

SEQ ID NO: 3551965 - RNA, 15 nt, Human
aaagacucauccguc

SEQ ID NO: 3551966 - RNA, 14 nt, Human
aaagacuccaaaga

SEQ ID NO: 3551967 - RNA, 14 nt, Human
aaagacugaucuca

SEQ ID NO: 3551968 - RNA, 15 nt, Human
aaagacugguuuucu

SEQ ID NO: 3551969 - RNA, 13 nt, Human
aaagacuguacaa

SEQ ID NO: 3551970 - RNA, 18 nt, Human
aaagacuuaguauauuuu

SEQ ID NO: 3551971 - RNA, 18 nt, Human
aaagacuuuaaaagugau

SEQ ID NO: 3551972 - RNA, 12 nt, Human
aaagagaaaaaa

SEQ ID NO: 3551973 - RNA, 17 nt, Human
aaagagaaaaagaaaug

SEQ ID NO: 3551974 - RNA, 12 nt, Human
aaagagaaaaga

SEQ ID NO: 3551975 - RNA, 15 nt, Human
aaagagaaaauugaa

SEQ ID NO: 3551976 - RNA, 12 nt, Human
aaagagaaacac

SEQ ID NO: 3551977 - RNA, 13 nt, Human
aaagagaaacacg

SEQ ID NO: 3551978 - RNA, 11 nt, Human
aaagagaaacu

SEQ ID NO: 3551979 - RNA, 13 nt, Human
aaagagaaacuuu

SEQ ID NO: 3551980 - RNA, 21 nt, Human
aaagagaaacuuugugcuaca

SEQ ID NO: 3551981 - RNA, 23 nt, Human
aaagagaaacuuugugcuacaug

SEQ ID NO: 3551982 - RNA, 18 nt, Human
aaagagaacuuccagauc

SEQ ID NO: 3551983 - RNA, 19 nt, Human
aaagagaauuagauuauau

SEQ ID NO: 3551984 - RNA, 15 nt, Human
aaagagacuggagca

SEQ ID NO: 3551985 - RNA, 16 nt, Human
aaagagagaaaauaaa

SEQ ID NO: 3551986 - RNA, 18 nt, Human
aaagagagaaacacugaa

SEQ ID NO: 3551987 - RNA, 18 nt, Human
aaagagagaauguagaua

SEQ ID NO: 3551988 - RNA, 14 nt, Human
aaagagagauuuuu

SEQ ID NO: 3551989 - RNA, 20 nt, Human
aaagagagcagagaauauaa

SEQ ID NO: 3551990 - RNA, 20 nt, Human
aaagagaguuaaucaacuga

SEQ ID NO: 3551991 - RNA, 21 nt, Human
aaagagauaccaagaugccau

SEQ ID NO: 3551992 - RNA, 13 nt, Human
aaagagauauuuu

SEQ ID NO: 3551993 - RNA, 19 nt, Human
aaagagaugaugaaaauau

SEQ ID NO: 3551994 - RNA, 20 nt, Human
aaagagaugaugaaaauauu

SEQ ID NO: 3551995 - RNA, 18 nt, Human
aaagagauggccugagaa

SEQ ID NO: 3551996 - RNA, 15 nt, Human
aaagagauuuaaacu

SEQ ID NO: 3551997 - RNA, 13 nt, Human
aaagagauuucaa

SEQ ID NO: 3551998 - RNA, 19 nt, Human
aaagagcacaaacauuuuu

SEQ ID NO: 3551999 - RNA, 22 nt, Human
aaagagcacuuaagagaauauu

SEQ ID NO: 3552000 - RNA, 18 nt, Human
aaagagcacuuacuguaa

SEQ ID NO: 3552001 - RNA, 12 nt, Human
aaagaggaaaga

SEQ ID NO: 3552002 - RNA, 15 nt, Human
aaagaggaaugaagu

SEQ ID NO: 3552003 - RNA, 21 nt, Human
aaagaggacucgcuuguaaau

SEQ ID NO: 3552004 - RNA, 19 nt, Human
aaagaggcaccaggaagcc

SEQ ID NO: 3552005 - RNA, 14 nt, Human
aaagaggcugcccc

SEQ ID NO: 3552006 - RNA, 18 nt, Human
aaagaggcugccccucuc

SEQ ID NO: 3552007 - RNA, 19 nt, Human
aaagagguuuuucuuaaau

SEQ ID NO: 3552008 - RNA, 12 nt, Human
aaagaguacucu

SEQ ID NO: 3552009 - RNA, 17 nt, Human
aaagaguacucuuguuu

SEQ ID NO: 3552010 - RNA, 13 nt, Human
aaagaguagaauu

SEQ ID NO: 3552011 - RNA, 18 nt, Human
aaagaguagaauugcauu

SEQ ID NO: 3552012 - RNA, 14 nt, Human
aaagaguaggaaga

SEQ ID NO: 3552013 - RNA, 21 nt, Human
aaagaguccauuguuuaaaaa

SEQ ID NO: 3552014 - RNA, 14 nt, Human
aaagagucuagauu

SEQ ID NO: 3552015 - RNA, 15 nt, Human
aaagagucuagauuc

SEQ ID NO: 3552016 - RNA, 14 nt, Human
aaagagucuuccaa

SEQ ID NO: 3552017 - RNA, 18 nt, Human
aaagaguguaaaauauuu

SEQ ID NO: 3552018 - RNA, 14 nt, Human
aaagaguucaagaa

SEQ ID NO: 3552019 - RNA, 14 nt, Human
aaagauaaauauua

SEQ ID NO: 3552020 - RNA, 21 nt, Human
aaagauaaauuauaucaauuu

SEQ ID NO: 3552021 - RNA, 19 nt, Human
aaagauaaucucagugcuu

SEQ ID NO: 3552022 - RNA, 23 nt, Human
aaagauaaucucagugcuuuccu

SEQ ID NO: 3552023 - RNA, 20 nt, Human
aaagauaauugcuauuuauu

SEQ ID NO: 3552024 - RNA, 15 nt, Human
aaagauacaguuacu

SEQ ID NO: 3552025 - RNA, 19 nt, Human
aaagauacauuuguauguu

SEQ ID NO: 3552026 - RNA, 19 nt, Human
aaagauaccuuaaaauuug

SEQ ID NO: 3552027 - RNA, 21 nt, Human
aaagauaccuuaaaauuugaa

SEQ ID NO: 3552028 - RNA, 15 nt, Human
aaagauagauaucca

SEQ ID NO: 3552029 - RNA, 17 nt, Human
aaagauauaagugcugu

SEQ ID NO: 3552030 - RNA, 19 nt, Human
aaagauauauuaaaaauau

SEQ ID NO: 3552031 - RNA, 21 nt, Human
aaagauauauuaaaaauauaa

SEQ ID NO: 3552032 - RNA, 23 nt, Human
aaagauauauuaaaaauauaaaa

SEQ ID NO: 3552033 - RNA, 19 nt, Human
aaagauauggagaauugcu

SEQ ID NO: 3552034 - RNA, 22 nt, Human
aaagcuaguguaccuccucuca

SEQ ID NO: 3552035 - RNA, 23 nt, Human
aaagcuaguguaccuccucucag

SEQ ID NO: 3552036 - RNA, 20 nt, Human
aaagcuauaaagcaguauuu

SEQ ID NO: 3552037 - RNA, 15 nt, Human
aaagcuauuagccag

SEQ ID NO: 3552038 - RNA, 18 nt, Human
aaagcuauuagccaggau

SEQ ID NO: 3552039 - RNA, 17 nt, Human
aaagcucaaagguuugg

SEQ ID NO: 3552040 - RNA, 23 nt, Human
aaagcucaaagguuuggaaggag

SEQ ID NO: 3552041 - RNA, 21 nt, Human
aaagcucauauuuuguauaua

SEQ ID NO: 3552042 - RNA, 20 nt, Human
aaagcuccuggggcguccag

SEQ ID NO: 3552043 - RNA, 14 nt, Human
aaagcucuagaauc

SEQ ID NO: 3552044 - RNA, 12 nt, Human
aaagcugaaaac

SEQ ID NO: 3552045 - RNA, 15 nt, Human
aaagcugaaaacugc

SEQ ID NO: 3552046 - RNA, 13 nt, Human
aaagcugagccug

SEQ ID NO: 3552047 - RNA, 14 nt, Human
aaagcugauuuuuu

SEQ ID NO: 3552048 - RNA, 22 nt, Human
aaagcugcccacuguuucucuu

SEQ ID NO: 3552049 - RNA, 23 nt, Human
aaagcugccuguaguuaggaaau

SEQ ID NO: 3552050 - RNA, 16 nt, Human
aaagcugcuaaaucuc

SEQ ID NO: 3552051 - RNA, 17 nt, Human
aaagcugcuaaaucucc

SEQ ID NO: 3552052 - RNA, 23 nt, Human
aaagcugcugagaaucuagccuc

SEQ ID NO: 3552053 - RNA, 19 nt, Human
aaagcuggugggugaaaga

SEQ ID NO: 3552054 - RNA, 16 nt, Human
aaagcuguugauggua

SEQ ID NO: 3552055 - RNA, 16 nt, Human
aaagcuuaaaacuuug

SEQ ID NO: 3552056 - RNA, 15 nt, Human
aaagcuuagcaggag

SEQ ID NO: 3552057 - RNA, 13 nt, Human
aaagcuuauuaaa

SEQ ID NO: 3552058 - RNA, 20 nt, Human
aaagcuucagugcugccgau

SEQ ID NO: 3552059 - RNA, 19 nt, Human
aaagcuucuaucccaggag

SEQ ID NO: 3552060 - RNA, 21 nt, Human
aaagcuucuaucccaggaggu

SEQ ID NO: 3552061 - RNA, 13 nt, Human
aaagcuucugugg

SEQ ID NO: 3552062 - RNA, 17 nt, Human
aaagcuucuuaauuaau

SEQ ID NO: 3552063 - RNA, 19 nt, Human
aaagcuugcaacaaaauuc

SEQ ID NO: 3552064 - RNA, 18 nt, Human
aaagcuugguucugugaa

SEQ ID NO: 3552065 - RNA, 15 nt, Human
aaagcuuguuaagau

SEQ ID NO: 3552066 - RNA, 19 nt, Human
aaagcuuuaugauuuucau

SEQ ID NO: 3552067 - RNA, 15 nt, Human
aaagcuuuccuggag

SEQ ID NO: 3552068 - RNA, 21 nt, Human
aaagcuuugcuuaugguaaua

SEQ ID NO: 3552069 - RNA, 15 nt, Human
aaagcuuuuagaaau

SEQ ID NO: 3552070 - RNA, 19 nt, Human
aaagcuuuuuauuccuccu

SEQ ID NO: 3552071 - RNA, 16 nt, Human
aaagcuuuuuccuccu

SEQ ID NO: 3552072 - RNA, 16 nt, Human
aaaggaaaaagcacaa

SEQ ID NO: 3552073 - RNA, 19 nt, Human
aaaggaaaaagcacaagaa

SEQ ID NO: 3552074 - RNA, 15 nt, Human
aaaggaaaaagcucc

SEQ ID NO: 3552075 - RNA, 17 nt, Human
aaaggaaaaagcuccau

SEQ ID NO: 3552076 - RNA, 15 nt, Human
aaaggaaaagaaaaa

SEQ ID NO: 3552077 - RNA, 16 nt, Human
aaaggaaaagaaaaaa

SEQ ID NO: 3552078 - RNA, 16 nt, Human
aaaggaaaaugucugu

SEQ ID NO: 3552079 - RNA, 16 nt, Human
aaaggaaagaaaacau

SEQ ID NO: 3552080 - RNA, 17 nt, Human
aaaggaaagugcuuucc

SEQ ID NO: 3552081 - RNA, 17 nt, Human
aaaggaaaucaaaugaa

SEQ ID NO: 3552082 - RNA, 23 nt, Human
aaaggaaaucucaccccauccca

SEQ ID NO: 3552083 - RNA, 12 nt, Human
aaaggaacauuu

SEQ ID NO: 3552084 - RNA, 16 nt, Human
aaaggaacauuuaggg

SEQ ID NO: 3552085 - RNA, 16 nt, Human
aaaggaagacaguucu

SEQ ID NO: 3552086 - RNA, 12 nt, Human
aaaggaagacua

SEQ ID NO: 3552087 - RNA, 17 nt, Human
aaaggaagcauuguaaa

SEQ ID NO: 3552088 - RNA, 22 nt, Human
aaaggaagcuuucucugcuuca

SEQ ID NO: 3552089 - RNA, 23 nt, Human
aaaggaagguucuggugugaacu

SEQ ID NO: 3552090 - RNA, 17 nt, Human
aaaggaagugcccccuc

SEQ ID NO: 3552091 - RNA, 17 nt, Human
aaaggaaucauuucuau

SEQ ID NO: 3552092 - RNA, 13 nt, Human
aaaggaauuuaaa

SEQ ID NO: 3552093 - RNA, 16 nt, Human
aaaggacaauuucaaa

SEQ ID NO: 3552094 - RNA, 22 nt, Human
aaaggacaccuuuuaacucacc

SEQ ID NO: 3552095 - RNA, 18 nt, Human
aaaggacaggcagaaaga

SEQ ID NO: 3552096 - RNA, 15 nt, Human
aaaggacgcacugag

SEQ ID NO: 3552097 - RNA, 15 nt, Human
aaaggagaaugaauc

SEQ ID NO: 3552098 - RNA, 13 nt, Human
aaaggagagcauc

SEQ ID NO: 3552099 - RNA, 14 nt, Human
aaaggagaguacuu

SEQ ID NO: 3552100 - RNA, 19 nt, Human
aaaggagcccuuaucugug

SEQ ID NO: 3552101 - RNA, 11 nt, Human
aaaggagccug

SEQ ID NO: 3552102 - RNA, 16 nt, Human
aaaggaggcaugccuc

SEQ ID NO: 3552103 - RNA, 18 nt, Human
aaaggaggcaugccucug

SEQ ID NO: 3552104 - RNA, 20 nt, Human
aaaggauaaacuuuuagaaa

SEQ ID NO: 3552105 - RNA, 23 nt, Human
aaacauucuuuuaacuucuuucu

SEQ ID NO: 3552106 - RNA, 16 nt, Human
aaacauugaaguaaug

SEQ ID NO: 3552107 - RNA, 20 nt, Human
aaacauugaaguaaugaauu

SEQ ID NO: 3552108 - RNA, 19 nt, Human
aaacauugacgauuccuuc

SEQ ID NO: 3552109 - RNA, 18 nt, Human
aaacauugccuuugaaug

SEQ ID NO: 3552110 - RNA, 19 nt, Human
aaacauugccuuugaaugu

SEQ ID NO: 3552111 - RNA, 19 nt, Human
aaacauuggaagcagguua

SEQ ID NO: 3552112 - RNA, 22 nt, Human
aaacauuggaagcagguuaaau

SEQ ID NO: 3552113 - RNA, 21 nt, Human
aaacauugguucuuguauuaa

SEQ ID NO: 3552114 - RNA, 21 nt, Human
aaacauuuaccaaucauauua

SEQ ID NO: 3552115 - RNA, 17 nt, Human
aaacauuuauuuugaca

SEQ ID NO: 3552116 - RNA, 21 nt, Human
aaacauuuauuuugacauaaa

SEQ ID NO: 3552117 - RNA, 14 nt, Human
aaacauuucauaau

SEQ ID NO: 3552118 - RNA, 21 nt, Human
aaacauuucauaauuuguuuc

SEQ ID NO: 3552119 - RNA, 15 nt, Human
aaacauuucauuucc

SEQ ID NO: 3552120 - RNA, 15 nt, Human
aaacauuuuaaaugg

SEQ ID NO: 3552121 - RNA, 22 nt, Human
aaacauuuucacacaauacaau

SEQ ID NO: 3552122 - RNA, 20 nt, Human
aaacauuuucucuuagaaaa

SEQ ID NO: 3552123 - RNA, 16 nt, Human
aaacauuuucuggcca

SEQ ID NO: 3552124 - RNA, 20 nt, Human
aaaccaaaaguuauuaaaau

SEQ ID NO: 3552125 - RNA, 22 nt, Human
aaaccaaaaguuauuaaaauug

SEQ ID NO: 3552126 - RNA, 19 nt, Human
aaaccaaaaugacaucuuu

SEQ ID NO: 3552127 - RNA, 15 nt, Human
aaaccaaagaagaaa

SEQ ID NO: 3552128 - RNA, 17 nt, Human
aaaccaaagagggcuuc

SEQ ID NO: 3552129 - RNA, 23 nt, Human
aaaccaaauucagggacaaaugg

SEQ ID NO: 3552130 - RNA, 17 nt, Human
aaaccaagagauugcua

SEQ ID NO: 3552131 - RNA, 19 nt, Human
aaaccaagagauugcuaau

SEQ ID NO: 3552132 - RNA, 21 nt, Human
aaaccaagucggaacagcaga

SEQ ID NO: 3552133 - RNA, 16 nt, Human
aaaccaauugcugcua

SEQ ID NO: 3552134 - RNA, 22 nt, Human
aaaccaauuuuuuguucuucag

SEQ ID NO: 3552135 - RNA, 15 nt, Human
aaaccacaaaaaaau

SEQ ID NO: 3552136 - RNA, 15 nt, Human
aaaccacaaaggcca

SEQ ID NO: 3552137 - RNA, 17 nt, Human
aaaccacagcccuguca

SEQ ID NO: 3552138 - RNA, 17 nt, Human
aaaccaccaaaaacaaa

SEQ ID NO: 3552139 - RNA, 15 nt, Human
aaaccacuagaaagu

SEQ ID NO: 3552140 - RNA, 12 nt, Human
aaaccacugaaa

SEQ ID NO: 3552141 - RNA, 18 nt, Human
aaaccacugaaaaaauau

SEQ ID NO: 3552142 - RNA, 16 nt, Human
aaaccagacaaggaaa

SEQ ID NO: 3552143 - RNA, 20 nt, Human
aaaccagcuuccuucagaga

SEQ ID NO: 3552144 - RNA, 21 nt, Human
aaaccaggcuuucuagaaaga

SEQ ID NO: 3552145 - RNA, 17 nt, Human
aaaccaguauuguacaa

SEQ ID NO: 3552146 - RNA, 22 nt, Human
aaaccaguauuguacaaaguau

SEQ ID NO: 3552147 - RNA, 23 nt, Human
aaaccauccagugacaaaccauc

SEQ ID NO: 3552148 - RNA, 22 nt, Human
aaaccaucucccuggugcuuau

SEQ ID NO: 3552149 - RNA, 14 nt, Human
aaaccaucuggccu

SEQ ID NO: 3552150 - RNA, 15 nt, Human
aaaccaucuggccug

SEQ ID NO: 3552151 - RNA, 13 nt, Human
aaaccauguagaa

SEQ ID NO: 3552152 - RNA, 22 nt, Human
aaaccauguagcagugagucau

SEQ ID NO: 3552153 - RNA, 20 nt, Human
aaaccauuaugaagaagaga

SEQ ID NO: 3552154 - RNA, 12 nt, Human
aaaccauugcuu

SEQ ID NO: 3552155 - RNA, 17 nt, Human
aaaccauugcuucacua

SEQ ID NO: 3552156 - RNA, 23 nt, Human
aaaccauuuuuguuacucucuuc

SEQ ID NO: 3552157 - RNA, 13 nt, Human
aaacccacaaaaa

SEQ ID NO: 3552158 - RNA, 17 nt, Human
aaacccacccuuucuac

SEQ ID NO: 3552159 - RNA, 18 nt, Human
aaacccaccugcuagugu

SEQ ID NO: 3552160 - RNA, 15 nt, Human
aaacccagacugaac

SEQ ID NO: 3552161 - RNA, 11 nt, Human
aaacccagaga

SEQ ID NO: 3552162 - RNA, 16 nt, Human
aaacccagcucugguc

SEQ ID NO: 3552163 - RNA, 22 nt, Human
aaacccauauuguaaaacaggu

SEQ ID NO: 3552164 - RNA, 20 nt, Human
aaaccccaccccaaaauuag

SEQ ID NO: 3552165 - RNA, 23 nt, Human
aaaccccauuugcuuucuuuucu

SEQ ID NO: 3552166 - RNA, 22 nt, Human
aaacccccacacacacacacau

SEQ ID NO: 3552167 - RNA, 15 nt, Human
aaaccccggggcucc

SEQ ID NO: 3552168 - RNA, 18 nt, Human
aaaccccuucucugugac

SEQ ID NO: 3552169 - RNA, 23 nt, Human
aaacccgaggguugauuaaggca

SEQ ID NO: 3552170 - RNA, 21 nt, Human
aaacccgucucuacuaaaaau

SEQ ID NO: 3552171 - RNA, 11 nt, Human
aaacccuaggu

SEQ ID NO: 3552172 - RNA, 18 nt, Human
aaacccucauuguguuuc

SEQ ID NO: 3552173 - RNA, 13 nt, Human
aaacccucgaggc

SEQ ID NO: 3552174 - RNA, 22 nt, Human
aaaccgaacugauguaaguaaa

SEQ ID NO: 3552175 - RNA, 15 nt, Human
aaaccgccaaggcug

SEQ ID NO: 3552176 - RNA, 23 nt, Human
aaaccgccagcgaacuugacaau

SEQ ID NO: 3552177 - RNA, 15 nt, Human
aaaccgccagcucug

SEQ ID NO: 3552178 - RNA, 22 nt, Human
aaaggaaugcaaagaugaaggu

SEQ ID NO: 3552179 - RNA, 23 nt, Human
aaaggaauuggcauguguauguu

SEQ ID NO: 3552180 - RNA, 18 nt, Human
aaaggacauuaugugugc

SEQ ID NO: 3552181 - RNA, 21 nt, Human
aaaggacuccugaaaaaaaac

SEQ ID NO: 3552182 - RNA, 22 nt, Human
aaaggacuguuuuuuccugagc

SEQ ID NO: 3552183 - RNA, 20 nt, Human
aaaggagacaaguuccaugg

SEQ ID NO: 3552184 - RNA, 19 nt, Human
aaaggagagaagagagaaa

SEQ ID NO: 3552185 - RNA, 22 nt, Human
aaaggagagacucccaugaagc

SEQ ID NO: 3552186 - RNA, 23 nt, Human
aaaggagagacucccaugaagcc

SEQ ID NO: 3552187 - RNA, 21 nt, Human
aaaggagagucuugcagugau

SEQ ID NO: 3552188 - RNA, 17 nt, Human
aaaggagauuggaagga

SEQ ID NO: 3552189 - RNA, 16 nt, Human
aaaggagcaagaacuu

SEQ ID NO: 3552190 - RNA, 20 nt, Human
aaaggagccuaggccaggug

SEQ ID NO: 3552191 - RNA, 22 nt, Human
aaaggagcucgaaggauauugu

SEQ ID NO: 3552192 - RNA, 21 nt, Human
aaaggagcuuaccucccaccu

SEQ ID NO: 3552193 - RNA, 13 nt, Human
aaaggaggcuggc

SEQ ID NO: 3552194 - RNA, 24 nt, Human
aaaggaguuucuuuagcugacaga

SEQ ID NO: 3552195 - RNA, 13 nt, Human
aaaggauaaagaa

SEQ ID NO: 3552196 - RNA, 23 nt, Human
aaaggauauuuaagaaaauacaa

SEQ ID NO: 3552197 - RNA, 18 nt, Human
aaaggaucuuuguggcca

SEQ ID NO: 3552198 - RNA, 19 nt, Human
aaaggauguaaacagugcc

SEQ ID NO: 3552199 - RNA, 20 nt, Human
aaaggauguaaacagugccu

SEQ ID NO: 3552200 - RNA, 18 nt, Human
aaaggauucauguggaau

SEQ ID NO: 3552201 - RNA, 16 nt, Human
aaaggcaaauguguac

SEQ ID NO: 3552202 - RNA, 17 nt, Human
aaaggcaaauguguaca

SEQ ID NO: 3552203 - RNA, 23 nt, Human
aaaggcaaguuaagagaaacuuu

SEQ ID NO: 3552204 - RNA, 12 nt, Human
aaaggcacagug

SEQ ID NO: 3552205 - RNA, 21 nt, Human
aaaggcacccccgucaagagu

SEQ ID NO: 3552206 - RNA, 20 nt, Human
aaaggcaccuauaaaacagg

SEQ ID NO: 3552207 - RNA, 21 nt, Human
aaaggcaccuauaaaacaggu

SEQ ID NO: 3552208 - RNA, 18 nt, Human
aaaggcaguauuuugugu

SEQ ID NO: 3552209 - RNA, 19 nt, Human
aaaggcaguauuuuguguc

SEQ ID NO: 3552210 - RNA, 17 nt, Human
aaaggcaguggggcugg

SEQ ID NO: 3552211 - RNA, 23 nt, Human
aaaggcaguuaccauuaaaccau

SEQ ID NO: 3552212 - RNA, 14 nt, Human
aaaggccaaaccuc

SEQ ID NO: 3552213 - RNA, 17 nt, Human
aaaggccaaaccucugu

SEQ ID NO: 3552214 - RNA, 18 nt, Human
aaaggccaaaccucuguu

SEQ ID NO: 3552215 - RNA, 17 nt, Human
aaaggccagaccugcag

SEQ ID NO: 3552216 - RNA, 12 nt, Human
aaaggccagcug

SEQ ID NO: 3552217 - RNA, 18 nt, Human
aaaggccagcuggcagca

SEQ ID NO: 3552218 - RNA, 12 nt, Human
aaaggcccccua

SEQ ID NO: 3552219 - RNA, 21 nt, Human
aaaggccuaauucuaugccug

SEQ ID NO: 3552220 - RNA, 14 nt, Human
aaaggccucugucc

SEQ ID NO: 3552221 - RNA, 15 nt, Human
aaaggccugcacaca

SEQ ID NO: 3552222 - RNA, 17 nt, Human
aaaggccuuuaaaauuu

SEQ ID NO: 3552223 - RNA, 21 nt, Human
aaaggcucagucucaggagca

SEQ ID NO: 3552224 - RNA, 19 nt, Human
aaaggcuccaggagcagcc

SEQ ID NO: 3552225 - RNA, 16 nt, Human
aaaggcucgauuuugu

SEQ ID NO: 3552226 - RNA, 23 nt, Human
aaaggcucgauuuuguaucugca

SEQ ID NO: 3552227 - RNA, 20 nt, Human
aaaggcucugaaagccagcu

SEQ ID NO: 3552228 - RNA, 18 nt, Human
aaaggcuguauucagcaa

SEQ ID NO: 3552229 - RNA, 18 nt, Human
aaaggcugugcugcccug

SEQ ID NO: 3552230 - RNA, 23 nt, Human
aaaggcugugcugcccugaagaa

SEQ ID NO: 3552231 - RNA, 18 nt, Human
aaaggcuguuaaauacag

SEQ ID NO: 3552232 - RNA, 17 nt, Human
aaaggcuucucucucac

SEQ ID NO: 3552233 - RNA, 12 nt, Human
aaagggacauga

SEQ ID NO: 3552234 - RNA, 23 nt, Human
aaagggagcacuggguugacuuu

SEQ ID NO: 3552235 - RNA, 20 nt, Human
aaagggagcagaacugaacc

SEQ ID NO: 3552236 - RNA, 18 nt, Human
aaagggagggcucugagg

SEQ ID NO: 3552237 - RNA, 19 nt, Human
aaagggauuacccaagcaa

SEQ ID NO: 3552238 - RNA, 20 nt, Human
aaagggcagggcaucuccug

SEQ ID NO: 3552239 - RNA, 19 nt, Human
aaagggcccaaugaauuau

SEQ ID NO: 3552240 - RNA, 20 nt, Human
aaagggcuguuauaaucuuu

SEQ ID NO: 3552241 - RNA, 15 nt, Human
aaaggggacaggccu

SEQ ID NO: 3552242 - RNA, 11 nt, Human
aaaggggagac

SEQ ID NO: 3552243 - RNA, 14 nt, Human
aaaggggagagccu

SEQ ID NO: 3552244 - RNA, 19 nt, Human
aaaggggagagccugcugg

SEQ ID NO: 3552245 - RNA, 14 nt, Human
aaagggggauuccc

SEQ ID NO: 3552246 - RNA, 16 nt, Human
aaagggggucccagug

SEQ ID NO: 3552247 - RNA, 23 nt, Human
aaagggggucccagugggagggg

SEQ ID NO: 3552248 - RNA, 17 nt, Human
aaagggucuugggaaau

SEQ ID NO: 3552249 - RNA, 10 nt, Human
aaagggugaa

SEQ ID NO: 3552250 - RNA, 14 nt, Human
aaagggugaagcua

SEQ ID NO: 3552251 - RNA, 16 nt, Human
aaaggguuuuaaugua

SEQ ID NO: 3552252 - RNA, 15 nt, Human
aaagguaaaacaaaa

SEQ ID NO: 3552253 - RNA, 14 nt, Human
aaagguaaaucaga

SEQ ID NO: 3552254 - RNA, 14 nt, Human
aaagguacuucaaa

SEQ ID NO: 3552255 - RNA, 20 nt, Human
aaagguauuauacaugugau

SEQ ID NO: 3552256 - RNA, 16 nt, Human
aaaggucaccucacuc

SEQ ID NO: 3552257 - RNA, 20 nt, Human
aaaggucaccucacucagca

SEQ ID NO: 3552258 - RNA, 19 nt, Human
aaagguccacaggucuaga

SEQ ID NO: 3552259 - RNA, 23 nt, Human
aaaggucuuggugccucugcagu

SEQ ID NO: 3552260 - RNA, 23 nt, Human
aaaggugacaucggaaaaauaau

SEQ ID NO: 3552261 - RNA, 23 nt, Human
aaagugaagcaaaucagaaacuu

SEQ ID NO: 3552262 - RNA, 18 nt, Human
aaagugaauaaacuucag

SEQ ID NO: 3552263 - RNA, 20 nt, Human
aaagugaauaaacuucagca

SEQ ID NO: 3552264 - RNA, 21 nt, Human
aaagugaauaaacuucagcac

SEQ ID NO: 3552265 - RNA, 16 nt, Human
aaagugaaugaaagau

SEQ ID NO: 3552266 - RNA, 18 nt, Human
aaagugaauuguugacaa

SEQ ID NO: 3552267 - RNA, 17 nt, Human
aaagugaauuugaauga

SEQ ID NO: 3552268 - RNA, 19 nt, Human
aaagugaauuugaaugaaa

SEQ ID NO: 3552269 - RNA, 14 nt, Human
aaagugacacagca

SEQ ID NO: 3552270 - RNA, 14 nt, Human
aaagugacccuguu

SEQ ID NO: 3552271 - RNA, 19 nt, Human
aaagugacuaauggcauga

SEQ ID NO: 3552272 - RNA, 19 nt, Human
aaagugagcaugcuuucug

SEQ ID NO: 3552273 - RNA, 15 nt, Human
aaagugauaauuucu

SEQ ID NO: 3552274 - RNA, 10 nt, Human
aaagugauua

SEQ ID NO: 3552275 - RNA, 21 nt, Human
aaagugccaaagaaagugguc

SEQ ID NO: 3552276 - RNA, 15 nt, Human
aaagugccacucauu

SEQ ID NO: 3552277 - RNA, 22 nt, Human
aaagugccucaagaggaaugaa

SEQ ID NO: 3552278 - RNA, 17 nt, Human
aaagugccuuucaggau

SEQ ID NO: 3552279 - RNA, 22 nt, Human
aaagugccuuucaggaucuauu

SEQ ID NO: 3552280 - RNA, 14 nt, Human
aaagugcugcggag

SEQ ID NO: 3552281 - RNA, 14 nt, Human
aaagugcugggauu

SEQ ID NO: 3552282 - RNA, 22 nt, Human
aaagugcuucauucuuugcagg

SEQ ID NO: 3552283 - RNA, 13 nt, Human
aaaguggaaaaau

SEQ ID NO: 3552284 - RNA, 19 nt, Human
aaaguggaaaacaaggaag

SEQ ID NO: 3552285 - RNA, 13 nt, Human
aaaguggaacgaa

SEQ ID NO: 3552286 - RNA, 22 nt, Human
aaaguggaauuucuuguuucuc

SEQ ID NO: 3552287 - RNA, 17 nt, Human
aaaguggagaagcacac

SEQ ID NO: 3552288 - RNA, 18 nt, Human
aaaguggcaccugucugc

SEQ ID NO: 3552289 - RNA, 20 nt, Human
aaaguggcaccugucugcuc

SEQ ID NO: 3552290 - RNA, 16 nt, Human
aaaguggccucuuugu

SEQ ID NO: 3552291 - RNA, 22 nt, Human
aaaguggcgugggagccagccu

SEQ ID NO: 3552292 - RNA, 21 nt, Human
aaagugggcccucauacacaa

SEQ ID NO: 3552293 - RNA, 17 nt, Human
aaagugggcuuaaugga

SEQ ID NO: 3552294 - RNA, 17 nt, Human
aaagugguauagaaaug

SEQ ID NO: 3552295 - RNA, 11 nt, Human
aaaguguaaag

SEQ ID NO: 3552296 - RNA, 12 nt, Human
aaaguguaaagc

SEQ ID NO: 3552297 - RNA, 20 nt, Human
aaaguguaaauccuuuuucu

SEQ ID NO: 3552298 - RNA, 15 nt, Human
aaaguguaauaauau

SEQ ID NO: 3552299 - RNA, 10 nt, Human
aaaguguauu

SEQ ID NO: 3552300 - RNA, 11 nt, Human
aaaguguauua

SEQ ID NO: 3552301 - RNA, 18 nt, Human
aaaguguauuauaacagu

SEQ ID NO: 3552302 - RNA, 15 nt, Human
aaaguguauuuguua

SEQ ID NO: 3552303 - RNA, 20 nt, Human
aaaguguauuuuauaaaauu

SEQ ID NO: 3552304 - RNA, 14 nt, Human
aaaguguauuuuuu

SEQ ID NO: 3552305 - RNA, 22 nt, Human
aaaguguauuuuuuuacuaaua

SEQ ID NO: 3552306 - RNA, 18 nt, Human
aaagugucaacucuuugu

SEQ ID NO: 3552307 - RNA, 21 nt, Human
aaagugucaccuuuucuugcc

SEQ ID NO: 3552308 - RNA, 23 nt, Human
aaagugucagaaggagcuacaaa

SEQ ID NO: 3552309 - RNA, 19 nt, Human
aaaguguccauugacaugu

SEQ ID NO: 3552310 - RNA, 22 nt, Human
aaaguguccauugacauguaca

SEQ ID NO: 3552311 - RNA, 18 nt, Human
aaagugugagcaaacuaa

SEQ ID NO: 3552312 - RNA, 19 nt, Human
aaagugugcuuuaugcuga

SEQ ID NO: 3552313 - RNA, 18 nt, Human
aaaguguguauauauuuu

SEQ ID NO: 3552314 - RNA, 21 nt, Human
aaaguguguauauauuuugug

SEQ ID NO: 3552315 - RNA, 23 nt, Human
aaaguguguauauauuuugugug

SEQ ID NO: 3552316 - RNA, 13 nt, Human
aaaguguguauua

SEQ ID NO: 3552317 - RNA, 20 nt, Human
aaaguguguuguugcuuuag

SEQ ID NO: 3552318 - RNA, 13 nt, Human
aaaguguuacuuu

SEQ ID NO: 3552319 - RNA, 17 nt, Human
aaaguguuuauuuuuca

SEQ ID NO: 3552320 - RNA, 13 nt, Human
aaaguguuugccu

SEQ ID NO: 3552321 - RNA, 16 nt, Human
aaagccuccuccagcc

SEQ ID NO: 3552322 - RNA, 21 nt, Human
aaagccucugugucacuggcu

SEQ ID NO: 3552323 - RNA, 16 nt, Human
aaagccucuguuuuga

SEQ ID NO: 3552324 - RNA, 13 nt, Human
aaagccugcaauu

SEQ ID NO: 3552325 - RNA, 18 nt, Human
aaagccugcaauuucaua

SEQ ID NO: 3552326 - RNA, 16 nt, Human
aaagccuguuguuuaa

SEQ ID NO: 3552327 - RNA, 21 nt, Human
aaagccuguuguuuaagugac

SEQ ID NO: 3552328 - RNA, 11 nt, Human
aaagccuucuu

SEQ ID NO: 3552329 - RNA, 14 nt, Human
aaagccuuguguau

SEQ ID NO: 3552330 - RNA, 18 nt, Human
aaagccuuguguauauuu

SEQ ID NO: 3552331 - RNA, 22 nt, Human
aaagccuuguguauauuuguau

SEQ ID NO: 3552332 - RNA, 23 nt, Human
aaagccuuguguauauuuguaua

SEQ ID NO: 3552333 - RNA, 13 nt, Human
aaagccuuucauu

SEQ ID NO: 3552334 - RNA, 18 nt, Human
aaagccuuucauuuugcu

SEQ ID NO: 3552335 - RNA, 22 nt, Human
aaagccuuucauuuugcuuuaa

SEQ ID NO: 3552336 - RNA, 17 nt, Human
aaagcgauauacagaug

SEQ ID NO: 3552337 - RNA, 16 nt, Human
aaagcggggggagggu

SEQ ID NO: 3552338 - RNA, 18 nt, Human
aaagcggggggaggguug

SEQ ID NO: 3552339 - RNA, 14 nt, Human
aaagcuaaaauaaa

SEQ ID NO: 3552340 - RNA, 14 nt, Human
aaagcuaaguauag

SEQ ID NO: 3552341 - RNA, 17 nt, Human
aaagcuacuuauuguag

SEQ ID NO: 3552342 - RNA, 20 nt, Human
aaagcuagaauugaguguuu

SEQ ID NO: 3552343 - RNA, 18 nt, Human
aaagcuaggccuggccag

SEQ ID NO: 3552344 - RNA, 20 nt, Human
aaagcuaguguaccuccucu

SEQ ID NO: 3552345 - RNA, 22 nt, Human
aaagcuauggugagaugcagcu

SEQ ID NO: 3552346 - RNA, 17 nt, Human
aaagcuauuagccagga

SEQ ID NO: 3552347 - RNA, 19 nt, Human
aaagcuauuagccaggauc

SEQ ID NO: 3552348 - RNA, 23 nt, Human
aaagcuauuagccaggaucaugg

SEQ ID NO: 3552349 - RNA, 18 nt, Human
aaagcuauuuaugggccc

SEQ ID NO: 3552350 - RNA, 19 nt, Human
aaagcucauuucaugcucu

SEQ ID NO: 3552351 - RNA, 22 nt, Human
aaagcucuguugcaauuaggau

SEQ ID NO: 3552352 - RNA, 15 nt, Human
aaagcugacauugcc

SEQ ID NO: 3552353 - RNA, 17 nt, Human
aaagcugacgaggcugg

SEQ ID NO: 3552354 - RNA, 15 nt, Human
aaagcugagccugca

SEQ ID NO: 3552355 - RNA, 19 nt, Human
aaagcugauuacugucaau

SEQ ID NO: 3552356 - RNA, 17 nt, Human
aaagcugccuguaguua

SEQ ID NO: 3552357 - RNA, 13 nt, Human
aaagcugcugaca

SEQ ID NO: 3552358 - RNA, 23 nt, Human
aaagcuggugggugaaagaaauc

SEQ ID NO: 3552359 - RNA, 15 nt, Human
aaagcuguauuuuga

SEQ ID NO: 3552360 - RNA, 23 nt, Human
aaagcuguggccagcuuguuauu

SEQ ID NO: 3552361 - RNA, 14 nt, Human
aaagcuguguggca

SEQ ID NO: 3552362 - RNA, 14 nt, Human
aaagcuguuaaacu

SEQ ID NO: 3552363 - RNA, 16 nt, Human
aaagcuguuaaacugu

SEQ ID NO: 3552364 - RNA, 23 nt, Human
aaagcuguuaaacuguuagcacu

SEQ ID NO: 3552365 - RNA, 14 nt, Human
aaagcuuaaaacuu

SEQ ID NO: 3552366 - RNA, 20 nt, Human
aaagcuuauccauaaaaaaa

SEQ ID NO: 3552367 - RNA, 23 nt, Human
aaagcuuauccauaaaaaaaaau

SEQ ID NO: 3552368 - RNA, 17 nt, Human
aaagcuucagugcugcc

SEQ ID NO: 3552369 - RNA, 17 nt, Human
aaagcuuccaugauucu

SEQ ID NO: 3552370 - RNA, 20 nt, Human
aaagcuuccaugauucuauu

SEQ ID NO: 3552371 - RNA, 13 nt, Human
aaagcuucccucc

SEQ ID NO: 3552372 - RNA, 16 nt, Human
aaagcuucccucccug

SEQ ID NO: 3552373 - RNA, 20 nt, Human
aaagcuucccucccugcugu

SEQ ID NO: 3552374 - RNA, 12 nt, Human
aaagcuucugug

SEQ ID NO: 3552375 - RNA, 23 nt, Human
aaagcuucuuaauuaauuugauu

SEQ ID NO: 3552376 - RNA, 20 nt, Human
aaagcuugaagaucguuagu

SEQ ID NO: 3552377 - RNA, 17 nt, Human
aaagcuugaguaaaaua

SEQ ID NO: 3552378 - RNA, 19 nt, Human
aaagcuuggauuaaauaca

SEQ ID NO: 3552379 - RNA, 21 nt, Human
aaagcuuggauuaaauacaua

SEQ ID NO: 3552380 - RNA, 13 nt, Human
aaagcuuuaugau

SEQ ID NO: 3552381 - RNA, 21 nt, Human
aaagcuuuaugauuuucauaa

SEQ ID NO: 3552382 - RNA, 13 nt, Human
aaagcuuucagaa

SEQ ID NO: 3552383 - RNA, 12 nt, Human
aaagcuuuccug

SEQ ID NO: 3552384 - RNA, 13 nt, Human
aaagcuuuccugc

SEQ ID NO: 3552385 - RNA, 23 nt, Human
aaagcuuuccugccccaggccug

SEQ ID NO: 3552386 - RNA, 23 nt, Human
aaagcuuuuaugagcucauguag

SEQ ID NO: 3552387 - RNA, 16 nt, Human
aaagcuuuugucuaca

SEQ ID NO: 3552388 - RNA, 13 nt, Human
aaagcuuuuugaa

SEQ ID NO: 3552389 - RNA, 14 nt, Human
aaaggaaaaagcuc

SEQ ID NO: 3552390 - RNA, 21 nt, Human
aaaggaaaaaguaucauggaa

SEQ ID NO: 3552391 - RNA, 22 nt, Human
aaaggaaaaaguaucauggaaa

SEQ ID NO: 3552392 - RNA, 15 nt, Human
aaaggaaaaccugaa

SEQ ID NO: 3552393 - RNA, 18 nt, Human
aaaggaaaaccugaagac

SEQ ID NO: 3552394 - RNA, 13 nt, Human
aaaggaaaccuuu

SEQ ID NO: 3552395 - RNA, 14 nt, Human
aaaggaaaccuuuu

SEQ ID NO: 3552396 - RNA, 17 nt, Human
aaaggaacauugugucu

SEQ ID NO: 3552397 - RNA, 15 nt, Human
aaaggaacugcagca

SEQ ID NO: 3552398 - RNA, 14 nt, Human
aaaggaagucuagg

SEQ ID NO: 3552399 - RNA, 21 nt, Human
aaaggaauccacucccaggca

SEQ ID NO: 3552400 - RNA, 15 nt, Human
aaaggaauggaggcu

SEQ ID NO: 3552401 - RNA, 19 nt, Human
aaaggacaggcagaaagag

SEQ ID NO: 3552402 - RNA, 14 nt, Human
aaaggacaucagca

SEQ ID NO: 3552403 - RNA, 15 nt, Human
aaaggacaucagcaa

SEQ ID NO: 3552404 - RNA, 16 nt, Human
aaaggacaucagcaaa

SEQ ID NO: 3552405 - RNA, 12 nt, Human
aaaggacucugg

SEQ ID NO: 3552406 - RNA, 15 nt, Human
aaaggacucuggggu

SEQ ID NO: 3552407 - RNA, 20 nt, Human
aaaggacuguuuuuuccuga

SEQ ID NO: 3552408 - RNA, 15 nt, Human
aaaggagagcaucgg

SEQ ID NO: 3552409 - RNA, 23 nt, Human
aaaggagcccuuaucugugcuca

SEQ ID NO: 3552410 - RNA, 12 nt, Human
aaaggagccugu

SEQ ID NO: 3552411 - RNA, 16 nt, Human
aaaggagucaaaacua

SEQ ID NO: 3552412 - RNA, 21 nt, Human
aaaggaguuuauguuccauua

SEQ ID NO: 3552413 - RNA, 19 nt, Human
aaaggauauuuaagaaaau

SEQ ID NO: 3552414 - RNA, 14 nt, Human
aaaggaugcacaga

SEQ ID NO: 3552415 - RNA, 20 nt, Human
aaaggaugcccaaagaugca

SEQ ID NO: 3552416 - RNA, 14 nt, Human
aaaggaugugauau

SEQ ID NO: 3552417 - RNA, 23 nt, Human
aaaggaugugauauauaagugua

SEQ ID NO: 3552418 - RNA, 13 nt, Human
aaaggaugugauu

SEQ ID NO: 3552419 - RNA, 16 nt, Human
aaaggauguugguguu

SEQ ID NO: 3552420 - RNA, 16 nt, Human
aaaggcaaacauuuga

SEQ ID NO: 3552421 - RNA, 12 nt, Human
aaaggcaaaggc

SEQ ID NO: 3552422 - RNA, 22 nt, Human
aaaggcaaguuaagagaaacuu

SEQ ID NO: 3552423 - RNA, 12 nt, Human
aaaggcagcugu

SEQ ID NO: 3552424 - RNA, 14 nt, Human
aaaggcagcuguug

SEQ ID NO: 3552425 - RNA, 23 nt, Human
aaaggcaguuugcaaaaaauguu

SEQ ID NO: 3552426 - RNA, 17 nt, Human
aaaggcauauugcuuuu

SEQ ID NO: 3552427 - RNA, 16 nt, Human
aaaggcauucucugaa

SEQ ID NO: 3552428 - RNA, 15 nt, Human
aaaggccaaaccucu

SEQ ID NO: 3552429 - RNA, 15 nt, Human
aaaggccaaacugcu

SEQ ID NO: 3552430 - RNA, 18 nt, Human
aaaggccaaacugcugga

SEQ ID NO: 3552431 - RNA, 20 nt, Human
aaaggccagcuggcagcaga

SEQ ID NO: 3552432 - RNA, 16 nt, Human
aaaggcccagccccua

SEQ ID NO: 3552433 - RNA, 11 nt, Human
aaaggccucuu

SEQ ID NO: 3552434 - RNA, 14 nt, Human
aaaggccucuuccu

SEQ ID NO: 3552435 - RNA, 21 nt, Human
aaaggccucuuguaaagacug

SEQ ID NO: 3552436 - RNA, 11 nt, Human
aaaggccuggg

SEQ ID NO: 3552437 - RNA, 13 nt, Human
aaaggccuggggu

SEQ ID NO: 3552438 - RNA, 12 nt, Human
aaaggccuuuaa

SEQ ID NO: 3552439 - RNA, 13 nt, Human
aaaggcgcugaga

SEQ ID NO: 3552440 - RNA, 14 nt, Human
aaaggcuaccuuug

SEQ ID NO: 3552441 - RNA, 17 nt, Human
aaaggcuaccuuuguau

SEQ ID NO: 3552442 - RNA, 19 nt, Human
aaaggcuagguacacagcu

SEQ ID NO: 3552443 - RNA, 20 nt, Human
aaaggcuaugauugucuuug

SEQ ID NO: 3552444 - RNA, 14 nt, Human
aaaggcuccaggag

SEQ ID NO: 3552445 - RNA, 16 nt, Human
aaaggcuccaggagca

SEQ ID NO: 3552446 - RNA, 22 nt, Human
aaaggcuccaggagcagccaca

SEQ ID NO: 3552447 - RNA, 18 nt, Human
aaaggcucgauuuuguau

SEQ ID NO: 3552448 - RNA, 15 nt, Human
aaaggcugugcugcc

SEQ ID NO: 3552449 - RNA, 13 nt, Human
aaaggcuguggua

SEQ ID NO: 3552450 - RNA, 20 nt, Human
aaaggcuguuaaauacagga

SEQ ID NO: 3552451 - RNA, 22 nt, Human
aaaggcuguuaaauacaggaaa

SEQ ID NO: 3552452 - RNA, 14 nt, Human
aaaggcuuauaaaa

SEQ ID NO: 3552453 - RNA, 15 nt, Human
aaaggcuucucucuc

SEQ ID NO: 3552454 - RNA, 17 nt, Human
aaaggcuugcagaacuu

SEQ ID NO: 3552455 - RNA, 20 nt, Human
aaagggaacaggaaaagaaa

SEQ ID NO: 3552456 - RNA, 18 nt, Human
aaagggaaguugugccuu

SEQ ID NO: 3552457 - RNA, 21 nt, Human
aaagggagaagugacauugca

SEQ ID NO: 3552458 - RNA, 17 nt, Human
aaagggagagagagagg

SEQ ID NO: 3552459 - RNA, 22 nt, Human
aaagggagcagagaaggccagg

SEQ ID NO: 3552460 - RNA, 18 nt, Human
aaagggagcuaucaggaa

SEQ ID NO: 3552461 - RNA, 19 nt, Human
aaagggagggcucugaggc

SEQ ID NO: 3552462 - RNA, 22 nt, Human
aaagggagggcucugaggcgcc

SEQ ID NO: 3552463 - RNA, 17 nt, Human
aaaggggaaagaacaua

SEQ ID NO: 3552464 - RNA, 23 nt, Human
aaaggggucggcugaccaugcuc

SEQ ID NO: 3552465 - RNA, 24 nt, Human
aaaggggucggcugaccaugcuca

SEQ ID NO: 3552466 - RNA, 18 nt, Human
aaaugguauccagaaugg

SEQ ID NO: 3552467 - RNA, 16 nt, Human
aaaugguaucuuuugg

SEQ ID NO: 3552468 - RNA, 21 nt, Human
aaaugguccaauuaguuuccu

SEQ ID NO: 3552469 - RNA, 22 nt, Human
aaaugguccaauuaguuuccuu

SEQ ID NO: 3552470 - RNA, 14 nt, Human
aaaugguccaggag

SEQ ID NO: 3552471 - RNA, 16 nt, Human
aaauggucgcccagga

SEQ ID NO: 3552472 - RNA, 23 nt, Human
aaauggugaaaauaaaauaaagc

SEQ ID NO: 3552473 - RNA, 19 nt, Human
aaauggugcucaccaugcu

SEQ ID NO: 3552474 - RNA, 18 nt, Human
aaaugguggcuucagcuc

SEQ ID NO: 3552475 - RNA, 19 nt, Human
aaaugguggcuucagcucc

SEQ ID NO: 3552476 - RNA, 20 nt, Human
aaaugguggcuucagcucca

SEQ ID NO: 3552477 - RNA, 23 nt, Human
aaaugcucuuauuucaucauuca

SEQ ID NO: 3552478 - RNA, 12 nt, Human
aaaugcugaccc

SEQ ID NO: 3552479 - RNA, 16 nt, Human
aaaugcugacccaugg

SEQ ID NO: 3552480 - RNA, 21 nt, Human
aaaugcugauuuaaacuucuu

SEQ ID NO: 3552481 - RNA, 14 nt, Human
aaaugcugcauuuu

SEQ ID NO: 3552482 - RNA, 13 nt, Human
aaaugcugccugc

SEQ ID NO: 3552483 - RNA, 16 nt, Human
aaaugcugccugccug

SEQ ID NO: 3552484 - RNA, 21 nt, Human
aaaugcugcgcccuuccccag

SEQ ID NO: 3552485 - RNA, 19 nt, Human
aaaugcuguaacuuucuga

SEQ ID NO: 3552486 - RNA, 22 nt, Human
aaaugcugucuuucuugcuccc

SEQ ID NO: 3552487 - RNA, 16 nt, Human
aaaugcuguguugggu

SEQ ID NO: 3552488 - RNA, 19 nt, Human
aaaugcuucacuguacgua

SEQ ID NO: 3552489 - RNA, 16 nt, Human
aaaugcuucauuugua

SEQ ID NO: 3552490 - RNA, 23 nt, Human
aaaugcuucauuuguaugucaaa

SEQ ID NO: 3552491 - RNA, 19 nt, Human
aaaugcuuuaaaaacuauu

SEQ ID NO: 3552492 - RNA, 22 nt, Human
aaaugcuuuaaaaacuauuuaa

SEQ ID NO: 3552493 - RNA, 14 nt, Human
aaaugcuuuagaaa

SEQ ID NO: 3552494 - RNA, 19 nt, Human
aaaugcuuugugugauuga

SEQ ID NO: 3552495 - RNA, 21 nt, Human
aaauggaaaggagaggaaaga

SEQ ID NO: 3552496 - RNA, 16 nt, Human
aaauggaaaugggcag

SEQ ID NO: 3552497 - RNA, 19 nt, Human
aaauggaauucauucuggu

SEQ ID NO: 3552498 - RNA, 22 nt, Human
aaauggaauugaaaaacucuuu

SEQ ID NO: 3552499 - RNA, 15 nt, Human
aaauggacauggugg

SEQ ID NO: 3552500 - RNA, 23 nt, Human
aaauggacuggagcucaucugca

SEQ ID NO: 3552501 - RNA, 19 nt, Human
aaauggacugguuugagau

SEQ ID NO: 3552502 - RNA, 20 nt, Human
aaauggaggaucucuaaaga

SEQ ID NO: 3552503 - RNA, 15 nt, Human
aaauggauacuacau

SEQ ID NO: 3552504 - RNA, 13 nt, Human
aaauggauacugg

SEQ ID NO: 3552505 - RNA, 17 nt, Human
aaauggaugccuugaau

SEQ ID NO: 3552506 - RNA, 22 nt, Human
aaauggaugccuugaauaauaa

SEQ ID NO: 3552507 - RNA, 22 nt, Human
aaauggccauuugcuuuuucac

SEQ ID NO: 3552508 - RNA, 11 nt, Human
aaauggccuca

SEQ ID NO: 3552509 - RNA, 23 nt, Human
aaauggcugcaucccccccaccu

SEQ ID NO: 3552510 - RNA, 17 nt, Human
aaauggcugguuuuuag

SEQ ID NO: 3552511 - RNA, 19 nt, Human
aaauggcuguaaucauuug

SEQ ID NO: 3552512 - RNA, 21 nt, Human
aaauggcuguaaucauuuguu

SEQ ID NO: 3552513 - RNA, 21 nt, Human
aaauggcuucggacaaaauau

SEQ ID NO: 3552514 - RNA, 23 nt, Human
aaauggcuucggacaaaauaucu

SEQ ID NO: 3552515 - RNA, 22 nt, Human
aaaugggaaaugccuaagaaga

SEQ ID NO: 3552516 - RNA, 22 nt, Human
aaaugggacuucuuuucacauu

SEQ ID NO: 3552517 - RNA, 20 nt, Human
aaaugggcacuuaaagcuuu

SEQ ID NO: 3552518 - RNA, 15 nt, Human
aaaugggcagagcag

SEQ ID NO: 3552519 - RNA, 18 nt, Human
aaaugggcagagcagaga

SEQ ID NO: 3552520 - RNA, 21 nt, Human
aaauggggccagauccagccu

SEQ ID NO: 3552521 - RNA, 19 nt, Human
aaaugggggugcauuugag

SEQ ID NO: 3552522 - RNA, 20 nt, Human
aaauggguuggugcuucuaa

SEQ ID NO: 3552523 - RNA, 22 nt, Human
aaauggguuggugcuucuaacc

SEQ ID NO: 3552524 - RNA, 14 nt, Human
aaauggguuuuacu

SEQ ID NO: 3552525 - RNA, 13 nt, Human
aaaugguaaaauu

SEQ ID NO: 3552526 - RNA, 19 nt, Human
aaaugguaaaauugcaugg

SEQ ID NO: 3552527 - RNA, 14 nt, Human
aaauggugccuuca

SEQ ID NO: 3552528 - RNA, 17 nt, Human
aaaugguggcuucagcu

SEQ ID NO: 3552529 - RNA, 20 nt, Human
aaaugguguacauaauguau

SEQ ID NO: 3552530 - RNA, 17 nt, Human
aaaugguguuuuaucuu

SEQ ID NO: 3552531 - RNA, 22 nt, Human
aaaugguguuuucauguaaaua

SEQ ID NO: 3552532 - RNA, 14 nt, Human
aaaugguguuuuuu

SEQ ID NO: 3552533 - RNA, 17 nt, Human
aaaugguuguauuagau

SEQ ID NO: 3552534 - RNA, 17 nt, Human
aaaugguuuauuuugua

SEQ ID NO: 3552535 - RNA, 22 nt, Human
aaauguaaacucagcaucaaaa

SEQ ID NO: 3552536 - RNA, 19 nt, Human
aaauguaaacuguuucuuu

SEQ ID NO: 3552537 - RNA, 13 nt, Human
aaauguaaagcca

SEQ ID NO: 3552538 - RNA, 17 nt, Human
aaauguaacagucugau

SEQ ID NO: 3552539 - RNA, 17 nt, Human
aaauguaagaaucauug

SEQ ID NO: 3552540 - RNA, 20 nt, Human
aaauguaagaaucauuguaa

SEQ ID NO: 3552541 - RNA, 20 nt, Human
aaauguaagauuauagauuc

SEQ ID NO: 3552542 - RNA, 21 nt, Human
aaauguaagauuauagauucu

SEQ ID NO: 3552543 - RNA, 16 nt, Human
aaauguaagggaaacu

SEQ ID NO: 3552544 - RNA, 22 nt, Human
aaauguaagggaaacugccagc

SEQ ID NO: 3552545 - RNA, 20 nt, Human
aaauguaauguggcuucugg

SEQ ID NO: 3552546 - RNA, 17 nt, Human
aaauguaauuuaaauga

SEQ ID NO: 3552547 - RNA, 19 nt, Human
aaauguaauuuaaaugaaa

SEQ ID NO: 3552548 - RNA, 17 nt, Human
aaauguacagacauauu

SEQ ID NO: 3552549 - RNA, 21 nt, Human
aaauguagcuucagucauuaa

SEQ ID NO: 3552550 - RNA, 16 nt, Human
aaauguaguugaugua

SEQ ID NO: 3552551 - RNA, 14 nt, Human
aaauguauaaacuu

SEQ ID NO: 3552552 - RNA, 13 nt, Human
aaauguauaaaua

SEQ ID NO: 3552553 - RNA, 19 nt, Human
aaauguauauacacauaua

SEQ ID NO: 3552554 - RNA, 22 nt, Human
aaauguauauacacauauaccu

SEQ ID NO: 3552555 - RNA, 17 nt, Human
aaauguauauauguaua

SEQ ID NO: 3552556 - RNA, 14 nt, Human
aaauguauauauuu

SEQ ID NO: 3552557 - RNA, 14 nt, Human
aaauguaugcaugu

SEQ ID NO: 3552558 - RNA, 15 nt, Human
aaauguaugcauguu

SEQ ID NO: 3552559 - RNA, 16 nt, Human
aaauguaugcauguug

SEQ ID NO: 3552560 - RNA, 13 nt, Human
aaauguaugcauu

SEQ ID NO: 3552561 - RNA, 15 nt, Human
aaauguauucaaaua

SEQ ID NO: 3552562 - RNA, 15 nt, Human
aaauguauuuuaugu

SEQ ID NO: 3552563 - RNA, 19 nt, Human
aaauguauuuuauguuaua

SEQ ID NO: 3552564 - RNA, 12 nt, Human
aaauguauuuuu

SEQ ID NO: 3552565 - RNA, 14 nt, Human
aaauguauuuuucu

SEQ ID NO: 3552566 - RNA, 15 nt, Human
aaauguauuuuucua

SEQ ID NO: 3552567 - RNA, 20 nt, Human
aaaugucaaaaguagaacuu

SEQ ID NO: 3552568 - RNA, 20 nt, Human
aaaugucacuuuuugaggca

SEQ ID NO: 3552569 - RNA, 15 nt, Human
aaaugucagauacaa

SEQ ID NO: 3552570 - RNA, 12 nt, Human
aaauguccucca

SEQ ID NO: 3552571 - RNA, 22 nt, Human
aaaugucuaauguauuuuauug

SEQ ID NO: 3552572 - RNA, 16 nt, Human
aaaugucuauuaaggu

SEQ ID NO: 3552573 - RNA, 19 nt, Human
aaaugucuggagaauaauu

SEQ ID NO: 3552574 - RNA, 14 nt, Human
aaaugucuguaaau

SEQ ID NO: 3552575 - RNA, 22 nt, Human
aaaugucuguggccuuguucuc

SEQ ID NO: 3552576 - RNA, 17 nt, Human
aaaugucuuuuagaaga

SEQ ID NO: 3552577 - RNA, 18 nt, Human
aaaugucuuuuagaagau

SEQ ID NO: 3552578 - RNA, 22 nt, Human
aaaugucuuuuuuuuaaugugc

SEQ ID NO: 3552579 - RNA, 19 nt, Human
aaaugugaaugggaaaaga

SEQ ID NO: 3552580 - RNA, 16 nt, Human
aaaugugaauuacuaa

SEQ ID NO: 3552581 - RNA, 23 nt, Human
aaaugugaauuacuaacuucuaa

SEQ ID NO: 3552582 - RNA, 16 nt, Human
aaaugugaguguuuuu

SEQ ID NO: 3552583 - RNA, 18 nt, Human
aaaugugauguucuaagg

SEQ ID NO: 3552584 - RNA, 15 nt, Human
aaauguggcuccugg

SEQ ID NO: 3552585 - RNA, 12 nt, Human
aaauguguacau

SEQ ID NO: 3552586 - RNA, 13 nt, Human
aaauguguauuuu

SEQ ID NO: 3552587 - RNA, 19 nt, Human
aaaugugugugaugugaca

SEQ ID NO: 3552588 - RNA, 20 nt, Human
aaaugugugugaugugacau

SEQ ID NO: 3552589 - RNA, 23 nt, Human
aaaugugugugaugugacauuug

SEQ ID NO: 3552590 - RNA, 14 nt, Human
aaauguuaaaaguu

SEQ ID NO: 3552591 - RNA, 19 nt, Human
aaauguuaaaaguuuuaua

SEQ ID NO: 3552592 - RNA, 23 nt, Human
aaauguuaaaaguuuuauaugcu

SEQ ID NO: 3552593 - RNA, 16 nt, Human
aaauguuaaagaugua

SEQ ID NO: 3552594 - RNA, 21 nt, Human
aaauguuaaagauguagcaaa

SEQ ID NO: 3552595 - RNA, 21 nt, Human
aaauguuacauaguguaggcu

SEQ ID NO: 3552596 - RNA, 14 nt, Human
aaauguuaccucug

SEQ ID NO: 3552597 - RNA, 17 nt, Human
aaauguuaguuucuugg

SEQ ID NO: 3552598 - RNA, 19 nt, Human
aaauguuaguuucuuggua

SEQ ID NO: 3552599 - RNA, 20 nt, Human
aaauguuaucuuauacugua

SEQ ID NO: 3552600 - RNA, 21 nt, Human
aaauguuaucuuauacuguac

SEQ ID NO: 3552601 - RNA, 23 nt, Human
aaauguuaucuuauacuguacaa

SEQ ID NO: 3552602 - RNA, 17 nt, Human
aaauguuaucuucucaa

SEQ ID NO: 3552603 - RNA, 18 nt, Human
aaauguuaucuucucaag

SEQ ID NO: 3552604 - RNA, 13 nt, Human
aaauguuauguau

SEQ ID NO: 3552605 - RNA, 14 nt, Human
aaauguuauguaua

SEQ ID NO: 3552606 - RNA, 15 nt, Human
aaauguuauuuaaca

SEQ ID NO: 3552607 - RNA, 15 nt, Human
aaauguuauuucugc

SEQ ID NO: 3552608 - RNA, 15 nt, Human
aaauguucagaaggu

SEQ ID NO: 3552609 - RNA, 15 nt, Human
aacagauuguuugca

SEQ ID NO: 3552610 - RNA, 14 nt, Human
aacagauuuggaaa

SEQ ID NO: 3552611 - RNA, 14 nt, Human
aacagauuugugaa

SEQ ID NO: 3552612 - RNA, 16 nt, Human
aacagauuugugaacu

SEQ ID NO: 3552613 - RNA, 21 nt, Human
aacagauuugugaacucagcc

SEQ ID NO: 3552614 - RNA, 22 nt, Human
aacagauuugugaacucagcca

SEQ ID NO: 3552615 - RNA, 23 nt, Human
aacagauuugugaacucagccaa

SEQ ID NO: 3552616 - RNA, 13 nt, Human
aacagauuuuuac

SEQ ID NO: 3552617 - RNA, 17 nt, Human
aacagauuuuuacaaau

SEQ ID NO: 3552618 - RNA, 16 nt, Human
aacagcaaaccaagag

SEQ ID NO: 3552619 - RNA, 18 nt, Human
aacagcaacacaaagcuu

SEQ ID NO: 3552620 - RNA, 13 nt, Human
aacagcaggccca

SEQ ID NO: 3552621 - RNA, 15 nt, Human
aacagcaguguuccc

SEQ ID NO: 3552622 - RNA, 15 nt, Human
aacagcaucuccaag

SEQ ID NO: 3552623 - RNA, 14 nt, Human
aacagcauugcuuu

SEQ ID NO: 3552624 - RNA, 15 nt, Human
aacagcauugcuuuc

SEQ ID NO: 3552625 - RNA, 15 nt, Human
aacagccaacagcua

SEQ ID NO: 3552626 - RNA, 19 nt, Human
aacagccaacuagccccug

SEQ ID NO: 3552627 - RNA, 18 nt, Human
aacagccaagauuuuccu

SEQ ID NO: 3552628 - RNA, 19 nt, Human
aacagcccuauuucuugau

SEQ ID NO: 3552629 - RNA, 19 nt, Human
aacagcccuccucugcacu

SEQ ID NO: 3552630 - RNA, 13 nt, Human
aacagccgagugg

SEQ ID NO: 3552631 - RNA, 23 nt, Human
aacagccgaguggauagaugccc

SEQ ID NO: 3552632 - RNA, 15 nt, Human
aacagccgcuccaga

SEQ ID NO: 3552633 - RNA, 13 nt, Human
aacagccucacag

SEQ ID NO: 3552634 - RNA, 12 nt, Human
aacagccugugu

SEQ ID NO: 3552635 - RNA, 15 nt, Human
aacagccugugucuu

SEQ ID NO: 3552636 - RNA, 20 nt, Human
aacagcgaaguagcuugcuc

SEQ ID NO: 3552637 - RNA, 14 nt, Human
aacagcuacaacag

SEQ ID NO: 3552638 - RNA, 15 nt, Human
aacagcuacaacagc

SEQ ID NO: 3552639 - RNA, 20 nt, Human
aacagcuacaacagccucac

SEQ ID NO: 3552640 - RNA, 15 nt, Human
aacagcuaccaugac

SEQ ID NO: 3552641 - RNA, 10 nt, Human
aacagcuccu

SEQ ID NO: 3552642 - RNA, 13 nt, Human
aacagcuccuugg

SEQ ID NO: 3552643 - RNA, 15 nt, Human
aacagcuccuuggga

SEQ ID NO: 3552644 - RNA, 13 nt, Human
aacagcucgacuu

SEQ ID NO: 3552645 - RNA, 19 nt, Human
aacagcucgauccaaauug

SEQ ID NO: 3552646 - RNA, 21 nt, Human
aacagcucugcaggcuuaaua

SEQ ID NO: 3552647 - RNA, 19 nt, Human
aacagcugccuuagcuuca

SEQ ID NO: 3552648 - RNA, 22 nt, Human
aacagcugccuuagcuucagga

SEQ ID NO: 3552649 - RNA, 23 nt, Human
aacagcugccuuagcuucaggaa

SEQ ID NO: 3552650 - RNA, 19 nt, Human
aacagcuggugcccugcuu

SEQ ID NO: 3552651 - RNA, 12 nt, Human
aacagcuggugu

SEQ ID NO: 3552652 - RNA, 13 nt, Human
aacagcuggugua

SEQ ID NO: 3552653 - RNA, 15 nt, Human
aacagcuguugacuc

SEQ ID NO: 3552654 - RNA, 15 nt, Human
aacagcuucagguua

SEQ ID NO: 3552655 - RNA, 21 nt, Human
aacagcuucaugccuuuguaa

SEQ ID NO: 3552656 - RNA, 17 nt, Human
aacaggaaaaaaacuuu

SEQ ID NO: 3552657 - RNA, 14 nt, Human
aacaggaaaagaaa

SEQ ID NO: 3552658 - RNA, 22 nt, Human
aacaggaaaggcucgaaauaca

SEQ ID NO: 3552659 - RNA, 14 nt, Human
aacaggaagaucuu

SEQ ID NO: 3552660 - RNA, 20 nt, Human
aacaggaucaguuaacuauu

SEQ ID NO: 3552661 - RNA, 19 nt, Human
aacaggauuagacagucaa

SEQ ID NO: 3552662 - RNA, 22 nt, Human
aacaggcaaacauuuucucuua

SEQ ID NO: 3552663 - RNA, 17 nt, Human
aacaggcacugcccugg

SEQ ID NO: 3552664 - RNA, 23 nt, Human
aacaggccauugugaaccaaugc

SEQ ID NO: 3552665 - RNA, 12 nt, Human
aacaggcccagc

SEQ ID NO: 3552666 - RNA, 16 nt, Human
aacaggcccuccuccc

SEQ ID NO: 3552667 - RNA, 14 nt, Human
aacaggccucaggg

SEQ ID NO: 3552668 - RNA, 20 nt, Human
aacaggccucagggcuccuu

SEQ ID NO: 3552669 - RNA, 15 nt, Human
aacaggccucuccau

SEQ ID NO: 3552670 - RNA, 21 nt, Human
aacaggcucaauauuccugaa

SEQ ID NO: 3552671 - RNA, 14 nt, Human
aacaggcucagagg

SEQ ID NO: 3552672 - RNA, 13 nt, Human
aacaggcugggcu

SEQ ID NO: 3552673 - RNA, 15 nt, Human
aacagggaaggcagg

SEQ ID NO: 3552674 - RNA, 22 nt, Human
aacagggaaggcaggcagggcu

SEQ ID NO: 3552675 - RNA, 11 nt, Human
aacagggaggg

SEQ ID NO: 3552676 - RNA, 14 nt, Human
aacagggccucugc

SEQ ID NO: 3552677 - RNA, 15 nt, Human
aacaggguaaauuau

SEQ ID NO: 3552678 - RNA, 16 nt, Human
aacaagucccuguaau

SEQ ID NO: 3552679 - RNA, 19 nt, Human
aacaauaaauguuggcuug

SEQ ID NO: 3552680 - RNA, 19 nt, Human
aacaauaacuacuguguuc

SEQ ID NO: 3552681 - RNA, 20 nt, Human
aacaauaacuacuguguucc

SEQ ID NO: 3552682 - RNA, 16 nt, Human
aacaauacaaauggau

SEQ ID NO: 3552683 - RNA, 21 nt, Human
aacaauaccugaaugcucugu

SEQ ID NO: 3552684 - RNA, 18 nt, Human
aacaauaguaauucucag

SEQ ID NO: 3552685 - RNA, 21 nt, Human
aacaauauuuuaugguuaugu

SEQ ID NO: 3552686 - RNA, 17 nt, Human
aacaauccuagugcuuu

SEQ ID NO: 3552687 - RNA, 14 nt, Human
aacaaugaagauaa

SEQ ID NO: 3552688 - RNA, 24 nt, Human
aacaaugaauaaaaacucaaggag

SEQ ID NO: 3552689 - RNA, 17 nt, Human
aacaaugacaaagcaga

SEQ ID NO: 3552690 - RNA, 18 nt, Human
aacaaugacaaagcagau

SEQ ID NO: 3552691 - RNA, 19 nt, Human
aacaaugacacuagaaaac

SEQ ID NO: 3552692 - RNA, 15 nt, Human
aacaaugaugcccug

SEQ ID NO: 3552693 - RNA, 19 nt, Human
aacaaugcagcaaggcccu

SEQ ID NO: 3552694 - RNA, 18 nt, Human
aacaaugccuauuguaau

SEQ ID NO: 3552695 - RNA, 16 nt, Human
aacaauguauuuucuu

SEQ ID NO: 3552696 - RNA, 12 nt, Human
aacaauguuaag

SEQ ID NO: 3552697 - RNA, 18 nt, Human
aacaauguuaaggaaacu

SEQ ID NO: 3552698 - RNA, 20 nt, Human
aacaauucaaagaaucaccu

SEQ ID NO: 3552699 - RNA, 12 nt, Human
aacaauucuaaa

SEQ ID NO: 3552700 - RNA, 22 nt, Human
aacaauugucgaaaagagucuu

SEQ ID NO: 3552701 - RNA, 14 nt, Human
aacaauugugaagu

SEQ ID NO: 3552702 - RNA, 18 nt, Human
aacaauuguguagccuuu

SEQ ID NO: 3552703 - RNA, 14 nt, Human
aacaauuuaaaaau

SEQ ID NO: 3552704 - RNA, 20 nt, Human
aacaauuuccuuuauauuua

SEQ ID NO: 3552705 - RNA, 13 nt, Human
aacaauuucuguc

SEQ ID NO: 3552706 - RNA, 20 nt, Human
aacaauuugagauguauuuc

SEQ ID NO: 3552707 - RNA, 20 nt, Human
aacaauuuucagauuugcac

SEQ ID NO: 3552708 - RNA, 23 nt, Human
aacaauuuucagauuugcacaaa

SEQ ID NO: 3552709 - RNA, 12 nt, Human
aacaauuuucuu

SEQ ID NO: 3552710 - RNA, 18 nt, Human
aacaauuuucuugugaca

SEQ ID NO: 3552711 - RNA, 19 nt, Human
aacacaaacgggcucagca

SEQ ID NO: 3552712 - RNA, 13 nt, Human
aacacaaacugua

SEQ ID NO: 3552713 - RNA, 12 nt, Human
aacacaaagcuu

SEQ ID NO: 3552714 - RNA, 13 nt, Human
aacacaaaugcag

SEQ ID NO: 3552715 - RNA, 15 nt, Human
aacacaacuauauug

SEQ ID NO: 3552716 - RNA, 20 nt, Human
aacacaagauugguguuuuu

SEQ ID NO: 3552717 - RNA, 12 nt, Human
aacacaagcaaa

SEQ ID NO: 3552718 - RNA, 14 nt, Human
aacacaagccacag

SEQ ID NO: 3552719 - RNA, 17 nt, Human
aacacaagccacagaag

SEQ ID NO: 3552720 - RNA, 18 nt, Human
aacacaagcuggaagcac

SEQ ID NO: 3552721 - RNA, 15 nt, Human
aacacaaggugggca

SEQ ID NO: 3552722 - RNA, 23 nt, Human
aacacaaguagaugccugaacuu

SEQ ID NO: 3552723 - RNA, 16 nt, Human
aacacaaguccuguga

SEQ ID NO: 3552724 - RNA, 14 nt, Human
aacacacaaaggua

SEQ ID NO: 3552725 - RNA, 12 nt, Human
aacacacagaca

SEQ ID NO: 3552726 - RNA, 19 nt, Human
aacacacgcgcgcacacac

SEQ ID NO: 3552727 - RNA, 19 nt, Human
aacacacuaccgaaugugu

SEQ ID NO: 3552728 - RNA, 23 nt, Human
aacacacuaccgaaugugucuuu

SEQ ID NO: 3552729 - RNA, 19 nt, Human
aacacacugaggcagggaa

SEQ ID NO: 3552730 - RNA, 23 nt, Human
aacacagcaguucugcagaggac

SEQ ID NO: 3552731 - RNA, 16 nt, Human
aacacagcauguguau

SEQ ID NO: 3552732 - RNA, 18 nt, Human
aacacagcauguguauuu

SEQ ID NO: 3552733 - RNA, 16 nt, Human
aacacagccugggccc

SEQ ID NO: 3552734 - RNA, 15 nt, Human
aacacaggcaaaauc

SEQ ID NO: 3552735 - RNA, 22 nt, Human
aacacaggcaaaauccuugcuu

SEQ ID NO: 3552736 - RNA, 22 nt, Human
aacacaggcagcuuucuagaag

SEQ ID NO: 3552737 - RNA, 12 nt, Human
aacacaguauuu

SEQ ID NO: 3552738 - RNA, 20 nt, Human
aacacaguguuuuuguaaag

SEQ ID NO: 3552739 - RNA, 21 nt, Human
aacacaguguuuuuguaaagu

SEQ ID NO: 3552740 - RNA, 18 nt, Human
aacacauaauuaacacuu

SEQ ID NO: 3552741 - RNA, 21 nt, Human
aacacauacaggaagguagaa

SEQ ID NO: 3552742 - RNA, 17 nt, Human
aacacauagauucaccu

SEQ ID NO: 3552743 - RNA, 21 nt, Human
aacacaucuaguaguuguucu

SEQ ID NO: 3552744 - RNA, 17 nt, Human
aacacaucuuuccuguc

SEQ ID NO: 3552745 - RNA, 18 nt, Human
aacacauggggaaaaaaa

SEQ ID NO: 3552746 - RNA, 22 nt, Human
aacacauggggaaaaaaaucau

SEQ ID NO: 3552747 - RNA, 14 nt, Human
aacacauugccuaa

SEQ ID NO: 3552748 - RNA, 19 nt, Human
aacacauuguuauuuucag

SEQ ID NO: 3552749 - RNA, 13 nt, Human
aacacauuucucu

SEQ ID NO: 3552750 - RNA, 22 nt, Human
aacacauuucuuuuuaaaaaaa

SEQ ID NO: 3552751 - RNA, 22 nt, Human
aacacauuuugguucuucucaa

SEQ ID NO: 3552752 - RNA, 17 nt, Human
aacaccaaaaaauaucu

SEQ ID NO: 3552753 - RNA, 18 nt, Human
aacaccaagcacagcagc

SEQ ID NO: 3552754 - RNA, 21 nt, Human
aacagcuacaacagccucacu

SEQ ID NO: 3552755 - RNA, 19 nt, Human
aacagcuaugggagcccca

SEQ ID NO: 3552756 - RNA, 22 nt, Human
aacagcuaugggagccccaggg

SEQ ID NO: 3552757 - RNA, 10 nt, Human
aacagcucag

SEQ ID NO: 3552758 - RNA, 14 nt, Human
aacagcucaggcug

SEQ ID NO: 3552759 - RNA, 18 nt, Human
aacagcucaguucuaguc

SEQ ID NO: 3552760 - RNA, 23 nt, Human
aacagcuccuugggaggaagcag

SEQ ID NO: 3552761 - RNA, 16 nt, Human
aacagcucgauccaaa

SEQ ID NO: 3552762 - RNA, 23 nt, Human
aacagcucucuucaaugacauag

SEQ ID NO: 3552763 - RNA, 19 nt, Human
aacagcugaggucucuuga

SEQ ID NO: 3552764 - RNA, 21 nt, Human
aacagcugcaauucccuggau

SEQ ID NO: 3552765 - RNA, 17 nt, Human
aacagcugcauuagaaa

SEQ ID NO: 3552766 - RNA, 13 nt, Human
aacagcugccuua

SEQ ID NO: 3552767 - RNA, 18 nt, Human
aacagcugccuuagcuuc

SEQ ID NO: 3552768 - RNA, 20 nt, Human
aacagcugguguagcuacag

SEQ ID NO: 3552769 - RNA, 21 nt, Human
aacagcugguguagcuacaga

SEQ ID NO: 3552770 - RNA, 22 nt, Human
aacagcugguguagcuacagag

SEQ ID NO: 3552771 - RNA, 18 nt, Human
aacagcugucacaacuug

SEQ ID NO: 3552772 - RNA, 14 nt, Human
aacagcuucagguu

SEQ ID NO: 3552773 - RNA, 22 nt, Human
aacagcuucaugccuuuguaag

SEQ ID NO: 3552774 - RNA, 16 nt, Human
aacagcuucucaauuu

SEQ ID NO: 3552775 - RNA, 12 nt, Human
aacaggaaaaga

SEQ ID NO: 3552776 - RNA, 20 nt, Human
aacaggaaucaagagcugcc

SEQ ID NO: 3552777 - RNA, 17 nt, Human
aacaggagacaggaagg

SEQ ID NO: 3552778 - RNA, 19 nt, Human
aacaggagcugggauccua

SEQ ID NO: 3552779 - RNA, 22 nt, Human
aacaggaggacaauucaugaac

SEQ ID NO: 3552780 - RNA, 16 nt, Human
aacaggauuagacagu

SEQ ID NO: 3552781 - RNA, 21 nt, Human
aacaggcacuuggcagccuug

SEQ ID NO: 3552782 - RNA, 15 nt, Human
aacaggccucagggc

SEQ ID NO: 3552783 - RNA, 23 nt, Human
aacaggcugggcuucaguggcag

SEQ ID NO: 3552784 - RNA, 18 nt, Human
aacaggcuuagugaugua

SEQ ID NO: 3552785 - RNA, 16 nt, Human
aacagggauugauuuu

SEQ ID NO: 3552786 - RNA, 17 nt, Human
aacagggauugauuuua

SEQ ID NO: 3552787 - RNA, 21 nt, Human
aacagggauugauuuuaaaau

SEQ ID NO: 3552788 - RNA, 17 nt, Human
aacagggcaucuccagg

SEQ ID NO: 3552789 - RNA, 21 nt, Human
aacagggcugccuucuggccu

SEQ ID NO: 3552790 - RNA, 13 nt, Human
aacaggggcuggu

SEQ ID NO: 3552791 - RNA, 16 nt, Human
aacaggguaaauuauu

SEQ ID NO: 3552792 - RNA, 22 nt, Human
aacagggucucuagugcuguga

SEQ ID NO: 3552793 - RNA, 15 nt, Human
aacagguauauacuu

SEQ ID NO: 3552794 - RNA, 17 nt, Human
aacagguauauacuuug

SEQ ID NO: 3552795 - RNA, 13 nt, Human
aacagguauuuug

SEQ ID NO: 3552796 - RNA, 18 nt, Human
aacagguauuuuguuucu

SEQ ID NO: 3552797 - RNA, 12 nt, Human
aacaggucuccu

SEQ ID NO: 3552798 - RNA, 18 nt, Human
aacaggucuccucuuaaa

SEQ ID NO: 3552799 - RNA, 22 nt, Human
aacagguggcaggaccaggacu

SEQ ID NO: 3552800 - RNA, 19 nt, Human
aacagguuauaacaguguu

SEQ ID NO: 3552801 - RNA, 21 nt, Human
aacagguuauuuuaguuucug

SEQ ID NO: 3552802 - RNA, 13 nt, Human
aacagguugggau

SEQ ID NO: 3552803 - RNA, 19 nt, Human
aacagguuuuccugaagaa

SEQ ID NO: 3552804 - RNA, 22 nt, Human
aacaguaacauagcugugauuu

SEQ ID NO: 3552805 - RNA, 17 nt, Human
aacaguauuuauuuugu

SEQ ID NO: 3552806 - RNA, 23 nt, Human
aacaguauuuauuuuguaauuau

SEQ ID NO: 3552807 - RNA, 22 nt, Human
aacaguauuucauugccugugu

SEQ ID NO: 3552808 - RNA, 13 nt, Human
aacagucauguuu

SEQ ID NO: 3552809 - RNA, 15 nt, Human
aacagucauguuuua

SEQ ID NO: 3552810 - RNA, 14 nt, Human
aacagucauuuaaa

SEQ ID NO: 3552811 - RNA, 23 nt, Human
aacaguccccguggccaucccug

SEQ ID NO: 3552812 - RNA, 19 nt, Human
aacagucucaggaaaucaa

SEQ ID NO: 3552813 - RNA, 13 nt, Human
aacagugagccug

SEQ ID NO: 3552814 - RNA, 21 nt, Human
aacagugagccugaauuuugu

SEQ ID NO: 3552815 - RNA, 22 nt, Human
aacagugauuaccagggacuga

SEQ ID NO: 3552816 - RNA, 14 nt, Human
aacagugccugcug

SEQ ID NO: 3552817 - RNA, 15 nt, Human
aacagugccugcuga

SEQ ID NO: 3552818 - RNA, 15 nt, Human
aacagugcuaaaaau

SEQ ID NO: 3552819 - RNA, 20 nt, Human
aacagugcuugccacagagc

SEQ ID NO: 3552820 - RNA, 18 nt, Human
aacagugugaaguuagaa

SEQ ID NO: 3552821 - RNA, 19 nt, Human
aacagugugcaaggcagcc

SEQ ID NO: 3552822 - RNA, 15 nt, Human
aacaguguguaaaca

SEQ ID NO: 3552823 - RNA, 20 nt, Human
aacaguguuaggccuggcac

SEQ ID NO: 3552824 - RNA, 22 nt, Human
aacaguguuaggccuggcacag

SEQ ID NO: 3552825 - RNA, 15 nt, Human
aacaguguuucccau

SEQ ID NO: 3552826 - RNA, 21 nt, Human
aacaguguuucccauaauuuu

SEQ ID NO: 3552827 - RNA, 20 nt, Human
aacaguguuuuggaauaaaa

SEQ ID NO: 3552828 - RNA, 19 nt, Human
aacaguuaauaccauuuuu

SEQ ID NO: 3552829 - RNA, 16 nt, Human
aacaguuagcuggagc

SEQ ID NO: 3552830 - RNA, 16 nt, Human
aacaguucauguuugc

SEQ ID NO: 3552831 - RNA, 14 nt, Human
aacaguugcacagc

SEQ ID NO: 3552832 - RNA, 18 nt, Human
aacaguugcauguaguaa

SEQ ID NO: 3552833 - RNA, 13 nt, Human
aacaguuguauuu

SEQ ID NO: 3552834 - RNA, 20 nt, Human
aacaguuguauuuaacagaa

SEQ ID NO: 3552835 - RNA, 19 nt, Human
aacaguuguguuugaagca

SEQ ID NO: 3552836 - RNA, 13 nt, Human
aacaguuuuccau

SEQ ID NO: 3552837 - RNA, 15 nt, Human
aacaguuuuccauga

SEQ ID NO: 3552838 - RNA, 22 nt, Human
aacauaaaaaggacaucagcaa

SEQ ID NO: 3552839 - RNA, 14 nt, Human
aacauaaaauacaa

SEQ ID NO: 3552840 - RNA, 19 nt, Human
aacauaaagcaaauagaca

SEQ ID NO: 3552841 - RNA, 17 nt, Human
aacauaaauaaaaugac

SEQ ID NO: 3552842 - RNA, 17 nt, Human
aaaucacgcuuuuugaa

SEQ ID NO: 3552843 - RNA, 20 nt, Human
aaaucacgcuuuuugaaaaa

SEQ ID NO: 3552844 - RNA, 21 nt, Human
aaaucagacuaugaaguuuuu

SEQ ID NO: 3552845 - RNA, 22 nt, Human
aaaucagaguuuucauguauuu

SEQ ID NO: 3552846 - RNA, 19 nt, Human
aaaucagccguguaaccau

SEQ ID NO: 3552847 - RNA, 18 nt, Human
aaaucagccugcuccagc

SEQ ID NO: 3552848 - RNA, 18 nt, Human
aaaucagcuauuuuguga

SEQ ID NO: 3552849 - RNA, 15 nt, Human
aaaucagguauuaau

SEQ ID NO: 3552850 - RNA, 16 nt, Human
aaaucagguuuucuuu

SEQ ID NO: 3552851 - RNA, 18 nt, Human
aaaucagguuuucuuuua

SEQ ID NO: 3552852 - RNA, 13 nt, Human
aaaucaguaagag

SEQ ID NO: 3552853 - RNA, 15 nt, Human
aaaucaguaagaggu

SEQ ID NO: 3552854 - RNA, 16 nt, Human
aaaucaguaagaggug

SEQ ID NO: 3552855 - RNA, 16 nt, Human
aaaucaguuacuaaga

SEQ ID NO: 3552856 - RNA, 17 nt, Human
aaaucaguuacuaagaa

SEQ ID NO: 3552857 - RNA, 14 nt, Human
aaaucauaaacugu

SEQ ID NO: 3552858 - RNA, 16 nt, Human
aaaucauaaacugugu

SEQ ID NO: 3552859 - RNA, 13 nt, Human
aaaucauaaaguc

SEQ ID NO: 3552860 - RNA, 16 nt, Human
aaaucauaaagucagu

SEQ ID NO: 3552861 - RNA, 22 nt, Human
aaaucauaagauauuuuucaug

SEQ ID NO: 3552862 - RNA, 18 nt, Human
aaaucaucaagaagggcu

SEQ ID NO: 3552863 - RNA, 20 nt, Human
aaaucaucagaaaggaaaaa

SEQ ID NO: 3552864 - RNA, 12 nt, Human
aaaucaucuauu

SEQ ID NO: 3552865 - RNA, 17 nt, Human
aaaucaucuauuuugau

SEQ ID NO: 3552866 - RNA, 19 nt, Human
aaaucaucuauuuugaugc

SEQ ID NO: 3552867 - RNA, 17 nt, Human
aaaucauggaaugguua

SEQ ID NO: 3552868 - RNA, 10 nt, Human
aaaucauguu

SEQ ID NO: 3552869 - RNA, 16 nt, Human
aaaucauguuaugaua

SEQ ID NO: 3552870 - RNA, 12 nt, Human
aaaucauuuguu

SEQ ID NO: 3552871 - RNA, 18 nt, Human
aaaucauuuuaggaaagg

SEQ ID NO: 3552872 - RNA, 21 nt, Human
aaaucauuuuauaugucaaag

SEQ ID NO: 3552873 - RNA, 14 nt, Human
aaauccaaauauug

SEQ ID NO: 3552874 - RNA, 16 nt, Human
aaauccaaauauuguu

SEQ ID NO: 3552875 - RNA, 20 nt, Human
aaauccacccauauguuaaa

SEQ ID NO: 3552876 - RNA, 15 nt, Human
aaauccacuuuaucu

SEQ ID NO: 3552877 - RNA, 11 nt, Human
aaauccagaaa

SEQ ID NO: 3552878 - RNA, 14 nt, Human
aaauccagaaagaa

SEQ ID NO: 3552879 - RNA, 15 nt, Human
aaauccauacauuug

SEQ ID NO: 3552880 - RNA, 21 nt, Human
aaauccauuuggaaaucuuua

SEQ ID NO: 3552881 - RNA, 22 nt, Human
aaauccauuuggaaaucuuuaa

SEQ ID NO: 3552882 - RNA, 22 nt, Human
aaaucccauuauucaaaguugc

SEQ ID NO: 3552883 - RNA, 15 nt, Human
aaaucccauuuaaaa

SEQ ID NO: 3552884 - RNA, 17 nt, Human
aaaucccuguuuaauau

SEQ ID NO: 3552885 - RNA, 20 nt, Human
aaauccgaaccuccucugug

SEQ ID NO: 3552886 - RNA, 21 nt, Human
aaauccuaugugauuuuaacu

SEQ ID NO: 3552887 - RNA, 23 nt, Human
aaauccuaugugauuuuaacucu

SEQ ID NO: 3552888 - RNA, 11 nt, Human
aaauccucugg

SEQ ID NO: 3552889 - RNA, 13 nt, Human
aaauccucuuccu

SEQ ID NO: 3552890 - RNA, 15 nt, Human
aaauccucuuccucu

SEQ ID NO: 3552891 - RNA, 15 nt, Human
aaauccugaagagca

SEQ ID NO: 3552892 - RNA, 17 nt, Human
aaauccugaagagcauu

SEQ ID NO: 3552893 - RNA, 16 nt, Human
aaauccugccauuuaa

SEQ ID NO: 3552894 - RNA, 18 nt, Human
aaauccugccauuuaaaa

SEQ ID NO: 3552895 - RNA, 13 nt, Human
aaauccuucuaau

SEQ ID NO: 3552896 - RNA, 15 nt, Human
aaauccuucuaaucu

SEQ ID NO: 3552897 - RNA, 18 nt, Human
aaauccuucuaaucugcu

SEQ ID NO: 3552898 - RNA, 17 nt, Human
aaauuauguuuauauaa

SEQ ID NO: 3552899 - RNA, 22 nt, Human
aaauuauguuuuacuguucauu

SEQ ID NO: 3552900 - RNA, 18 nt, Human
aaauuauuaauuuaugca

SEQ ID NO: 3552901 - RNA, 16 nt, Human
aaauuauuauaagcau

SEQ ID NO: 3552902 - RNA, 22 nt, Human
aaauuauuauaagcauugaaau

SEQ ID NO: 3552903 - RNA, 23 nt, Human
aaauuauucaguuaagaaaaaaa

SEQ ID NO: 3552904 - RNA, 12 nt, Human
aaauuauuuaaa

SEQ ID NO: 3552905 - RNA, 13 nt, Human
aaauuauuucaga

SEQ ID NO: 3552906 - RNA, 12 nt, Human
aaauuauuucuu

SEQ ID NO: 3552907 - RNA, 14 nt, Human
aaauuauuucuuaa

SEQ ID NO: 3552908 - RNA, 15 nt, Human
aaauuauuucuuaau

SEQ ID NO: 3552909 - RNA, 14 nt, Human
aaauuauuugcagg

SEQ ID NO: 3552910 - RNA, 21 nt, Human
aaauuauuuguguaauagaaa

SEQ ID NO: 3552911 - RNA, 22 nt, Human
aaauuauuuguguaauagaaaa

SEQ ID NO: 3552912 - RNA, 15 nt, Human
aaauuauuuuaaaca

SEQ ID NO: 3552913 - RNA, 21 nt, Human
aaauuauuuuguucauacaua

SEQ ID NO: 3552914 - RNA, 11 nt, Human
aaauucaaaua

SEQ ID NO: 3552915 - RNA, 14 nt, Human
aaauucaacaaaca

SEQ ID NO: 3552916 - RNA, 15 nt, Human
aaauucaauuguaaa

SEQ ID NO: 3552917 - RNA, 17 nt, Human
aaauucaauuguaaauu

SEQ ID NO: 3552918 - RNA, 16 nt, Human
aaauucacaaaguuaa

SEQ ID NO: 3552919 - RNA, 19 nt, Human
aaauucacaaguuguguuu

SEQ ID NO: 3552920 - RNA, 19 nt, Human
aaauucacaugaugcacuu

SEQ ID NO: 3552921 - RNA, 15 nt, Human
aaauucacuuucauu

SEQ ID NO: 3552922 - RNA, 13 nt, Human
aaauucaguuuca

SEQ ID NO: 3552923 - RNA, 16 nt, Human
aaauucauauucuguc

SEQ ID NO: 3552924 - RNA, 21 nt, Human
aaauucaucaaauggaagaca

SEQ ID NO: 3552925 - RNA, 17 nt, Human
aaauucauuucacauua

SEQ ID NO: 3552926 - RNA, 12 nt, Human
aaauucauuuua

SEQ ID NO: 3552927 - RNA, 19 nt, Human
aaauucauuuuuuaaauuc

SEQ ID NO: 3552928 - RNA, 20 nt, Human
aaauucccagauuugaagac

SEQ ID NO: 3552929 - RNA, 16 nt, Human
aaauuccccacccuga

SEQ ID NO: 3552930 - RNA, 19 nt, Human
aaauucccuucaucuggaa

SEQ ID NO: 3552931 - RNA, 21 nt, Human
aaauucccuuuucaccuuuuc

SEQ ID NO: 3552932 - RNA, 15 nt, Human
aaauuccuauuguga

SEQ ID NO: 3552933 - RNA, 18 nt, Human
aaauuccuauugugauuu

SEQ ID NO: 3552934 - RNA, 18 nt, Human
aaauuccucuuugcuuug

SEQ ID NO: 3552935 - RNA, 20 nt, Human
aaauuccucuuugcuuugcu

SEQ ID NO: 3552936 - RNA, 11 nt, Human
aaauuccugua

SEQ ID NO: 3552937 - RNA, 22 nt, Human
aaauucuauaggaacauaugaa

SEQ ID NO: 3552938 - RNA, 21 nt, Human
aaauucuauucugaucuuauu

SEQ ID NO: 3552939 - RNA, 20 nt, Human
aaauucucagucaguaauug

SEQ ID NO: 3552940 - RNA, 12 nt, Human
aaauucuccacu

SEQ ID NO: 3552941 - RNA, 14 nt, Human
aaauucugaauuug

SEQ ID NO: 3552942 - RNA, 17 nt, Human
aaauucugaauuugcaa

SEQ ID NO: 3552943 - RNA, 15 nt, Human
aaauucugcucagau

SEQ ID NO: 3552944 - RNA, 9 nt, Human
aaauucugu

SEQ ID NO: 3552945 - RNA, 18 nt, Human
aaauucugucucuggauu

SEQ ID NO: 3552946 - RNA, 16 nt, Human
aaauucugugccuugu

SEQ ID NO: 3552947 - RNA, 19 nt, Human
aaauucuguuaaaaucuau

SEQ ID NO: 3552948 - RNA, 20 nt, Human
aaauucuguuaaaaucuauu

SEQ ID NO: 3552949 - RNA, 14 nt, Human
aaauucuguuucuu

SEQ ID NO: 3552950 - RNA, 15 nt, Human
aaauucuguuucuug

SEQ ID NO: 3552951 - RNA, 12 nt, Human
aaauucuguuuu

SEQ ID NO: 3552952 - RNA, 19 nt, Human
aaauucuguuuuuaaaaau

SEQ ID NO: 3552953 - RNA, 15 nt, Human
aaauucuugcaaagu

SEQ ID NO: 3552954 - RNA, 15 nt, Human
aaauucuuuauuucu

SEQ ID NO: 3552955 - RNA, 20 nt, Human
aaauucuuucagcuaucagu

SEQ ID NO: 3552956 - RNA, 13 nt, Human
aaauucuuucauu

SEQ ID NO: 3552957 - RNA, 21 nt, Human
aaauucuuuuuuaaauuuucu

SEQ ID NO: 3552958 - RNA, 23 nt, Human
aaauucuuuuuuaaauuuucuuc

SEQ ID NO: 3552959 - RNA, 13 nt, Human
aaauugaaauaua

SEQ ID NO: 3552960 - RNA, 13 nt, Human
aaauugaaaugua

SEQ ID NO: 3552961 - RNA, 12 nt, Human
aaauugaaauug

SEQ ID NO: 3552962 - RNA, 22 nt, Human
aaauugaaccuuugugcccuau

SEQ ID NO: 3552963 - RNA, 13 nt, Human
aaauugaauaaug

SEQ ID NO: 3552964 - RNA, 14 nt, Human
aaauugaauacuuu

SEQ ID NO: 3552965 - RNA, 17 nt, Human
aaauugaauacuuugaa

SEQ ID NO: 3552966 - RNA, 23 nt, Human
aaauugaaucaguauaaacaaag

SEQ ID NO: 3552967 - RNA, 15 nt, Human
aaauugaaugcaaac

SEQ ID NO: 3552968 - RNA, 20 nt, Human
aaauugacacaaguggaccu

SEQ ID NO: 3552969 - RNA, 19 nt, Human
aaauugacacuuaaaaaug

SEQ ID NO: 3552970 - RNA, 22 nt, Human
aaauugacagaucaagcuguga

SEQ ID NO: 3552971 - RNA, 14 nt, Human
aaauugacuguacu

SEQ ID NO: 3552972 - RNA, 13 nt, Human
aaauugagagaau

SEQ ID NO: 3552973 - RNA, 17 nt, Human
aaauugagagaauggaa

SEQ ID NO: 3552974 - RNA, 16 nt, Human
aaauugagcugcuuuu

SEQ ID NO: 3552975 - RNA, 14 nt, Human
aaauugauuuugaa

SEQ ID NO: 3552976 - RNA, 19 nt, Human
aaauugcacagaaguccug

SEQ ID NO: 3552977 - RNA, 20 nt, Human
aaauugcacagaaguccugu

SEQ ID NO: 3552978 - RNA, 17 nt, Human
aaauugcauacuuugua

SEQ ID NO: 3552979 - RNA, 23 nt, Human
aaauugcauacuuuguauuuuga

SEQ ID NO: 3552980 - RNA, 17 nt, Human
aaauugcaugcugcuuu

SEQ ID NO: 3552981 - RNA, 18 nt, Human
aaauugcaugcugcuuua

SEQ ID NO: 3552982 - RNA, 21 nt, Human
aaauugcaugcugcuuuaauu

SEQ ID NO: 3552983 - RNA, 22 nt, Human
aaauugcauggguuuuguaggu

SEQ ID NO: 3552984 - RNA, 16 nt, Human
aaauugccauauugca

SEQ ID NO: 3552985 - RNA, 19 nt, Human
aaauugccuuucuguguuu

SEQ ID NO: 3552986 - RNA, 20 nt, Human
aaauugccuuucuguguuua

SEQ ID NO: 3552987 - RNA, 21 nt, Human
aaauugcuauguuacuauuuu

SEQ ID NO: 3552988 - RNA, 18 nt, Human
aaauugcucacaguuauu

SEQ ID NO: 3552989 - RNA, 14 nt, Human
aaauugcuccuuga

SEQ ID NO: 3552990 - RNA, 14 nt, Human
aaauugcugugcuu

SEQ ID NO: 3552991 - RNA, 18 nt, Human
aaauugcuuuguauugua

SEQ ID NO: 3552992 - RNA, 16 nt, Human
aaauuggaaagcaggu

SEQ ID NO: 3552993 - RNA, 19 nt, Human
aaauuggaacagaauguuu

SEQ ID NO: 3552994 - RNA, 23 nt, Human
aaauuggaguuggaguagaaugu

SEQ ID NO: 3552995 - RNA, 23 nt, Human
aaauuggcauggaaauuuaaagc

SEQ ID NO: 3552996 - RNA, 21 nt, Human
aaauuggccugguauggcugc

SEQ ID NO: 3552997 - RNA, 19 nt, Human
aaauuggcuaguugaaucu

SEQ ID NO: 3552998 - RNA, 20 nt, Human
aaauugggaaaggaguagaa

SEQ ID NO: 3552999 - RNA, 16 nt, Human
aaauuggggauucuua

SEQ ID NO: 3553000 - RNA, 20 nt, Human
aaauuggggauucuuaaagu

SEQ ID NO: 3553001 - RNA, 19 nt, Human
aaauuggguucaugaugca

SEQ ID NO: 3553002 - RNA, 16 nt, Human
aaauugguaccuugca

SEQ ID NO: 3553003 - RNA, 22 nt, Human
aaauugguuggagaauuuaggu

SEQ ID NO: 3553004 - RNA, 14 nt, Human
aaauuguaauuaua

SEQ ID NO: 3553005 - RNA, 17 nt, Human
aaauuguauuacaaauc

SEQ ID NO: 3553006 - RNA, 19 nt, Human
aaauugucaccugcuucuc

SEQ ID NO: 3553007 - RNA, 16 nt, Human
aaauugucuuaaugga

SEQ ID NO: 3553008 - RNA, 14 nt, Human
aaauugucuuuaaa

SEQ ID NO: 3553009 - RNA, 20 nt, Human
aaauugucuuuaaaaacugu

SEQ ID NO: 3553010 - RNA, 20 nt, Human
aaauugugaucagaccauaa

SEQ ID NO: 3553011 - RNA, 15 nt, Human
aaauugugauguguc

SEQ ID NO: 3553012 - RNA, 23 nt, Human
aaauugugcaguacuuugugcau

SEQ ID NO: 3553013 - RNA, 17 nt, Human
aaauugugcuucucccc

SEQ ID NO: 3553014 - RNA, 21 nt, Human
aaauugugcuucuccccagaa

SEQ ID NO: 3553015 - RNA, 13 nt, Human
aaauugugugugc

SEQ ID NO: 3553016 - RNA, 23 nt, Human
aaauuguuguccgguuuacuuua

SEQ ID NO: 3553017 - RNA, 22 nt, Human
aaauuguuuaaguguuguaaau

SEQ ID NO: 3553018 - RNA, 19 nt, Human
aaauuguuuaguggaaaau

SEQ ID NO: 3553019 - RNA, 21 nt, Human
aaauuguuucaaaauaaaaac

SEQ ID NO: 3553020 - RNA, 16 nt, Human
aaauuuaaaaaauaaa

SEQ ID NO: 3553021 - RNA, 18 nt, Human
aaauuuaaaaagcccaac

SEQ ID NO: 3553022 - RNA, 18 nt, Human
aaauuuaaaaguaaaaug

SEQ ID NO: 3553023 - RNA, 19 nt, Human
aaauuuaaacuauaagcaa

SEQ ID NO: 3553024 - RNA, 17 nt, Human
aaauuuaagcauuguuu

SEQ ID NO: 3553025 - RNA, 13 nt, Human
aaauuuaaugcug

SEQ ID NO: 3553026 - RNA, 15 nt, Human
aaauuuaaugcugcc

SEQ ID NO: 3553027 - RNA, 18 nt, Human
aaauuuaauucauguuuc

SEQ ID NO: 3553028 - RNA, 12 nt, Human
aaauuuaauucu

SEQ ID NO: 3553029 - RNA, 17 nt, Human
aaauuuacuuuaaacua

SEQ ID NO: 3553030 - RNA, 20 nt, Human
aaauuuacuuuaaacuacau

SEQ ID NO: 3553031 - RNA, 13 nt, Human
aaauuuagaaacu

SEQ ID NO: 3553032 - RNA, 17 nt, Human
aaauuuagaaacuaauu

SEQ ID NO: 3553033 - RNA, 12 nt, Human
aaauuuagaaca

SEQ ID NO: 3553034 - RNA, 16 nt, Human
aaauuuagccgggcgc

SEQ ID NO: 3553035 - RNA, 21 nt, Human
aaauuuauaauuuuaagauuc

SEQ ID NO: 3553036 - RNA, 20 nt, Human
aaauuuauacaccaauugau

SEQ ID NO: 3553037 - RNA, 14 nt, Human
aaauuuauaugaaa

SEQ ID NO: 3553038 - RNA, 16 nt, Human
aaauuuauauuguaaa

SEQ ID NO: 3553039 - RNA, 12 nt, Human
aaauuuaucaaa

SEQ ID NO: 3553040 - RNA, 13 nt, Human
aaauuuaucaaag

SEQ ID NO: 3553041 - RNA, 20 nt, Human
aaauuuauuuaaugugaguu

SEQ ID NO: 3553042 - RNA, 19 nt, Human
aaauuuauuuacugcuagu

SEQ ID NO: 3553043 - RNA, 15 nt, Human
aacugaagauguuga

SEQ ID NO: 3553044 - RNA, 20 nt, Human
aacugaagcagccucucccc

SEQ ID NO: 3553045 - RNA, 19 nt, Human
aacugaagggggcggccua

SEQ ID NO: 3553046 - RNA, 15 nt, Human
aacugaagucugaaa

SEQ ID NO: 3553047 - RNA, 16 nt, Human
aacugaagucugaaau

SEQ ID NO: 3553048 - RNA, 18 nt, Human
aacugaaguucuauuuau

SEQ ID NO: 3553049 - RNA, 13 nt, Human
aacugaaguucug

SEQ ID NO: 3553050 - RNA, 12 nt, Human
aacugaauaaau

SEQ ID NO: 3553051 - RNA, 24 nt, Human
aacugaauaccacucuguaauugc

SEQ ID NO: 3553052 - RNA, 22 nt, Human
aacugaauggaagguuuguaua

SEQ ID NO: 3553053 - RNA, 13 nt, Human
aacugaauuugga

SEQ ID NO: 3553054 - RNA, 14 nt, Human
aacugaauuuggag

SEQ ID NO: 3553055 - RNA, 16 nt, Human
aacugaauuuguacuu

SEQ ID NO: 3553056 - RNA, 14 nt, Human
aacugaauuuuguc

SEQ ID NO: 3553057 - RNA, 20 nt, Human
aacugacaagcuccauuuaa

SEQ ID NO: 3553058 - RNA, 23 nt, Human
aacugauuuuuuuuuccuucagu

SEQ ID NO: 3553059 - RNA, 18 nt, Human
aacugcaaagugaaguug

SEQ ID NO: 3553060 - RNA, 18 nt, Human
aacugcaauaacuucuga

SEQ ID NO: 3553061 - RNA, 18 nt, Human
aacugcaauagagacugu

SEQ ID NO: 3553062 - RNA, 17 nt, Human
aacugcacaugaagaaa

SEQ ID NO: 3553063 - RNA, 19 nt, Human
aacugcacaugauuucaca

SEQ ID NO: 3553064 - RNA, 20 nt, Human
aacugcacaugauuucacaa

SEQ ID NO: 3553065 - RNA, 19 nt, Human
aacugcacugucaagauga

SEQ ID NO: 3553066 - RNA, 16 nt, Human
aacugcagucacugca

SEQ ID NO: 3553067 - RNA, 17 nt, Human
aacugcaugcccagaga

SEQ ID NO: 3553068 - RNA, 22 nt, Human
aacugcaugcccagagacccag

SEQ ID NO: 3553069 - RNA, 14 nt, Human
aacugcaugcugcu

SEQ ID NO: 3553070 - RNA, 14 nt, Human
aacugcauguauaa

SEQ ID NO: 3553071 - RNA, 21 nt, Human
aacugcauuaccgcguuguaa

SEQ ID NO: 3553072 - RNA, 14 nt, Human
aacugcauugagaa

SEQ ID NO: 3553073 - RNA, 12 nt, Human
aacugccauuau

SEQ ID NO: 3553074 - RNA, 18 nt, Human
aacugccauuauuuucug

SEQ ID NO: 3553075 - RNA, 21 nt, Human
aacugccauuauuuucuguca

SEQ ID NO: 3553076 - RNA, 14 nt, Human
aacugcccugucua

SEQ ID NO: 3553077 - RNA, 16 nt, Human
aacugccguaauuuaa

SEQ ID NO: 3553078 - RNA, 22 nt, Human
aacugccuagaaacaacacugu

SEQ ID NO: 3553079 - RNA, 20 nt, Human
aacugccucgaaacacagaa

SEQ ID NO: 3553080 - RNA, 15 nt, Human
aacugccucuuuccu

SEQ ID NO: 3553081 - RNA, 16 nt, Human
aacugccuuggcuuca

SEQ ID NO: 3553082 - RNA, 19 nt, Human
aacugcuaaucuacuuucu

SEQ ID NO: 3553083 - RNA, 23 nt, Human
aacugcugaaaacuagcucguga

SEQ ID NO: 3553084 - RNA, 15 nt, Human
aacugcugacuguuu

SEQ ID NO: 3553085 - RNA, 13 nt, Human
aacugcugccacu

SEQ ID NO: 3553086 - RNA, 14 nt, Human
aacugcugccacug

SEQ ID NO: 3553087 - RNA, 23 nt, Human
aacugcuucccuuacuuugcuga

SEQ ID NO: 3553088 - RNA, 22 nt, Human
aacugcuuccuauaauuuugau

SEQ ID NO: 3553089 - RNA, 20 nt, Human
aacugcuuuaucccacggaa

SEQ ID NO: 3553090 - RNA, 14 nt, Human
aacugcuuucuguu

SEQ ID NO: 3553091 - RNA, 15 nt, Human
aacugcuuucuguuc

SEQ ID NO: 3553092 - RNA, 17 nt, Human
aacugcuuucuguucca

SEQ ID NO: 3553093 - RNA, 20 nt, Human
aacugcuuucuguuccaaau

SEQ ID NO: 3553094 - RNA, 21 nt, Human
aacugcuuucuuucguuuguu

SEQ ID NO: 3553095 - RNA, 15 nt, Human
aacuggaaaacagaa

SEQ ID NO: 3553096 - RNA, 21 nt, Human
aacuggaaaacagaacacuua

SEQ ID NO: 3553097 - RNA, 19 nt, Human
aacuggaacggugaaggug

SEQ ID NO: 3553098 - RNA, 20 nt, Human
aacuggaagcauguaggaga

SEQ ID NO: 3553099 - RNA, 15 nt, Human
aacuggaaguuauuu

SEQ ID NO: 3553100 - RNA, 20 nt, Human
aacuggaauuaaaaggauag

SEQ ID NO: 3553101 - RNA, 20 nt, Human
aacuggacccuguugcuaag

SEQ ID NO: 3553102 - RNA, 21 nt, Human
aacuggacccuguugcuaagc

SEQ ID NO: 3553103 - RNA, 19 nt, Human
aacuggacugguucaaaug

SEQ ID NO: 3553104 - RNA, 14 nt, Human
aacuggagucugga

SEQ ID NO: 3553105 - RNA, 16 nt, Human
aacuggagucuggagu

SEQ ID NO: 3553106 - RNA, 20 nt, Human
aacuggagucuggagugggc

SEQ ID NO: 3553107 - RNA, 21 nt, Human
aacuggccggucugcaaguca

SEQ ID NO: 3553108 - RNA, 20 nt, Human
aacugggaaccccuuuccca

SEQ ID NO: 3553109 - RNA, 21 nt, Human
aacugggaaccccuuucccac

SEQ ID NO: 3553110 - RNA, 22 nt, Human
aacugggaaccccuuucccacc

SEQ ID NO: 3553111 - RNA, 20 nt, Human
aacugggaugaggugacuau

SEQ ID NO: 3553112 - RNA, 16 nt, Human
aacugggcugaacacu

SEQ ID NO: 3553113 - RNA, 22 nt, Human
aacugggggagggugaagugaa

SEQ ID NO: 3553114 - RNA, 14 nt, Human
aacuggucuuccuu

SEQ ID NO: 3553115 - RNA, 22 nt, Human
aacugguggacauggcuguuca

SEQ ID NO: 3553116 - RNA, 20 nt, Human
aacugguuauuuaaaaugua

SEQ ID NO: 3553117 - RNA, 20 nt, Human
aacuguaaaaaaugugugua

SEQ ID NO: 3553118 - RNA, 18 nt, Human
aacuguaauuauuugaau

SEQ ID NO: 3553119 - RNA, 23 nt, Human
aacuguacauuucacaggcuaau

SEQ ID NO: 3553120 - RNA, 16 nt, Human
aacuguaccaugugcu

SEQ ID NO: 3553121 - RNA, 23 nt, Human
aacuguacuagucugugugggac

SEQ ID NO: 3553122 - RNA, 14 nt, Human
aacuguacugggcc

SEQ ID NO: 3553123 - RNA, 18 nt, Human
aacuguacuuuuaaggca

SEQ ID NO: 3553124 - RNA, 14 nt, Human
aacuguauauauuc

SEQ ID NO: 3553125 - RNA, 13 nt, Human
aacuguauuugaa

SEQ ID NO: 3553126 - RNA, 20 nt, Human
aacuguauuugaaauaagaa

SEQ ID NO: 3553127 - RNA, 15 nt, Human
aacugucauuacaga

SEQ ID NO: 3553128 - RNA, 16 nt, Human
aacuguccagagagca

SEQ ID NO: 3553129 - RNA, 13 nt, Human
aacuguccugucc

SEQ ID NO: 3553130 - RNA, 16 nt, Human
aacugucggaggaaag

SEQ ID NO: 3553131 - RNA, 19 nt, Human
aacugucggaggaaagaca

SEQ ID NO: 3553132 - RNA, 14 nt, Human
aacugucuauuucu

SEQ ID NO: 3553133 - RNA, 23 nt, Human
aacugucucgaugcaaugaacac

SEQ ID NO: 3553134 - RNA, 18 nt, Human
aacugucuuuaaaagaga

SEQ ID NO: 3553135 - RNA, 17 nt, Human
aacugugaaguuuacau

SEQ ID NO: 3553136 - RNA, 21 nt, Human
aacugugcugaaugcuuuaga

SEQ ID NO: 3553137 - RNA, 11 nt, Human
aacuguggaua

SEQ ID NO: 3553138 - RNA, 13 nt, Human
aacuguggauauu

SEQ ID NO: 3553139 - RNA, 22 nt, Human
aacuguguaacugcccaaagca

SEQ ID NO: 3553140 - RNA, 14 nt, Human
aacuguguacuguu

SEQ ID NO: 3553141 - RNA, 15 nt, Human
aacuguguagcaucu

SEQ ID NO: 3553142 - RNA, 13 nt, Human
aacuguguaugua

SEQ ID NO: 3553143 - RNA, 21 nt, Human
aacuguguguaauuguuccuu

SEQ ID NO: 3553144 - RNA, 15 nt, Human
aacuguguuguauua

SEQ ID NO: 3553145 - RNA, 16 nt, Human
aacuguguuguauuaa

SEQ ID NO: 3553146 - RNA, 20 nt, Human
aacuguguuguauuaacaaa

SEQ ID NO: 3553147 - RNA, 14 nt, Human
aacuguuaccauug

SEQ ID NO: 3553148 - RNA, 17 nt, Human
aacuguuaccauuggaa

SEQ ID NO: 3553149 - RNA, 18 nt, Human
aacuguuaccauuggaaa

SEQ ID NO: 3553150 - RNA, 20 nt, Human
aacuguuaccuaaaguauuu

SEQ ID NO: 3553151 - RNA, 14 nt, Human
aacuguuagaaugu

SEQ ID NO: 3553152 - RNA, 17 nt, Human
aacuguuagcacuguug

SEQ ID NO: 3553153 - RNA, 15 nt, Human
aacuguuauuuauaa

SEQ ID NO: 3553154 - RNA, 16 nt, Human
aacuguuauuuauaau

SEQ ID NO: 3553155 - RNA, 13 nt, Human
aacuguucccacc

SEQ ID NO: 3553156 - RNA, 14 nt, Human
aacuguuguauaaa

SEQ ID NO: 3553157 - RNA, 19 nt, Human
aacuguuguauaaauuuau

SEQ ID NO: 3553158 - RNA, 22 nt, Human
aacuguuuagggcccugauuug

SEQ ID NO: 3553159 - RNA, 16 nt, Human
aacuguuuauaugugu

SEQ ID NO: 3553160 - RNA, 18 nt, Human
aacuguuuauauguguug

SEQ ID NO: 3553161 - RNA, 19 nt, Human
aacuguuuauauguguuga

SEQ ID NO: 3553162 - RNA, 22 nt, Human
aacuguuuauauguguugaaaa

SEQ ID NO: 3553163 - RNA, 21 nt, Human
aacuguuuuggguagcugcca

SEQ ID NO: 3553164 - RNA, 13 nt, Human
aacuguuuuuuaa

SEQ ID NO: 3553165 - RNA, 20 nt, Human
aacuuaaaaagucugcauua

SEQ ID NO: 3553166 - RNA, 18 nt, Human
aacuuaaaaauguaaaua

SEQ ID NO: 3553167 - RNA, 16 nt, Human
aacuuaaaauauuuua

SEQ ID NO: 3553168 - RNA, 13 nt, Human
aacuuaaauaaua

SEQ ID NO: 3553169 - RNA, 19 nt, Human
aacuuaaauaaugugaaac

SEQ ID NO: 3553170 - RNA, 21 nt, Human
aacuuaaauguuauuaucugg

SEQ ID NO: 3553171 - RNA, 16 nt, Human
aacuuaaauuuuaauu

SEQ ID NO: 3553172 - RNA, 19 nt, Human
aacuuaaauuuuaauuuau

SEQ ID NO: 3553173 - RNA, 15 nt, Human
aacuuaacaugcugu

SEQ ID NO: 3553174 - RNA, 13 nt, Human
aacuuaacuuuaa

SEQ ID NO: 3553175 - RNA, 18 nt, Human
aacuuaaguggcuaaaga

SEQ ID NO: 3553176 - RNA, 21 nt, Human
aacuuaaguugguccuuuaca

SEQ ID NO: 3553177 - RNA, 15 nt, Human
aacuuaauaaucaag

SEQ ID NO: 3553178 - RNA, 17 nt, Human
aacuuaauaaucaagag

SEQ ID NO: 3553179 - RNA, 15 nt, Human
aacuuaauaguauuu

SEQ ID NO: 3553180 - RNA, 15 nt, Human
aacuuaaucuaaaug

SEQ ID NO: 3553181 - RNA, 13 nt, Human
aacuuacacacaa

SEQ ID NO: 3553182 - RNA, 23 nt, Human
aacuuaccuaagugacauuugua

SEQ ID NO: 3553183 - RNA, 18 nt, Human
aacuuacuuaguguuaug

SEQ ID NO: 3553184 - RNA, 21 nt, Human
aacuuacuugcauaccaaguu

SEQ ID NO: 3553185 - RNA, 17 nt, Human
aacuuagaauaaaauug

SEQ ID NO: 3553186 - RNA, 19 nt, Human
aacuuagaauaaaauugua

SEQ ID NO: 3553187 - RNA, 19 nt, Human
aagagaggaguucaaugau

SEQ ID NO: 3553188 - RNA, 21 nt, Human
aagagaggaguucaaugaucu

SEQ ID NO: 3553189 - RNA, 22 nt, Human
aagagaggaguucaaugaucua

SEQ ID NO: 3553190 - RNA, 19 nt, Human
aagagaguuuuuaauagaa

SEQ ID NO: 3553191 - RNA, 16 nt, Human
aagagauaacuguaaa

SEQ ID NO: 3553192 - RNA, 14 nt, Human
aagagauacagagg

SEQ ID NO: 3553193 - RNA, 21 nt, Human
aagagauauuuuaaaaugaga

SEQ ID NO: 3553194 - RNA, 13 nt, Human
aagagauauuuug

SEQ ID NO: 3553195 - RNA, 22 nt, Human
aagagauauuuugggcaugugg

SEQ ID NO: 3553196 - RNA, 15 nt, Human
aagagaucaggaaga

SEQ ID NO: 3553197 - RNA, 16 nt, Human
aagagauccaaagacu

SEQ ID NO: 3553198 - RNA, 18 nt, Human
aagagaugggcuuguuuu

SEQ ID NO: 3553199 - RNA, 15 nt, Human
aagagauugcuaauu

SEQ ID NO: 3553200 - RNA, 17 nt, Human
aagagauuguuguuugc

SEQ ID NO: 3553201 - RNA, 13 nt, Human
aagagauuuuuca

SEQ ID NO: 3553202 - RNA, 14 nt, Human
aagagcaaaucaau

SEQ ID NO: 3553203 - RNA, 17 nt, Human
aagagcaaggaagguaa

SEQ ID NO: 3553204 - RNA, 19 nt, Human
aagagcaauguguggcuga

SEQ ID NO: 3553205 - RNA, 17 nt, Human
aagagcacaaacauuuu

SEQ ID NO: 3553206 - RNA, 21 nt, Human
aagagcacaaacauuuuucaa

SEQ ID NO: 3553207 - RNA, 13 nt, Human
aagagcacagccc

SEQ ID NO: 3553208 - RNA, 17 nt, Human
aagagcacuuaagagaa

SEQ ID NO: 3553209 - RNA, 21 nt, Human
aagagcacuuaagagaauauu

SEQ ID NO: 3553210 - RNA, 14 nt, Human
aagagcagaacaga

SEQ ID NO: 3553211 - RNA, 17 nt, Human
aagagcagcaccuccuc

SEQ ID NO: 3553212 - RNA, 13 nt, Human
aagagcagccugu

SEQ ID NO: 3553213 - RNA, 17 nt, Human
aagagcagccuguggca

SEQ ID NO: 3553214 - RNA, 22 nt, Human
aagagcagcuccuuccuagccu

SEQ ID NO: 3553215 - RNA, 15 nt, Human
aagagcaucaugccu

SEQ ID NO: 3553216 - RNA, 21 nt, Human
aagagcaucaugccucugagg

SEQ ID NO: 3553217 - RNA, 14 nt, Human
aagagcaucugauu

SEQ ID NO: 3553218 - RNA, 21 nt, Human
aagagccauguagaagcugca

SEQ ID NO: 3553219 - RNA, 23 nt, Human
aagagcccagucuguugaguuag

SEQ ID NO: 3553220 - RNA, 16 nt, Human
aagagccccacucuca

SEQ ID NO: 3553221 - RNA, 13 nt, Human
aagagcccuugcc

SEQ ID NO: 3553222 - RNA, 18 nt, Human
aagagcccuugccucccc

SEQ ID NO: 3553223 - RNA, 19 nt, Human
aagagccugaucucuuccu

SEQ ID NO: 3553224 - RNA, 12 nt, Human
aagagccugcag

SEQ ID NO: 3553225 - RNA, 16 nt, Human
aagagccuggagaagc

SEQ ID NO: 3553226 - RNA, 17 nt, Human
aagagccuggagaagcu

SEQ ID NO: 3553227 - RNA, 16 nt, Human
aagagccuuaaaacau

SEQ ID NO: 3553228 - RNA, 18 nt, Human
aagagccuuccacccagg

SEQ ID NO: 3553229 - RNA, 23 nt, Human
aagagcgagagaucaaagaugaa

SEQ ID NO: 3553230 - RNA, 16 nt, Human
aagagcuacauaauuu

SEQ ID NO: 3553231 - RNA, 22 nt, Human
aagagcuaggcagggugucugc

SEQ ID NO: 3553232 - RNA, 23 nt, Human
aagagcuaggcagggugucugcc

SEQ ID NO: 3553233 - RNA, 13 nt, Human
aagagcuauugcc

SEQ ID NO: 3553234 - RNA, 12 nt, Human
aagagcucagga

SEQ ID NO: 3553235 - RNA, 11 nt, Human
aagagcugagg

SEQ ID NO: 3553236 - RNA, 16 nt, Human
aagagcuguccuggua

SEQ ID NO: 3553237 - RNA, 14 nt, Human
aagagcuuagaaac

SEQ ID NO: 3553238 - RNA, 21 nt, Human
aagagcuuagaaacuggaaau

SEQ ID NO: 3553239 - RNA, 18 nt, Human
aagagcuuuacaaaaaga

SEQ ID NO: 3553240 - RNA, 21 nt, Human
aagaggaaaaugaauaauaca

SEQ ID NO: 3553241 - RNA, 15 nt, Human
aagaggaaagaauga

SEQ ID NO: 3553242 - RNA, 20 nt, Human
aagaggaacagcacugggga

SEQ ID NO: 3553243 - RNA, 14 nt, Human
aagaggaagcaaau

SEQ ID NO: 3553244 - RNA, 23 nt, Human
aagaggaaugaaguacucauaca

SEQ ID NO: 3553245 - RNA, 20 nt, Human
aagaggacucgcuuguaaau

SEQ ID NO: 3553246 - RNA, 18 nt, Human
aagaggagcacuuccaaa

SEQ ID NO: 3553247 - RNA, 20 nt, Human
aagaggaggggaagaggccu

SEQ ID NO: 3553248 - RNA, 20 nt, Human
aagaggaguuucgagguaga

SEQ ID NO: 3553249 - RNA, 14 nt, Human
aagaggcagggucu

SEQ ID NO: 3553250 - RNA, 15 nt, Human
aagaggcgggccagc

SEQ ID NO: 3553251 - RNA, 17 nt, Human
aagaggcguugcuuuca

SEQ ID NO: 3553252 - RNA, 22 nt, Human
aagaggcguugcuuucacucuc

SEQ ID NO: 3553253 - RNA, 18 nt, Human
aagaggcugaaagaggcc

SEQ ID NO: 3553254 - RNA, 13 nt, Human
aagaggcugaggc

SEQ ID NO: 3553255 - RNA, 21 nt, Human
aagaggcugauaauuccagug

SEQ ID NO: 3553256 - RNA, 21 nt, Human
aagaggcugccccucucacca

SEQ ID NO: 3553257 - RNA, 23 nt, Human
aagagggaagaaagagaaggagc

SEQ ID NO: 3553258 - RNA, 21 nt, Human
aagagggagggagggcuccag

SEQ ID NO: 3553259 - RNA, 13 nt, Human
aagaggggacagg

SEQ ID NO: 3553260 - RNA, 16 nt, Human
aagaggggcagcccuu

SEQ ID NO: 3553261 - RNA, 22 nt, Human
aagaggggugcagaggcugugg

SEQ ID NO: 3553262 - RNA, 15 nt, Human
aagagguacaggguu

SEQ ID NO: 3553263 - RNA, 20 nt, Human
aagagguacaggguuuuuac

SEQ ID NO: 3553264 - RNA, 21 nt, Human
aacaguuaauuaguuaacagu

SEQ ID NO: 3553265 - RNA, 17 nt, Human
aacaguugcacagcauc

SEQ ID NO: 3553266 - RNA, 18 nt, Human
aacaguugcacagcaucu

SEQ ID NO: 3553267 - RNA, 20 nt, Human
aacaguugcacagcaucuca

SEQ ID NO: 3553268 - RNA, 22 nt, Human
aacaguugcacagcaucucagc

SEQ ID NO: 3553269 - RNA, 14 nt, Human
aacaguugcaugua

SEQ ID NO: 3553270 - RNA, 22 nt, Human
aacaguugcauguaguaacacu

SEQ ID NO: 3553271 - RNA, 17 nt, Human
aacaguugguaacuuuu

SEQ ID NO: 3553272 - RNA, 23 nt, Human
aacaguuguauuuaacagaaauu

SEQ ID NO: 3553273 - RNA, 15 nt, Human
aacaguuuaaugaag

SEQ ID NO: 3553274 - RNA, 20 nt, Human
aacaguuuaaugaagaucua

SEQ ID NO: 3553275 - RNA, 13 nt, Human
aacaguuucaaaa

SEQ ID NO: 3553276 - RNA, 13 nt, Human
aacaguuuguaca

SEQ ID NO: 3553277 - RNA, 11 nt, Human
aacaguuuucc

SEQ ID NO: 3553278 - RNA, 16 nt, Human
aacaguuuuccaugaa

SEQ ID NO: 3553279 - RNA, 18 nt, Human
aacaguuuuccaugaaaa

SEQ ID NO: 3553280 - RNA, 17 nt, Human
aacaguuuuguguaacu

SEQ ID NO: 3553281 - RNA, 20 nt, Human
aacauaaaaaggacaucagc

SEQ ID NO: 3553282 - RNA, 22 nt, Human
aacauaaaaaguuaaaaaaaau

SEQ ID NO: 3553283 - RNA, 13 nt, Human
aacauaaaaauga

SEQ ID NO: 3553284 - RNA, 12 nt, Human
aacauaaaucug

SEQ ID NO: 3553285 - RNA, 14 nt, Human
aacauaaaucugug

SEQ ID NO: 3553286 - RNA, 15 nt, Human
aacauaaaucuguga

SEQ ID NO: 3553287 - RNA, 13 nt, Human
aacauaacauaaa

SEQ ID NO: 3553288 - RNA, 18 nt, Human
aacauaagcuauuuuucu

SEQ ID NO: 3553289 - RNA, 16 nt, Human
aacauaaucuaguuua

SEQ ID NO: 3553290 - RNA, 15 nt, Human
aacauaaugaaaaua

SEQ ID NO: 3553291 - RNA, 14 nt, Human
aacauacaaaugca

SEQ ID NO: 3553292 - RNA, 19 nt, Human
aacauacauuuuguaccaa

SEQ ID NO: 3553293 - RNA, 20 nt, Human
aacauaccccuuacaaauga

SEQ ID NO: 3553294 - RNA, 21 nt, Human
aacauacgugugcaugugucu

SEQ ID NO: 3553295 - RNA, 20 nt, Human
aacauacucccaucugugaa

SEQ ID NO: 3553296 - RNA, 19 nt, Human
aacauaguaaguucagcac

SEQ ID NO: 3553297 - RNA, 15 nt, Human
aacauauaaaauaau

SEQ ID NO: 3553298 - RNA, 18 nt, Human
aacauauaauguuguuau

SEQ ID NO: 3553299 - RNA, 22 nt, Human
aacauauaauguuguuauuuaa

SEQ ID NO: 3553300 - RNA, 14 nt, Human
aacauauggucucc

SEQ ID NO: 3553301 - RNA, 16 nt, Human
aacauauguacauaaa

SEQ ID NO: 3553302 - RNA, 19 nt, Human
aacauauguacauaaauug

SEQ ID NO: 3553303 - RNA, 14 nt, Human
aacauauuguugaa

SEQ ID NO: 3553304 - RNA, 13 nt, Human
aacaucacacaca

SEQ ID NO: 3553305 - RNA, 13 nt, Human
aacaucacagccc

SEQ ID NO: 3553306 - RNA, 17 nt, Human
aacaucacugaaaugcu

SEQ ID NO: 3553307 - RNA, 14 nt, Human
aacaucagcuugac

SEQ ID NO: 3553308 - RNA, 21 nt, Human
aacaucaguuacucugaaggg

SEQ ID NO: 3553309 - RNA, 16 nt, Human
aacaucaucaaggcac

SEQ ID NO: 3553310 - RNA, 14 nt, Human
aacaucauuagaac

SEQ ID NO: 3553311 - RNA, 11 nt, Human
aacauccaaaa

SEQ ID NO: 3553312 - RNA, 15 nt, Human
aacauccaaaaucuu

SEQ ID NO: 3553313 - RNA, 16 nt, Human
aacauccaaguggccu

SEQ ID NO: 3553314 - RNA, 24 nt, Human
aacauccaaguggccuccgucacu

SEQ ID NO: 3553315 - RNA, 21 nt, Human
aacauccaauaggaaugcuaa

SEQ ID NO: 3553316 - RNA, 22 nt, Human
aacauccaauaggaaugcuaac

SEQ ID NO: 3553317 - RNA, 15 nt, Human
aacauccacucucuc

SEQ ID NO: 3553318 - RNA, 15 nt, Human
aacaucccaagauuu

SEQ ID NO: 3553319 - RNA, 15 nt, Human
aacaucccuccuggg

SEQ ID NO: 3553320 - RNA, 22 nt, Human
aacauccuacaagacacaguga

SEQ ID NO: 3553321 - RNA, 12 nt, Human
aacauccugcca

SEQ ID NO: 3553322 - RNA, 14 nt, Human
aacauccugccagc

SEQ ID NO: 3553323 - RNA, 19 nt, Human
aacauccuucaagaacucu

SEQ ID NO: 3553324 - RNA, 20 nt, Human
aacaucuacaaaacauuaaa

SEQ ID NO: 3553325 - RNA, 16 nt, Human
aacaucuagaaauugc

SEQ ID NO: 3553326 - RNA, 16 nt, Human
aacaucugaaagccac

SEQ ID NO: 3553327 - RNA, 16 nt, Human
aacaucugaguccugg

SEQ ID NO: 3553328 - RNA, 22 nt, Human
aacaucuguccugugaaagacu

SEQ ID NO: 3553329 - RNA, 12 nt, Human
aacaucuuuaag

SEQ ID NO: 3553330 - RNA, 11 nt, Human
aacaucuuuuc

SEQ ID NO: 3553331 - RNA, 13 nt, Human
aacaugaaacacc

SEQ ID NO: 3553332 - RNA, 13 nt, Human
aagauacuuugua

SEQ ID NO: 3553333 - RNA, 14 nt, Human
aagauacuuuguau

SEQ ID NO: 3553334 - RNA, 14 nt, Human
aagauagaagaaaa

SEQ ID NO: 3553335 - RNA, 21 nt, Human
aagauagaagaaaaaagaaug

SEQ ID NO: 3553336 - RNA, 12 nt, Human
aagauagacagg

SEQ ID NO: 3553337 - RNA, 19 nt, Human
aagauagacagguccugau

SEQ ID NO: 3553338 - RNA, 23 nt, Human
aagauagauuuggaauaggaaua

SEQ ID NO: 3553339 - RNA, 15 nt, Human
aagauagcagggcau

SEQ ID NO: 3553340 - RNA, 20 nt, Human
aagauauaacuauugcccag

SEQ ID NO: 3553341 - RNA, 17 nt, Human
aagauauaagugcugua

SEQ ID NO: 3553342 - RNA, 20 nt, Human
aagauauaagugcuguauaa

SEQ ID NO: 3553343 - RNA, 21 nt, Human
aagauauaagugcuguauaaa

SEQ ID NO: 3553344 - RNA, 14 nt, Human
aagauauacaugaa

SEQ ID NO: 3553345 - RNA, 15 nt, Human
aagauauacuuguuu

SEQ ID NO: 3553346 - RNA, 19 nt, Human
aagauauacuuguuuuugu

SEQ ID NO: 3553347 - RNA, 21 nt, Human
aagauauauuaaaaauauaaa

SEQ ID NO: 3553348 - RNA, 16 nt, Human
aagauaucuuuucuuu

SEQ ID NO: 3553349 - RNA, 19 nt, Human
aagauaucuuuucuuuaga

SEQ ID NO: 3553350 - RNA, 13 nt, Human
aagauauggagaa

SEQ ID NO: 3553351 - RNA, 15 nt, Human
aagauauggagaauu

SEQ ID NO: 3553352 - RNA, 13 nt, Human
aagauauuauuca

SEQ ID NO: 3553353 - RNA, 13 nt, Human
aagauauuccuga

SEQ ID NO: 3553354 - RNA, 19 nt, Human
aagauauuugcaguuuuuc

SEQ ID NO: 3553355 - RNA, 19 nt, Human
aagauauuuuuaucuuuau

SEQ ID NO: 3553356 - RNA, 15 nt, Human
aagauauuuuucaug

SEQ ID NO: 3553357 - RNA, 21 nt, Human
aagaucaaaaaggcuuauaaa

SEQ ID NO: 3553358 - RNA, 22 nt, Human
aagaucaaaagcuuauucaucu

SEQ ID NO: 3553359 - RNA, 21 nt, Human
aagaucaaaauaaaaagugac

SEQ ID NO: 3553360 - RNA, 22 nt, Human
aagaucaaaauaaaaagugaca

SEQ ID NO: 3553361 - RNA, 15 nt, Human
aagaucacuuucuca

SEQ ID NO: 3553362 - RNA, 16 nt, Human
aagaucauguacccca

SEQ ID NO: 3553363 - RNA, 11 nt, Human
aagauccugug

SEQ ID NO: 3553364 - RNA, 16 nt, Human
aagaucgaauuuuuca

SEQ ID NO: 3553365 - RNA, 20 nt, Human
aagaucgguuaacaaauaac

SEQ ID NO: 3553366 - RNA, 14 nt, Human
aagaucuacaugaa

SEQ ID NO: 3553367 - RNA, 16 nt, Human
aagaucuauaaagcga

SEQ ID NO: 3553368 - RNA, 21 nt, Human
aagaucucacucugccccccc

SEQ ID NO: 3553369 - RNA, 18 nt, Human
aagaucucugcagggccg

SEQ ID NO: 3553370 - RNA, 14 nt, Human
aagaucucuuucua

SEQ ID NO: 3553371 - RNA, 20 nt, Human
aagaucuguuuugaaggcaa

SEQ ID NO: 3553372 - RNA, 16 nt, Human
aagaucuuagauucuc

SEQ ID NO: 3553373 - RNA, 17 nt, Human
aagaucuucaaaaguaa

SEQ ID NO: 3553374 - RNA, 13 nt, Human
aagaucuugcaga

SEQ ID NO: 3553375 - RNA, 19 nt, Human
aagaucuugcagaaguucu

SEQ ID NO: 3553376 - RNA, 15 nt, Human
aagaucuuuuauuuu

SEQ ID NO: 3553377 - RNA, 18 nt, Human
aagaucuuuuauuuugcc

SEQ ID NO: 3553378 - RNA, 15 nt, Human
aagaugaacagacug

SEQ ID NO: 3553379 - RNA, 23 nt, Human
aagaugaacccgaggcugagaau

SEQ ID NO: 3553380 - RNA, 14 nt, Human
aagaugaagaggau

SEQ ID NO: 3553381 - RNA, 23 nt, Human
aagaugaaggagaggcaacaucc

SEQ ID NO: 3553382 - RNA, 19 nt, Human
aagaugaauacauuuuguu

SEQ ID NO: 3553383 - RNA, 15 nt, Human
aagaugaaucaaugg

SEQ ID NO: 3553384 - RNA, 13 nt, Human
aagaugacacaag

SEQ ID NO: 3553385 - RNA, 16 nt, Human
aagaugacauugcuaa

SEQ ID NO: 3553386 - RNA, 22 nt, Human
aagaugacauugcuaagaugcu

SEQ ID NO: 3553387 - RNA, 13 nt, Human
aagaugacugagg

SEQ ID NO: 3553388 - RNA, 14 nt, Human
aagaugacugaggg

SEQ ID NO: 3553389 - RNA, 17 nt, Human
aagaugacuguguugua

SEQ ID NO: 3553390 - RNA, 13 nt, Human
aagaugaucauuu

SEQ ID NO: 3553391 - RNA, 16 nt, Human
aagaugcacuuugcuu

SEQ ID NO: 3553392 - RNA, 18 nt, Human
aagaugccaauuauuguu

SEQ ID NO: 3553393 - RNA, 15 nt, Human
aagaugccacauuca

SEQ ID NO: 3553394 - RNA, 16 nt, Human
aagaugccaucugugu

SEQ ID NO: 3553395 - RNA, 15 nt, Human
aagaugcucuucugu

SEQ ID NO: 3553396 - RNA, 10 nt, Human
aagaugcugg

SEQ ID NO: 3553397 - RNA, 16 nt, Human
aagaugcuggguuggu

SEQ ID NO: 3553398 - RNA, 12 nt, Human
aagaugcuuuua

SEQ ID NO: 3553399 - RNA, 18 nt, Human
aagauggaguuucuaagg

SEQ ID NO: 3553400 - RNA, 15 nt, Human
aagauggaugugcuu

SEQ ID NO: 3553401 - RNA, 14 nt, Human
aagauggauucuca

SEQ ID NO: 3553402 - RNA, 23 nt, Human
aagauggcacuuauaaccaaagc

SEQ ID NO: 3553403 - RNA, 19 nt, Human
aagauggcauaaccugucu

SEQ ID NO: 3553404 - RNA, 19 nt, Human
aagauggcucagaggggga

SEQ ID NO: 3553405 - RNA, 23 nt, Human
aagauggcugugccucugccugu

SEQ ID NO: 3553406 - RNA, 19 nt, Human
aagaugggcaucuuuugua

SEQ ID NO: 3553407 - RNA, 19 nt, Human
aagaugggggcagggcugu

SEQ ID NO: 3553408 - RNA, 18 nt, Human
aagauggggucuguaaaa

SEQ ID NO: 3553409 - RNA, 19 nt, Human
aagauggggucuguaaaau

SEQ ID NO: 3553410 - RNA, 22 nt, Human
aagauggggucuguaaaaucuu

SEQ ID NO: 3553411 - RNA, 18 nt, Human
aagaugggugaaggcugg

SEQ ID NO: 3553412 - RNA, 16 nt, Human
aagaugguacaaccuu

SEQ ID NO: 3553413 - RNA, 17 nt, Human
aagauguaccuggugga

SEQ ID NO: 3553414 - RNA, 17 nt, Human
aagauguacuauaacau

SEQ ID NO: 3553415 - RNA, 19 nt, Human
aagauguagaggagaaacu

SEQ ID NO: 3553416 - RNA, 16 nt, Human
aagauguagauuuauu

SEQ ID NO: 3553417 - RNA, 22 nt, Human
aagauguagauuuauuucauca

SEQ ID NO: 3553418 - RNA, 12 nt, Human
aagaugucuguu

SEQ ID NO: 3553419 - RNA, 16 nt, Human
aagaugucuguuugcu

SEQ ID NO: 3553420 - RNA, 11 nt, Human
aagaugugaaa

SEQ ID NO: 3553421 - RNA, 13 nt, Human
aagaugugaaaau

SEQ ID NO: 3553422 - RNA, 11 nt, Human
aagaugugaau

SEQ ID NO: 3553423 - RNA, 20 nt, Human
aagaugugauauucuaagac

SEQ ID NO: 3553424 - RNA, 21 nt, Human
aagaugugauauucuaagacu

SEQ ID NO: 3553425 - RNA, 17 nt, Human
aagaugugucuucaauu

SEQ ID NO: 3553426 - RNA, 21 nt, Human
aacauuuuguucuuacacaua

SEQ ID NO: 3553427 - RNA, 23 nt, Human
aacauuuuuuuuuuaaaucaagu

SEQ ID NO: 3553428 - RNA, 18 nt, Human
aaccaaaaagaccagacu

SEQ ID NO: 3553429 - RNA, 20 nt, Human
aaccaaaaagaccagacuaa

SEQ ID NO: 3553430 - RNA, 20 nt, Human
aaccaaaaguuauuaaaauu

SEQ ID NO: 3553431 - RNA, 20 nt, Human
aaccaaaaugacaucuuuuu

SEQ ID NO: 3553432 - RNA, 14 nt, Human
aaccaaaaugauac

SEQ ID NO: 3553433 - RNA, 16 nt, Human
aaccaaagagacugga

SEQ ID NO: 3553434 - RNA, 18 nt, Human
aaccaaaggacauuaugu

SEQ ID NO: 3553435 - RNA, 20 nt, Human
aaccaaaggugaaggaauau

SEQ ID NO: 3553436 - RNA, 21 nt, Human
aaccaaaggugaaggaauaua

SEQ ID NO: 3553437 - RNA, 23 nt, Human
aaccaaaggugaaggaauauaug

SEQ ID NO: 3553438 - RNA, 19 nt, Human
aaccaacaccaucacagcu

SEQ ID NO: 3553439 - RNA, 19 nt, Human
aaccaacccuucccugaaa

SEQ ID NO: 3553440 - RNA, 17 nt, Human
aaccaacuacaaccaag

SEQ ID NO: 3553441 - RNA, 15 nt, Human
aaccaagaggcuggu

SEQ ID NO: 3553442 - RNA, 15 nt, Human
aaccaagucaaguga

SEQ ID NO: 3553443 - RNA, 16 nt, Human
aaccaagucaugugca

SEQ ID NO: 3553444 - RNA, 10 nt, Human
aaccaaguuc

SEQ ID NO: 3553445 - RNA, 14 nt, Human
aaccaaucaagaua

SEQ ID NO: 3553446 - RNA, 16 nt, Human
aaccaaucuacaaucu

SEQ ID NO: 3553447 - RNA, 15 nt, Human
aaccaauguuuaaaa

SEQ ID NO: 3553448 - RNA, 13 nt, Human
aaccaauuauuuu

SEQ ID NO: 3553449 - RNA, 16 nt, Human
aaccacaaaacucauc

SEQ ID NO: 3553450 - RNA, 15 nt, Human
aaccacaaaggccaa

SEQ ID NO: 3553451 - RNA, 21 nt, Human
aaccacaaaggccaaacugcu

SEQ ID NO: 3553452 - RNA, 14 nt, Human
aaccacaacugaca

SEQ ID NO: 3553453 - RNA, 20 nt, Human
aaccacaacugacacaggaa

SEQ ID NO: 3553454 - RNA, 12 nt, Human
aaccacagcccu

SEQ ID NO: 3553455 - RNA, 15 nt, Human
aaccacagcccuguc

SEQ ID NO: 3553456 - RNA, 16 nt, Human
aaccacagcccuguca

SEQ ID NO: 3553457 - RNA, 13 nt, Human
aaccacagcuccu

SEQ ID NO: 3553458 - RNA, 19 nt, Human
aaccacagcuccuuuucca

SEQ ID NO: 3553459 - RNA, 15 nt, Human
aaccacagcugcugg

SEQ ID NO: 3553460 - RNA, 16 nt, Human
aaccacagcugcugga

SEQ ID NO: 3553461 - RNA, 18 nt, Human
aaccacagcugcuggaga

SEQ ID NO: 3553462 - RNA, 22 nt, Human
aaccacaguguaccauuaaaau

SEQ ID NO: 3553463 - RNA, 22 nt, Human
aaccacaucuugcucugcugac

SEQ ID NO: 3553464 - RNA, 14 nt, Human
aaccacauggcaca

SEQ ID NO: 3553465 - RNA, 17 nt, Human
aaccacauggcacagag

SEQ ID NO: 3553466 - RNA, 16 nt, Human
aaccaccaaaaacaaa

SEQ ID NO: 3553467 - RNA, 21 nt, Human
aaccaccccggcccccugccc

SEQ ID NO: 3553468 - RNA, 22 nt, Human
aaccaccccggcccccugcccg

SEQ ID NO: 3553469 - RNA, 17 nt, Human
aaccaccgcuccccagc

SEQ ID NO: 3553470 - RNA, 14 nt, Human
aaccacggaaaaga

SEQ ID NO: 3553471 - RNA, 16 nt, Human
aaccacggccacauuu

SEQ ID NO: 3553472 - RNA, 13 nt, Human
aaccacuuaaaaa

SEQ ID NO: 3553473 - RNA, 18 nt, Human
aaccacuuguagauuuga

SEQ ID NO: 3553474 - RNA, 22 nt, Human
aaccagaagcaacagaaaaaau

SEQ ID NO: 3553475 - RNA, 16 nt, Human
aaccagacaaggaaau

SEQ ID NO: 3553476 - RNA, 16 nt, Human
aaccagagcaagcuuu

SEQ ID NO: 3553477 - RNA, 19 nt, Human
aagauugagcucucugccc

SEQ ID NO: 3553478 - RNA, 14 nt, Human
aagauugauaucua

SEQ ID NO: 3553479 - RNA, 20 nt, Human
aagauugguguuuuuuucua

SEQ ID NO: 3553480 - RNA, 23 nt, Human
aagauugguguuuuuuucuaugg

SEQ ID NO: 3553481 - RNA, 17 nt, Human
aagauuuaauuugccaa

SEQ ID NO: 3553482 - RNA, 13 nt, Human
aagauuuagaaaa

SEQ ID NO: 3553483 - RNA, 21 nt, Human
aagauuuaggccaaucagaag

SEQ ID NO: 3553484 - RNA, 17 nt, Human
aagauuuccaagugcca

SEQ ID NO: 3553485 - RNA, 16 nt, Human
aagauuugcuuuaauu

SEQ ID NO: 3553486 - RNA, 21 nt, Human
aagauuuguacuacaguucuu

SEQ ID NO: 3553487 - RNA, 16 nt, Human
aagauuuguuuuuaaa

SEQ ID NO: 3553488 - RNA, 19 nt, Human
aagauuuguuuuuaaacug

SEQ ID NO: 3553489 - RNA, 22 nt, Human
aagauuuguuuuuaaacuguac

SEQ ID NO: 3553490 - RNA, 18 nt, Human
aagauuuuaaucaaguug

SEQ ID NO: 3553491 - RNA, 19 nt, Human
aagauuuuccucuugugau

SEQ ID NO: 3553492 - RNA, 20 nt, Human
aagauuuuccucuugugauu

SEQ ID NO: 3553493 - RNA, 18 nt, Human
aagauuuuccuuuuuuau

SEQ ID NO: 3553494 - RNA, 19 nt, Human
aagauuuugaaauuuuuau

SEQ ID NO: 3553495 - RNA, 17 nt, Human
aagauuuugaaugcuuc

SEQ ID NO: 3553496 - RNA, 21 nt, Human
aagauuuugaucucacauuuu

SEQ ID NO: 3553497 - RNA, 16 nt, Human
aagauuuuuuaauaau

SEQ ID NO: 3553498 - RNA, 18 nt, Human
aagauuuuuuaauuguuu

SEQ ID NO: 3553499 - RNA, 17 nt, Human
aagauuuuuucauuuca

SEQ ID NO: 3553500 - RNA, 13 nt, Human
aagcaaaaaauga

SEQ ID NO: 3553501 - RNA, 14 nt, Human
aagcaaaaaugcua

SEQ ID NO: 3553502 - RNA, 16 nt, Human
aagcaaaaaugcuaau

SEQ ID NO: 3553503 - RNA, 15 nt, Human
aagcaaaauaaaaac

SEQ ID NO: 3553504 - RNA, 14 nt, Human
aagcaaaauauuau

SEQ ID NO: 3553505 - RNA, 23 nt, Human
aagcaaaaucauuuuauauguca

SEQ ID NO: 3553506 - RNA, 19 nt, Human
aagcaaaauuuuuucucua

SEQ ID NO: 3553507 - RNA, 16 nt, Human
aagcaaacccagacgg

SEQ ID NO: 3553508 - RNA, 15 nt, Human
aagcaaagcacagag

SEQ ID NO: 3553509 - RNA, 16 nt, Human
aagcaaagcacagaga

SEQ ID NO: 3553510 - RNA, 17 nt, Human
aagcaaagcaccagcuu

SEQ ID NO: 3553511 - RNA, 14 nt, Human
aagcaaagggcucc

SEQ ID NO: 3553512 - RNA, 12 nt, Human
aagcaaagggga

SEQ ID NO: 3553513 - RNA, 18 nt, Human
aagcaaauacuuagcaaa

SEQ ID NO: 3553514 - RNA, 17 nt, Human
aagcaaaucagaaacuu

SEQ ID NO: 3553515 - RNA, 14 nt, Human
aagcaaaucauuug

SEQ ID NO: 3553516 - RNA, 19 nt, Human
aagcaaaucauuuguuuaa

SEQ ID NO: 3553517 - RNA, 16 nt, Human
aagcaaaugucaugcu

SEQ ID NO: 3553518 - RNA, 21 nt, Human
aagcaaaugucaugcugccuu

SEQ ID NO: 3553519 - RNA, 18 nt, Human
aagcaaaugugaccugug

SEQ ID NO: 3553520 - RNA, 13 nt, Human
aagcaacaauuuu

SEQ ID NO: 3553521 - RNA, 18 nt, Human
aagcaacaauuuucagau

SEQ ID NO: 3553522 - RNA, 20 nt, Human
aagcaacaauuuucagauuu

SEQ ID NO: 3553523 - RNA, 14 nt, Human
aagcaacagguuuu

SEQ ID NO: 3553524 - RNA, 13 nt, Human
aagcaacauggcu

SEQ ID NO: 3553525 - RNA, 20 nt, Human
aagcaacauucauagucuuu

SEQ ID NO: 3553526 - RNA, 15 nt, Human
aagcaaccaaaaaga

SEQ ID NO: 3553527 - RNA, 15 nt, Human
aagcaaccucaguaa

SEQ ID NO: 3553528 - RNA, 19 nt, Human
aagcaaccucaguaauuua

SEQ ID NO: 3553529 - RNA, 21 nt, Human
aagcaaccucaguaauuuaga

SEQ ID NO: 3553530 - RNA, 19 nt, Human
aagcaaccucccaacccag

SEQ ID NO: 3553531 - RNA, 20 nt, Human
aagcaaccuggguccaaaua

SEQ ID NO: 3553532 - RNA, 21 nt, Human
aagcaaccuggguccaaauaa

SEQ ID NO: 3553533 - RNA, 22 nt, Human
aagcaaccuggguccaaauaaa

SEQ ID NO: 3553534 - RNA, 17 nt, Human
aagcaacugucuauuuc

SEQ ID NO: 3553535 - RNA, 22 nt, Human
aagcaacugucuauuucugcug

SEQ ID NO: 3553536 - RNA, 23 nt, Human
aagcaacugucuauuucugcuga

SEQ ID NO: 3553537 - RNA, 23 nt, Human
aagcaagaaucagagaaggaaca

SEQ ID NO: 3553538 - RNA, 22 nt, Human
aagcaagaggccguggcugcug

SEQ ID NO: 3553539 - RNA, 14 nt, Human
aagcaagcaagagg

SEQ ID NO: 3553540 - RNA, 19 nt, Human
aagcaagcauucagaagaa

SEQ ID NO: 3553541 - RNA, 15 nt, Human
aagcaagcuaaccuu

SEQ ID NO: 3553542 - RNA, 13 nt, Human
aagcaagcuuaau

SEQ ID NO: 3553543 - RNA, 16 nt, Human
aagcaaggaucuuuca

SEQ ID NO: 3553544 - RNA, 22 nt, Human
aagcaagugauugggacagagg

SEQ ID NO: 3553545 - RNA, 20 nt, Human
aagcaauaaaauuuuuuugg

SEQ ID NO: 3553546 - RNA, 12 nt, Human
aagcaauagaaa

SEQ ID NO: 3553547 - RNA, 14 nt, Human
aagcaauagaaaca

SEQ ID NO: 3553548 - RNA, 15 nt, Human
aagcaauagaaacaa

SEQ ID NO: 3553549 - RNA, 17 nt, Human
aagcaauauuuuggagu

SEQ ID NO: 3553550 - RNA, 16 nt, Human
aagcaaugcauuuugg

SEQ ID NO: 3553551 - RNA, 13 nt, Human
aagcaauuuuccu

SEQ ID NO: 3553552 - RNA, 21 nt, Human
aagcaauuuuccuugaagccg

SEQ ID NO: 3553553 - RNA, 13 nt, Human
aagcacaaaggaa

SEQ ID NO: 3553554 - RNA, 19 nt, Human
aagcacaccaaucuuacuu

SEQ ID NO: 3553555 - RNA, 13 nt, Human
aagcacagucagg

SEQ ID NO: 3553556 - RNA, 20 nt, Human
aagcacagucugaugacaca

SEQ ID NO: 3553557 - RNA, 12 nt, Human
aagcacaguggu

SEQ ID NO: 3553558 - RNA, 14 nt, Human
aagcacaguggugg

SEQ ID NO: 3553559 - RNA, 20 nt, Human
aagcacagugguggcagggc

SEQ ID NO: 3553560 - RNA, 24 nt, Human
aagcacagugguggcagggccuag

SEQ ID NO: 3553561 - RNA, 13 nt, Human
aagcacaguguua

SEQ ID NO: 3553562 - RNA, 18 nt, Human
aagcacaguuugaacaaa

SEQ ID NO: 3553563 - RNA, 16 nt, Human
aagcacaucugcauuu

SEQ ID NO: 3553564 - RNA, 18 nt, Human
aagcacauuuuaaaagug

SEQ ID NO: 3553565 - RNA, 20 nt, Human
aagcaccagcuucuccaggc

SEQ ID NO: 3553566 - RNA, 14 nt, Human
aagcaccccaugcc

SEQ ID NO: 3553567 - RNA, 12 nt, Human
aagcacccuuga

SEQ ID NO: 3553568 - RNA, 13 nt, Human
aagcaccugccga

SEQ ID NO: 3553569 - RNA, 16 nt, Human
aagcacuaaacaaaga

SEQ ID NO: 3553570 - RNA, 19 nt, Human
aagcacuacaccuugccuu

SEQ ID NO: 3553571 - RNA, 23 nt, Human
aagcacuacauaaacugacuuua

SEQ ID NO: 3553572 - RNA, 12 nt, Human
aagcacucgugu

SEQ ID NO: 3553573 - RNA, 13 nt, Human
aagcacugaaaaa

SEQ ID NO: 3553574 - RNA, 17 nt, Human
aagcacugacuucuaag

SEQ ID NO: 3553575 - RNA, 12 nt, Human
aagcacugugcu

SEQ ID NO: 3553576 - RNA, 13 nt, Human
aagcacugugcua

SEQ ID NO: 3553577 - RNA, 16 nt, Human
aagcacugugcucagg

SEQ ID NO: 3553578 - RNA, 16 nt, Human
aagcacuguuuuucca

SEQ ID NO: 3553579 - RNA, 19 nt, Human
aagcacuuggacucuugcu

SEQ ID NO: 3553580 - RNA, 20 nt, Human
aagcacuuggacucuugcuc

SEQ ID NO: 3553581 - RNA, 12 nt, Human
aagcagaaagug

SEQ ID NO: 3553582 - RNA, 23 nt, Human
aagcagaaagugccuuucaggau

SEQ ID NO: 3553583 - RNA, 17 nt, Human
aagcagaauaaagcaau

SEQ ID NO: 3553584 - RNA, 19 nt, Human
aagcagaauaaagcaauuu

SEQ ID NO: 3553585 - RNA, 21 nt, Human
aagcagaauaaagcaauuuuc

SEQ ID NO: 3553586 - RNA, 22 nt, Human
aagaugcuggaugucugccaau

SEQ ID NO: 3553587 - RNA, 11 nt, Human
aagaugcuggg

SEQ ID NO: 3553588 - RNA, 17 nt, Human
aagauggauucucagau

SEQ ID NO: 3553589 - RNA, 18 nt, Human
aagauggcauccugugaa

SEQ ID NO: 3553590 - RNA, 17 nt, Human
aagauggcucagagggg

SEQ ID NO: 3553591 - RNA, 21 nt, Human
aagauggcucagagggggacu

SEQ ID NO: 3553592 - RNA, 20 nt, Human
aagauggcugugccucugcc

SEQ ID NO: 3553593 - RNA, 22 nt, Human
aagaugggcaucuuuuguauua

SEQ ID NO: 3553594 - RNA, 17 nt, Human
aagauggggucuguaaa

SEQ ID NO: 3553595 - RNA, 18 nt, Human
aagaugguaucauauauu

SEQ ID NO: 3553596 - RNA, 20 nt, Human
aagaugguguggguguccug

SEQ ID NO: 3553597 - RNA, 13 nt, Human
aagauguagagga

SEQ ID NO: 3553598 - RNA, 13 nt, Human
aagauguagcaaa

SEQ ID NO: 3553599 - RNA, 23 nt, Human
aagauguagcaaacccugucaaa

SEQ ID NO: 3553600 - RNA, 21 nt, Human
aagauguagcgcuuugaauau

SEQ ID NO: 3553601 - RNA, 14 nt, Human
aagauguauauagg

SEQ ID NO: 3553602 - RNA, 16 nt, Human
aagaugucagacuggc

SEQ ID NO: 3553603 - RNA, 14 nt, Human
aagaugugaaaauu

SEQ ID NO: 3553604 - RNA, 12 nt, Human
aagaugugaauu

SEQ ID NO: 3553605 - RNA, 20 nt, Human
aagaugugaauuauugacac

SEQ ID NO: 3553606 - RNA, 21 nt, Human
aagaugugaauuauugacacu

SEQ ID NO: 3553607 - RNA, 16 nt, Human
aagaugugauauucua

SEQ ID NO: 3553608 - RNA, 17 nt, Human
aagaugugauauucuaa

SEQ ID NO: 3553609 - RNA, 18 nt, Human
aagaugugcagcauuuca

SEQ ID NO: 3553610 - RNA, 21 nt, Human
aagaugugcagcauuucacuu

SEQ ID NO: 3553611 - RNA, 12 nt, Human
aagauguuauau

SEQ ID NO: 3553612 - RNA, 18 nt, Human
aagauguuauauuuuucu

SEQ ID NO: 3553613 - RNA, 18 nt, Human
aagauguuuaacuuaauc

SEQ ID NO: 3553614 - RNA, 20 nt, Human
aagauuacaaaucagaaguc

SEQ ID NO: 3553615 - RNA, 18 nt, Human
aagauuagaaugaaaauu

SEQ ID NO: 3553616 - RNA, 24 nt, Human
aagauuagcaaggucauuucuuca

SEQ ID NO: 3553617 - RNA, 16 nt, Human
aagauuauagauucua

SEQ ID NO: 3553618 - RNA, 19 nt, Human
aagauuauuuuauuaugcg

SEQ ID NO: 3553619 - RNA, 15 nt, Human
aagauucagcuagug

SEQ ID NO: 3553620 - RNA, 15 nt, Human
aagauucccagagac

SEQ ID NO: 3553621 - RNA, 20 nt, Human
aagauucccagagacaggaa

SEQ ID NO: 3553622 - RNA, 16 nt, Human
aaggccugucccuggc

SEQ ID NO: 3553623 - RNA, 11 nt, Human
aaggccuuaag

SEQ ID NO: 3553624 - RNA, 17 nt, Human
aaggccuuuaaaauuuu

SEQ ID NO: 3553625 - RNA, 18 nt, Human
aaggcgcuaacuugcuua

SEQ ID NO: 3553626 - RNA, 13 nt, Human
aaggcggccccuc

SEQ ID NO: 3553627 - RNA, 18 nt, Human
aaggcgggagcaucucuu

SEQ ID NO: 3553628 - RNA, 14 nt, Human
aaggcguggagcug

SEQ ID NO: 3553629 - RNA, 16 nt, Human
aaggcuaaaaagcaac

SEQ ID NO: 3553630 - RNA, 16 nt, Human
aaggcuaaaacuuaac

SEQ ID NO: 3553631 - RNA, 21 nt, Human
aaggcuaccuuauuguacguu

SEQ ID NO: 3553632 - RNA, 20 nt, Human
aaggcuacuucggggcuggg

SEQ ID NO: 3553633 - RNA, 23 nt, Human
aaggcuacuucggggcugggaag

SEQ ID NO: 3553634 - RNA, 19 nt, Human
aaggcuccaggagcagcca

SEQ ID NO: 3553635 - RNA, 15 nt, Human
aaggcuccauauaua

SEQ ID NO: 3553636 - RNA, 16 nt, Human
aaggcucgagcaugcc

SEQ ID NO: 3553637 - RNA, 22 nt, Human
aaggcucgagcaugccuggaug

SEQ ID NO: 3553638 - RNA, 17 nt, Human
aaggcucgauuuuguau

SEQ ID NO: 3553639 - RNA, 13 nt, Human
aaggcucuagauc

SEQ ID NO: 3553640 - RNA, 16 nt, Human
aaggcucuaugagucu

SEQ ID NO: 3553641 - RNA, 21 nt, Human
aaggcucuaugagucuagaug

SEQ ID NO: 3553642 - RNA, 21 nt, Human
aagcuacagguuacaacagau

SEQ ID NO: 3553643 - RNA, 13 nt, Human
aagcuacuuauug

SEQ ID NO: 3553644 - RNA, 16 nt, Human
aagcuagaaccuggag

SEQ ID NO: 3553645 - RNA, 17 nt, Human
aagcuagaaggccacau

SEQ ID NO: 3553646 - RNA, 19 nt, Human
aagcuagaauugaguguuu

SEQ ID NO: 3553647 - RNA, 15 nt, Human
aagcuagacacauga

SEQ ID NO: 3553648 - RNA, 16 nt, Human
aagcuagacacaugaa

SEQ ID NO: 3553649 - RNA, 15 nt, Human
aagcuagcuccccuc

SEQ ID NO: 3553650 - RNA, 22 nt, Human
aagcuaggccuggccagaugca

SEQ ID NO: 3553651 - RNA, 15 nt, Human
aagcuaggugcuaau

SEQ ID NO: 3553652 - RNA, 12 nt, Human
aagcuagucuuu

SEQ ID NO: 3553653 - RNA, 19 nt, Human
aagcuagucuuuugcuuuu

SEQ ID NO: 3553654 - RNA, 19 nt, Human
aagcuaguugaauacuuga

SEQ ID NO: 3553655 - RNA, 20 nt, Human
aagcuaguugaauacuugaa

SEQ ID NO: 3553656 - RNA, 21 nt, Human
aagcuaguugaauacuugaac

SEQ ID NO: 3553657 - RNA, 20 nt, Human
aagcuauaaagcaguauuuu

SEQ ID NO: 3553658 - RNA, 14 nt, Human
aagcuauaaauuau

SEQ ID NO: 3553659 - RNA, 17 nt, Human
aagcuaucguaaaauua

SEQ ID NO: 3553660 - RNA, 15 nt, Human
aagcuaucuucaugu

SEQ ID NO: 3553661 - RNA, 15 nt, Human
aagcuauggugagau

SEQ ID NO: 3553662 - RNA, 21 nt, Human
aagcuauggugagaugcagcu

SEQ ID NO: 3553663 - RNA, 18 nt, Human
aagcuauuuaugggcccc

SEQ ID NO: 3553664 - RNA, 14 nt, Human
aagcuauuugaugu

SEQ ID NO: 3553665 - RNA, 16 nt, Human
aagcuauuugauguaa

SEQ ID NO: 3553666 - RNA, 23 nt, Human
aagcuauuugauguaauacuucu

SEQ ID NO: 3553667 - RNA, 21 nt, Human
aagcucaaagguuuggaagga

SEQ ID NO: 3553668 - RNA, 18 nt, Human
aagcucaaauaaaaauaa

SEQ ID NO: 3553669 - RNA, 19 nt, Human
aagcucaaguguucacaac

SEQ ID NO: 3553670 - RNA, 20 nt, Human
aagcucacagaccuuugaac

SEQ ID NO: 3553671 - RNA, 19 nt, Human
aagcucacaguuccucgcc

SEQ ID NO: 3553672 - RNA, 16 nt, Human
aagcucagaaggcucu

SEQ ID NO: 3553673 - RNA, 14 nt, Human
aagcucagaaucca

SEQ ID NO: 3553674 - RNA, 13 nt, Human
aagcucagcccac

SEQ ID NO: 3553675 - RNA, 17 nt, Human
aagcucagggccuggcu

SEQ ID NO: 3553676 - RNA, 12 nt, Human
aagcucauauuu

SEQ ID NO: 3553677 - RNA, 22 nt, Human
aagcucauauuuuguauauauc

SEQ ID NO: 3553678 - RNA, 16 nt, Human
aagcuccacugucacc

SEQ ID NO: 3553679 - RNA, 14 nt, Human
aagcuccagguaga

SEQ ID NO: 3553680 - RNA, 11 nt, Human
aagcucccagg

SEQ ID NO: 3553681 - RNA, 15 nt, Human
aagcucccccagcaa

SEQ ID NO: 3553682 - RNA, 11 nt, Human
aagcucccugc

SEQ ID NO: 3553683 - RNA, 16 nt, Human
aagcucccugccccaa

SEQ ID NO: 3553684 - RNA, 17 nt, Human
aagcucccugccccaaa

SEQ ID NO: 3553685 - RNA, 15 nt, Human
aagcuccgcaggacu

SEQ ID NO: 3553686 - RNA, 17 nt, Human
aagcuccuccucccugc

SEQ ID NO: 3553687 - RNA, 19 nt, Human
aagcuccuccucccugcau

SEQ ID NO: 3553688 - RNA, 21 nt, Human
aagcuccuccucccugcaucu

SEQ ID NO: 3553689 - RNA, 17 nt, Human
aagcuccuccucggaac

SEQ ID NO: 3553690 - RNA, 18 nt, Human
aagcuccucuccccagcc

SEQ ID NO: 3553691 - RNA, 19 nt, Human
aagcuccuggucuugagau

SEQ ID NO: 3553692 - RNA, 13 nt, Human
aagcuccuguccu

SEQ ID NO: 3553693 - RNA, 17 nt, Human
aagcuccuguccuccca

SEQ ID NO: 3553694 - RNA, 20 nt, Human
aagcuccuguccucccaucc

SEQ ID NO: 3553695 - RNA, 22 nt, Human
aagcuccuguccucccaucccc

SEQ ID NO: 3553696 - RNA, 23 nt, Human
aagcucgauguggucacagcugu

SEQ ID NO: 3553697 - RNA, 12 nt, Human
aagcucugaagu

SEQ ID NO: 3553698 - RNA, 12 nt, Human
aagcucugacau

SEQ ID NO: 3553699 - RNA, 16 nt, Human
aagcucugaccacuug

SEQ ID NO: 3553700 - RNA, 12 nt, Human
aagcucugagcu

SEQ ID NO: 3553701 - RNA, 16 nt, Human
aagcucugagcuguca

SEQ ID NO: 3553702 - RNA, 14 nt, Human
aagcucugcuauua

SEQ ID NO: 3553703 - RNA, 17 nt, Human
aagcucugcuccucucc

SEQ ID NO: 3553704 - RNA, 11 nt, Human
aagcucuggcu

SEQ ID NO: 3553705 - RNA, 21 nt, Human
aagcucuggcugaacccugug

SEQ ID NO: 3553706 - RNA, 23 nt, Human
aagcucuggcugaacccugugcu

SEQ ID NO: 3553707 - RNA, 22 nt, Human
aagcucuuacacuacauuagaa

SEQ ID NO: 3553708 - RNA, 19 nt, Human
aagcucuugaagacacuga

SEQ ID NO: 3553709 - RNA, 16 nt, Human
aagcucuuugaaacaa

SEQ ID NO: 3553710 - RNA, 12 nt, Human
aagcugaaaaua

SEQ ID NO: 3553711 - RNA, 13 nt, Human
aagcugaaauuuu

SEQ ID NO: 3553712 - RNA, 15 nt, Human
aagcugaagccgcca

SEQ ID NO: 3553713 - RNA, 19 nt, Human
aagcugaagugcauccaaa

SEQ ID NO: 3553714 - RNA, 21 nt, Human
aagcugaagugcauccaaagg

SEQ ID NO: 3553715 - RNA, 23 nt, Human
aagcugaauacauucugcuuuca

SEQ ID NO: 3553716 - RNA, 21 nt, Human
aagcugaaucagacaguggau

SEQ ID NO: 3553717 - RNA, 20 nt, Human
aagcugacgaacuuccaugg

SEQ ID NO: 3553718 - RNA, 17 nt, Human
aagcugacuuggcuggu

SEQ ID NO: 3553719 - RNA, 19 nt, Human
aagcugacuuggcuggugu

SEQ ID NO: 3553720 - RNA, 14 nt, Human
aagcugaggcggga

SEQ ID NO: 3553721 - RNA, 19 nt, Human
aagcugaggugcccaggag

SEQ ID NO: 3553722 - RNA, 18 nt, Human
aagcugaguauuaaaaug

SEQ ID NO: 3553723 - RNA, 19 nt, Human
aagcugaguauuaaaaugu

SEQ ID NO: 3553724 - RNA, 22 nt, Human
aagcugaucauaagugaauuua

SEQ ID NO: 3553725 - RNA, 19 nt, Human
aagcugauuacugucaaua

SEQ ID NO: 3553726 - RNA, 18 nt, Human
aagcugauuuuuuuuaau

SEQ ID NO: 3553727 - RNA, 15 nt, Human
aagcugcaaaucuga

SEQ ID NO: 3553728 - RNA, 13 nt, Human
aagcugcacccuc

SEQ ID NO: 3553729 - RNA, 19 nt, Human
aagcugcacccucaggcag

SEQ ID NO: 3553730 - RNA, 12 nt, Human
aagcugcagcuu

SEQ ID NO: 3553731 - RNA, 14 nt, Human
aagcugcagcuucc

SEQ ID NO: 3553732 - RNA, 15 nt, Human
aagcugcagcuuccu

SEQ ID NO: 3553733 - RNA, 17 nt, Human
aagcugcagcuuccugu

SEQ ID NO: 3553734 - RNA, 15 nt, Human
aagcugccucccugu

SEQ ID NO: 3553735 - RNA, 12 nt, Human
aagcugccugcu

SEQ ID NO: 3553736 - RNA, 15 nt, Human
aagcugccugcuuuu

SEQ ID NO: 3553737 - RNA, 14 nt, Human
aagcugccuguagu

SEQ ID NO: 3553738 - RNA, 19 nt, Human
aagcugccuguaguuagga

SEQ ID NO: 3553739 - RNA, 17 nt, Human
aagcugcuccaggccug

SEQ ID NO: 3553740 - RNA, 16 nt, Human
aagcugcucuggaauu

SEQ ID NO: 3553741 - RNA, 14 nt, Human
aagcugcugacagu

SEQ ID NO: 3553742 - RNA, 21 nt, Human
aagcugcugaccaauugugcu

SEQ ID NO: 3553743 - RNA, 14 nt, Human
aagcugcuuuauuc

SEQ ID NO: 3553744 - RNA, 14 nt, Human
aagcugcuuuugac

SEQ ID NO: 3553745 - RNA, 20 nt, Human
aagcuggcugggguggccug

SEQ ID NO: 3553746 - RNA, 23 nt, Human
aagcuggcugggguggccugugu

SEQ ID NO: 3553747 - RNA, 18 nt, Human
aagcuggucccacucagu

SEQ ID NO: 3553748 - RNA, 19 nt, Human
aagcugguggcagaguccu

SEQ ID NO: 3553749 - RNA, 17 nt, Human
aagcugguggccuuggc

SEQ ID NO: 3553750 - RNA, 17 nt, Human
aagcuggugggugaaag

SEQ ID NO: 3553751 - RNA, 17 nt, Human
aagcuguaaaaagagag

SEQ ID NO: 3553752 - RNA, 17 nt, Human
aagcugugacccucaau

SEQ ID NO: 3553753 - RNA, 22 nt, Human
aagcugugagacagugggaaau

SEQ ID NO: 3553754 - RNA, 20 nt, Human
aagcuguguccuugcaccug

SEQ ID NO: 3553755 - RNA, 22 nt, Human
aagcuguguccuugcaccugca

SEQ ID NO: 3553756 - RNA, 20 nt, Human
aagcuguuaaacuguuagca

SEQ ID NO: 3553757 - RNA, 18 nt, Human
aagcuguuacugucuuca

SEQ ID NO: 3553758 - RNA, 14 nt, Human
aagcuguucuuccu

SEQ ID NO: 3553759 - RNA, 15 nt, Human
aagcuguucuuccug

SEQ ID NO: 3553760 - RNA, 14 nt, Human
aagcuguuguacau

SEQ ID NO: 3553761 - RNA, 23 nt, Human
aagcuguuuccauagggugacac

SEQ ID NO: 3553762 - RNA, 21 nt, Human
aagcuguuuggaaaagacagu

SEQ ID NO: 3553763 - RNA, 20 nt, Human
aagcuguuugguuuuaaaau

SEQ ID NO: 3553764 - RNA, 15 nt, Human
aagcuuaaaaaaaac

SEQ ID NO: 3553765 - RNA, 19 nt, Human
aagcuuaauggcugauaau

SEQ ID NO: 3553766 - RNA, 16 nt, Human
aagcuuagcaggagag

SEQ ID NO: 3553767 - RNA, 13 nt, Human
aagggucaggccu

SEQ ID NO: 3553768 - RNA, 20 nt, Human
aagggucaggccuuugagcu

SEQ ID NO: 3553769 - RNA, 17 nt, Human
aagggucuagggagaga

SEQ ID NO: 3553770 - RNA, 24 nt, Human
aagggucuccgaaaugcugucuuu

SEQ ID NO: 3553771 - RNA, 15 nt, Human
aagggucuugggaaa

SEQ ID NO: 3553772 - RNA, 16 nt, Human
aagggugaaaauuauu

SEQ ID NO: 3553773 - RNA, 21 nt, Human
aaggguguugggagggugguu

SEQ ID NO: 3553774 - RNA, 17 nt, Human
aaggguucuggcugccc

SEQ ID NO: 3553775 - RNA, 16 nt, Human
aaggguucuguaaaau

SEQ ID NO: 3553776 - RNA, 17 nt, Human
aaggguuuguggcuggg

SEQ ID NO: 3553777 - RNA, 20 nt, Human
aaggguuuguggcugggggc

SEQ ID NO: 3553778 - RNA, 16 nt, Human
aaggguuuuaauguag

SEQ ID NO: 3553779 - RNA, 21 nt, Human
aaggguuuuccacccuggaau

SEQ ID NO: 3553780 - RNA, 22 nt, Human
aagguaaaaugccaugaugccu

SEQ ID NO: 3553781 - RNA, 14 nt, Human
aagguacuucaaau

SEQ ID NO: 3553782 - RNA, 19 nt, Human
aagguacuuucauauuuua

SEQ ID NO: 3553783 - RNA, 22 nt, Human
aagguacuuucauauuuuaaac

SEQ ID NO: 3553784 - RNA, 17 nt, Human
aagguagaaccucaccu

SEQ ID NO: 3553785 - RNA, 20 nt, Human
aagguagcauucuuuggagu

SEQ ID NO: 3553786 - RNA, 14 nt, Human
aagguagccauccc

SEQ ID NO: 3553787 - RNA, 20 nt, Human
aagguagcuuaccugacaca

SEQ ID NO: 3553788 - RNA, 22 nt, Human
aagguaggguaggcagccugag

SEQ ID NO: 3553789 - RNA, 18 nt, Human
aagguauaauaaaauuau

SEQ ID NO: 3553790 - RNA, 11 nt, Human
aagguauaauu

SEQ ID NO: 3553791 - RNA, 16 nt, Human
aagguauaucauucua

SEQ ID NO: 3553792 - RNA, 19 nt, Human
aagguaucaguugcaauaa

SEQ ID NO: 3553793 - RNA, 22 nt, Human
aagguauuccuuuuguguacag

SEQ ID NO: 3553794 - RNA, 17 nt, Human
aagguauuugggaaacu

SEQ ID NO: 3553795 - RNA, 21 nt, Human
aagguauuugggaaacuuguc

SEQ ID NO: 3553796 - RNA, 22 nt, Human
aagguauuugggaaacuuguca

SEQ ID NO: 3553797 - RNA, 19 nt, Human
aagguauuuugaauaccau

SEQ ID NO: 3553798 - RNA, 12 nt, Human
aaggucauuuuu

SEQ ID NO: 3553799 - RNA, 20 nt, Human
aaggucguuuuuuucauucc

SEQ ID NO: 3553800 - RNA, 13 nt, Human
aaggucugagcca

SEQ ID NO: 3553801 - RNA, 18 nt, Human
aaggucuguuugcuguug

SEQ ID NO: 3553802 - RNA, 18 nt, Human
aacuguuagcacuguuga

SEQ ID NO: 3553803 - RNA, 16 nt, Human
aacuguuaugaaauaa

SEQ ID NO: 3553804 - RNA, 17 nt, Human
aacuguuauuuauaauc

SEQ ID NO: 3553805 - RNA, 15 nt, Human
aacuguucccaccug

SEQ ID NO: 3553806 - RNA, 18 nt, Human
aacuguugccagagaugg

SEQ ID NO: 3553807 - RNA, 18 nt, Human
aacuguuguagaagacaa

SEQ ID NO: 3553808 - RNA, 19 nt, Human
aacuguuguagaagacaaa

SEQ ID NO: 3553809 - RNA, 16 nt, Human
aacuguuucaaagcca

SEQ ID NO: 3553810 - RNA, 17 nt, Human
aacuuaaaaaaaugaca

SEQ ID NO: 3553811 - RNA, 14 nt, Human
aacuuaaauaauaa

SEQ ID NO: 3553812 - RNA, 15 nt, Human
aacuuaaauguuauu

SEQ ID NO: 3553813 - RNA, 16 nt, Human
aacuuaacauauuuac

SEQ ID NO: 3553814 - RNA, 15 nt, Human
aacuuaacaugggcu

SEQ ID NO: 3553815 - RNA, 15 nt, Human
aacuuaagaaacacu

SEQ ID NO: 3553816 - RNA, 14 nt, Human
aacuuaagcaaagg

SEQ ID NO: 3553817 - RNA, 20 nt, Human
aacuuaauaaucaagagccu

SEQ ID NO: 3553818 - RNA, 16 nt, Human
aacuuaaucuaaaugg

SEQ ID NO: 3553819 - RNA, 13 nt, Human
aacuuaaugaaaa

SEQ ID NO: 3553820 - RNA, 23 nt, Human
aacuuaauguucuuaugcaaaau

SEQ ID NO: 3553821 - RNA, 21 nt, Human
aacuuacauuguucaauuaga

SEQ ID NO: 3553822 - RNA, 22 nt, Human
aacuuacauuguucaauuagaa

SEQ ID NO: 3553823 - RNA, 23 nt, Human
aacuuacccuguauaucagggua

SEQ ID NO: 3553824 - RNA, 15 nt, Human
aacuuacugauuauu

SEQ ID NO: 3553825 - RNA, 14 nt, Human
aacuuacuuagugu

SEQ ID NO: 3553826 - RNA, 15 nt, Human
aacuuagaauaaaau

SEQ ID NO: 3553827 - RNA, 20 nt, Human
aacuuagacucuaguauuua

SEQ ID NO: 3553828 - RNA, 16 nt, Human
aacuuagcauguguug

SEQ ID NO: 3553829 - RNA, 21 nt, Human
aacuuagcuuaugaguagcuu

SEQ ID NO: 3553830 - RNA, 19 nt, Human
aacuuaguguaauauacca

SEQ ID NO: 3553831 - RNA, 12 nt, Human
aacuuaguuuug

SEQ ID NO: 3553832 - RNA, 14 nt, Human
aacuuauaaaucau

SEQ ID NO: 3553833 - RNA, 23 nt, Human
aacuuauaucaucagcauaccuu

SEQ ID NO: 3553834 - RNA, 12 nt, Human
aacuuauauuga

SEQ ID NO: 3553835 - RNA, 21 nt, Human
aacuuauauuguaagaaauac

SEQ ID NO: 3553836 - RNA, 16 nt, Human
aacuuaugaauguuuc

SEQ ID NO: 3553837 - RNA, 21 nt, Human
aacuuaugaccucuuccuuua

SEQ ID NO: 3553838 - RNA, 14 nt, Human
aacuuauguagaua

SEQ ID NO: 3553839 - RNA, 22 nt, Human
aacuuauucaaagagaaaacau

SEQ ID NO: 3553840 - RNA, 19 nt, Human
aacuuauuuuaaauaugcc

SEQ ID NO: 3553841 - RNA, 18 nt, Human
aacuuauuuuuuucugau

SEQ ID NO: 3553842 - RNA, 22 nt, Human
aacuuauuuuuuucugauugua

SEQ ID NO: 3553843 - RNA, 14 nt, Human
aacuucaacauuua

SEQ ID NO: 3553844 - RNA, 16 nt, Human
aacuucacaacuaggc

SEQ ID NO: 3553845 - RNA, 13 nt, Human
aacuucacauauu

SEQ ID NO: 3553846 - RNA, 22 nt, Human
aacuucaccauauuaccacaga

SEQ ID NO: 3553847 - RNA, 23 nt, Human
aacuucagagggaaaguaaauau

SEQ ID NO: 3553848 - RNA, 17 nt, Human
aacuucagcuguacuuc

SEQ ID NO: 3553849 - RNA, 21 nt, Human
aacuucaggauaauaaagugu

SEQ ID NO: 3553850 - RNA, 19 nt, Human
aacuucaguuucacagaaa

SEQ ID NO: 3553851 - RNA, 16 nt, Human
aacuucaucuggaagu

SEQ ID NO: 3553852 - RNA, 16 nt, Human
aacuucaucugucugu

SEQ ID NO: 3553853 - RNA, 12 nt, Human
aacuucauggau

SEQ ID NO: 3553854 - RNA, 13 nt, Human
aacuuccaaagaa

SEQ ID NO: 3553855 - RNA, 14 nt, Human
aacuuccaaagaaa

SEQ ID NO: 3553856 - RNA, 17 nt, Human
aacuuccaaagaaaguu

SEQ ID NO: 3553857 - RNA, 23 nt, Human
aacuuccaaauaaauaauuuuca

SEQ ID NO: 3553858 - RNA, 22 nt, Human
aacuuccagguguuacuguaau

SEQ ID NO: 3553859 - RNA, 23 nt, Human
aacuuccccauacaaauaagcau

SEQ ID NO: 3553860 - RNA, 17 nt, Human
aacuuccccaucuucua

SEQ ID NO: 3553861 - RNA, 22 nt, Human
aacuucccgucccauauccugc

SEQ ID NO: 3553862 - RNA, 23 nt, Human
aacuucccgucccauauccugcc

SEQ ID NO: 3553863 - RNA, 15 nt, Human
aacuuccugcaggua

SEQ ID NO: 3553864 - RNA, 23 nt, Human
aacuucgcaucaaaagacaauuc

SEQ ID NO: 3553865 - RNA, 13 nt, Human
aacuucuaaaacu

SEQ ID NO: 3553866 - RNA, 23 nt, Human
aacuucuaaaacuguacuuugau

SEQ ID NO: 3553867 - RNA, 16 nt, Human
aacuucuaauugccau

SEQ ID NO: 3553868 - RNA, 17 nt, Human
aacuucuaauugccaug

SEQ ID NO: 3553869 - RNA, 14 nt, Human
aacuucucucagac

SEQ ID NO: 3553870 - RNA, 22 nt, Human
aacuucugcaacaagcaugcag

SEQ ID NO: 3553871 - RNA, 15 nt, Human
aacuucuuauggaau

SEQ ID NO: 3553872 - RNA, 16 nt, Human
aacuucuuauggaauu

SEQ ID NO: 3553873 - RNA, 19 nt, Human
aacuucuuauggaauugau

SEQ ID NO: 3553874 - RNA, 24 nt, Human
aacuucuuauggaauugauuugca

SEQ ID NO: 3553875 - RNA, 11 nt, Human
aacuucuucag

SEQ ID NO: 3553876 - RNA, 12 nt, Human
aacuucuugcuu

SEQ ID NO: 3553877 - RNA, 18 nt, Human
aacuucuugcuucuuucu

SEQ ID NO: 3553878 - RNA, 14 nt, Human
aacuucuugucaga

SEQ ID NO: 3553879 - RNA, 16 nt, Human
aacuucuugucagaca

SEQ ID NO: 3553880 - RNA, 18 nt, Human
aacuucuugucagacaua

SEQ ID NO: 3553881 - RNA, 22 nt, Human
aacuucuugucagacauaaagc

SEQ ID NO: 3553882 - RNA, 14 nt, Human
aacuugaaaauaua

SEQ ID NO: 3553883 - RNA, 19 nt, Human
aacuugaaauuauaucugu

SEQ ID NO: 3553884 - RNA, 18 nt, Human
aacuugaagccugcuccu

SEQ ID NO: 3553885 - RNA, 21 nt, Human
aacuugagaacuuuauuucca

SEQ ID NO: 3553886 - RNA, 21 nt, Human
aacuugagccugucaagaggc

SEQ ID NO: 3553887 - RNA, 22 nt, Human
aacuugagcgugaaucuguauc

SEQ ID NO: 3553888 - RNA, 13 nt, Human
aacuugaggacac

SEQ ID NO: 3553889 - RNA, 17 nt, Human
aacuugaggacacaugu

SEQ ID NO: 3553890 - RNA, 18 nt, Human
aacuugaggacacauguc

SEQ ID NO: 3553891 - RNA, 23 nt, Human
aacuugagguggccuccuugcuu

SEQ ID NO: 3553892 - RNA, 18 nt, Human
aacuugcaaaaucaguuu

SEQ ID NO: 3553893 - RNA, 14 nt, Human
aacuugccuuugaa

SEQ ID NO: 3553894 - RNA, 15 nt, Human
aacuugccuuugaag

SEQ ID NO: 3553895 - RNA, 14 nt, Human
aacuugcugccucg

SEQ ID NO: 3553896 - RNA, 16 nt, Human
aacuugcugcugucuu

SEQ ID NO: 3553897 - RNA, 12 nt, Human
aacuugcuuaaa

SEQ ID NO: 3553898 - RNA, 17 nt, Human
aacuugcuuaaauguga

SEQ ID NO: 3553899 - RNA, 15 nt, Human
aacuugcuuaaauuu

SEQ ID NO: 3553900 - RNA, 18 nt, Human
aacuugcuuaaauuucuu

SEQ ID NO: 3553901 - RNA, 19 nt, Human
aacuugcuuaaauuucuua

SEQ ID NO: 3553902 - RNA, 21 nt, Human
aacuugcuuaaauuucuuaug

SEQ ID NO: 3553903 - RNA, 15 nt, Human
aacuuggagccccag

SEQ ID NO: 3553904 - RNA, 12 nt, Human
aacuuggagccg

SEQ ID NO: 3553905 - RNA, 14 nt, Human
aacuuggcgcugcc

SEQ ID NO: 3553906 - RNA, 22 nt, Human
aacuuggcucgaaucucugugc

SEQ ID NO: 3553907 - RNA, 22 nt, Human
aacuugggagugugguuucuuu

SEQ ID NO: 3553908 - RNA, 22 nt, Human
aacuuggggaguuaagaccugg

SEQ ID NO: 3553909 - RNA, 17 nt, Human
aacuugguauuuuucag

SEQ ID NO: 3553910 - RNA, 14 nt, Human
aacuugguuauaca

SEQ ID NO: 3553911 - RNA, 11 nt, Human
aaguuuucagg

SEQ ID NO: 3553912 - RNA, 22 nt, Human
aaguuuucccuugaggaaacaa

SEQ ID NO: 3553913 - RNA, 20 nt, Human
aaguuuuccuacacuugaga

SEQ ID NO: 3553914 - RNA, 21 nt, Human
aaguuuucuguagucauuuac

SEQ ID NO: 3553915 - RNA, 16 nt, Human
aaguuuugaaaagcua

SEQ ID NO: 3553916 - RNA, 13 nt, Human
aaguuuuguacag

SEQ ID NO: 3553917 - RNA, 13 nt, Human
aaguuuugugaaa

SEQ ID NO: 3553918 - RNA, 14 nt, Human
aaguuuugugaaau

SEQ ID NO: 3553919 - RNA, 15 nt, Human
aaguuuugugaaauu

SEQ ID NO: 3553920 - RNA, 18 nt, Human
aaguuuugugaaauuuuu

SEQ ID NO: 3553921 - RNA, 21 nt, Human
aaguuuugugaaauuuuucau

SEQ ID NO: 3553922 - RNA, 14 nt, Human
aaguuuuuguacug

SEQ ID NO: 3553923 - RNA, 12 nt, Human
aaguuuuuuugc

SEQ ID NO: 3553924 - RNA, 15 nt, Human
aauaaaaaagauccc

SEQ ID NO: 3553925 - RNA, 16 nt, Human
aauaaaaaauuaugac

SEQ ID NO: 3553926 - RNA, 12 nt, Human
aauaaaaacuau

SEQ ID NO: 3553927 - RNA, 14 nt, Human
aauaaaaagacaac

SEQ ID NO: 3553928 - RNA, 19 nt, Human
aauaaaaagaucacuuucu

SEQ ID NO: 3553929 - RNA, 16 nt, Human
aauaaaaagcuuuugu

SEQ ID NO: 3553930 - RNA, 18 nt, Human
aauaaaaagcuuuugucu

SEQ ID NO: 3553931 - RNA, 13 nt, Human
aauaaaaagugac

SEQ ID NO: 3553932 - RNA, 15 nt, Human
aauaaaaaguuaaaa

SEQ ID NO: 3553933 - RNA, 16 nt, Human
aauaaaaauaaauuug

SEQ ID NO: 3553934 - RNA, 17 nt, Human
aauaaaaauuaaggcaa

SEQ ID NO: 3553935 - RNA, 21 nt, Human
aauaaaacagcugucucuaac

SEQ ID NO: 3553936 - RNA, 14 nt, Human
aauaaaacauuaug

SEQ ID NO: 3553937 - RNA, 17 nt, Human
aauaaaacauuuucaca

SEQ ID NO: 3553938 - RNA, 13 nt, Human
aauaaaaccagcu

SEQ ID NO: 3553939 - RNA, 15 nt, Human
aauaaaaccuuucaa

SEQ ID NO: 3553940 - RNA, 12 nt, Human
aauaaaacugau

SEQ ID NO: 3553941 - RNA, 15 nt, Human
aauaaaacugaugug

SEQ ID NO: 3553942 - RNA, 19 nt, Human
aauaaaagaaaugcacaau

SEQ ID NO: 3553943 - RNA, 16 nt, Human
aauaaaagauauaaau

SEQ ID NO: 3553944 - RNA, 13 nt, Human
aauaaaagcccag

SEQ ID NO: 3553945 - RNA, 19 nt, Human
aauaaaagcccaggagccc

SEQ ID NO: 3553946 - RNA, 12 nt, Human
aauaaaaggaaa

SEQ ID NO: 3553947 - RNA, 13 nt, Human
aauaaaaggaaaa

SEQ ID NO: 3553948 - RNA, 14 nt, Human
aauaaaagugcaca

SEQ ID NO: 3553949 - RNA, 19 nt, Human
aauaaaagugcacaccuua

SEQ ID NO: 3553950 - RNA, 14 nt, Human
aauaaaauaaaaau

SEQ ID NO: 3553951 - RNA, 17 nt, Human
aauaaaauaauucuaaa

SEQ ID NO: 3553952 - RNA, 14 nt, Human
aauaaaauauaauu

SEQ ID NO: 3553953 - RNA, 14 nt, Human
aauaaaauaucauu

SEQ ID NO: 3553954 - RNA, 16 nt, Human
aauaaaauaucauuca

SEQ ID NO: 3553955 - RNA, 18 nt, Human
aauaaaauaucauucagc

SEQ ID NO: 3553956 - RNA, 20 nt, Human
aauaaaauaucauucagcaa

SEQ ID NO: 3553957 - RNA, 13 nt, Human
aauaaaaucaauu

SEQ ID NO: 3553958 - RNA, 18 nt, Human
aauaaaaucauguacauu

SEQ ID NO: 3553959 - RNA, 19 nt, Human
aauaaaaugaaaauuguau

SEQ ID NO: 3553960 - RNA, 19 nt, Human
aauaaaaugaggacauguu

SEQ ID NO: 3553961 - RNA, 13 nt, Human
aauaaaaugugau

SEQ ID NO: 3553962 - RNA, 18 nt, Human
aauaaaauuaaagcugaa

SEQ ID NO: 3553963 - RNA, 14 nt, Human
aauaaaauuauuug

SEQ ID NO: 3553964 - RNA, 16 nt, Human
aauaaaauuauuugca

SEQ ID NO: 3553965 - RNA, 19 nt, Human
aauaaaauuauuugcaggu

SEQ ID NO: 3553966 - RNA, 22 nt, Human
aauaaaauucaacaaacauuug

SEQ ID NO: 3553967 - RNA, 19 nt, Human
aauaaaauucccuaaagcc

SEQ ID NO: 3553968 - RNA, 14 nt, Human
aauaaaauugcacu

SEQ ID NO: 3553969 - RNA, 14 nt, Human
aauaaaauuguaaa

SEQ ID NO: 3553970 - RNA, 11 nt, Human
aauaaaauuug

SEQ ID NO: 3553971 - RNA, 17 nt, Human
aauaaaauuuguugcau

SEQ ID NO: 3553972 - RNA, 19 nt, Human
aauaaaauuuuuuuucaug

SEQ ID NO: 3553973 - RNA, 22 nt, Human
aauaaacacauagauucaccug

SEQ ID NO: 3553974 - RNA, 13 nt, Human
aauaaacacugug

SEQ ID NO: 3553975 - RNA, 22 nt, Human
aauaaacagcuucaugccuuug

SEQ ID NO: 3553976 - RNA, 12 nt, Human
aauaaacaggag

SEQ ID NO: 3553977 - RNA, 23 nt, Human
aauaaacauccuucaagaacucu

SEQ ID NO: 3553978 - RNA, 17 nt, Human
aauaaaccaaaggacau

SEQ ID NO: 3553979 - RNA, 21 nt, Human
aauaaaccaaaggacauuaug

SEQ ID NO: 3553980 - RNA, 15 nt, Human
aauaaacgucuuaaa

SEQ ID NO: 3553981 - RNA, 17 nt, Human
aauaaacgucuuaaaua

SEQ ID NO: 3553982 - RNA, 14 nt, Human
aauaaacuacucuu

SEQ ID NO: 3553983 - RNA, 17 nt, Human
aauaaacuacucuuuga

SEQ ID NO: 3553984 - RNA, 19 nt, Human
aauaaacuacucuuugauu

SEQ ID NO: 3553985 - RNA, 19 nt, Human
aauaaacuuagaauaaaau

SEQ ID NO: 3553986 - RNA, 12 nt, Human
aauaaacuuucu

SEQ ID NO: 3553987 - RNA, 13 nt, Human
aauaaacuuuuuu

SEQ ID NO: 3553988 - RNA, 20 nt, Human
aauaaacuuuuuuuugagaa

SEQ ID NO: 3553989 - RNA, 16 nt, Human
aauaaagaaaagaugc

SEQ ID NO: 3553990 - RNA, 14 nt, Human
aauaaagaauacuu

SEQ ID NO: 3553991 - RNA, 18 nt, Human
aauaaagaguuagaauga

SEQ ID NO: 3553992 - RNA, 19 nt, Human
aauaaagaucauguaaaag

SEQ ID NO: 3553993 - RNA, 12 nt, Human
aauaaagcaauu

SEQ ID NO: 3553994 - RNA, 24 nt, Human
aauaaagcaauuuuccuugaagcc

SEQ ID NO: 3553995 - RNA, 14 nt, Human
aauaaagcagcguu

SEQ ID NO: 3553996 - RNA, 14 nt, Human
aauaaagcugcuga

SEQ ID NO: 3553997 - RNA, 11 nt, Human
aauaaaggacu

SEQ ID NO: 3553998 - RNA, 18 nt, Human
aauaaaggaugugauugu

SEQ ID NO: 3553999 - RNA, 19 nt, Human
aauaaagguaugaaagggu

SEQ ID NO: 3554000 - RNA, 9 nt, Human
aauaaagua

SEQ ID NO: 3554001 - RNA, 14 nt, Human
aauaaaguauauaa

SEQ ID NO: 3554002 - RNA, 15 nt, Human
aauaaaguauauaua

SEQ ID NO: 3554003 - RNA, 11 nt, Human
aauaaaguauc

SEQ ID NO: 3554004 - RNA, 18 nt, Human
aauaaaguaucaugcauu

SEQ ID NO: 3554005 - RNA, 19 nt, Human
aagacauaacguuuuuccu

SEQ ID NO: 3554006 - RNA, 20 nt, Human
aagacauaacguuuuuccuu

SEQ ID NO: 3554007 - RNA, 23 nt, Human
aagacauacuccuuccaucaaau

SEQ ID NO: 3554008 - RNA, 18 nt, Human
aagacauagcauccaagu

SEQ ID NO: 3554009 - RNA, 21 nt, Human
aagacauccauaaagaagcaa

SEQ ID NO: 3554010 - RNA, 13 nt, Human
aagacaugaacca

SEQ ID NO: 3554011 - RNA, 12 nt, Human
aagacaugaagc

SEQ ID NO: 3554012 - RNA, 15 nt, Human
aagacaugaauauga

SEQ ID NO: 3554013 - RNA, 14 nt, Human
aagacaugcagccu

SEQ ID NO: 3554014 - RNA, 16 nt, Human
aagacaugucuguucu

SEQ ID NO: 3554015 - RNA, 18 nt, Human
aagacauuaaaucuauga

SEQ ID NO: 3554016 - RNA, 21 nt, Human
aagacauuaguaacauaauaa

SEQ ID NO: 3554017 - RNA, 18 nt, Human
aagacauucuuauauuuc

SEQ ID NO: 3554018 - RNA, 21 nt, Human
aagacauucuuccaaaaagau

SEQ ID NO: 3554019 - RNA, 18 nt, Human
aagaccaaaaugacaaug

SEQ ID NO: 3554020 - RNA, 19 nt, Human
aagaccaccucaaauuuaa

SEQ ID NO: 3554021 - RNA, 12 nt, Human
aagaccagccug

SEQ ID NO: 3554022 - RNA, 13 nt, Human
aagaccauuuuuc

SEQ ID NO: 3554023 - RNA, 13 nt, Human
aagacccaaaagg

SEQ ID NO: 3554024 - RNA, 22 nt, Human
aagaccccacccaagcuuggca

SEQ ID NO: 3554025 - RNA, 15 nt, Human
aagacccccagcacu

SEQ ID NO: 3554026 - RNA, 15 nt, Human
aagaccccuaacccu

SEQ ID NO: 3554027 - RNA, 15 nt, Human
aagacccgagcuggg

SEQ ID NO: 3554028 - RNA, 18 nt, Human
aagacccuaaacauccau

SEQ ID NO: 3554029 - RNA, 22 nt, Human
aagacccucuugcccauccuga

SEQ ID NO: 3554030 - RNA, 22 nt, Human
aagacccuuguggucccacccc

SEQ ID NO: 3554031 - RNA, 21 nt, Human
aagaccuacuguucuaaagcu

SEQ ID NO: 3554032 - RNA, 18 nt, Human
aagaccuagugcucuuaa

SEQ ID NO: 3554033 - RNA, 15 nt, Human
aagaccucagggcac

SEQ ID NO: 3554034 - RNA, 12 nt, Human
aagaccuggcaa

SEQ ID NO: 3554035 - RNA, 17 nt, Human
aagaccuggcagcucug

SEQ ID NO: 3554036 - RNA, 19 nt, Human
aagaccugggguugucagc

SEQ ID NO: 3554037 - RNA, 18 nt, Human
aagaccuucuccuucacc

SEQ ID NO: 3554038 - RNA, 20 nt, Human
aagaccuuuuucugcacuau

SEQ ID NO: 3554039 - RNA, 16 nt, Human
aagacgcaccagccca

SEQ ID NO: 3554040 - RNA, 15 nt, Human
aagacgcugugcugc

SEQ ID NO: 3554041 - RNA, 18 nt, Human
aagacgcugugcugcccu

SEQ ID NO: 3554042 - RNA, 20 nt, Human
aagacgcugugcugcccugc

SEQ ID NO: 3554043 - RNA, 21 nt, Human
aagacgcugugcugcccugcc

SEQ ID NO: 3554044 - RNA, 19 nt, Human
aagacggcacggucuuccc

SEQ ID NO: 3554045 - RNA, 23 nt, Human
aagacgugauuuugcuguagaag

SEQ ID NO: 3554046 - RNA, 17 nt, Human
aagacguuuuauaagca

SEQ ID NO: 3554047 - RNA, 16 nt, Human
aagacuaucuaaaugu

SEQ ID NO: 3554048 - RNA, 17 nt, Human
aagacuaucuaaauguu

SEQ ID NO: 3554049 - RNA, 14 nt, Human
aagacuauucaaac

SEQ ID NO: 3554050 - RNA, 10 nt, Human
aagacucauc

SEQ ID NO: 3554051 - RNA, 11 nt, Human
aagacucaucc

SEQ ID NO: 3554052 - RNA, 17 nt, Human
aagacuccaaagaaaug

SEQ ID NO: 3554053 - RNA, 13 nt, Human
aagacuccagaaa

SEQ ID NO: 3554054 - RNA, 22 nt, Human
aagacucccaugagggagaugc

SEQ ID NO: 3554055 - RNA, 12 nt, Human
aagacucuagag

SEQ ID NO: 3554056 - RNA, 15 nt, Human
aagacucuagagucc

SEQ ID NO: 3554057 - RNA, 22 nt, Human
aagacucuuuuugguuguccuc

SEQ ID NO: 3554058 - RNA, 12 nt, Human
aauaacauguaa

SEQ ID NO: 3554059 - RNA, 22 nt, Human
aauaaccacuuaaaaaaugucc

SEQ ID NO: 3554060 - RNA, 22 nt, Human
aauaaccccauucuuugcuuga

SEQ ID NO: 3554061 - RNA, 16 nt, Human
aauaacuccucccagg

SEQ ID NO: 3554062 - RNA, 13 nt, Human
aauaacugaauuu

SEQ ID NO: 3554063 - RNA, 21 nt, Human
aauaacugauuaguaagucuu

SEQ ID NO: 3554064 - RNA, 16 nt, Human
aauaacugugaaguuu

SEQ ID NO: 3554065 - RNA, 22 nt, Human
aauaagaaacaacucuuugaga

SEQ ID NO: 3554066 - RNA, 15 nt, Human
aauaagaagcaaaua

SEQ ID NO: 3554067 - RNA, 18 nt, Human
aauaagaauagaaauaaa

SEQ ID NO: 3554068 - RNA, 20 nt, Human
aauaagaauagaacaacaua

SEQ ID NO: 3554069 - RNA, 14 nt, Human
aauaagaaugauuu

SEQ ID NO: 3554070 - RNA, 14 nt, Human
aauaagaauuuagg

SEQ ID NO: 3554071 - RNA, 12 nt, Human
aauaagaauuug

SEQ ID NO: 3554072 - RNA, 16 nt, Human
aauaagaauuugcaua

SEQ ID NO: 3554073 - RNA, 14 nt, Human
aauaagagaaagaa

SEQ ID NO: 3554074 - RNA, 16 nt, Human
aauaagauacaucaca

SEQ ID NO: 3554075 - RNA, 14 nt, Human
aauaagaucuuuuu

SEQ ID NO: 3554076 - RNA, 13 nt, Human
aauaagauucuaa

SEQ ID NO: 3554077 - RNA, 17 nt, Human
aauaagcacuuuuuaaa

SEQ ID NO: 3554078 - RNA, 13 nt, Human
aauaagcuaaaga

SEQ ID NO: 3554079 - RNA, 14 nt, Human
aauaagcuaaagag

SEQ ID NO: 3554080 - RNA, 19 nt, Human
aauaagcuacuagcaaaau

SEQ ID NO: 3554081 - RNA, 20 nt, Human
aauaagcuacuagcaaaaua

SEQ ID NO: 3554082 - RNA, 14 nt, Human
aauaagcuauuuga

SEQ ID NO: 3554083 - RNA, 18 nt, Human
aauaagcuauuugaugua

SEQ ID NO: 3554084 - RNA, 21 nt, Human
aauaagcuauuugauguaaua

SEQ ID NO: 3554085 - RNA, 14 nt, Human
aauaaggaaaagcu

SEQ ID NO: 3554086 - RNA, 13 nt, Human
aauaaggaaaagu

SEQ ID NO: 3554087 - RNA, 19 nt, Human
aauaaggaaaaguuuaaua

SEQ ID NO: 3554088 - RNA, 22 nt, Human
aauaaggaaaaguuuaauauua

SEQ ID NO: 3554089 - RNA, 14 nt, Human
aauaaggauuuuuc

SEQ ID NO: 3554090 - RNA, 21 nt, Human
aauaagggaaaaaucaaguau

SEQ ID NO: 3554091 - RNA, 19 nt, Human
aauaagguacaagaagcau

SEQ ID NO: 3554092 - RNA, 15 nt, Human
aauaagucugauuua

SEQ ID NO: 3554093 - RNA, 18 nt, Human
aauaagugcccucuccca

SEQ ID NO: 3554094 - RNA, 17 nt, Human
aauaagugguuauuucu

SEQ ID NO: 3554095 - RNA, 22 nt, Human
aauaagugugugguagaaacaa

SEQ ID NO: 3554096 - RNA, 22 nt, Human
aauaaguuaacuauuuuauuuu

SEQ ID NO: 3554097 - RNA, 22 nt, Human
aauaaguucaaauucuucugaa

SEQ ID NO: 3554098 - RNA, 21 nt, Human
aauaauaaaagauucaccuga

SEQ ID NO: 3554099 - RNA, 13 nt, Human
aauaauaaaauca

SEQ ID NO: 3554100 - RNA, 12 nt, Human
aauaauaaagaa

SEQ ID NO: 3554101 - RNA, 16 nt, Human
aauaauaaauaguucu

SEQ ID NO: 3554102 - RNA, 14 nt, Human
aauaauaaauauuu

SEQ ID NO: 3554103 - RNA, 21 nt, Human
aauaauaaauugcaugcugcu

SEQ ID NO: 3554104 - RNA, 18 nt, Human
aauaauaccuaagccuuc

SEQ ID NO: 3554105 - RNA, 18 nt, Human
aauaauagauugugaaua

SEQ ID NO: 3554106 - RNA, 17 nt, Human
aauaauaguaugaguaa

SEQ ID NO: 3554107 - RNA, 12 nt, Human
aauaauauacuu

SEQ ID NO: 3554108 - RNA, 20 nt, Human
aauaauauccaggucaacag

SEQ ID NO: 3554109 - RNA, 22 nt, Human
aauaauauccaggucaacagaa

SEQ ID NO: 3554110 - RNA, 11 nt, Human
aauaauaugca

SEQ ID NO: 3554111 - RNA, 12 nt, Human
aauaauaugcau

SEQ ID NO: 3554112 - RNA, 22 nt, Human
aauaauauuguuuuucuuucua

SEQ ID NO: 3554113 - RNA, 11 nt, Human
aauaaucaaga

SEQ ID NO: 3554114 - RNA, 13 nt, Human
aauaaucauugga

SEQ ID NO: 3554115 - RNA, 13 nt, Human
aauaaucuuauua

SEQ ID NO: 3554116 - RNA, 14 nt, Human
aauaaucuuugggu

SEQ ID NO: 3554117 - RNA, 22 nt, Human
aauaaugaauggacucaaacug

SEQ ID NO: 3554118 - RNA, 22 nt, Human
aauaaugagcuauuaaaacuca

SEQ ID NO: 3554119 - RNA, 19 nt, Human
aauaaugcuacaauuuuaa

SEQ ID NO: 3554120 - RNA, 13 nt, Human
aauaaugcuuuga

SEQ ID NO: 3554121 - RNA, 19 nt, Human
aauaaugggcuuagagcag

SEQ ID NO: 3554122 - RNA, 13 nt, Human
aauaaugguacca

SEQ ID NO: 3554123 - RNA, 23 nt, Human
aauaaugguaccagauaaaauua

SEQ ID NO: 3554124 - RNA, 21 nt, Human
aauaauggucccauccaggca

SEQ ID NO: 3554125 - RNA, 12 nt, Human
aauaauguaaga

SEQ ID NO: 3554126 - RNA, 19 nt, Human
aauaauguacaucuggccu

SEQ ID NO: 3554127 - RNA, 20 nt, Human
aauaaugucuuguuaauauu

SEQ ID NO: 3554128 - RNA, 17 nt, Human
aauaaugugaaacugga

SEQ ID NO: 3554129 - RNA, 21 nt, Human
aauaaugugggaagaaacaaa

SEQ ID NO: 3554130 - RNA, 14 nt, Human
aauaauguguaguu

SEQ ID NO: 3554131 - RNA, 20 nt, Human
aauaauguguaguucaugua

SEQ ID NO: 3554132 - RNA, 22 nt, Human
aauaauguguaguucauguaaa

SEQ ID NO: 3554133 - RNA, 19 nt, Human
aauaauuacagugccuaaa

SEQ ID NO: 3554134 - RNA, 20 nt, Human
aauaauuauaugcuauuucu

SEQ ID NO: 3554135 - RNA, 21 nt, Human
aauaauuauaugcuauuucua

SEQ ID NO: 3554136 - RNA, 18 nt, Human
aauaauuauccagaguuu

SEQ ID NO: 3554137 - RNA, 18 nt, Human
aauaauuauuuauuuaau

SEQ ID NO: 3554138 - RNA, 19 nt, Human
aauaauucauauucuucau

SEQ ID NO: 3554139 - RNA, 17 nt, Human
aauaauucugaguuuug

SEQ ID NO: 3554140 - RNA, 19 nt, Human
aauaauucugaguuuugug

SEQ ID NO: 3554141 - RNA, 15 nt, Human
aauaauucuuugauu

SEQ ID NO: 3554142 - RNA, 21 nt, Human
aauaauugaucaaauucauuu

SEQ ID NO: 3554143 - RNA, 21 nt, Human
aauaauugcagaacuaaacuc

SEQ ID NO: 3554144 - RNA, 22 nt, Human
aauaauuguuguucuguuaacu

SEQ ID NO: 3554145 - RNA, 23 nt, Human
aauaauuuaacuacccuuaauua

SEQ ID NO: 3554146 - RNA, 22 nt, Human
aauaauuucccaauuaggaagu

SEQ ID NO: 3554147 - RNA, 20 nt, Human
aauaauuuccuggugugaag

SEQ ID NO: 3554148 - RNA, 21 nt, Human
aauaauuuccuggugugaagg

SEQ ID NO: 3554149 - RNA, 15 nt, Human
aauaauuucuaaugu

SEQ ID NO: 3554150 - RNA, 16 nt, Human
aauaauuucuaauguu

SEQ ID NO: 3554151 - RNA, 15 nt, Human
aauaauuucucuaca

SEQ ID NO: 3554152 - RNA, 21 nt, Human
aauaauuuuaggcacccaucc

SEQ ID NO: 3554153 - RNA, 14 nt, Human
aauaauuuuaugaa

SEQ ID NO: 3554154 - RNA, 22 nt, Human
aauaauuuuaugaacugcaugu

SEQ ID NO: 3554155 - RNA, 13 nt, Human
aauaauuuuguaa

SEQ ID NO: 3554156 - RNA, 15 nt, Human
aauaauuuuguaaug

SEQ ID NO: 3554157 - RNA, 17 nt, Human
aauaauuuuuauauuua

SEQ ID NO: 3554158 - RNA, 22 nt, Human
aauaauuuuuauauuuaauuau

SEQ ID NO: 3554159 - RNA, 22 nt, Human
aauaauuuuucacuucaaaaca

SEQ ID NO: 3554160 - RNA, 20 nt, Human
aauacaaaaauuagccgggc

SEQ ID NO: 3554161 - RNA, 16 nt, Human
aauacaaaaggcucca

SEQ ID NO: 3554162 - RNA, 11 nt, Human
aauacaaacaa

SEQ ID NO: 3554163 - RNA, 13 nt, Human
aauacaaacaaug

SEQ ID NO: 3554164 - RNA, 17 nt, Human
aauacaaacauauuugu

SEQ ID NO: 3554165 - RNA, 21 nt, Human
aauacaaacauauuuguuaaa

SEQ ID NO: 3554166 - RNA, 12 nt, Human
aauacaaaugga

SEQ ID NO: 3554167 - RNA, 18 nt, Human
aauacaacuuaaauaaua

SEQ ID NO: 3554168 - RNA, 12 nt, Human
aauacaagguau

SEQ ID NO: 3554169 - RNA, 20 nt, Human
aauacaagguauaauaaaau

SEQ ID NO: 3554170 - RNA, 22 nt, Human
aauacaagguauaauaaaauua

SEQ ID NO: 3554171 - RNA, 16 nt, Human
aauacaaguucuauuu

SEQ ID NO: 3554172 - RNA, 11 nt, Human
aauacaauaaa

SEQ ID NO: 3554173 - RNA, 15 nt, Human
aauacaauuuuguuu

SEQ ID NO: 3554174 - RNA, 22 nt, Human
aauacaauuuuguuucuguacu

SEQ ID NO: 3554175 - RNA, 22 nt, Human
aauacaauuuuuauuucuuuua

SEQ ID NO: 3554176 - RNA, 20 nt, Human
aauacaauuuuuuuuauuag

SEQ ID NO: 3554177 - RNA, 16 nt, Human
aauacacaaaaucaaa

SEQ ID NO: 3554178 - RNA, 17 nt, Human
aauacacacaaguauac

SEQ ID NO: 3554179 - RNA, 14 nt, Human
aauacacacucaaa

SEQ ID NO: 3554180 - RNA, 20 nt, Human
aauacaccaccucacuccug

SEQ ID NO: 3554181 - RNA, 16 nt, Human
aauacacuaguuguuu

SEQ ID NO: 3554182 - RNA, 17 nt, Human
aauacacuaguuguuuc

SEQ ID NO: 3554183 - RNA, 15 nt, Human
aauacagacacuaag

SEQ ID NO: 3554184 - RNA, 13 nt, Human
aauacagauauau

SEQ ID NO: 3554185 - RNA, 15 nt, Human
aauacagaucaucuu

SEQ ID NO: 3554186 - RNA, 19 nt, Human
aauacagauuuugauagca

SEQ ID NO: 3554187 - RNA, 20 nt, Human
aauacagauuuugauagcaa

SEQ ID NO: 3554188 - RNA, 21 nt, Human
aauacagauuuugauagcaaa

SEQ ID NO: 3554189 - RNA, 18 nt, Human
aauacagcagcaagaaaa

SEQ ID NO: 3554190 - RNA, 24 nt, Human
aauacagccaaagauaaucucuca

SEQ ID NO: 3554191 - RNA, 14 nt, Human
aauacagcuuucug

SEQ ID NO: 3554192 - RNA, 15 nt, Human
aauacaggaaacagu

SEQ ID NO: 3554193 - RNA, 23 nt, Human
aauacagggcaugcauuuugcag

SEQ ID NO: 3554194 - RNA, 21 nt, Human
aauacaguaagcugcucuauu

SEQ ID NO: 3554195 - RNA, 18 nt, Human
aauacaguacaggcagca

SEQ ID NO: 3554196 - RNA, 15 nt, Human
aauacaguauucugu

SEQ ID NO: 3554197 - RNA, 16 nt, Human
aauacagucuuccaca

SEQ ID NO: 3554198 - RNA, 18 nt, Human
aauacagucuuccacaaa

SEQ ID NO: 3554199 - RNA, 21 nt, Human
aauacagucuuccauuugcaa

SEQ ID NO: 3554200 - RNA, 12 nt, Human
aauacaguguua

SEQ ID NO: 3554201 - RNA, 18 nt, Human
aauacaguuguuggccuc

SEQ ID NO: 3554202 - RNA, 22 nt, Human
aagaggcaguugcccagccucu

SEQ ID NO: 3554203 - RNA, 14 nt, Human
aagaggcgggccag

SEQ ID NO: 3554204 - RNA, 20 nt, Human
aagaggcgggccagccaggc

SEQ ID NO: 3554205 - RNA, 19 nt, Human
aagaggcgucuguauauuu

SEQ ID NO: 3554206 - RNA, 15 nt, Human
aagaggcuacagggc

SEQ ID NO: 3554207 - RNA, 16 nt, Human
aagaggcugaaagagg

SEQ ID NO: 3554208 - RNA, 14 nt, Human
aagaggcugaggca

SEQ ID NO: 3554209 - RNA, 20 nt, Human
aagaggcugaggccuggacu

SEQ ID NO: 3554210 - RNA, 17 nt, Human
aagaggcugccccucuc

SEQ ID NO: 3554211 - RNA, 22 nt, Human
aagaggcugccccucucaccaa

SEQ ID NO: 3554212 - RNA, 16 nt, Human
aagaggcugcccuccu

SEQ ID NO: 3554213 - RNA, 13 nt, Human
aagaggcugguuc

SEQ ID NO: 3554214 - RNA, 13 nt, Human
aagaggcugguuu

SEQ ID NO: 3554215 - RNA, 19 nt, Human
aagaggggaccagaagcca

SEQ ID NO: 3554216 - RNA, 15 nt, Human
aagaggggcugggcu

SEQ ID NO: 3554217 - RNA, 13 nt, Human
aagagggggugga

SEQ ID NO: 3554218 - RNA, 19 nt, Human
aagaggggugcagaggcug

SEQ ID NO: 3554219 - RNA, 14 nt, Human
aagagggguggaga

SEQ ID NO: 3554220 - RNA, 15 nt, Human
aagagggguggagac

SEQ ID NO: 3554221 - RNA, 15 nt, Human
aagagguauaaagcu

SEQ ID NO: 3554222 - RNA, 21 nt, Human
aagaggugaccccagggcaca

SEQ ID NO: 3554223 - RNA, 15 nt, Human
aagaggugggagggc

SEQ ID NO: 3554224 - RNA, 20 nt, Human
aagaguagaaacugcaggga

SEQ ID NO: 3554225 - RNA, 13 nt, Human
aagaguagacauu

SEQ ID NO: 3554226 - RNA, 13 nt, Human
aagaguaggaaga

SEQ ID NO: 3554227 - RNA, 22 nt, Human
aagaguaguugauguugcauuu

SEQ ID NO: 3554228 - RNA, 18 nt, Human
aagaguccauuguuuaaa

SEQ ID NO: 3554229 - RNA, 15 nt, Human
aagagucgcugugcc

SEQ ID NO: 3554230 - RNA, 14 nt, Human
aagagucuagauuc

SEQ ID NO: 3554231 - RNA, 16 nt, Human
aagagucuauugucuc

SEQ ID NO: 3554232 - RNA, 17 nt, Human
aagagucuggggaccag

SEQ ID NO: 3554233 - RNA, 13 nt, Human
aagagucuuucuu

SEQ ID NO: 3554234 - RNA, 20 nt, Human
aagagugacuaguacaaauu

SEQ ID NO: 3554235 - RNA, 18 nt, Human
aagagugacucuccaggg

SEQ ID NO: 3554236 - RNA, 19 nt, Human
aagagugacucuccagggg

SEQ ID NO: 3554237 - RNA, 16 nt, Human
aagagugauucuugcu

SEQ ID NO: 3554238 - RNA, 21 nt, Human
aagagugauugcagcuuuaug

SEQ ID NO: 3554239 - RNA, 15 nt, Human
aagaguggaggugga

SEQ ID NO: 3554240 - RNA, 16 nt, Human
aagaguggccccaccu

SEQ ID NO: 3554241 - RNA, 17 nt, Human
aagaguggccccaccug

SEQ ID NO: 3554242 - RNA, 16 nt, Human
aagagugggcugcauc

SEQ ID NO: 3554243 - RNA, 15 nt, Human
aagaguguaaaauau

SEQ ID NO: 3554244 - RNA, 12 nt, Human
aagaguguacug

SEQ ID NO: 3554245 - RNA, 14 nt, Human
aagaguguagaagc

SEQ ID NO: 3554246 - RNA, 15 nt, Human
aagaguguagaagca

SEQ ID NO: 3554247 - RNA, 22 nt, Human
aagaguguagaagcauuccuuc

SEQ ID NO: 3554248 - RNA, 19 nt, Human
aagaguguagaucagagca

SEQ ID NO: 3554249 - RNA, 21 nt, Human
aagaguguggagucauucuca

SEQ ID NO: 3554250 - RNA, 23 nt, Human
aagaguguggagucauucucauu

SEQ ID NO: 3554251 - RNA, 12 nt, Human
aagaguguggca

SEQ ID NO: 3554252 - RNA, 21 nt, Human
aagaguugccccgucucuguu

SEQ ID NO: 3554253 - RNA, 19 nt, Human
aagaguuucaguuuguugg

SEQ ID NO: 3554254 - RNA, 21 nt, Human
aagaguuugagaccugaauag

SEQ ID NO: 3554255 - RNA, 14 nt, Human
aagaguuuugggag

SEQ ID NO: 3554256 - RNA, 20 nt, Human
aagauaacaagaucuuucag

SEQ ID NO: 3554257 - RNA, 17 nt, Human
aagauaauugcuauuua

SEQ ID NO: 3554258 - RNA, 18 nt, Human
aagauacaaauuaauuuu

SEQ ID NO: 3554259 - RNA, 20 nt, Human
aagauacagaacucuuucaa

SEQ ID NO: 3554260 - RNA, 22 nt, Human
aagauacagccugcaaguggua

SEQ ID NO: 3554261 - RNA, 17 nt, Human
aagauacaguuacucag

SEQ ID NO: 3554262 - RNA, 13 nt, Human
aagauaccuaaaa

SEQ ID NO: 3554263 - RNA, 22 nt, Human
aagauaccuaaaagagauuuca

SEQ ID NO: 3554264 - RNA, 16 nt, Human
aagauaccuuaaaauu

SEQ ID NO: 3554265 - RNA, 20 nt, Human
aagauaccuuaaaauuugaa

SEQ ID NO: 3554266 - RNA, 23 nt, Human
aagauaccuuaaaauuugaaaca

SEQ ID NO: 3554267 - RNA, 21 nt, Human
aagauaccuuuuuuuuucuuu

SEQ ID NO: 3554268 - RNA, 18 nt, Human
aagauacgacuuuauuuu

SEQ ID NO: 3554269 - RNA, 20 nt, Human
aagauacuaaggacguuguu

SEQ ID NO: 3554270 - RNA, 14 nt, Human
aagauacuuaagug

SEQ ID NO: 3554271 - RNA, 13 nt, Human
aagauagacaggu

SEQ ID NO: 3554272 - RNA, 17 nt, Human
aagauagacagguccug

SEQ ID NO: 3554273 - RNA, 13 nt, Human
aagauaggcucug

SEQ ID NO: 3554274 - RNA, 16 nt, Human
aagauagucuuggaag

SEQ ID NO: 3554275 - RNA, 19 nt, Human
aagauauaagugcuguaua

SEQ ID NO: 3554276 - RNA, 16 nt, Human
aagauauacuuguuuu

SEQ ID NO: 3554277 - RNA, 15 nt, Human
aagauauauuaaaaa

SEQ ID NO: 3554278 - RNA, 13 nt, Human
aagauaucuuuuc

SEQ ID NO: 3554279 - RNA, 17 nt, Human
aagauauggagaauugc

SEQ ID NO: 3554280 - RNA, 16 nt, Human
aagauaugggacauuu

SEQ ID NO: 3554281 - RNA, 17 nt, Human
aagauauuguacauaaa

SEQ ID NO: 3554282 - RNA, 18 nt, Human
aagauauuuauauauauu

SEQ ID NO: 3554283 - RNA, 11 nt, Human
aagauauuuua

SEQ ID NO: 3554284 - RNA, 12 nt, Human
aagauauuuuau

SEQ ID NO: 3554285 - RNA, 17 nt, Human
aagauauuuugcuuugu

SEQ ID NO: 3554286 - RNA, 20 nt, Human
aagauauuuugcuuugugau

SEQ ID NO: 3554287 - RNA, 22 nt, Human
aagauauuuugcuuugugauuu

SEQ ID NO: 3554288 - RNA, 17 nt, Human
aagauauuuuucaugau

SEQ ID NO: 3554289 - RNA, 13 nt, Human
aagauauuuuucc

SEQ ID NO: 3554290 - RNA, 23 nt, Human
aagaucaaaagguuaauaaagua

SEQ ID NO: 3554291 - RNA, 15 nt, Human
aagaucaaaauaaaa

SEQ ID NO: 3554292 - RNA, 12 nt, Human
aagaucaauaaa

SEQ ID NO: 3554293 - RNA, 20 nt, Human
aagaucacuguuuagauuug

SEQ ID NO: 3554294 - RNA, 14 nt, Human
aagauccaagaagg

SEQ ID NO: 3554295 - RNA, 14 nt, Human
aagaucccauuuga

SEQ ID NO: 3554296 - RNA, 23 nt, Human
aagauccuaccccaauuccuugu

SEQ ID NO: 3554297 - RNA, 21 nt, Human
aagaucgguuaacaaauaaca

SEQ ID NO: 3554298 - RNA, 14 nt, Human
aagaucguuaguau

SEQ ID NO: 3554299 - RNA, 17 nt, Human
aagaucguucucugccu

SEQ ID NO: 3554300 - RNA, 12 nt, Human
aagaucuaaauc

SEQ ID NO: 3554301 - RNA, 18 nt, Human
aagaucucagugguuaag

SEQ ID NO: 3554302 - RNA, 18 nt, Human
aagaucuguccucagccu

SEQ ID NO: 3554303 - RNA, 19 nt, Human
aagaucuguccucagccuu

SEQ ID NO: 3554304 - RNA, 20 nt, Human
aagaucuguccucagccuug

SEQ ID NO: 3554305 - RNA, 21 nt, Human
aagaucuguuuugaaggcaaa

SEQ ID NO: 3554306 - RNA, 14 nt, Human
aagaucuuaaauuu

SEQ ID NO: 3554307 - RNA, 14 nt, Human
aagaucuuagauuc

SEQ ID NO: 3554308 - RNA, 15 nt, Human
aagaucuuagauucu

SEQ ID NO: 3554309 - RNA, 23 nt, Human
aagaucuuagauucucugugucu

SEQ ID NO: 3554310 - RNA, 22 nt, Human
aagaucuucaaaaguaaugccu

SEQ ID NO: 3554311 - RNA, 13 nt, Human
aagaugaaaauau

SEQ ID NO: 3554312 - RNA, 14 nt, Human
aagaugaaaauauu

SEQ ID NO: 3554313 - RNA, 21 nt, Human
aagaugaaaggcaggccuauu

SEQ ID NO: 3554314 - RNA, 17 nt, Human
aagaugaacagacugac

SEQ ID NO: 3554315 - RNA, 14 nt, Human
aagaugaacucuga

SEQ ID NO: 3554316 - RNA, 18 nt, Human
aagaugaaggucuguuuu

SEQ ID NO: 3554317 - RNA, 20 nt, Human
aagaugacauugcuaagaug

SEQ ID NO: 3554318 - RNA, 21 nt, Human
aagaugacauugcuaagaugc

SEQ ID NO: 3554319 - RNA, 14 nt, Human
aagaugacuuccca

SEQ ID NO: 3554320 - RNA, 15 nt, Human
aagaugacuucccaa

SEQ ID NO: 3554321 - RNA, 19 nt, Human
aagaugagaacagauaaag

SEQ ID NO: 3554322 - RNA, 20 nt, Human
aagaugagauuggcauggcu

SEQ ID NO: 3554323 - RNA, 14 nt, Human
aagaugaucauuug

SEQ ID NO: 3554324 - RNA, 17 nt, Human
aagaugaucuacucaga

SEQ ID NO: 3554325 - RNA, 16 nt, Human
aauagcaucuguacaa

SEQ ID NO: 3554326 - RNA, 20 nt, Human
aauagcaucuguacaaaggg

SEQ ID NO: 3554327 - RNA, 14 nt, Human
aauagcauguauug

SEQ ID NO: 3554328 - RNA, 16 nt, Human
aauagcauguuguaga

SEQ ID NO: 3554329 - RNA, 22 nt, Human
aauagccaacacccaucuguuu

SEQ ID NO: 3554330 - RNA, 20 nt, Human
aauagccacauuuggaauac

SEQ ID NO: 3554331 - RNA, 23 nt, Human
aauagccacauuuggaauacuuu

SEQ ID NO: 3554332 - RNA, 23 nt, Human
aauagccacuaaccuugccuggu

SEQ ID NO: 3554333 - RNA, 15 nt, Human
aauagccauauuugu

SEQ ID NO: 3554334 - RNA, 21 nt, Human
aauagccauauuuguaaaaug

SEQ ID NO: 3554335 - RNA, 14 nt, Human
aauagcguucuugu

SEQ ID NO: 3554336 - RNA, 18 nt, Human
aauagcguucuuguaauu

SEQ ID NO: 3554337 - RNA, 19 nt, Human
aauagcguucuuguaauuu

SEQ ID NO: 3554338 - RNA, 20 nt, Human
aauagcuagacuggugacug

SEQ ID NO: 3554339 - RNA, 19 nt, Human
aauagcucuuucagggggg

SEQ ID NO: 3554340 - RNA, 21 nt, Human
aauagcugcccauuucgugag

SEQ ID NO: 3554341 - RNA, 13 nt, Human
aauaggaaacaag

SEQ ID NO: 3554342 - RNA, 19 nt, Human
aauaggaaucauucagaaa

SEQ ID NO: 3554343 - RNA, 22 nt, Human
aauaggaaucauucagaaaugu

SEQ ID NO: 3554344 - RNA, 15 nt, Human
aauaggcaaauuaau

SEQ ID NO: 3554345 - RNA, 16 nt, Human
aauaggcaaauuaauc

SEQ ID NO: 3554346 - RNA, 19 nt, Human
aauaggcggggcuugccuu

SEQ ID NO: 3554347 - RNA, 23 nt, Human
aauacaucccuuaccugggaaag

SEQ ID NO: 3554348 - RNA, 18 nt, Human
aauacaugccacaucaaa

SEQ ID NO: 3554349 - RNA, 14 nt, Human
aauacaugcugcua

SEQ ID NO: 3554350 - RNA, 13 nt, Human
aauacauuaaagc

SEQ ID NO: 3554351 - RNA, 17 nt, Human
aauacauugaauuagaa

SEQ ID NO: 3554352 - RNA, 17 nt, Human
aauacauuuaaaacauu

SEQ ID NO: 3554353 - RNA, 21 nt, Human
aauacauuuaaaacauuaaaa

SEQ ID NO: 3554354 - RNA, 21 nt, Human
aauaccacucuguaauugcaa

SEQ ID NO: 3554355 - RNA, 18 nt, Human
aauaccauuaaaacugcu

SEQ ID NO: 3554356 - RNA, 15 nt, Human
aauaccauuuaguaa

SEQ ID NO: 3554357 - RNA, 21 nt, Human
aauacccaugucuacacagau

SEQ ID NO: 3554358 - RNA, 20 nt, Human
aauaccccaagacucccaug

SEQ ID NO: 3554359 - RNA, 17 nt, Human
aauaccucaauguuuga

SEQ ID NO: 3554360 - RNA, 15 nt, Human
aauaccucauguuua

SEQ ID NO: 3554361 - RNA, 23 nt, Human
aauaccucauguuuaugaaaaua

SEQ ID NO: 3554362 - RNA, 14 nt, Human
aauaccucuuagcu

SEQ ID NO: 3554363 - RNA, 17 nt, Human
aauaccugaaugcucug

SEQ ID NO: 3554364 - RNA, 12 nt, Human
aauaccugcuca

SEQ ID NO: 3554365 - RNA, 15 nt, Human
aauaccugucccccu

SEQ ID NO: 3554366 - RNA, 13 nt, Human
aauaccuuagaag

SEQ ID NO: 3554367 - RNA, 19 nt, Human
aauacgcaggcaucugauu

SEQ ID NO: 3554368 - RNA, 19 nt, Human
aauacgugggcauucaaau

SEQ ID NO: 3554369 - RNA, 15 nt, Human
aauacuaaggaacca

SEQ ID NO: 3554370 - RNA, 15 nt, Human
aauacuacuccugua

SEQ ID NO: 3554371 - RNA, 14 nt, Human
aauacuauuuaaga

SEQ ID NO: 3554372 - RNA, 15 nt, Human
aauacuauuuuuacu

SEQ ID NO: 3554373 - RNA, 23 nt, Human
aauacucagggaaagcauuuaaa

SEQ ID NO: 3554374 - RNA, 16 nt, Human
aauacucauguguaug

SEQ ID NO: 3554375 - RNA, 15 nt, Human
aauacucuaauucua

SEQ ID NO: 3554376 - RNA, 12 nt, Human
aauacucuauuu

SEQ ID NO: 3554377 - RNA, 13 nt, Human
aauacucuuauau

SEQ ID NO: 3554378 - RNA, 14 nt, Human
aauacucuuuauuu

SEQ ID NO: 3554379 - RNA, 13 nt, Human
aauacugaaccac

SEQ ID NO: 3554380 - RNA, 15 nt, Human
aauacugaaccacuu

SEQ ID NO: 3554381 - RNA, 16 nt, Human
aauacugagaaaaccu

SEQ ID NO: 3554382 - RNA, 18 nt, Human
aauacugauggaauuuuu

SEQ ID NO: 3554383 - RNA, 16 nt, Human
aaucucaaggaaucuu

SEQ ID NO: 3554384 - RNA, 16 nt, Human
aaucucaauauuucag

SEQ ID NO: 3554385 - RNA, 16 nt, Human
aaucucaauccugcag

SEQ ID NO: 3554386 - RNA, 17 nt, Human
aaucucaauucuucccu

SEQ ID NO: 3554387 - RNA, 14 nt, Human
aaucucaauuugag

SEQ ID NO: 3554388 - RNA, 23 nt, Human
aaucucacauauacaaguagcuu

SEQ ID NO: 3554389 - RNA, 22 nt, Human
aaucucaccccaucccacaccc

SEQ ID NO: 3554390 - RNA, 22 nt, Human
aaucucagcaaugauuacucuu

SEQ ID NO: 3554391 - RNA, 14 nt, Human
aaucucagugcuuu

SEQ ID NO: 3554392 - RNA, 16 nt, Human
aaucucaguugauuuu

SEQ ID NO: 3554393 - RNA, 18 nt, Human
aaucucauaauuuauaca

SEQ ID NO: 3554394 - RNA, 16 nt, Human
aaucucauaccucuga

SEQ ID NO: 3554395 - RNA, 22 nt, Human
aaucucauaccucugaccaaca

SEQ ID NO: 3554396 - RNA, 12 nt, Human
aaucucauuugg

SEQ ID NO: 3554397 - RNA, 18 nt, Human
aaucuccaaaauaaaacu

SEQ ID NO: 3554398 - RNA, 22 nt, Human
aaucucccauuuuggaauuugc

SEQ ID NO: 3554399 - RNA, 17 nt, Human
aaucucccgcugcugcu

SEQ ID NO: 3554400 - RNA, 19 nt, Human
aaucucccgcugcugcugc

SEQ ID NO: 3554401 - RNA, 18 nt, Human
aaucucccuucacaaguu

SEQ ID NO: 3554402 - RNA, 15 nt, Human
aaucuccucuuuuau

SEQ ID NO: 3554403 - RNA, 18 nt, Human
aaucucggcucacugcau

SEQ ID NO: 3554404 - RNA, 19 nt, Human
aaucucguauagaagucuu

SEQ ID NO: 3554405 - RNA, 20 nt, Human
aaucucguauagaagucuuc

SEQ ID NO: 3554406 - RNA, 21 nt, Human
aaucucuacaaacccucugua

SEQ ID NO: 3554407 - RNA, 15 nt, Human
aaucucuaggaaguc

SEQ ID NO: 3554408 - RNA, 13 nt, Human
aaucucuauacug

SEQ ID NO: 3554409 - RNA, 19 nt, Human
aaucucuccacuuucagcu

SEQ ID NO: 3554410 - RNA, 16 nt, Human
aaucucuccauucccg

SEQ ID NO: 3554411 - RNA, 19 nt, Human
aaucucucugcagcugccg

SEQ ID NO: 3554412 - RNA, 21 nt, Human
aaucucugauucccugauuua

SEQ ID NO: 3554413 - RNA, 13 nt, Human
aaucucuguuaug

SEQ ID NO: 3554414 - RNA, 12 nt, Human
aaucucuucugu

SEQ ID NO: 3554415 - RNA, 19 nt, Human
aaucucuucuuauacagau

SEQ ID NO: 3554416 - RNA, 20 nt, Human
aaucucuuuuugcuuucgaa

SEQ ID NO: 3554417 - RNA, 14 nt, Human
aaucugaaauucua

SEQ ID NO: 3554418 - RNA, 14 nt, Human
aaucugaagauugu

SEQ ID NO: 3554419 - RNA, 21 nt, Human
aaucugaagauuguuuaucua

SEQ ID NO: 3554420 - RNA, 15 nt, Human
aaucugaauguaauu

SEQ ID NO: 3554421 - RNA, 18 nt, Human
aaucugaauguaauuugu

SEQ ID NO: 3554422 - RNA, 18 nt, Human
aaucugaauuggaaugca

SEQ ID NO: 3554423 - RNA, 15 nt, Human
aaucugacccagugc

SEQ ID NO: 3554424 - RNA, 19 nt, Human
aaucugagggaaauguuuu

SEQ ID NO: 3554425 - RNA, 22 nt, Human
aaucugagggaaauguuuugua

SEQ ID NO: 3554426 - RNA, 16 nt, Human
aaucugagggagcuga

SEQ ID NO: 3554427 - RNA, 20 nt, Human
aaucugauauguauuguuug

SEQ ID NO: 3554428 - RNA, 14 nt, Human
aaucugauggccuu

SEQ ID NO: 3554429 - RNA, 16 nt, Human
aaucugauggccuuaa

SEQ ID NO: 3554430 - RNA, 21 nt, Human
aaucugauggccuuaauuucc

SEQ ID NO: 3554431 - RNA, 17 nt, Human
aaucugcagaaggaaaa

SEQ ID NO: 3554432 - RNA, 16 nt, Human
aaucugcauuauugga

SEQ ID NO: 3554433 - RNA, 17 nt, Human
aaucugcauuuagcaca

SEQ ID NO: 3554434 - RNA, 12 nt, Human
aaucugccuggg

SEQ ID NO: 3554435 - RNA, 20 nt, Human
aaucugcucacuuuaaaccu

SEQ ID NO: 3554436 - RNA, 22 nt, Human
aaucugcuuuuuaaagaaugcu

SEQ ID NO: 3554437 - RNA, 15 nt, Human
aaucuggaagaaaaa

SEQ ID NO: 3554438 - RNA, 16 nt, Human
aaucuggacuccucug

SEQ ID NO: 3554439 - RNA, 14 nt, Human
aaucuggagugagg

SEQ ID NO: 3554440 - RNA, 19 nt, Human
aaucuggaugccucauuau

SEQ ID NO: 3554441 - RNA, 16 nt, Human
aaucuggauucauauu

SEQ ID NO: 3554442 - RNA, 23 nt, Human
aaucuggcuucuggccaggaagc

SEQ ID NO: 3554443 - RNA, 18 nt, Human
aaucugggccagaauuuc

SEQ ID NO: 3554444 - RNA, 20 nt, Human
aaucuggucuuguuagaaaa

SEQ ID NO: 3554445 - RNA, 11 nt, Human
aaucuguaaaa

SEQ ID NO: 3554446 - RNA, 23 nt, Human
aaucuguaaacuguguauuccaa

SEQ ID NO: 3554447 - RNA, 12 nt, Human
aaucuguacauu

SEQ ID NO: 3554448 - RNA, 19 nt, Human
aaucuguagggcuggaccu

SEQ ID NO: 3554449 - RNA, 22 nt, Human
aaucugucacguagaacuugga

SEQ ID NO: 3554450 - RNA, 19 nt, Human
aaucugugaacuugaaauu

SEQ ID NO: 3554451 - RNA, 16 nt, Human
aaucugugcuguuuca

SEQ ID NO: 3554452 - RNA, 19 nt, Human
aaucugugggucugggagu

SEQ ID NO: 3554453 - RNA, 13 nt, Human
aaucuguguacaa

SEQ ID NO: 3554454 - RNA, 17 nt, Human
aaucuguguauauuauu

SEQ ID NO: 3554455 - RNA, 18 nt, Human
aaucuguguauauuauuu

SEQ ID NO: 3554456 - RNA, 12 nt, Human
aaucuguuaucc

SEQ ID NO: 3554457 - RNA, 14 nt, Human
aaucuguuauccca

SEQ ID NO: 3554458 - RNA, 11 nt, Human
aaucuguugcc

SEQ ID NO: 3554459 - RNA, 17 nt, Human
aaucuguuugaucccug

SEQ ID NO: 3554460 - RNA, 17 nt, Human
aaucuuaaaaaguuguu

SEQ ID NO: 3554461 - RNA, 14 nt, Human
aaucuuaagaaaua

SEQ ID NO: 3554462 - RNA, 20 nt, Human
aaucuuaagguguagccaca

SEQ ID NO: 3554463 - RNA, 13 nt, Human
aaucuuaauguuc

SEQ ID NO: 3554464 - RNA, 23 nt, Human
aaucuuacagcuggguggcacug

SEQ ID NO: 3554465 - RNA, 16 nt, Human
aaucuuacuuuguaaa

SEQ ID NO: 3554466 - RNA, 17 nt, Human
aaucuuacuuuguaaau

SEQ ID NO: 3554467 - RNA, 23 nt, Human
aaucuuaguguaugauuacuggc

SEQ ID NO: 3554468 - RNA, 14 nt, Human
aaucuuauaauugu

SEQ ID NO: 3554469 - RNA, 15 nt, Human
aaucuuauaauuguu

SEQ ID NO: 3554470 - RNA, 15 nt, Human
aaucuuauauuccau

SEQ ID NO: 3554471 - RNA, 18 nt, Human
aaucuuauuaaaguuuca

SEQ ID NO: 3554472 - RNA, 21 nt, Human
aaucuuauuaaaguuucaaaa

SEQ ID NO: 3554473 - RNA, 16 nt, Human
aaucuucaaagccuuc

SEQ ID NO: 3554474 - RNA, 21 nt, Human
aaucuucauggaauucacaaa

SEQ ID NO: 3554475 - RNA, 23 nt, Human
aaucuucauggaauucacaaagu

SEQ ID NO: 3554476 - RNA, 13 nt, Human
aaucuucugaacu

SEQ ID NO: 3554477 - RNA, 23 nt, Human
aaucuugaucaguuaagaaauuu

SEQ ID NO: 3554478 - RNA, 13 nt, Human
aaucuugcucugc

SEQ ID NO: 3554479 - RNA, 17 nt, Human
aaucuugucauguguau

SEQ ID NO: 3554480 - RNA, 18 nt, Human
aaucuugucauguguaua

SEQ ID NO: 3554481 - RNA, 19 nt, Human
aaucuugucauguguauaa

SEQ ID NO: 3554482 - RNA, 17 nt, Human
aaucuugucucaaugcu

SEQ ID NO: 3554483 - RNA, 21 nt, Human
aaucuugucucaaugcucaua

SEQ ID NO: 3554484 - RNA, 19 nt, Human
aaucuuguuucugaaaaga

SEQ ID NO: 3554485 - RNA, 17 nt, Human
aaucuuuaaaagaugcu

SEQ ID NO: 3554486 - RNA, 21 nt, Human
aaucuuuaaaagaugcuuuua

SEQ ID NO: 3554487 - RNA, 15 nt, Human
aaucuuuaaaccaau

SEQ ID NO: 3554488 - RNA, 23 nt, Human
aaucuuuaaaccaauugcugcua

SEQ ID NO: 3554489 - RNA, 15 nt, Human
aaucuuuaccuguau

SEQ ID NO: 3554490 - RNA, 22 nt, Human
aaucuuuaccuguauacagugc

SEQ ID NO: 3554491 - RNA, 21 nt, Human
aaucuuuagagaaguauacau

SEQ ID NO: 3554492 - RNA, 15 nt, Human
aagcugaguuuccua

SEQ ID NO: 3554493 - RNA, 13 nt, Human
aagcugauccugc

SEQ ID NO: 3554494 - RNA, 16 nt, Human
aagcugauuaaaugac

SEQ ID NO: 3554495 - RNA, 16 nt, Human
aagcugauuacuguca

SEQ ID NO: 3554496 - RNA, 23 nt, Human
aagcugauuacugucaauaaaca

SEQ ID NO: 3554497 - RNA, 21 nt, Human
aagcugcacccucaggcaggu

SEQ ID NO: 3554498 - RNA, 11 nt, Human
aagcugcagcu

SEQ ID NO: 3554499 - RNA, 13 nt, Human
aagcugcagcuuc

SEQ ID NO: 3554500 - RNA, 16 nt, Human
aagcugcagcuuccug

SEQ ID NO: 3554501 - RNA, 11 nt, Human
aagcugccagc

SEQ ID NO: 3554502 - RNA, 20 nt, Human
aagcugcccacuguuucucu

SEQ ID NO: 3554503 - RNA, 16 nt, Human
aagcugccucaaggaa

SEQ ID NO: 3554504 - RNA, 23 nt, Human
aagcugccuccccucuccuuccu

SEQ ID NO: 3554505 - RNA, 14 nt, Human
aagcugccucccug

SEQ ID NO: 3554506 - RNA, 17 nt, Human
aagcugccucccugucc

SEQ ID NO: 3554507 - RNA, 15 nt, Human
aagcugccuguaguu

SEQ ID NO: 3554508 - RNA, 21 nt, Human
aagcugccuguaguuaggaaa

SEQ ID NO: 3554509 - RNA, 22 nt, Human
aagcugccuguaguuaggaaau

SEQ ID NO: 3554510 - RNA, 23 nt, Human
aagcugcucaacuugcaaaauca

SEQ ID NO: 3554511 - RNA, 12 nt, Human
aagcugcucuga

SEQ ID NO: 3554512 - RNA, 19 nt, Human
aagcugcucugagccacag

SEQ ID NO: 3554513 - RNA, 13 nt, Human
aagcugcugacca

SEQ ID NO: 3554514 - RNA, 21 nt, Human
aagcugcugagaaucuagccu

SEQ ID NO: 3554515 - RNA, 14 nt, Human
aagcuggaagcaca

SEQ ID NO: 3554516 - RNA, 19 nt, Human
aagcuggaggacuagaacc

SEQ ID NO: 3554517 - RNA, 20 nt, Human
aagcuggagugcaguggcau

SEQ ID NO: 3554518 - RNA, 12 nt, Human
aagcuggccucu

SEQ ID NO: 3554519 - RNA, 13 nt, Human
aagcuggccugag

SEQ ID NO: 3554520 - RNA, 23 nt, Human
aagcuggcggcuggggucccagc

SEQ ID NO: 3554521 - RNA, 12 nt, Human
aagcuggcuggg

SEQ ID NO: 3554522 - RNA, 18 nt, Human
aagcuggcuuacacuggc

SEQ ID NO: 3554523 - RNA, 13 nt, Human
aagcugggcaggu

SEQ ID NO: 3554524 - RNA, 15 nt, Human
aagcugggcagguug

SEQ ID NO: 3554525 - RNA, 18 nt, Human
aagcugggccccagccca

SEQ ID NO: 3554526 - RNA, 17 nt, Human
aagcugguaaacuauuu

SEQ ID NO: 3554527 - RNA, 21 nt, Human
aagcuggugggugaaagaaau

SEQ ID NO: 3554528 - RNA, 16 nt, Human
aagcugguuuaauguu

SEQ ID NO: 3554529 - RNA, 23 nt, Human
aagcuguaguagcccuuucugug

SEQ ID NO: 3554530 - RNA, 19 nt, Human
aagcugugacuucuccagg

SEQ ID NO: 3554531 - RNA, 13 nt, Human
aagcugugagaca

SEQ ID NO: 3554532 - RNA, 20 nt, Human
aagcugugccacccugggcu

SEQ ID NO: 3554533 - RNA, 21 nt, Human
aagcugugccacccugggcuc

SEQ ID NO: 3554534 - RNA, 21 nt, Human
aagcugugugcucuccaagcc

SEQ ID NO: 3554535 - RNA, 18 nt, Human
aagcuguguggcagucug

SEQ ID NO: 3554536 - RNA, 18 nt, Human
aagcuguuaaacuguuag

SEQ ID NO: 3554537 - RNA, 18 nt, Human
aagcuguugaccaggcac

SEQ ID NO: 3554538 - RNA, 19 nt, Human
aagcuguuggccucugcaa

SEQ ID NO: 3554539 - RNA, 13 nt, Human
aagcuguuguaca

SEQ ID NO: 3554540 - RNA, 17 nt, Human
aagcuguuguacauuua

SEQ ID NO: 3554541 - RNA, 20 nt, Human
aagcuguuguacauuuauga

SEQ ID NO: 3554542 - RNA, 21 nt, Human
aagcuguuguacauuuaugau

SEQ ID NO: 3554543 - RNA, 14 nt, Human
aaugaaauuguaaa

SEQ ID NO: 3554544 - RNA, 22 nt, Human
aaugaaauuuuaccaaguuaua

SEQ ID NO: 3554545 - RNA, 12 nt, Human
aaugaacaagag

SEQ ID NO: 3554546 - RNA, 17 nt, Human
aaugaacaagagaagca

SEQ ID NO: 3554547 - RNA, 22 nt, Human
aaugaacagaacauagacagaa

SEQ ID NO: 3554548 - RNA, 14 nt, Human
aaugaacauuaaca

SEQ ID NO: 3554549 - RNA, 17 nt, Human
aaugaaccauaaauuca

SEQ ID NO: 3554550 - RNA, 18 nt, Human
aaugaaccauaaauucaa

SEQ ID NO: 3554551 - RNA, 21 nt, Human
aaugaacccccaugauguaag

SEQ ID NO: 3554552 - RNA, 22 nt, Human
aaugaacccccaugauguaagu

SEQ ID NO: 3554553 - RNA, 11 nt, Human
aaugaacugaa

SEQ ID NO: 3554554 - RNA, 15 nt, Human
aaugaagaauuuaaa

SEQ ID NO: 3554555 - RNA, 17 nt, Human
aaugaagaauuuaaaga

SEQ ID NO: 3554556 - RNA, 12 nt, Human
aaugaagaucua

SEQ ID NO: 3554557 - RNA, 15 nt, Human
aaugaagccuuagcc

SEQ ID NO: 3554558 - RNA, 16 nt, Human
aaugaagcuuguguau

SEQ ID NO: 3554559 - RNA, 22 nt, Human
aaugaaggugucagaauaauaa

SEQ ID NO: 3554560 - RNA, 21 nt, Human
aaugaagguuaggauuuaaca

SEQ ID NO: 3554561 - RNA, 20 nt, Human
aaugaagguuuuuguaaaga

SEQ ID NO: 3554562 - RNA, 14 nt, Human
aaugaagucucuga

SEQ ID NO: 3554563 - RNA, 16 nt, Human
aaugaagucucugaag

SEQ ID NO: 3554564 - RNA, 17 nt, Human
aaugaaguuguagguaa

SEQ ID NO: 3554565 - RNA, 15 nt, Human
aaugaaguuuauaca

SEQ ID NO: 3554566 - RNA, 18 nt, Human
aaugaaguuugaauguua

SEQ ID NO: 3554567 - RNA, 15 nt, Human
aaugaauaauggaaa

SEQ ID NO: 3554568 - RNA, 21 nt, Human
aaugaauaauggaaaaugcca

SEQ ID NO: 3554569 - RNA, 16 nt, Human
aaugaauaauuuccca

SEQ ID NO: 3554570 - RNA, 12 nt, Human
aaugaauaccuu

SEQ ID NO: 3554571 - RNA, 20 nt, Human
aaugaauacuuuauaaagga

SEQ ID NO: 3554572 - RNA, 15 nt, Human
aaugaauaucuauua

SEQ ID NO: 3554573 - RNA, 18 nt, Human
aaugaauccuacacaccu

SEQ ID NO: 3554574 - RNA, 17 nt, Human
aaugaaugcauaaaaug

SEQ ID NO: 3554575 - RNA, 21 nt, Human
aaugaauggaggaacuuucca

SEQ ID NO: 3554576 - RNA, 13 nt, Human
aaugaaugucagu

SEQ ID NO: 3554577 - RNA, 13 nt, Human
aaugaaugugugu

SEQ ID NO: 3554578 - RNA, 17 nt, Human
aaugaauuccuagaauu

SEQ ID NO: 3554579 - RNA, 21 nt, Human
aaugaauuccuagaauuaaac

SEQ ID NO: 3554580 - RNA, 13 nt, Human
aaugaauuuuguu

SEQ ID NO: 3554581 - RNA, 12 nt, Human
aaugacaauauu

SEQ ID NO: 3554582 - RNA, 16 nt, Human
aaugacagagccagug

SEQ ID NO: 3554583 - RNA, 22 nt, Human
aaugacagguuugggaccccug

SEQ ID NO: 3554584 - RNA, 22 nt, Human
aaugacaguccgucaaaacaga

SEQ ID NO: 3554585 - RNA, 18 nt, Human
aaugacaucuucaaagcu

SEQ ID NO: 3554586 - RNA, 13 nt, Human
aaugacaucuuuu

SEQ ID NO: 3554587 - RNA, 21 nt, Human
aaugacaucuuuuuaaagcuu

SEQ ID NO: 3554588 - RNA, 22 nt, Human
aaugacaucuuuuuaaagcuua

SEQ ID NO: 3554589 - RNA, 16 nt, Human
aaugacaugcacugac

SEQ ID NO: 3554590 - RNA, 23 nt, Human
aaugacaugugucaagcugcuug

SEQ ID NO: 3554591 - RNA, 15 nt, Human
aaugacauuuugcca

SEQ ID NO: 3554592 - RNA, 14 nt, Human
aaugaccaauauua

SEQ ID NO: 3554593 - RNA, 16 nt, Human
aaugaccucaagaugu

SEQ ID NO: 3554594 - RNA, 16 nt, Human
aaugaccuuguaaugu

SEQ ID NO: 3554595 - RNA, 22 nt, Human
aaugaccuuguaauguaacugc

SEQ ID NO: 3554596 - RNA, 20 nt, Human
aaugacuaaaaaacaaagaa

SEQ ID NO: 3554597 - RNA, 17 nt, Human
aaugacuaauucuugca

SEQ ID NO: 3554598 - RNA, 18 nt, Human
aaugacuaauucuugcau

SEQ ID NO: 3554599 - RNA, 20 nt, Human
aaugacuaauucuugcauau

SEQ ID NO: 3554600 - RNA, 21 nt, Human
aaugacuauauaauuuauuuc

SEQ ID NO: 3554601 - RNA, 15 nt, Human
aaugacucaaagucu

SEQ ID NO: 3554602 - RNA, 11 nt, Human
aaugacuuuau

SEQ ID NO: 3554603 - RNA, 17 nt, Human
aaugagaaggaauuuga

SEQ ID NO: 3554604 - RNA, 13 nt, Human
aaugagacaucca

SEQ ID NO: 3554605 - RNA, 18 nt, Human
aaugagagaauaagucau

SEQ ID NO: 3554606 - RNA, 12 nt, Human
aaugagagcaua

SEQ ID NO: 3554607 - RNA, 23 nt, Human
aaugagagggcaguguuuccuuu

SEQ ID NO: 3554608 - RNA, 17 nt, Human
aaugagaucaggcucug

SEQ ID NO: 3554609 - RNA, 18 nt, Human
aaugagauuaauuccuuu

SEQ ID NO: 3554610 - RNA, 16 nt, Human
aaugagauugaauuuc

SEQ ID NO: 3554611 - RNA, 18 nt, Human
aaugagcaauaucugcua

SEQ ID NO: 3554612 - RNA, 23 nt, Human
aaugagcacccauuccaaagcuu

SEQ ID NO: 3554613 - RNA, 13 nt, Human
aaugagcaccucc

SEQ ID NO: 3554614 - RNA, 14 nt, Human
aaugagcaccucca

SEQ ID NO: 3554615 - RNA, 18 nt, Human
aaugagcagcuuuagcaa

SEQ ID NO: 3554616 - RNA, 14 nt, Human
aaugagcauguuua

SEQ ID NO: 3554617 - RNA, 13 nt, Human
aaugagccuggca

SEQ ID NO: 3554618 - RNA, 14 nt, Human
aaugagccuggcaa

SEQ ID NO: 3554619 - RNA, 20 nt, Human
aaugagcuuucugaacagcu

SEQ ID NO: 3554620 - RNA, 22 nt, Human
aaugagcuuucugaacagcugg

SEQ ID NO: 3554621 - RNA, 17 nt, Human
aaugaggauuauugaua

SEQ ID NO: 3554622 - RNA, 20 nt, Human
aaugagggacuggaaccagg

SEQ ID NO: 3554623 - RNA, 21 nt, Human
aaugagggacuggaaccaggg

SEQ ID NO: 3554624 - RNA, 15 nt, Human
aaugagggggcucag

SEQ ID NO: 3554625 - RNA, 15 nt, Human
aaugaggucccaggc

SEQ ID NO: 3554626 - RNA, 12 nt, Human
aaugaguaacau

SEQ ID NO: 3554627 - RNA, 19 nt, Human
aaugaguaacauuugcugu

SEQ ID NO: 3554628 - RNA, 19 nt, Human
aaugagucuguuguguguc

SEQ ID NO: 3554629 - RNA, 14 nt, Human
aaugaguugugaaa

SEQ ID NO: 3554630 - RNA, 13 nt, Human
aaugauaaaacac

SEQ ID NO: 3554631 - RNA, 14 nt, Human
aaugauaaaacacc

SEQ ID NO: 3554632 - RNA, 15 nt, Human
aaugauaaacucucu

SEQ ID NO: 3554633 - RNA, 18 nt, Human
aaugauaaguaaaugcua

SEQ ID NO: 3554634 - RNA, 21 nt, Human
aaugauagacaauugagguaa

SEQ ID NO: 3554635 - RNA, 18 nt, Human
aaugauaguugauuuuca

SEQ ID NO: 3554636 - RNA, 18 nt, Human
aaugauauagccagaaaa

SEQ ID NO: 3554637 - RNA, 17 nt, Human
aaggcuuucagggccuc

SEQ ID NO: 3554638 - RNA, 22 nt, Human
aaggcuuucagggccuccagcc

SEQ ID NO: 3554639 - RNA, 22 nt, Human
aaggcuuugcccugcugcccuc

SEQ ID NO: 3554640 - RNA, 22 nt, Human
aaggcuuuuggucucccuggga

SEQ ID NO: 3554641 - RNA, 11 nt, Human
aagggaaaaau

SEQ ID NO: 3554642 - RNA, 16 nt, Human
aagggaaaagucucuu

SEQ ID NO: 3554643 - RNA, 23 nt, Human
aagggaaacugccagcaacgcag

SEQ ID NO: 3554644 - RNA, 15 nt, Human
aagggaaagaaaaug

SEQ ID NO: 3554645 - RNA, 12 nt, Human
aagggaaauaga

SEQ ID NO: 3554646 - RNA, 16 nt, Human
aagggaacaggaaaag

SEQ ID NO: 3554647 - RNA, 20 nt, Human
aagggaagaaggaggaaugc

SEQ ID NO: 3554648 - RNA, 18 nt, Human
aagggaagacauuucuuu

SEQ ID NO: 3554649 - RNA, 16 nt, Human
aagggaagauuuaugu

SEQ ID NO: 3554650 - RNA, 14 nt, Human
aagggaaggacaga

SEQ ID NO: 3554651 - RNA, 21 nt, Human
aagggaccagggagaugccac

SEQ ID NO: 3554652 - RNA, 15 nt, Human
aagggagaagaaagg

SEQ ID NO: 3554653 - RNA, 14 nt, Human
aagggagccaaggg

SEQ ID NO: 3554654 - RNA, 18 nt, Human
aagggagccaagggaugg

SEQ ID NO: 3554655 - RNA, 19 nt, Human
aagggagccaagggaugga

SEQ ID NO: 3554656 - RNA, 21 nt, Human
aagggagccaagggauggaca

SEQ ID NO: 3554657 - RNA, 17 nt, Human
aagggagcuagccagag

SEQ ID NO: 3554658 - RNA, 22 nt, Human
aagggaggacgggagcugggga

SEQ ID NO: 3554659 - RNA, 13 nt, Human
aagggagggcaga

SEQ ID NO: 3554660 - RNA, 13 nt, Human
aagggagggcucu

SEQ ID NO: 3554661 - RNA, 19 nt, Human
aagggagggcucugaggcg

SEQ ID NO: 3554662 - RNA, 15 nt, Human
aagggaguuuaaaaa

SEQ ID NO: 3554663 - RNA, 19 nt, Human
aagggauauauaagaugga

SEQ ID NO: 3554664 - RNA, 16 nt, Human
aagggaucaucaugca

SEQ ID NO: 3554665 - RNA, 23 nt, Human
aagggaugcaggcuccccugagg

SEQ ID NO: 3554666 - RNA, 20 nt, Human
aagggauggaaaaggaagac

SEQ ID NO: 3554667 - RNA, 22 nt, Human
aagggauggaagaaguaaauau

SEQ ID NO: 3554668 - RNA, 16 nt, Human
aagggauggacaucuu

SEQ ID NO: 3554669 - RNA, 17 nt, Human
aagggauuuuagucaca

SEQ ID NO: 3554670 - RNA, 18 nt, Human
aagggcaaauuggagaaa

SEQ ID NO: 3554671 - RNA, 20 nt, Human
aagggcaacaauaaaauagc

SEQ ID NO: 3554672 - RNA, 15 nt, Human
aagggcagagucaca

SEQ ID NO: 3554673 - RNA, 21 nt, Human
aagggcaggaaggagagccug

SEQ ID NO: 3554674 - RNA, 22 nt, Human
aagggcaggaaggagagccugc

SEQ ID NO: 3554675 - RNA, 14 nt, Human
aagggcaguggagg

SEQ ID NO: 3554676 - RNA, 13 nt, Human
aagggcaugccuu

SEQ ID NO: 3554677 - RNA, 23 nt, Human
aagggcauuggccauucuauugu

SEQ ID NO: 3554678 - RNA, 12 nt, Human
aagggccagagc

SEQ ID NO: 3554679 - RNA, 17 nt, Human
aagggccaggagaugga

SEQ ID NO: 3554680 - RNA, 16 nt, Human
aagggccaguccugcc

SEQ ID NO: 3554681 - RNA, 16 nt, Human
aagggccaugcugaag

SEQ ID NO: 3554682 - RNA, 16 nt, Human
aagggcccuccuuccu

SEQ ID NO: 3554683 - RNA, 12 nt, Human
aagggcccuggg

SEQ ID NO: 3554684 - RNA, 20 nt, Human
aagggcccuucacugccuuu

SEQ ID NO: 3554685 - RNA, 16 nt, Human
aagggcccuuuuucaa

SEQ ID NO: 3554686 - RNA, 18 nt, Human
aagggcugaccugccucu

SEQ ID NO: 3554687 - RNA, 15 nt, Human
aagggcuguuauaau

SEQ ID NO: 3554688 - RNA, 18 nt, Human
aagggcuucugcacccuc

SEQ ID NO: 3554689 - RNA, 16 nt, Human
aaggggaaucuggagg

SEQ ID NO: 3554690 - RNA, 21 nt, Human
aaggggaaucuggagguagcc

SEQ ID NO: 3554691 - RNA, 22 nt, Human
aaggggaauguuugccucugcc

SEQ ID NO: 3554692 - RNA, 15 nt, Human
aaggggaauuaacaa

SEQ ID NO: 3554693 - RNA, 11 nt, Human
aaggggacagc

SEQ ID NO: 3554694 - RNA, 15 nt, Human
aaggggacaggccuc

SEQ ID NO: 3554695 - RNA, 19 nt, Human
aaggggacugccaccuccc

SEQ ID NO: 3554696 - RNA, 12 nt, Human
aaggggagagcc

SEQ ID NO: 3554697 - RNA, 14 nt, Human
aaggggagagccug

SEQ ID NO: 3554698 - RNA, 15 nt, Human
aaggggagagccugc

SEQ ID NO: 3554699 - RNA, 19 nt, Human
aaggggagagccugcuggc

SEQ ID NO: 3554700 - RNA, 13 nt, Human
aaggggagaguaa

SEQ ID NO: 3554701 - RNA, 13 nt, Human
aaggggagcccac

SEQ ID NO: 3554702 - RNA, 15 nt, Human
aaggggccugagcag

SEQ ID NO: 3554703 - RNA, 13 nt, Human
aaggggcuucagg

SEQ ID NO: 3554704 - RNA, 15 nt, Human
aagggggaggggaag

SEQ ID NO: 3554705 - RNA, 21 nt, Human
aagggggauaugaauggagau

SEQ ID NO: 3554706 - RNA, 16 nt, Human
aaggggggagggggag

SEQ ID NO: 3554707 - RNA, 18 nt, Human
aagggggggcuacauuau

SEQ ID NO: 3554708 - RNA, 20 nt, Human
aagggggggcuacauuauaa

SEQ ID NO: 3554709 - RNA, 16 nt, Human
aaggggguccacccag

SEQ ID NO: 3554710 - RNA, 17 nt, Human
aagggggucccaguggg

SEQ ID NO: 3554711 - RNA, 13 nt, Human
aagggguaaaagg

SEQ ID NO: 3554712 - RNA, 16 nt, Human
aaggggucacuuacag

SEQ ID NO: 3554713 - RNA, 16 nt, Human
aaggggucugaaauuu

SEQ ID NO: 3554714 - RNA, 14 nt, Human
aagggguuccucaa

SEQ ID NO: 3554715 - RNA, 18 nt, Human
aagggguuccucaaauuu

SEQ ID NO: 3554716 - RNA, 19 nt, Human
aagggguuggggugacagu

SEQ ID NO: 3554717 - RNA, 13 nt, Human
aagggguuuucuu

SEQ ID NO: 3554718 - RNA, 15 nt, Human
aaggguaaacaauau

SEQ ID NO: 3554719 - RNA, 16 nt, Human
aaggguaucuggugac

SEQ ID NO: 3554720 - RNA, 16 nt, Human
aagggucaggccuuug

SEQ ID NO: 3554721 - RNA, 18 nt, Human
aagggucgaaagcucuag

SEQ ID NO: 3554722 - RNA, 22 nt, Human
aagggucgaaagcucuagaauc

SEQ ID NO: 3554723 - RNA, 16 nt, Human
aagggucuagggagag

SEQ ID NO: 3554724 - RNA, 18 nt, Human
aagggucuagggagagac

SEQ ID NO: 3554725 - RNA, 19 nt, Human
aagggucuugggaaauaug

SEQ ID NO: 3554726 - RNA, 19 nt, Human
aagggugcugcuucccucu

SEQ ID NO: 3554727 - RNA, 23 nt, Human
aagggugcugcuucccucugccu

SEQ ID NO: 3554728 - RNA, 18 nt, Human
aagggugggugcucagaa

SEQ ID NO: 3554729 - RNA, 13 nt, Human
aagggugucugag

SEQ ID NO: 3554730 - RNA, 14 nt, Human
aaggguugagcugg

SEQ ID NO: 3554731 - RNA, 13 nt, Human
aaggguuucucua

SEQ ID NO: 3554732 - RNA, 14 nt, Human
aaggguuucucuau

SEQ ID NO: 3554733 - RNA, 14 nt, Human
aagguaaaaaguua

SEQ ID NO: 3554734 - RNA, 18 nt, Human
aagguaaaaugccaugau

SEQ ID NO: 3554735 - RNA, 13 nt, Human
aagguaaugugug

SEQ ID NO: 3554736 - RNA, 17 nt, Human
aagguaauuucuugugc

SEQ ID NO: 3554737 - RNA, 19 nt, Human
aagguacaagaagcauuuu

SEQ ID NO: 3554738 - RNA, 14 nt, Human
aagguacuguauga

SEQ ID NO: 3554739 - RNA, 15 nt, Human
aagguacuguaugau

SEQ ID NO: 3554740 - RNA, 19 nt, Human
aagguacuguaugaucaaa

SEQ ID NO: 3554741 - RNA, 21 nt, Human
aagguacuguaugaucaaaug

SEQ ID NO: 3554742 - RNA, 13 nt, Human
aagguagaaugac

SEQ ID NO: 3554743 - RNA, 17 nt, Human
aagguagaaugaccuug

SEQ ID NO: 3554744 - RNA, 20 nt, Human
aagguagaaugaccuuguaa

SEQ ID NO: 3554745 - RNA, 23 nt, Human
aauuaggcaaggcuaugugauua

SEQ ID NO: 3554746 - RNA, 20 nt, Human
aauuaggcccccaucauccu

SEQ ID NO: 3554747 - RNA, 17 nt, Human
aauuaggcuguaacuac

SEQ ID NO: 3554748 - RNA, 21 nt, Human
aauuaggcuguaacuacuuua

SEQ ID NO: 3554749 - RNA, 23 nt, Human
aauuaggcuguaacuacuuuaua

SEQ ID NO: 3554750 - RNA, 18 nt, Human
aauuagggcucuaauuuc

SEQ ID NO: 3554751 - RNA, 16 nt, Human
aauuagguuaacauug

SEQ ID NO: 3554752 - RNA, 14 nt, Human
aauuagguugaaac

SEQ ID NO: 3554753 - RNA, 21 nt, Human
aauuagguuuuuccuuauuug

SEQ ID NO: 3554754 - RNA, 20 nt, Human
aauuaguaaaaaaucaauua

SEQ ID NO: 3554755 - RNA, 15 nt, Human
aauuagugccacuua

SEQ ID NO: 3554756 - RNA, 20 nt, Human
aauuagugccacuuaaugua

SEQ ID NO: 3554757 - RNA, 14 nt, Human
aauuagugcuaagu

SEQ ID NO: 3554758 - RNA, 20 nt, Human
aauuagugcuaagugugaac

SEQ ID NO: 3554759 - RNA, 14 nt, Human
aauuaguuauauau

SEQ ID NO: 3554760 - RNA, 21 nt, Human
aauuaguuguguacucuggcc

SEQ ID NO: 3554761 - RNA, 13 nt, Human
aauuaguuuccuu

SEQ ID NO: 3554762 - RNA, 24 nt, Human
aauuaguuuuaaaaugauauuguu

SEQ ID NO: 3554763 - RNA, 18 nt, Human
aauuauaaagauaaagcu

SEQ ID NO: 3554764 - RNA, 23 nt, Human
aauuauaacuuaaaauauuuuau

SEQ ID NO: 3554765 - RNA, 17 nt, Human
aauuauaagaggcugau

SEQ ID NO: 3554766 - RNA, 15 nt, Human
aauuauaaggacugc

SEQ ID NO: 3554767 - RNA, 14 nt, Human
aauuauaagucaca

SEQ ID NO: 3554768 - RNA, 14 nt, Human
aauuauacuacuuu

SEQ ID NO: 3554769 - RNA, 16 nt, Human
aauuauacugugugug

SEQ ID NO: 3554770 - RNA, 19 nt, Human
aauuauagcucuaauguuu

SEQ ID NO: 3554771 - RNA, 21 nt, Human
aauuauaggagccuuaauuuu

SEQ ID NO: 3554772 - RNA, 21 nt, Human
aauuauagugucaugcagagu

SEQ ID NO: 3554773 - RNA, 15 nt, Human
aauuauaguuucuga

SEQ ID NO: 3554774 - RNA, 17 nt, Human
aauuauauaacuguauu

SEQ ID NO: 3554775 - RNA, 15 nt, Human
aauuauauaaguauu

SEQ ID NO: 3554776 - RNA, 16 nt, Human
aauuauauaaguauuc

SEQ ID NO: 3554777 - RNA, 17 nt, Human
aauuauauaaguauucu

SEQ ID NO: 3554778 - RNA, 21 nt, Human
aauuauaucuguggucuucaa

SEQ ID NO: 3554779 - RNA, 20 nt, Human
aauuauaugcuauuucuaua

SEQ ID NO: 3554780 - RNA, 21 nt, Human
aauuauaugcuauuucuauau

SEQ ID NO: 3554781 - RNA, 23 nt, Human
aauuauauuugugcuauaguauu

SEQ ID NO: 3554782 - RNA, 18 nt, Human
aauucuagugcugcugaa

SEQ ID NO: 3554783 - RNA, 13 nt, Human
aauucuccacugu

SEQ ID NO: 3554784 - RNA, 19 nt, Human
aauucucccgggacucugc

SEQ ID NO: 3554785 - RNA, 16 nt, Human
aauucuccugauaaaa

SEQ ID NO: 3554786 - RNA, 15 nt, Human
aauucucuauuuuuu

SEQ ID NO: 3554787 - RNA, 23 nt, Human
aauucucuuccaaccauuuaucu

SEQ ID NO: 3554788 - RNA, 14 nt, Human
aauucucuuucaaa

SEQ ID NO: 3554789 - RNA, 14 nt, Human
aauucugaaguuau

SEQ ID NO: 3554790 - RNA, 10 nt, Human
aauucugaau

SEQ ID NO: 3554791 - RNA, 19 nt, Human
aauucugagacauguguca

SEQ ID NO: 3554792 - RNA, 17 nt, Human
aauucugaguuuugugu

SEQ ID NO: 3554793 - RNA, 14 nt, Human
aauucugauuucuu

SEQ ID NO: 3554794 - RNA, 22 nt, Human
aauucugauuucuuuucaccau

SEQ ID NO: 3554795 - RNA, 20 nt, Human
aauucugcaauguuuuccuu

SEQ ID NO: 3554796 - RNA, 15 nt, Human
aauucugcuaccuca

SEQ ID NO: 3554797 - RNA, 16 nt, Human
aauucugcucagauag

SEQ ID NO: 3554798 - RNA, 12 nt, Human
aauucuguaaau

SEQ ID NO: 3554799 - RNA, 19 nt, Human
aauucuguacauagccuau

SEQ ID NO: 3554800 - RNA, 13 nt, Human
aauucuguauaga

SEQ ID NO: 3554801 - RNA, 20 nt, Human
aauucuguauagauuagaga

SEQ ID NO: 3554802 - RNA, 19 nt, Human
aauucugucacucaccacu

SEQ ID NO: 3554803 - RNA, 15 nt, Human
aauucuguuaaaauc

SEQ ID NO: 3554804 - RNA, 18 nt, Human
aauucuguucauuuguua

SEQ ID NO: 3554805 - RNA, 22 nt, Human
aauucuguucauuuguuauucu

SEQ ID NO: 3554806 - RNA, 15 nt, Human
aauucuguuuaauuu

SEQ ID NO: 3554807 - RNA, 17 nt, Human
aauucuguuuuuaaaaa

SEQ ID NO: 3554808 - RNA, 20 nt, Human
aauucuguuuuuaaaaauua

SEQ ID NO: 3554809 - RNA, 21 nt, Human
aauucuguuuuuaaugcuauu

SEQ ID NO: 3554810 - RNA, 22 nt, Human
aauucuuauuccauauuagaaa

SEQ ID NO: 3554811 - RNA, 17 nt, Human
aauucuuauuuugugga

SEQ ID NO: 3554812 - RNA, 21 nt, Human
aauucuucagcguaaaauggu

SEQ ID NO: 3554813 - RNA, 18 nt, Human
aauucuucagguggaaaa

SEQ ID NO: 3554814 - RNA, 13 nt, Human
aauucuuccuuug

SEQ ID NO: 3554815 - RNA, 15 nt, Human
aauucuuccuuugua

SEQ ID NO: 3554816 - RNA, 16 nt, Human
aauucuugaaggaaaa

SEQ ID NO: 3554817 - RNA, 14 nt, Human
aauucuugcaaagu

SEQ ID NO: 3554818 - RNA, 20 nt, Human
aauucuugcaaaguaucccu

SEQ ID NO: 3554819 - RNA, 21 nt, Human
aauucuugccaaauauaaaua

SEQ ID NO: 3554820 - RNA, 13 nt, Human
aauucuuggaaua

SEQ ID NO: 3554821 - RNA, 18 nt, Human
aauucuugguugaggaaa

SEQ ID NO: 3554822 - RNA, 20 nt, Human
aauucuuuauacaacagugc

SEQ ID NO: 3554823 - RNA, 17 nt, Human
aauucuuucaauacaga

SEQ ID NO: 3554824 - RNA, 18 nt, Human
aauucuuucaauacagau

SEQ ID NO: 3554825 - RNA, 21 nt, Human
aauucuuucaauacagauaua

SEQ ID NO: 3554826 - RNA, 18 nt, Human
aauucuuugaccuguugg

SEQ ID NO: 3554827 - RNA, 14 nt, Human
aauucuuuuuuauu

SEQ ID NO: 3554828 - RNA, 16 nt, Human
aauucuuuuuuauuaa

SEQ ID NO: 3554829 - RNA, 16 nt, Human
aauugaaaagaaguag

SEQ ID NO: 3554830 - RNA, 12 nt, Human
aauugaaccuuu

SEQ ID NO: 3554831 - RNA, 22 nt, Human
aauugaauaaugguaccagaua

SEQ ID NO: 3554832 - RNA, 23 nt, Human
aauugaauaaugguaccagauaa

SEQ ID NO: 3554833 - RNA, 15 nt, Human
aauugaaucacugcu

SEQ ID NO: 3554834 - RNA, 19 nt, Human
aauugacagaucaagcugu

SEQ ID NO: 3554835 - RNA, 17 nt, Human
aauugacauugaaaucu

SEQ ID NO: 3554836 - RNA, 18 nt, Human
aauugacauugaaaucua

SEQ ID NO: 3554837 - RNA, 24 nt, Human
aauugacgguuuuuuauuauugug

SEQ ID NO: 3554838 - RNA, 11 nt, Human
aauugacuacc

SEQ ID NO: 3554839 - RNA, 14 nt, Human
aauugacuguauuu

SEQ ID NO: 3554840 - RNA, 22 nt, Human
aauugagagaauggaaaacaga

SEQ ID NO: 3554841 - RNA, 19 nt, Human
aauugagaugauuaaaaug

SEQ ID NO: 3554842 - RNA, 17 nt, Human
aauugagccuaaaaaua

SEQ ID NO: 3554843 - RNA, 23 nt, Human
aauugagccuaaaaauaaagcac

SEQ ID NO: 3554844 - RNA, 21 nt, Human
aauugaguaaugguguagaac

SEQ ID NO: 3554845 - RNA, 13 nt, Human
aauugauaauaaa

SEQ ID NO: 3554846 - RNA, 14 nt, Human
aauugauaauaaac

SEQ ID NO: 3554847 - RNA, 22 nt, Human
aauugaucauuuuccccccacu

SEQ ID NO: 3554848 - RNA, 14 nt, Human
aauugauguguuua

SEQ ID NO: 3554849 - RNA, 23 nt, Human
aauugauugggcacaucauuuca

SEQ ID NO: 3554850 - RNA, 16 nt, Human
aauugauuugcauuga

SEQ ID NO: 3554851 - RNA, 20 nt, Human
aauugauuugcauugaacac

SEQ ID NO: 3554852 - RNA, 20 nt, Human
aauugauuuuuauaaauacu

SEQ ID NO: 3554853 - RNA, 19 nt, Human
aauugcacagaaguccugu

SEQ ID NO: 3554854 - RNA, 22 nt, Human
aauugcacgcggagugaguuuu

SEQ ID NO: 3554855 - RNA, 14 nt, Human
aauugcacucuaaa

SEQ ID NO: 3554856 - RNA, 15 nt, Human
aauugcauaaagcau

SEQ ID NO: 3554857 - RNA, 11 nt, Human
aauugcauuga

SEQ ID NO: 3554858 - RNA, 18 nt, Human
aauugcauugacuuuccc

SEQ ID NO: 3554859 - RNA, 21 nt, Human
aauugccaaaaagugaaauaa

SEQ ID NO: 3554860 - RNA, 23 nt, Human
aauugccaaaaagugaaauaaug

SEQ ID NO: 3554861 - RNA, 12 nt, Human
aauugccagcug

SEQ ID NO: 3554862 - RNA, 22 nt, Human
aauugccuauccugcuguucua

SEQ ID NO: 3554863 - RNA, 15 nt, Human
aauugccugacgaac

SEQ ID NO: 3554864 - RNA, 14 nt, Human
aauugcguuggucu

SEQ ID NO: 3554865 - RNA, 18 nt, Human
aauugcguuggucucugc

SEQ ID NO: 3554866 - RNA, 20 nt, Human
aauugcguuggucucugcau

SEQ ID NO: 3554867 - RNA, 15 nt, Human
aauugcuaauguugc

SEQ ID NO: 3554868 - RNA, 16 nt, Human
aauugcuaauguugcu

SEQ ID NO: 3554869 - RNA, 20 nt, Human
aauugcuauguuacuauuuu

SEQ ID NO: 3554870 - RNA, 23 nt, Human
aauugcuauguuuugacauuuuu

SEQ ID NO: 3554871 - RNA, 13 nt, Human
aauugcucacagu

SEQ ID NO: 3554872 - RNA, 21 nt, Human
aauugcucacaguuauuacau

SEQ ID NO: 3554873 - RNA, 18 nt, Human
aauugcucauaagcaaua

SEQ ID NO: 3554874 - RNA, 17 nt, Human
aauugcugacuguagcu

SEQ ID NO: 3554875 - RNA, 13 nt, Human
aauugcugcuacu

SEQ ID NO: 3554876 - RNA, 13 nt, Human
aauugcugugccu

SEQ ID NO: 3554877 - RNA, 19 nt, Human
aauugcuuaccaaaggaua

SEQ ID NO: 3554878 - RNA, 23 nt, Human
aauugcuuacuuuggaauacauu

SEQ ID NO: 3554879 - RNA, 22 nt, Human
aauugcuugaaagaaaauaugc

SEQ ID NO: 3554880 - RNA, 22 nt, Human
aauugcuuuaccuuuuuucuua

SEQ ID NO: 3554881 - RNA, 10 nt, Human
aauugcuuug

SEQ ID NO: 3554882 - RNA, 17 nt, Human
aauugcuuuuuuaaaua

SEQ ID NO: 3554883 - RNA, 20 nt, Human
aauuggaacagaauguuuua

SEQ ID NO: 3554884 - RNA, 20 nt, Human
aauuggaagcugcccugccc

SEQ ID NO: 3554885 - RNA, 18 nt, Human
aauuggaccauccuauuu

SEQ ID NO: 3554886 - RNA, 15 nt, Human
aauuggagcagggac

SEQ ID NO: 3554887 - RNA, 22 nt, Human
aauuggauacgacaacuugcac

SEQ ID NO: 3554888 - RNA, 20 nt, Human
aauuggcaccgaagcccaga

SEQ ID NO: 3554889 - RNA, 23 nt, Human
aauuggcauggaaauuuaaagca

SEQ ID NO: 3554890 - RNA, 17 nt, Human
aauuggcauuaaaacuu

SEQ ID NO: 3554891 - RNA, 14 nt, Human
aauugggaguccag

SEQ ID NO: 3554892 - RNA, 15 nt, Human
aauugggaguccagg

SEQ ID NO: 3554893 - RNA, 18 nt, Human
aauugggaguccaggcac

SEQ ID NO: 3554894 - RNA, 16 nt, Human
aauugggcacuauuua

SEQ ID NO: 3554895 - RNA, 16 nt, Human
aauuggggaggagggg

SEQ ID NO: 3554896 - RNA, 17 nt, Human
aauuggggauucuuaaa

SEQ ID NO: 3554897 - RNA, 20 nt, Human
aauuggggauucuuaaaguu

SEQ ID NO: 3554898 - RNA, 13 nt, Human
aauuggggcacuu

SEQ ID NO: 3554899 - RNA, 18 nt, Human
aauugggucauagaaauu

SEQ ID NO: 3554900 - RNA, 23 nt, Human
aauuggguggggggcuucauaca

SEQ ID NO: 3554901 - RNA, 16 nt, Human
aauuggguucaugaug

SEQ ID NO: 3554902 - RNA, 20 nt, Human
aauuggguucaugaugcagu

SEQ ID NO: 3554903 - RNA, 20 nt, Human
aauugguaaaacucacugug

SEQ ID NO: 3554904 - RNA, 15 nt, Human
aauugguaccuugca

SEQ ID NO: 3554905 - RNA, 19 nt, Human
aauugguacuuuuaaaaac

SEQ ID NO: 3554906 - RNA, 18 nt, Human
aauuguaaaauuguauag

SEQ ID NO: 3554907 - RNA, 13 nt, Human
aauuguaaacugu

SEQ ID NO: 3554908 - RNA, 17 nt, Human
aauuguaaacuguacua

SEQ ID NO: 3554909 - RNA, 22 nt, Human
aaucuguagggcuggaccuaug

SEQ ID NO: 3554910 - RNA, 20 nt, Human
aaucuguaucuguagugaga

SEQ ID NO: 3554911 - RNA, 16 nt, Human
aaucugucaaaacacu

SEQ ID NO: 3554912 - RNA, 17 nt, Human
aaucugucaaaacacug

SEQ ID NO: 3554913 - RNA, 21 nt, Human
aaucugucaaaacacugugga

SEQ ID NO: 3554914 - RNA, 21 nt, Human
aaucuguccaaaggaggcugg

SEQ ID NO: 3554915 - RNA, 15 nt, Human
aaucugugaacuuga

SEQ ID NO: 3554916 - RNA, 17 nt, Human
aaucugugaacuugaaa

SEQ ID NO: 3554917 - RNA, 21 nt, Human
aaucugugaacuugaaauuug

SEQ ID NO: 3554918 - RNA, 17 nt, Human
aaucugugggucuggga

SEQ ID NO: 3554919 - RNA, 19 nt, Human
aaucuguguacaaagaaau

SEQ ID NO: 3554920 - RNA, 18 nt, Human
aaucuguguagacgaagg

SEQ ID NO: 3554921 - RNA, 23 nt, Human
aaucugugugaaacuuucauucc

SEQ ID NO: 3554922 - RNA, 20 nt, Human
aaucuguuauguacuagugu

SEQ ID NO: 3554923 - RNA, 19 nt, Human
aaucuguugauaaauccau

SEQ ID NO: 3554924 - RNA, 21 nt, Human
aaucuguuuuauaccuugcuu

SEQ ID NO: 3554925 - RNA, 19 nt, Human
aaucuguuuuuacguaugu

SEQ ID NO: 3554926 - RNA, 21 nt, Human
aaguacugguaagauuguuau

SEQ ID NO: 3554927 - RNA, 23 nt, Human
aaguacuguaagaauaauuuaua

SEQ ID NO: 3554928 - RNA, 14 nt, Human
aaguacuguaauaa

SEQ ID NO: 3554929 - RNA, 20 nt, Human
aaguacuguaauaauaccuc

SEQ ID NO: 3554930 - RNA, 18 nt, Human
aaguacuucuccacccug

SEQ ID NO: 3554931 - RNA, 20 nt, Human
aaguacuucuccacccugcu

SEQ ID NO: 3554932 - RNA, 17 nt, Human
aaguacuuguaguucca

SEQ ID NO: 3554933 - RNA, 15 nt, Human
aaguacuuuuggcau

SEQ ID NO: 3554934 - RNA, 16 nt, Human
aaguagaaacaaaaua

SEQ ID NO: 3554935 - RNA, 13 nt, Human
aaguagaaauggu

SEQ ID NO: 3554936 - RNA, 18 nt, Human
aaguagaacuuuguauag

SEQ ID NO: 3554937 - RNA, 21 nt, Human
aaguagaacuuuguauaguua

SEQ ID NO: 3554938 - RNA, 18 nt, Human
aaguagacaaucauuguu

SEQ ID NO: 3554939 - RNA, 21 nt, Human
aaguagacaaucauuguuuug

SEQ ID NO: 3554940 - RNA, 23 nt, Human
aaguagacuucauuuuuccuaac

SEQ ID NO: 3554941 - RNA, 12 nt, Human
aaguagaggagg

SEQ ID NO: 3554942 - RNA, 15 nt, Human
aaguagaugcauuug

SEQ ID NO: 3554943 - RNA, 13 nt, Human
aaguagauuucau

SEQ ID NO: 3554944 - RNA, 15 nt, Human
aaguagcagugugaa

SEQ ID NO: 3554945 - RNA, 17 nt, Human
aaguagcauuuacugug

SEQ ID NO: 3554946 - RNA, 22 nt, Human
aaguagccaccugaguuccuga

SEQ ID NO: 3554947 - RNA, 13 nt, Human
aaguaggaaguaa

SEQ ID NO: 3554948 - RNA, 14 nt, Human
aaguaggcaggacc

SEQ ID NO: 3554949 - RNA, 21 nt, Human
aaguagggacuucugucuuca

SEQ ID NO: 3554950 - RNA, 18 nt, Human
aaguaguaaaaauuaaaa

SEQ ID NO: 3554951 - RNA, 19 nt, Human
aaguaguacuucuucugua

SEQ ID NO: 3554952 - RNA, 20 nt, Human
aaguaguacuucuucuguaa

SEQ ID NO: 3554953 - RNA, 15 nt, Human
aaguaguggagcccc

SEQ ID NO: 3554954 - RNA, 15 nt, Human
aaguagugugcaguu

SEQ ID NO: 3554955 - RNA, 19 nt, Human
aaguaguuaucauguuagu

SEQ ID NO: 3554956 - RNA, 19 nt, Human
aaguaguucuguauuugaa

SEQ ID NO: 3554957 - RNA, 16 nt, Human
aaguauaaauuugugu

SEQ ID NO: 3554958 - RNA, 15 nt, Human
aaguauacauaaguu

SEQ ID NO: 3554959 - RNA, 13 nt, Human
aaguauagagaga

SEQ ID NO: 3554960 - RNA, 18 nt, Human
aaguauauaaugguuuca

SEQ ID NO: 3554961 - RNA, 23 nt, Human
aaguauaucauguaaagaaaugu

SEQ ID NO: 3554962 - RNA, 19 nt, Human
aaguaucaaguauagaaaa

SEQ ID NO: 3554963 - RNA, 12 nt, Human
aaguaucagaaa

SEQ ID NO: 3554964 - RNA, 13 nt, Human
aaguaucagaaag

SEQ ID NO: 3554965 - RNA, 19 nt, Human
aaguaucaucaguguagaa

SEQ ID NO: 3554966 - RNA, 18 nt, Human
aaguaucuuuuuucaaaa

SEQ ID NO: 3554967 - RNA, 21 nt, Human
aaguaugagggaaaaugagua

SEQ ID NO: 3554968 - RNA, 22 nt, Human
aaguauguaaaguauguaaaca

SEQ ID NO: 3554969 - RNA, 21 nt, Human
aaguauguauauuaaaaaaga

SEQ ID NO: 3554970 - RNA, 22 nt, Human
aaguauguauauuaaaaaagag

SEQ ID NO: 3554971 - RNA, 14 nt, Human
aaguauguauuauu

SEQ ID NO: 3554972 - RNA, 13 nt, Human
aaguaugugagug

SEQ ID NO: 3554973 - RNA, 18 nt, Human
aaguaugugguuuuguaa

SEQ ID NO: 3554974 - RNA, 14 nt, Human
aaguauuaaaacau

SEQ ID NO: 3554975 - RNA, 15 nt, Human
aaguauuaaaacauu

SEQ ID NO: 3554976 - RNA, 21 nt, Human
aaguauuaaaacauuggauua

SEQ ID NO: 3554977 - RNA, 16 nt, Human
aaguauuccaccuuaa

SEQ ID NO: 3554978 - RNA, 17 nt, Human
aaguauuccaccuuaaa

SEQ ID NO: 3554979 - RNA, 14 nt, Human
aaguauucugccuu

SEQ ID NO: 3554980 - RNA, 20 nt, Human
aaguauucugccuuugcaga

SEQ ID NO: 3554981 - RNA, 23 nt, Human
aaguauucuuauuuaaugaaaga

SEQ ID NO: 3554982 - RNA, 17 nt, Human
aaguauugccaaacauu

SEQ ID NO: 3554983 - RNA, 18 nt, Human
aaguauugccaaacauua

SEQ ID NO: 3554984 - RNA, 13 nt, Human
aaguauuguaaau

SEQ ID NO: 3554985 - RNA, 21 nt, Human
aaguauuguaaauuauauuug

SEQ ID NO: 3554986 - RNA, 13 nt, Human
aaguauuuaagcc

SEQ ID NO: 3554987 - RNA, 16 nt, Human
aaguauuuaauuagug

SEQ ID NO: 3554988 - RNA, 19 nt, Human
aaguauuuaauuagugcua

SEQ ID NO: 3554989 - RNA, 12 nt, Human
aaguauuuauaa

SEQ ID NO: 3554990 - RNA, 13 nt, Human
aaguauuuauaua

SEQ ID NO: 3554991 - RNA, 16 nt, Human
aaguauuuauauauuu

SEQ ID NO: 3554992 - RNA, 22 nt, Human
aaguauuuauauauuuauaacu

SEQ ID NO: 3554993 - RNA, 23 nt, Human
aaguauuuauauauuuauaacuc

SEQ ID NO: 3554994 - RNA, 20 nt, Human
aaguauuuguuaauuuagaa

SEQ ID NO: 3554995 - RNA, 14 nt, Human
aaguauuuuauucu

SEQ ID NO: 3554996 - RNA, 14 nt, Human
aaguauuuuccugu

SEQ ID NO: 3554997 - RNA, 15 nt, Human
aaguauuuuccugua

SEQ ID NO: 3554998 - RNA, 15 nt, Human
aaguauuuuccuguu

SEQ ID NO: 3554999 - RNA, 11 nt, Human
aaguauuuuga

SEQ ID NO: 3555000 - RNA, 14 nt, Human
aaguauuuugaagu

SEQ ID NO: 3555001 - RNA, 16 nt, Human
aaguauuuugaaguuu

SEQ ID NO: 3555002 - RNA, 21 nt, Human
aaguauuuugaaguuuacauu

SEQ ID NO: 3555003 - RNA, 22 nt, Human
aaguauuuugaaguuuacauuu

SEQ ID NO: 3555004 - RNA, 21 nt, Human
aaguauuuuuauaaauauaag

SEQ ID NO: 3555005 - RNA, 19 nt, Human
aaguauuuuuucaguauua

SEQ ID NO: 3555006 - RNA, 16 nt, Human
aagucaaaaggugccu

SEQ ID NO: 3555007 - RNA, 21 nt, Human
aagucaaaauauuuuuaaaag

SEQ ID NO: 3555008 - RNA, 20 nt, Human
aagucaaacacuugugacuu

SEQ ID NO: 3555009 - RNA, 20 nt, Human
aagucaaagcaaggaaacua

SEQ ID NO: 3555010 - RNA, 17 nt, Human
aagucaacaguaaacca

SEQ ID NO: 3555011 - RNA, 21 nt, Human
aagucaacaguaaaccacuga

SEQ ID NO: 3555012 - RNA, 13 nt, Human
aagucaaggagaa

SEQ ID NO: 3555013 - RNA, 22 nt, Human
aagucaaggcuuagacccucau

SEQ ID NO: 3555014 - RNA, 16 nt, Human
aagucaaucauuucuc

SEQ ID NO: 3555015 - RNA, 18 nt, Human
aagucaaucauuucucac

SEQ ID NO: 3555016 - RNA, 18 nt, Human
aagucacaauguucuuua

SEQ ID NO: 3555017 - RNA, 13 nt, Human
aagucacacagug

SEQ ID NO: 3555018 - RNA, 15 nt, Human
aagucacagggcagu

SEQ ID NO: 3555019 - RNA, 19 nt, Human
aagucacaucacaggacac

SEQ ID NO: 3555020 - RNA, 15 nt, Human
aagucacaugcguaa

SEQ ID NO: 3555021 - RNA, 21 nt, Human
aagucacccggcccccaugca

SEQ ID NO: 3555022 - RNA, 16 nt, Human
aagucacccuagcccu

SEQ ID NO: 3555023 - RNA, 22 nt, Human
aagucacccuagcccucucccu

SEQ ID NO: 3555024 - RNA, 23 nt, Human
aagucacccuagcccucucccuc

SEQ ID NO: 3555025 - RNA, 21 nt, Human
aagucacucaauuguuuuugu

SEQ ID NO: 3555026 - RNA, 23 nt, Human
aagucacucccaagcccccuccu

SEQ ID NO: 3555027 - RNA, 22 nt, Human
aagucacugcacagugcaucuc

SEQ ID NO: 3555028 - RNA, 20 nt, Human
aagucacuuacuauuguugc

SEQ ID NO: 3555029 - RNA, 18 nt, Human
aagucagaacagcagacu

SEQ ID NO: 3555030 - RNA, 12 nt, Human
aagucagaaguu

SEQ ID NO: 3555031 - RNA, 13 nt, Human
aagucagaaguuu

SEQ ID NO: 3555032 - RNA, 18 nt, Human
aagucagaaucagaagau

SEQ ID NO: 3555033 - RNA, 23 nt, Human
aagucagaaucagaagauagucu

SEQ ID NO: 3555034 - RNA, 22 nt, Human
aagucagaggauggccaguguc

SEQ ID NO: 3555035 - RNA, 20 nt, Human
aagucagauggaaaauucau

SEQ ID NO: 3555036 - RNA, 19 nt, Human
aagucagcccaacaggcag

SEQ ID NO: 3555037 - RNA, 15 nt, Human
aagucagcuccagcu

SEQ ID NO: 3555038 - RNA, 20 nt, Human
aagucagcuccagcuuucug

SEQ ID NO: 3555039 - RNA, 17 nt, Human
aagucaguacccaccac

SEQ ID NO: 3555040 - RNA, 16 nt, Human
aagucaguauggucua

SEQ ID NO: 3555041 - RNA, 23 nt, Human
aagucaguccaggaugcuaacau

SEQ ID NO: 3555042 - RNA, 20 nt, Human
aagucaguugcucaaaaaga

SEQ ID NO: 3555043 - RNA, 23 nt, Human
aagucaugaagcccaagugaaau

SEQ ID NO: 3555044 - RNA, 19 nt, Human
aagucaugauguuuuuaaa

SEQ ID NO: 3555045 - RNA, 22 nt, Human
aagucaugauguuuuuaaaauc

SEQ ID NO: 3555046 - RNA, 21 nt, Human
aagucaugcuccccugugcca

SEQ ID NO: 3555047 - RNA, 13 nt, Human
aagucauguaugu

SEQ ID NO: 3555048 - RNA, 16 nt, Human
aagucauguauguuuc

SEQ ID NO: 3555049 - RNA, 17 nt, Human
aagucauguauguuucu

SEQ ID NO: 3555050 - RNA, 16 nt, Human
aagucauuuuaacuuu

SEQ ID NO: 3555051 - RNA, 18 nt, Human
aaguccaagcauuuagau

SEQ ID NO: 3555052 - RNA, 18 nt, Human
aaguccaauuuuaauuua

SEQ ID NO: 3555053 - RNA, 19 nt, Human
aaguccaauuuuaauuuag

SEQ ID NO: 3555054 - RNA, 23 nt, Human
aaguccagauuuacacugggaga

SEQ ID NO: 3555055 - RNA, 13 nt, Human
aaguccagguccu

SEQ ID NO: 3555056 - RNA, 19 nt, Human
aaguccagguccugguggg

SEQ ID NO: 3555057 - RNA, 22 nt, Human
aaguccccaggccccaggaagc

SEQ ID NO: 3555058 - RNA, 19 nt, Human
aagucccugacucucugug

SEQ ID NO: 3555059 - RNA, 13 nt, Human
aagucccugcccc

SEQ ID NO: 3555060 - RNA, 18 nt, Human
aaguccgcagaagcccug

SEQ ID NO: 3555061 - RNA, 20 nt, Human
aaguccuacuuuuaaagaau

SEQ ID NO: 3555062 - RNA, 14 nt, Human
aaguccuauggaaa

SEQ ID NO: 3555063 - RNA, 21 nt, Human
aaguccucccugacuuuucug

SEQ ID NO: 3555064 - RNA, 13 nt, Human
aaguccugaagag

SEQ ID NO: 3555065 - RNA, 17 nt, Human
aaguccugaagaggcgg

SEQ ID NO: 3555066 - RNA, 12 nt, Human
aaguccuggcuu

SEQ ID NO: 3555067 - RNA, 17 nt, Human
aaguccuguaugucugu

SEQ ID NO: 3555068 - RNA, 15 nt, Human
aaugacaggccuguc

SEQ ID NO: 3555069 - RNA, 21 nt, Human
aaugacaugugucaagcugcu

SEQ ID NO: 3555070 - RNA, 21 nt, Human
aauaaaagcagcaucugcuaa

SEQ ID NO: 3555071 - RNA, 11 nt, Human
aauaaaagccu

SEQ ID NO: 3555072 - RNA, 14 nt, Human
aauaaaaggaaaag

SEQ ID NO: 3555073 - RNA, 20 nt, Human
aauaaaaggaagccaaagag

SEQ ID NO: 3555074 - RNA, 21 nt, Human
aauaaaaggaagccaaagagu

SEQ ID NO: 3555075 - RNA, 15 nt, Human
aauaaaauauaauug

SEQ ID NO: 3555076 - RNA, 20 nt, Human
aauaaaauauaucuuauaaa

SEQ ID NO: 3555077 - RNA, 12 nt, Human
aauaaaauauca

SEQ ID NO: 3555078 - RNA, 17 nt, Human
aauaaaauaucauucag

SEQ ID NO: 3555079 - RNA, 15 nt, Human
aauaaaauauuuucu

SEQ ID NO: 3555080 - RNA, 18 nt, Human
aauaaaauauuuucugug

SEQ ID NO: 3555081 - RNA, 16 nt, Human
aauaaaaucuugaaaa

SEQ ID NO: 3555082 - RNA, 13 nt, Human
aauaaaaugaaaa

SEQ ID NO: 3555083 - RNA, 14 nt, Human
aauaaaauggguuu

SEQ ID NO: 3555084 - RNA, 19 nt, Human
aauaaaauggguuuuacug

SEQ ID NO: 3555085 - RNA, 14 nt, Human
aauaaaaugugauu

SEQ ID NO: 3555086 - RNA, 21 nt, Human
aauaaaaugugauuuuucuga

SEQ ID NO: 3555087 - RNA, 17 nt, Human
aauaaaauguugaaaag

SEQ ID NO: 3555088 - RNA, 23 nt, Human
aauaaaauuaaagcugaaaacug

SEQ ID NO: 3555089 - RNA, 14 nt, Human
aauaaaauuaagaa

SEQ ID NO: 3555090 - RNA, 17 nt, Human
aauaaaauuauuugcag

SEQ ID NO: 3555091 - RNA, 12 nt, Human
aauaaaauugua

SEQ ID NO: 3555092 - RNA, 15 nt, Human
aauaaaauuucuaag

SEQ ID NO: 3555093 - RNA, 21 nt, Human
aauaaaauuucuaagagagcu

SEQ ID NO: 3555094 - RNA, 14 nt, Human
aauaaaauuuguug

SEQ ID NO: 3555095 - RNA, 16 nt, Human
aauaaaauuuguugca

SEQ ID NO: 3555096 - RNA, 17 nt, Human
aauaaaauuuuaguuga

SEQ ID NO: 3555097 - RNA, 18 nt, Human
aauaaacacauagauuca

SEQ ID NO: 3555098 - RNA, 21 nt, Human
aauaaacacauagauucaccu

SEQ ID NO: 3555099 - RNA, 10 nt, Human
aauaaacacu

SEQ ID NO: 3555100 - RNA, 16 nt, Human
aauaaacacucuugaa

SEQ ID NO: 3555101 - RNA, 12 nt, Human
aauaaacacugu

SEQ ID NO: 3555102 - RNA, 21 nt, Human
aauaaacagcuucaugccuuu

SEQ ID NO: 3555103 - RNA, 16 nt, Human
aauaaaccaaaggaca

SEQ ID NO: 3555104 - RNA, 15 nt, Human
aauaaacccucagag

SEQ ID NO: 3555105 - RNA, 20 nt, Human
aauaaaccucaaaaugucua

SEQ ID NO: 3555106 - RNA, 15 nt, Human
aauaaacuauuggaa

SEQ ID NO: 3555107 - RNA, 18 nt, Human
aauaaacucaaugagcuc

SEQ ID NO: 3555108 - RNA, 18 nt, Human
aauaaacuggcagcucag

SEQ ID NO: 3555109 - RNA, 17 nt, Human
aauaaacuguguuuacu

SEQ ID NO: 3555110 - RNA, 16 nt, Human
aauaaacuuaacuuua

SEQ ID NO: 3555111 - RNA, 21 nt, Human
aauaaacuuagaauaaaauug

SEQ ID NO: 3555112 - RNA, 13 nt, Human
aauaaacuuuaau

SEQ ID NO: 3555113 - RNA, 18 nt, Human
aauaaacuuuuuuucaau

SEQ ID NO: 3555114 - RNA, 20 nt, Human
aauaaacuuuuuuucaaugu

SEQ ID NO: 3555115 - RNA, 17 nt, Human
aauaaagaaaagaugca

SEQ ID NO: 3555116 - RNA, 20 nt, Human
aauaaagaaaagaugcacuu

SEQ ID NO: 3555117 - RNA, 13 nt, Human
aauaaagaauacu

SEQ ID NO: 3555118 - RNA, 15 nt, Human
aauaaagaauacuug

SEQ ID NO: 3555119 - RNA, 19 nt, Human
aauaaagaauacuugaacu

SEQ ID NO: 3555120 - RNA, 12 nt, Human
aauaaagacagg

SEQ ID NO: 3555121 - RNA, 14 nt, Human
aauaaagaucaugu

SEQ ID NO: 3555122 - RNA, 18 nt, Human
aaugucauauacugccau

SEQ ID NO: 3555123 - RNA, 19 nt, Human
aaugucauauacugccaug

SEQ ID NO: 3555124 - RNA, 17 nt, Human
aaugucaugcugccuua

SEQ ID NO: 3555125 - RNA, 19 nt, Human
aaugucaugcugccuuauu

SEQ ID NO: 3555126 - RNA, 14 nt, Human
aaugucauuuuggu

SEQ ID NO: 3555127 - RNA, 17 nt, Human
aauguccaguaagauca

SEQ ID NO: 3555128 - RNA, 19 nt, Human
aauguccaguaagaucacu

SEQ ID NO: 3555129 - RNA, 15 nt, Human
aaugucuaaaugcug

SEQ ID NO: 3555130 - RNA, 16 nt, Human
aaugucuaauguauuu

SEQ ID NO: 3555131 - RNA, 19 nt, Human
aaugucucacugagcacug

SEQ ID NO: 3555132 - RNA, 17 nt, Human
aaugucugagugaaccu

SEQ ID NO: 3555133 - RNA, 15 nt, Human
aaugucugcugagga

SEQ ID NO: 3555134 - RNA, 16 nt, Human
aaugucugcugaggag

SEQ ID NO: 3555135 - RNA, 14 nt, Human
aaugucuggagacc

SEQ ID NO: 3555136 - RNA, 14 nt, Human
aaugucuguaaaua

SEQ ID NO: 3555137 - RNA, 16 nt, Human
aaugucuguaauaaua

SEQ ID NO: 3555138 - RNA, 19 nt, Human
aaugucuguaauaauagac

SEQ ID NO: 3555139 - RNA, 23 nt, Human
aaugucuguaauaauagacugua

SEQ ID NO: 3555140 - RNA, 17 nt, Human
aaugucuucauuucauu

SEQ ID NO: 3555141 - RNA, 21 nt, Human
aaugucuucauuucauuguau

SEQ ID NO: 3555142 - RNA, 14 nt, Human
aaugucuugagcuc

SEQ ID NO: 3555143 - RNA, 19 nt, Human
aaugucuugagcucuauua

SEQ ID NO: 3555144 - RNA, 17 nt, Human
aaugucuuguaagcaaa

SEQ ID NO: 3555145 - RNA, 11 nt, Human
aaugucuugug

SEQ ID NO: 3555146 - RNA, 13 nt, Human
aaugucuuguguu

SEQ ID NO: 3555147 - RNA, 13 nt, Human
aaugucuuguuaa

SEQ ID NO: 3555148 - RNA, 20 nt, Human
aaugucuuuaaugcaauaua

SEQ ID NO: 3555149 - RNA, 15 nt, Human
aaugucuuuccaaau

SEQ ID NO: 3555150 - RNA, 23 nt, Human
aaugucuuuccaaauuauuucuu

SEQ ID NO: 3555151 - RNA, 15 nt, Human
aaugucuuuguaagu

SEQ ID NO: 3555152 - RNA, 22 nt, Human
aaugucuuuguaagucaguguu

SEQ ID NO: 3555153 - RNA, 22 nt, Human
aaugucuuuguuggaaaagaau

SEQ ID NO: 3555154 - RNA, 17 nt, Human
aaugucuuuugaauauu

SEQ ID NO: 3555155 - RNA, 22 nt, Human
aaugucuuuuuuuuaaugugcu

SEQ ID NO: 3555156 - RNA, 15 nt, Human
aaugugaaaagaaaa

SEQ ID NO: 3555157 - RNA, 19 nt, Human
aaugugaaaagaaaaauga

SEQ ID NO: 3555158 - RNA, 22 nt, Human
aaugugaaaaugguccaggaga

SEQ ID NO: 3555159 - RNA, 20 nt, Human
aaugugaacuagcuggaauu

SEQ ID NO: 3555160 - RNA, 15 nt, Human
aaugugaacuuuauu

SEQ ID NO: 3555161 - RNA, 12 nt, Human
aaugugaagaug

SEQ ID NO: 3555162 - RNA, 22 nt, Human
aaugugaagaugcauuguaguu

SEQ ID NO: 3555163 - RNA, 16 nt, Human
aaugugaauaaaauua

SEQ ID NO: 3555164 - RNA, 23 nt, Human
aaugugaaucagacccuacccca

SEQ ID NO: 3555165 - RNA, 12 nt, Human
aaugugaauuac

SEQ ID NO: 3555166 - RNA, 17 nt, Human
aaugugaauuacuaacu

SEQ ID NO: 3555167 - RNA, 14 nt, Human
aaugugacucaaga

SEQ ID NO: 3555168 - RNA, 15 nt, Human
aaugugagaagccag

SEQ ID NO: 3555169 - RNA, 16 nt, Human
aaugugauaaaacccc

SEQ ID NO: 3555170 - RNA, 22 nt, Human
aaugugaucuauguuucaucuu

SEQ ID NO: 3555171 - RNA, 20 nt, Human
aaugugaugaauacuguauu

SEQ ID NO: 3555172 - RNA, 18 nt, Human
aaugugaugauguaauug

SEQ ID NO: 3555173 - RNA, 20 nt, Human
aaugugaugauguaauugac

SEQ ID NO: 3555174 - RNA, 16 nt, Human
aaugugauguucuaag

SEQ ID NO: 3555175 - RNA, 17 nt, Human
aaugugauguucuaagg

SEQ ID NO: 3555176 - RNA, 16 nt, Human
aaugugauuuuucuga

SEQ ID NO: 3555177 - RNA, 22 nt, Human
aaugugcagguuuguuacauag

SEQ ID NO: 3555178 - RNA, 18 nt, Human
aaugugcuauacugcaua

SEQ ID NO: 3555179 - RNA, 21 nt, Human
aaugugcugaaugguuuucaa

SEQ ID NO: 3555180 - RNA, 14 nt, Human
aaugugcuguguaa

SEQ ID NO: 3555181 - RNA, 19 nt, Human
aaugugcuguguaaaguua

SEQ ID NO: 3555182 - RNA, 21 nt, Human
aaugugcuguguaaaguuagu

SEQ ID NO: 3555183 - RNA, 17 nt, Human
aauguggcagcugucuc

SEQ ID NO: 3555184 - RNA, 21 nt, Human
aauguggccccugaacaagaa

SEQ ID NO: 3555185 - RNA, 21 nt, Human
aauguggcuugagaaauaugg

SEQ ID NO: 3555186 - RNA, 21 nt, Human
aaugugggaagaaacaaaccc

SEQ ID NO: 3555187 - RNA, 16 nt, Human
aaugugguagccucac

SEQ ID NO: 3555188 - RNA, 19 nt, Human
aaugugguuauuucucuga

SEQ ID NO: 3555189 - RNA, 23 nt, Human
aaugugguuauuucucugauuug

SEQ ID NO: 3555190 - RNA, 21 nt, Human
aauguguaguucauguaaaua

SEQ ID NO: 3555191 - RNA, 22 nt, Human
aauguguaguucauguaaauaa

SEQ ID NO: 3555192 - RNA, 14 nt, Human
aauguguccuaucu

SEQ ID NO: 3555193 - RNA, 23 nt, Human
aauguguccuaucuaucuuccaa

SEQ ID NO: 3555194 - RNA, 23 nt, Human
aaugugucuuuagauagcccugu

SEQ ID NO: 3555195 - RNA, 15 nt, Human
aaugugucuuucuaa

SEQ ID NO: 3555196 - RNA, 22 nt, Human
aaugugucuuucuuuuuggaca

SEQ ID NO: 3555197 - RNA, 22 nt, Human
aaugugugaaaaagaugccaau

SEQ ID NO: 3555198 - RNA, 21 nt, Human
aaugugugguggccucagcug

SEQ ID NO: 3555199 - RNA, 13 nt, Human
aauguguguauau

SEQ ID NO: 3555200 - RNA, 17 nt, Human
aauguguguauauggac

SEQ ID NO: 3555201 - RNA, 13 nt, Human
aauguguguaugu

SEQ ID NO: 3555202 - RNA, 21 nt, Human
aauguguguauguguauuuau

SEQ ID NO: 3555203 - RNA, 16 nt, Human
aaugugugucaauuua

SEQ ID NO: 3555204 - RNA, 21 nt, Human
aaugugugugaugugacauuu

SEQ ID NO: 3555205 - RNA, 22 nt, Human
aaugugugugguuuuuuuucua

SEQ ID NO: 3555206 - RNA, 16 nt, Human
aauguguugaaacugc

SEQ ID NO: 3555207 - RNA, 14 nt, Human
aauguguuggacaa

SEQ ID NO: 3555208 - RNA, 18 nt, Human
aauguguuucaaacugua

SEQ ID NO: 3555209 - RNA, 13 nt, Human
aauguguuucugu

SEQ ID NO: 3555210 - RNA, 22 nt, Human
aauguguuuuagaguaagaaau

SEQ ID NO: 3555211 - RNA, 17 nt, Human
aauguguuuuguacaug

SEQ ID NO: 3555212 - RNA, 16 nt, Human
aauguguuuuucucca

SEQ ID NO: 3555213 - RNA, 15 nt, Human
aauguuaaaaugugu

SEQ ID NO: 3555214 - RNA, 16 nt, Human
aauguuaaaauguguu

SEQ ID NO: 3555215 - RNA, 23 nt, Human
acaaugcugugcccuaaagugua

SEQ ID NO: 3555216 - RNA, 24 nt, Human
acaaugcugugcccuaaaguguau

SEQ ID NO: 3555217 - RNA, 14 nt, Human
acaauggaaacuga

SEQ ID NO: 3555218 - RNA, 21 nt, Human
acaauggcuaauucccagagu

SEQ ID NO: 3555219 - RNA, 21 nt, Human
acaaugguuuucuuguguguu

SEQ ID NO: 3555220 - RNA, 14 nt, Human
acaauguacacacu

SEQ ID NO: 3555221 - RNA, 17 nt, Human
acaauguagauaagugu

SEQ ID NO: 3555222 - RNA, 15 nt, Human
acaaugucaguauuu

SEQ ID NO: 3555223 - RNA, 22 nt, Human
acaaugucaguauuucagugua

SEQ ID NO: 3555224 - RNA, 23 nt, Human
acaaugucaguauuucaguguag

SEQ ID NO: 3555225 - RNA, 12 nt, Human
acaaugugaacu

SEQ ID NO: 3555226 - RNA, 19 nt, Human
acaaugugaacuuuauuaa

SEQ ID NO: 3555227 - RNA, 20 nt, Human
acaaugugacuuugaaaaua

SEQ ID NO: 3555228 - RNA, 14 nt, Human
acaaugugucugag

SEQ ID NO: 3555229 - RNA, 22 nt, Human
acaaugugucuuucuuuuugga

SEQ ID NO: 3555230 - RNA, 19 nt, Human
acaauguuaaggaaacucu

SEQ ID NO: 3555231 - RNA, 13 nt, Human
acaauguucuuua

SEQ ID NO: 3555232 - RNA, 16 nt, Human
acaauuacuuuagaaa

SEQ ID NO: 3555233 - RNA, 20 nt, Human
acaauuauuccaaaccaaau

SEQ ID NO: 3555234 - RNA, 18 nt, Human
acaauuauuuuuacaguu

SEQ ID NO: 3555235 - RNA, 21 nt, Human
acaauuauuuuuacaguucuc

SEQ ID NO: 3555236 - RNA, 19 nt, Human
acaauucaaagaaucaccu

SEQ ID NO: 3555237 - RNA, 15 nt, Human
acaauucaugaacuu

SEQ ID NO: 3555238 - RNA, 20 nt, Human
acaauucaugaacuucgcau

SEQ ID NO: 3555239 - RNA, 18 nt, Human
acaauuccaaaggaaucu

SEQ ID NO: 3555240 - RNA, 13 nt, Human
acaauuccaugac

SEQ ID NO: 3555241 - RNA, 15 nt, Human
acaauucccugcugu

SEQ ID NO: 3555242 - RNA, 16 nt, Human
acaauucccugcuguc

SEQ ID NO: 3555243 - RNA, 12 nt, Human
acaauucuaaaa

SEQ ID NO: 3555244 - RNA, 17 nt, Human
acaauucuaaaaugauu

SEQ ID NO: 3555245 - RNA, 23 nt, Human
acaauucuaaaaugauuguagua

SEQ ID NO: 3555246 - RNA, 17 nt, Human
acaauucuguuuuuaau

SEQ ID NO: 3555247 - RNA, 16 nt, Human
acaauucuuuauacaa

SEQ ID NO: 3555248 - RNA, 19 nt, Human
acaauucuuuauacaacag

SEQ ID NO: 3555249 - RNA, 21 nt, Human
acaauucuuuauacaacagug

SEQ ID NO: 3555250 - RNA, 22 nt, Human
acaauugaaguaaacuuuuugu

SEQ ID NO: 3555251 - RNA, 22 nt, Human
acaauugagguaaguuuuuuga

SEQ ID NO: 3555252 - RNA, 13 nt, Human
acaauugggagcu

SEQ ID NO: 3555253 - RNA, 20 nt, Human
acaauuguaaaacugaggca

SEQ ID NO: 3555254 - RNA, 21 nt, Human
acaauugucgaaaagagucuu

SEQ ID NO: 3555255 - RNA, 21 nt, Human
acaauuguguagccuuuuugu

SEQ ID NO: 3555256 - RNA, 18 nt, Human
acaauuguuuuaaucuga

SEQ ID NO: 3555257 - RNA, 20 nt, Human
acaauuguuuuaaucugaaa

SEQ ID NO: 3555258 - RNA, 13 nt, Human
acaauuuaaagca

SEQ ID NO: 3555259 - RNA, 14 nt, Human
acaauuuaaagcaa

SEQ ID NO: 3555260 - RNA, 13 nt, Human
acaauuuacaaag

SEQ ID NO: 3555261 - RNA, 14 nt, Human
acaauuuauuaugg

SEQ ID NO: 3555262 - RNA, 15 nt, Human
acaauuuauuauggc

SEQ ID NO: 3555263 - RNA, 16 nt, Human
acaauuuauuauggca

SEQ ID NO: 3555264 - RNA, 20 nt, Human
acaauuuccuuuauauuuag

SEQ ID NO: 3555265 - RNA, 14 nt, Human
acaauuugauacau

SEQ ID NO: 3555266 - RNA, 14 nt, Human
acaauuuggcaauu

SEQ ID NO: 3555267 - RNA, 22 nt, Human
acaauuuggcaauuuugugguu

SEQ ID NO: 3555268 - RNA, 23 nt, Human
acaauuugggcuuccuguuugua

SEQ ID NO: 3555269 - RNA, 19 nt, Human
acaauuuucagauuugcac

SEQ ID NO: 3555270 - RNA, 22 nt, Human
acaauuuucagauuugcacaaa

SEQ ID NO: 3555271 - RNA, 17 nt, Human
acaauuuuguuucugua

SEQ ID NO: 3555272 - RNA, 14 nt, Human
acaauuuuuaaugg

SEQ ID NO: 3555273 - RNA, 15 nt, Human
acaauuuuuaauggc

SEQ ID NO: 3555274 - RNA, 21 nt, Human
acaauuuuuuuaauuuuguau

SEQ ID NO: 3555275 - RNA, 17 nt, Human
acacaaaacaaauccug

SEQ ID NO: 3555276 - RNA, 12 nt, Human
acacaaaaucaa

SEQ ID NO: 3555277 - RNA, 19 nt, Human
acacaaaccacaacugaca

SEQ ID NO: 3555278 - RNA, 15 nt, Human
acacaaaccugccug

SEQ ID NO: 3555279 - RNA, 15 nt, Human
acacaaacuguaaau

SEQ ID NO: 3555280 - RNA, 19 nt, Human
acacaaacuguaaauaaaa

SEQ ID NO: 3555281 - RNA, 11 nt, Human
aauaaagcaau

SEQ ID NO: 3555282 - RNA, 13 nt, Human
aauaaagcaauuu

SEQ ID NO: 3555283 - RNA, 18 nt, Human
aauaaagcaauuuuccuu

SEQ ID NO: 3555284 - RNA, 22 nt, Human
aauaaagcaauuuuccuugaag

SEQ ID NO: 3555285 - RNA, 21 nt, Human
aauaaagccuugugaucacuu

SEQ ID NO: 3555286 - RNA, 19 nt, Human
aauaaagcuguguggcagu

SEQ ID NO: 3555287 - RNA, 18 nt, Human
aauaaaggacuguaaucu

SEQ ID NO: 3555288 - RNA, 16 nt, Human
aauaaaggaugugauu

SEQ ID NO: 3555289 - RNA, 15 nt, Human
aauaaaggcaguuuu

SEQ ID NO: 3555290 - RNA, 18 nt, Human
aauaaaggcaguuuucua

SEQ ID NO: 3555291 - RNA, 19 nt, Human
aauaaaggcaguuuucuaa

SEQ ID NO: 3555292 - RNA, 18 nt, Human
aauaaagguuguuuugaa

SEQ ID NO: 3555293 - RNA, 14 nt, Human
aauaaaguaauuau

SEQ ID NO: 3555294 - RNA, 16 nt, Human
aauaaaguacaagagc

SEQ ID NO: 3555295 - RNA, 15 nt, Human
aauaaaguauauaau

SEQ ID NO: 3555296 - RNA, 15 nt, Human
aauaaaguaucaugc

SEQ ID NO: 3555297 - RNA, 19 nt, Human
aauaaaguaucaugcauuc

SEQ ID NO: 3555298 - RNA, 15 nt, Human
aauaaaguauuccac

SEQ ID NO: 3555299 - RNA, 14 nt, Human
aauaaaguauuuaa

SEQ ID NO: 3555300 - RNA, 19 nt, Human
aauaaaguauuuaauuagu

SEQ ID NO: 3555301 - RNA, 20 nt, Human
aauaaaguauuuaauuagug

SEQ ID NO: 3555302 - RNA, 12 nt, Human
aauaaaguguau

SEQ ID NO: 3555303 - RNA, 15 nt, Human
aauaaaguguuuuca

SEQ ID NO: 3555304 - RNA, 18 nt, Human
aauaaaguguuuucagag

SEQ ID NO: 3555305 - RNA, 19 nt, Human
aauaaaguguuuucagagc

SEQ ID NO: 3555306 - RNA, 19 nt, Human
aauaaaguuggucuuuuga

SEQ ID NO: 3555307 - RNA, 19 nt, Human
aauaaaguuugaucuuccu

SEQ ID NO: 3555308 - RNA, 14 nt, Human
aauaaauaaaugca

SEQ ID NO: 3555309 - RNA, 20 nt, Human
aauaaauaccucuuagcuga

SEQ ID NO: 3555310 - RNA, 21 nt, Human
aauaaauagagcaauuacaag

SEQ ID NO: 3555311 - RNA, 10 nt, Human
aauaaauagu

SEQ ID NO: 3555312 - RNA, 12 nt, Human
aauaaauauaua

SEQ ID NO: 3555313 - RNA, 16 nt, Human
aauaaauauauauaaa

SEQ ID NO: 3555314 - RNA, 19 nt, Human
aauaaauauauauaaaccu

SEQ ID NO: 3555315 - RNA, 15 nt, Human
aauaaauauauauau

SEQ ID NO: 3555316 - RNA, 16 nt, Human
aauaaaucauaaaacu

SEQ ID NO: 3555317 - RNA, 16 nt, Human
aauaaaucugacccag

SEQ ID NO: 3555318 - RNA, 17 nt, Human
aauaaaucugacccagu

SEQ ID NO: 3555319 - RNA, 20 nt, Human
aauaaaucugguagaaaaau

SEQ ID NO: 3555320 - RNA, 22 nt, Human
aauaaaucuguugccaagcugg

SEQ ID NO: 3555321 - RNA, 14 nt, Human
aauaaaucuuccua

SEQ ID NO: 3555322 - RNA, 15 nt, Human
aauaaaucuuuggaa

SEQ ID NO: 3555323 - RNA, 16 nt, Human
aauaaaugagcuaugu

SEQ ID NO: 3555324 - RNA, 16 nt, Human
aauaaaugcccucuuc

SEQ ID NO: 3555325 - RNA, 17 nt, Human
aauaaaugguauagcaa

SEQ ID NO: 3555326 - RNA, 21 nt, Human
aauaaaugguauagcaaaugu

SEQ ID NO: 3555327 - RNA, 22 nt, Human
aauaaaugguauagcaaauguu

SEQ ID NO: 3555328 - RNA, 13 nt, Human
aauaaaugucacu

SEQ ID NO: 3555329 - RNA, 13 nt, Human
aauaaaugucauu

SEQ ID NO: 3555330 - RNA, 17 nt, Human
aauaaaugucauuaaaa

SEQ ID NO: 3555331 - RNA, 13 nt, Human
aauaaaugucuuu

SEQ ID NO: 3555332 - RNA, 23 nt, Human
aauaaaugucuuuuuuuuaaugu

SEQ ID NO: 3555333 - RNA, 12 nt, Human
aauaaaugugcc

SEQ ID NO: 3555334 - RNA, 18 nt, Human
aauaaauuaaaacaugca

SEQ ID NO: 3555335 - RNA, 21 nt, Human
aauaaauuaaauaaaauaacc

SEQ ID NO: 3555336 - RNA, 14 nt, Human
aauaaauuaguugu

SEQ ID NO: 3555337 - RNA, 14 nt, Human
aauaaauugaaauu

SEQ ID NO: 3555338 - RNA, 22 nt, Human
aauaaauugauuuuuauaaaua

SEQ ID NO: 3555339 - RNA, 20 nt, Human
aauaaauugcaugcugcuuu

SEQ ID NO: 3555340 - RNA, 19 nt, Human
aauaaauugcuaauguugc

SEQ ID NO: 3555341 - RNA, 14 nt, Human
aauaaauuggaguu

SEQ ID NO: 3555342 - RNA, 15 nt, Human
aauaaauuguauauu

SEQ ID NO: 3555343 - RNA, 17 nt, Human
aauaaauuguauauuca

SEQ ID NO: 3555344 - RNA, 13 nt, Human
aauaaauuguuug

SEQ ID NO: 3555345 - RNA, 12 nt, Human
aauaaauuuuga

SEQ ID NO: 3555346 - RNA, 22 nt, Human
aauaaauuuugaaaaguaauau

SEQ ID NO: 3555347 - RNA, 22 nt, Human
aauaaauuuuuuauaaaagugu

SEQ ID NO: 3555348 - RNA, 15 nt, Human
aauaacaaagcccuu

SEQ ID NO: 3555349 - RNA, 19 nt, Human
aauaacaaugugcucucgg

SEQ ID NO: 3555350 - RNA, 19 nt, Human
aauaacacuaaaauuuuag

SEQ ID NO: 3555351 - RNA, 13 nt, Human
aauaacagccgcu

SEQ ID NO: 3555352 - RNA, 16 nt, Human
aauaacauaacaaaua

SEQ ID NO: 3555353 - RNA, 20 nt, Human
aauaacauaauuuguacaua

SEQ ID NO: 3555354 - RNA, 15 nt, Human
aauaacauuaccuua

SEQ ID NO: 3555355 - RNA, 20 nt, Human
aauaacauuaccuuacugug

SEQ ID NO: 3555356 - RNA, 17 nt, Human
aauaaccggauauauac

SEQ ID NO: 3555357 - RNA, 16 nt, Human
aauaaccguaaagguu

SEQ ID NO: 3555358 - RNA, 15 nt, Human
aauaacuaaaaugua

SEQ ID NO: 3555359 - RNA, 13 nt, Human
aauaacuacugug

SEQ ID NO: 3555360 - RNA, 17 nt, Human
aauauauuucuaaaugu

SEQ ID NO: 3555361 - RNA, 13 nt, Human
aauauauuugugu

SEQ ID NO: 3555362 - RNA, 14 nt, Human
aauauauuugugua

SEQ ID NO: 3555363 - RNA, 12 nt, Human
aauauauuuuag

SEQ ID NO: 3555364 - RNA, 17 nt, Human
aauauauuuuguaugca

SEQ ID NO: 3555365 - RNA, 20 nt, Human
aauaucaaagucauuaaaga

SEQ ID NO: 3555366 - RNA, 21 nt, Human
aauaucaaaugcaguauauuu

SEQ ID NO: 3555367 - RNA, 19 nt, Human
aauaucaaauuaauugugu

SEQ ID NO: 3555368 - RNA, 19 nt, Human
aauaucaccaaaaaccuau

SEQ ID NO: 3555369 - RNA, 20 nt, Human
aauaucaccaaaaaccuauu

SEQ ID NO: 3555370 - RNA, 20 nt, Human
aauaucacuugucaauaaaa

SEQ ID NO: 3555371 - RNA, 13 nt, Human
aauaucagacuuu

SEQ ID NO: 3555372 - RNA, 22 nt, Human
aauaucauaucaucacauugag

SEQ ID NO: 3555373 - RNA, 13 nt, Human
aauaucauuuauu

SEQ ID NO: 3555374 - RNA, 23 nt, Human
aauauccaggucaacagaaugaa

SEQ ID NO: 3555375 - RNA, 24 nt, Human
aauauccaggucaacagaaugaaa

SEQ ID NO: 3555376 - RNA, 18 nt, Human
aauaucccuacauguauu

SEQ ID NO: 3555377 - RNA, 12 nt, Human
aauaucccuccu

SEQ ID NO: 3555378 - RNA, 21 nt, Human
aauaucccuuggacauuuuau

SEQ ID NO: 3555379 - RNA, 18 nt, Human
aauauccuaaacaucauu

SEQ ID NO: 3555380 - RNA, 19 nt, Human
aauauccuaauaaaaaggu

SEQ ID NO: 3555381 - RNA, 12 nt, Human
aauauccuuugc

SEQ ID NO: 3555382 - RNA, 12 nt, Human
aauaucuaaagu

SEQ ID NO: 3555383 - RNA, 15 nt, Human
aauaucuaaaguuau

SEQ ID NO: 3555384 - RNA, 16 nt, Human
aauaucuaaaguuaua

SEQ ID NO: 3555385 - RNA, 16 nt, Human
aauaucuaguaauaua

SEQ ID NO: 3555386 - RNA, 16 nt, Human
aauaucuauuaauaua

SEQ ID NO: 3555387 - RNA, 16 nt, Human
aauaucuccgucaacu

SEQ ID NO: 3555388 - RNA, 15 nt, Human
aauaucucuauuuaa

SEQ ID NO: 3555389 - RNA, 16 nt, Human
aauaucucuauuuaau

SEQ ID NO: 3555390 - RNA, 23 nt, Human
aauaucucuauuuaauuuugaca

SEQ ID NO: 3555391 - RNA, 16 nt, Human
aauaucugaaaaugua

SEQ ID NO: 3555392 - RNA, 12 nt, Human
aauaucugaagc

SEQ ID NO: 3555393 - RNA, 13 nt, Human
aauaucugcugua

SEQ ID NO: 3555394 - RNA, 15 nt, Human
aauaucuuggccuaa

SEQ ID NO: 3555395 - RNA, 12 nt, Human
aauaucuuucug

SEQ ID NO: 3555396 - RNA, 19 nt, Human
aauaucuuugugauaauuu

SEQ ID NO: 3555397 - RNA, 22 nt, Human
aauaucuuugugauaauuuaag

SEQ ID NO: 3555398 - RNA, 14 nt, Human
aauaucuuuuaugu

SEQ ID NO: 3555399 - RNA, 19 nt, Human
aauaucuuuuuuuuaauaa

SEQ ID NO: 3555400 - RNA, 13 nt, Human
aauaugaaaacuu

SEQ ID NO: 3555401 - RNA, 14 nt, Human
aauaugaaaacuua

SEQ ID NO: 3555402 - RNA, 20 nt, Human
aauaugaaauuuuuuuucau

SEQ ID NO: 3555403 - RNA, 21 nt, Human
aauaugaacccuuuguuucuu

SEQ ID NO: 3555404 - RNA, 12 nt, Human
aauaugaaugcc

SEQ ID NO: 3555405 - RNA, 22 nt, Human
aauaugaaugcccccagcuggc

SEQ ID NO: 3555406 - RNA, 19 nt, Human
aauaugacuuuuuauaaaa

SEQ ID NO: 3555407 - RNA, 16 nt, Human
aauaugagaaucagau

SEQ ID NO: 3555408 - RNA, 19 nt, Human
aauaugaggcauuuggcau

SEQ ID NO: 3555409 - RNA, 16 nt, Human
aauaugaguacaaaug

SEQ ID NO: 3555410 - RNA, 17 nt, Human
aauaugaguacaaaugc

SEQ ID NO: 3555411 - RNA, 11 nt, Human
aauaugaugac

SEQ ID NO: 3555412 - RNA, 14 nt, Human
aauaugaugacaau

SEQ ID NO: 3555413 - RNA, 18 nt, Human
aauaugauuaaaaauauc

SEQ ID NO: 3555414 - RNA, 18 nt, Human
aauaugauuaguaaagaa

SEQ ID NO: 3555415 - RNA, 12 nt, Human
aauaugauuuua

SEQ ID NO: 3555416 - RNA, 22 nt, Human
aauaugauuuuuuaaaagaaau

SEQ ID NO: 3555417 - RNA, 24 nt, Human
aauaugcaaagcacugacuucuaa

SEQ ID NO: 3555418 - RNA, 18 nt, Human
aauaugcaaagucuaggu

SEQ ID NO: 3555419 - RNA, 20 nt, Human
aauaugccuaguaacacaua

SEQ ID NO: 3555420 - RNA, 16 nt, Human
aauaugcuaauucuca

SEQ ID NO: 3555421 - RNA, 13 nt, Human
aauaugcuaauuu

SEQ ID NO: 3555422 - RNA, 14 nt, Human
aauaugcugccaaa

SEQ ID NO: 3555423 - RNA, 16 nt, Human
aauaugcuuaaaauaa

SEQ ID NO: 3555424 - RNA, 23 nt, Human
aauaugcuuaaaauaagcaggug

SEQ ID NO: 3555425 - RNA, 11 nt, Human
aauaugcuuac

SEQ ID NO: 3555426 - RNA, 23 nt, Human
aauaugcuuucaucuucuguugc

SEQ ID NO: 3555427 - RNA, 14 nt, Human
aauauggaacuuac

SEQ ID NO: 3555428 - RNA, 24 nt, Human
aauauggaacuuacauuguucaau

SEQ ID NO: 3555429 - RNA, 20 nt, Human
aauauggaacuucuaauaua

SEQ ID NO: 3555430 - RNA, 18 nt, Human
aauaugguguacauucuu

SEQ ID NO: 3555431 - RNA, 16 nt, Human
aauauguacauuucua

SEQ ID NO: 3555432 - RNA, 15 nt, Human
aauauguaccaagaa

SEQ ID NO: 3555433 - RNA, 15 nt, Human
aauauguauaacuuu

SEQ ID NO: 3555434 - RNA, 21 nt, Human
aauauguauucuguaaaagaa

SEQ ID NO: 3555435 - RNA, 20 nt, Human
aauauguauuuuauguaugu

SEQ ID NO: 3555436 - RNA, 11 nt, Human
aauaugucagu

SEQ ID NO: 3555437 - RNA, 17 nt, Human
aauauguccauaucuaa

SEQ ID NO: 3555438 - RNA, 19 nt, Human
aauauguccauaucuaacc

SEQ ID NO: 3555439 - RNA, 19 nt, Human
aauaugugaaggaccuuca

SEQ ID NO: 3555440 - RNA, 21 nt, Human
aauauguuaaccucaguguca

SEQ ID NO: 3555441 - RNA, 16 nt, Human
aauauguuagcaaaga

SEQ ID NO: 3555442 - RNA, 13 nt, Human
aauauguuuccuu

SEQ ID NO: 3555443 - RNA, 19 nt, Human
aauauguuuccuuguuuau

SEQ ID NO: 3555444 - RNA, 21 nt, Human
aauauuaaaaaacuucaugua

SEQ ID NO: 3555445 - RNA, 13 nt, Human
aauauuaaaaagu

SEQ ID NO: 3555446 - RNA, 17 nt, Human
aauauuaaaaagucuuu

SEQ ID NO: 3555447 - RNA, 20 nt, Human
aauauuaaaaagucuuuuaa

SEQ ID NO: 3555448 - RNA, 19 nt, Human
aauauuaaaagucacaaug

SEQ ID NO: 3555449 - RNA, 17 nt, Human
aauauuaaacccuggau

SEQ ID NO: 3555450 - RNA, 12 nt, Human
aauauuaaagcc

SEQ ID NO: 3555451 - RNA, 16 nt, Human
aauauuaaagccaugu

SEQ ID NO: 3555452 - RNA, 18 nt, Human
aauauuaaagccauguuu

SEQ ID NO: 3555453 - RNA, 17 nt, Human
aauauuaaauacagaca

SEQ ID NO: 3555454 - RNA, 19 nt, Human
aauauuaaauacagacacu

SEQ ID NO: 3555455 - RNA, 21 nt, Human
aauauuaaaucugcuggaguu

SEQ ID NO: 3555456 - RNA, 22 nt, Human
aauauuaaugccuuuaaaguau

SEQ ID NO: 3555457 - RNA, 13 nt, Human
aauauuagaaaca

SEQ ID NO: 3555458 - RNA, 12 nt, Human
aauauuagaugu

SEQ ID NO: 3555459 - RNA, 20 nt, Human
aauauuagaugugauuuaau

SEQ ID NO: 3555460 - RNA, 22 nt, Human
aauauuaggcuuaaaaacugaa

SEQ ID NO: 3555461 - RNA, 14 nt, Human
aauauuaguuaaug

SEQ ID NO: 3555462 - RNA, 18 nt, Human
aauauuaguuaauggauu

SEQ ID NO: 3555463 - RNA, 22 nt, Human
aauauuauacuaagaaaagaua

SEQ ID NO: 3555464 - RNA, 17 nt, Human
aauauuauauuuggaug

SEQ ID NO: 3555465 - RNA, 11 nt, Human
aauauuaucuu

SEQ ID NO: 3555466 - RNA, 18 nt, Human
aauauuaugagaugcugg

SEQ ID NO: 3555467 - RNA, 21 nt, Human
aauauuaugcaaauucccaga

SEQ ID NO: 3555468 - RNA, 15 nt, Human
aauauucagaaucuu

SEQ ID NO: 3555469 - RNA, 20 nt, Human
aauauucagacaaaauggau

SEQ ID NO: 3555470 - RNA, 18 nt, Human
aauauucauaguuuaauu

SEQ ID NO: 3555471 - RNA, 18 nt, Human
aauauuccagaucuuuca

SEQ ID NO: 3555472 - RNA, 22 nt, Human
aauauuccagaucuuucagaaa

SEQ ID NO: 3555473 - RNA, 15 nt, Human
aauauuccugaauga

SEQ ID NO: 3555474 - RNA, 15 nt, Human
aauauuccugcauuu

SEQ ID NO: 3555475 - RNA, 20 nt, Human
aauauucuauaugaauuuaa

SEQ ID NO: 3555476 - RNA, 14 nt, Human
aauauucucuauuu

SEQ ID NO: 3555477 - RNA, 15 nt, Human
aauauucucuguaca

SEQ ID NO: 3555478 - RNA, 14 nt, Human
aauauugaaaauug

SEQ ID NO: 3555479 - RNA, 16 nt, Human
aauauugaaaauugaa

SEQ ID NO: 3555480 - RNA, 14 nt, Human
aauauugaaguacu

SEQ ID NO: 3555481 - RNA, 20 nt, Human
aauauugacauuuguaguug

SEQ ID NO: 3555482 - RNA, 14 nt, Human
aauauugacuugua

SEQ ID NO: 3555483 - RNA, 16 nt, Human
aauauugacuuugucu

SEQ ID NO: 3555484 - RNA, 16 nt, Human
aauauugagaaagaaa

SEQ ID NO: 3555485 - RNA, 17 nt, Human
aauauugaggcuuugug

SEQ ID NO: 3555486 - RNA, 15 nt, Human
acacgugaugugaua

SEQ ID NO: 3555487 - RNA, 23 nt, Human
acacgugcaauuuguuugugcuu

SEQ ID NO: 3555488 - RNA, 20 nt, Human
acacguggaggaaugcuccc

SEQ ID NO: 3555489 - RNA, 21 nt, Human
acacguggaggaaugcucccc

SEQ ID NO: 3555490 - RNA, 18 nt, Human
acacgugggcuccccucu

SEQ ID NO: 3555491 - RNA, 23 nt, Human
acacgugggcuccccucuuccuc

SEQ ID NO: 3555492 - RNA, 16 nt, Human
acacguuuuaaggacu

SEQ ID NO: 3555493 - RNA, 14 nt, Human
acacuaaaauuuua

SEQ ID NO: 3555494 - RNA, 15 nt, Human
acacuaaaauuuuag

SEQ ID NO: 3555495 - RNA, 20 nt, Human
acacuaaacagacuauuuaa

SEQ ID NO: 3555496 - RNA, 21 nt, Human
acacuaaacagacuauuuaac

SEQ ID NO: 3555497 - RNA, 17 nt, Human
acacuaaagauccaaga

SEQ ID NO: 3555498 - RNA, 12 nt, Human
acacuaaauguu

SEQ ID NO: 3555499 - RNA, 13 nt, Human
acacuaaauguua

SEQ ID NO: 3555500 - RNA, 14 nt, Human
acacuaaccaaauc

SEQ ID NO: 3555501 - RNA, 22 nt, Human
acacuaaccaagcugaguuucc

SEQ ID NO: 3555502 - RNA, 14 nt, Human
acacuaaccacgcu

SEQ ID NO: 3555503 - RNA, 16 nt, Human
acacuaaccacgcugg

SEQ ID NO: 3555504 - RNA, 19 nt, Human
acacuaaccacgcuggacc

SEQ ID NO: 3555505 - RNA, 18 nt, Human
acaaagcacaguuugaac

SEQ ID NO: 3555506 - RNA, 15 nt, Human
acaaagcacuagaga

SEQ ID NO: 3555507 - RNA, 11 nt, Human
acaaagcccaa

SEQ ID NO: 3555508 - RNA, 18 nt, Human
acaaagcccuuccauguc

SEQ ID NO: 3555509 - RNA, 18 nt, Human
acaaagcuguuaaacugu

SEQ ID NO: 3555510 - RNA, 16 nt, Human
acaaagcuuagcagga

SEQ ID NO: 3555511 - RNA, 22 nt, Human
acaaagcuuuugcauauugcau

SEQ ID NO: 3555512 - RNA, 23 nt, Human
acaaagcuuuugcauauugcaua

SEQ ID NO: 3555513 - RNA, 18 nt, Human
acaaaggaauggaggcuc

SEQ ID NO: 3555514 - RNA, 13 nt, Human
acaaaggagccug

SEQ ID NO: 3555515 - RNA, 16 nt, Human
acaaaggagccuguga

SEQ ID NO: 3555516 - RNA, 17 nt, Human
acaaaggccaaacugcu

SEQ ID NO: 3555517 - RNA, 19 nt, Human
acaaaggcuguauucagca

SEQ ID NO: 3555518 - RNA, 22 nt, Human
acaaagggcacagcaucuguag

SEQ ID NO: 3555519 - RNA, 17 nt, Human
acaaaggggcuuaauua

SEQ ID NO: 3555520 - RNA, 15 nt, Human
acaaaggguuuuaau

SEQ ID NO: 3555521 - RNA, 22 nt, Human
acaaagguuuaaaugaacaaga

SEQ ID NO: 3555522 - RNA, 16 nt, Human
acaaaguaauuuggaa

SEQ ID NO: 3555523 - RNA, 15 nt, Human
acaaaguauuaagca

SEQ ID NO: 3555524 - RNA, 15 nt, Human
acaaaguggaaggaa

SEQ ID NO: 3555525 - RNA, 23 nt, Human
acaaaguggaaggaaagaugcuc

SEQ ID NO: 3555526 - RNA, 13 nt, Human
acaaaguguguau

SEQ ID NO: 3555527 - RNA, 16 nt, Human
acaaaguguguauuaa

SEQ ID NO: 3555528 - RNA, 17 nt, Human
acaaaguguguauuaaa

SEQ ID NO: 3555529 - RNA, 18 nt, Human
acaaaguuaaaauuguua

SEQ ID NO: 3555530 - RNA, 19 nt, Human
acaaaguuuaccagaaagc

SEQ ID NO: 3555531 - RNA, 19 nt, Human
acaaaguuucaauuuguuu

SEQ ID NO: 3555532 - RNA, 20 nt, Human
acaaaguuucagaguauauu

SEQ ID NO: 3555533 - RNA, 14 nt, Human
acaaauaacaacuu

SEQ ID NO: 3555534 - RNA, 15 nt, Human
acaaauaacaacuuu

SEQ ID NO: 3555535 - RNA, 16 nt, Human
acaaauaacaagaaua

SEQ ID NO: 3555536 - RNA, 12 nt, Human
acaaauaaucac

SEQ ID NO: 3555537 - RNA, 14 nt, Human
acaaauaauuuaga

SEQ ID NO: 3555538 - RNA, 19 nt, Human
acaaauacaauacauagga

SEQ ID NO: 3555539 - RNA, 23 nt, Human
acaaauacucuuaggaagagaaa

SEQ ID NO: 3555540 - RNA, 15 nt, Human
acaaauacuuauuca

SEQ ID NO: 3555541 - RNA, 16 nt, Human
acaaauacuuauucau

SEQ ID NO: 3555542 - RNA, 17 nt, Human
acaaauacuuauucauu

SEQ ID NO: 3555543 - RNA, 21 nt, Human
acaaauacuuauucauugugg

SEQ ID NO: 3555544 - RNA, 13 nt, Human
acaaauagaaaau

SEQ ID NO: 3555545 - RNA, 16 nt, Human
acaaauagaaaauggu

SEQ ID NO: 3555546 - RNA, 16 nt, Human
acaaauauaagaauaa

SEQ ID NO: 3555547 - RNA, 17 nt, Human
acaaauauaagaauaaa

SEQ ID NO: 3555548 - RNA, 14 nt, Human
acaaauauaagauu

SEQ ID NO: 3555549 - RNA, 15 nt, Human
acaaauauauuguua

SEQ ID NO: 3555550 - RNA, 11 nt, Human
acaaauaugca

SEQ ID NO: 3555551 - RNA, 17 nt, Human
acaaauaugcuaauuug

SEQ ID NO: 3555552 - RNA, 18 nt, Human
acaaauaugcuaauuugg

SEQ ID NO: 3555553 - RNA, 18 nt, Human
acaaauauuaaaaagucu

SEQ ID NO: 3555554 - RNA, 21 nt, Human
acaaauauugguguugucagu

SEQ ID NO: 3555555 - RNA, 22 nt, Human
acaaauauuuauuuucuuucug

SEQ ID NO: 3555556 - RNA, 23 nt, Human
acaaauauuuauuuucuuucugu

SEQ ID NO: 3555557 - RNA, 20 nt, Human
acaaauauuucuagacacuu

SEQ ID NO: 3555558 - RNA, 17 nt, Human
acaaaucaacagaagca

SEQ ID NO: 3555559 - RNA, 17 nt, Human
acaaaucaaguuuccaa

SEQ ID NO: 3555560 - RNA, 20 nt, Human
acaaaucaaguuuccaagca

SEQ ID NO: 3555561 - RNA, 12 nt, Human
acaaaucaguaa

SEQ ID NO: 3555562 - RNA, 13 nt, Human
acaaaucaguaau

SEQ ID NO: 3555563 - RNA, 16 nt, Human
acaaaucaguaauuuu

SEQ ID NO: 3555564 - RNA, 14 nt, Human
acaaaucuauuuaa

SEQ ID NO: 3555565 - RNA, 19 nt, Human
acaaaucugcaaagcaugu

SEQ ID NO: 3555566 - RNA, 14 nt, Human
acaaaucugucugc

SEQ ID NO: 3555567 - RNA, 19 nt, Human
acaaaucuguguauauuau

SEQ ID NO: 3555568 - RNA, 15 nt, Human
acaaaugacuuuauu

SEQ ID NO: 3555569 - RNA, 17 nt, Human
acaaaugacuuuauuau

SEQ ID NO: 3555570 - RNA, 16 nt, Human
acaaaugauugcuuuu

SEQ ID NO: 3555571 - RNA, 19 nt, Human
acaaaugauugcuuuuaaa

SEQ ID NO: 3555572 - RNA, 21 nt, Human
acaaaugauugcuuuuaaaau

SEQ ID NO: 3555573 - RNA, 20 nt, Human
acaaaugcaucuuugaugug

SEQ ID NO: 3555574 - RNA, 17 nt, Human
acaaaugcuauuaaagu

SEQ ID NO: 3555575 - RNA, 15 nt, Human
acaaauggacauagg

SEQ ID NO: 3555576 - RNA, 14 nt, Human
acaaaugugaagau

SEQ ID NO: 3555577 - RNA, 17 nt, Human
acaaaugugaagaugca

SEQ ID NO: 3555578 - RNA, 21 nt, Human
acaaaugugaagaugcauugu

SEQ ID NO: 3555579 - RNA, 19 nt, Human
acaaauguuaaaauguguu

SEQ ID NO: 3555580 - RNA, 14 nt, Human
acaaauuaaaaaga

SEQ ID NO: 3555581 - RNA, 16 nt, Human
acaaauuaaaaagauu

SEQ ID NO: 3555582 - RNA, 15 nt, Human
acaaauuauaaugua

SEQ ID NO: 3555583 - RNA, 15 nt, Human
acaaauuaucuuaaa

SEQ ID NO: 3555584 - RNA, 17 nt, Human
acaaauuauuaaugaaa

SEQ ID NO: 3555585 - RNA, 14 nt, Human
acaaauuauuuuug

SEQ ID NO: 3555586 - RNA, 21 nt, Human
acaaauucugucucuggauua

SEQ ID NO: 3555587 - RNA, 15 nt, Human
acaaauugagacagu

SEQ ID NO: 3555588 - RNA, 20 nt, Human
acaaauugcacagaaguccu

SEQ ID NO: 3555589 - RNA, 20 nt, Human
acaaauugcuuacuuuggaa

SEQ ID NO: 3555590 - RNA, 18 nt, Human
acaaauugcuugaaagaa

SEQ ID NO: 3555591 - RNA, 18 nt, Human
acaaauuuaaaacaaaca

SEQ ID NO: 3555592 - RNA, 17 nt, Human
acaaauuuacagagaca

SEQ ID NO: 3555593 - RNA, 18 nt, Human
acaaauuuuuauuucuaa

SEQ ID NO: 3555594 - RNA, 21 nt, Human
acaaauuuuuauuucuaaaau

SEQ ID NO: 3555595 - RNA, 11 nt, Human
acaacaaaaau

SEQ ID NO: 3555596 - RNA, 15 nt, Human
acaacaaccugguca

SEQ ID NO: 3555597 - RNA, 13 nt, Human
acaacaagaguuu

SEQ ID NO: 3555598 - RNA, 15 nt, Human
acaacacaaccaacg

SEQ ID NO: 3555599 - RNA, 23 nt, Human
acaacacuguaguaaauaaugcu

SEQ ID NO: 3555600 - RNA, 22 nt, Human
acaacagagacugaaauguguu

SEQ ID NO: 3555601 - RNA, 13 nt, Human
acaacagauuugu

SEQ ID NO: 3555602 - RNA, 16 nt, Human
acaacagauuugugaa

SEQ ID NO: 3555603 - RNA, 15 nt, Human
acaacagcugaagca

SEQ ID NO: 3555604 - RNA, 16 nt, Human
acaacagcugaagcac

SEQ ID NO: 3555605 - RNA, 15 nt, Human
acaacagcuggugcc

SEQ ID NO: 3555606 - RNA, 22 nt, Human
acaacauagcagaucuguuuug

SEQ ID NO: 3555607 - RNA, 23 nt, Human
acaacauccaaguggccuccguc

SEQ ID NO: 3555608 - RNA, 23 nt, Human
acaacauccauguccuaugugug

SEQ ID NO: 3555609 - RNA, 14 nt, Human
acaacauguauaau

SEQ ID NO: 3555610 - RNA, 21 nt, Human
acaaccaagcgcauccaaucu

SEQ ID NO: 3555611 - RNA, 16 nt, Human
acaaccaauggaaugu

SEQ ID NO: 3555612 - RNA, 20 nt, Human
acaaccaccgcuccccagcc

SEQ ID NO: 3555613 - RNA, 17 nt, Human
acaaccacucauucaaa

SEQ ID NO: 3555614 - RNA, 18 nt, Human
acaaccauuaaagucaga

SEQ ID NO: 3555615 - RNA, 11 nt, Human
acaacccaucu

SEQ ID NO: 3555616 - RNA, 14 nt, Human
acaacccugcaaag

SEQ ID NO: 3555617 - RNA, 18 nt, Human
acaacccuguuuuauacu

SEQ ID NO: 3555618 - RNA, 13 nt, Human
acaaccguuggaa

SEQ ID NO: 3555619 - RNA, 15 nt, Human
acaaccucaacugcc

SEQ ID NO: 3555620 - RNA, 16 nt, Human
acaaccucaacugccu

SEQ ID NO: 3555621 - RNA, 15 nt, Human
acaaccucccucuug

SEQ ID NO: 3555622 - RNA, 17 nt, Human
acaaccucccucuuguu

SEQ ID NO: 3555623 - RNA, 20 nt, Human
acaaccucccucuuguuuug

SEQ ID NO: 3555624 - RNA, 22 nt, Human
acaaccucccucuuguuuuguu

SEQ ID NO: 3555625 - RNA, 23 nt, Human
acaaccucccucuuguuuuguuu

SEQ ID NO: 3555626 - RNA, 23 nt, Human
acaaccugcuuggguggagaagc

SEQ ID NO: 3555627 - RNA, 23 nt, Human
acaaccuucauuuaaaaagguuu

SEQ ID NO: 3555628 - RNA, 15 nt, Human
acaacgaggaagccc

SEQ ID NO: 3555629 - RNA, 22 nt, Human
acaacggaggccugcgacccug

SEQ ID NO: 3555630 - RNA, 20 nt, Human
acaacggagucaaaaauuaa

SEQ ID NO: 3555631 - RNA, 16 nt, Human
acaacgugcauugugc

SEQ ID NO: 3555632 - RNA, 17 nt, Human
acaacgugcauugugcu

SEQ ID NO: 3555633 - RNA, 20 nt, Human
acaacuacagaaaaaccaga

SEQ ID NO: 3555634 - RNA, 16 nt, Human
acaacuaggcuucagc

SEQ ID NO: 3555635 - RNA, 13 nt, Human
acaacuauauugu

SEQ ID NO: 3555636 - RNA, 19 nt, Human
acaacucacuccuuuuaaa

SEQ ID NO: 3555637 - RNA, 20 nt, Human
acaacuccuagggccacuga

SEQ ID NO: 3555638 - RNA, 15 nt, Human
acaacugacacagga

SEQ ID NO: 3555639 - RNA, 16 nt, Human
acaacugacacaggaa

SEQ ID NO: 3555640 - RNA, 15 nt, Human
acaacugcaaagaaa

SEQ ID NO: 3555641 - RNA, 21 nt, Human
acaacugcaauaacuucugac

SEQ ID NO: 3555642 - RNA, 22 nt, Human
acaacugccucgaaacacagaa

SEQ ID NO: 3555643 - RNA, 17 nt, Human
acaacugcucccaccuc

SEQ ID NO: 3555644 - RNA, 14 nt, Human
acaacugugacugu

SEQ ID NO: 3555645 - RNA, 15 nt, Human
acaacuuaaaaaguc

SEQ ID NO: 3555646 - RNA, 14 nt, Human
acacuuaaauuaug

SEQ ID NO: 3555647 - RNA, 11 nt, Human
acacuuaacag

SEQ ID NO: 3555648 - RNA, 20 nt, Human
acacuuaaggguuuuagaaa

SEQ ID NO: 3555649 - RNA, 14 nt, Human
acacuuaauucugu

SEQ ID NO: 3555650 - RNA, 18 nt, Human
aauccuaccaaccucuga

SEQ ID NO: 3555651 - RNA, 15 nt, Human
aauccuaccuguuuu

SEQ ID NO: 3555652 - RNA, 20 nt, Human
aauccuaccuugcuuuugcu

SEQ ID NO: 3555653 - RNA, 17 nt, Human
aauccuauauagaaugc

SEQ ID NO: 3555654 - RNA, 20 nt, Human
aauccuaugugauuuuaacu

SEQ ID NO: 3555655 - RNA, 21 nt, Human
aauccuaugugauuuuaacuc

SEQ ID NO: 3555656 - RNA, 14 nt, Human
acaacuuaaauaau

SEQ ID NO: 3555657 - RNA, 22 nt, Human
acaacuuaaguugguccuuuac

SEQ ID NO: 3555658 - RNA, 17 nt, Human
acaacuucaauauccaa

SEQ ID NO: 3555659 - RNA, 14 nt, Human
acaacuucagcagu

SEQ ID NO: 3555660 - RNA, 17 nt, Human
acaacuucuaauugcca

SEQ ID NO: 3555661 - RNA, 15 nt, Human
acaacuuuuuuuucu

SEQ ID NO: 3555662 - RNA, 18 nt, Human
acaacuuuuuuuucuuuu

SEQ ID NO: 3555663 - RNA, 16 nt, Human
acaagaaaaaaugaau

SEQ ID NO: 3555664 - RNA, 17 nt, Human
acaagaaaaauaaagaa

SEQ ID NO: 3555665 - RNA, 20 nt, Human
acaagaaaaauaaagaaaag

SEQ ID NO: 3555666 - RNA, 23 nt, Human
acaagaaaaauaaagaaaagaug

SEQ ID NO: 3555667 - RNA, 19 nt, Human
acaagaaaauaagagcuca

SEQ ID NO: 3555668 - RNA, 23 nt, Human
acaagaaaauaagagcucaggau

SEQ ID NO: 3555669 - RNA, 13 nt, Human
acaagaaaggaga

SEQ ID NO: 3555670 - RNA, 22 nt, Human
acaagaaaggcugcuguacuga

SEQ ID NO: 3555671 - RNA, 17 nt, Human
acaagaaaguuucccca

SEQ ID NO: 3555672 - RNA, 21 nt, Human
acaagaaaguuuccccaccag

SEQ ID NO: 3555673 - RNA, 21 nt, Human
acaagaaaucccuguuuaaua

SEQ ID NO: 3555674 - RNA, 13 nt, Human
acaagaaaugaaa

SEQ ID NO: 3555675 - RNA, 15 nt, Human
acaagaaaugaaagc

SEQ ID NO: 3555676 - RNA, 14 nt, Human
acaagaaguuuauu

SEQ ID NO: 3555677 - RNA, 17 nt, Human
acaagaauaaaggcagc

SEQ ID NO: 3555678 - RNA, 18 nt, Human
acaagaauaaaggcagcu

SEQ ID NO: 3555679 - RNA, 15 nt, Human
acaagaaugaagguu

SEQ ID NO: 3555680 - RNA, 13 nt, Human
acaagaauggauc

SEQ ID NO: 3555681 - RNA, 16 nt, Human
acaagaccacguuucu

SEQ ID NO: 3555682 - RNA, 19 nt, Human
acaagacccuugugguccc

SEQ ID NO: 3555683 - RNA, 17 nt, Human
acaagacuucaguaugu

SEQ ID NO: 3555684 - RNA, 15 nt, Human
acaagagaagcauuc

SEQ ID NO: 3555685 - RNA, 19 nt, Human
acaagagaagcauucucau

SEQ ID NO: 3555686 - RNA, 15 nt, Human
acaagagcacuacau

SEQ ID NO: 3555687 - RNA, 16 nt, Human
acaagagcagccugug

SEQ ID NO: 3555688 - RNA, 20 nt, Human
acaagagcagccuguggcau

SEQ ID NO: 3555689 - RNA, 18 nt, Human
acaagagcccaggccucc

SEQ ID NO: 3555690 - RNA, 19 nt, Human
acaagagguacaggguuuu

SEQ ID NO: 3555691 - RNA, 22 nt, Human
acaagaguuuauuuccaaauaa

SEQ ID NO: 3555692 - RNA, 18 nt, Human
acaagauauuguacauaa

SEQ ID NO: 3555693 - RNA, 17 nt, Human
acaagaugguucuagca

SEQ ID NO: 3555694 - RNA, 17 nt, Human
acaagauucccagagac

SEQ ID NO: 3555695 - RNA, 21 nt, Human
acaagauugcuuaauaaauug

SEQ ID NO: 3555696 - RNA, 18 nt, Human
acaagauugguguuuuuu

SEQ ID NO: 3555697 - RNA, 20 nt, Human
acaagauuuccuugugcaaa

SEQ ID NO: 3555698 - RNA, 21 nt, Human
acaagauuuuuuaauuguuua

SEQ ID NO: 3555699 - RNA, 22 nt, Human
acaagcaauuagacaagaacuu

SEQ ID NO: 3555700 - RNA, 18 nt, Human
acaagcacuaaacaaaga

SEQ ID NO: 3555701 - RNA, 14 nt, Human
acaagccaacuugu

SEQ ID NO: 3555702 - RNA, 20 nt, Human
acaagccacaagucuuccag

SEQ ID NO: 3555703 - RNA, 12 nt, Human
acaagccacaga

SEQ ID NO: 3555704 - RNA, 22 nt, Human
acaagccagaacuugacccuga

SEQ ID NO: 3555705 - RNA, 11 nt, Human
acaagccaggg

SEQ ID NO: 3555706 - RNA, 13 nt, Human
acaagccucugcc

SEQ ID NO: 3555707 - RNA, 20 nt, Human
acaagccugguaggaaaggg

SEQ ID NO: 3555708 - RNA, 17 nt, Human
acaagcgugagccacug

SEQ ID NO: 3555709 - RNA, 23 nt, Human
acaagcuauucccucaaaucuga

SEQ ID NO: 3555710 - RNA, 22 nt, Human
acaagcucacagaccuuugaac

SEQ ID NO: 3555711 - RNA, 19 nt, Human
acaagcuccaagcucccag

SEQ ID NO: 3555712 - RNA, 17 nt, Human
acaagcuccauuuaaac

SEQ ID NO: 3555713 - RNA, 22 nt, Human
acaagcugcaaaucagccaugu

SEQ ID NO: 3555714 - RNA, 11 nt, Human
acaagcugccu

SEQ ID NO: 3555715 - RNA, 13 nt, Human
acaagcugccucc

SEQ ID NO: 3555716 - RNA, 22 nt, Human
acaagcuguugaccaggcaccu

SEQ ID NO: 3555717 - RNA, 21 nt, Human
acaaggauagaugcuggccca

SEQ ID NO: 3555718 - RNA, 22 nt, Human
acaaggauagaugcuggcccag

SEQ ID NO: 3555719 - RNA, 21 nt, Human
acaaggaugaauuaaguuuuu

SEQ ID NO: 3555720 - RNA, 16 nt, Human
acaaggauugcuacug

SEQ ID NO: 3555721 - RNA, 15 nt, Human
acaaggcaaaaacaa

SEQ ID NO: 3555722 - RNA, 12 nt, Human
acaaggcaaggc

SEQ ID NO: 3555723 - RNA, 15 nt, Human
acaaggcaaggcugu

SEQ ID NO: 3555724 - RNA, 22 nt, Human
acaaggcagcaaggcccgagca

SEQ ID NO: 3555725 - RNA, 16 nt, Human
acaaggccccagagac

SEQ ID NO: 3555726 - RNA, 17 nt, Human
acaaggcuagaucauga

SEQ ID NO: 3555727 - RNA, 15 nt, Human
acaaggcuguugcau

SEQ ID NO: 3555728 - RNA, 19 nt, Human
acaagggagagaccucauc

SEQ ID NO: 3555729 - RNA, 16 nt, Human
acaagggcaguggagg

SEQ ID NO: 3555730 - RNA, 21 nt, Human
acaagggcaguggaggugcug

SEQ ID NO: 3555731 - RNA, 13 nt, Human
acaaggggcccuu

SEQ ID NO: 3555732 - RNA, 20 nt, Human
acaaggucauggccacacug

SEQ ID NO: 3555733 - RNA, 24 nt, Human
acaaggucauggccacacugugac

SEQ ID NO: 3555734 - RNA, 15 nt, Human
acaaguaaaacugug

SEQ ID NO: 3555735 - RNA, 18 nt, Human
acaaguaguucuguauuu

SEQ ID NO: 3555736 - RNA, 19 nt, Human
acaaguaguucuguauuug

SEQ ID NO: 3555737 - RNA, 22 nt, Human
acaaguaguucuguauuugaaa

SEQ ID NO: 3555738 - RNA, 16 nt, Human
acaaguauacuuauau

SEQ ID NO: 3555739 - RNA, 22 nt, Human
acaaguauuuguuaauuuagaa

SEQ ID NO: 3555740 - RNA, 12 nt, Human
acaaguauuuuu

SEQ ID NO: 3555741 - RNA, 15 nt, Human
acaaguauuuuuaau

SEQ ID NO: 3555742 - RNA, 17 nt, Human
acaagucccuguaauug

SEQ ID NO: 3555743 - RNA, 21 nt, Human
acaaguccuggauguugugug

SEQ ID NO: 3555744 - RNA, 15 nt, Human
acaaguccugugaau

SEQ ID NO: 3555745 - RNA, 23 nt, Human
acaagugaaauaacaaaauggac

SEQ ID NO: 3555746 - RNA, 23 nt, Human
acaagugaugcuaaaaccugaaa

SEQ ID NO: 3555747 - RNA, 14 nt, Human
acaagugcccucca

SEQ ID NO: 3555748 - RNA, 23 nt, Human
acaagugccgcaaauuguaccuu

SEQ ID NO: 3555749 - RNA, 15 nt, Human
acaaguggacucagg

SEQ ID NO: 3555750 - RNA, 18 nt, Human
acaaguggacucagggca

SEQ ID NO: 3555751 - RNA, 13 nt, Human
acaaguguaauga

SEQ ID NO: 3555752 - RNA, 16 nt, Human
acaaguuggagucacu

SEQ ID NO: 3555753 - RNA, 14 nt, Human
acaaguuuuaaaua

SEQ ID NO: 3555754 - RNA, 15 nt, Human
acaaguuuuaaugua

SEQ ID NO: 3555755 - RNA, 15 nt, Human
acaaguuuuucuguc

SEQ ID NO: 3555756 - RNA, 20 nt, Human
acaauaaaaauggcucagau

SEQ ID NO: 3555757 - RNA, 16 nt, Human
acaauaaaacauuaau

SEQ ID NO: 3555758 - RNA, 14 nt, Human
acaauaaaauuuuu

SEQ ID NO: 3555759 - RNA, 23 nt, Human
acaauaaaauuuuuuuucauguu

SEQ ID NO: 3555760 - RNA, 12 nt, Human
acaauaaaugua

SEQ ID NO: 3555761 - RNA, 19 nt, Human
acaauaaauguauucaaau

SEQ ID NO: 3555762 - RNA, 14 nt, Human
acaauaaaugugca

SEQ ID NO: 3555763 - RNA, 21 nt, Human
acaauaacacuaaaauuuuag

SEQ ID NO: 3555764 - RNA, 21 nt, Human
acaauaacuacuguguuccug

SEQ ID NO: 3555765 - RNA, 15 nt, Human
acaauaacuccuccc

SEQ ID NO: 3555766 - RNA, 21 nt, Human
acaauaaguuaacuauuuuau

SEQ ID NO: 3555767 - RNA, 22 nt, Human
acaauaauauuguuguauaauu

SEQ ID NO: 3555768 - RNA, 21 nt, Human
acaauaauucuggagauacug

SEQ ID NO: 3555769 - RNA, 14 nt, Human
acaauaauuuucua

SEQ ID NO: 3555770 - RNA, 12 nt, Human
acaauacagaua

SEQ ID NO: 3555771 - RNA, 17 nt, Human
acaauacagaucaucuu

SEQ ID NO: 3555772 - RNA, 16 nt, Human
acaauacaugcugcua

SEQ ID NO: 3555773 - RNA, 19 nt, Human
acaauacucauaaugugaa

SEQ ID NO: 3555774 - RNA, 23 nt, Human
acaauaggaguggugauuugaaa

SEQ ID NO: 3555775 - RNA, 18 nt, Human
acaauaggugcuuauucu

SEQ ID NO: 3555776 - RNA, 18 nt, Human
acaauaguaaccugggua

SEQ ID NO: 3555777 - RNA, 18 nt, Human
acaauauaaaacuguacu

SEQ ID NO: 3555778 - RNA, 23 nt, Human
acaauauauagcuggcaagaaug

SEQ ID NO: 3555779 - RNA, 14 nt, Human
acaauaugcaaugu

SEQ ID NO: 3555780 - RNA, 18 nt, Human
acaauaugcccuuucugg

SEQ ID NO: 3555781 - RNA, 17 nt, Human
acaauauguacauuucu

SEQ ID NO: 3555782 - RNA, 18 nt, Human
acaauauugauugggaaa

SEQ ID NO: 3555783 - RNA, 14 nt, Human
acaauauuguuucu

SEQ ID NO: 3555784 - RNA, 15 nt, Human
acaauauuguuucua

SEQ ID NO: 3555785 - RNA, 16 nt, Human
acaauauuuaaaauuu

SEQ ID NO: 3555786 - RNA, 18 nt, Human
acaauauuugugugcuaa

SEQ ID NO: 3555787 - RNA, 19 nt, Human
acaauauuugugugcuaaa

SEQ ID NO: 3555788 - RNA, 16 nt, Human
acaauauuuuaagcau

SEQ ID NO: 3555789 - RNA, 17 nt, Human
acaauauuuuguggcuu

SEQ ID NO: 3555790 - RNA, 14 nt, Human
acaaucaaaggaaa

SEQ ID NO: 3555791 - RNA, 17 nt, Human
acaaucaaaggaaaaua

SEQ ID NO: 3555792 - RNA, 18 nt, Human
acaaucagcuccuuccug

SEQ ID NO: 3555793 - RNA, 14 nt, Human
acaaucagcugcuu

SEQ ID NO: 3555794 - RNA, 13 nt, Human
acacuuaaaaaug

SEQ ID NO: 3555795 - RNA, 13 nt, Human
acacuuaacagau

SEQ ID NO: 3555796 - RNA, 14 nt, Human
acacuuaacagaug

SEQ ID NO: 3555797 - RNA, 21 nt, Human
acacuuacacuuuaugcacaa

SEQ ID NO: 3555798 - RNA, 18 nt, Human
acacuuacuguaagacau

SEQ ID NO: 3555799 - RNA, 21 nt, Human
acacuuacuguaagacauuag

SEQ ID NO: 3555800 - RNA, 23 nt, Human
acacuuacuguuguccuauggga

SEQ ID NO: 3555801 - RNA, 16 nt, Human
acacuucaaacuacuu

SEQ ID NO: 3555802 - RNA, 19 nt, Human
acacuucaauaauugucca

SEQ ID NO: 3555803 - RNA, 13 nt, Human
acacuucagagag

SEQ ID NO: 3555804 - RNA, 16 nt, Human
acacuucagagagcug

SEQ ID NO: 3555805 - RNA, 15 nt, Human
acacuucaggcucuu

SEQ ID NO: 3555806 - RNA, 19 nt, Human
acacuucaggcucuucucc

SEQ ID NO: 3555807 - RNA, 12 nt, Human
acacuuccagac

SEQ ID NO: 3555808 - RNA, 14 nt, Human
acacuuccauaauc

SEQ ID NO: 3555809 - RNA, 18 nt, Human
acacuucccucuguuucu

SEQ ID NO: 3555810 - RNA, 22 nt, Human
acacuucccucuguuucucuuu

SEQ ID NO: 3555811 - RNA, 14 nt, Human
acacuucccuggcg

SEQ ID NO: 3555812 - RNA, 16 nt, Human
acacuucguucgcaga

SEQ ID NO: 3555813 - RNA, 24 nt, Human
acacuucucaggacacaggccugu

SEQ ID NO: 3555814 - RNA, 20 nt, Human
acacuucuuacgcaaugcuu

SEQ ID NO: 3555815 - RNA, 22 nt, Human
acacuugaaccugggaggugga

SEQ ID NO: 3555816 - RNA, 21 nt, Human
acacuugagaggaugaaugua

SEQ ID NO: 3555817 - RNA, 16 nt, Human
acacuugagaugauuu

SEQ ID NO: 3555818 - RNA, 23 nt, Human
acacuugauggagugugagccac

SEQ ID NO: 3555819 - RNA, 21 nt, Human
acacuugcccugcucccucuc

SEQ ID NO: 3555820 - RNA, 17 nt, Human
acacuuguauaaaugua

SEQ ID NO: 3555821 - RNA, 17 nt, Human
acacuuguccacauagg

SEQ ID NO: 3555822 - RNA, 19 nt, Human
acacuuguccccaaauccg

SEQ ID NO: 3555823 - RNA, 14 nt, Human
acacuugucggcuc

SEQ ID NO: 3555824 - RNA, 18 nt, Human
acacuugugugugggcug

SEQ ID NO: 3555825 - RNA, 12 nt, Human
acacuuuacaau

SEQ ID NO: 3555826 - RNA, 13 nt, Human
acacuuuacaaug

SEQ ID NO: 3555827 - RNA, 23 nt, Human
acacuuuaugccggaugugcuuu

SEQ ID NO: 3555828 - RNA, 12 nt, Human
acacuuucucuu

SEQ ID NO: 3555829 - RNA, 22 nt, Human
acacuuugcacugauauaucau

SEQ ID NO: 3555830 - RNA, 19 nt, Human
acacuuugccauauuuuca

SEQ ID NO: 3555831 - RNA, 15 nt, Human
acacuuuggaccuua

SEQ ID NO: 3555832 - RNA, 16 nt, Human
acacuuuucauaucau

SEQ ID NO: 3555833 - RNA, 17 nt, Human
acacuuuuggaaccaug

SEQ ID NO: 3555834 - RNA, 23 nt, Human
acacuuuuuuggggauaugcuua

SEQ ID NO: 3555835 - RNA, 19 nt, Human
acagaaaaauauguaccaa

SEQ ID NO: 3555836 - RNA, 15 nt, Human
acagaaaaaucuugu

SEQ ID NO: 3555837 - RNA, 11 nt, Human
acagaaaacaa

SEQ ID NO: 3555838 - RNA, 20 nt, Human
acagaaaacgguuaaaacug

SEQ ID NO: 3555839 - RNA, 13 nt, Human
acagaaaacuaga

SEQ ID NO: 3555840 - RNA, 14 nt, Human
acagaaaacuagaa

SEQ ID NO: 3555841 - RNA, 17 nt, Human
acagaaaacuagaauuu

SEQ ID NO: 3555842 - RNA, 13 nt, Human
acagaaaagcaua

SEQ ID NO: 3555843 - RNA, 14 nt, Human
acagaaaauauacu

SEQ ID NO: 3555844 - RNA, 19 nt, Human
acagaaaauauacuguaaa

SEQ ID NO: 3555845 - RNA, 20 nt, Human
acagaaaauauacuguaaag

SEQ ID NO: 3555846 - RNA, 12 nt, Human
acagaaaauaug

SEQ ID NO: 3555847 - RNA, 14 nt, Human
acagaaaauaugua

SEQ ID NO: 3555848 - RNA, 14 nt, Human
acagaaacacugcc

SEQ ID NO: 3555849 - RNA, 19 nt, Human
acagaaacacugccuuuuu

SEQ ID NO: 3555850 - RNA, 17 nt, Human
acagaaaccuauccuca

SEQ ID NO: 3555851 - RNA, 12 nt, Human
acagaaagagag

SEQ ID NO: 3555852 - RNA, 13 nt, Human
acagaaagcugcc

SEQ ID NO: 3555853 - RNA, 24 nt, Human
acagaaagggcaacaauaaaauag

SEQ ID NO: 3555854 - RNA, 17 nt, Human
acagaaaguggugcuca

SEQ ID NO: 3555855 - RNA, 19 nt, Human
acagaaauauaauaaaaug

SEQ ID NO: 3555856 - RNA, 20 nt, Human
acaguagugagaagaauauu

SEQ ID NO: 3555857 - RNA, 21 nt, Human
acaguagugagaagaauauug

SEQ ID NO: 3555858 - RNA, 20 nt, Human
acaguauaauuaacauguua

SEQ ID NO: 3555859 - RNA, 23 nt, Human
acaguauaauuaacauguuaaac

SEQ ID NO: 3555860 - RNA, 15 nt, Human
acaguauauuuuauu

SEQ ID NO: 3555861 - RNA, 17 nt, Human
acaguauauuuuauuuc

SEQ ID NO: 3555862 - RNA, 19 nt, Human
acaguaugagucaaugugc

SEQ ID NO: 3555863 - RNA, 21 nt, Human
acaguaugagucaaugugcag

SEQ ID NO: 3555864 - RNA, 23 nt, Human
acaguaugguaacuuugcaaaug

SEQ ID NO: 3555865 - RNA, 16 nt, Human
acaguauuacuucugc

SEQ ID NO: 3555866 - RNA, 14 nt, Human
acaguauucuguac

SEQ ID NO: 3555867 - RNA, 12 nt, Human
acaguauugcuc

SEQ ID NO: 3555868 - RNA, 18 nt, Human
acaguauuuauuuuguaa

SEQ ID NO: 3555869 - RNA, 15 nt, Human
acaguauuucauugc

SEQ ID NO: 3555870 - RNA, 18 nt, Human
acagucaaaaccaaguca

SEQ ID NO: 3555871 - RNA, 19 nt, Human
acagucaaaauaauucuaa

SEQ ID NO: 3555872 - RNA, 15 nt, Human
acagucaacaagccu

SEQ ID NO: 3555873 - RNA, 17 nt, Human
acagucaaccaacccca

SEQ ID NO: 3555874 - RNA, 19 nt, Human
acagucacugccacuuugc

SEQ ID NO: 3555875 - RNA, 22 nt, Human
acagucacugccacuuugcaca

SEQ ID NO: 3555876 - RNA, 21 nt, Human
acagucagauuuccagucucc

SEQ ID NO: 3555877 - RNA, 19 nt, Human
acagucaucaucagggccu

SEQ ID NO: 3555878 - RNA, 21 nt, Human
acagucaucgcucguguguuc

SEQ ID NO: 3555879 - RNA, 16 nt, Human
acaguccagccuggag

SEQ ID NO: 3555880 - RNA, 13 nt, Human
acaguccucccau

SEQ ID NO: 3555881 - RNA, 23 nt, Human
acaguccugggagaaccucaggc

SEQ ID NO: 3555882 - RNA, 18 nt, Human
acaguccuuaaaaaucac

SEQ ID NO: 3555883 - RNA, 21 nt, Human
acaguccuuaccagcagagca

SEQ ID NO: 3555884 - RNA, 12 nt, Human
acagucuaaagc

SEQ ID NO: 3555885 - RNA, 13 nt, Human
acagucuaauuuu

SEQ ID NO: 3555886 - RNA, 12 nt, Human
acagucucacca

SEQ ID NO: 3555887 - RNA, 13 nt, Human
acagucuccccca

SEQ ID NO: 3555888 - RNA, 14 nt, Human
acagucucuuuaau

SEQ ID NO: 3555889 - RNA, 20 nt, Human
acagucugaucgugacgcug

SEQ ID NO: 3555890 - RNA, 22 nt, Human
acagucugaucgugacgcugaa

SEQ ID NO: 3555891 - RNA, 11 nt, Human
acagucugucu

SEQ ID NO: 3555892 - RNA, 15 nt, Human
acagucugucuucug

SEQ ID NO: 3555893 - RNA, 20 nt, Human
acagucugucuucuguauau

SEQ ID NO: 3555894 - RNA, 14 nt, Human
acagucuucauuuu

SEQ ID NO: 3555895 - RNA, 13 nt, Human
acagucuuccaca

SEQ ID NO: 3555896 - RNA, 14 nt, Human
acagucuuccauuu

SEQ ID NO: 3555897 - RNA, 20 nt, Human
acagugaaagaaaauaacaa

SEQ ID NO: 3555898 - RNA, 18 nt, Human
acagugaagacagaaguu

SEQ ID NO: 3555899 - RNA, 14 nt, Human
acagugaagcaaau

SEQ ID NO: 3555900 - RNA, 23 nt, Human
acagugaaguuuuacugucuauu

SEQ ID NO: 3555901 - RNA, 20 nt, Human
acagugacucgggcuccugu

SEQ ID NO: 3555902 - RNA, 15 nt, Human
acagugacuucugag

SEQ ID NO: 3555903 - RNA, 17 nt, Human
acagugacuucugagau

SEQ ID NO: 3555904 - RNA, 18 nt, Human
acagugagacucugucuc

SEQ ID NO: 3555905 - RNA, 23 nt, Human
acagugagagacuccauaguuug

SEQ ID NO: 3555906 - RNA, 12 nt, Human
acagugagccaa

SEQ ID NO: 3555907 - RNA, 13 nt, Human
acagugagccaag

SEQ ID NO: 3555908 - RNA, 18 nt, Human
acagugagggagauccca

SEQ ID NO: 3555909 - RNA, 16 nt, Human
acagugagguccuggg

SEQ ID NO: 3555910 - RNA, 19 nt, Human
acagugagguccugggggc

SEQ ID NO: 3555911 - RNA, 20 nt, Human
acagugagguccugggggcc

SEQ ID NO: 3555912 - RNA, 23 nt, Human
acagugagucgaggacagggagg

SEQ ID NO: 3555913 - RNA, 21 nt, Human
acagugaucuccauauguuac

SEQ ID NO: 3555914 - RNA, 10 nt, Human
acagugauuu

SEQ ID NO: 3555915 - RNA, 23 nt, Human
acagugauuuuuuuuuagaacag

SEQ ID NO: 3555916 - RNA, 14 nt, Human
acagugcacaugaa

SEQ ID NO: 3555917 - RNA, 15 nt, Human
acagugcacaugaac

SEQ ID NO: 3555918 - RNA, 22 nt, Human
acagugcagagccuucucagaa

SEQ ID NO: 3555919 - RNA, 17 nt, Human
acagugcaucucagccc

SEQ ID NO: 3555920 - RNA, 20 nt, Human
acagugccugggaauguauu

SEQ ID NO: 3555921 - RNA, 20 nt, Human
acagugccuucaauaaaugg

SEQ ID NO: 3555922 - RNA, 15 nt, Human
acagugcuacugaaa

SEQ ID NO: 3555923 - RNA, 17 nt, Human
acagugcuacugaaagg

SEQ ID NO: 3555924 - RNA, 15 nt, Human
acagugcucuuuucu

SEQ ID NO: 3555925 - RNA, 17 nt, Human
acagugcucuuuucucc

SEQ ID NO: 3555926 - RNA, 20 nt, Human
acagugcugcagcucccugg

SEQ ID NO: 3555927 - RNA, 18 nt, Human
acagugcuucagccugag

SEQ ID NO: 3555928 - RNA, 18 nt, Human
acaguggaauauaaggaa

SEQ ID NO: 3555929 - RNA, 17 nt, Human
acaguggaucacaaagu

SEQ ID NO: 3555930 - RNA, 17 nt, Human
acaguggauugcauuuc

SEQ ID NO: 3555931 - RNA, 21 nt, Human
acaguggcucacgccuguaau

SEQ ID NO: 3555932 - RNA, 14 nt, Human
acagugggaaauau

SEQ ID NO: 3555933 - RNA, 15 nt, Human
acagugggagccagg

SEQ ID NO: 3555934 - RNA, 16 nt, Human
acagugggagccaggg

SEQ ID NO: 3555935 - RNA, 21 nt, Human
acagugggugccccccuugcc

SEQ ID NO: 3555936 - RNA, 18 nt, Human
acagugguuuuauacuga

SEQ ID NO: 3555937 - RNA, 16 nt, Human
acaguguagcuugccc

SEQ ID NO: 3555938 - RNA, 13 nt, Human
acaguguauguag

SEQ ID NO: 3555939 - RNA, 16 nt, Human
acagacuauugacauc

SEQ ID NO: 3555940 - RNA, 15 nt, Human
acagacucauccuga

SEQ ID NO: 3555941 - RNA, 19 nt, Human
acagacuggaagcacagcu

SEQ ID NO: 3555942 - RNA, 21 nt, Human
acagacuggaagcacagcuuc

SEQ ID NO: 3555943 - RNA, 20 nt, Human
acagacuggccugaggagca

SEQ ID NO: 3555944 - RNA, 20 nt, Human
acagacuguugucccugcac

SEQ ID NO: 3555945 - RNA, 17 nt, Human
acagacuucuccagacc

SEQ ID NO: 3555946 - RNA, 17 nt, Human
acagacuuuagcuuucu

SEQ ID NO: 3555947 - RNA, 13 nt, Human
acagagaaaccag

SEQ ID NO: 3555948 - RNA, 14 nt, Human
acagagaaaccagc

SEQ ID NO: 3555949 - RNA, 14 nt, Human
acagagaaagaaau

SEQ ID NO: 3555950 - RNA, 11 nt, Human
acagagaaagu

SEQ ID NO: 3555951 - RNA, 18 nt, Human
acagagaaaguacuucuc

SEQ ID NO: 3555952 - RNA, 14 nt, Human
acagagaaccugga

SEQ ID NO: 3555953 - RNA, 16 nt, Human
acagagaagacaaaau

SEQ ID NO: 3555954 - RNA, 11 nt, Human
acagagaagcc

SEQ ID NO: 3555955 - RNA, 12 nt, Human
acagagaagcca

SEQ ID NO: 3555956 - RNA, 13 nt, Human
acagagaagccag

SEQ ID NO: 3555957 - RNA, 17 nt, Human
acagagaagccagcuug

SEQ ID NO: 3555958 - RNA, 14 nt, Human
acagagaagccauc

SEQ ID NO: 3555959 - RNA, 15 nt, Human
acagagaagccauca

SEQ ID NO: 3555960 - RNA, 13 nt, Human
acagagaagccuu

SEQ ID NO: 3555961 - RNA, 22 nt, Human
acagagaagccuucaagcucug

SEQ ID NO: 3555962 - RNA, 14 nt, Human
acagagaagcuggg

SEQ ID NO: 3555963 - RNA, 12 nt, Human
acagagaaggaa

SEQ ID NO: 3555964 - RNA, 13 nt, Human
acagagaaggaau

SEQ ID NO: 3555965 - RNA, 15 nt, Human
acagagaaggaaugu

SEQ ID NO: 3555966 - RNA, 21 nt, Human
acagagaagucacagggcagu

SEQ ID NO: 3555967 - RNA, 17 nt, Human
acagagaauaugucugc

SEQ ID NO: 3555968 - RNA, 14 nt, Human
acagagacaccugc

SEQ ID NO: 3555969 - RNA, 16 nt, Human
acagagacauuccucc

SEQ ID NO: 3555970 - RNA, 12 nt, Human
acagagaccaag

SEQ ID NO: 3555971 - RNA, 22 nt, Human
acagagaccugcccucaagagc

SEQ ID NO: 3555972 - RNA, 20 nt, Human
acagagagacagacuugaga

SEQ ID NO: 3555973 - RNA, 20 nt, Human
acagagagagauacucuggg

SEQ ID NO: 3555974 - RNA, 18 nt, Human
acagagaggagaaacaca

SEQ ID NO: 3555975 - RNA, 14 nt, Human
acagagagucugga

SEQ ID NO: 3555976 - RNA, 23 nt, Human
acagagcaaccccuggaccccag

SEQ ID NO: 3555977 - RNA, 15 nt, Human
acagagcaagacucu

SEQ ID NO: 3555978 - RNA, 21 nt, Human
acagagcaagugagacccugu

SEQ ID NO: 3555979 - RNA, 20 nt, Human
acagagcacuagguucaauu

SEQ ID NO: 3555980 - RNA, 13 nt, Human
acagagccaggag

SEQ ID NO: 3555981 - RNA, 14 nt, Human
acagagccaggaga

SEQ ID NO: 3555982 - RNA, 16 nt, Human
acagagccaggagaag

SEQ ID NO: 3555983 - RNA, 15 nt, Human
acagagcccacgccc

SEQ ID NO: 3555984 - RNA, 19 nt, Human
acagagccugccccagcgc

SEQ ID NO: 3555985 - RNA, 17 nt, Human
acagagcgacagagcag

SEQ ID NO: 3555986 - RNA, 22 nt, Human
acagagcgugagcugagcaggc

SEQ ID NO: 3555987 - RNA, 18 nt, Human
acagagcuacacagggga

SEQ ID NO: 3555988 - RNA, 10 nt, Human
acagagcugg

SEQ ID NO: 3555989 - RNA, 23 nt, Human
acagagcuggagaugaggccaga

SEQ ID NO: 3555990 - RNA, 14 nt, Human
acagagcugggaug

SEQ ID NO: 3555991 - RNA, 22 nt, Human
acagagcuguggaggauugcua

SEQ ID NO: 3555992 - RNA, 16 nt, Human
acagagcuucccugac

SEQ ID NO: 3555993 - RNA, 16 nt, Human
acagaggaagagcagg

SEQ ID NO: 3555994 - RNA, 18 nt, Human
acagaggaagagcaggca

SEQ ID NO: 3555995 - RNA, 20 nt, Human
acagaggagggcgugacuca

SEQ ID NO: 3555996 - RNA, 14 nt, Human
acagaggcagcccc

SEQ ID NO: 3555997 - RNA, 17 nt, Human
acagaggccauggcaga

SEQ ID NO: 3555998 - RNA, 21 nt, Human
acagaggccaugggccuccug

SEQ ID NO: 3555999 - RNA, 23 nt, Human
acagaggccaugggccuccugug

SEQ ID NO: 3556000 - RNA, 16 nt, Human
acagaggccccagccu

SEQ ID NO: 3556001 - RNA, 18 nt, Human
acagaggccccagccucc

SEQ ID NO: 3556002 - RNA, 22 nt, Human
acagaggccccagccucccuga

SEQ ID NO: 3556003 - RNA, 20 nt, Human
acagaggcccucaagucuuu

SEQ ID NO: 3556004 - RNA, 20 nt, Human
acagagggaagaaaagagcu

SEQ ID NO: 3556005 - RNA, 15 nt, Human
acagaggggacucug

SEQ ID NO: 3556006 - RNA, 16 nt, Human
acagaggggacucugg

SEQ ID NO: 3556007 - RNA, 24 nt, Human
acagagguagucucacugcuugaa

SEQ ID NO: 3556008 - RNA, 17 nt, Human
acagaguaagacauugg

SEQ ID NO: 3556009 - RNA, 19 nt, Human
acagaguagccagguucug

SEQ ID NO: 3556010 - RNA, 14 nt, Human
acagagucucacug

SEQ ID NO: 3556011 - RNA, 19 nt, Human
acagagucuuccucugucu

SEQ ID NO: 3556012 - RNA, 15 nt, Human
acagagugagacucu

SEQ ID NO: 3556013 - RNA, 21 nt, Human
acagagugagacucugucuca

SEQ ID NO: 3556014 - RNA, 22 nt, Human
acagagugccaacuucuuucau

SEQ ID NO: 3556015 - RNA, 22 nt, Human
acagaguggaauaagacagaga

SEQ ID NO: 3556016 - RNA, 23 nt, Human
acagaguggaauaagacagagac

SEQ ID NO: 3556017 - RNA, 18 nt, Human
acaguuuucugagaaaga

SEQ ID NO: 3556018 - RNA, 21 nt, Human
acaguuuucugagaaagacua

SEQ ID NO: 3556019 - RNA, 14 nt, Human
acaguuuucuucau

SEQ ID NO: 3556020 - RNA, 13 nt, Human
acaguuuugagaa

SEQ ID NO: 3556021 - RNA, 23 nt, Human
acaguuuugucagucuuucuuag

SEQ ID NO: 3556022 - RNA, 19 nt, Human
acaguuuuuaacucuacug

SEQ ID NO: 3556023 - RNA, 21 nt, Human
acauaaaaacaacuuuauacc

SEQ ID NO: 3556024 - RNA, 15 nt, Human
acauaaaaaggacau

SEQ ID NO: 3556025 - RNA, 13 nt, Human
acauaaaaaguua

SEQ ID NO: 3556026 - RNA, 14 nt, Human
acauaaaagaaaua

SEQ ID NO: 3556027 - RNA, 17 nt, Human
acauaaaagaaauaaac

SEQ ID NO: 3556028 - RNA, 15 nt, Human
acauaaacugacuuu

SEQ ID NO: 3556029 - RNA, 20 nt, Human
acauaaagacuaaguagccc

SEQ ID NO: 3556030 - RNA, 13 nt, Human
acauaaagcaaau

SEQ ID NO: 3556031 - RNA, 15 nt, Human
acauaaagcaaauag

SEQ ID NO: 3556032 - RNA, 18 nt, Human
acauaaagcaaauagaca

SEQ ID NO: 3556033 - RNA, 16 nt, Human
acauaaagccauguuu

SEQ ID NO: 3556034 - RNA, 16 nt, Human
acauaaaggaaaagac

SEQ ID NO: 3556035 - RNA, 13 nt, Human
acauaaaggauaa

SEQ ID NO: 3556036 - RNA, 17 nt, Human
acauaaaggauaaacuu

SEQ ID NO: 3556037 - RNA, 18 nt, Human
acauaaagguaaaacaaa

SEQ ID NO: 3556038 - RNA, 18 nt, Human
acauaaagguuauuuucu

SEQ ID NO: 3556039 - RNA, 22 nt, Human
acauaaagguuauuuucuccug

SEQ ID NO: 3556040 - RNA, 23 nt, Human
acauaaagguuauuuucuccuga

SEQ ID NO: 3556041 - RNA, 12 nt, Human
acauaaaguuga

SEQ ID NO: 3556042 - RNA, 15 nt, Human
acauaaaucugugaa

SEQ ID NO: 3556043 - RNA, 18 nt, Human
acauaaaucugugaacuu

SEQ ID NO: 3556044 - RNA, 17 nt, Human
acauaaaugcagcccau

SEQ ID NO: 3556045 - RNA, 13 nt, Human
acauaaauuagag

SEQ ID NO: 3556046 - RNA, 16 nt, Human
acauaacaggguaaau

SEQ ID NO: 3556047 - RNA, 22 nt, Human
acauaacguuuuuccuuuaaaa

SEQ ID NO: 3556048 - RNA, 23 nt, Human
acauaacguuuuuccuuuaaaaa

SEQ ID NO: 3556049 - RNA, 15 nt, Human
acauaacuaaauuug

SEQ ID NO: 3556050 - RNA, 12 nt, Human
acauaacugaaa

SEQ ID NO: 3556051 - RNA, 14 nt, Human
acauaagcucagaa

SEQ ID NO: 3556052 - RNA, 20 nt, Human
acauaagggguuugccauuu

SEQ ID NO: 3556053 - RNA, 20 nt, Human
acauaaguaauucaagaaaa

SEQ ID NO: 3556054 - RNA, 20 nt, Human
acauaaguauuuaauucaug

SEQ ID NO: 3556055 - RNA, 14 nt, Human
acauaauaaauuaa

SEQ ID NO: 3556056 - RNA, 16 nt, Human
acauaauacugaacca

SEQ ID NO: 3556057 - RNA, 18 nt, Human
acauaauacugaaccacu

SEQ ID NO: 3556058 - RNA, 19 nt, Human
acauaaucuaguuuacaga

SEQ ID NO: 3556059 - RNA, 23 nt, Human
acauaaucuucugccuucucaug

SEQ ID NO: 3556060 - RNA, 18 nt, Human
acauaaugcuuaauuucu

SEQ ID NO: 3556061 - RNA, 21 nt, Human
acauaaugggccacugaaauc

SEQ ID NO: 3556062 - RNA, 22 nt, Human
acauaaugggccacugaaaucu

SEQ ID NO: 3556063 - RNA, 23 nt, Human
acauaaugggccacugaaaucug

SEQ ID NO: 3556064 - RNA, 13 nt, Human
acauaauuaaagu

SEQ ID NO: 3556065 - RNA, 13 nt, Human
acauaauucuuau

SEQ ID NO: 3556066 - RNA, 19 nt, Human
acauaauuuaguuguuucu

SEQ ID NO: 3556067 - RNA, 22 nt, Human
acauacaauuauuuuuacaguu

SEQ ID NO: 3556068 - RNA, 16 nt, Human
acauacaauuccaaac

SEQ ID NO: 3556069 - RNA, 16 nt, Human
acauacacacauaugu

SEQ ID NO: 3556070 - RNA, 13 nt, Human
acauacaccagca

SEQ ID NO: 3556071 - RNA, 15 nt, Human
acauacaccagcauu

SEQ ID NO: 3556072 - RNA, 15 nt, Human
acauacaguuuuaug

SEQ ID NO: 3556073 - RNA, 10 nt, Human
acauacauug

SEQ ID NO: 3556074 - RNA, 14 nt, Human
acauacccccuccc

SEQ ID NO: 3556075 - RNA, 17 nt, Human
acauacccgccuagcug

SEQ ID NO: 3556076 - RNA, 16 nt, Human
acauacccugaccugg

SEQ ID NO: 3556077 - RNA, 21 nt, Human
acauacccuggccgcccccug

SEQ ID NO: 3556078 - RNA, 15 nt, Human
acauaccuggcccug

SEQ ID NO: 3556079 - RNA, 20 nt, Human
acauaccuggguauguguag

SEQ ID NO: 3556080 - RNA, 17 nt, Human
acauacgaaacacaaac

SEQ ID NO: 3556081 - RNA, 15 nt, Human
acauacgauuuaagg

SEQ ID NO: 3556082 - RNA, 18 nt, Human
acauacgauuuaagguau

SEQ ID NO: 3556083 - RNA, 21 nt, Human
acauacggucagguuuaacau

SEQ ID NO: 3556084 - RNA, 23 nt, Human
acaguaugugggauauugaaugu

SEQ ID NO: 3556085 - RNA, 19 nt, Human
acaguauuacuucugcuac

SEQ ID NO: 3556086 - RNA, 15 nt, Human
acaguauugcucacc

SEQ ID NO: 3556087 - RNA, 16 nt, Human
acaguauugcucaccc

SEQ ID NO: 3556088 - RNA, 14 nt, Human
acaguauuuguaau

SEQ ID NO: 3556089 - RNA, 18 nt, Human
acaguauuuguaauuaaa

SEQ ID NO: 3556090 - RNA, 17 nt, Human
acagucaaaacagagau

SEQ ID NO: 3556091 - RNA, 16 nt, Human
acagucaagauagaaa

SEQ ID NO: 3556092 - RNA, 17 nt, Human
acagucaaggaguggcu

SEQ ID NO: 3556093 - RNA, 22 nt, Human
acagucaaggaguggcuuacua

SEQ ID NO: 3556094 - RNA, 17 nt, Human
acagucacaugcuugau

SEQ ID NO: 3556095 - RNA, 16 nt, Human
acagucacauuccaag

SEQ ID NO: 3556096 - RNA, 16 nt, Human
acagucaccucaugga

SEQ ID NO: 3556097 - RNA, 17 nt, Human
acagucaccucauggaa

SEQ ID NO: 3556098 - RNA, 18 nt, Human
acagucacugauguacaa

SEQ ID NO: 3556099 - RNA, 14 nt, Human
acagucauuuaaaa

SEQ ID NO: 3556100 - RNA, 18 nt, Human
acaguccagccuggagau

SEQ ID NO: 3556101 - RNA, 15 nt, Human
acagucccacugugc

SEQ ID NO: 3556102 - RNA, 17 nt, Human
acagucccuaaagaaaa

SEQ ID NO: 3556103 - RNA, 18 nt, Human
acagucccuauggaaaga

SEQ ID NO: 3556104 - RNA, 12 nt, Human
acagucccugcc

SEQ ID NO: 3556105 - RNA, 14 nt, Human
acaguccucccauc

SEQ ID NO: 3556106 - RNA, 12 nt, Human
acaguccuggga

SEQ ID NO: 3556107 - RNA, 21 nt, Human
acaguccugggagaaccucag

SEQ ID NO: 3556108 - RNA, 22 nt, Human
acaguccugggagaaccucagg

SEQ ID NO: 3556109 - RNA, 18 nt, Human
acaguccuuaccagcaga

SEQ ID NO: 3556110 - RNA, 20 nt, Human
acaguccuuaccagcagagc

SEQ ID NO: 3556111 - RNA, 14 nt, Human
acagucuaaagcug

SEQ ID NO: 3556112 - RNA, 14 nt, Human
acagucuaauuuuu

SEQ ID NO: 3556113 - RNA, 23 nt, Human
acagucuauuugagacuccucag

SEQ ID NO: 3556114 - RNA, 18 nt, Human
acagucucaccauuuccc

SEQ ID NO: 3556115 - RNA, 13 nt, Human
acagucucaggaa

SEQ ID NO: 3556116 - RNA, 15 nt, Human
acagucucaggaaau

SEQ ID NO: 3556117 - RNA, 17 nt, Human
acagucucaggaaauca

SEQ ID NO: 3556118 - RNA, 19 nt, Human
acagucugaucgugacgcu

SEQ ID NO: 3556119 - RNA, 12 nt, Human
acagucugucuu

SEQ ID NO: 3556120 - RNA, 16 nt, Human
acagucugucuucugu

SEQ ID NO: 3556121 - RNA, 18 nt, Human
acagucugucuucuguau

SEQ ID NO: 3556122 - RNA, 19 nt, Human
acagucugucuucuguaua

SEQ ID NO: 3556123 - RNA, 23 nt, Human
acagucugucuucuguauauaaa

SEQ ID NO: 3556124 - RNA, 19 nt, Human
acagucuuccauuugcaag

SEQ ID NO: 3556125 - RNA, 15 nt, Human
acagucuugcagcag

SEQ ID NO: 3556126 - RNA, 14 nt, Human
acagucuuguauua

SEQ ID NO: 3556127 - RNA, 14 nt, Human
acagugaaaaugua

SEQ ID NO: 3556128 - RNA, 18 nt, Human
acagugaaaauguaagcu

SEQ ID NO: 3556129 - RNA, 21 nt, Human
acagugaaaauguaagcuguu

SEQ ID NO: 3556130 - RNA, 14 nt, Human
acagugagccugaa

SEQ ID NO: 3556131 - RNA, 18 nt, Human
acagugagccugaauuuu

SEQ ID NO: 3556132 - RNA, 23 nt, Human
acagugagcuuggaaaggaccag

SEQ ID NO: 3556133 - RNA, 22 nt, Human
acagugagguccugggggccug

SEQ ID NO: 3556134 - RNA, 22 nt, Human
acagugagucgaggacagggag

SEQ ID NO: 3556135 - RNA, 14 nt, Human
acagugaucuccau

SEQ ID NO: 3556136 - RNA, 18 nt, Human
acagugaucuccauaugu

SEQ ID NO: 3556137 - RNA, 19 nt, Human
acagugaucuccauauguu

SEQ ID NO: 3556138 - RNA, 22 nt, Human
acagugaucuccauauguuaca

SEQ ID NO: 3556139 - RNA, 21 nt, Human
acagugauuaccagggacuga

SEQ ID NO: 3556140 - RNA, 19 nt, Human
acagugcagagccuucuca

SEQ ID NO: 3556141 - RNA, 21 nt, Human
acagugcauauuccuuucuau

SEQ ID NO: 3556142 - RNA, 18 nt, Human
acagugccugggaaugua

SEQ ID NO: 3556143 - RNA, 21 nt, Human
acagugccugggaauguauua

SEQ ID NO: 3556144 - RNA, 17 nt, Human
acagugccuucaauaaa

SEQ ID NO: 3556145 - RNA, 21 nt, Human
acagugcucuuuucuccucac

SEQ ID NO: 3556146 - RNA, 23 nt, Human
acagugcugucugaucugugcuu

SEQ ID NO: 3556147 - RNA, 17 nt, Human
acagugcuucagccuga

SEQ ID NO: 3556148 - RNA, 18 nt, Human
acaguggcaggacaggaa

SEQ ID NO: 3556149 - RNA, 20 nt, Human
acaguggcaggacaggaaaa

SEQ ID NO: 3556150 - RNA, 13 nt, Human
acagugggagcca

SEQ ID NO: 3556151 - RNA, 14 nt, Human
acagugggagccag

SEQ ID NO: 3556152 - RNA, 23 nt, Human
acagugguggcagggccuagcug

SEQ ID NO: 3556153 - RNA, 13 nt, Human
acaguguacaguc

SEQ ID NO: 3556154 - RNA, 12 nt, Human
acaguguaugua

SEQ ID NO: 3556155 - RNA, 24 nt, Human
acagugucccccagguuccgaaga

SEQ ID NO: 3556156 - RNA, 19 nt, Human
acagugucugggcugacug

SEQ ID NO: 3556157 - RNA, 24 nt, Human
acagugucuguaucggagacagug

SEQ ID NO: 3556158 - RNA, 14 nt, Human
acagugucuuuuuu

SEQ ID NO: 3556159 - RNA, 15 nt, Human
acagugugaaguuag

SEQ ID NO: 3556160 - RNA, 18 nt, Human
acagugugaaguuagaau

SEQ ID NO: 3556161 - RNA, 19 nt, Human
acagugugaaguuagaauu

SEQ ID NO: 3556162 - RNA, 22 nt, Human
acagugugaaguuagaauuccu

SEQ ID NO: 3556163 - RNA, 13 nt, Human
acagugugcaagg

SEQ ID NO: 3556164 - RNA, 15 nt, Human
acagugugguaguua

SEQ ID NO: 3556165 - RNA, 20 nt, Human
acagugugguaguuaauaaa

SEQ ID NO: 3556166 - RNA, 17 nt, Human
acaguguguaaacaaaa

SEQ ID NO: 3556167 - RNA, 18 nt, Human
acaguguguaaacaaaau

SEQ ID NO: 3556168 - RNA, 17 nt, Human
acaguguuaggccuggc

SEQ ID NO: 3556169 - RNA, 22 nt, Human
acaguguuaggccuggcacagu

SEQ ID NO: 3556170 - RNA, 11 nt, Human
acaguguuccg

SEQ ID NO: 3556171 - RNA, 16 nt, Human
acaguguugagaacua

SEQ ID NO: 3556172 - RNA, 23 nt, Human
acaguguuucccauaauuuucuu

SEQ ID NO: 3556173 - RNA, 14 nt, Human
acaguguuuucaga

SEQ ID NO: 3556174 - RNA, 16 nt, Human
acaguguuuuuguaaa

SEQ ID NO: 3556175 - RNA, 18 nt, Human
acaguguuuuuguaaagu

SEQ ID NO: 3556176 - RNA, 22 nt, Human
acaguguuuuuguaaagugugg

SEQ ID NO: 3556177 - RNA, 21 nt, Human
acaguuaaaugagaacaugaa

SEQ ID NO: 3556178 - RNA, 16 nt, Human
acaguuaaggaauaua

SEQ ID NO: 3556179 - RNA, 21 nt, Human
acaguuaccucugccucagaa

SEQ ID NO: 3556180 - RNA, 13 nt, Human
acaguuacucaga

SEQ ID NO: 3556181 - RNA, 20 nt, Human
acaguuacucagaauucucu

SEQ ID NO: 3556182 - RNA, 12 nt, Human
acaguuacuuuu

SEQ ID NO: 3556183 - RNA, 13 nt, Human
acaguuacuuuuc

SEQ ID NO: 3556184 - RNA, 15 nt, Human
acaguuacuuuuccu

SEQ ID NO: 3556185 - RNA, 19 nt, Human
acaguuauaaaauuaaaag

SEQ ID NO: 3556186 - RNA, 21 nt, Human
acaguucaguggcagggcuca

SEQ ID NO: 3556187 - RNA, 16 nt, Human
acaguucaguuccucu

SEQ ID NO: 3556188 - RNA, 20 nt, Human
acaguucauguuugcuucau

SEQ ID NO: 3556189 - RNA, 19 nt, Human
acaguucauucagggccga

SEQ ID NO: 3556190 - RNA, 18 nt, Human
acaguuccccuaugugga

SEQ ID NO: 3556191 - RNA, 19 nt, Human
acaguuccccuauguggaa

SEQ ID NO: 3556192 - RNA, 14 nt, Human
acaguuccucgccc

SEQ ID NO: 3556193 - RNA, 19 nt, Human
acaguuccucgcccugggu

SEQ ID NO: 3556194 - RNA, 13 nt, Human
acaguuccuggga

SEQ ID NO: 3556195 - RNA, 15 nt, Human
acaguucugaagaau

SEQ ID NO: 3556196 - RNA, 16 nt, Human
acaguucugcucuggu

SEQ ID NO: 3556197 - RNA, 13 nt, Human
acaguucugucau

SEQ ID NO: 3556198 - RNA, 12 nt, Human
acaguucugugg

SEQ ID NO: 3556199 - RNA, 22 nt, Human
acaguucugugguuucauguua

SEQ ID NO: 3556200 - RNA, 23 nt, Human
acaguugcacagcaucucagcuc

SEQ ID NO: 3556201 - RNA, 23 nt, Human
acaguugccaccaccucuguggc

SEQ ID NO: 3556202 - RNA, 14 nt, Human
acaguugguaacuu

SEQ ID NO: 3556203 - RNA, 20 nt, Human
acaguugucuagagauauau

SEQ ID NO: 3556204 - RNA, 15 nt, Human
acaguuguuggccuc

SEQ ID NO: 3556205 - RNA, 22 nt, Human
acaguuguuugaugcauuaaaa

SEQ ID NO: 3556206 - RNA, 22 nt, Human
acaguuuaccaguugccuuuua

SEQ ID NO: 3556207 - RNA, 20 nt, Human
acaguuuaucaugaagccug

SEQ ID NO: 3556208 - RNA, 12 nt, Human
acaguuucuuag

SEQ ID NO: 3556209 - RNA, 18 nt, Human
acaguuucuuagcuuuuu

SEQ ID NO: 3556210 - RNA, 20 nt, Human
acaguuucuuagcuuuuuaa

SEQ ID NO: 3556211 - RNA, 15 nt, Human
acaguuugaacaaaa

SEQ ID NO: 3556212 - RNA, 14 nt, Human
acaguuugcucuag

SEQ ID NO: 3556213 - RNA, 13 nt, Human
acaguuuguaaau

SEQ ID NO: 3556214 - RNA, 19 nt, Human
acaguuuguaaauguuauu

SEQ ID NO: 3556215 - RNA, 22 nt, Human
acaguuuguaaauguuauuucu

SEQ ID NO: 3556216 - RNA, 14 nt, Human
acaguuugucacau

SEQ ID NO: 3556217 - RNA, 14 nt, Human
acaguuuguuuaca

SEQ ID NO: 3556218 - RNA, 21 nt, Human
acaguuuuaacuguggauauu

SEQ ID NO: 3556219 - RNA, 14 nt, Human
acaguuuucagaaa

SEQ ID NO: 3556220 - RNA, 12 nt, Human
acaguuuuccau

SEQ ID NO: 3556221 - RNA, 15 nt, Human
acaguuuuccaugaa

SEQ ID NO: 3556222 - RNA, 16 nt, Human
acaguuuuccaugaaa

SEQ ID NO: 3556223 - RNA, 23 nt, Human
acaguuuuccaugaaaacguuuu

SEQ ID NO: 3556224 - RNA, 22 nt, Human
acaguuuuccuucucaucugug

SEQ ID NO: 3556225 - RNA, 22 nt, Human
accaauuuuuugugugugaagc

SEQ ID NO: 3556226 - RNA, 18 nt, Human
accaauuuuuuguucuuc

SEQ ID NO: 3556227 - RNA, 23 nt, Human
accaauuuuuuguucuucagaga

SEQ ID NO: 3556228 - RNA, 12 nt, Human
acaugauuucac

SEQ ID NO: 3556229 - RNA, 17 nt, Human
acaugauuucacaaaua

SEQ ID NO: 3556230 - RNA, 19 nt, Human
acaugauuucacaaauauu

SEQ ID NO: 3556231 - RNA, 18 nt, Human
acaugcaaaaagaaauga

SEQ ID NO: 3556232 - RNA, 23 nt, Human
acaugcaaaaagaaaugacuaau

SEQ ID NO: 3556233 - RNA, 16 nt, Human
acaugcaaggucauuu

SEQ ID NO: 3556234 - RNA, 18 nt, Human
acaugcaaggucauuuuu

SEQ ID NO: 3556235 - RNA, 19 nt, Human
acaugcaaggucauuuuuu

SEQ ID NO: 3556236 - RNA, 15 nt, Human
acaugcaauaaaauu

SEQ ID NO: 3556237 - RNA, 13 nt, Human
acaugcacgugug

SEQ ID NO: 3556238 - RNA, 17 nt, Human
acaugcacuaugaggaa

SEQ ID NO: 3556239 - RNA, 18 nt, Human
acaugcacucagcucuug

SEQ ID NO: 3556240 - RNA, 18 nt, Human
acaugcacugacccuucc

SEQ ID NO: 3556241 - RNA, 18 nt, Human
acaugcacuuggcugcau

SEQ ID NO: 3556242 - RNA, 22 nt, Human
acaugcagcccaugcccaccug

SEQ ID NO: 3556243 - RNA, 17 nt, Human
acaugcaguuugaaauu

SEQ ID NO: 3556244 - RNA, 18 nt, Human
acaugcaguuugaaauuc

SEQ ID NO: 3556245 - RNA, 12 nt, Human
acaugcauacac

SEQ ID NO: 3556246 - RNA, 17 nt, Human
accagagcacuguauac

SEQ ID NO: 3556247 - RNA, 12 nt, Human
accagagcagau

SEQ ID NO: 3556248 - RNA, 15 nt, Human
accagagcagaugca

SEQ ID NO: 3556249 - RNA, 22 nt, Human
accagagcagaugcagagagcc

SEQ ID NO: 3556250 - RNA, 13 nt, Human
accagagccaugg

SEQ ID NO: 3556251 - RNA, 12 nt, Human
accagagcccac

SEQ ID NO: 3556252 - RNA, 23 nt, Human
accagagcucuggagccaccugu

SEQ ID NO: 3556253 - RNA, 18 nt, Human
accagaggaaucacucuu

SEQ ID NO: 3556254 - RNA, 14 nt, Human
accagaggagccuu

SEQ ID NO: 3556255 - RNA, 15 nt, Human
accagaggagccuuu

SEQ ID NO: 3556256 - RNA, 16 nt, Human
accagaggagccuuuu

SEQ ID NO: 3556257 - RNA, 17 nt, Human
accagaggagccuuuuu

SEQ ID NO: 3556258 - RNA, 21 nt, Human
accagaggcugcagaaggcca

SEQ ID NO: 3556259 - RNA, 22 nt, Human
accagaggcugcagaaggccaa

SEQ ID NO: 3556260 - RNA, 19 nt, Human
accagauaacugaggaggg

SEQ ID NO: 3556261 - RNA, 14 nt, Human
accagauaacuuuu

SEQ ID NO: 3556262 - RNA, 21 nt, Human
accagauaagaaugcugguuu

SEQ ID NO: 3556263 - RNA, 13 nt, Human
accagaugagaau

SEQ ID NO: 3556264 - RNA, 17 nt, Human
accagcaauauguaaau

SEQ ID NO: 3556265 - RNA, 14 nt, Human
accagcacacuccc

SEQ ID NO: 3556266 - RNA, 20 nt, Human
accagcaccaucucuccucc

SEQ ID NO: 3556267 - RNA, 15 nt, Human
accagcacugucuca

SEQ ID NO: 3556268 - RNA, 16 nt, Human
accagcacugucucag

SEQ ID NO: 3556269 - RNA, 13 nt, Human
accagcagaaaug

SEQ ID NO: 3556270 - RNA, 15 nt, Human
accagcagaucccag

SEQ ID NO: 3556271 - RNA, 19 nt, Human
accagcagaucccagcuca

SEQ ID NO: 3556272 - RNA, 13 nt, Human
accagcagccugg

SEQ ID NO: 3556273 - RNA, 18 nt, Human
accagcagucugccugga

SEQ ID NO: 3556274 - RNA, 18 nt, Human
accagcaucaccugccug

SEQ ID NO: 3556275 - RNA, 19 nt, Human
accagcaucaccugccugu

SEQ ID NO: 3556276 - RNA, 19 nt, Human
accagccaggcucugugcu

SEQ ID NO: 3556277 - RNA, 20 nt, Human
accagccaggcucugugcug

SEQ ID NO: 3556278 - RNA, 19 nt, Human
accagccagggaaagacug

SEQ ID NO: 3556279 - RNA, 11 nt, Human
accagcccacg

SEQ ID NO: 3556280 - RNA, 19 nt, Human
accagcccaucgccacaaa

SEQ ID NO: 3556281 - RNA, 16 nt, Human
accagccccacccugu

SEQ ID NO: 3556282 - RNA, 16 nt, Human
accagccccacugcca

SEQ ID NO: 3556283 - RNA, 18 nt, Human
accagccccacugccagc

SEQ ID NO: 3556284 - RNA, 18 nt, Human
accagccccagugcccac

SEQ ID NO: 3556285 - RNA, 19 nt, Human
accagccccagugcccaca

SEQ ID NO: 3556286 - RNA, 18 nt, Human
accagcccuggggcuggg

SEQ ID NO: 3556287 - RNA, 22 nt, Human
accagcccuugagggagaacuu

SEQ ID NO: 3556288 - RNA, 19 nt, Human
accagccuccaugcugccu

SEQ ID NO: 3556289 - RNA, 20 nt, Human
accagccuccaugcugccuc

SEQ ID NO: 3556290 - RNA, 20 nt, Human
accagccuccguauuucaga

SEQ ID NO: 3556291 - RNA, 23 nt, Human
accagccucucuugguuuccuuc

SEQ ID NO: 3556292 - RNA, 15 nt, Human
accagccugaccaaa

SEQ ID NO: 3556293 - RNA, 23 nt, Human
accagccuguuggacccgcucug

SEQ ID NO: 3556294 - RNA, 17 nt, Human
accagccuuucucccag

SEQ ID NO: 3556295 - RNA, 22 nt, Human
accagccuuucucccaggccag

SEQ ID NO: 3556296 - RNA, 19 nt, Human
accagcgcucuaaaagcac

SEQ ID NO: 3556297 - RNA, 22 nt, Human
accagcgugugacuacuccccc

SEQ ID NO: 3556298 - RNA, 23 nt, Human
accagcuaagaaaagauuuuaau

SEQ ID NO: 3556299 - RNA, 13 nt, Human
accagcucagcac

SEQ ID NO: 3556300 - RNA, 14 nt, Human
accagcucagcacu

SEQ ID NO: 3556301 - RNA, 15 nt, Human
accagcucaggacag

SEQ ID NO: 3556302 - RNA, 14 nt, Human
accagcuccucccu

SEQ ID NO: 3556303 - RNA, 11 nt, Human
accagcugcaa

SEQ ID NO: 3556304 - RNA, 19 nt, Human
accagcugcaaaguguuuu

SEQ ID NO: 3556305 - RNA, 18 nt, Human
accagcugcgcuugcuuu

SEQ ID NO: 3556306 - RNA, 20 nt, Human
accagcugcgcuugcuuuuc

SEQ ID NO: 3556307 - RNA, 22 nt, Human
accagcugcuccgaggacccag

SEQ ID NO: 3556308 - RNA, 10 nt, Human
accagcuggg

SEQ ID NO: 3556309 - RNA, 20 nt, Human
accagcuggggcguggggag

SEQ ID NO: 3556310 - RNA, 16 nt, Human
accagcuuagauuuua

SEQ ID NO: 3556311 - RNA, 22 nt, Human
accagcuuccuucagagagcag

SEQ ID NO: 3556312 - RNA, 18 nt, Human
accagcuugcgaauaaca

SEQ ID NO: 3556313 - RNA, 20 nt, Human
accagcuuggcucaggcuga

SEQ ID NO: 3556314 - RNA, 22 nt, Human
accagcuuguaugcaauggauu

SEQ ID NO: 3556315 - RNA, 19 nt, Human
accagcuuuuaaccaucug

SEQ ID NO: 3556316 - RNA, 14 nt, Human
accaggacaggacc

SEQ ID NO: 3556317 - RNA, 12 nt, Human
accaggacccug

SEQ ID NO: 3556318 - RNA, 20 nt, Human
accaggacuauagcccaggu

SEQ ID NO: 3556319 - RNA, 16 nt, Human
accaggacucccuccu

SEQ ID NO: 3556320 - RNA, 17 nt, Human
accaggacucccuccuc

SEQ ID NO: 3556321 - RNA, 21 nt, Human
accaggacucccuccucaccu

SEQ ID NO: 3556322 - RNA, 14 nt, Human
accaggagcugcuc

SEQ ID NO: 3556323 - RNA, 17 nt, Human
accaggagucccuggua

SEQ ID NO: 3556324 - RNA, 16 nt, Human
accaggaguggguggg

SEQ ID NO: 3556325 - RNA, 13 nt, Human
accaggauuuuuu

SEQ ID NO: 3556326 - RNA, 19 nt, Human
accaggcaacuugggaacu

SEQ ID NO: 3556327 - RNA, 19 nt, Human
accaggcaccaaaagaagu

SEQ ID NO: 3556328 - RNA, 20 nt, Human
accaggcaccaaaagaagua

SEQ ID NO: 3556329 - RNA, 16 nt, Human
accaggcaccucuucc

SEQ ID NO: 3556330 - RNA, 20 nt, Human
accaggcacgaacccaccug

SEQ ID NO: 3556331 - RNA, 21 nt, Human
accaggcacgaacccaccugc

SEQ ID NO: 3556332 - RNA, 20 nt, Human
accaggcagccucugggggg

SEQ ID NO: 3556333 - RNA, 21 nt, Human
accaggcagccucuggggggu

SEQ ID NO: 3556334 - RNA, 14 nt, Human
accaggccaccucc

SEQ ID NO: 3556335 - RNA, 17 nt, Human
accaggccaccucccca

SEQ ID NO: 3556336 - RNA, 15 nt, Human
accaggccccccugu

SEQ ID NO: 3556337 - RNA, 12 nt, Human
accaggcccugg

SEQ ID NO: 3556338 - RNA, 18 nt, Human
accaggccguccucccgg

SEQ ID NO: 3556339 - RNA, 18 nt, Human
accaggcuggagugcagu

SEQ ID NO: 3556340 - RNA, 20 nt, Human
accaggcuggcgcagccaag

SEQ ID NO: 3556341 - RNA, 18 nt, Human
accaggcuugccugcagg

SEQ ID NO: 3556342 - RNA, 19 nt, Human
accaggcuugccugcaggc

SEQ ID NO: 3556343 - RNA, 21 nt, Human
accagggagaccgagcgcuuu

SEQ ID NO: 3556344 - RNA, 17 nt, Human
accagggcaucucuggg

SEQ ID NO: 3556345 - RNA, 17 nt, Human
accagggccagccucua

SEQ ID NO: 3556346 - RNA, 16 nt, Human
accagggccgaggagg

SEQ ID NO: 3556347 - RNA, 21 nt, Human
accagggccuuuucuggcacc

SEQ ID NO: 3556348 - RNA, 22 nt, Human
accagggcgaacgacaauagcu

SEQ ID NO: 3556349 - RNA, 16 nt, Human
accagggcuccagccc

SEQ ID NO: 3556350 - RNA, 13 nt, Human
accagggcuggaa

SEQ ID NO: 3556351 - RNA, 15 nt, Human
accaggggcaggcac

SEQ ID NO: 3556352 - RNA, 16 nt, Human
accaggggcaggcaca

SEQ ID NO: 3556353 - RNA, 19 nt, Human
accaggggcaggcacagca

SEQ ID NO: 3556354 - RNA, 21 nt, Human
accaggguccuuuugacacug

SEQ ID NO: 3556355 - RNA, 20 nt, Human
accaggguugaccccagagg

SEQ ID NO: 3556356 - RNA, 19 nt, Human
accaggguuggcaccuucc

SEQ ID NO: 3556357 - RNA, 17 nt, Human
accaggugccuuucaaa

SEQ ID NO: 3556358 - RNA, 18 nt, Human
accaguaaaguguaacau

SEQ ID NO: 3556359 - RNA, 19 nt, Human
accaguaaaguguaacaua

SEQ ID NO: 3556360 - RNA, 18 nt, Human
accaguaauugugaaaau

SEQ ID NO: 3556361 - RNA, 17 nt, Human
accaguacauucucagu

SEQ ID NO: 3556362 - RNA, 18 nt, Human
accaguauacaagauaag

SEQ ID NO: 3556363 - RNA, 20 nt, Human
accaguaucgcucauagauc

SEQ ID NO: 3556364 - RNA, 20 nt, Human
accaguauuguacaaaguau

SEQ ID NO: 3556365 - RNA, 23 nt, Human
accaguauuguacaaaguauuaa

SEQ ID NO: 3556366 - RNA, 16 nt, Human
accagucauuuuucag

SEQ ID NO: 3556367 - RNA, 15 nt, Human
accaguccccccacc

SEQ ID NO: 3556368 - RNA, 13 nt, Human
accagucugaagu

SEQ ID NO: 3556369 - RNA, 14 nt, Human
accagucugacccu

SEQ ID NO: 3556370 - RNA, 14 nt, Human
accagucugacugu

SEQ ID NO: 3556371 - RNA, 23 nt, Human
accagucuuuaaaggcccagccc

SEQ ID NO: 3556372 - RNA, 14 nt, Human
acccccuucucugc

SEQ ID NO: 3556373 - RNA, 20 nt, Human
acccccuucucugcuccacc

SEQ ID NO: 3556374 - RNA, 13 nt, Human
acccccuucuggg

SEQ ID NO: 3556375 - RNA, 16 nt, Human
acccccuucugggcau

SEQ ID NO: 3556376 - RNA, 16 nt, Human
accccgacgccacagc

SEQ ID NO: 3556377 - RNA, 12 nt, Human
accccgacuuuu

SEQ ID NO: 3556378 - RNA, 13 nt, Human
accccgagcccua

SEQ ID NO: 3556379 - RNA, 14 nt, Human
accccgaggcccug

SEQ ID NO: 3556380 - RNA, 16 nt, Human
accccgaggcccugca

SEQ ID NO: 3556381 - RNA, 22 nt, Human
accccgcaagcaccauccccuc

SEQ ID NO: 3556382 - RNA, 16 nt, Human
accccgcucugcaugc

SEQ ID NO: 3556383 - RNA, 22 nt, Human
accccgcucugcaugcggccca

SEQ ID NO: 3556384 - RNA, 23 nt, Human
accccgcucugcaugcggcccag

SEQ ID NO: 3556385 - RNA, 13 nt, Human
accccggcaggcc

SEQ ID NO: 3556386 - RNA, 22 nt, Human
accccggcaggcccugcagugu

SEQ ID NO: 3556387 - RNA, 17 nt, Human
accccgggcucucugcu

SEQ ID NO: 3556388 - RNA, 15 nt, Human
accccggggacccug

SEQ ID NO: 3556389 - RNA, 17 nt, Human
accccggggacccugug

SEQ ID NO: 3556390 - RNA, 18 nt, Human
accccggggacccuguga

SEQ ID NO: 3556391 - RNA, 13 nt, Human
accccggggugag

SEQ ID NO: 3556392 - RNA, 21 nt, Human
accccgguggcggccccagca

SEQ ID NO: 3556393 - RNA, 22 nt, Human
accccuaaaagaaacccugcac

SEQ ID NO: 3556394 - RNA, 22 nt, Human
accccuaaagagauacuuugau

SEQ ID NO: 3556395 - RNA, 12 nt, Human
accccuaggacu

SEQ ID NO: 3556396 - RNA, 15 nt, Human
accccuaguucccuc

SEQ ID NO: 3556397 - RNA, 17 nt, Human
accccuaguucccucug

SEQ ID NO: 3556398 - RNA, 19 nt, Human
accccuaguucccucugcu

SEQ ID NO: 3556399 - RNA, 22 nt, Human
accccucaccuugcaacacaca

SEQ ID NO: 3556400 - RNA, 23 nt, Human
accccucaccuugcaacacacag

SEQ ID NO: 3556401 - RNA, 17 nt, Human
accccucacucuggccu

SEQ ID NO: 3556402 - RNA, 13 nt, Human
accccucccagcu

SEQ ID NO: 3556403 - RNA, 11 nt, Human
accccucccau

SEQ ID NO: 3556404 - RNA, 12 nt, Human
accccuccccuc

SEQ ID NO: 3556405 - RNA, 18 nt, Human
accccucccuuucucccc

SEQ ID NO: 3556406 - RNA, 16 nt, Human
accccuccucacuggc

SEQ ID NO: 3556407 - RNA, 17 nt, Human
accccuccucacuggcc

SEQ ID NO: 3556408 - RNA, 23 nt, Human
accccuccucacuggccaucccu

SEQ ID NO: 3556409 - RNA, 18 nt, Human
accccuccuggggccagg

SEQ ID NO: 3556410 - RNA, 18 nt, Human
accccucgcccaguccca

SEQ ID NO: 3556411 - RNA, 22 nt, Human
accccucgcccagucccagcag

SEQ ID NO: 3556412 - RNA, 24 nt, Human
accccucgcccagucccagcagcc

SEQ ID NO: 3556413 - RNA, 16 nt, Human
accccucuaccaagcu

SEQ ID NO: 3556414 - RNA, 18 nt, Human
accccucuaccaagcugu

SEQ ID NO: 3556415 - RNA, 15 nt, Human
accccucuggccagg

SEQ ID NO: 3556416 - RNA, 23 nt, Human
accccugcauuggaacuggaggc

SEQ ID NO: 3556417 - RNA, 20 nt, Human
accccugcccccagccccgg

SEQ ID NO: 3556418 - RNA, 14 nt, Human
accccugcccuggg

SEQ ID NO: 3556419 - RNA, 16 nt, Human
accccugcccuugucc

SEQ ID NO: 3556420 - RNA, 13 nt, Human
accccugccucca

SEQ ID NO: 3556421 - RNA, 14 nt, Human
accccugccuccac

SEQ ID NO: 3556422 - RNA, 15 nt, Human
accccugccuccacc

SEQ ID NO: 3556423 - RNA, 16 nt, Human
accccugccuccaccc

SEQ ID NO: 3556424 - RNA, 17 nt, Human
accccugccuccacccu

SEQ ID NO: 3556425 - RNA, 19 nt, Human
accccugccuccacccucu

SEQ ID NO: 3556426 - RNA, 20 nt, Human
accccugccuccacccucug

SEQ ID NO: 3556427 - RNA, 21 nt, Human
accccugccuccacccucuga

SEQ ID NO: 3556428 - RNA, 14 nt, Human
accccugcggcagg

SEQ ID NO: 3556429 - RNA, 9 nt, Human
accccugcu

SEQ ID NO: 3556430 - RNA, 14 nt, Human
accccugcuucuga

SEQ ID NO: 3556431 - RNA, 12 nt, Human
accccuggaaga

SEQ ID NO: 3556432 - RNA, 18 nt, Human
accccuggaagagcccag

SEQ ID NO: 3556433 - RNA, 23 nt, Human
accccuggaagagcccagucugu

SEQ ID NO: 3556434 - RNA, 17 nt, Human
accccuggaccccagcc

SEQ ID NO: 3556435 - RNA, 18 nt, Human
accccuggaccccagccu

SEQ ID NO: 3556436 - RNA, 23 nt, Human
accccuggaccccagccucaaau

SEQ ID NO: 3556437 - RNA, 12 nt, Human
accccuggccuc

SEQ ID NO: 3556438 - RNA, 12 nt, Human
accccuggcuuu

SEQ ID NO: 3556439 - RNA, 15 nt, Human
accccuggcuuuuca

SEQ ID NO: 3556440 - RNA, 17 nt, Human
accccuggcuuuucacu

SEQ ID NO: 3556441 - RNA, 18 nt, Human
accccuggcuuuucacug

SEQ ID NO: 3556442 - RNA, 21 nt, Human
accccuggcuuuucacugcug

SEQ ID NO: 3556443 - RNA, 17 nt, Human
accccugggggcucuca

SEQ ID NO: 3556444 - RNA, 14 nt, Human
accccugguucuca

SEQ ID NO: 3556445 - RNA, 22 nt, Human
accagccccacugccagcagca

SEQ ID NO: 3556446 - RNA, 23 nt, Human
accagccccacugccagcagcag

SEQ ID NO: 3556447 - RNA, 16 nt, Human
accagccccagugccc

SEQ ID NO: 3556448 - RNA, 17 nt, Human
accagccccagugccca

SEQ ID NO: 3556449 - RNA, 11 nt, Human
accagccccug

SEQ ID NO: 3556450 - RNA, 18 nt, Human
accagccccugccccagc

SEQ ID NO: 3556451 - RNA, 14 nt, Human
accagcccggccug

SEQ ID NO: 3556452 - RNA, 16 nt, Human
accagcccggccugcu

SEQ ID NO: 3556453 - RNA, 15 nt, Human
accagcccuggggcu

SEQ ID NO: 3556454 - RNA, 16 nt, Human
accagcccuggggcug

SEQ ID NO: 3556455 - RNA, 17 nt, Human
accagcccuggggcugg

SEQ ID NO: 3556456 - RNA, 18 nt, Human
accagcccuugagggaga

SEQ ID NO: 3556457 - RNA, 14 nt, Human
accagccgugagca

SEQ ID NO: 3556458 - RNA, 19 nt, Human
accagccgugagcauguuu

SEQ ID NO: 3556459 - RNA, 14 nt, Human
accagccucaccag

SEQ ID NO: 3556460 - RNA, 19 nt, Human
accagccucgucuucauua

SEQ ID NO: 3556461 - RNA, 20 nt, Human
accagccugaccaacauggu

SEQ ID NO: 3556462 - RNA, 17 nt, Human
accagccuggccaacau

SEQ ID NO: 3556463 - RNA, 13 nt, Human
accagccugggca

SEQ ID NO: 3556464 - RNA, 14 nt, Human
accagcgaagggag

SEQ ID NO: 3556465 - RNA, 17 nt, Human
accagcgcccgcugggc

SEQ ID NO: 3556466 - RNA, 23 nt, Human
accagcgcccgcugggcugagcc

SEQ ID NO: 3556467 - RNA, 19 nt, Human
accagcgcuugaagccuga

SEQ ID NO: 3556468 - RNA, 22 nt, Human
accagcuaagaaaagauuuuaa

SEQ ID NO: 3556469 - RNA, 16 nt, Human
accagcuacccugugu

SEQ ID NO: 3556470 - RNA, 14 nt, Human
accagcucaggaca

SEQ ID NO: 3556471 - RNA, 23 nt, Human
accagcucaggacagaugccaca

SEQ ID NO: 3556472 - RNA, 13 nt, Human
accagcuccuccc

SEQ ID NO: 3556473 - RNA, 22 nt, Human
accagcucugccgucucuggag

SEQ ID NO: 3556474 - RNA, 23 nt, Human
accagcugaaguugcagauguua

SEQ ID NO: 3556475 - RNA, 13 nt, Human
accagcugcaaag

SEQ ID NO: 3556476 - RNA, 18 nt, Human
accagcugcaaaguguuu

SEQ ID NO: 3556477 - RNA, 20 nt, Human
accagcugcaaaguguuuug

SEQ ID NO: 3556478 - RNA, 14 nt, Human
accagcugccucuu

SEQ ID NO: 3556479 - RNA, 16 nt, Human
accagcugcgcuugcu

SEQ ID NO: 3556480 - RNA, 17 nt, Human
accagcugcugcucuga

SEQ ID NO: 3556481 - RNA, 11 nt, Human
accagcugggg

SEQ ID NO: 3556482 - RNA, 21 nt, Human
accagcuggggcguggggagg

SEQ ID NO: 3556483 - RNA, 13 nt, Human
accagcugugucc

SEQ ID NO: 3556484 - RNA, 18 nt, Human
accagcuguguccggccc

SEQ ID NO: 3556485 - RNA, 22 nt, Human
accagcuguucugucccuugga

SEQ ID NO: 3556486 - RNA, 18 nt, Human
accagcuuccuucagaga

SEQ ID NO: 3556487 - RNA, 15 nt, Human
accagcuuggcucag

SEQ ID NO: 3556488 - RNA, 15 nt, Human
accagcuuugacccg

SEQ ID NO: 3556489 - RNA, 15 nt, Human
accagcuuuuaacca

SEQ ID NO: 3556490 - RNA, 19 nt, Human
accaggaaaggauuuuaua

SEQ ID NO: 3556491 - RNA, 13 nt, Human
accaggaacagca

SEQ ID NO: 3556492 - RNA, 20 nt, Human
accaggaacucuggaguuca

SEQ ID NO: 3556493 - RNA, 12 nt, Human
accaggaagccg

SEQ ID NO: 3556494 - RNA, 17 nt, Human
accaggacaggaccaga

SEQ ID NO: 3556495 - RNA, 19 nt, Human
accaggacuauagcccagg

SEQ ID NO: 3556496 - RNA, 15 nt, Human
accaggacucccucc

SEQ ID NO: 3556497 - RNA, 18 nt, Human
accaggacucccuccuca

SEQ ID NO: 3556498 - RNA, 11 nt, Human
accaggagaca

SEQ ID NO: 3556499 - RNA, 12 nt, Human
accaggagacag

SEQ ID NO: 3556500 - RNA, 14 nt, Human
accaggauagagac

SEQ ID NO: 3556501 - RNA, 17 nt, Human
accaggauagagacugg

SEQ ID NO: 3556502 - RNA, 17 nt, Human
accaggcaccaaaagaa

SEQ ID NO: 3556503 - RNA, 21 nt, Human
accaggcaccaaaagaaguaa

SEQ ID NO: 3556504 - RNA, 15 nt, Human
accaggcaccaggca

SEQ ID NO: 3556505 - RNA, 15 nt, Human
accaggcaccucccc

SEQ ID NO: 3556506 - RNA, 23 nt, Human
accaggcacgaacccaccugcug

SEQ ID NO: 3556507 - RNA, 19 nt, Human
accaggccgccccagccuc

SEQ ID NO: 3556508 - RNA, 19 nt, Human
accaggccguccucccggg

SEQ ID NO: 3556509 - RNA, 17 nt, Human
accaggcugccucccuu

SEQ ID NO: 3556510 - RNA, 16 nt, Human
accaggcuggcgcagc

SEQ ID NO: 3556511 - RNA, 19 nt, Human
accaggcuggcgcagccaa

SEQ ID NO: 3556512 - RNA, 13 nt, Human
accaggcuguguc

SEQ ID NO: 3556513 - RNA, 21 nt, Human
accagggaugaugcaacaucc

SEQ ID NO: 3556514 - RNA, 19 nt, Human
accagggauuguuucuguu

SEQ ID NO: 3556515 - RNA, 15 nt, Human
accagggcagggcca

SEQ ID NO: 3556516 - RNA, 22 nt, Human
accagggcaucucugggcugga

SEQ ID NO: 3556517 - RNA, 18 nt, Human
acaaaguguguauuaaaa

SEQ ID NO: 3556518 - RNA, 15 nt, Human
acaaaguuguaugug

SEQ ID NO: 3556519 - RNA, 16 nt, Human
acaaauaacaaugugc

SEQ ID NO: 3556520 - RNA, 20 nt, Human
acaaauaauuuuuaaauaua

SEQ ID NO: 3556521 - RNA, 16 nt, Human
acaaauacuaaaaaga

SEQ ID NO: 3556522 - RNA, 16 nt, Human
acaaauacucaugugu

SEQ ID NO: 3556523 - RNA, 17 nt, Human
acaaauacucaugugua

SEQ ID NO: 3556524 - RNA, 15 nt, Human
acaaauagaaaaugg

SEQ ID NO: 3556525 - RNA, 17 nt, Human
acaaauaguaggcaaga

SEQ ID NO: 3556526 - RNA, 19 nt, Human
acaaauaguaggcaagaug

SEQ ID NO: 3556527 - RNA, 21 nt, Human
acaaauaguaggcaagauggc

SEQ ID NO: 3556528 - RNA, 15 nt, Human
acaaauauaaaucuu

SEQ ID NO: 3556529 - RNA, 16 nt, Human
acaaauauuaaaaagu

SEQ ID NO: 3556530 - RNA, 13 nt, Human
acaaauauuauuu

SEQ ID NO: 3556531 - RNA, 15 nt, Human
acaaauauuauuugu

SEQ ID NO: 3556532 - RNA, 21 nt, Human
acaaaucaacagaagcauuug

SEQ ID NO: 3556533 - RNA, 13 nt, Human
acaaaucaaguuu

SEQ ID NO: 3556534 - RNA, 15 nt, Human
acaaaucaaguuucc

SEQ ID NO: 3556535 - RNA, 15 nt, Human
acaaaucagaaguca

SEQ ID NO: 3556536 - RNA, 16 nt, Human
acaaaucagaagucau

SEQ ID NO: 3556537 - RNA, 14 nt, Human
acaaaucuaugcca

SEQ ID NO: 3556538 - RNA, 22 nt, Human
acaaaucugcaaagcauguuuu

SEQ ID NO: 3556539 - RNA, 20 nt, Human
acaaaucuguguauauuauu

SEQ ID NO: 3556540 - RNA, 15 nt, Human
acaaaucuuuccaua

SEQ ID NO: 3556541 - RNA, 13 nt, Human
acaaaugacuuua

SEQ ID NO: 3556542 - RNA, 21 nt, Human
acaaaugacuuuauuauuuau

SEQ ID NO: 3556543 - RNA, 15 nt, Human
acaaaugauugcuuu

SEQ ID NO: 3556544 - RNA, 18 nt, Human
acaaaugauugcuuuuaa

SEQ ID NO: 3556545 - RNA, 15 nt, Human
acaaaugcaucuuug

SEQ ID NO: 3556546 - RNA, 16 nt, Human
acaaaugcaucuuuga

SEQ ID NO: 3556547 - RNA, 18 nt, Human
acaaaugcaugaacaagu

SEQ ID NO: 3556548 - RNA, 22 nt, Human
acaaaugccaaauuaaaaaaga

SEQ ID NO: 3556549 - RNA, 15 nt, Human
acaaaugccacacau

SEQ ID NO: 3556550 - RNA, 19 nt, Human
acaaaugccuuaaaaugga

SEQ ID NO: 3556551 - RNA, 20 nt, Human
acaaaugccuuaaaauggaa

SEQ ID NO: 3556552 - RNA, 21 nt, Human
acaaaugggcgccccccccuc

SEQ ID NO: 3556553 - RNA, 22 nt, Human
acaaaugggcgccccccccucc

SEQ ID NO: 3556554 - RNA, 18 nt, Human
acaaauguuaaaaugugu

SEQ ID NO: 3556555 - RNA, 23 nt, Human
acaaauguuuugcucaauagauu

SEQ ID NO: 3556556 - RNA, 17 nt, Human
acaaauuaaaaagauuc

SEQ ID NO: 3556557 - RNA, 21 nt, Human
acaaauuaaaaagauucuuuu

SEQ ID NO: 3556558 - RNA, 13 nt, Human
acaaauuaauuuu

SEQ ID NO: 3556559 - RNA, 22 nt, Human
acaaauuagaaaauguuauuua

SEQ ID NO: 3556560 - RNA, 20 nt, Human
acaaauuauaauguauucau

SEQ ID NO: 3556561 - RNA, 18 nt, Human
acaaauuaugcuaagaau

SEQ ID NO: 3556562 - RNA, 17 nt, Human
acaaauucauauucugu

SEQ ID NO: 3556563 - RNA, 21 nt, Human
acaaauucugaauauuuuuug

SEQ ID NO: 3556564 - RNA, 18 nt, Human
acaaauucugucucugga

SEQ ID NO: 3556565 - RNA, 15 nt, Human
acaaauucuguuucu

SEQ ID NO: 3556566 - RNA, 16 nt, Human
acaaauucuguuucuu

SEQ ID NO: 3556567 - RNA, 22 nt, Human
acaaauugcuugaaagaaaaua

SEQ ID NO: 3556568 - RNA, 22 nt, Human
acaaauuguuacuccauauaua

SEQ ID NO: 3556569 - RNA, 14 nt, Human
acaaauuuaaaaca

SEQ ID NO: 3556570 - RNA, 16 nt, Human
acaaauuuaaaacaaa

SEQ ID NO: 3556571 - RNA, 23 nt, Human
acaaauuuuucugcuuuaaaaau

SEQ ID NO: 3556572 - RNA, 10 nt, Human
acaacaaaaa

SEQ ID NO: 3556573 - RNA, 14 nt, Human
acaacaaaaaauaa

SEQ ID NO: 3556574 - RNA, 13 nt, Human
acaacaaaaauuu

SEQ ID NO: 3556575 - RNA, 15 nt, Human
acaacaaaaauuuga

SEQ ID NO: 3556576 - RNA, 15 nt, Human
acaacaacaaaauga

SEQ ID NO: 3556577 - RNA, 18 nt, Human
acaacaauugguaaaacu

SEQ ID NO: 3556578 - RNA, 19 nt, Human
acaacaauugguaaaacuc

SEQ ID NO: 3556579 - RNA, 20 nt, Human
acaacacacacuguucugaa

SEQ ID NO: 3556580 - RNA, 12 nt, Human
acaacacucaca

SEQ ID NO: 3556581 - RNA, 15 nt, Human
acaacacuuuaaugg

SEQ ID NO: 3556582 - RNA, 19 nt, Human
acaacagaagcuucagaag

SEQ ID NO: 3556583 - RNA, 11 nt, Human
acaacagaagu

SEQ ID NO: 3556584 - RNA, 18 nt, Human
acaacagauuggauuuua

SEQ ID NO: 3556585 - RNA, 22 nt, Human
acaacagauuggauuuuauguu

SEQ ID NO: 3556586 - RNA, 15 nt, Human
acaacagauuuguga

SEQ ID NO: 3556587 - RNA, 17 nt, Human
acaacagauuugugaac

SEQ ID NO: 3556588 - RNA, 16 nt, Human
acaacagccaacagcu

SEQ ID NO: 3556589 - RNA, 17 nt, Human
acaacagccaacagcua

SEQ ID NO: 3556590 - RNA, 20 nt, Human
acaacagcucgauccaaauu

SEQ ID NO: 3556591 - RNA, 14 nt, Human
acaacagcugccug

SEQ ID NO: 3556592 - RNA, 17 nt, Human
acaacauccauguccua

SEQ ID NO: 3556593 - RNA, 19 nt, Human
acaacauccauguccuaug

SEQ ID NO: 3556594 - RNA, 16 nt, Human
acaacauguuuccagc

SEQ ID NO: 3556595 - RNA, 21 nt, Human
acaacauguuuccagcauucc

SEQ ID NO: 3556596 - RNA, 14 nt, Human
acaacauuucuaua

SEQ ID NO: 3556597 - RNA, 22 nt, Human
acaacauuucuauagccaaaaa

SEQ ID NO: 3556598 - RNA, 18 nt, Human
acaaccaagcucucugca

SEQ ID NO: 3556599 - RNA, 18 nt, Human
acaaccacauacaacaca

SEQ ID NO: 3556600 - RNA, 19 nt, Human
acaaccaccgcuccccagc

SEQ ID NO: 3556601 - RNA, 13 nt, Human
acaacccccagcu

SEQ ID NO: 3556602 - RNA, 14 nt, Human
acaacccccagcuc

SEQ ID NO: 3556603 - RNA, 23 nt, Human
acaaccccccaucacaaacuuaa

SEQ ID NO: 3556604 - RNA, 19 nt, Human
acaaccgaugcuccagcca

SEQ ID NO: 3556605 - RNA, 20 nt, Human
acaaccgaugcuccagccaa

SEQ ID NO: 3556606 - RNA, 22 nt, Human
acaaccuccauucuauuuuaga

SEQ ID NO: 3556607 - RNA, 16 nt, Human
acaaccucccucuugu

SEQ ID NO: 3556608 - RNA, 13 nt, Human
acaaccugaaccu

SEQ ID NO: 3556609 - RNA, 12 nt, Human
acaaccuggaga

SEQ ID NO: 3556610 - RNA, 16 nt, Human
acaacgagccuuuuca

SEQ ID NO: 3556611 - RNA, 19 nt, Human
accaugauggccaggcuga

SEQ ID NO: 3556612 - RNA, 20 nt, Human
accaugccaggcuaauuuuu

SEQ ID NO: 3556613 - RNA, 22 nt, Human
accaugcccggcuaauuuuugu

SEQ ID NO: 3556614 - RNA, 20 nt, Human
accaugcucaucugcugguc

SEQ ID NO: 3556615 - RNA, 16 nt, Human
accaugcugcugggga

SEQ ID NO: 3556616 - RNA, 17 nt, Human
accaugcugucuggcac

SEQ ID NO: 3556617 - RNA, 18 nt, Human
accaugcugucuggcaca

SEQ ID NO: 3556618 - RNA, 22 nt, Human
accaugcugucuggcacagccu

SEQ ID NO: 3556619 - RNA, 23 nt, Human
accaugcugucuggcacagccug

SEQ ID NO: 3556620 - RNA, 21 nt, Human
accauggacacuacacccagc

SEQ ID NO: 3556621 - RNA, 22 nt, Human
accauggacacuacacccagca

SEQ ID NO: 3556622 - RNA, 19 nt, Human
accaugggauaaaugccau

SEQ ID NO: 3556623 - RNA, 16 nt, Human
accauggugaagugcu

SEQ ID NO: 3556624 - RNA, 19 nt, Human
accaugguuaagaguccaa

SEQ ID NO: 3556625 - RNA, 14 nt, Human
accauguaaaacaa

SEQ ID NO: 3556626 - RNA, 22 nt, Human
accauguaaaacaaaaaacaau

SEQ ID NO: 3556627 - RNA, 11 nt, Human
accauguacau

SEQ ID NO: 3556628 - RNA, 14 nt, Human
accauguacauagc

SEQ ID NO: 3556629 - RNA, 16 nt, Human
accauguauuuuguaa

SEQ ID NO: 3556630 - RNA, 19 nt, Human
accaugucguaguuacucu

SEQ ID NO: 3556631 - RNA, 16 nt, Human
accaugugagcucuuc

SEQ ID NO: 3556632 - RNA, 19 nt, Human
accaugugagcucuuccua

SEQ ID NO: 3556633 - RNA, 22 nt, Human
accaugugcuacaggggccaga

SEQ ID NO: 3556634 - RNA, 14 nt, Human
accauguggccaca

SEQ ID NO: 3556635 - RNA, 15 nt, Human
accaugugucacuug

SEQ ID NO: 3556636 - RNA, 16 nt, Human
accaugugucacuugu

SEQ ID NO: 3556637 - RNA, 17 nt, Human
accauguguuauguuuu

SEQ ID NO: 3556638 - RNA, 20 nt, Human
accauguuggccaggcugcu

SEQ ID NO: 3556639 - RNA, 21 nt, Human
accauguuggccaggcugguc

SEQ ID NO: 3556640 - RNA, 23 nt, Human
accauguugguugcacuuuguag

SEQ ID NO: 3556641 - RNA, 19 nt, Human
accauguuugagcucagac

SEQ ID NO: 3556642 - RNA, 20 nt, Human
accauuaaaacugaagucug

SEQ ID NO: 3556643 - RNA, 22 nt, Human
accauuaaaacugaagucugaa

SEQ ID NO: 3556644 - RNA, 23 nt, Human
accauuaaaacugaagucugaaa

SEQ ID NO: 3556645 - RNA, 20 nt, Human
accauuaaaacugcuuuuuu

SEQ ID NO: 3556646 - RNA, 12 nt, Human
accauuauuuuu

SEQ ID NO: 3556647 - RNA, 19 nt, Human
accauucacaauaaaagcu

SEQ ID NO: 3556648 - RNA, 20 nt, Human
accauucacaauaaaagcuu

SEQ ID NO: 3556649 - RNA, 20 nt, Human
accauucaggaaccuggacc

SEQ ID NO: 3556650 - RNA, 21 nt, Human
accauucuccaccugccaggg

SEQ ID NO: 3556651 - RNA, 13 nt, Human
accauucugacuc

SEQ ID NO: 3556652 - RNA, 15 nt, Human
accauugaacuguac

SEQ ID NO: 3556653 - RNA, 13 nt, Human
accauugacacau

SEQ ID NO: 3556654 - RNA, 16 nt, Human
accauugcugcuccuu

SEQ ID NO: 3556655 - RNA, 23 nt, Human
accauugcugcuccuuagcugcc

SEQ ID NO: 3556656 - RNA, 11 nt, Human
accauugcuuc

SEQ ID NO: 3556657 - RNA, 16 nt, Human
accauugcuucacuac

SEQ ID NO: 3556658 - RNA, 21 nt, Human
accauugcuucacuacccauc

SEQ ID NO: 3556659 - RNA, 18 nt, Human
accauuggaaauuucacg

SEQ ID NO: 3556660 - RNA, 19 nt, Human
accauuggaaauuucacgu

SEQ ID NO: 3556661 - RNA, 21 nt, Human
acaagacuucaguauguuguc

SEQ ID NO: 3556662 - RNA, 17 nt, Human
acaagagaagcauucuc

SEQ ID NO: 3556663 - RNA, 14 nt, Human
acaagagcagccug

SEQ ID NO: 3556664 - RNA, 15 nt, Human
acaagagcagccugu

SEQ ID NO: 3556665 - RNA, 19 nt, Human
acaagagcagccuguggca

SEQ ID NO: 3556666 - RNA, 13 nt, Human
acaagagcccagc

SEQ ID NO: 3556667 - RNA, 17 nt, Human
acaagagcccaggccuc

SEQ ID NO: 3556668 - RNA, 22 nt, Human
acaagagccugaucucuuccug

SEQ ID NO: 3556669 - RNA, 17 nt, Human
acaagagcgaaacuccg

SEQ ID NO: 3556670 - RNA, 18 nt, Human
acaagaguuuauuuccaa

SEQ ID NO: 3556671 - RNA, 17 nt, Human
acaagauauuguacaua

SEQ ID NO: 3556672 - RNA, 20 nt, Human
acaagaucuuucaggaaaga

SEQ ID NO: 3556673 - RNA, 18 nt, Human
acaagauggaauuuauca

SEQ ID NO: 3556674 - RNA, 18 nt, Human
acaagauuauaauauuuu

SEQ ID NO: 3556675 - RNA, 14 nt, Human
acaagauucccaga

SEQ ID NO: 3556676 - RNA, 16 nt, Human
acaagauucccagaga

SEQ ID NO: 3556677 - RNA, 18 nt, Human
acaagauucccagagaca

SEQ ID NO: 3556678 - RNA, 22 nt, Human
acaagauugguguuuuuuucua

SEQ ID NO: 3556679 - RNA, 19 nt, Human
acaagauugucauuaguga

SEQ ID NO: 3556680 - RNA, 15 nt, Human
acaagauuuuuuaau

SEQ ID NO: 3556681 - RNA, 20 nt, Human
acaagauuuuuuaauuguuu

SEQ ID NO: 3556682 - RNA, 19 nt, Human
acaagcaaacccagacggc

SEQ ID NO: 3556683 - RNA, 19 nt, Human
acaagcagauacugcugug

SEQ ID NO: 3556684 - RNA, 17 nt, Human
acaagcauauaaaaugg

SEQ ID NO: 3556685 - RNA, 19 nt, Human
acaagcaugcagcuuugca

SEQ ID NO: 3556686 - RNA, 12 nt, Human
acaagccacccc

SEQ ID NO: 3556687 - RNA, 12 nt, Human
acaagccagcca

SEQ ID NO: 3556688 - RNA, 15 nt, Human
acaagccagcuggag

SEQ ID NO: 3556689 - RNA, 15 nt, Human
acaagccccaggcag

SEQ ID NO: 3556690 - RNA, 19 nt, Human
acaagccccaggcaggcug

SEQ ID NO: 3556691 - RNA, 17 nt, Human
acaagcccccccuucca

SEQ ID NO: 3556692 - RNA, 18 nt, Human
acaagcccccccuuccac

SEQ ID NO: 3556693 - RNA, 18 nt, Human
acaagccucugcccaggc

SEQ ID NO: 3556694 - RNA, 20 nt, Human
acaagccucugcccaggcac

SEQ ID NO: 3556695 - RNA, 14 nt, Human
acaagcuaaaauua

SEQ ID NO: 3556696 - RNA, 17 nt, Human
acaagcuaggugcuaau

SEQ ID NO: 3556697 - RNA, 22 nt, Human
acaagcuccaagcucccaggca

SEQ ID NO: 3556698 - RNA, 22 nt, Human
acaagcugcacccucaggcagg

SEQ ID NO: 3556699 - RNA, 19 nt, Human
acaagcuggcuuacacugg

SEQ ID NO: 3556700 - RNA, 16 nt, Human
acaagcuucugagacg

SEQ ID NO: 3556701 - RNA, 20 nt, Human
acaagcuuuuuuacacaaau

SEQ ID NO: 3556702 - RNA, 21 nt, Human
acaaggaagucaaagcaagga

SEQ ID NO: 3556703 - RNA, 22 nt, Human
acaaggacacgcgccccccucc

SEQ ID NO: 3556704 - RNA, 18 nt, Human
acaaggacuaggguccug

SEQ ID NO: 3556705 - RNA, 15 nt, Human
acaaggacuuccugu

SEQ ID NO: 3556706 - RNA, 14 nt, Human
acaaggagggcaca

SEQ ID NO: 3556707 - RNA, 17 nt, Human
acaaggauugaaaauuc

SEQ ID NO: 3556708 - RNA, 17 nt, Human
acaaggauugcuacugu

SEQ ID NO: 3556709 - RNA, 20 nt, Human
acaaggcaaggcugucaauu

SEQ ID NO: 3556710 - RNA, 20 nt, Human
acaaggcacuucauguaaag

SEQ ID NO: 3556711 - RNA, 18 nt, Human
acaaggcagcaaggcccg

SEQ ID NO: 3556712 - RNA, 23 nt, Human
acaaggcauucaaguguacagug

SEQ ID NO: 3556713 - RNA, 11 nt, Human
acaaggcccca

SEQ ID NO: 3556714 - RNA, 17 nt, Human
acaaggccccagagacu

SEQ ID NO: 3556715 - RNA, 18 nt, Human
acaaggccccagagacuc

SEQ ID NO: 3556716 - RNA, 13 nt, Human
acaaggcugacca

SEQ ID NO: 3556717 - RNA, 18 nt, Human
acaaggcugaccaagaga

SEQ ID NO: 3556718 - RNA, 22 nt, Human
acaaggcuugcugcagauacua

SEQ ID NO: 3556719 - RNA, 20 nt, Human
acaagggaagauuuauguuu

SEQ ID NO: 3556720 - RNA, 16 nt, Human
acaagggaaggacaga

SEQ ID NO: 3556721 - RNA, 18 nt, Human
acaagggagagaccucau

SEQ ID NO: 3556722 - RNA, 21 nt, Human
acaagguaccccuuucuggcu

SEQ ID NO: 3556723 - RNA, 17 nt, Human
acaaggucauggccaca

SEQ ID NO: 3556724 - RNA, 19 nt, Human
acaaggucauggccacacu

SEQ ID NO: 3556725 - RNA, 21 nt, Human
acaaggucauggccacacugu

SEQ ID NO: 3556726 - RNA, 17 nt, Human
acaagguccaagauacc

SEQ ID NO: 3556727 - RNA, 23 nt, Human
acaagguccucugucagucacag

SEQ ID NO: 3556728 - RNA, 16 nt, Human
acaaggugcaggcagg

SEQ ID NO: 3556729 - RNA, 14 nt, Human
acaaggugggcagg

SEQ ID NO: 3556730 - RNA, 15 nt, Human
acaaggugggcaggg

SEQ ID NO: 3556731 - RNA, 19 nt, Human
acaagguucccucugagaa

SEQ ID NO: 3556732 - RNA, 13 nt, Human
acaagguucuucc

SEQ ID NO: 3556733 - RNA, 23 nt, Human
acaaguaagagacucagccugca

SEQ ID NO: 3556734 - RNA, 19 nt, Human
acaaguauacuuauauuuc

SEQ ID NO: 3556735 - RNA, 14 nt, Human
acaaguauuuguua

SEQ ID NO: 3556736 - RNA, 17 nt, Human
acaaguauuuguuaauu

SEQ ID NO: 3556737 - RNA, 18 nt, Human
acaagugacuguaucugu

SEQ ID NO: 3556738 - RNA, 21 nt, Human
acaagugagacaaaaagcacu

SEQ ID NO: 3556739 - RNA, 18 nt, Human
acaagugccgcaaauugu

SEQ ID NO: 3556740 - RNA, 20 nt, Human
acaagugccgcaaauuguac

SEQ ID NO: 3556741 - RNA, 12 nt, Human
acaagugcuggc

SEQ ID NO: 3556742 - RNA, 18 nt, Human
acaaguggcaaccugcuu

SEQ ID NO: 3556743 - RNA, 16 nt, Human
acaaguguaaugaaua

SEQ ID NO: 3556744 - RNA, 20 nt, Human
acaaguguaaugaauaccuu

SEQ ID NO: 3556745 - RNA, 18 nt, Human
acaaguguauaucagaaa

SEQ ID NO: 3556746 - RNA, 15 nt, Human
acaaguuaagauucu

SEQ ID NO: 3556747 - RNA, 20 nt, Human
acaaguugagcuaugacuua

SEQ ID NO: 3556748 - RNA, 21 nt, Human
acaaguugagcuaugacuuaa

SEQ ID NO: 3556749 - RNA, 18 nt, Human
acaaguugcuuuuaccug

SEQ ID NO: 3556750 - RNA, 17 nt, Human
acaaguuggagucacuc

SEQ ID NO: 3556751 - RNA, 18 nt, Human
acaaguuggagucacucu

SEQ ID NO: 3556752 - RNA, 15 nt, Human
acaaguuguguuuga

SEQ ID NO: 3556753 - RNA, 21 nt, Human
acaaguuuucauaagcacacu

SEQ ID NO: 3556754 - RNA, 14 nt, Human
acaauaaaaauguu

SEQ ID NO: 3556755 - RNA, 15 nt, Human
acaauaaaacauuau

SEQ ID NO: 3556756 - RNA, 13 nt, Human
acaauaaaagcuu

SEQ ID NO: 3556757 - RNA, 12 nt, Human
acaauaaaauau

SEQ ID NO: 3556758 - RNA, 21 nt, Human
acaauaaaauuuuuuuucaug

SEQ ID NO: 3556759 - RNA, 12 nt, Human
acaauaaagaga

SEQ ID NO: 3556760 - RNA, 14 nt, Human
acaauaaagagauu

SEQ ID NO: 3556761 - RNA, 23 nt, Human
acaauaaagaucgcccccaccuc

SEQ ID NO: 3556762 - RNA, 16 nt, Human
acaauaaauugcuaau

SEQ ID NO: 3556763 - RNA, 17 nt, Human
acaauaacuacuguguu

SEQ ID NO: 3556764 - RNA, 19 nt, Human
acaauaacuacuguguucc

SEQ ID NO: 3556765 - RNA, 20 nt, Human
acaauaacuacuguguuccu

SEQ ID NO: 3556766 - RNA, 18 nt, Human
acaauaauauuguuguau

SEQ ID NO: 3556767 - RNA, 14 nt, Human
acaauacaaaugga

SEQ ID NO: 3556768 - RNA, 15 nt, Human
acaauacaaauggau

SEQ ID NO: 3556769 - RNA, 14 nt, Human
acaauacagauaac

SEQ ID NO: 3556770 - RNA, 13 nt, Human
accggagagagaa

SEQ ID NO: 3556771 - RNA, 20 nt, Human
accggaggcaaaaggcagug

SEQ ID NO: 3556772 - RNA, 16 nt, Human
accggauccugggugg

SEQ ID NO: 3556773 - RNA, 17 nt, Human
accggcaauuuccggcc

SEQ ID NO: 3556774 - RNA, 17 nt, Human
accggccugccaggagg

SEQ ID NO: 3556775 - RNA, 11 nt, Human
accggcgcgcu

SEQ ID NO: 3556776 - RNA, 14 nt, Human
accggcgcgcucuu

SEQ ID NO: 3556777 - RNA, 14 nt, Human
accggcugcuuuuc

SEQ ID NO: 3556778 - RNA, 22 nt, Human
accggcuggcagggcuggcccc

SEQ ID NO: 3556779 - RNA, 19 nt, Human
accggcuggccuggccccu

SEQ ID NO: 3556780 - RNA, 19 nt, Human
accggcuuuaccaaaccgc

SEQ ID NO: 3556781 - RNA, 14 nt, Human
accgggcacucaga

SEQ ID NO: 3556782 - RNA, 19 nt, Human
accgggcacucagaagaca

SEQ ID NO: 3556783 - RNA, 15 nt, Human
accgggccacagaga

SEQ ID NO: 3556784 - RNA, 12 nt, Human
accgggccacuc

SEQ ID NO: 3556785 - RNA, 15 nt, Human
accgggcccuggguu

SEQ ID NO: 3556786 - RNA, 22 nt, Human
accggggagcccccgccccgcc

SEQ ID NO: 3556787 - RNA, 17 nt, Human
accgguccagcuggccu

SEQ ID NO: 3556788 - RNA, 16 nt, Human
accguaaagguuuauu

SEQ ID NO: 3556789 - RNA, 23 nt, Human
accgucauggcuuaauguuuauu

SEQ ID NO: 3556790 - RNA, 15 nt, Human
accguccccucccag

SEQ ID NO: 3556791 - RNA, 14 nt, Human
accguccgcccugc

SEQ ID NO: 3556792 - RNA, 15 nt, Human
accguccgcccugcu

SEQ ID NO: 3556793 - RNA, 12 nt, Human
accguccucacc

SEQ ID NO: 3556794 - RNA, 16 nt, Human
accgucgggggcugag

SEQ ID NO: 3556795 - RNA, 15 nt, Human
accgucuacauuuca

SEQ ID NO: 3556796 - RNA, 18 nt, Human
accguggaccuuccugcc

SEQ ID NO: 3556797 - RNA, 18 nt, Human
accguggaggaggaaggc

SEQ ID NO: 3556798 - RNA, 20 nt, Human
accguggcccugcccucucc

SEQ ID NO: 3556799 - RNA, 16 nt, Human
accguggcccuuccug

SEQ ID NO: 3556800 - RNA, 17 nt, Human
accguggcccuuccugg

SEQ ID NO: 3556801 - RNA, 18 nt, Human
accguggcccuuccugga

SEQ ID NO: 3556802 - RNA, 15 nt, Human
accgugggcggggcc

SEQ ID NO: 3556803 - RNA, 17 nt, Human
accgugggcggggccuu

SEQ ID NO: 3556804 - RNA, 20 nt, Human
accgugggcggggccuugcg

SEQ ID NO: 3556805 - RNA, 17 nt, Human
accgugguaugucugcc

SEQ ID NO: 3556806 - RNA, 16 nt, Human
accgggcacucagaag

SEQ ID NO: 3556807 - RNA, 19 nt, Human
accgggcccuggguuccuc

SEQ ID NO: 3556808 - RNA, 16 nt, Human
accgggccgcuagaug

SEQ ID NO: 3556809 - RNA, 18 nt, Human
accggguuccagcaccac

SEQ ID NO: 3556810 - RNA, 15 nt, Human
accgguccagcuggc

SEQ ID NO: 3556811 - RNA, 18 nt, Human
accgguccagcuggccug

SEQ ID NO: 3556812 - RNA, 23 nt, Human
accgguccagcuggccuggacag

SEQ ID NO: 3556813 - RNA, 14 nt, Human
accgguggggcugg

SEQ ID NO: 3556814 - RNA, 15 nt, Human
accgguugcuucugg

SEQ ID NO: 3556815 - RNA, 16 nt, Human
accgguugcuucuggg

SEQ ID NO: 3556816 - RNA, 23 nt, Human
accguaaagguuuauuuuucugu

SEQ ID NO: 3556817 - RNA, 17 nt, Human
accguaauaauuauuau

SEQ ID NO: 3556818 - RNA, 22 nt, Human
accgucauggcuuaauguuuau

SEQ ID NO: 3556819 - RNA, 16 nt, Human
accguccgcccugcuc

SEQ ID NO: 3556820 - RNA, 13 nt, Human
accguccucaccc

SEQ ID NO: 3556821 - RNA, 15 nt, Human
accguccucaccccu

SEQ ID NO: 3556822 - RNA, 18 nt, Human
accguccucaccccuguc

SEQ ID NO: 3556823 - RNA, 16 nt, Human
accgucuacauuucac

SEQ ID NO: 3556824 - RNA, 20 nt, Human
accgugaagauacuuuguau

SEQ ID NO: 3556825 - RNA, 18 nt, Human
accgugagcgacaaagau

SEQ ID NO: 3556826 - RNA, 16 nt, Human
accgugaggccagaga

SEQ ID NO: 3556827 - RNA, 23 nt, Human
accgugaggccagagacacaagc

SEQ ID NO: 3556828 - RNA, 17 nt, Human
accguggaccuuccugc

SEQ ID NO: 3556829 - RNA, 15 nt, Human
accguggaggaggaa

SEQ ID NO: 3556830 - RNA, 16 nt, Human
accgugggcagggagc

SEQ ID NO: 3556831 - RNA, 14 nt, Human
accgugggcucccu

SEQ ID NO: 3556832 - RNA, 20 nt, Human
accgugguaugucugccaug

SEQ ID NO: 3556833 - RNA, 22 nt, Human
accguguuggucuguacugauu

SEQ ID NO: 3556834 - RNA, 14 nt, Human
accguucugugcac

SEQ ID NO: 3556835 - RNA, 18 nt, Human
accguuggggauugggga

SEQ ID NO: 3556836 - RNA, 15 nt, Human
accuaaaaaagauau

SEQ ID NO: 3556837 - RNA, 16 nt, Human
accuaaaaaagauaua

SEQ ID NO: 3556838 - RNA, 22 nt, Human
accuaaaaggaaaucucacccc

SEQ ID NO: 3556839 - RNA, 12 nt, Human
accuaaagaaaa

SEQ ID NO: 3556840 - RNA, 17 nt, Human
accuaaagaaaaacaaa

SEQ ID NO: 3556841 - RNA, 15 nt, Human
accuaaauggccuca

SEQ ID NO: 3556842 - RNA, 11 nt, Human
accuaacauuc

SEQ ID NO: 3556843 - RNA, 14 nt, Human
accuaaccagggcc

SEQ ID NO: 3556844 - RNA, 15 nt, Human
accuaaccccuuucc

SEQ ID NO: 3556845 - RNA, 15 nt, Human
accuaaccugugucu

SEQ ID NO: 3556846 - RNA, 18 nt, Human
accuaacucuucuuucau

SEQ ID NO: 3556847 - RNA, 12 nt, Human
accuaacuguau

SEQ ID NO: 3556848 - RNA, 15 nt, Human
accuaacuguaucuu

SEQ ID NO: 3556849 - RNA, 21 nt, Human
accuaagauuacaaaucagaa

SEQ ID NO: 3556850 - RNA, 13 nt, Human
accuaaguacugu

SEQ ID NO: 3556851 - RNA, 15 nt, Human
accuaagucucugug

SEQ ID NO: 3556852 - RNA, 18 nt, Human
accuaagucucugugaau

SEQ ID NO: 3556853 - RNA, 18 nt, Human
accuaagugacauuugua

SEQ ID NO: 3556854 - RNA, 15 nt, Human
accuaauccaggcag

SEQ ID NO: 3556855 - RNA, 21 nt, Human
accuaaugaaagugaugacau

SEQ ID NO: 3556856 - RNA, 22 nt, Human
accuaaugaaagugaugacaua

SEQ ID NO: 3556857 - RNA, 15 nt, Human
accuaauuaauauau

SEQ ID NO: 3556858 - RNA, 15 nt, Human
accuaauuaauuuca

SEQ ID NO: 3556859 - RNA, 19 nt, Human
accuaauuagagcagauga

SEQ ID NO: 3556860 - RNA, 21 nt, Human
accuaauucgaugaaggcugc

SEQ ID NO: 3556861 - RNA, 15 nt, Human
accuaauugcacaac

SEQ ID NO: 3556862 - RNA, 17 nt, Human
accuacaguguacaguc

SEQ ID NO: 3556863 - RNA, 13 nt, Human
accuacauguauu

SEQ ID NO: 3556864 - RNA, 14 nt, Human
accuacauguauuu

SEQ ID NO: 3556865 - RNA, 19 nt, Human
accuacauguuauucuagu

SEQ ID NO: 3556866 - RNA, 16 nt, Human
accuaccacagugucu

SEQ ID NO: 3556867 - RNA, 19 nt, Human
accuaccacagugucugua

SEQ ID NO: 3556868 - RNA, 15 nt, Human
accuaccacaugcca

SEQ ID NO: 3556869 - RNA, 15 nt, Human
accuaccacuacauu

SEQ ID NO: 3556870 - RNA, 20 nt, Human
accuaccacucacaugacac

SEQ ID NO: 3556871 - RNA, 14 nt, Human
accuaccucagguu

SEQ ID NO: 3556872 - RNA, 13 nt, Human
accuaccucccac

SEQ ID NO: 3556873 - RNA, 18 nt, Human
accuaccuucauuucagg

SEQ ID NO: 3556874 - RNA, 14 nt, Human
accuacucacacag

SEQ ID NO: 3556875 - RNA, 17 nt, Human
accuacucacacaggca

SEQ ID NO: 3556876 - RNA, 23 nt, Human
accuacugcccaggcacugcaaa

SEQ ID NO: 3556877 - RNA, 15 nt, Human
accuacuguucuaaa

SEQ ID NO: 3556878 - RNA, 23 nt, Human
accuacuguucuaaagcucugac

SEQ ID NO: 3556879 - RNA, 17 nt, Human
accuagagaagauaauu

SEQ ID NO: 3556880 - RNA, 21 nt, Human
accuagcgggauggggcuccc

SEQ ID NO: 3556881 - RNA, 18 nt, Human
accuagcugaauguuuuu

SEQ ID NO: 3556882 - RNA, 20 nt, Human
accuagcugaauguuuuucu

SEQ ID NO: 3556883 - RNA, 21 nt, Human
accuagcugaauguuuuucua

SEQ ID NO: 3556884 - RNA, 17 nt, Human
accuaggaagccucaga

SEQ ID NO: 3556885 - RNA, 22 nt, Human
accuaggaagccucagauuccu

SEQ ID NO: 3556886 - RNA, 19 nt, Human
accuaggcaguaggccggu

SEQ ID NO: 3556887 - RNA, 20 nt, Human
accuaggcucauggacgaga

SEQ ID NO: 3556888 - RNA, 17 nt, Human
accuagggaggaccuua

SEQ ID NO: 3556889 - RNA, 15 nt, Human
accuaggggcgccgc

SEQ ID NO: 3556890 - RNA, 15 nt, Human
accuaggucuccagu

SEQ ID NO: 3556891 - RNA, 13 nt, Human
accuagugaaacu

SEQ ID NO: 3556892 - RNA, 19 nt, Human
accuagugaaacuuuucua

SEQ ID NO: 3556893 - RNA, 20 nt, Human
accuagugaaacuuuucuag

SEQ ID NO: 3556894 - RNA, 16 nt, Human
accuaguggcugucca

SEQ ID NO: 3556895 - RNA, 23 nt, Human
accuaguggcuguccagugccca

SEQ ID NO: 3556896 - RNA, 22 nt, Human
accuaguuaaagaaaggaaaag

SEQ ID NO: 3556897 - RNA, 15 nt, Human
accuauaaaacaggu

SEQ ID NO: 3556898 - RNA, 18 nt, Human
accuauaccuguguuucu

SEQ ID NO: 3556899 - RNA, 22 nt, Human
accuauauaauaaagcuacuga

SEQ ID NO: 3556900 - RNA, 17 nt, Human
accuaucccaccuccau

SEQ ID NO: 3556901 - RNA, 15 nt, Human
accuauccucacugc

SEQ ID NO: 3556902 - RNA, 17 nt, Human
accuaucucgugggaga

SEQ ID NO: 3556903 - RNA, 14 nt, Human
accuaugaagcaau

SEQ ID NO: 3556904 - RNA, 22 nt, Human
accuaugucauuucauuuccua

SEQ ID NO: 3556905 - RNA, 19 nt, Human
accuauguccuaaggacac

SEQ ID NO: 3556906 - RNA, 22 nt, Human
accuauguccuaaggacacacu

SEQ ID NO: 3556907 - RNA, 12 nt, Human
accuauuuccau

SEQ ID NO: 3556908 - RNA, 11 nt, Human
accuauuucuc

SEQ ID NO: 3556909 - RNA, 16 nt, Human
accuauuuuagacaaa

SEQ ID NO: 3556910 - RNA, 16 nt, Human
accucaaaaugucuaa

SEQ ID NO: 3556911 - RNA, 16 nt, Human
accucaaacuaucugg

SEQ ID NO: 3556912 - RNA, 20 nt, Human
accucaaaugaugugccugc

SEQ ID NO: 3556913 - RNA, 12 nt, Human
accucaaauuua

SEQ ID NO: 3556914 - RNA, 17 nt, Human
accucaacaagaagaau

SEQ ID NO: 3556915 - RNA, 19 nt, Human
accucaacccccauuucua

SEQ ID NO: 3556916 - RNA, 17 nt, Human
accucaaccuguaaauu

SEQ ID NO: 3556917 - RNA, 16 nt, Human
accucaaccugugaug

SEQ ID NO: 3556918 - RNA, 22 nt, Human
accucaacugccuacuccaaaa

SEQ ID NO: 3556919 - RNA, 10 nt, Human
accucaaggg

SEQ ID NO: 3556920 - RNA, 15 nt, Human
accucaagggggacu

SEQ ID NO: 3556921 - RNA, 19 nt, Human
accucaaguuuuuguuuug

SEQ ID NO: 3556922 - RNA, 19 nt, Human
accucaaucagucucagaa

SEQ ID NO: 3556923 - RNA, 13 nt, Human
accucaauguccc

SEQ ID NO: 3556924 - RNA, 14 nt, Human
accucaauguuuga

SEQ ID NO: 3556925 - RNA, 18 nt, Human
accucaauuuucacugug

SEQ ID NO: 3556926 - RNA, 18 nt, Human
accucacagaaaugagau

SEQ ID NO: 3556927 - RNA, 19 nt, Human
accucacagugacccuucc

SEQ ID NO: 3556928 - RNA, 15 nt, Human
accucaccaacuccu

SEQ ID NO: 3556929 - RNA, 16 nt, Human
accucaccaacuccua

SEQ ID NO: 3556930 - RNA, 17 nt, Human
accucaccaagcugcug

SEQ ID NO: 3556931 - RNA, 19 nt, Human
accucaccccgaggcccug

SEQ ID NO: 3556932 - RNA, 20 nt, Human
accucaccccgaggcccugc

SEQ ID NO: 3556933 - RNA, 12 nt, Human
accucacccugc

SEQ ID NO: 3556934 - RNA, 15 nt, Human
accucaccuagaaau

SEQ ID NO: 3556935 - RNA, 15 nt, Human
accucacgcaccucc

SEQ ID NO: 3556936 - RNA, 18 nt, Human
accucacgcaccucccau

SEQ ID NO: 3556937 - RNA, 19 nt, Human
accucacgcaccucccauc

SEQ ID NO: 3556938 - RNA, 17 nt, Human
accucacucagcaccac

SEQ ID NO: 3556939 - RNA, 13 nt, Human
accucacuccugu

SEQ ID NO: 3556940 - RNA, 15 nt, Human
accucacucugcuac

SEQ ID NO: 3556941 - RNA, 16 nt, Human
accucacucugcuacc

SEQ ID NO: 3556942 - RNA, 24 nt, Human
accucacucugcuaccuugcccca

SEQ ID NO: 3556943 - RNA, 14 nt, Human
accucacucuuuau

SEQ ID NO: 3556944 - RNA, 13 nt, Human
accucagaaguaa

SEQ ID NO: 3556945 - RNA, 22 nt, Human
accucagacuuaccaggaagca

SEQ ID NO: 3556946 - RNA, 15 nt, Human
accucagagccccgc

SEQ ID NO: 3556947 - RNA, 17 nt, Human
accucagaguccaggcc

SEQ ID NO: 3556948 - RNA, 14 nt, Human
accucagauggcag

SEQ ID NO: 3556949 - RNA, 16 nt, Human
accucagauggcagcu

SEQ ID NO: 3556950 - RNA, 20 nt, Human
accucagauggcagcuuuua

SEQ ID NO: 3556951 - RNA, 14 nt, Human
accucagccaugag

SEQ ID NO: 3556952 - RNA, 18 nt, Human
acacuucagagagcuggu

SEQ ID NO: 3556953 - RNA, 20 nt, Human
acacuucagagagcugguag

SEQ ID NO: 3556954 - RNA, 22 nt, Human
acacuucaggcucuucuccuuu

SEQ ID NO: 3556955 - RNA, 15 nt, Human
acacuuccaccagcc

SEQ ID NO: 3556956 - RNA, 17 nt, Human
acacuuccaccagccug

SEQ ID NO: 3556957 - RNA, 19 nt, Human
acacuuccaccagccugca

SEQ ID NO: 3556958 - RNA, 15 nt, Human
acacuucccucuguu

SEQ ID NO: 3556959 - RNA, 14 nt, Human
acacuucucaggac

SEQ ID NO: 3556960 - RNA, 16 nt, Human
acacuucucaggacac

SEQ ID NO: 3556961 - RNA, 20 nt, Human
acacuucucaggacacaggc

SEQ ID NO: 3556962 - RNA, 23 nt, Human
acacuucugugagacccccacac

SEQ ID NO: 3556963 - RNA, 14 nt, Human
acacuugaaaccuu

SEQ ID NO: 3556964 - RNA, 18 nt, Human
acacuugaaccugggagg

SEQ ID NO: 3556965 - RNA, 18 nt, Human
acacuugagaggaugaau

SEQ ID NO: 3556966 - RNA, 13 nt, Human
acacuugcaaccu

SEQ ID NO: 3556967 - RNA, 17 nt, Human
acacuugcccugcuccc

SEQ ID NO: 3556968 - RNA, 20 nt, Human
acacuugcccugcucccucu

SEQ ID NO: 3556969 - RNA, 18 nt, Human
acacuugccuucuucacc

SEQ ID NO: 3556970 - RNA, 15 nt, Human
acacuuggugcuggg

SEQ ID NO: 3556971 - RNA, 20 nt, Human
acacuugguuggguccucac

SEQ ID NO: 3556972 - RNA, 13 nt, Human
acacuugugaaua

SEQ ID NO: 3556973 - RNA, 22 nt, Human
acacuugugugugggcugugag

SEQ ID NO: 3556974 - RNA, 20 nt, Human
acacuuguuccagcucuuug

SEQ ID NO: 3556975 - RNA, 20 nt, Human
acacuuguugauuaauggaa

SEQ ID NO: 3556976 - RNA, 23 nt, Human
acacuuguugauuaauggaaaug

SEQ ID NO: 3556977 - RNA, 13 nt, Human
acacuuuaauggg

SEQ ID NO: 3556978 - RNA, 22 nt, Human
acacuuuaauuaccaaccuguu

SEQ ID NO: 3556979 - RNA, 17 nt, Human
acacuuugaaauguguu

SEQ ID NO: 3556980 - RNA, 23 nt, Human
acacuuugaaauguguuucugua

SEQ ID NO: 3556981 - RNA, 17 nt, Human
acacuuugcacugauau

SEQ ID NO: 3556982 - RNA, 19 nt, Human
acacuuugcacugauauau

SEQ ID NO: 3556983 - RNA, 19 nt, Human
acacuuugccuccugugua

SEQ ID NO: 3556984 - RNA, 22 nt, Human
acacuuuggaaguuuguguucu

SEQ ID NO: 3556985 - RNA, 15 nt, Human
acacuuuucaccucc

SEQ ID NO: 3556986 - RNA, 17 nt, Human
acacuuuucauaucauu

SEQ ID NO: 3556987 - RNA, 18 nt, Human
acacuuuucauaucauuu

SEQ ID NO: 3556988 - RNA, 14 nt, Human
accuucaaagcuga

SEQ ID NO: 3556989 - RNA, 12 nt, Human
accuucaagcug

SEQ ID NO: 3556990 - RNA, 14 nt, Human
accuucaagcugcu

SEQ ID NO: 3556991 - RNA, 20 nt, Human
accuucaagcugcuuuuugu

SEQ ID NO: 3556992 - RNA, 20 nt, Human
accuucaauaaaguaucuac

SEQ ID NO: 3556993 - RNA, 18 nt, Human
accuucaauuccugggcc

SEQ ID NO: 3556994 - RNA, 19 nt, Human
accuucacucuaagauguu

SEQ ID NO: 3556995 - RNA, 20 nt, Human
accuucacucuaagauguua

SEQ ID NO: 3556996 - RNA, 21 nt, Human
accuucacucuaagauguuau

SEQ ID NO: 3556997 - RNA, 22 nt, Human
accuucacugugaccuugagaa

SEQ ID NO: 3556998 - RNA, 17 nt, Human
accuucagauccuaccc

SEQ ID NO: 3556999 - RNA, 22 nt, Human
accuucaguaacccccacugga

SEQ ID NO: 3557000 - RNA, 19 nt, Human
accuucaguuaugauuuuu

SEQ ID NO: 3557001 - RNA, 15 nt, Human
accuucauuuaaaaa

SEQ ID NO: 3557002 - RNA, 22 nt, Human
accuucauuucauguauaguuu

SEQ ID NO: 3557003 - RNA, 15 nt, Human
accuucauuuugagg

SEQ ID NO: 3557004 - RNA, 16 nt, Human
accuuccaagagccug

SEQ ID NO: 3557005 - RNA, 15 nt, Human
accuuccagaaauac

SEQ ID NO: 3557006 - RNA, 22 nt, Human
accuucccaaacgccuccccug

SEQ ID NO: 3557007 - RNA, 12 nt, Human
accuucccagcu

SEQ ID NO: 3557008 - RNA, 20 nt, Human
accuucccccucccccagcc

SEQ ID NO: 3557009 - RNA, 19 nt, Human
accuucccucucaccaucc

SEQ ID NO: 3557010 - RNA, 14 nt, Human
accuucccuugcca

SEQ ID NO: 3557011 - RNA, 17 nt, Human
accuuccucacuuccau

SEQ ID NO: 3557012 - RNA, 15 nt, Human
accuuccucgcagag

SEQ ID NO: 3557013 - RNA, 16 nt, Human
accuuccucgcagaga

SEQ ID NO: 3557014 - RNA, 17 nt, Human
accuuccucgcagagag

SEQ ID NO: 3557015 - RNA, 15 nt, Human
accuuccucuggggc

SEQ ID NO: 3557016 - RNA, 11 nt, Human
accuuccugcc

SEQ ID NO: 3557017 - RNA, 18 nt, Human
accuuccugccaccaguc

SEQ ID NO: 3557018 - RNA, 19 nt, Human
accuuccuucccugggcug

SEQ ID NO: 3557019 - RNA, 15 nt, Human
accuucgccaccugg

SEQ ID NO: 3557020 - RNA, 15 nt, Human
accuucgggcugugc

SEQ ID NO: 3557021 - RNA, 17 nt, Human
accuucgggcugugccc

SEQ ID NO: 3557022 - RNA, 22 nt, Human
accuucguuuacuaugccugug

SEQ ID NO: 3557023 - RNA, 23 nt, Human
accuucguuuacuaugccugugu

SEQ ID NO: 3557024 - RNA, 17 nt, Human
accuucuauagcaucac

SEQ ID NO: 3557025 - RNA, 20 nt, Human
accuucuauagcaucacuua

SEQ ID NO: 3557026 - RNA, 14 nt, Human
accuucuccaaaug

SEQ ID NO: 3557027 - RNA, 18 nt, Human
accuucuccccagcuccc

SEQ ID NO: 3557028 - RNA, 23 nt, Human
accuucuccccagcucccaggac

SEQ ID NO: 3557029 - RNA, 17 nt, Human
accuucuccccauucug

SEQ ID NO: 3557030 - RNA, 16 nt, Human
accuucucuauaucau

SEQ ID NO: 3557031 - RNA, 15 nt, Human
accuucucuggagcc

SEQ ID NO: 3557032 - RNA, 17 nt, Human
accuucucuggagccaa

SEQ ID NO: 3557033 - RNA, 13 nt, Human
accuucugacuuu

SEQ ID NO: 3557034 - RNA, 19 nt, Human
accuucugccuuugauguu

SEQ ID NO: 3557035 - RNA, 13 nt, Human
accuucuguggcu

SEQ ID NO: 3557036 - RNA, 15 nt, Human
accuucuguggcuca

SEQ ID NO: 3557037 - RNA, 19 nt, Human
accuucuucagccaccucu

SEQ ID NO: 3557038 - RNA, 16 nt, Human
accuugaaaaaaaaca

SEQ ID NO: 3557039 - RNA, 18 nt, Human
accuugaacacuggggga

SEQ ID NO: 3557040 - RNA, 21 nt, Human
accuugaacacugggggaggg

SEQ ID NO: 3557041 - RNA, 15 nt, Human
accuugaacugaagg

SEQ ID NO: 3557042 - RNA, 13 nt, Human
accuugaaugcug

SEQ ID NO: 3557043 - RNA, 15 nt, Human
accuugaaugcugcc

SEQ ID NO: 3557044 - RNA, 18 nt, Human
accuugaaugcugccagu

SEQ ID NO: 3557045 - RNA, 16 nt, Human
accuugacagggcaca

SEQ ID NO: 3557046 - RNA, 18 nt, Human
accuugaccuuuguacag

SEQ ID NO: 3557047 - RNA, 11 nt, Human
accuugagguc

SEQ ID NO: 3557048 - RNA, 12 nt, Human
accuugccccaa

SEQ ID NO: 3557049 - RNA, 18 nt, Human
accuugccccaacccuuc

SEQ ID NO: 3557050 - RNA, 22 nt, Human
accuugccccaacccuucuuca

SEQ ID NO: 3557051 - RNA, 18 nt, Human
accuugccugaacauccu

SEQ ID NO: 3557052 - RNA, 24 nt, Human
accuugccugaacauccuuccuuc

SEQ ID NO: 3557053 - RNA, 18 nt, Human
accuugccugguacagua

SEQ ID NO: 3557054 - RNA, 22 nt, Human
accuugcugcaagcacagcccu

SEQ ID NO: 3557055 - RNA, 12 nt, Human
accuugcugucc

SEQ ID NO: 3557056 - RNA, 22 nt, Human
accuugcuucuuacugauaauu

SEQ ID NO: 3557057 - RNA, 18 nt, Human
accuuggacauccuccuc

SEQ ID NO: 3557058 - RNA, 15 nt, Human
accuuggccugggcc

SEQ ID NO: 3557059 - RNA, 14 nt, Human
accuuggcugcagg

SEQ ID NO: 3557060 - RNA, 18 nt, Human
accuuggcugcagggagu

SEQ ID NO: 3557061 - RNA, 21 nt, Human
accuuggcuuggcccuggcag

SEQ ID NO: 3557062 - RNA, 12 nt, Human
accuugggccaa

SEQ ID NO: 3557063 - RNA, 23 nt, Human
accuuggguuagaccuacagggg

SEQ ID NO: 3557064 - RNA, 19 nt, Human
accuuguauaaauuauuca

SEQ ID NO: 3557065 - RNA, 12 nt, Human
accuugugccug

SEQ ID NO: 3557066 - RNA, 16 nt, Human
accuugugccuggggu

SEQ ID NO: 3557067 - RNA, 13 nt, Human
accuugugucugu

SEQ ID NO: 3557068 - RNA, 15 nt, Human
accuugugucuguac

SEQ ID NO: 3557069 - RNA, 15 nt, Human
accuuguuacuucug

SEQ ID NO: 3557070 - RNA, 17 nt, Human
accuuguuauuucucag

SEQ ID NO: 3557071 - RNA, 14 nt, Human
accuuguucacacu

SEQ ID NO: 3557072 - RNA, 16 nt, Human
accuuguucacacucu

SEQ ID NO: 3557073 - RNA, 18 nt, Human
accuuguuguuguuaaau

SEQ ID NO: 3557074 - RNA, 15 nt, Human
accuuuaagagaaau

SEQ ID NO: 3557075 - RNA, 21 nt, Human
accuuuaaguagauaagcaga

SEQ ID NO: 3557076 - RNA, 18 nt, Human
accuuuaccccaucccug

SEQ ID NO: 3557077 - RNA, 21 nt, Human
accuuuagaaacucaaaaacu

SEQ ID NO: 3557078 - RNA, 15 nt, Human
accuuuagggcagcu

SEQ ID NO: 3557079 - RNA, 15 nt, Human
accuuuaugguuucu

SEQ ID NO: 3557080 - RNA, 14 nt, Human
accuuuauuaaaau

SEQ ID NO: 3557081 - RNA, 17 nt, Human
accuuuauuaaaaucuu

SEQ ID NO: 3557082 - RNA, 20 nt, Human
accuuuauuaaaaucuuaaa

SEQ ID NO: 3557083 - RNA, 17 nt, Human
accuuuauucuuuucca

SEQ ID NO: 3557084 - RNA, 22 nt, Human
accuuuauuggguaucaagaca

SEQ ID NO: 3557085 - RNA, 15 nt, Human
accuuucaaagccau

SEQ ID NO: 3557086 - RNA, 18 nt, Human
accuuucaaagccauuuu

SEQ ID NO: 3557087 - RNA, 18 nt, Human
accuuucauaaucuuugc

SEQ ID NO: 3557088 - RNA, 23 nt, Human
accuuuccaaaguuaacagauuu

SEQ ID NO: 3557089 - RNA, 18 nt, Human
accuuucccaucuuccaa

SEQ ID NO: 3557090 - RNA, 13 nt, Human
accuuucccucac

SEQ ID NO: 3557091 - RNA, 17 nt, Human
accuuucccucaccccc

SEQ ID NO: 3557092 - RNA, 20 nt, Human
accuuucuauaauuuuacaa

SEQ ID NO: 3557093 - RNA, 18 nt, Human
accuuugacaaagguaaa

SEQ ID NO: 3557094 - RNA, 17 nt, Human
accuuuggaaagcucug

SEQ ID NO: 3557095 - RNA, 18 nt, Human
accuuuguacagcccaga

SEQ ID NO: 3557096 - RNA, 21 nt, Human
acuagagucugaacagcugua

SEQ ID NO: 3557097 - RNA, 20 nt, Human
acuagaguuuagcuggaaaa

SEQ ID NO: 3557098 - RNA, 13 nt, Human
acuagaugaccuc

SEQ ID NO: 3557099 - RNA, 15 nt, Human
acuagaugaccucau

SEQ ID NO: 3557100 - RNA, 18 nt, Human
acuagaugaccucauuaa

SEQ ID NO: 3557101 - RNA, 15 nt, Human
acuagauggcgagca

SEQ ID NO: 3557102 - RNA, 12 nt, Human
acuagauguagu

SEQ ID NO: 3557103 - RNA, 13 nt, Human
acuagauguagua

SEQ ID NO: 3557104 - RNA, 16 nt, Human
acuagauguaguauuu

SEQ ID NO: 3557105 - RNA, 13 nt, Human
acuagauugacua

SEQ ID NO: 3557106 - RNA, 15 nt, Human
acuagauugugaucc

SEQ ID NO: 3557107 - RNA, 20 nt, Human
acuagauuuucacuuaugaa

SEQ ID NO: 3557108 - RNA, 18 nt, Human
acuagcaaaauaaaacau

SEQ ID NO: 3557109 - RNA, 14 nt, Human
acuagccaaaccag

SEQ ID NO: 3557110 - RNA, 17 nt, Human
acuagccaaaccucacc

SEQ ID NO: 3557111 - RNA, 19 nt, Human
acuagccaaaccucaccaa

SEQ ID NO: 3557112 - RNA, 22 nt, Human
acuagccaaaccucaccaacuc

SEQ ID NO: 3557113 - RNA, 21 nt, Human
acuagccaacggccccagcuu

SEQ ID NO: 3557114 - RNA, 16 nt, Human
acuagccaccaacucu

SEQ ID NO: 3557115 - RNA, 20 nt, Human
acuagccaggaaguacuucc

SEQ ID NO: 3557116 - RNA, 21 nt, Human
acuagccaugauaacugcaau

SEQ ID NO: 3557117 - RNA, 21 nt, Human
acuagccuaggucauaaagag

SEQ ID NO: 3557118 - RNA, 15 nt, Human
acuagccucuccagg

SEQ ID NO: 3557119 - RNA, 17 nt, Human
acuagccuuuggcucug

SEQ ID NO: 3557120 - RNA, 19 nt, Human
acuagcuaucuagguggag

SEQ ID NO: 3557121 - RNA, 13 nt, Human
acuagcucuuguu

SEQ ID NO: 3557122 - RNA, 17 nt, Human
acuagcuggaauuuuuu

SEQ ID NO: 3557123 - RNA, 19 nt, Human
acuagcuuacaugagaaca

SEQ ID NO: 3557124 - RNA, 15 nt, Human
acuaggaaaauugga

SEQ ID NO: 3557125 - RNA, 21 nt, Human
acuaggagcuuugacucagga

SEQ ID NO: 3557126 - RNA, 22 nt, Human
acuaggagcuuugacucaggag

SEQ ID NO: 3557127 - RNA, 23 nt, Human
acuaggagcuuugacucaggagc

SEQ ID NO: 3557128 - RNA, 20 nt, Human
acuaggcccccacuugccuc

SEQ ID NO: 3557129 - RNA, 14 nt, Human
acuaggcugagcaa

SEQ ID NO: 3557130 - RNA, 21 nt, Human
acuaggcugggugcccacagc

SEQ ID NO: 3557131 - RNA, 14 nt, Human
acuagggagccaug

SEQ ID NO: 3557132 - RNA, 19 nt, Human
acuagggagccauguuuca

SEQ ID NO: 3557133 - RNA, 17 nt, Human
acuaggggacaaagcaa

SEQ ID NO: 3557134 - RNA, 15 nt, Human
acuaggguccugggg

SEQ ID NO: 3557135 - RNA, 18 nt, Human
acuagguaacuucauauu

SEQ ID NO: 3557136 - RNA, 23 nt, Human
acuaguaccuucagauccuaccc

SEQ ID NO: 3557137 - RNA, 16 nt, Human
acuagugacagcuugu

SEQ ID NO: 3557138 - RNA, 19 nt, Human
acuagugaccccuucccug

SEQ ID NO: 3557139 - RNA, 13 nt, Human
acuagugcaaauc

SEQ ID NO: 3557140 - RNA, 14 nt, Human
acuagugcugaagc

SEQ ID NO: 3557141 - RNA, 17 nt, Human
acuagugcugaagcuua

SEQ ID NO: 3557142 - RNA, 20 nt, Human
acuagugggguuuccuggca

SEQ ID NO: 3557143 - RNA, 15 nt, Human
acuaguguugcuugg

SEQ ID NO: 3557144 - RNA, 15 nt, Human
acuaguuacacaucu

SEQ ID NO: 3557145 - RNA, 20 nt, Human
acuaguugugaccuuagugu

SEQ ID NO: 3557146 - RNA, 20 nt, Human
acuaguugugucuggcaguu

SEQ ID NO: 3557147 - RNA, 19 nt, Human
acuaguuuaguuaaaugag

SEQ ID NO: 3557148 - RNA, 21 nt, Human
acuaguuuuuccuaucauguu

SEQ ID NO: 3557149 - RNA, 14 nt, Human
acuauaaaacaaaa

SEQ ID NO: 3557150 - RNA, 18 nt, Human
acuauaaaaugucuucaa

SEQ ID NO: 3557151 - RNA, 23 nt, Human
acuauaacauagaauugcaaucu

SEQ ID NO: 3557152 - RNA, 11 nt, Human
acuauaaugua

SEQ ID NO: 3557153 - RNA, 15 nt, Human
acuauacuugaacaa

SEQ ID NO: 3557154 - RNA, 16 nt, Human
acuauagcaaaguagu

SEQ ID NO: 3557155 - RNA, 14 nt, Human
acuauagcccaggu

SEQ ID NO: 3557156 - RNA, 17 nt, Human
acuauagccuaggugac

SEQ ID NO: 3557157 - RNA, 18 nt, Human
acuauagccuaggugaca

SEQ ID NO: 3557158 - RNA, 20 nt, Human
acuauagccuaggugacaga

SEQ ID NO: 3557159 - RNA, 18 nt, Human
acuauagcggcauauaga

SEQ ID NO: 3557160 - RNA, 21 nt, Human
acuauauaauuuauuuccacu

SEQ ID NO: 3557161 - RNA, 15 nt, Human
acuauauacaugugu

SEQ ID NO: 3557162 - RNA, 16 nt, Human
acuauauacaugugug

SEQ ID NO: 3557163 - RNA, 17 nt, Human
acuauauacaugugugu

SEQ ID NO: 3557164 - RNA, 18 nt, Human
acuauauacaugugugua

SEQ ID NO: 3557165 - RNA, 21 nt, Human
acuauauacauguguguauau

SEQ ID NO: 3557166 - RNA, 20 nt, Human
acuauauauauaaauguaua

SEQ ID NO: 3557167 - RNA, 14 nt, Human
acuauaucuguaua

SEQ ID NO: 3557168 - RNA, 18 nt, Human
acuauaucuguauauaaa

SEQ ID NO: 3557169 - RNA, 22 nt, Human
acuauaucuguauauaaaauau

SEQ ID NO: 3557170 - RNA, 16 nt, Human
acuauaucuguuuuac

SEQ ID NO: 3557171 - RNA, 14 nt, Human
acuauaugcaaaca

SEQ ID NO: 3557172 - RNA, 13 nt, Human
acuauauguaugg

SEQ ID NO: 3557173 - RNA, 19 nt, Human
acuauauugauuguccuuu

SEQ ID NO: 3557174 - RNA, 15 nt, Human
acuauauuguacaca

SEQ ID NO: 3557175 - RNA, 17 nt, Human
acuauauuguuugcuaa

SEQ ID NO: 3557176 - RNA, 14 nt, Human
acuaucaaacugaa

SEQ ID NO: 3557177 - RNA, 17 nt, Human
acuaucacugguuuggu

SEQ ID NO: 3557178 - RNA, 20 nt, Human
acuaucagcccaagaugcuu

SEQ ID NO: 3557179 - RNA, 17 nt, Human
acuauccaugcaccaaa

SEQ ID NO: 3557180 - RNA, 18 nt, Human
acuauccaugcaccaaac

SEQ ID NO: 3557181 - RNA, 15 nt, Human
acuauccugacuucu

SEQ ID NO: 3557182 - RNA, 16 nt, Human
acuaucuaaauguuga

SEQ ID NO: 3557183 - RNA, 21 nt, Human
acuaucuaaauguugaaagau

SEQ ID NO: 3557184 - RNA, 15 nt, Human
acuaucuacucuccu

SEQ ID NO: 3557185 - RNA, 13 nt, Human
acuaucucagaga

SEQ ID NO: 3557186 - RNA, 12 nt, Human
acuaucugcuuu

SEQ ID NO: 3557187 - RNA, 17 nt, Human
acuaucugucugguggc

SEQ ID NO: 3557188 - RNA, 22 nt, Human
acuaucuuaucucagauauuug

SEQ ID NO: 3557189 - RNA, 20 nt, Human
acuaugaaaagcuagaauug

SEQ ID NO: 3557190 - RNA, 21 nt, Human
acuaugaaaagcuagaauuga

SEQ ID NO: 3557191 - RNA, 18 nt, Human
acuaugaaaaugcuggcu

SEQ ID NO: 3557192 - RNA, 22 nt, Human
acuaugaaguuuuuuuuauaca

SEQ ID NO: 3557193 - RNA, 15 nt, Human
acaggagguuggagg

SEQ ID NO: 3557194 - RNA, 21 nt, Human
acaggaugaggugguggagug

SEQ ID NO: 3557195 - RNA, 16 nt, Human
acaggauggucucugc

SEQ ID NO: 3557196 - RNA, 22 nt, Human
acaggaugguucccuugaugaa

SEQ ID NO: 3557197 - RNA, 22 nt, Human
acaggauguguuugcuuucuga

SEQ ID NO: 3557198 - RNA, 14 nt, Human
acaggauuauugga

SEQ ID NO: 3557199 - RNA, 20 nt, Human
acaggauuugaacucagauc

SEQ ID NO: 3557200 - RNA, 19 nt, Human
acaggcaaaauccuugcuu

SEQ ID NO: 3557201 - RNA, 16 nt, Human
acaggcaacugaggca

SEQ ID NO: 3557202 - RNA, 14 nt, Human
acaggcaaugcugg

SEQ ID NO: 3557203 - RNA, 16 nt, Human
acaggcaaugcuggcu

SEQ ID NO: 3557204 - RNA, 17 nt, Human
acaggcaaugcuggcug

SEQ ID NO: 3557205 - RNA, 13 nt, Human
acaggcaauuccg

SEQ ID NO: 3557206 - RNA, 13 nt, Human
acaggcacuuggc

SEQ ID NO: 3557207 - RNA, 13 nt, Human
acaggcagcagag

SEQ ID NO: 3557208 - RNA, 15 nt, Human
acaggcagccagugc

SEQ ID NO: 3557209 - RNA, 19 nt, Human
acaggcagccagugcccug

SEQ ID NO: 3557210 - RNA, 23 nt, Human
acaggcagggcaggaccagccca

SEQ ID NO: 3557211 - RNA, 18 nt, Human
acaggcagucucucucuu

SEQ ID NO: 3557212 - RNA, 21 nt, Human
acaggcauaaaauagaguaaa

SEQ ID NO: 3557213 - RNA, 22 nt, Human
acaggcaugggugcaaggaaaa

SEQ ID NO: 3557214 - RNA, 19 nt, Human
acaggcaugugucaccaug

SEQ ID NO: 3557215 - RNA, 14 nt, Human
acaggcauguucuc

SEQ ID NO: 3557216 - RNA, 19 nt, Human
acaggcauguucucugagg

SEQ ID NO: 3557217 - RNA, 22 nt, Human
acaggcauguucucugaggaca

SEQ ID NO: 3557218 - RNA, 20 nt, Human
acaggcauuuccuggguggc

SEQ ID NO: 3557219 - RNA, 19 nt, Human
acaggccauugugaaccaa

SEQ ID NO: 3557220 - RNA, 22 nt, Human
acaggcccaagagaugaagagu

SEQ ID NO: 3557221 - RNA, 11 nt, Human
acaggcccagc

SEQ ID NO: 3557222 - RNA, 18 nt, Human
acaggcccagcauugcug

SEQ ID NO: 3557223 - RNA, 23 nt, Human
acaggcccagcauugcugguucu

SEQ ID NO: 3557224 - RNA, 12 nt, Human
acaggcccccuu

SEQ ID NO: 3557225 - RNA, 18 nt, Human
acaggcccggcuccaggc

SEQ ID NO: 3557226 - RNA, 21 nt, Human
acaggcccggcuccaggcucc

SEQ ID NO: 3557227 - RNA, 22 nt, Human
acaggcccucccuguuccccag

SEQ ID NO: 3557228 - RNA, 19 nt, Human
acaggcccugcuccugcag

SEQ ID NO: 3557229 - RNA, 20 nt, Human
acaggcccugcuccugcagc

SEQ ID NO: 3557230 - RNA, 13 nt, Human
acaggcccuuccu

SEQ ID NO: 3557231 - RNA, 19 nt, Human
acaggcccuuuccucaggc

SEQ ID NO: 3557232 - RNA, 16 nt, Human
acaggccgcccugcgg

SEQ ID NO: 3557233 - RNA, 14 nt, Human
acaggccucaccuc

SEQ ID NO: 3557234 - RNA, 15 nt, Human
acaggccucaccucu

SEQ ID NO: 3557235 - RNA, 20 nt, Human
acaggccucaccucuaccca

SEQ ID NO: 3557236 - RNA, 21 nt, Human
acaggccucaccucuacccaa

SEQ ID NO: 3557237 - RNA, 16 nt, Human
acaggccucccuguuu

SEQ ID NO: 3557238 - RNA, 15 nt, Human
acaggccugagauuu

SEQ ID NO: 3557239 - RNA, 13 nt, Human
acaggcgagagag

SEQ ID NO: 3557240 - RNA, 18 nt, Human
acuaagccuaccugcucu

SEQ ID NO: 3557241 - RNA, 19 nt, Human
acuaagccuaccugcucuc

SEQ ID NO: 3557242 - RNA, 20 nt, Human
acuaagcuuugccagcugcu

SEQ ID NO: 3557243 - RNA, 22 nt, Human
acuaaggggcccggccagccau

SEQ ID NO: 3557244 - RNA, 18 nt, Human
acuaagucucuuuuuuac

SEQ ID NO: 3557245 - RNA, 17 nt, Human
acuaaguuauaguauau

SEQ ID NO: 3557246 - RNA, 22 nt, Human
acuaauaaaagcauaaaugcaa

SEQ ID NO: 3557247 - RNA, 13 nt, Human
acuaauaaaauau

SEQ ID NO: 3557248 - RNA, 22 nt, Human
acuaauaaaauauuuucugugu

SEQ ID NO: 3557249 - RNA, 23 nt, Human
acuaauaaaauauuuucugugug

SEQ ID NO: 3557250 - RNA, 17 nt, Human
acuaauacagcugagcu

SEQ ID NO: 3557251 - RNA, 16 nt, Human
acuaauagaaaaguau

SEQ ID NO: 3557252 - RNA, 16 nt, Human
acuaauagaauaaagg

SEQ ID NO: 3557253 - RNA, 18 nt, Human
acuaauauauuuaaaaau

SEQ ID NO: 3557254 - RNA, 19 nt, Human
acuaaucgaacuaugaacu

SEQ ID NO: 3557255 - RNA, 22 nt, Human
acuaaucuauuggguucauuau

SEQ ID NO: 3557256 - RNA, 19 nt, Human
acuaaucugggaagggaag

SEQ ID NO: 3557257 - RNA, 14 nt, Human
acuaaucuuucugc

SEQ ID NO: 3557258 - RNA, 24 nt, Human
acuaaugccuuacucuucuugaaa

SEQ ID NO: 3557259 - RNA, 15 nt, Human
acuaauguaaaauga

SEQ ID NO: 3557260 - RNA, 21 nt, Human
acuaauuauacuacuuuguua

SEQ ID NO: 3557261 - RNA, 23 nt, Human
acuaauuccacaccuuuuauuga

SEQ ID NO: 3557262 - RNA, 14 nt, Human
acuaauucuugcau

SEQ ID NO: 3557263 - RNA, 22 nt, Human
acuaauucuugcauauuuugua

SEQ ID NO: 3557264 - RNA, 20 nt, Human
acuaauuggccucuuuaaga

SEQ ID NO: 3557265 - RNA, 15 nt, Human
acuaauuguauaaca

SEQ ID NO: 3557266 - RNA, 16 nt, Human
acuaauuguauaacag

SEQ ID NO: 3557267 - RNA, 18 nt, Human
acuaauuguauaacaggu

SEQ ID NO: 3557268 - RNA, 20 nt, Human
acuaauuguauaacagguua

SEQ ID NO: 3557269 - RNA, 14 nt, Human
acuaauuucaaaau

SEQ ID NO: 3557270 - RNA, 12 nt, Human
acuaauuucuuc

SEQ ID NO: 3557271 - RNA, 15 nt, Human
acuaauuuuacaugu

SEQ ID NO: 3557272 - RNA, 15 nt, Human
acuaauuuuacuucu

SEQ ID NO: 3557273 - RNA, 23 nt, Human
acuaauuuugcaugcguauuuau

SEQ ID NO: 3557274 - RNA, 15 nt, Human
acuaauuuuuauuuu

SEQ ID NO: 3557275 - RNA, 16 nt, Human
acuacaaaauuugaaa

SEQ ID NO: 3557276 - RNA, 18 nt, Human
acuacaaacaaaauuucu

SEQ ID NO: 3557277 - RNA, 20 nt, Human
acuacaaacaaaauuucuau

SEQ ID NO: 3557278 - RNA, 19 nt, Human
acuacaaagguuuaaauga

SEQ ID NO: 3557279 - RNA, 19 nt, Human
acuacaaaucaaguauuug

SEQ ID NO: 3557280 - RNA, 19 nt, Human
acuacaaccaagcucucug

SEQ ID NO: 3557281 - RNA, 13 nt, Human
acuacaauaugua

SEQ ID NO: 3557282 - RNA, 21 nt, Human
acuacacauauguauuccuga

SEQ ID NO: 3557283 - RNA, 23 nt, Human
acuacacaucccuaaugugugcc

SEQ ID NO: 3557284 - RNA, 16 nt, Human
acuacacauuuuuaaa

SEQ ID NO: 3557285 - RNA, 20 nt, Human
acuacacauuuuuaaauugu

SEQ ID NO: 3557286 - RNA, 23 nt, Human
acuacaccacacacaacagccaa

SEQ ID NO: 3557287 - RNA, 21 nt, Human
acuacaccuugccuugcuguu

SEQ ID NO: 3557288 - RNA, 20 nt, Human
acuacacuccagccugagca

SEQ ID NO: 3557289 - RNA, 16 nt, Human
acuacacugaggagag

SEQ ID NO: 3557290 - RNA, 14 nt, Human
acuacagaaaugag

SEQ ID NO: 3557291 - RNA, 23 nt, Human
acuacagaaaugaggaggaugcu

SEQ ID NO: 3557292 - RNA, 17 nt, Human
acuacagaccugcuuuu

SEQ ID NO: 3557293 - RNA, 19 nt, Human
acuacagaccugcuuuuug

SEQ ID NO: 3557294 - RNA, 17 nt, Human
acuacagcuaugaagaa

SEQ ID NO: 3557295 - RNA, 18 nt, Human
acuacagcuaugaagaaa

SEQ ID NO: 3557296 - RNA, 19 nt, Human
acuacagcucuuaaaugua

SEQ ID NO: 3557297 - RNA, 20 nt, Human
acuacaggcacacaccacca

SEQ ID NO: 3557298 - RNA, 15 nt, Human
acuacagucaggaaa

SEQ ID NO: 3557299 - RNA, 15 nt, Human
acuacaguccuccca

SEQ ID NO: 3557300 - RNA, 14 nt, Human
acuacaguuuguua

SEQ ID NO: 3557301 - RNA, 23 nt, Human
acuacauaaacugacuuuauccu

SEQ ID NO: 3557302 - RNA, 18 nt, Human
acuacaucuuuaaacagu

SEQ ID NO: 3557303 - RNA, 20 nt, Human
acuacaugagaacaaacaga

SEQ ID NO: 3557304 - RNA, 15 nt, Human
acuacaugugguuua

SEQ ID NO: 3557305 - RNA, 11 nt, Human
acuacauucug

SEQ ID NO: 3557306 - RNA, 14 nt, Human
acuacauucuguua

SEQ ID NO: 3557307 - RNA, 11 nt, Human
acuacauuuau

SEQ ID NO: 3557308 - RNA, 12 nt, Human
acuacauuuuaa

SEQ ID NO: 3557309 - RNA, 14 nt, Human
acuacauuuuaaca

SEQ ID NO: 3557310 - RNA, 16 nt, Human
acuacauuuuaacaug

SEQ ID NO: 3557311 - RNA, 23 nt, Human
acuacccacguucucacacccac

SEQ ID NO: 3557312 - RNA, 19 nt, Human
acuacccagguuaagaaaa

SEQ ID NO: 3557313 - RNA, 21 nt, Human
acuaccccuugauuuuccauc

SEQ ID NO: 3557314 - RNA, 16 nt, Human
acuaccgaaugugucu

SEQ ID NO: 3557315 - RNA, 17 nt, Human
acuaccuccucagggau

SEQ ID NO: 3557316 - RNA, 12 nt, Human
acuaccuggcug

SEQ ID NO: 3557317 - RNA, 18 nt, Human
acuaccuguauuuaaaaa

SEQ ID NO: 3557318 - RNA, 19 nt, Human
acuaccuuuggcuuaauuc

SEQ ID NO: 3557319 - RNA, 14 nt, Human
acuacuagauugac

SEQ ID NO: 3557320 - RNA, 21 nt, Human
acuacuaguuuuuacuuuuau

SEQ ID NO: 3557321 - RNA, 15 nt, Human
acuacucagggaaug

SEQ ID NO: 3557322 - RNA, 17 nt, Human
acuacucccccaggugg

SEQ ID NO: 3557323 - RNA, 20 nt, Human
acuacuccggagacaggguu

SEQ ID NO: 3557324 - RNA, 19 nt, Human
acuacugaccagacaagcu

SEQ ID NO: 3557325 - RNA, 15 nt, Human
acuacugcaccauuu

SEQ ID NO: 3557326 - RNA, 12 nt, Human
acuacugcagca

SEQ ID NO: 3557327 - RNA, 18 nt, Human
acuacugggcaaagagug

SEQ ID NO: 3557328 - RNA, 12 nt, Human
acuacugggugu

SEQ ID NO: 3557329 - RNA, 14 nt, Human
acuacuggguguca

SEQ ID NO: 3557330 - RNA, 16 nt, Human
acuacuguguuaugca

SEQ ID NO: 3557331 - RNA, 13 nt, Human
acuacuguguucc

SEQ ID NO: 3557332 - RNA, 15 nt, Human
acuacuuaccauuug

SEQ ID NO: 3557333 - RNA, 21 nt, Human
acuacuuugccuucuuuugua

SEQ ID NO: 3557334 - RNA, 19 nt, Human
acuacuuuguuaggauuuu

SEQ ID NO: 3557335 - RNA, 14 nt, Human
acuagaaccuggag

SEQ ID NO: 3557336 - RNA, 15 nt, Human
acuagaacucuccau

SEQ ID NO: 3557337 - RNA, 16 nt, Human
acuagaacugaauuuu

SEQ ID NO: 3557338 - RNA, 17 nt, Human
acuagaacugaauuuug

SEQ ID NO: 3557339 - RNA, 18 nt, Human
acuagaacugaauuuugu

SEQ ID NO: 3557340 - RNA, 19 nt, Human
acuagaacugaauuuuguc

SEQ ID NO: 3557341 - RNA, 13 nt, Human
acuagaagaugaa

SEQ ID NO: 3557342 - RNA, 14 nt, Human
acuagaagggccag

SEQ ID NO: 3557343 - RNA, 18 nt, Human
acuagaauucuagugcug

SEQ ID NO: 3557344 - RNA, 13 nt, Human
acuagaauucugu

SEQ ID NO: 3557345 - RNA, 22 nt, Human
acuagaauuucauuuauuuugu

SEQ ID NO: 3557346 - RNA, 12 nt, Human
acuagacaagcc

SEQ ID NO: 3557347 - RNA, 13 nt, Human
acuagacacacaa

SEQ ID NO: 3557348 - RNA, 17 nt, Human
acuagacaccaaaguuc

SEQ ID NO: 3557349 - RNA, 15 nt, Human
acuagacauucuguc

SEQ ID NO: 3557350 - RNA, 20 nt, Human
acuagacauucugucgccuu

SEQ ID NO: 3557351 - RNA, 16 nt, Human
acuagacguucauuug

SEQ ID NO: 3557352 - RNA, 19 nt, Human
acuagacucuucacuguua

SEQ ID NO: 3557353 - RNA, 22 nt, Human
acuagacugguggcaggggcuu

SEQ ID NO: 3557354 - RNA, 12 nt, Human
acuagagaaugc

SEQ ID NO: 3557355 - RNA, 16 nt, Human
acuagagaaugcacag

SEQ ID NO: 3557356 - RNA, 19 nt, Human
acuagagauauuuuguaaa

SEQ ID NO: 3557357 - RNA, 14 nt, Human
acaguaagcugcuc

SEQ ID NO: 3557358 - RNA, 16 nt, Human
acaguaaguuccuacu

SEQ ID NO: 3557359 - RNA, 17 nt, Human
acaguaauuguguuuac

SEQ ID NO: 3557360 - RNA, 18 nt, Human
acaguaauuguguuuaca

SEQ ID NO: 3557361 - RNA, 21 nt, Human
acaguaauuguguuuacauuu

SEQ ID NO: 3557362 - RNA, 13 nt, Human
acaguacaggcag

SEQ ID NO: 3557363 - RNA, 16 nt, Human
acaguacaggcagcac

SEQ ID NO: 3557364 - RNA, 15 nt, Human
acaguaccaucugaa

SEQ ID NO: 3557365 - RNA, 14 nt, Human
acaguacuuugaau

SEQ ID NO: 3557366 - RNA, 18 nt, Human
acaguagaacugucugug

SEQ ID NO: 3557367 - RNA, 16 nt, Human
acaguagagccagcuu

SEQ ID NO: 3557368 - RNA, 18 nt, Human
acaguaggugacacuaua

SEQ ID NO: 3557369 - RNA, 17 nt, Human
acaguagugagaagaau

SEQ ID NO: 3557370 - RNA, 23 nt, Human
acaguaguuagaauuauaucacu

SEQ ID NO: 3557371 - RNA, 16 nt, Human
acaguauaaaaauaga

SEQ ID NO: 3557372 - RNA, 21 nt, Human
acaguauauuuuauuucaaug

SEQ ID NO: 3557373 - RNA, 23 nt, Human
acaguauauuuuauuucaaugua

SEQ ID NO: 3557374 - RNA, 21 nt, Human
acaguaucacugucuuuccua

SEQ ID NO: 3557375 - RNA, 23 nt, Human
acaguaucacugucuuuccuaga

SEQ ID NO: 3557376 - RNA, 23 nt, Human
acaguaugagucaaugugcagug

SEQ ID NO: 3557377 - RNA, 23 nt, Human
acaguauggggguuguaaauugg

SEQ ID NO: 3557378 - RNA, 22 nt, Human
acaguaugguaacuuugcaaau

SEQ ID NO: 3557379 - RNA, 17 nt, Human
acaguauuacuucugcu

SEQ ID NO: 3557380 - RNA, 20 nt, Human
acaguauuauacgcuggcaa

SEQ ID NO: 3557381 - RNA, 22 nt, Human
acaguauugcucacccagugcc

SEQ ID NO: 3557382 - RNA, 16 nt, Human
acaguauuuauuuugu

SEQ ID NO: 3557383 - RNA, 12 nt, Human
acaguauuucca

SEQ ID NO: 3557384 - RNA, 13 nt, Human
acuccucccuccg

SEQ ID NO: 3557385 - RNA, 13 nt, Human
acuccuccuagcc

SEQ ID NO: 3557386 - RNA, 16 nt, Human
acuccuccuagccacc

SEQ ID NO: 3557387 - RNA, 15 nt, Human
acuccuccucuuucu

SEQ ID NO: 3557388 - RNA, 18 nt, Human
acuccucgguacucccau

SEQ ID NO: 3557389 - RNA, 17 nt, Human
acuccucugcagugccu

SEQ ID NO: 3557390 - RNA, 20 nt, Human
acuccucugcagugccuugg

SEQ ID NO: 3557391 - RNA, 23 nt, Human
acuccucugcgucuauccugugu

SEQ ID NO: 3557392 - RNA, 21 nt, Human
acuccucugcugaccugcuga

SEQ ID NO: 3557393 - RNA, 16 nt, Human
acuccugaaaaaaaac

SEQ ID NO: 3557394 - RNA, 15 nt, Human
acuccugacagucuu

SEQ ID NO: 3557395 - RNA, 14 nt, Human
acuccugaccucag

SEQ ID NO: 3557396 - RNA, 17 nt, Human
acuccugaccucaggca

SEQ ID NO: 3557397 - RNA, 23 nt, Human
acuccugacgucugaagcuugac

SEQ ID NO: 3557398 - RNA, 11 nt, Human
acuccugacuc

SEQ ID NO: 3557399 - RNA, 23 nt, Human
acuccugagaccccuggccuccg

SEQ ID NO: 3557400 - RNA, 21 nt, Human
acuccugaggacagcuguccu

SEQ ID NO: 3557401 - RNA, 21 nt, Human
acuccugccccuguucucuuc

SEQ ID NO: 3557402 - RNA, 22 nt, Human
acuccugcccuguuguguauag

SEQ ID NO: 3557403 - RNA, 13 nt, Human
acaugacacugac

SEQ ID NO: 3557404 - RNA, 21 nt, Human
acaugacccuaaaucuugacu

SEQ ID NO: 3557405 - RNA, 19 nt, Human
acaugacgacaaagcugcu

SEQ ID NO: 3557406 - RNA, 15 nt, Human
acaugacucuuuauu

SEQ ID NO: 3557407 - RNA, 23 nt, Human
acaugacucuuuauugucuguaa

SEQ ID NO: 3557408 - RNA, 15 nt, Human
acaugagaacaaaca

SEQ ID NO: 3557409 - RNA, 23 nt, Human
acaugagauguguggacuguggc

SEQ ID NO: 3557410 - RNA, 19 nt, Human
acaugagcaucaggccagg

SEQ ID NO: 3557411 - RNA, 18 nt, Human
acaugaggacucuauucu

SEQ ID NO: 3557412 - RNA, 13 nt, Human
acaugaggccacu

SEQ ID NO: 3557413 - RNA, 16 nt, Human
acaugaggggacauuu

SEQ ID NO: 3557414 - RNA, 16 nt, Human
acaugagguacugaga

SEQ ID NO: 3557415 - RNA, 19 nt, Human
acaugaucuucuuuauaau

SEQ ID NO: 3557416 - RNA, 18 nt, Human
acaugaugcuuuuacuga

SEQ ID NO: 3557417 - RNA, 23 nt, Human
acaugaugcuuuuacugaacuuu

SEQ ID NO: 3557418 - RNA, 22 nt, Human
acaugauguuauguaccauaug

SEQ ID NO: 3557419 - RNA, 15 nt, Human
acaugauuucacaaa

SEQ ID NO: 3557420 - RNA, 18 nt, Human
acaugauuucacaaauau

SEQ ID NO: 3557421 - RNA, 20 nt, Human
acaugauuucacaaauauua

SEQ ID NO: 3557422 - RNA, 13 nt, Human
acaugauuuccuu

SEQ ID NO: 3557423 - RNA, 17 nt, Human
acaugauuuccuugaau

SEQ ID NO: 3557424 - RNA, 21 nt, Human
acaugcaaaaagaaaugacua

SEQ ID NO: 3557425 - RNA, 13 nt, Human
acaugcaauaaaa

SEQ ID NO: 3557426 - RNA, 14 nt, Human
acaugcaauaaaau

SEQ ID NO: 3557427 - RNA, 11 nt, Human
acaugcacaca

SEQ ID NO: 3557428 - RNA, 20 nt, Human
acaugcacagcuaacaugga

SEQ ID NO: 3557429 - RNA, 16 nt, Human
acaugcacuaugagga

SEQ ID NO: 3557430 - RNA, 13 nt, Human
acaugcacugacc

SEQ ID NO: 3557431 - RNA, 14 nt, Human
acaugcacugaccc

SEQ ID NO: 3557432 - RNA, 19 nt, Human
acaugcacugacccuucca

SEQ ID NO: 3557433 - RNA, 23 nt, Human
acaugcagccacuuaggacaaau

SEQ ID NO: 3557434 - RNA, 15 nt, Human
acaugcagcccaugc

SEQ ID NO: 3557435 - RNA, 17 nt, Human
acaugcagcccaugccc

SEQ ID NO: 3557436 - RNA, 18 nt, Human
acaugcagcccaugccca

SEQ ID NO: 3557437 - RNA, 23 nt, Human
acaugcagcugcacccucccucc

SEQ ID NO: 3557438 - RNA, 10 nt, Human
acaugcaguu

SEQ ID NO: 3557439 - RNA, 15 nt, Human
acaugcaguuugaaa

SEQ ID NO: 3557440 - RNA, 16 nt, Human
acaugcaguuugaaau

SEQ ID NO: 3557441 - RNA, 23 nt, Human
acaugcaguuugaaauucugaau

SEQ ID NO: 3557442 - RNA, 13 nt, Human
acaugcauacaca

SEQ ID NO: 3557443 - RNA, 15 nt, Human
acaugcauacacaca

SEQ ID NO: 3557444 - RNA, 16 nt, Human
acaugcauacauacac

SEQ ID NO: 3557445 - RNA, 17 nt, Human
acaugcauacuucaaaa

SEQ ID NO: 3557446 - RNA, 19 nt, Human
acaugcauacuucaaaagu

SEQ ID NO: 3557447 - RNA, 18 nt, Human
acaugcauauaaugaaua

SEQ ID NO: 3557448 - RNA, 19 nt, Human
acaugccacaucaaaccuu

SEQ ID NO: 3557449 - RNA, 20 nt, Human
acaugccagccacugugaua

SEQ ID NO: 3557450 - RNA, 17 nt, Human
acaugccauuuguacug

SEQ ID NO: 3557451 - RNA, 12 nt, Human
acaugcccccug

SEQ ID NO: 3557452 - RNA, 23 nt, Human
acaugcccucccuucucccugga

SEQ ID NO: 3557453 - RNA, 14 nt, Human
acaugccuaccaau

SEQ ID NO: 3557454 - RNA, 17 nt, Human
acaugcggagaacaaau

SEQ ID NO: 3557455 - RNA, 16 nt, Human
acaugcgggcugggca

SEQ ID NO: 3557456 - RNA, 19 nt, Human
acaugcgggcugggcagcu

SEQ ID NO: 3557457 - RNA, 22 nt, Human
acaugcgggcugggcagcuguu

SEQ ID NO: 3557458 - RNA, 17 nt, Human
acaugcgguagccagca

SEQ ID NO: 3557459 - RNA, 18 nt, Human
acaugcgguagccagcac

SEQ ID NO: 3557460 - RNA, 20 nt, Human
acaugcgguagccagcacac

SEQ ID NO: 3557461 - RNA, 17 nt, Human
acaugcuaagagaagua

SEQ ID NO: 3557462 - RNA, 18 nt, Human
acaugcuaagagaaguag

SEQ ID NO: 3557463 - RNA, 14 nt, Human
acaugcugaacauc

SEQ ID NO: 3557464 - RNA, 14 nt, Human
acaugcugagucuc

SEQ ID NO: 3557465 - RNA, 22 nt, Human
acaugcuggacaggucugggag

SEQ ID NO: 3557466 - RNA, 16 nt, Human
acaugcuggccagccu

SEQ ID NO: 3557467 - RNA, 17 nt, Human
acaugcuguacauacuu

SEQ ID NO: 3557468 - RNA, 20 nt, Human
acaugcuguacauacuuuuu

SEQ ID NO: 3557469 - RNA, 21 nt, Human
acaugcuguacauacuuuuug

SEQ ID NO: 3557470 - RNA, 20 nt, Human
acaugcuguguaagcugugu

SEQ ID NO: 3557471 - RNA, 18 nt, Human
acaugcuuauuccaugac

SEQ ID NO: 3557472 - RNA, 23 nt, Human
acaugcuuauuccaugacugcuu

SEQ ID NO: 3557473 - RNA, 13 nt, Human
acaugcuucccuu

SEQ ID NO: 3557474 - RNA, 14 nt, Human
acauggaaguacua

SEQ ID NO: 3557475 - RNA, 13 nt, Human
acauggacccgga

SEQ ID NO: 3557476 - RNA, 16 nt, Human
acauggacccggagcu

SEQ ID NO: 3557477 - RNA, 22 nt, Human
acauggacccggagcuaacacu

SEQ ID NO: 3557478 - RNA, 15 nt, Human
acauggacuuguaua

SEQ ID NO: 3557479 - RNA, 18 nt, Human
acauggacuuguauauuu

SEQ ID NO: 3557480 - RNA, 16 nt, Human
acauggagacuccugc

SEQ ID NO: 3557481 - RNA, 16 nt, Human
acauggagguucuaag

SEQ ID NO: 3557482 - RNA, 15 nt, Human
acauggaguauaugu

SEQ ID NO: 3557483 - RNA, 19 nt, Human
acauggaguauaugucaag

SEQ ID NO: 3557484 - RNA, 14 nt, Human
acauggauucaguu

SEQ ID NO: 3557485 - RNA, 13 nt, Human
acauggcacagag

SEQ ID NO: 3557486 - RNA, 14 nt, Human
acauggccagugug

SEQ ID NO: 3557487 - RNA, 21 nt, Human
acauggccccucccccugcca

SEQ ID NO: 3557488 - RNA, 17 nt, Human
acauggccuaugcacau

SEQ ID NO: 3557489 - RNA, 19 nt, Human
acauggcucuggacucuaa

SEQ ID NO: 3557490 - RNA, 20 nt, Human
acauggcucuggacucuaaa

SEQ ID NO: 3557491 - RNA, 22 nt, Human
acauggcuggagcuagaauuug

SEQ ID NO: 3557492 - RNA, 22 nt, Human
acaugggaaaggaggcaugccu

SEQ ID NO: 3557493 - RNA, 11 nt, Human
acaugggacau

SEQ ID NO: 3557494 - RNA, 14 nt, Human
acaugggacauuug

SEQ ID NO: 3557495 - RNA, 21 nt, Human
acaugggacauuugcucaugg

SEQ ID NO: 3557496 - RNA, 17 nt, Human
acaugggacuaugcuuu

SEQ ID NO: 3557497 - RNA, 18 nt, Human
acaugggacuaugcuuuu

SEQ ID NO: 3557498 - RNA, 20 nt, Human
acaugggagcaguccaugca

SEQ ID NO: 3557499 - RNA, 15 nt, Human
acauggggaggagga

SEQ ID NO: 3557500 - RNA, 20 nt, Human
acauggggaguguuucaugg

SEQ ID NO: 3557501 - RNA, 20 nt, Human
acaugggguuggcugggccc

SEQ ID NO: 3557502 - RNA, 22 nt, Human
acaugggguuuucaauuuugca

SEQ ID NO: 3557503 - RNA, 21 nt, Human
acauggugaaaccucaucucu

SEQ ID NO: 3557504 - RNA, 11 nt, Human
acauggugaug

SEQ ID NO: 3557505 - RNA, 20 nt, Human
acaugguuaccucugcauaa

SEQ ID NO: 3557506 - RNA, 17 nt, Human
acaugguuugacucccg

SEQ ID NO: 3557507 - RNA, 23 nt, Human
acauguaauaaaaaguauauguu

SEQ ID NO: 3557508 - RNA, 22 nt, Human
acauguaauuaaguacuaugua

SEQ ID NO: 3557509 - RNA, 23 nt, Human
acauguaauuaaguacuauguau

SEQ ID NO: 3557510 - RNA, 15 nt, Human
acauguaauuugugu

SEQ ID NO: 3557511 - RNA, 23 nt, Human
acauguagguguuuguucaucug

SEQ ID NO: 3557512 - RNA, 14 nt, Human
acauguauaauauu

SEQ ID NO: 3557513 - RNA, 19 nt, Human
acauguauaauauuuuuaa

SEQ ID NO: 3557514 - RNA, 20 nt, Human
acauguauaauauuuuuaau

SEQ ID NO: 3557515 - RNA, 21 nt, Human
acauguaucuaugcauuuucu

SEQ ID NO: 3557516 - RNA, 11 nt, Human
acauguauguu

SEQ ID NO: 3557517 - RNA, 14 nt, Human
acauguauguuuug

SEQ ID NO: 3557518 - RNA, 14 nt, Human
acauguauuaaauu

SEQ ID NO: 3557519 - RNA, 19 nt, Human
acauguauuaaauuacauu

SEQ ID NO: 3557520 - RNA, 18 nt, Human
acauguauugcacauugu

SEQ ID NO: 3557521 - RNA, 18 nt, Human
acauguauuuguuugcau

SEQ ID NO: 3557522 - RNA, 19 nt, Human
acauguauuuguuugcaua

SEQ ID NO: 3557523 - RNA, 15 nt, Human
acauguccaagaagc

SEQ ID NO: 3557524 - RNA, 19 nt, Human
acauguccaagaagcccag

SEQ ID NO: 3557525 - RNA, 21 nt, Human
acauguccagugggaggugag

SEQ ID NO: 3557526 - RNA, 15 nt, Human
acaugucccuacacc

SEQ ID NO: 3557527 - RNA, 16 nt, Human
acauguccuugugugu

SEQ ID NO: 3557528 - RNA, 17 nt, Human
acugauaguuacuguug

SEQ ID NO: 3557529 - RNA, 18 nt, Human
acugauaguuacuguugu

SEQ ID NO: 3557530 - RNA, 20 nt, Human
acugauaguuacuguuguga

SEQ ID NO: 3557531 - RNA, 16 nt, Human
acugauauauuuuaca

SEQ ID NO: 3557532 - RNA, 19 nt, Human
acugauaugggucuugaua

SEQ ID NO: 3557533 - RNA, 13 nt, Human
acugauauucaga

SEQ ID NO: 3557534 - RNA, 15 nt, Human
acugaucacaaaaac

SEQ ID NO: 3557535 - RNA, 18 nt, Human
acugaucaggaccuccaa

SEQ ID NO: 3557536 - RNA, 15 nt, Human
acugaucaugcauug

SEQ ID NO: 3557537 - RNA, 16 nt, Human
acugaucaugcauugu

SEQ ID NO: 3557538 - RNA, 21 nt, Human
acugaucauguuuaugagaaa

SEQ ID NO: 3557539 - RNA, 23 nt, Human
acugaucauguuuaugagaaacu

SEQ ID NO: 3557540 - RNA, 16 nt, Human
acugauccagcccuga

SEQ ID NO: 3557541 - RNA, 14 nt, Human
acugaucucguuuu

SEQ ID NO: 3557542 - RNA, 12 nt, Human
acugaugcugcc

SEQ ID NO: 3557543 - RNA, 18 nt, Human
acugauggaaacaaagug

SEQ ID NO: 3557544 - RNA, 12 nt, Human
acugauggaauu

SEQ ID NO: 3557545 - RNA, 22 nt, Human
acugauggaauuuuuuuguacg

SEQ ID NO: 3557546 - RNA, 21 nt, Human
acugauguuacaucacagugu

SEQ ID NO: 3557547 - RNA, 19 nt, Human
acugauguuaggcugggcc

SEQ ID NO: 3557548 - RNA, 21 nt, Human
acugauguuaggcugggccca

SEQ ID NO: 3557549 - RNA, 17 nt, Human
acugauguuguguuuuu

SEQ ID NO: 3557550 - RNA, 18 nt, Human
acugauguuguguuuuua

SEQ ID NO: 3557551 - RNA, 16 nt, Human
acugauguuugugcag

SEQ ID NO: 3557552 - RNA, 14 nt, Human
acugauuacugccu

SEQ ID NO: 3557553 - RNA, 22 nt, Human
acugauuaguaagucuugccua

SEQ ID NO: 3557554 - RNA, 20 nt, Human
acugauucauaauaaauauc

SEQ ID NO: 3557555 - RNA, 20 nt, Human
acugauucugggaugcuccu

SEQ ID NO: 3557556 - RNA, 12 nt, Human
acugauucuuca

SEQ ID NO: 3557557 - RNA, 15 nt, Human
acuccugcucugcuc

SEQ ID NO: 3557558 - RNA, 16 nt, Human
acuccugcucugcucg

SEQ ID NO: 3557559 - RNA, 13 nt, Human
acuccugcuuaau

SEQ ID NO: 3557560 - RNA, 13 nt, Human
acuccuggaagcu

SEQ ID NO: 3557561 - RNA, 16 nt, Human
acuccuggaagcugug

SEQ ID NO: 3557562 - RNA, 13 nt, Human
acuccuggccuca

SEQ ID NO: 3557563 - RNA, 15 nt, Human
acuccugggcucaag

SEQ ID NO: 3557564 - RNA, 17 nt, Human
acuccuggguugagcug

SEQ ID NO: 3557565 - RNA, 13 nt, Human
acuccuguacacu

SEQ ID NO: 3557566 - RNA, 15 nt, Human
acuccuguacacuga

SEQ ID NO: 3557567 - RNA, 15 nt, Human
acuccugucuucugc

SEQ ID NO: 3557568 - RNA, 16 nt, Human
acuccugucuucugcu

SEQ ID NO: 3557569 - RNA, 19 nt, Human
acuccugucuucugcuuug

SEQ ID NO: 3557570 - RNA, 19 nt, Human
acuccugugggagccucgc

SEQ ID NO: 3557571 - RNA, 15 nt, Human
acuccuuauuuggcg

SEQ ID NO: 3557572 - RNA, 20 nt, Human
acuccuucaacaauucuaaa

SEQ ID NO: 3557573 - RNA, 23 nt, Human
acuccuuccaguguccuuagaac

SEQ ID NO: 3557574 - RNA, 21 nt, Human
acuccuuccugccaccugcug

SEQ ID NO: 3557575 - RNA, 14 nt, Human
acuccuuccuggcc

SEQ ID NO: 3557576 - RNA, 16 nt, Human
acuccuuccuggccug

SEQ ID NO: 3557577 - RNA, 17 nt, Human
acuccuuccuggccuga

SEQ ID NO: 3557578 - RNA, 11 nt, Human
acuccuugcau

SEQ ID NO: 3557579 - RNA, 12 nt, Human
acuccuugcauc

SEQ ID NO: 3557580 - RNA, 15 nt, Human
acuccuugcaucaag

SEQ ID NO: 3557581 - RNA, 12 nt, Human
acuccuuggccu

SEQ ID NO: 3557582 - RNA, 14 nt, Human
acuccuuggccuag

SEQ ID NO: 3557583 - RNA, 18 nt, Human
acuccuuggccuagccca

SEQ ID NO: 3557584 - RNA, 20 nt, Human
acuccuugugguuuauguca

SEQ ID NO: 3557585 - RNA, 21 nt, Human
acuccuuuugguguguuggac

SEQ ID NO: 3557586 - RNA, 16 nt, Human
acucgagaccuuuuca

SEQ ID NO: 3557587 - RNA, 18 nt, Human
acucgagucacacucaag

SEQ ID NO: 3557588 - RNA, 14 nt, Human
acucgagucugagg

SEQ ID NO: 3557589 - RNA, 17 nt, Human
acucgcccgcccacugu

SEQ ID NO: 3557590 - RNA, 22 nt, Human
acucgcccgcccacuguccugg

SEQ ID NO: 3557591 - RNA, 12 nt, Human
acucgcuucccc

SEQ ID NO: 3557592 - RNA, 12 nt, Human
acucgcuuguaa

SEQ ID NO: 3557593 - RNA, 15 nt, Human
acucgcuuguaaaua

SEQ ID NO: 3557594 - RNA, 17 nt, Human
acucggaaucuauuuuc

SEQ ID NO: 3557595 - RNA, 16 nt, Human
acucgggaggcugagg

SEQ ID NO: 3557596 - RNA, 20 nt, Human
acucgggaggcugaggcaca

SEQ ID NO: 3557597 - RNA, 14 nt, Human
acucggugucccca

SEQ ID NO: 3557598 - RNA, 18 nt, Human
acucgguguccccaccau

SEQ ID NO: 3557599 - RNA, 15 nt, Human
acucgucucccccaa

SEQ ID NO: 3557600 - RNA, 15 nt, Human
acucguggcugucaa

SEQ ID NO: 3557601 - RNA, 15 nt, Human
acucguguguuucua

SEQ ID NO: 3557602 - RNA, 14 nt, Human
acucguuaauuugu

SEQ ID NO: 3557603 - RNA, 14 nt, Human
acucguuuuuuaca

SEQ ID NO: 3557604 - RNA, 15 nt, Human
acucuaaaagauccu

SEQ ID NO: 3557605 - RNA, 21 nt, Human
acucuaaaagauccuuuuuaa

SEQ ID NO: 3557606 - RNA, 19 nt, Human
acucuaaaagguucaggga

SEQ ID NO: 3557607 - RNA, 15 nt, Human
acucuaaaauuauaa

SEQ ID NO: 3557608 - RNA, 13 nt, Human
acucuaaagcaaa

SEQ ID NO: 3557609 - RNA, 17 nt, Human
acucuaaauucuuuauu

SEQ ID NO: 3557610 - RNA, 14 nt, Human
acucuaagaaagaa

SEQ ID NO: 3557611 - RNA, 19 nt, Human
acucuaagauguuauauuu

SEQ ID NO: 3557612 - RNA, 14 nt, Human
acucuaauagugcu

SEQ ID NO: 3557613 - RNA, 15 nt, Human
acucuaauucuaacc

SEQ ID NO: 3557614 - RNA, 16 nt, Human
acucuacacugugaac

SEQ ID NO: 3557615 - RNA, 14 nt, Human
acucuaccagacug

SEQ ID NO: 3557616 - RNA, 19 nt, Human
acucuaccagacuguguau

SEQ ID NO: 3557617 - RNA, 17 nt, Human
acucuaccagugcaggc

SEQ ID NO: 3557618 - RNA, 22 nt, Human
acucuaccagugcaggcuggcc

SEQ ID NO: 3557619 - RNA, 15 nt, Human
acucuacccucccac

SEQ ID NO: 3557620 - RNA, 18 nt, Human
acucuacccucuuagaaa

SEQ ID NO: 3557621 - RNA, 14 nt, Human
acucuacuguguaa

SEQ ID NO: 3557622 - RNA, 19 nt, Human
acucuagaguccaagguuu

SEQ ID NO: 3557623 - RNA, 20 nt, Human
acucuagaguccaagguuua

SEQ ID NO: 3557624 - RNA, 21 nt, Human
acucuagauaccuaaaacaua

SEQ ID NO: 3557625 - RNA, 14 nt, Human
acucuagauuuugu

SEQ ID NO: 3557626 - RNA, 20 nt, Human
acucuagcugggggugggcc

SEQ ID NO: 3557627 - RNA, 22 nt, Human
acucuaggauguauauuuuaua

SEQ ID NO: 3557628 - RNA, 15 nt, Human
acucuagggaaaaac

SEQ ID NO: 3557629 - RNA, 17 nt, Human
acucuaggugcccuugg

SEQ ID NO: 3557630 - RNA, 15 nt, Human
acucuauagacucua

SEQ ID NO: 3557631 - RNA, 22 nt, Human
acucuauauagcugaucaguuu

SEQ ID NO: 3557632 - RNA, 14 nt, Human
acucuaucaaguau

SEQ ID NO: 3557633 - RNA, 18 nt, Human
acucuaucugggccuggg

SEQ ID NO: 3557634 - RNA, 17 nt, Human
acucuaugccccaaaua

SEQ ID NO: 3557635 - RNA, 21 nt, Human
acucuaugccccaaauauagc

SEQ ID NO: 3557636 - RNA, 16 nt, Human
acucuauuuuuacauu

SEQ ID NO: 3557637 - RNA, 20 nt, Human
acucuauuuuuacauuuaaa

SEQ ID NO: 3557638 - RNA, 21 nt, Human
acucucacacugguucucaau

SEQ ID NO: 3557639 - RNA, 14 nt, Human
acucucacauguuu

SEQ ID NO: 3557640 - RNA, 14 nt, Human
acucucagaggccc

SEQ ID NO: 3557641 - RNA, 15 nt, Human
acucucagaggcccc

SEQ ID NO: 3557642 - RNA, 22 nt, Human
acucucagcccagaagaaaauu

SEQ ID NO: 3557643 - RNA, 22 nt, Human
acucucaggaucaagaaagugu

SEQ ID NO: 3557644 - RNA, 13 nt, Human
acucucagucucu

SEQ ID NO: 3557645 - RNA, 14 nt, Human
acucucagucucug

SEQ ID NO: 3557646 - RNA, 18 nt, Human
acucucagucucugagca

SEQ ID NO: 3557647 - RNA, 22 nt, Human
acucucagugcuucuuacuauu

SEQ ID NO: 3557648 - RNA, 16 nt, Human
acucucaucacuacag

SEQ ID NO: 3557649 - RNA, 17 nt, Human
acucucaucacuacagu

SEQ ID NO: 3557650 - RNA, 18 nt, Human
acucucaucacuacagua

SEQ ID NO: 3557651 - RNA, 17 nt, Human
acucucauuccccaggu

SEQ ID NO: 3557652 - RNA, 21 nt, Human
acucucauuccccagguggcu

SEQ ID NO: 3557653 - RNA, 19 nt, Human
acucuccaaccuggacaac

SEQ ID NO: 3557654 - RNA, 15 nt, Human
acucuccaggggucc

SEQ ID NO: 3557655 - RNA, 10 nt, Human
acucucccca

SEQ ID NO: 3557656 - RNA, 20 nt, Human
acucuccccacgagggcugg

SEQ ID NO: 3557657 - RNA, 10 nt, Human
acucuccccc

SEQ ID NO: 3557658 - RNA, 20 nt, Human
acucucccccacccccuccc

SEQ ID NO: 3557659 - RNA, 14 nt, Human
acucuccccucuua

SEQ ID NO: 3557660 - RNA, 23 nt, Human
acucuccuaggcauucuggaccu

SEQ ID NO: 3557661 - RNA, 16 nt, Human
acucuccuaugccuuu

SEQ ID NO: 3557662 - RNA, 20 nt, Human
acucuccucggcccccucca

SEQ ID NO: 3557663 - RNA, 13 nt, Human
acucuccucugcu

SEQ ID NO: 3557664 - RNA, 19 nt, Human
acucuccucugcugcuggc

SEQ ID NO: 3557665 - RNA, 17 nt, Human
acucuccuggaaauauu

SEQ ID NO: 3557666 - RNA, 18 nt, Human
acucuccuggaaauauua

SEQ ID NO: 3557667 - RNA, 15 nt, Human
acucuccuggacugc

SEQ ID NO: 3557668 - RNA, 13 nt, Human
acucuccugggcc

SEQ ID NO: 3557669 - RNA, 16 nt, Human
acucuccugggccccu

SEQ ID NO: 3557670 - RNA, 15 nt, Human
acucuccuugcaguu

SEQ ID NO: 3557671 - RNA, 18 nt, Human
acucucugaaccccuccc

SEQ ID NO: 3557672 - RNA, 21 nt, Human
acucucuuauugccucacuuc

SEQ ID NO: 3557673 - RNA, 15 nt, Human
acucucuucuucuca

SEQ ID NO: 3557674 - RNA, 10 nt, Human
acugccucug

SEQ ID NO: 3557675 - RNA, 11 nt, Human
acugccucugc

SEQ ID NO: 3557676 - RNA, 12 nt, Human
acugccucugcc

SEQ ID NO: 3557677 - RNA, 14 nt, Human
acugccugaauaaa

SEQ ID NO: 3557678 - RNA, 24 nt, Human
acugccugcagaggucugugcuga

SEQ ID NO: 3557679 - RNA, 13 nt, Human
acugccugcccac

SEQ ID NO: 3557680 - RNA, 23 nt, Human
acugccugcccacccguggagau

SEQ ID NO: 3557681 - RNA, 13 nt, Human
acugccugccuua

SEQ ID NO: 3557682 - RNA, 15 nt, Human
acugccuuaaaacuu

SEQ ID NO: 3557683 - RNA, 16 nt, Human
acugccuuaaaacuuu

SEQ ID NO: 3557684 - RNA, 22 nt, Human
acugccuucgcuucuugccucu

SEQ ID NO: 3557685 - RNA, 19 nt, Human
acugccuucucaacuccaa

SEQ ID NO: 3557686 - RNA, 18 nt, Human
acugccuuggcuucaggg

SEQ ID NO: 3557687 - RNA, 19 nt, Human
acugccuuuggcagaguuc

SEQ ID NO: 3557688 - RNA, 21 nt, Human
acugcgaagacccucuugccc

SEQ ID NO: 3557689 - RNA, 19 nt, Human
acugcgggaugguccuggg

SEQ ID NO: 3557690 - RNA, 13 nt, Human
acugcuaaauaaa

SEQ ID NO: 3557691 - RNA, 18 nt, Human
acugcuaagaauauuuga

SEQ ID NO: 3557692 - RNA, 19 nt, Human
acugcuaaguauuucccag

SEQ ID NO: 3557693 - RNA, 16 nt, Human
acugcuacagcaauuu

SEQ ID NO: 3557694 - RNA, 13 nt, Human
acugcuacuguaa

SEQ ID NO: 3557695 - RNA, 22 nt, Human
acugcuacuguaauuuuauaug

SEQ ID NO: 3557696 - RNA, 19 nt, Human
acugcuaggcgagugccag

SEQ ID NO: 3557697 - RNA, 20 nt, Human
acugcuaggcgagugccagg

SEQ ID NO: 3557698 - RNA, 21 nt, Human
acugcuaggcgagugccagga

SEQ ID NO: 3557699 - RNA, 23 nt, Human
acugcuaggcgagugccaggacu

SEQ ID NO: 3557700 - RNA, 19 nt, Human
acugcuagucuuaagaacu

SEQ ID NO: 3557701 - RNA, 16 nt, Human
acugcuaguguucugu

SEQ ID NO: 3557702 - RNA, 16 nt, Human
acugcucaagaagaca

SEQ ID NO: 3557703 - RNA, 19 nt, Human
acugcucaucauuccuuga

SEQ ID NO: 3557704 - RNA, 16 nt, Human
acugcucccaccuccu

SEQ ID NO: 3557705 - RNA, 18 nt, Human
acugcucccaccuccuga

SEQ ID NO: 3557706 - RNA, 19 nt, Human
acugcucccaccuccugac

SEQ ID NO: 3557707 - RNA, 21 nt, Human
acugcucccuaagccagccug

SEQ ID NO: 3557708 - RNA, 15 nt, Human
acugcucccugaagc

SEQ ID NO: 3557709 - RNA, 16 nt, Human
acugcucccugaagcc

SEQ ID NO: 3557710 - RNA, 19 nt, Human
acugcucccugaagccagc

SEQ ID NO: 3557711 - RNA, 22 nt, Human
acugcucccugaagccagccuu

SEQ ID NO: 3557712 - RNA, 13 nt, Human
acugcuccuccuc

SEQ ID NO: 3557713 - RNA, 15 nt, Human
acugcuccugagccc

SEQ ID NO: 3557714 - RNA, 16 nt, Human
acugcuccugagcccc

SEQ ID NO: 3557715 - RNA, 17 nt, Human
acugcuccugagccccc

SEQ ID NO: 3557716 - RNA, 17 nt, Human
acugcucuaagcacacg

SEQ ID NO: 3557717 - RNA, 19 nt, Human
acugcucuaagcacacgga

SEQ ID NO: 3557718 - RNA, 11 nt, Human
acugcucucac

SEQ ID NO: 3557719 - RNA, 23 nt, Human
acucugcugucuaaccugugacc

SEQ ID NO: 3557720 - RNA, 18 nt, Human
acucugcuucucugacuu

SEQ ID NO: 3557721 - RNA, 22 nt, Human
acucugcuucucugacuucugc

SEQ ID NO: 3557722 - RNA, 12 nt, Human
acucuggaaaag

SEQ ID NO: 3557723 - RNA, 17 nt, Human
acucuggacuuucucua

SEQ ID NO: 3557724 - RNA, 21 nt, Human
acucuggacuuucucuaauaa

SEQ ID NO: 3557725 - RNA, 22 nt, Human
acucuggacuuucucuaauaau

SEQ ID NO: 3557726 - RNA, 17 nt, Human
acucuggcaaagcuuuu

SEQ ID NO: 3557727 - RNA, 15 nt, Human
acucuggcagcaccg

SEQ ID NO: 3557728 - RNA, 20 nt, Human
acucuggcagcaccgccucu

SEQ ID NO: 3557729 - RNA, 14 nt, Human
acucuggcccuggc

SEQ ID NO: 3557730 - RNA, 16 nt, Human
acucuggcccuggccc

SEQ ID NO: 3557731 - RNA, 16 nt, Human
acucuggccucuguca

SEQ ID NO: 3557732 - RNA, 16 nt, Human
acucuggcuuggccua

SEQ ID NO: 3557733 - RNA, 19 nt, Human
acucugggaaauaagagag

SEQ ID NO: 3557734 - RNA, 11 nt, Human
acucugggaac

SEQ ID NO: 3557735 - RNA, 18 nt, Human
acucugggcuauggacac

SEQ ID NO: 3557736 - RNA, 20 nt, Human
acucugggcuauggacacag

SEQ ID NO: 3557737 - RNA, 22 nt, Human
acucugggcuauggacacaggg

SEQ ID NO: 3557738 - RNA, 14 nt, Human
acucugggcuccag

SEQ ID NO: 3557739 - RNA, 12 nt, Human
acucugggcugu

SEQ ID NO: 3557740 - RNA, 14 nt, Human
acucuggugccucc

SEQ ID NO: 3557741 - RNA, 15 nt, Human
acucuguaaaaacac

SEQ ID NO: 3557742 - RNA, 12 nt, Human
acucuguaauug

SEQ ID NO: 3557743 - RNA, 14 nt, Human
acucugucagaugg

SEQ ID NO: 3557744 - RNA, 20 nt, Human
acucuguccugaaggccuga

SEQ ID NO: 3557745 - RNA, 17 nt, Human
acucugucucaguccau

SEQ ID NO: 3557746 - RNA, 18 nt, Human
acucugucucaguccaug

SEQ ID NO: 3557747 - RNA, 17 nt, Human
acucugucuucaccuga

SEQ ID NO: 3557748 - RNA, 11 nt, Human
acucugugcca

SEQ ID NO: 3557749 - RNA, 20 nt, Human
acucugugccagagccuggg

SEQ ID NO: 3557750 - RNA, 23 nt, Human
acucugugccagagccuggggcu

SEQ ID NO: 3557751 - RNA, 15 nt, Human
acucugugcccaugg

SEQ ID NO: 3557752 - RNA, 16 nt, Human
acucugugcuggccag

SEQ ID NO: 3557753 - RNA, 21 nt, Human
acucugugucagguggggcag

SEQ ID NO: 3557754 - RNA, 16 nt, Human
acucuguuauuuagac

SEQ ID NO: 3557755 - RNA, 20 nt, Human
acucuguucauuccuccagg

SEQ ID NO: 3557756 - RNA, 12 nt, Human
acucuguuccug

SEQ ID NO: 3557757 - RNA, 14 nt, Human
acucuguuccuuca

SEQ ID NO: 3557758 - RNA, 22 nt, Human
acucuguuccuucacauccugu

SEQ ID NO: 3557759 - RNA, 18 nt, Human
acucuuaaaacccaagug

SEQ ID NO: 3557760 - RNA, 17 nt, Human
acucuuaaaugaucugc

SEQ ID NO: 3557761 - RNA, 15 nt, Human
acucuuaagaagacu

SEQ ID NO: 3557762 - RNA, 14 nt, Human
acucuuaagccauc

SEQ ID NO: 3557763 - RNA, 17 nt, Human
acucuuaaguuucucag

SEQ ID NO: 3557764 - RNA, 19 nt, Human
acucuuaaguuucucagcu

SEQ ID NO: 3557765 - RNA, 22 nt, Human
acucuuaccauauguuugguaa

SEQ ID NO: 3557766 - RNA, 17 nt, Human
acucuuaggaagagaaa

SEQ ID NO: 3557767 - RNA, 10 nt, Human
acucuuaggc

SEQ ID NO: 3557768 - RNA, 19 nt, Human
acucuuaggcacuuugggg

SEQ ID NO: 3557769 - RNA, 16 nt, Human
acucuuauaaauuucu

SEQ ID NO: 3557770 - RNA, 16 nt, Human
acucuuauaucuauau

SEQ ID NO: 3557771 - RNA, 19 nt, Human
acucuuauaucuauauuuu

SEQ ID NO: 3557772 - RNA, 22 nt, Human
acucuuauaucuauauuuuaca

SEQ ID NO: 3557773 - RNA, 22 nt, Human
acucuuaucucagucaugcaua

SEQ ID NO: 3557774 - RNA, 21 nt, Human
acucuuaugcuguacccaguu

SEQ ID NO: 3557775 - RNA, 19 nt, Human
acucuuauugcccacgcug

SEQ ID NO: 3557776 - RNA, 18 nt, Human
acucuucaaaaacuguuu

SEQ ID NO: 3557777 - RNA, 15 nt, Human
acucuucaaaugccu

SEQ ID NO: 3557778 - RNA, 19 nt, Human
acucuucaaggacuuucug

SEQ ID NO: 3557779 - RNA, 20 nt, Human
acucuucaaggucugcuuuu

SEQ ID NO: 3557780 - RNA, 15 nt, Human
acucuucagagaaau

SEQ ID NO: 3557781 - RNA, 21 nt, Human
acucuucaguuaagccuuugg

SEQ ID NO: 3557782 - RNA, 20 nt, Human
acucuuccuccaaggacaga

SEQ ID NO: 3557783 - RNA, 15 nt, Human
acucuuccugcaagg

SEQ ID NO: 3557784 - RNA, 16 nt, Human
acucuuccugcaagga

SEQ ID NO: 3557785 - RNA, 18 nt, Human
acucuucucauuacuugu

SEQ ID NO: 3557786 - RNA, 13 nt, Human
acucuucucucug

SEQ ID NO: 3557787 - RNA, 23 nt, Human
acucuucugagcaccuacuuaca

SEQ ID NO: 3557788 - RNA, 20 nt, Human
acucuucuuaacuuaaauuu

SEQ ID NO: 3557789 - RNA, 14 nt, Human
acucuugaaaaaug

SEQ ID NO: 3557790 - RNA, 14 nt, Human
acucuugaccucag

SEQ ID NO: 3557791 - RNA, 15 nt, Human
acucuugaccucagg

SEQ ID NO: 3557792 - RNA, 16 nt, Human
acucuugaguuguuuu

SEQ ID NO: 3557793 - RNA, 20 nt, Human
acucuugaguuguuuuugua

SEQ ID NO: 3557794 - RNA, 14 nt, Human
acucuugccuguuu

SEQ ID NO: 3557795 - RNA, 16 nt, Human
acucuugcucuuucua

SEQ ID NO: 3557796 - RNA, 14 nt, Human
acucuuggagccug

SEQ ID NO: 3557797 - RNA, 15 nt, Human
acucuuggagccugc

SEQ ID NO: 3557798 - RNA, 16 nt, Human
acucuugguuucuuca

SEQ ID NO: 3557799 - RNA, 15 nt, Human
acucuuguaagauuu

SEQ ID NO: 3557800 - RNA, 18 nt, Human
acucuuguaagauuuuga

SEQ ID NO: 3557801 - RNA, 22 nt, Human
acucuuguaagauuuugaaaac

SEQ ID NO: 3557802 - RNA, 18 nt, Human
acucuuguggauguuuua

SEQ ID NO: 3557803 - RNA, 17 nt, Human
acucuuuacccuugagc

SEQ ID NO: 3557804 - RNA, 17 nt, Human
acucuuuaugcuugcaa

SEQ ID NO: 3557805 - RNA, 15 nt, Human
acucuuuauugucug

SEQ ID NO: 3557806 - RNA, 23 nt, Human
acucuuucgguagguggaagcua

SEQ ID NO: 3557807 - RNA, 21 nt, Human
acucuuucuguauauacuuuu

SEQ ID NO: 3557808 - RNA, 18 nt, Human
acucuuugaaugacaaag

SEQ ID NO: 3557809 - RNA, 13 nt, Human
acucuuugagaaa

SEQ ID NO: 3557810 - RNA, 16 nt, Human
acucuuugagaaacaa

SEQ ID NO: 3557811 - RNA, 12 nt, Human
acucuuugagag

SEQ ID NO: 3557812 - RNA, 23 nt, Human
acucuuugagauagaagaacugc

SEQ ID NO: 3557813 - RNA, 15 nt, Human
acucuuugcugcugc

SEQ ID NO: 3557814 - RNA, 11 nt, Human
acucuuuggau

SEQ ID NO: 3557815 - RNA, 19 nt, Human
acucuuuggucguuuuuuu

SEQ ID NO: 3557816 - RNA, 13 nt, Human
acucuuuguaaga

SEQ ID NO: 3557817 - RNA, 21 nt, Human
acucuuuuccaaacacaggca

SEQ ID NO: 3557818 - RNA, 14 nt, Human
acucuuuugcuuua

SEQ ID NO: 3557819 - RNA, 17 nt, Human
accagagccccacacgg

SEQ ID NO: 3557820 - RNA, 15 nt, Human
accagagcucuggag

SEQ ID NO: 3557821 - RNA, 17 nt, Human
accagagcucuggagcc

SEQ ID NO: 3557822 - RNA, 12 nt, Human
accagagcugcc

SEQ ID NO: 3557823 - RNA, 13 nt, Human
accagaggcagcu

SEQ ID NO: 3557824 - RNA, 19 nt, Human
accagaggcugcagaaggc

SEQ ID NO: 3557825 - RNA, 22 nt, Human
accagauaccuuaucuuacaau

SEQ ID NO: 3557826 - RNA, 14 nt, Human
accagaugcagcuc

SEQ ID NO: 3557827 - RNA, 21 nt, Human
accagaugcgucccaagaugu

SEQ ID NO: 3557828 - RNA, 22 nt, Human
accagaugcgucccaagauguu

SEQ ID NO: 3557829 - RNA, 11 nt, Human
accagaugcug

SEQ ID NO: 3557830 - RNA, 20 nt, Human
accagauucuauccucaucu

SEQ ID NO: 3557831 - RNA, 21 nt, Human
accagauucuauccucaucuu

SEQ ID NO: 3557832 - RNA, 16 nt, Human
accagcaacuugaacu

SEQ ID NO: 3557833 - RNA, 23 nt, Human
accagcaacuugucuuuuucugg

SEQ ID NO: 3557834 - RNA, 17 nt, Human
accagcaauauaucuga

SEQ ID NO: 3557835 - RNA, 13 nt, Human
accagcacacucc

SEQ ID NO: 3557836 - RNA, 15 nt, Human
accagcacacucccg

SEQ ID NO: 3557837 - RNA, 18 nt, Human
accagcacacucccgaga

SEQ ID NO: 3557838 - RNA, 20 nt, Human
accagcagacagagccagga

SEQ ID NO: 3557839 - RNA, 14 nt, Human
accagccagauccu

SEQ ID NO: 3557840 - RNA, 17 nt, Human
accagccaguaaauggg

SEQ ID NO: 3557841 - RNA, 21 nt, Human
accagccauuggcuauuuaaa

SEQ ID NO: 3557842 - RNA, 17 nt, Human
accagcccacgcugacu

SEQ ID NO: 3557843 - RNA, 21 nt, Human
accagcccacgcugacuacag

SEQ ID NO: 3557844 - RNA, 20 nt, Human
accagccccagugcccacag

SEQ ID NO: 3557845 - RNA, 15 nt, Human
accagccccugcccc

SEQ ID NO: 3557846 - RNA, 15 nt, Human
accagcccggccugc

SEQ ID NO: 3557847 - RNA, 21 nt, Human
accagcccggccugcucccag

SEQ ID NO: 3557848 - RNA, 11 nt, Human
accagcccugg

SEQ ID NO: 3557849 - RNA, 20 nt, Human
accagcccuggggcugggcc

SEQ ID NO: 3557850 - RNA, 22 nt, Human
accagccgugagcauguuugga

SEQ ID NO: 3557851 - RNA, 14 nt, Human
accagccuccaugc

SEQ ID NO: 3557852 - RNA, 11 nt, Human
accagccuggc

SEQ ID NO: 3557853 - RNA, 14 nt, Human
accagccuggccca

SEQ ID NO: 3557854 - RNA, 14 nt, Human
accagccugggcag

SEQ ID NO: 3557855 - RNA, 14 nt, Human
accagccuguugga

SEQ ID NO: 3557856 - RNA, 19 nt, Human
accagccuuucucccaggc

SEQ ID NO: 3557857 - RNA, 13 nt, Human
accagcgcccgcu

SEQ ID NO: 3557858 - RNA, 15 nt, Human
accagcgcccgcugg

SEQ ID NO: 3557859 - RNA, 19 nt, Human
accagcgcccgcugggcug

SEQ ID NO: 3557860 - RNA, 20 nt, Human
accagcgcccgcugggcuga

SEQ ID NO: 3557861 - RNA, 21 nt, Human
accagcguauauauaagaaag

SEQ ID NO: 3557862 - RNA, 23 nt, Human
accagcguauauauaagaaagac

SEQ ID NO: 3557863 - RNA, 16 nt, Human
accagcucagcacugc

SEQ ID NO: 3557864 - RNA, 16 nt, Human
accagcucaggacaga

SEQ ID NO: 3557865 - RNA, 19 nt, Human
accagcucccccucccucc

SEQ ID NO: 3557866 - RNA, 20 nt, Human
accagcucccccucccuccc

SEQ ID NO: 3557867 - RNA, 12 nt, Human
accagcugaaag

SEQ ID NO: 3557868 - RNA, 10 nt, Human
accagcugca

SEQ ID NO: 3557869 - RNA, 16 nt, Human
accagcugcaaagugu

SEQ ID NO: 3557870 - RNA, 22 nt, Human
accagcugcaaaguguuuugua

SEQ ID NO: 3557871 - RNA, 16 nt, Human
accagcugccucuucu

SEQ ID NO: 3557872 - RNA, 19 nt, Human
accagcugcgcuugcuuuu

SEQ ID NO: 3557873 - RNA, 17 nt, Human
accagcuguaacacagc

SEQ ID NO: 3557874 - RNA, 23 nt, Human
accagcuguucugucccuuggag

SEQ ID NO: 3557875 - RNA, 18 nt, Human
accagcuucuccaggcuc

SEQ ID NO: 3557876 - RNA, 20 nt, Human
accagcuucuccaggcucuu

SEQ ID NO: 3557877 - RNA, 19 nt, Human
accagcuuggcucaggcug

SEQ ID NO: 3557878 - RNA, 21 nt, Human
accagcuuguaugcaauggau

SEQ ID NO: 3557879 - RNA, 21 nt, Human
accaggaaaggauuuuauaau

SEQ ID NO: 3557880 - RNA, 17 nt, Human
accaggaaccucuucag

SEQ ID NO: 3557881 - RNA, 15 nt, Human
accaggacaggacca

SEQ ID NO: 3557882 - RNA, 14 nt, Human
accaggacucccuc

SEQ ID NO: 3557883 - RNA, 18 nt, Human
accaggagaaccacuaca

SEQ ID NO: 3557884 - RNA, 19 nt, Human
accaggagaaccacuacau

SEQ ID NO: 3557885 - RNA, 16 nt, Human
accaggagcugcucac

SEQ ID NO: 3557886 - RNA, 16 nt, Human
accaggaggcggcagu

SEQ ID NO: 3557887 - RNA, 20 nt, Human
accaggaguggguggggagu

SEQ ID NO: 3557888 - RNA, 14 nt, Human
accaggauggcccu

SEQ ID NO: 3557889 - RNA, 14 nt, Human
accaggauuucuaa

SEQ ID NO: 3557890 - RNA, 19 nt, Human
accaggcaccuccccuccc

SEQ ID NO: 3557891 - RNA, 23 nt, Human
accaggcaccuccccucccgccc

SEQ ID NO: 3557892 - RNA, 22 nt, Human
accaggcacgaacccaccugcu

SEQ ID NO: 3557893 - RNA, 11 nt, Human
accaggcaggg

SEQ ID NO: 3557894 - RNA, 15 nt, Human
accaggccauucugc

SEQ ID NO: 3557895 - RNA, 15 nt, Human
accaggcccuggcua

SEQ ID NO: 3557896 - RNA, 16 nt, Human
accaggccguccuccc

SEQ ID NO: 3557897 - RNA, 20 nt, Human
accaggccguccucccgggc

SEQ ID NO: 3557898 - RNA, 12 nt, Human
accaggccuggg

SEQ ID NO: 3557899 - RNA, 23 nt, Human
accaggcgagagacuuguggccu

SEQ ID NO: 3557900 - RNA, 19 nt, Human
accaggcugcucagggcug

SEQ ID NO: 3557901 - RNA, 17 nt, Human
accaggcuggcgcagcc

SEQ ID NO: 3557902 - RNA, 22 nt, Human
accaggcuggcgcagccaaggc

SEQ ID NO: 3557903 - RNA, 14 nt, Human
accagggacugagg

SEQ ID NO: 3557904 - RNA, 20 nt, Human
accagggagccccuuugaug

SEQ ID NO: 3557905 - RNA, 19 nt, Human
accagggagcugcaggggc

SEQ ID NO: 3557906 - RNA, 16 nt, Human
accagggauuguuucu

SEQ ID NO: 3557907 - RNA, 18 nt, Human
accagggauuguuucugu

SEQ ID NO: 3557908 - RNA, 18 nt, Human
accagggcaccaagccca

SEQ ID NO: 3557909 - RNA, 14 nt, Human
accagggcagggcc

SEQ ID NO: 3557910 - RNA, 18 nt, Human
accagggcaucucugggc

SEQ ID NO: 3557911 - RNA, 19 nt, Human
accagggcaucucugggcu

SEQ ID NO: 3557912 - RNA, 20 nt, Human
accagggcaucucugggcug

SEQ ID NO: 3557913 - RNA, 21 nt, Human
accagggcaucucugggcugg

SEQ ID NO: 3557914 - RNA, 15 nt, Human
accagggcuccagcc

SEQ ID NO: 3557915 - RNA, 18 nt, Human
accaggggcaggcacagc

SEQ ID NO: 3557916 - RNA, 24 nt, Human
accaggggugauuucagagagggc

SEQ ID NO: 3557917 - RNA, 19 nt, Human
acuucauucuugaaagcug

SEQ ID NO: 3557918 - RNA, 21 nt, Human
acuucauucuugaaagcugug

SEQ ID NO: 3557919 - RNA, 21 nt, Human
acuucauugagaguuuugucu

SEQ ID NO: 3557920 - RNA, 16 nt, Human
acuuccaaaauucuua

SEQ ID NO: 3557921 - RNA, 19 nt, Human
acuuccaaaauucuuauuu

SEQ ID NO: 3557922 - RNA, 20 nt, Human
acuuccaaaccugacagaug

SEQ ID NO: 3557923 - RNA, 14 nt, Human
acuuccaaacuaau

SEQ ID NO: 3557924 - RNA, 17 nt, Human
acuuccaaacuaauuuu

SEQ ID NO: 3557925 - RNA, 16 nt, Human
acuuccaaagaaaguu

SEQ ID NO: 3557926 - RNA, 15 nt, Human
acuuccaaagaaugu

SEQ ID NO: 3557927 - RNA, 23 nt, Human
acuuccaaagaauguuagagcac

SEQ ID NO: 3557928 - RNA, 22 nt, Human
acuuccaagaccugacucaggc

SEQ ID NO: 3557929 - RNA, 16 nt, Human
acuuccaggggaaccu

SEQ ID NO: 3557930 - RNA, 21 nt, Human
acuuccagguguuacuguaau

SEQ ID NO: 3557931 - RNA, 15 nt, Human
acuuccaugaauuuu

SEQ ID NO: 3557932 - RNA, 17 nt, Human
acuuccaugaggccaaa

SEQ ID NO: 3557933 - RNA, 12 nt, Human
acuuccaugccu

SEQ ID NO: 3557934 - RNA, 17 nt, Human
acuucccacccugcccc

SEQ ID NO: 3557935 - RNA, 11 nt, Human
acuucccagcu

SEQ ID NO: 3557936 - RNA, 24 nt, Human
acuucccaguucaggagucccaag

SEQ ID NO: 3557937 - RNA, 19 nt, Human
acuucccauuuuggaaguu

SEQ ID NO: 3557938 - RNA, 12 nt, Human
acuuccccuccu

SEQ ID NO: 3557939 - RNA, 13 nt, Human
acuuccccuuccu

SEQ ID NO: 3557940 - RNA, 19 nt, Human
acuuccccuuccuaauucc

SEQ ID NO: 3557941 - RNA, 20 nt, Human
acuucccgggccagggcugc

SEQ ID NO: 3557942 - RNA, 20 nt, Human
acuucccgucccauauccug

SEQ ID NO: 3557943 - RNA, 22 nt, Human
acuucccgucccauauccugcc

SEQ ID NO: 3557944 - RNA, 17 nt, Human
acuucccuaacacuuac

SEQ ID NO: 3557945 - RNA, 17 nt, Human
acuucccucaucucucc

SEQ ID NO: 3557946 - RNA, 11 nt, Human
acuucccuggc

SEQ ID NO: 3557947 - RNA, 21 nt, Human
acuucccuggguuagacugcc

SEQ ID NO: 3557948 - RNA, 23 nt, Human
acuucccuggguuagacugccag

SEQ ID NO: 3557949 - RNA, 12 nt, Human
acuucccugugu

SEQ ID NO: 3557950 - RNA, 15 nt, Human
acuuccuccucccca

SEQ ID NO: 3557951 - RNA, 18 nt, Human
acuuccucgccucuccca

SEQ ID NO: 3557952 - RNA, 22 nt, Human
acuuccucucgcggcccucagu

SEQ ID NO: 3557953 - RNA, 17 nt, Human
acuuccugccuggucuc

SEQ ID NO: 3557954 - RNA, 14 nt, Human
acuuccuguccaga

SEQ ID NO: 3557955 - RNA, 15 nt, Human
acuuccugugacuuc

SEQ ID NO: 3557956 - RNA, 18 nt, Human
acuuccuguuugggcccc

SEQ ID NO: 3557957 - RNA, 19 nt, Human
acuuccuugcucucccucu

SEQ ID NO: 3557958 - RNA, 14 nt, Human
acuuccuuuuaacu

SEQ ID NO: 3557959 - RNA, 15 nt, Human
acuucgacucaggau

SEQ ID NO: 3557960 - RNA, 19 nt, Human
acuucgacucaggauccag

SEQ ID NO: 3557961 - RNA, 23 nt, Human
acuucgcaucaaaagacaauucu

SEQ ID NO: 3557962 - RNA, 20 nt, Human
acuucgggaggucgaggcag

SEQ ID NO: 3557963 - RNA, 18 nt, Human
acuucgucuucuaauuuc

SEQ ID NO: 3557964 - RNA, 13 nt, Human
acuucgugggauc

SEQ ID NO: 3557965 - RNA, 23 nt, Human
acuucgugggaucugccccuccc

SEQ ID NO: 3557966 - RNA, 23 nt, Human
acuucguuuugguuaaguuggcu

SEQ ID NO: 3557967 - RNA, 14 nt, Human
acuucuaaaacugu

SEQ ID NO: 3557968 - RNA, 19 nt, Human
acuucuaaaacuguacuuu

SEQ ID NO: 3557969 - RNA, 21 nt, Human
acuucuaaaacuguacuuuga

SEQ ID NO: 3557970 - RNA, 17 nt, Human
acuucuaaaugcauauc

SEQ ID NO: 3557971 - RNA, 17 nt, Human
acuucuaagacuuuacu

SEQ ID NO: 3557972 - RNA, 19 nt, Human
acuucuaagacuuuacuua

SEQ ID NO: 3557973 - RNA, 23 nt, Human
acuucuaaguugaguauauuaua

SEQ ID NO: 3557974 - RNA, 22 nt, Human
acuucuaauauauuuuuauauu

SEQ ID NO: 3557975 - RNA, 14 nt, Human
acuucuaccugccc

SEQ ID NO: 3557976 - RNA, 22 nt, Human
acuucucaggacacaggccugu

SEQ ID NO: 3557977 - RNA, 16 nt, Human
acuucucaucacacac

SEQ ID NO: 3557978 - RNA, 18 nt, Human
acuucuccacccugcucu

SEQ ID NO: 3557979 - RNA, 21 nt, Human
acuucucuacccaucuuaaaa

SEQ ID NO: 3557980 - RNA, 16 nt, Human
acuucucucuaaggag

SEQ ID NO: 3557981 - RNA, 13 nt, Human
acuucucugaagg

SEQ ID NO: 3557982 - RNA, 21 nt, Human
acuucucugccuuugacauuu

SEQ ID NO: 3557983 - RNA, 19 nt, Human
acuucucuuaaacuuguga

SEQ ID NO: 3557984 - RNA, 17 nt, Human
acuucucuugcuuucua

SEQ ID NO: 3557985 - RNA, 14 nt, Human
acuucucuuugccu

SEQ ID NO: 3557986 - RNA, 15 nt, Human
acuucucuuugccuc

SEQ ID NO: 3557987 - RNA, 16 nt, Human
acuucucuuugccuca

SEQ ID NO: 3557988 - RNA, 16 nt, Human
acuucugacagccuca

SEQ ID NO: 3557989 - RNA, 18 nt, Human
acuucugacucuucccca

SEQ ID NO: 3557990 - RNA, 16 nt, Human
acuucugcaacaagca

SEQ ID NO: 3557991 - RNA, 24 nt, Human
acuucugcaacaagcaugcagcuu

SEQ ID NO: 3557992 - RNA, 14 nt, Human
acuucugcuggcau

SEQ ID NO: 3557993 - RNA, 14 nt, Human
acuucugcuuucca

SEQ ID NO: 3557994 - RNA, 16 nt, Human
acuucuggcucccucu

SEQ ID NO: 3557995 - RNA, 18 nt, Human
acuucuggcucccucuuc

SEQ ID NO: 3557996 - RNA, 13 nt, Human
acuucuggcuccu

SEQ ID NO: 3557997 - RNA, 15 nt, Human
acuucuggcuccuca

SEQ ID NO: 3557998 - RNA, 16 nt, Human
acuucuggcuccucaa

SEQ ID NO: 3557999 - RNA, 15 nt, Human
acuucuggucaauca

SEQ ID NO: 3558000 - RNA, 15 nt, Human
acuucuguaauugug

SEQ ID NO: 3558001 - RNA, 22 nt, Human
acuucugucuucacaacagauu

SEQ ID NO: 3558002 - RNA, 20 nt, Human
acuucugugagacccccaca

SEQ ID NO: 3558003 - RNA, 16 nt, Human
acuucuuaaauaucuu

SEQ ID NO: 3558004 - RNA, 19 nt, Human
acuucuuaaauaucuuuua

SEQ ID NO: 3558005 - RNA, 20 nt, Human
acuucuuaaauaucuuuuau

SEQ ID NO: 3558006 - RNA, 18 nt, Human
acuucuuauacauuugau

SEQ ID NO: 3558007 - RNA, 16 nt, Human
acuucuuauggaauug

SEQ ID NO: 3558008 - RNA, 17 nt, Human
acuucuuauggaauuga

SEQ ID NO: 3558009 - RNA, 20 nt, Human
acuucuuauggaauugauuu

SEQ ID NO: 3558010 - RNA, 17 nt, Human
acuucuuccuuucucuu

SEQ ID NO: 3558011 - RNA, 14 nt, Human
acuucuucuccauc

SEQ ID NO: 3558012 - RNA, 17 nt, Human
acuucuucuccaucccu

SEQ ID NO: 3558013 - RNA, 14 nt, Human
acuucuucuguaau

SEQ ID NO: 3558014 - RNA, 20 nt, Human
acuucuugaaggugcugacg

SEQ ID NO: 3558015 - RNA, 13 nt, Human
acuucuugaauau

SEQ ID NO: 3558016 - RNA, 13 nt, Human
acuucuugucaga

SEQ ID NO: 3558017 - RNA, 12 nt, Human
acuucuuucacu

SEQ ID NO: 3558018 - RNA, 14 nt, Human
acuucuuucuauuu

SEQ ID NO: 3558019 - RNA, 16 nt, Human
acuucuuugcuuugcc

SEQ ID NO: 3558020 - RNA, 18 nt, Human
acuucuuugcuuugccca

SEQ ID NO: 3558021 - RNA, 14 nt, Human
acuucuuuucacau

SEQ ID NO: 3558022 - RNA, 21 nt, Human
acuucuuuucacauucuuaua

SEQ ID NO: 3558023 - RNA, 21 nt, Human
acuucuuuuuucaaaagaaag

SEQ ID NO: 3558024 - RNA, 23 nt, Human
acuucuuuuuucaaaagaaaguc

SEQ ID NO: 3558025 - RNA, 11 nt, Human
acuugaaaaga

SEQ ID NO: 3558026 - RNA, 15 nt, Human
acuugaaaagagaca

SEQ ID NO: 3558027 - RNA, 22 nt, Human
acuugaaaagagacaggcaggu

SEQ ID NO: 3558028 - RNA, 16 nt, Human
acuugaaaauuaacau

SEQ ID NO: 3558029 - RNA, 18 nt, Human
acuugaaaauuaacauga

SEQ ID NO: 3558030 - RNA, 12 nt, Human
acuugaaagaaa

SEQ ID NO: 3558031 - RNA, 13 nt, Human
acuugaaagcauc

SEQ ID NO: 3558032 - RNA, 14 nt, Human
acuugaaagcaucc

SEQ ID NO: 3558033 - RNA, 18 nt, Human
acuugaaauaccagugaa

SEQ ID NO: 3558034 - RNA, 14 nt, Human
acuugaaauguuag

SEQ ID NO: 3558035 - RNA, 23 nt, Human
acuugaaauguuagucauuguua

SEQ ID NO: 3558036 - RNA, 23 nt, Human
acuugaaauuauaucuguggucu

SEQ ID NO: 3558037 - RNA, 19 nt, Human
acuugaaauuugaauuuug

SEQ ID NO: 3558038 - RNA, 17 nt, Human
acuugaacaaaaucugu

SEQ ID NO: 3558039 - RNA, 19 nt, Human
acuugaacaaaaucuguug

SEQ ID NO: 3558040 - RNA, 14 nt, Human
acuugaaccauaaa

SEQ ID NO: 3558041 - RNA, 16 nt, Human
acuugaaccauaaaau

SEQ ID NO: 3558042 - RNA, 17 nt, Human
acuugaaccauaaaaug

SEQ ID NO: 3558043 - RNA, 22 nt, Human
acuugaaccauaaaauguccag

SEQ ID NO: 3558044 - RNA, 19 nt, Human
acuugaacccgggaggcag

SEQ ID NO: 3558045 - RNA, 20 nt, Human
acuugaacccgggaggcaga

SEQ ID NO: 3558046 - RNA, 21 nt, Human
acuugaacccgggaggcagag

SEQ ID NO: 3558047 - RNA, 22 nt, Human
acuugaacccgggaggcagagg

SEQ ID NO: 3558048 - RNA, 23 nt, Human
acuugaacccgggaggcagaggu

SEQ ID NO: 3558049 - RNA, 21 nt, Human
acuugaacguuuucuaauugc

SEQ ID NO: 3558050 - RNA, 14 nt, Human
acuugaagccugcu

SEQ ID NO: 3558051 - RNA, 15 nt, Human
acuugaagggccaga

SEQ ID NO: 3558052 - RNA, 18 nt, Human
acuugaagggccagagcc

SEQ ID NO: 3558053 - RNA, 20 nt, Human
acuugaagggccagagccag

SEQ ID NO: 3558054 - RNA, 12 nt, Human
acuugaaguugu

SEQ ID NO: 3558055 - RNA, 13 nt, Human
acuugaaguuguu

SEQ ID NO: 3558056 - RNA, 20 nt, Human
acuugaaguuguuacuaacu

SEQ ID NO: 3558057 - RNA, 20 nt, Human
acuugaauaaccaucugaaa

SEQ ID NO: 3558058 - RNA, 19 nt, Human
acuugaauaauaguaugag

SEQ ID NO: 3558059 - RNA, 13 nt, Human
acuugaaugaaaa

SEQ ID NO: 3558060 - RNA, 15 nt, Human
acuugaaugugucag

SEQ ID NO: 3558061 - RNA, 20 nt, Human
acuugaauucauagaaaaag

SEQ ID NO: 3558062 - RNA, 20 nt, Human
acuugaauuuucccacugca

SEQ ID NO: 3558063 - RNA, 12 nt, Human
acuugacagugg

SEQ ID NO: 3558064 - RNA, 14 nt, Human
acuugacaguggaa

SEQ ID NO: 3558065 - RNA, 19 nt, Human
acuugacccccuugagggu

SEQ ID NO: 3558066 - RNA, 14 nt, Human
acugcuguggccag

SEQ ID NO: 3558067 - RNA, 20 nt, Human
acugcuguggccaggaggug

SEQ ID NO: 3558068 - RNA, 15 nt, Human
acugcuguuauauuu

SEQ ID NO: 3558069 - RNA, 18 nt, Human
acugcuuaacuucacaua

SEQ ID NO: 3558070 - RNA, 20 nt, Human
acugcuuaacuucacauauu

SEQ ID NO: 3558071 - RNA, 16 nt, Human
acugcuuaauucaaau

SEQ ID NO: 3558072 - RNA, 19 nt, Human
acugcuucaugacauuccu

SEQ ID NO: 3558073 - RNA, 18 nt, Human
acugcuuccagugaggcu

SEQ ID NO: 3558074 - RNA, 23 nt, Human
acugcuuccagugaggcucugcc

SEQ ID NO: 3558075 - RNA, 15 nt, Human
acugcuucccauccu

SEQ ID NO: 3558076 - RNA, 17 nt, Human
acugcuucccauccuac

SEQ ID NO: 3558077 - RNA, 17 nt, Human
acugcuuccuauaauuu

SEQ ID NO: 3558078 - RNA, 22 nt, Human
acugcuuccuauaauuuugaua

SEQ ID NO: 3558079 - RNA, 18 nt, Human
acugcuuccuuucuugau

SEQ ID NO: 3558080 - RNA, 20 nt, Human
acugcuugaugaagcaagga

SEQ ID NO: 3558081 - RNA, 13 nt, Human
acugcuuggagcu

SEQ ID NO: 3558082 - RNA, 16 nt, Human
acugcuuggagcugag

SEQ ID NO: 3558083 - RNA, 21 nt, Human
acugcuugugaaaggaaagag

SEQ ID NO: 3558084 - RNA, 16 nt, Human
acugcuuguuuccuag

SEQ ID NO: 3558085 - RNA, 17 nt, Human
acugcuuucuguuccaa

SEQ ID NO: 3558086 - RNA, 19 nt, Human
acugcuuucuguuccaaau

SEQ ID NO: 3558087 - RNA, 23 nt, Human
acugcuuucuuucguuuguuugu

SEQ ID NO: 3558088 - RNA, 23 nt, Human
acugcuuugggauuuaauuucca

SEQ ID NO: 3558089 - RNA, 14 nt, Human
acugcuuuuggucu

SEQ ID NO: 3558090 - RNA, 19 nt, Human
acuggaaaacagaacacuu

SEQ ID NO: 3558091 - RNA, 17 nt, Human
acuggaaaggggagagc

SEQ ID NO: 3558092 - RNA, 23 nt, Human
acuggaaaggggagagccugcug

SEQ ID NO: 3558093 - RNA, 16 nt, Human
acuggaacccuuuuaa

SEQ ID NO: 3558094 - RNA, 17 nt, Human
acuggaacuugaacuga

SEQ ID NO: 3558095 - RNA, 14 nt, Human
acuggaagcacagc

SEQ ID NO: 3558096 - RNA, 17 nt, Human
acuggaagcacagcuuc

SEQ ID NO: 3558097 - RNA, 19 nt, Human
acuggaagcacagcuucau

SEQ ID NO: 3558098 - RNA, 18 nt, Human
acuggaaggggaagggac

SEQ ID NO: 3558099 - RNA, 22 nt, Human
acuggaaguucauaccuaagua

SEQ ID NO: 3558100 - RNA, 14 nt, Human
acuggacagcuugu

SEQ ID NO: 3558101 - RNA, 16 nt, Human
acuggaccacugggca

SEQ ID NO: 3558102 - RNA, 20 nt, Human
acuggaccacugggcaauga

SEQ ID NO: 3558103 - RNA, 17 nt, Human
acuggacccuguugcua

SEQ ID NO: 3558104 - RNA, 19 nt, Human
acuggacccuguugcuaag

SEQ ID NO: 3558105 - RNA, 20 nt, Human
acuggacucaggaugcccag

SEQ ID NO: 3558106 - RNA, 21 nt, Human
acuggacucaggaugcccagg

SEQ ID NO: 3558107 - RNA, 20 nt, Human
acuugcagcugauguuggaa

SEQ ID NO: 3558108 - RNA, 13 nt, Human
acuugcaucugug

SEQ ID NO: 3558109 - RNA, 19 nt, Human
acuugcauugaauauauua

SEQ ID NO: 3558110 - RNA, 14 nt, Human
acuugccagaaguu

SEQ ID NO: 3558111 - RNA, 16 nt, Human
acuugcccugaccaug

SEQ ID NO: 3558112 - RNA, 21 nt, Human
acuugcccugaccaugcauuu

SEQ ID NO: 3558113 - RNA, 18 nt, Human
acuugcccugcucccucu

SEQ ID NO: 3558114 - RNA, 23 nt, Human
acuugccgcgucgcccucccagg

SEQ ID NO: 3558115 - RNA, 13 nt, Human
acuugccucugca

SEQ ID NO: 3558116 - RNA, 20 nt, Human
acuugccucuuuuaccugcu

SEQ ID NO: 3558117 - RNA, 13 nt, Human
acuugccugccuu

SEQ ID NO: 3558118 - RNA, 14 nt, Human
acuugccugccuuu

SEQ ID NO: 3558119 - RNA, 18 nt, Human
acuugccugccuuuccau

SEQ ID NO: 3558120 - RNA, 21 nt, Human
acuugccuuccuaagccugug

SEQ ID NO: 3558121 - RNA, 24 nt, Human
acuugccuuccuaagccuguggcu

SEQ ID NO: 3558122 - RNA, 20 nt, Human
acuugccuucuucacccagc

SEQ ID NO: 3558123 - RNA, 15 nt, Human
acuugccuuugaaga

SEQ ID NO: 3558124 - RNA, 14 nt, Human
acuugcuacccuga

SEQ ID NO: 3558125 - RNA, 20 nt, Human
acuugcucagguacuuguaa

SEQ ID NO: 3558126 - RNA, 16 nt, Human
acuugcucuggaccug

SEQ ID NO: 3558127 - RNA, 18 nt, Human
acuugcucuggaccugcc

SEQ ID NO: 3558128 - RNA, 14 nt, Human
acuugcucuugaug

SEQ ID NO: 3558129 - RNA, 16 nt, Human
acuugcucuugaugcc

SEQ ID NO: 3558130 - RNA, 12 nt, Human
acuugcugccuc

SEQ ID NO: 3558131 - RNA, 20 nt, Human
acuugcugcugucuuguugc

SEQ ID NO: 3558132 - RNA, 18 nt, Human
acuugcuuaaaugugaau

SEQ ID NO: 3558133 - RNA, 16 nt, Human
acuugcuuaaauuucu

SEQ ID NO: 3558134 - RNA, 18 nt, Human
acuugcuuaaauuucuua

SEQ ID NO: 3558135 - RNA, 16 nt, Human
acuugcuuauuugaca

SEQ ID NO: 3558136 - RNA, 15 nt, Human
acuugcuucucuagc

SEQ ID NO: 3558137 - RNA, 22 nt, Human
acuugcuuuaugccuucuuauu

SEQ ID NO: 3558138 - RNA, 23 nt, Human
acuuggaacugaagggggcggcc

SEQ ID NO: 3558139 - RNA, 23 nt, Human
acuuggaccagcauccuuaagua

SEQ ID NO: 3558140 - RNA, 15 nt, Human
acuuggacucuugcu

SEQ ID NO: 3558141 - RNA, 16 nt, Human
acuuggacucuugcuc

SEQ ID NO: 3558142 - RNA, 19 nt, Human
acuuggacucuugcucuuu

SEQ ID NO: 3558143 - RNA, 19 nt, Human
acuuggagccccagugcca

SEQ ID NO: 3558144 - RNA, 16 nt, Human
acuuggcaacagaagc

SEQ ID NO: 3558145 - RNA, 13 nt, Human
acuuggcagccuu

SEQ ID NO: 3558146 - RNA, 19 nt, Human
acuuggcucacacucgaca

SEQ ID NO: 3558147 - RNA, 20 nt, Human
acuugggagaccuguaauca

SEQ ID NO: 3558148 - RNA, 17 nt, Human
acuugggcacccccagc

SEQ ID NO: 3558149 - RNA, 18 nt, Human
acuuggggaaauugcuuu

SEQ ID NO: 3558150 - RNA, 21 nt, Human
acuuggggaguuaagaccugg

SEQ ID NO: 3558151 - RNA, 15 nt, Human
acuugggggcucagc

SEQ ID NO: 3558152 - RNA, 23 nt, Human
acuugggggcucagcaaggccac

SEQ ID NO: 3558153 - RNA, 19 nt, Human
acuuggggguucaggcccg

SEQ ID NO: 3558154 - RNA, 16 nt, Human
acuugguaauuguacu

SEQ ID NO: 3558155 - RNA, 20 nt, Human
acuuggucugugagaugcua

SEQ ID NO: 3558156 - RNA, 17 nt, Human
acuugguucugcuucaa

SEQ ID NO: 3558157 - RNA, 18 nt, Human
acuuguaaaggaauuuaa

SEQ ID NO: 3558158 - RNA, 14 nt, Human
acuuguaaauauaa

SEQ ID NO: 3558159 - RNA, 15 nt, Human
acuuguaaauauaaa

SEQ ID NO: 3558160 - RNA, 18 nt, Human
acuuguaaaugugguaaa

SEQ ID NO: 3558161 - RNA, 22 nt, Human
acuuguaauauuuuuauauaca

SEQ ID NO: 3558162 - RNA, 13 nt, Human
acuuguaauuaug

SEQ ID NO: 3558163 - RNA, 18 nt, Human
acuuguacaaaauaaaca

SEQ ID NO: 3558164 - RNA, 15 nt, Human
acuuguagauuugau

SEQ ID NO: 3558165 - RNA, 17 nt, Human
acuuguagcuguaaaac

SEQ ID NO: 3558166 - RNA, 21 nt, Human
acuuguagcuguaaaacgcug

SEQ ID NO: 3558167 - RNA, 16 nt, Human
acuuguaguuuagugu

SEQ ID NO: 3558168 - RNA, 20 nt, Human
acuuguauaaauguauauac

SEQ ID NO: 3558169 - RNA, 19 nt, Human
acuuguauauucuauuuua

SEQ ID NO: 3558170 - RNA, 18 nt, Human
acuuguauauuuguacaa

SEQ ID NO: 3558171 - RNA, 14 nt, Human
acuuguauauuuua

SEQ ID NO: 3558172 - RNA, 20 nt, Human
acuuguauauuuuaagaaau

SEQ ID NO: 3558173 - RNA, 15 nt, Human
acuuguauuaugugu

SEQ ID NO: 3558174 - RNA, 15 nt, Human
acuugucaaagaagg

SEQ ID NO: 3558175 - RNA, 13 nt, Human
acuugucaauauu

SEQ ID NO: 3558176 - RNA, 14 nt, Human
acuugucaauauuu

SEQ ID NO: 3558177 - RNA, 20 nt, Human
acuugucacagaugcagauu

SEQ ID NO: 3558178 - RNA, 21 nt, Human
acuugucacugacacaaagga

SEQ ID NO: 3558179 - RNA, 14 nt, Human
acuugucacuugca

SEQ ID NO: 3558180 - RNA, 17 nt, Human
acuugucacuugcaugu

SEQ ID NO: 3558181 - RNA, 23 nt, Human
acuugucaggguauaaaaugaca

SEQ ID NO: 3558182 - RNA, 20 nt, Human
acuugucauauguagccuuc

SEQ ID NO: 3558183 - RNA, 23 nt, Human
acuugucauuguuauauaaucau

SEQ ID NO: 3558184 - RNA, 18 nt, Human
acuugucccacuaucugg

SEQ ID NO: 3558185 - RNA, 17 nt, Human
acuuguccccaaauccg

SEQ ID NO: 3558186 - RNA, 21 nt, Human
acuuguccuuagccuggaccu

SEQ ID NO: 3558187 - RNA, 22 nt, Human
acuugucuaaauaaguuugcaa

SEQ ID NO: 3558188 - RNA, 19 nt, Human
acuugucucauuuuaaugu

SEQ ID NO: 3558189 - RNA, 13 nt, Human
acuugucuuucug

SEQ ID NO: 3558190 - RNA, 14 nt, Human
acuugucuuucugg

SEQ ID NO: 3558191 - RNA, 17 nt, Human
acuugugaaacacagcu

SEQ ID NO: 3558192 - RNA, 18 nt, Human
acuugugaaacacagcug

SEQ ID NO: 3558193 - RNA, 12 nt, Human
acuugugaaugc

SEQ ID NO: 3558194 - RNA, 17 nt, Human
acuugugaaugcuucuc

SEQ ID NO: 3558195 - RNA, 17 nt, Human
acuugugacuuuugcuu

SEQ ID NO: 3558196 - RNA, 21 nt, Human
acuugugcccucccuguccuu

SEQ ID NO: 3558197 - RNA, 16 nt, Human
acuuguggacacagcu

SEQ ID NO: 3558198 - RNA, 19 nt, Human
acuuguggacacagcucuu

SEQ ID NO: 3558199 - RNA, 22 nt, Human
acuuguggacacagcucuucuc

SEQ ID NO: 3558200 - RNA, 19 nt, Human
acuuguggacuaaaagaua

SEQ ID NO: 3558201 - RNA, 21 nt, Human
acuuguucuuccaaagcagag

SEQ ID NO: 3558202 - RNA, 19 nt, Human
acuuguugauuaauggaaa

SEQ ID NO: 3558203 - RNA, 21 nt, Human
acuuguugauuaauggaaaug

SEQ ID NO: 3558204 - RNA, 18 nt, Human
acuuguuguuuaauguuu

SEQ ID NO: 3558205 - RNA, 13 nt, Human
acuuguuuaauaa

SEQ ID NO: 3558206 - RNA, 14 nt, Human
acuuguuuaauaaa

SEQ ID NO: 3558207 - RNA, 19 nt, Human
acuuguuucucuguuguaa

SEQ ID NO: 3558208 - RNA, 16 nt, Human
acuuguuucugaucua

SEQ ID NO: 3558209 - RNA, 18 nt, Human
acuuguuuucaaaccagu

SEQ ID NO: 3558210 - RNA, 16 nt, Human
acuuguuuucugggaa

SEQ ID NO: 3558211 - RNA, 12 nt, Human
acuuuaaaagug

SEQ ID NO: 3558212 - RNA, 15 nt, Human
acuuuaaaauaaaau

SEQ ID NO: 3558213 - RNA, 15 nt, Human
acuuuaagagagaaa

SEQ ID NO: 3558214 - RNA, 16 nt, Human
acuuuaauauguauuu

SEQ ID NO: 3558215 - RNA, 22 nt, Human
acuuuaauuaccaaccuguuac

SEQ ID NO: 3558216 - RNA, 19 nt, Human
acuuuacaauguucauccc

SEQ ID NO: 3558217 - RNA, 20 nt, Human
acuuuacaauguucauccca

SEQ ID NO: 3558218 - RNA, 20 nt, Human
acuuuacacaauagaauuau

SEQ ID NO: 3558219 - RNA, 18 nt, Human
acuuuacacucggcuuug

SEQ ID NO: 3558220 - RNA, 15 nt, Human
acuuuacaugacaca

SEQ ID NO: 3558221 - RNA, 18 nt, Human
acuuuacaugacacagcu

SEQ ID NO: 3558222 - RNA, 20 nt, Human
acuuuacaugacacagcuuu

SEQ ID NO: 3558223 - RNA, 17 nt, Human
acuuuacccaaaaacua

SEQ ID NO: 3558224 - RNA, 18 nt, Human
acuuuacccaccuagaac

SEQ ID NO: 3558225 - RNA, 14 nt, Human
acugguccugugug

SEQ ID NO: 3558226 - RNA, 13 nt, Human
acuggucugcugu

SEQ ID NO: 3558227 - RNA, 12 nt, Human
acuggugacugc

SEQ ID NO: 3558228 - RNA, 13 nt, Human
acuggugauauau

SEQ ID NO: 3558229 - RNA, 18 nt, Human
acuggugcacuuuguaaa

SEQ ID NO: 3558230 - RNA, 20 nt, Human
acuggugcacuuuguaaauu

SEQ ID NO: 3558231 - RNA, 13 nt, Human
acuggugcccucc

SEQ ID NO: 3558232 - RNA, 20 nt, Human
acugguggcccgacagccug

SEQ ID NO: 3558233 - RNA, 23 nt, Human
acugguggcccgacagccuggca

SEQ ID NO: 3558234 - RNA, 14 nt, Human
acugguguccagcu

SEQ ID NO: 3558235 - RNA, 21 nt, Human
acuggugugaccugagggcag

SEQ ID NO: 3558236 - RNA, 12 nt, Human
acugguucucaa

SEQ ID NO: 3558237 - RNA, 13 nt, Human
acugguugcaugg

SEQ ID NO: 3558238 - RNA, 15 nt, Human
acugguugcauggaa

SEQ ID NO: 3558239 - RNA, 14 nt, Human
acugguuugagauu

SEQ ID NO: 3558240 - RNA, 17 nt, Human
acugguuuguucccugu

SEQ ID NO: 3558241 - RNA, 14 nt, Human
acugguuuucacau

SEQ ID NO: 3558242 - RNA, 15 nt, Human
acugguuuucugcca

SEQ ID NO: 3558243 - RNA, 15 nt, Human
acuguaaaaugcaaa

SEQ ID NO: 3558244 - RNA, 16 nt, Human
acuguaaaaugcaaaa

SEQ ID NO: 3558245 - RNA, 19 nt, Human
acuguaaaaugcaaaaaau

SEQ ID NO: 3558246 - RNA, 21 nt, Human
acuguaaaaugcaaaaaaucu

SEQ ID NO: 3558247 - RNA, 13 nt, Human
acuguaaagaaag

SEQ ID NO: 3558248 - RNA, 14 nt, Human
acuguaaagaaaga

SEQ ID NO: 3558249 - RNA, 19 nt, Human
acuguaaagaaagagagaa

SEQ ID NO: 3558250 - RNA, 20 nt, Human
acuguaaagaaagagagaaa

SEQ ID NO: 3558251 - RNA, 20 nt, Human
acuguaacacuuuacaaugu

SEQ ID NO: 3558252 - RNA, 22 nt, Human
acuugauggucagacacaaaca

SEQ ID NO: 3558253 - RNA, 23 nt, Human
acuugauuaagauuuuacaaaag

SEQ ID NO: 3558254 - RNA, 17 nt, Human
acuugauuugagauuuu

SEQ ID NO: 3558255 - RNA, 23 nt, Human
acuugcaaaaagggucaguaugg

SEQ ID NO: 3558256 - RNA, 17 nt, Human
acuugcaaaaucaguuu

SEQ ID NO: 3558257 - RNA, 19 nt, Human
acuugcacgcccaugugug

SEQ ID NO: 3558258 - RNA, 22 nt, Human
acuugcagacucuacagaggcc

SEQ ID NO: 3558259 - RNA, 23 nt, Human
acuugcagacucuacagaggcca

SEQ ID NO: 3558260 - RNA, 14 nt, Human
acuugcaucacuua

SEQ ID NO: 3558261 - RNA, 12 nt, Human
acuugcaugucc

SEQ ID NO: 3558262 - RNA, 19 nt, Human
acuugcaugucccaucacg

SEQ ID NO: 3558263 - RNA, 14 nt, Human
acuugcauuuuugc

SEQ ID NO: 3558264 - RNA, 20 nt, Human
acuugccagaaguuguggau

SEQ ID NO: 3558265 - RNA, 21 nt, Human
acuugccaugugacucuggcu

SEQ ID NO: 3558266 - RNA, 22 nt, Human
acuugccaugugacucuggcuu

SEQ ID NO: 3558267 - RNA, 21 nt, Human
acuugcccacaccgagggcga

SEQ ID NO: 3558268 - RNA, 20 nt, Human
acuugcccugaccaugcauu

SEQ ID NO: 3558269 - RNA, 15 nt, Human
acuugcccugcuccc

SEQ ID NO: 3558270 - RNA, 16 nt, Human
acuugcccugcucccu

SEQ ID NO: 3558271 - RNA, 12 nt, Human
acuugccucuuc

SEQ ID NO: 3558272 - RNA, 21 nt, Human
acuugccucuuuuaccugcug

SEQ ID NO: 3558273 - RNA, 14 nt, Human
acuugccuuugaag

SEQ ID NO: 3558274 - RNA, 16 nt, Human
acuugccuuugaagag

SEQ ID NO: 3558275 - RNA, 16 nt, Human
agaaagggccaggaga

SEQ ID NO: 3558276 - RNA, 20 nt, Human
agaaagggccaggagaugga

SEQ ID NO: 3558277 - RNA, 23 nt, Human
agaaagggcccugggccugccuc

SEQ ID NO: 3558278 - RNA, 16 nt, Human
agaaaggggagcccac

SEQ ID NO: 3558279 - RNA, 20 nt, Human
agaaaggggcaguuuaaagc

SEQ ID NO: 3558280 - RNA, 17 nt, Human
agaaaggguguuuuucu

SEQ ID NO: 3558281 - RNA, 16 nt, Human
agaaagguucugcccg

SEQ ID NO: 3558282 - RNA, 17 nt, Human
agaaaguaaauaaaagg

SEQ ID NO: 3558283 - RNA, 22 nt, Human
agaaaguaaggugcuuggaguu

SEQ ID NO: 3558284 - RNA, 23 nt, Human
agaaaguacuucuccacccugcu

SEQ ID NO: 3558285 - RNA, 14 nt, Human
agaaagugagcagu

SEQ ID NO: 3558286 - RNA, 22 nt, Human
agaaagugccugacacacuaac

SEQ ID NO: 3558287 - RNA, 20 nt, Human
agaaaguggaaaacaaggaa

SEQ ID NO: 3558288 - RNA, 18 nt, Human
agaaagugggaggucagg

SEQ ID NO: 3558289 - RNA, 21 nt, Human
agaaagugggugagaugcugg

SEQ ID NO: 3558290 - RNA, 19 nt, Human
agaaaguggucuuaagaaa

SEQ ID NO: 3558291 - RNA, 13 nt, Human
agaaaguguaaau

SEQ ID NO: 3558292 - RNA, 13 nt, Human
agaaaguguauuu

SEQ ID NO: 3558293 - RNA, 23 nt, Human
agaaagugugagcaaacuaacuu

SEQ ID NO: 3558294 - RNA, 15 nt, Human
agaaagugugcuuua

SEQ ID NO: 3558295 - RNA, 18 nt, Human
agaaaguguucuguuaca

SEQ ID NO: 3558296 - RNA, 11 nt, Human
agaaaguuauu

SEQ ID NO: 3558297 - RNA, 23 nt, Human
agaaaguuauugauaaguucaua

SEQ ID NO: 3558298 - RNA, 14 nt, Human
agaaaguucaugcu

SEQ ID NO: 3558299 - RNA, 12 nt, Human
agaaaguugauu

SEQ ID NO: 3558300 - RNA, 22 nt, Human
agaaaguugcaaggcaaauguu

SEQ ID NO: 3558301 - RNA, 15 nt, Human
agaaauaaaacuguu

SEQ ID NO: 3558302 - RNA, 17 nt, Human
agaaauaaaaggaagcc

SEQ ID NO: 3558303 - RNA, 19 nt, Human
agaaauaagugcccucucc

SEQ ID NO: 3558304 - RNA, 22 nt, Human
agaaauaagugguuauuucuca

SEQ ID NO: 3558305 - RNA, 13 nt, Human
agaaauaaguuuu

SEQ ID NO: 3558306 - RNA, 14 nt, Human
agaaauaaguuuuu

SEQ ID NO: 3558307 - RNA, 14 nt, Human
agaaauaauaaaaa

SEQ ID NO: 3558308 - RNA, 16 nt, Human
agaaauaauaugcauu

SEQ ID NO: 3558309 - RNA, 19 nt, Human
agaaauaaugucaaaaaua

SEQ ID NO: 3558310 - RNA, 18 nt, Human
agaaauacagauaaauga

SEQ ID NO: 3558311 - RNA, 20 nt, Human
agaaauacagauaaaugauu

SEQ ID NO: 3558312 - RNA, 16 nt, Human
agaaauacagauuuug

SEQ ID NO: 3558313 - RNA, 21 nt, Human
agaaauacagauuuugauagc

SEQ ID NO: 3558314 - RNA, 13 nt, Human
agaaauacuguac

SEQ ID NO: 3558315 - RNA, 14 nt, Human
agaaauagacaaaa

SEQ ID NO: 3558316 - RNA, 17 nt, Human
agaaauagacaaaaagu

SEQ ID NO: 3558317 - RNA, 21 nt, Human
agaaauagacaaaaaguauau

SEQ ID NO: 3558318 - RNA, 19 nt, Human
agaaauagcuccguggagc

SEQ ID NO: 3558319 - RNA, 15 nt, Human
agaaauagucgguga

SEQ ID NO: 3558320 - RNA, 18 nt, Human
agaaauauaacacauuuu

SEQ ID NO: 3558321 - RNA, 16 nt, Human
agaaauauauauacau

SEQ ID NO: 3558322 - RNA, 17 nt, Human
agaaauauauauacaua

SEQ ID NO: 3558323 - RNA, 20 nt, Human
agaaauauauauacauaugu

SEQ ID NO: 3558324 - RNA, 19 nt, Human
agaaauaucugaaaaugua

SEQ ID NO: 3558325 - RNA, 19 nt, Human
agaaauaucugugaaauau

SEQ ID NO: 3558326 - RNA, 20 nt, Human
agaaauaucuucacuuguca

SEQ ID NO: 3558327 - RNA, 21 nt, Human
agaaauaugcacaauagcagu

SEQ ID NO: 3558328 - RNA, 16 nt, Human
agaaauaugugagauu

SEQ ID NO: 3558329 - RNA, 14 nt, Human
agaaauaugugguu

SEQ ID NO: 3558330 - RNA, 17 nt, Human
agaaauauuaagcaugu

SEQ ID NO: 3558331 - RNA, 20 nt, Human
agaaauauuugugacaaaaa

SEQ ID NO: 3558332 - RNA, 21 nt, Human
agaaauauuuuaaaaucagcu

SEQ ID NO: 3558333 - RNA, 21 nt, Human
agaaauauuuuaauuuuuaaa

SEQ ID NO: 3558334 - RNA, 23 nt, Human
agaaauauuuuaauuuuuaaaug

SEQ ID NO: 3558335 - RNA, 17 nt, Human
agaaaucaaagagagaa

SEQ ID NO: 3558336 - RNA, 19 nt, Human
agaaaucaaguaaugaauc

SEQ ID NO: 3558337 - RNA, 14 nt, Human
agaaaucauguuau

SEQ ID NO: 3558338 - RNA, 21 nt, Human
agaaaucauuuggguuaauau

SEQ ID NO: 3558339 - RNA, 17 nt, Human
agaaaucauuuugcaau

SEQ ID NO: 3558340 - RNA, 22 nt, Human
agaaaucauuuugcaaucccuu

SEQ ID NO: 3558341 - RNA, 14 nt, Human
agaaaucuagaaga

SEQ ID NO: 3558342 - RNA, 21 nt, Human
agaaaucuauagaaaguguuc

SEQ ID NO: 3558343 - RNA, 13 nt, Human
agaaaucuauuuc

SEQ ID NO: 3558344 - RNA, 18 nt, Human
agaaaucucacuuuucuc

SEQ ID NO: 3558345 - RNA, 16 nt, Human
agaaaugaaaaaauau

SEQ ID NO: 3558346 - RNA, 17 nt, Human
agaaaugaaaaaauaua

SEQ ID NO: 3558347 - RNA, 18 nt, Human
agaaaugaaaaaauauau

SEQ ID NO: 3558348 - RNA, 18 nt, Human
agaaaugaaauuuuacca

SEQ ID NO: 3558349 - RNA, 13 nt, Human
agaaaugaacauu

SEQ ID NO: 3558350 - RNA, 12 nt, Human
agaaaugaauaa

SEQ ID NO: 3558351 - RNA, 23 nt, Human
agaaaugacuuugaaaaccuggc

SEQ ID NO: 3558352 - RNA, 17 nt, Human
agaaaugagaucaggcu

SEQ ID NO: 3558353 - RNA, 22 nt, Human
agaaaugaggaggaugcuaaaa

SEQ ID NO: 3558354 - RNA, 16 nt, Human
agaaaugcaaauucuc

SEQ ID NO: 3558355 - RNA, 18 nt, Human
agaaaugcaaauucucaa

SEQ ID NO: 3558356 - RNA, 12 nt, Human
agaaaugcagaa

SEQ ID NO: 3558357 - RNA, 16 nt, Human
agaaaugcauauugua

SEQ ID NO: 3558358 - RNA, 14 nt, Human
agaaaugccaagca

SEQ ID NO: 3558359 - RNA, 22 nt, Human
agaaaugccaagcacuucuuuu

SEQ ID NO: 3558360 - RNA, 15 nt, Human
agaaaugccuuaccc

SEQ ID NO: 3558361 - RNA, 22 nt, Human
agaaaugcugccugccugucug

SEQ ID NO: 3558362 - RNA, 13 nt, Human
agaaaugcugcug

SEQ ID NO: 3558363 - RNA, 14 nt, Human
agaaaugcugcugg

SEQ ID NO: 3558364 - RNA, 21 nt, Human
agaaaugcugguuuuucaguu

SEQ ID NO: 3558365 - RNA, 15 nt, Human
agaaaugcuuagaaa

SEQ ID NO: 3558366 - RNA, 16 nt, Human
agaaauggaaauuuug

SEQ ID NO: 3558367 - RNA, 21 nt, Human
agaaaugggaaaugccuaaga

SEQ ID NO: 3558368 - RNA, 16 nt, Human
agaaauggugaaaaua

SEQ ID NO: 3558369 - RNA, 20 nt, Human
agaaaugguuguauuagaug

SEQ ID NO: 3558370 - RNA, 21 nt, Human
agaaaugguuguauuagaugu

SEQ ID NO: 3558371 - RNA, 22 nt, Human
agaaaugguuguauuagauguu

SEQ ID NO: 3558372 - RNA, 18 nt, Human
agaaauguaaacugccau

SEQ ID NO: 3558373 - RNA, 17 nt, Human
agaaauguacagcaagg

SEQ ID NO: 3558374 - RNA, 10 nt, Human
agaaauguag

SEQ ID NO: 3558375 - RNA, 20 nt, Human
agaaaugucuaaaugcugaa

SEQ ID NO: 3558376 - RNA, 17 nt, Human
agaaaugucuggagaau

SEQ ID NO: 3558377 - RNA, 19 nt, Human
agaaaugucuggagaauaa

SEQ ID NO: 3558378 - RNA, 12 nt, Human
agaaauuaacuu

SEQ ID NO: 3558379 - RNA, 15 nt, Human
agaaauuagccgggc

SEQ ID NO: 3558380 - RNA, 15 nt, Human
agaaauuagcugugu

SEQ ID NO: 3558381 - RNA, 13 nt, Human
agaaauuagggcu

SEQ ID NO: 3558382 - RNA, 20 nt, Human
agaaauuagggcucuaauuu

SEQ ID NO: 3558383 - RNA, 14 nt, Human
agaaauuauuuaau

SEQ ID NO: 3558384 - RNA, 16 nt, Human
agaaauuauuuaauaa

SEQ ID NO: 3558385 - RNA, 19 nt, Human
agaaauucaauuuggauuu

SEQ ID NO: 3558386 - RNA, 24 nt, Human
agaaauucccuggaccagaugcug

SEQ ID NO: 3558387 - RNA, 13 nt, Human
agaaauuccugua

SEQ ID NO: 3558388 - RNA, 20 nt, Human
agaaauuccuguagcaucuu

SEQ ID NO: 3558389 - RNA, 20 nt, Human
agaaauucguguguuuuuuu

SEQ ID NO: 3558390 - RNA, 11 nt, Human
agaaauucugu

SEQ ID NO: 3558391 - RNA, 21 nt, Human
agaaauucugucauagaaagu

SEQ ID NO: 3558392 - RNA, 18 nt, Human
agaaauucuguuaaaauc

SEQ ID NO: 3558393 - RNA, 21 nt, Human
agaaauucuguuuuuaaaaau

SEQ ID NO: 3558394 - RNA, 17 nt, Human
agaaauugcauuuccug

SEQ ID NO: 3558395 - RNA, 20 nt, Human
agaaauugccuauccugcug

SEQ ID NO: 3558396 - RNA, 19 nt, Human
acccuguuuggauuuuuaa

SEQ ID NO: 3558397 - RNA, 13 nt, Human
acccuuacaguag

SEQ ID NO: 3558398 - RNA, 19 nt, Human
acccuuacaguaggagccc

SEQ ID NO: 3558399 - RNA, 22 nt, Human
acccuuaccaugugccugaucc

SEQ ID NO: 3558400 - RNA, 22 nt, Human
acccuuaccccuuagccucccu

SEQ ID NO: 3558401 - RNA, 13 nt, Human
acccuuagaaucc

SEQ ID NO: 3558402 - RNA, 17 nt, Human
acccuuauugcuguccu

SEQ ID NO: 3558403 - RNA, 19 nt, Human
acccuuauugcuguccugg

SEQ ID NO: 3558404 - RNA, 21 nt, Human
acccuucaacguuucuucacu

SEQ ID NO: 3558405 - RNA, 22 nt, Human
acccuucaacguuucuucacuu

SEQ ID NO: 3558406 - RNA, 19 nt, Human
acccuucaucuuccugugu

SEQ ID NO: 3558407 - RNA, 13 nt, Human
acccuuccagaca

SEQ ID NO: 3558408 - RNA, 22 nt, Human
acccuuccccuccuucucccuu

SEQ ID NO: 3558409 - RNA, 19 nt, Human
acccuucccuugagcccuc

SEQ ID NO: 3558410 - RNA, 20 nt, Human
acccuucccuugagcccucu

SEQ ID NO: 3558411 - RNA, 11 nt, Human
acccuuccuuc

SEQ ID NO: 3558412 - RNA, 16 nt, Human
acccuucucccacucu

SEQ ID NO: 3558413 - RNA, 14 nt, Human
acccuucugugccc

SEQ ID NO: 3558414 - RNA, 16 nt, Human
acccuucugugcccag

SEQ ID NO: 3558415 - RNA, 17 nt, Human
acccuucugugcccagc

SEQ ID NO: 3558416 - RNA, 17 nt, Human
acccuucuucauguuca

SEQ ID NO: 3558417 - RNA, 22 nt, Human
acccuucuucauguucaauuau

SEQ ID NO: 3558418 - RNA, 15 nt, Human
acccuucuuuccucu

SEQ ID NO: 3558419 - RNA, 16 nt, Human
acccuucuuuccucuu

SEQ ID NO: 3558420 - RNA, 11 nt, Human
acccuugacac

SEQ ID NO: 3558421 - RNA, 16 nt, Human
acccuugcccacccca

SEQ ID NO: 3558422 - RNA, 17 nt, Human
acccuugcccaccccac

SEQ ID NO: 3558423 - RNA, 15 nt, Human
acccuuggacuugag

SEQ ID NO: 3558424 - RNA, 13 nt, Human
acccuuggccugu

SEQ ID NO: 3558425 - RNA, 17 nt, Human
acccuuggcucaauccu

SEQ ID NO: 3558426 - RNA, 16 nt, Human
acccuugggccagaag

SEQ ID NO: 3558427 - RNA, 17 nt, Human
acccuugguuccuaacu

SEQ ID NO: 3558428 - RNA, 19 nt, Human
acccuuuccuuccuucccu

SEQ ID NO: 3558429 - RNA, 23 nt, Human
acccuuuccuuccuucccuggcu

SEQ ID NO: 3558430 - RNA, 19 nt, Human
acccuuucuacuuccaaga

SEQ ID NO: 3558431 - RNA, 12 nt, Human
acccuuugcccc

SEQ ID NO: 3558432 - RNA, 13 nt, Human
acccuuugggggu

SEQ ID NO: 3558433 - RNA, 21 nt, Human
acccuuugguuuuuuucuucu

SEQ ID NO: 3558434 - RNA, 15 nt, Human
agaacacccucuaaa

SEQ ID NO: 3558435 - RNA, 12 nt, Human
agaacacuaacc

SEQ ID NO: 3558436 - RNA, 18 nt, Human
agaacacuaacucaccag

SEQ ID NO: 3558437 - RNA, 20 nt, Human
agaacacuaacucaccagcc

SEQ ID NO: 3558438 - RNA, 19 nt, Human
agaacacuaauucauaauc

SEQ ID NO: 3558439 - RNA, 22 nt, Human
agaacacuauuuucagaaucug

SEQ ID NO: 3558440 - RNA, 13 nt, Human
agaacacugccaa

SEQ ID NO: 3558441 - RNA, 17 nt, Human
agaacacugugaaaaca

SEQ ID NO: 3558442 - RNA, 12 nt, Human
agaacagaaaac

SEQ ID NO: 3558443 - RNA, 22 nt, Human
agaacagaaaacaacaaaaaau

SEQ ID NO: 3558444 - RNA, 16 nt, Human
agaacagacuggccug

SEQ ID NO: 3558445 - RNA, 13 nt, Human
agaacagcagagg

SEQ ID NO: 3558446 - RNA, 17 nt, Human
agaacagcaggcccacc

SEQ ID NO: 3558447 - RNA, 23 nt, Human
agaacagcaggguagucugguuu

SEQ ID NO: 3558448 - RNA, 20 nt, Human
agaacagccgcuccugucug

SEQ ID NO: 3558449 - RNA, 12 nt, Human
agaacagcuuca

SEQ ID NO: 3558450 - RNA, 13 nt, Human
agaacagcuucag

SEQ ID NO: 3558451 - RNA, 14 nt, Human
agaacagcuucagg

SEQ ID NO: 3558452 - RNA, 18 nt, Human
agaacagcuucagguuau

SEQ ID NO: 3558453 - RNA, 22 nt, Human
agaacagcuucagguuaucgaa

SEQ ID NO: 3558454 - RNA, 11 nt, Human
agaacaggacu

SEQ ID NO: 3558455 - RNA, 12 nt, Human
agaacaggacua

SEQ ID NO: 3558456 - RNA, 22 nt, Human
agaacagggaaaauaggcagga

SEQ ID NO: 3558457 - RNA, 23 nt, Human
agaacagguguuggugacaauug

SEQ ID NO: 3558458 - RNA, 17 nt, Human
agaacagguuuuuuugu

SEQ ID NO: 3558459 - RNA, 21 nt, Human
agaacagguuuuuuuguuugu

SEQ ID NO: 3558460 - RNA, 14 nt, Human
agaacaguaugaau

SEQ ID NO: 3558461 - RNA, 17 nt, Human
agaacaguaugaauuug

SEQ ID NO: 3558462 - RNA, 20 nt, Human
agaacaguaugaauuugagc

SEQ ID NO: 3558463 - RNA, 22 nt, Human
agaacagugauuaccagggacu

SEQ ID NO: 3558464 - RNA, 22 nt, Human
agaacaguggaaacuauguguu

SEQ ID NO: 3558465 - RNA, 17 nt, Human
agaacaguuaagcagcc

SEQ ID NO: 3558466 - RNA, 20 nt, Human
agaacaguuaagcagccgcc

SEQ ID NO: 3558467 - RNA, 15 nt, Human
agaacaguuuguaca

SEQ ID NO: 3558468 - RNA, 21 nt, Human
agaacauagacagaagaaaca

SEQ ID NO: 3558469 - RNA, 15 nt, Human
agaacaucauuagaa

SEQ ID NO: 3558470 - RNA, 18 nt, Human
agaacaucauuagaacaa

SEQ ID NO: 3558471 - RNA, 15 nt, Human
agaacauccaaggag

SEQ ID NO: 3558472 - RNA, 18 nt, Human
agaacauccaaggagaaa

SEQ ID NO: 3558473 - RNA, 17 nt, Human
agaacaucccuccuggg

SEQ ID NO: 3558474 - RNA, 17 nt, Human
agaacaucccugccagc

SEQ ID NO: 3558475 - RNA, 19 nt, Human
agaacaucccugccagcuc

SEQ ID NO: 3558476 - RNA, 17 nt, Human
agaacaugcaguuugaa

SEQ ID NO: 3558477 - RNA, 18 nt, Human
agaacaugcaguuugaaa

SEQ ID NO: 3558478 - RNA, 19 nt, Human
agaacaugcaguuugaaau

SEQ ID NO: 3558479 - RNA, 22 nt, Human
agaacaugcaguuugaaauucu

SEQ ID NO: 3558480 - RNA, 19 nt, Human
agaacauggacuuguauau

SEQ ID NO: 3558481 - RNA, 14 nt, Human
agaacauguagaaa

SEQ ID NO: 3558482 - RNA, 17 nt, Human
agaacauguagaaaaca

SEQ ID NO: 3558483 - RNA, 22 nt, Human
agaacaugugagagguuugacu

SEQ ID NO: 3558484 - RNA, 16 nt, Human
agaacauguugguauu

SEQ ID NO: 3558485 - RNA, 22 nt, Human
agaacauguugguauuuaucua

SEQ ID NO: 3558486 - RNA, 16 nt, Human
agaacauuuuaauuca

SEQ ID NO: 3558487 - RNA, 20 nt, Human
agaaccaaaaguuuuccuga

SEQ ID NO: 3558488 - RNA, 16 nt, Human
agaaccaaagaagaaa

SEQ ID NO: 3558489 - RNA, 19 nt, Human
agaaccaaagaagaaaguc

SEQ ID NO: 3558490 - RNA, 13 nt, Human
agaaccaaauuaa

SEQ ID NO: 3558491 - RNA, 16 nt, Human
agaaccacacuugaaa

SEQ ID NO: 3558492 - RNA, 19 nt, Human
agaaccacacuugaaaccu

SEQ ID NO: 3558493 - RNA, 20 nt, Human
agaaccacacuugaaaccuu

SEQ ID NO: 3558494 - RNA, 21 nt, Human
agaaccacacuugaaaccuuu

SEQ ID NO: 3558495 - RNA, 22 nt, Human
agaaccaccccggcccccugcc

SEQ ID NO: 3558496 - RNA, 20 nt, Human
agaaccagccauauacacuu

SEQ ID NO: 3558497 - RNA, 20 nt, Human
agaaccaggcaacuugggaa

SEQ ID NO: 3558498 - RNA, 16 nt, Human
agaaccaggcuacaag

SEQ ID NO: 3558499 - RNA, 16 nt, Human
agaaccagucccccca

SEQ ID NO: 3558500 - RNA, 20 nt, Human
agaaccaguccccccacccu

SEQ ID NO: 3558501 - RNA, 14 nt, Human
agaacccagggcuc

SEQ ID NO: 3558502 - RNA, 19 nt, Human
agaacccagggcucugccc

SEQ ID NO: 3558503 - RNA, 22 nt, Human
agaacccagggcucugccccag

SEQ ID NO: 3558504 - RNA, 21 nt, Human
agaacccauggaaaaaugcca

SEQ ID NO: 3558505 - RNA, 23 nt, Human
agaacccugccauggaacuguuu

SEQ ID NO: 3558506 - RNA, 20 nt, Human
agaacccugcguggggacag

SEQ ID NO: 3558507 - RNA, 20 nt, Human
agaacccuuggcuugcccac

SEQ ID NO: 3558508 - RNA, 15 nt, Human
agaaccuaacuguau

SEQ ID NO: 3558509 - RNA, 19 nt, Human
agaaccuaacuguaucuug

SEQ ID NO: 3558510 - RNA, 13 nt, Human
agaaccucuuccc

SEQ ID NO: 3558511 - RNA, 22 nt, Human
agaaccucuuugucuacaccau

SEQ ID NO: 3558512 - RNA, 13 nt, Human
agaaccuggaacu

SEQ ID NO: 3558513 - RNA, 21 nt, Human
agaaccuggaacuuggggagu

SEQ ID NO: 3558514 - RNA, 15 nt, Human
agaaccuggaagggc

SEQ ID NO: 3558515 - RNA, 16 nt, Human
agaaccuggaagggcu

SEQ ID NO: 3558516 - RNA, 13 nt, Human
agaaccuggccuu

SEQ ID NO: 3558517 - RNA, 22 nt, Human
agaaccuggccuucaguguacc

SEQ ID NO: 3558518 - RNA, 21 nt, Human
agaaccuguccuugcacacuc

SEQ ID NO: 3558519 - RNA, 19 nt, Human
agaaccuugccugaacauc

SEQ ID NO: 3558520 - RNA, 23 nt, Human
agaaccuugugccuggcucagag

SEQ ID NO: 3558521 - RNA, 22 nt, Human
agaacgccagggaccccagaau

SEQ ID NO: 3558522 - RNA, 13 nt, Human
agaacggaagaag

SEQ ID NO: 3558523 - RNA, 19 nt, Human
agaacggggcucuucucau

SEQ ID NO: 3558524 - RNA, 17 nt, Human
agaacguggcucugcug

SEQ ID NO: 3558525 - RNA, 16 nt, Human
agaacguuuuuuccuc

SEQ ID NO: 3558526 - RNA, 19 nt, Human
agaacuaaacuaguuuuuc

SEQ ID NO: 3558527 - RNA, 18 nt, Human
agaacuaaacucauuuau

SEQ ID NO: 3558528 - RNA, 18 nt, Human
agaacuaaagguggccac

SEQ ID NO: 3558529 - RNA, 16 nt, Human
agaacuaaauguucua

SEQ ID NO: 3558530 - RNA, 18 nt, Human
agaacuaccaccugacau

SEQ ID NO: 3558531 - RNA, 19 nt, Human
agaacuacucagggaauga

SEQ ID NO: 3558532 - RNA, 21 nt, Human
agaacuagccaaaccaggacc

SEQ ID NO: 3558533 - RNA, 16 nt, Human
agaacuauaugugaau

SEQ ID NO: 3558534 - RNA, 21 nt, Human
agaacuauugugcucagagac

SEQ ID NO: 3558535 - RNA, 17 nt, Human
agaacucaguuuuaacu

SEQ ID NO: 3558536 - RNA, 15 nt, Human
agaacuccaggcccu

SEQ ID NO: 3558537 - RNA, 14 nt, Human
agaacucccuuuca

SEQ ID NO: 3558538 - RNA, 17 nt, Human
agaacucccuuucaaca

SEQ ID NO: 3558539 - RNA, 15 nt, Human
agaacuccugacugu

SEQ ID NO: 3558540 - RNA, 21 nt, Human
accguguugguuuugacugga

SEQ ID NO: 3558541 - RNA, 13 nt, Human
accguugucucau

SEQ ID NO: 3558542 - RNA, 17 nt, Human
accuaaaaaaagagaau

SEQ ID NO: 3558543 - RNA, 13 nt, Human
accuaaaaaagau

SEQ ID NO: 3558544 - RNA, 13 nt, Human
accuaaaagagau

SEQ ID NO: 3558545 - RNA, 21 nt, Human
accuaaaauuugcccucccau

SEQ ID NO: 3558546 - RNA, 22 nt, Human
accuaaaauuugcccucccauc

SEQ ID NO: 3558547 - RNA, 15 nt, Human
accuaaacagauaua

SEQ ID NO: 3558548 - RNA, 13 nt, Human
accuaaagaaaaa

SEQ ID NO: 3558549 - RNA, 20 nt, Human
accuaaagguguauuuaaac

SEQ ID NO: 3558550 - RNA, 16 nt, Human
accuaaauaaccaauc

SEQ ID NO: 3558551 - RNA, 13 nt, Human
accuaaaugaaua

SEQ ID NO: 3558552 - RNA, 12 nt, Human
accuaacauucg

SEQ ID NO: 3558553 - RNA, 13 nt, Human
accuaacccagaa

SEQ ID NO: 3558554 - RNA, 16 nt, Human
accuaaccccuuuccu

SEQ ID NO: 3558555 - RNA, 17 nt, Human
accuaaccccuuuccug

SEQ ID NO: 3558556 - RNA, 12 nt, Human
accuaaccugug

SEQ ID NO: 3558557 - RNA, 17 nt, Human
accuaaccugugucugc

SEQ ID NO: 3558558 - RNA, 21 nt, Human
accuaacucaccuaacucaua

SEQ ID NO: 3558559 - RNA, 17 nt, Human
accuaacucuucuuuca

SEQ ID NO: 3558560 - RNA, 15 nt, Human
accuaaguacuguaa

SEQ ID NO: 3558561 - RNA, 16 nt, Human
accuaagucucuguga

SEQ ID NO: 3558562 - RNA, 16 nt, Human
accuaaucaggcugag

SEQ ID NO: 3558563 - RNA, 17 nt, Human
accuaaucaggcugagg

SEQ ID NO: 3558564 - RNA, 22 nt, Human
accuaauccaggcagauccagg

SEQ ID NO: 3558565 - RNA, 21 nt, Human
accuaaucucuguaaagcuaa

SEQ ID NO: 3558566 - RNA, 20 nt, Human
accuaaugcuccuuguuccu

SEQ ID NO: 3558567 - RNA, 22 nt, Human
accuaauucgaugaaggcugcc

SEQ ID NO: 3558568 - RNA, 23 nt, Human
accuaauugcacaacagagacug

SEQ ID NO: 3558569 - RNA, 16 nt, Human
accuacacacugucau

SEQ ID NO: 3558570 - RNA, 23 nt, Human
accuacacacugucaugcuucau

SEQ ID NO: 3558571 - RNA, 13 nt, Human
accuacagaauac

SEQ ID NO: 3558572 - RNA, 17 nt, Human
accuacagggggucugg

SEQ ID NO: 3558573 - RNA, 19 nt, Human
accuacagggggucuggcu

SEQ ID NO: 3558574 - RNA, 22 nt, Human
accuacagggggucuggcuggu

SEQ ID NO: 3558575 - RNA, 23 nt, Human
accuacagggggucuggcuggug

SEQ ID NO: 3558576 - RNA, 11 nt, Human
accuacaguuu

SEQ ID NO: 3558577 - RNA, 15 nt, Human
accuacauguauuug

SEQ ID NO: 3558578 - RNA, 14 nt, Human
accuaccaaaaugg

SEQ ID NO: 3558579 - RNA, 15 nt, Human
accuaccacaguguc

SEQ ID NO: 3558580 - RNA, 20 nt, Human
accuaccccugacuucuguu

SEQ ID NO: 3558581 - RNA, 12 nt, Human
accuaccucagg

SEQ ID NO: 3558582 - RNA, 19 nt, Human
accuacugcccaggcacug

SEQ ID NO: 3558583 - RNA, 13 nt, Human
accuacuuucuuc

SEQ ID NO: 3558584 - RNA, 21 nt, Human
accuacuuugacuuuuugcau

SEQ ID NO: 3558585 - RNA, 12 nt, Human
accuagaaaaca

SEQ ID NO: 3558586 - RNA, 22 nt, Human
accuagaaauugacacaagugg

SEQ ID NO: 3558587 - RNA, 22 nt, Human
accuagagaacaggugguuuuu

SEQ ID NO: 3558588 - RNA, 13 nt, Human
accuagagaagau

SEQ ID NO: 3558589 - RNA, 21 nt, Human
accuagcagcaccguucugug

SEQ ID NO: 3558590 - RNA, 16 nt, Human
accuagcuaauuauuu

SEQ ID NO: 3558591 - RNA, 19 nt, Human
accuagcugaauguuuuuc

SEQ ID NO: 3558592 - RNA, 22 nt, Human
accuagcugaauguuuuucuaa

SEQ ID NO: 3558593 - RNA, 16 nt, Human
agaagaaagaggugac

SEQ ID NO: 3558594 - RNA, 12 nt, Human
agaagaaaugaa

SEQ ID NO: 3558595 - RNA, 17 nt, Human
agaagaaaugaaauuuu

SEQ ID NO: 3558596 - RNA, 14 nt, Human
agaagaaaugaaua

SEQ ID NO: 3558597 - RNA, 13 nt, Human
agaagaacaucca

SEQ ID NO: 3558598 - RNA, 13 nt, Human
agaagaacugaaa

SEQ ID NO: 3558599 - RNA, 21 nt, Human
agaagaacugaaaucauacuu

SEQ ID NO: 3558600 - RNA, 10 nt, Human
agaagaagaa

SEQ ID NO: 3558601 - RNA, 11 nt, Human
agaagaagaaa

SEQ ID NO: 3558602 - RNA, 14 nt, Human
agaagaagaaaaaa

SEQ ID NO: 3558603 - RNA, 14 nt, Human
agaagaagaaaaga

SEQ ID NO: 3558604 - RNA, 15 nt, Human
agaagaagaaaagag

SEQ ID NO: 3558605 - RNA, 17 nt, Human
agaagaaggaaaugaau

SEQ ID NO: 3558606 - RNA, 21 nt, Human
agaagaaggaaaugaauuucu

SEQ ID NO: 3558607 - RNA, 16 nt, Human
agaagaaguucauguc

SEQ ID NO: 3558608 - RNA, 15 nt, Human
agaagaauauucagg

SEQ ID NO: 3558609 - RNA, 16 nt, Human
agaagaauauuguauu

SEQ ID NO: 3558610 - RNA, 22 nt, Human
agaagaaugcaugcuuuccaua

SEQ ID NO: 3558611 - RNA, 13 nt, Human
agaagacaaaauu

SEQ ID NO: 3558612 - RNA, 16 nt, Human
agaagacaaacuuugc

SEQ ID NO: 3558613 - RNA, 17 nt, Human
agaagacaccagagcag

SEQ ID NO: 3558614 - RNA, 18 nt, Human
agaagacaccagagcaga

SEQ ID NO: 3558615 - RNA, 23 nt, Human
agaagacaccagagcagaugcag

SEQ ID NO: 3558616 - RNA, 12 nt, Human
agaagacacugc

SEQ ID NO: 3558617 - RNA, 19 nt, Human
agaagacauggagacuccu

SEQ ID NO: 3558618 - RNA, 20 nt, Human
agaagacauggagacuccug

SEQ ID NO: 3558619 - RNA, 15 nt, Human
agaagacauuugcca

SEQ ID NO: 3558620 - RNA, 16 nt, Human
agaagagaggagagga

SEQ ID NO: 3558621 - RNA, 22 nt, Human
agaagagaugggcuuguuuucu

SEQ ID NO: 3558622 - RNA, 13 nt, Human
agaagagccacag

SEQ ID NO: 3558623 - RNA, 14 nt, Human
agaagagccccacu

SEQ ID NO: 3558624 - RNA, 22 nt, Human
agaagagccccacucucagagg

SEQ ID NO: 3558625 - RNA, 20 nt, Human
agaagagccggagccuccag

SEQ ID NO: 3558626 - RNA, 24 nt, Human
agaagagcgagagaucaaagauga

SEQ ID NO: 3558627 - RNA, 21 nt, Human
agaagagcuguucacagccag

SEQ ID NO: 3558628 - RNA, 17 nt, Human
agaagaggcagauucaa

SEQ ID NO: 3558629 - RNA, 14 nt, Human
agaagagggccugu

SEQ ID NO: 3558630 - RNA, 16 nt, Human
agaagagggccugugg

SEQ ID NO: 3558631 - RNA, 15 nt, Human
agaagagggguuuuu

SEQ ID NO: 3558632 - RNA, 17 nt, Human
agaagauaauuguugaa

SEQ ID NO: 3558633 - RNA, 22 nt, Human
agaagauauuagucuuggggca

SEQ ID NO: 3558634 - RNA, 18 nt, Human
agaagauccuaaaacaaa

SEQ ID NO: 3558635 - RNA, 16 nt, Human
agaagauccuacccca

SEQ ID NO: 3558636 - RNA, 12 nt, Human
agaagaugaaaa

SEQ ID NO: 3558637 - RNA, 13 nt, Human
agaagaugaauac

SEQ ID NO: 3558638 - RNA, 14 nt, Human
agaagaugaauaca

SEQ ID NO: 3558639 - RNA, 16 nt, Human
agaagaugaucagacc

SEQ ID NO: 3558640 - RNA, 14 nt, Human
agaagaugcuccag

SEQ ID NO: 3558641 - RNA, 18 nt, Human
agaagaugguaccaccag

SEQ ID NO: 3558642 - RNA, 19 nt, Human
agaagauuugaugcuggag

SEQ ID NO: 3558643 - RNA, 22 nt, Human
agaagauuugaugcuggagagg

SEQ ID NO: 3558644 - RNA, 23 nt, Human
agaagauuugaugcuggagaggu

SEQ ID NO: 3558645 - RNA, 18 nt, Human
agaagauuuugaaauuuu

SEQ ID NO: 3558646 - RNA, 13 nt, Human
agaagcaaguaaa

SEQ ID NO: 3558647 - RNA, 19 nt, Human
agaagcacagaauauuuuu

SEQ ID NO: 3558648 - RNA, 21 nt, Human
agaagcacagaauauuuuuau

SEQ ID NO: 3558649 - RNA, 19 nt, Human
agaagcaccaaucaugaau

SEQ ID NO: 3558650 - RNA, 12 nt, Human
agaagcagcucu

SEQ ID NO: 3558651 - RNA, 14 nt, Human
agaagcaggcugga

SEQ ID NO: 3558652 - RNA, 13 nt, Human
agaagcagugagc

SEQ ID NO: 3558653 - RNA, 14 nt, Human
agaagcagugagcc

SEQ ID NO: 3558654 - RNA, 23 nt, Human
agaagcaguuguaccaagugaaa

SEQ ID NO: 3558655 - RNA, 13 nt, Human
agaagcaugaaaa

SEQ ID NO: 3558656 - RNA, 17 nt, Human
agaagcaugaagucuua

SEQ ID NO: 3558657 - RNA, 19 nt, Human
agaagcauuccuucuuuga

SEQ ID NO: 3558658 - RNA, 20 nt, Human
agaagcauuccuucuuugau

SEQ ID NO: 3558659 - RNA, 22 nt, Human
agaagcauuccuucuuugauaa

SEQ ID NO: 3558660 - RNA, 22 nt, Human
agaagcauucucauuggaaauu

SEQ ID NO: 3558661 - RNA, 18 nt, Human
agaagccaagggaaaggg

SEQ ID NO: 3558662 - RNA, 22 nt, Human
agaagccaagggaaaggggugc

SEQ ID NO: 3558663 - RNA, 22 nt, Human
agaagccaaucuacaaucucuu

SEQ ID NO: 3558664 - RNA, 17 nt, Human
agaagccacaggccuga

SEQ ID NO: 3558665 - RNA, 21 nt, Human
agaagccacaggccugagauu

SEQ ID NO: 3558666 - RNA, 14 nt, Human
agaagccagcuugu

SEQ ID NO: 3558667 - RNA, 15 nt, Human
agaagccagcuuguu

SEQ ID NO: 3558668 - RNA, 20 nt, Human
agaagccaucaccucagaug

SEQ ID NO: 3558669 - RNA, 10 nt, Human
agaagccauu

SEQ ID NO: 3558670 - RNA, 14 nt, Human
agaagccauugucu

SEQ ID NO: 3558671 - RNA, 12 nt, Human
agaagcccagga

SEQ ID NO: 3558672 - RNA, 21 nt, Human
agaagccccacccugccucac

SEQ ID NO: 3558673 - RNA, 14 nt, Human
agaagcccccagcu

SEQ ID NO: 3558674 - RNA, 15 nt, Human
agaagccccuucccc

SEQ ID NO: 3558675 - RNA, 13 nt, Human
agaagcccggcuc

SEQ ID NO: 3558676 - RNA, 15 nt, Human
agaagcccggcuccu

SEQ ID NO: 3558677 - RNA, 18 nt, Human
agaagcccggcuccuggu

SEQ ID NO: 3558678 - RNA, 20 nt, Human
agaagcccgugugagaagug

SEQ ID NO: 3558679 - RNA, 18 nt, Human
agaagccgggaacagaca

SEQ ID NO: 3558680 - RNA, 14 nt, Human
agaagccuauugua

SEQ ID NO: 3558681 - RNA, 22 nt, Human
agaagccuauuguaaauacaag

SEQ ID NO: 3558682 - RNA, 23 nt, Human
agaagccuauuguaaauacaagu

SEQ ID NO: 3558683 - RNA, 14 nt, Human
agaagccucuggcu

SEQ ID NO: 3558684 - RNA, 22 nt, Human
agaagccucugggucagugguc

SEQ ID NO: 3558685 - RNA, 15 nt, Human
accucugcuuuuauc

SEQ ID NO: 3558686 - RNA, 18 nt, Human
accucuggauucauuguc

SEQ ID NO: 3558687 - RNA, 14 nt, Human
accucugggagcug

SEQ ID NO: 3558688 - RNA, 10 nt, Human
accucugggc

SEQ ID NO: 3558689 - RNA, 23 nt, Human
accucuguaauuuuucagcucuc

SEQ ID NO: 3558690 - RNA, 17 nt, Human
accucugugaccucagg

SEQ ID NO: 3558691 - RNA, 19 nt, Human
accucugugaccucaggca

SEQ ID NO: 3558692 - RNA, 16 nt, Human
accucugugccucugu

SEQ ID NO: 3558693 - RNA, 20 nt, Human
accucuguuguccuccccuu

SEQ ID NO: 3558694 - RNA, 21 nt, Human
accucuuaaagaaaacccacc

SEQ ID NO: 3558695 - RNA, 20 nt, Human
accucuuaacaauuucuguc

SEQ ID NO: 3558696 - RNA, 16 nt, Human
accucuucucuuccug

SEQ ID NO: 3558697 - RNA, 17 nt, Human
accucuucucuuccugu

SEQ ID NO: 3558698 - RNA, 14 nt, Human
accucuucuggcuc

SEQ ID NO: 3558699 - RNA, 21 nt, Human
accucuugagccuugaacuuu

SEQ ID NO: 3558700 - RNA, 15 nt, Human
accucuugcugucuc

SEQ ID NO: 3558701 - RNA, 18 nt, Human
accucuugcugucucugc

SEQ ID NO: 3558702 - RNA, 17 nt, Human
accucuuuaaguauuga

SEQ ID NO: 3558703 - RNA, 19 nt, Human
accucuuuauuuuuugauu

SEQ ID NO: 3558704 - RNA, 18 nt, Human
accugaaaacacugugca

SEQ ID NO: 3558705 - RNA, 21 nt, Human
accugaaaacacugugcacau

SEQ ID NO: 3558706 - RNA, 12 nt, Human
accugaaaagau

SEQ ID NO: 3558707 - RNA, 14 nt, Human
accugaaccuagga

SEQ ID NO: 3558708 - RNA, 15 nt, Human
accugaagucuuugu

SEQ ID NO: 3558709 - RNA, 15 nt, Human
accugaaguucacca

SEQ ID NO: 3558710 - RNA, 18 nt, Human
accugaauaaagaaugaa

SEQ ID NO: 3558711 - RNA, 16 nt, Human
accugaaugcucugua

SEQ ID NO: 3558712 - RNA, 12 nt, Human
accugacagaug

SEQ ID NO: 3558713 - RNA, 17 nt, Human
accugacagccccuccc

SEQ ID NO: 3558714 - RNA, 17 nt, Human
accugaccaacauggag

SEQ ID NO: 3558715 - RNA, 16 nt, Human
accugaccucuugcug

SEQ ID NO: 3558716 - RNA, 22 nt, Human
accugaccucuugcugucucug

SEQ ID NO: 3558717 - RNA, 17 nt, Human
accugacucaggcauca

SEQ ID NO: 3558718 - RNA, 13 nt, Human
accugacucugaa

SEQ ID NO: 3558719 - RNA, 22 nt, Human
accugacucugaaaucugaaga

SEQ ID NO: 3558720 - RNA, 23 nt, Human
accugagaccaguugggagcacu

SEQ ID NO: 3558721 - RNA, 16 nt, Human
accugagauggcccuc

SEQ ID NO: 3558722 - RNA, 21 nt, Human
accugagauggcccucuggua

SEQ ID NO: 3558723 - RNA, 21 nt, Human
accugagcccggaugcuucuc

SEQ ID NO: 3558724 - RNA, 14 nt, Human
accugagccugccg

SEQ ID NO: 3558725 - RNA, 15 nt, Human
accugagcuccccac

SEQ ID NO: 3558726 - RNA, 20 nt, Human
accugaggacauggcuucug

SEQ ID NO: 3558727 - RNA, 15 nt, Human
accugaggcccuucu

SEQ ID NO: 3558728 - RNA, 16 nt, Human
accugaggcccuucuc

SEQ ID NO: 3558729 - RNA, 22 nt, Human
accugaggcccuucucuccagc

SEQ ID NO: 3558730 - RNA, 23 nt, Human
accugaggcccuucucuccagcc

SEQ ID NO: 3558731 - RNA, 14 nt, Human
accugaggcugguu

SEQ ID NO: 3558732 - RNA, 14 nt, Human
accugaggcugugg

SEQ ID NO: 3558733 - RNA, 23 nt, Human
accugagggcagaaagguucugc

SEQ ID NO: 3558734 - RNA, 14 nt, Human
accugaggggccuc

SEQ ID NO: 3558735 - RNA, 17 nt, Human
accugagggucuguagg

SEQ ID NO: 3558736 - RNA, 18 nt, Human
accugagggucuguaggu

SEQ ID NO: 3558737 - RNA, 22 nt, Human
accugaggucgggaguuggaga

SEQ ID NO: 3558738 - RNA, 18 nt, Human
accugaggugggcccagg

SEQ ID NO: 3558739 - RNA, 22 nt, Human
accugagucacccuaccugugc

SEQ ID NO: 3558740 - RNA, 21 nt, Human
accugagucguacagaaagcu

SEQ ID NO: 3558741 - RNA, 19 nt, Human
accugauacggcuccccag

SEQ ID NO: 3558742 - RNA, 17 nt, Human
accugaucaaugacaga

SEQ ID NO: 3558743 - RNA, 18 nt, Human
accugaucacuagccugu

SEQ ID NO: 3558744 - RNA, 19 nt, Human
accugaucacuagccuguc

SEQ ID NO: 3558745 - RNA, 22 nt, Human
accugauccuggaggcccaguu

SEQ ID NO: 3558746 - RNA, 14 nt, Human
accugaugaaaaua

SEQ ID NO: 3558747 - RNA, 15 nt, Human
accugaugaaaauaa

SEQ ID NO: 3558748 - RNA, 18 nt, Human
accugaugaaaauaaaga

SEQ ID NO: 3558749 - RNA, 21 nt, Human
accugaugaaaauaaagaaug

SEQ ID NO: 3558750 - RNA, 15 nt, Human
accugauguguacau

SEQ ID NO: 3558751 - RNA, 22 nt, Human
accugauuaacugaggcaucca

SEQ ID NO: 3558752 - RNA, 19 nt, Human
accugauucaacuaaaaaa

SEQ ID NO: 3558753 - RNA, 14 nt, Human
accugauugugucu

SEQ ID NO: 3558754 - RNA, 15 nt, Human
accugauugugucuc

SEQ ID NO: 3558755 - RNA, 17 nt, Human
accugauugugucucuu

SEQ ID NO: 3558756 - RNA, 18 nt, Human
accugauugugucucuug

SEQ ID NO: 3558757 - RNA, 17 nt, Human
accugauuuuuuuuccu

SEQ ID NO: 3558758 - RNA, 20 nt, Human
accugcaagggcuccccacu

SEQ ID NO: 3558759 - RNA, 16 nt, Human
accugcaccucccccc

SEQ ID NO: 3558760 - RNA, 18 nt, Human
accugcaccuccccccac

SEQ ID NO: 3558761 - RNA, 17 nt, Human
accugcacuaacagagu

SEQ ID NO: 3558762 - RNA, 23 nt, Human
accugcacuggggagcccgucuc

SEQ ID NO: 3558763 - RNA, 19 nt, Human
accugcaggccaagagcag

SEQ ID NO: 3558764 - RNA, 17 nt, Human
accugcagguugggcca

SEQ ID NO: 3558765 - RNA, 14 nt, Human
accugcauaaaaag

SEQ ID NO: 3558766 - RNA, 16 nt, Human
accugcaucuggggcc

SEQ ID NO: 3558767 - RNA, 17 nt, Human
accugccacccugggcc

SEQ ID NO: 3558768 - RNA, 21 nt, Human
accugccacucacacagccag

SEQ ID NO: 3558769 - RNA, 16 nt, Human
accugccagccuggcu

SEQ ID NO: 3558770 - RNA, 12 nt, Human
accugccaggaa

SEQ ID NO: 3558771 - RNA, 19 nt, Human
accugccaggaagccagca

SEQ ID NO: 3558772 - RNA, 12 nt, Human
accugccaggga

SEQ ID NO: 3558773 - RNA, 13 nt, Human
accugccagggac

SEQ ID NO: 3558774 - RNA, 15 nt, Human
accugccagggacag

SEQ ID NO: 3558775 - RNA, 16 nt, Human
accugccagggacaga

SEQ ID NO: 3558776 - RNA, 18 nt, Human
accugccagggagacaga

SEQ ID NO: 3558777 - RNA, 21 nt, Human
accugccagggagacagagcu

SEQ ID NO: 3558778 - RNA, 16 nt, Human
accugccaugccagga

SEQ ID NO: 3558779 - RNA, 15 nt, Human
accugccauuugcac

SEQ ID NO: 3558780 - RNA, 22 nt, Human
accugcccagaucccagaagga

SEQ ID NO: 3558781 - RNA, 22 nt, Human
accugccccacuuguccuuagc

SEQ ID NO: 3558782 - RNA, 14 nt, Human
accugccccauccc

SEQ ID NO: 3558783 - RNA, 22 nt, Human
accugcccccuucucccacacu

SEQ ID NO: 3558784 - RNA, 15 nt, Human
accugccccucaacu

SEQ ID NO: 3558785 - RNA, 18 nt, Human
accugccccuccucucug

SEQ ID NO: 3558786 - RNA, 14 nt, Human
accugcccucaagg

SEQ ID NO: 3558787 - RNA, 17 nt, Human
accugcccugcccugcc

SEQ ID NO: 3558788 - RNA, 21 nt, Human
accugcccugcccugccaccu

SEQ ID NO: 3558789 - RNA, 14 nt, Human
agaauuuugugaaa

SEQ ID NO: 3558790 - RNA, 22 nt, Human
agaauuuugugaaacagacuug

SEQ ID NO: 3558791 - RNA, 16 nt, Human
agaauuuuuuugucuu

SEQ ID NO: 3558792 - RNA, 14 nt, Human
agaauuuuuuuugu

SEQ ID NO: 3558793 - RNA, 15 nt, Human
agaauuuuuuuuguu

SEQ ID NO: 3558794 - RNA, 12 nt, Human
agacaaaaagua

SEQ ID NO: 3558795 - RNA, 17 nt, Human
agacaaaaauacucuaa

SEQ ID NO: 3558796 - RNA, 19 nt, Human
agacaaaacauacauuuug

SEQ ID NO: 3558797 - RNA, 15 nt, Human
agacaaaagagcagu

SEQ ID NO: 3558798 - RNA, 14 nt, Human
agacaaaauguuuu

SEQ ID NO: 3558799 - RNA, 21 nt, Human
agacaaacuguaaaaaaugug

SEQ ID NO: 3558800 - RNA, 18 nt, Human
agacaaagguuuuccucu

SEQ ID NO: 3558801 - RNA, 19 nt, Human
agacaaauagaaaaugguc

SEQ ID NO: 3558802 - RNA, 18 nt, Human
agacaaaucaacagaagc

SEQ ID NO: 3558803 - RNA, 21 nt, Human
agacaaaucaacagaagcauu

SEQ ID NO: 3558804 - RNA, 23 nt, Human
agacaaaucuaugccacucagaa

SEQ ID NO: 3558805 - RNA, 18 nt, Human
agacaaaugcugcgcccu

SEQ ID NO: 3558806 - RNA, 18 nt, Human
agacaaauggaggaauau

SEQ ID NO: 3558807 - RNA, 13 nt, Human
agacaagaaaucc

SEQ ID NO: 3558808 - RNA, 18 nt, Human
agacaagaaaucccuguu

SEQ ID NO: 3558809 - RNA, 15 nt, Human
agacaagagauggga

SEQ ID NO: 3558810 - RNA, 15 nt, Human
agacaagauauugua

SEQ ID NO: 3558811 - RNA, 21 nt, Human
agacaagauauuguacauaaa

SEQ ID NO: 3558812 - RNA, 22 nt, Human
agacaagauauuguacauaaaa

SEQ ID NO: 3558813 - RNA, 21 nt, Human
agacaagauuuuuuaauuguu

SEQ ID NO: 3558814 - RNA, 14 nt, Human
agacaagcaacagg

SEQ ID NO: 3558815 - RNA, 15 nt, Human
agacaagccagaacu

SEQ ID NO: 3558816 - RNA, 20 nt, Human
agacaagugacuguaucugu

SEQ ID NO: 3558817 - RNA, 22 nt, Human
agacaauaaacccucagagccu

SEQ ID NO: 3558818 - RNA, 20 nt, Human
agacaauaugugagugccuu

SEQ ID NO: 3558819 - RNA, 21 nt, Human
agacaauaugugagugccuuu

SEQ ID NO: 3558820 - RNA, 14 nt, Human
agacaaucuucugu

SEQ ID NO: 3558821 - RNA, 20 nt, Human
agacaaugacuuacuguaca

SEQ ID NO: 3558822 - RNA, 22 nt, Human
agacaaugacuuacuguacaug

SEQ ID NO: 3558823 - RNA, 17 nt, Human
agacaaugcagaugcca

SEQ ID NO: 3558824 - RNA, 18 nt, Human
agacaauggacccuuuuu

SEQ ID NO: 3558825 - RNA, 21 nt, Human
agacaaugucugcagcccuga

SEQ ID NO: 3558826 - RNA, 21 nt, Human
agacaauuuauuauggcacau

SEQ ID NO: 3558827 - RNA, 16 nt, Human
agacaauuugauacau

SEQ ID NO: 3558828 - RNA, 22 nt, Human
agacaauuugauacauaauaaa

SEQ ID NO: 3558829 - RNA, 20 nt, Human
accuggaauauauaaccagu

SEQ ID NO: 3558830 - RNA, 16 nt, Human
accuggaccaaagcug

SEQ ID NO: 3558831 - RNA, 20 nt, Human
accuggagagcuagaaccug

SEQ ID NO: 3558832 - RNA, 16 nt, Human
accuggagauggugga

SEQ ID NO: 3558833 - RNA, 16 nt, Human
accuggagccccuggg

SEQ ID NO: 3558834 - RNA, 18 nt, Human
accuggagccccugggug

SEQ ID NO: 3558835 - RNA, 20 nt, Human
accuggagggcuagaaccug

SEQ ID NO: 3558836 - RNA, 23 nt, Human
accuggagggcuagaaccuggag

SEQ ID NO: 3558837 - RNA, 19 nt, Human
accuggaguuccugaaccu

SEQ ID NO: 3558838 - RNA, 20 nt, Human
accuggcaagcuagaaccug

SEQ ID NO: 3558839 - RNA, 14 nt, Human
accuggcacugcug

SEQ ID NO: 3558840 - RNA, 17 nt, Human
accuggcacugcugugc

SEQ ID NO: 3558841 - RNA, 17 nt, Human
accuggcccaucagggu

SEQ ID NO: 3558842 - RNA, 18 nt, Human
accuggcccucucugaag

SEQ ID NO: 3558843 - RNA, 17 nt, Human
accuggcccuggggccu

SEQ ID NO: 3558844 - RNA, 19 nt, Human
accuggcugagguuccucu

SEQ ID NO: 3558845 - RNA, 22 nt, Human
accuggcugagguuccucugcc

SEQ ID NO: 3558846 - RNA, 16 nt, Human
accuggcugccauacu

SEQ ID NO: 3558847 - RNA, 20 nt, Human
accuggcuuuucuuucuacc

SEQ ID NO: 3558848 - RNA, 22 nt, Human
accugggaggcggauguugaag

SEQ ID NO: 3558849 - RNA, 14 nt, Human
accugggcaccugg

SEQ ID NO: 3558850 - RNA, 15 nt, Human
accugggcauaucca

SEQ ID NO: 3558851 - RNA, 14 nt, Human
accuggggagccag

SEQ ID NO: 3558852 - RNA, 13 nt, Human
accuggggagugg

SEQ ID NO: 3558853 - RNA, 18 nt, Human
accuggggcacaguccag

SEQ ID NO: 3558854 - RNA, 19 nt, Human
accuggggcagucaccugc

SEQ ID NO: 3558855 - RNA, 14 nt, Human
accuggggcugcug

SEQ ID NO: 3558856 - RNA, 15 nt, Human
accuggggcugcugg

SEQ ID NO: 3558857 - RNA, 20 nt, Human
accuggggcugcuggccuga

SEQ ID NO: 3558858 - RNA, 19 nt, Human
accuggggcugcugugaag

SEQ ID NO: 3558859 - RNA, 21 nt, Human
accuggggugugggaggcccg

SEQ ID NO: 3558860 - RNA, 19 nt, Human
accuggguaaaugcagcgu

SEQ ID NO: 3558861 - RNA, 19 nt, Human
accuggguauguguaggca

SEQ ID NO: 3558862 - RNA, 14 nt, Human
accuggguccaaau

SEQ ID NO: 3558863 - RNA, 15 nt, Human
accuggguccaaaua

SEQ ID NO: 3558864 - RNA, 17 nt, Human
accuggguccaaauaaa

SEQ ID NO: 3558865 - RNA, 21 nt, Human
accuggucacaggacucugcc

SEQ ID NO: 3558866 - RNA, 22 nt, Human
accuggucacaggacucugccu

SEQ ID NO: 3558867 - RNA, 23 nt, Human
accuggucacaggacucugccuc

SEQ ID NO: 3558868 - RNA, 11 nt, Human
accuggugcug

SEQ ID NO: 3558869 - RNA, 13 nt, Human
accuggugcugga

SEQ ID NO: 3558870 - RNA, 15 nt, Human
accugguggccucug

SEQ ID NO: 3558871 - RNA, 14 nt, Human
accuguaaaacuuu

SEQ ID NO: 3558872 - RNA, 16 nt, Human
accuguaaaacuuuau

SEQ ID NO: 3558873 - RNA, 17 nt, Human
accuguaaaacuuuauu

SEQ ID NO: 3558874 - RNA, 21 nt, Human
accuguaaaacuuuauuuuau

SEQ ID NO: 3558875 - RNA, 22 nt, Human
accuguaaaacuuuauuuuaua

SEQ ID NO: 3558876 - RNA, 19 nt, Human
accuguaaauuauuuuaaa

SEQ ID NO: 3558877 - RNA, 17 nt, Human
accuguaacuuuuguaa

SEQ ID NO: 3558878 - RNA, 20 nt, Human
accuguaaugacaggccugu

SEQ ID NO: 3558879 - RNA, 15 nt, Human
accuguacuggagag

SEQ ID NO: 3558880 - RNA, 17 nt, Human
accuguagucccagcua

SEQ ID NO: 3558881 - RNA, 17 nt, Human
accuguauaacccuguu

SEQ ID NO: 3558882 - RNA, 12 nt, Human
accuguaucuuu

SEQ ID NO: 3558883 - RNA, 18 nt, Human
accuguaucuuucuaugc

SEQ ID NO: 3558884 - RNA, 12 nt, Human
accuguauuuaa

SEQ ID NO: 3558885 - RNA, 18 nt, Human
accuguauuuaaaaauag

SEQ ID NO: 3558886 - RNA, 15 nt, Human
accuguauuuaagca

SEQ ID NO: 3558887 - RNA, 18 nt, Human
accuguauuuaagcaaau

SEQ ID NO: 3558888 - RNA, 19 nt, Human
accugucaaacaaagccag

SEQ ID NO: 3558889 - RNA, 13 nt, Human
accugucacauug

SEQ ID NO: 3558890 - RNA, 16 nt, Human
accugucacauugcau

SEQ ID NO: 3558891 - RNA, 22 nt, Human
accugucacauugcauucuauu

SEQ ID NO: 3558892 - RNA, 18 nt, Human
accugucaccgugagcag

SEQ ID NO: 3558893 - RNA, 15 nt, Human
accugucaugccccc

SEQ ID NO: 3558894 - RNA, 13 nt, Human
accugucccaccu

SEQ ID NO: 3558895 - RNA, 12 nt, Human
accugucccccu

SEQ ID NO: 3558896 - RNA, 15 nt, Human
accugucccccugac

SEQ ID NO: 3558897 - RNA, 22 nt, Human
accuguccuaaggaaccuuccu

SEQ ID NO: 3558898 - RNA, 13 nt, Human
accugucucacca

SEQ ID NO: 3558899 - RNA, 18 nt, Human
accugucucaccuggacu

SEQ ID NO: 3558900 - RNA, 18 nt, Human
accugucugacuguagcu

SEQ ID NO: 3558901 - RNA, 11 nt, Human
accugucugcu

SEQ ID NO: 3558902 - RNA, 20 nt, Human
accugucugcuccagcucug

SEQ ID NO: 3558903 - RNA, 11 nt, Human
accugucuguc

SEQ ID NO: 3558904 - RNA, 14 nt, Human
accugucugucugu

SEQ ID NO: 3558905 - RNA, 18 nt, Human
accugucugucugucugu

SEQ ID NO: 3558906 - RNA, 22 nt, Human
accugucuugccuuuuucauua

SEQ ID NO: 3558907 - RNA, 15 nt, Human
accugucuuuuggga

SEQ ID NO: 3558908 - RNA, 15 nt, Human
accugugaagcugaa

SEQ ID NO: 3558909 - RNA, 14 nt, Human
accugugaccagca

SEQ ID NO: 3558910 - RNA, 23 nt, Human
accugugaccagcacugucucag

SEQ ID NO: 3558911 - RNA, 18 nt, Human
accugugagcccagcugg

SEQ ID NO: 3558912 - RNA, 21 nt, Human
accugugagcugcaccaggua

SEQ ID NO: 3558913 - RNA, 16 nt, Human
accugugaguaaauau

SEQ ID NO: 3558914 - RNA, 18 nt, Human
accugugaguuuaaagca

SEQ ID NO: 3558915 - RNA, 17 nt, Human
accuguggccaaguucu

SEQ ID NO: 3558916 - RNA, 18 nt, Human
accuguggccaaguucuu

SEQ ID NO: 3558917 - RNA, 19 nt, Human
accuguggggauuucuccc

SEQ ID NO: 3558918 - RNA, 18 nt, Human
accuguguauuuuuuaaa

SEQ ID NO: 3558919 - RNA, 20 nt, Human
accugugucugcgaaguccu

SEQ ID NO: 3558920 - RNA, 18 nt, Human
accuguguuucuugccuc

SEQ ID NO: 3558921 - RNA, 19 nt, Human
accuguguuucuugccuca

SEQ ID NO: 3558922 - RNA, 20 nt, Human
accuguguuucuugccucau

SEQ ID NO: 3558923 - RNA, 17 nt, Human
accuguucagugucccg

SEQ ID NO: 3558924 - RNA, 18 nt, Human
accuguucagugucccgg

SEQ ID NO: 3558925 - RNA, 19 nt, Human
accuguugagcaucacaga

SEQ ID NO: 3558926 - RNA, 21 nt, Human
accuguugagcaucacagaau

SEQ ID NO: 3558927 - RNA, 16 nt, Human
accuguugguuccaag

SEQ ID NO: 3558928 - RNA, 16 nt, Human
accuguuuaaauauuu

SEQ ID NO: 3558929 - RNA, 13 nt, Human
accuguuuaaauu

SEQ ID NO: 3558930 - RNA, 15 nt, Human
accuguuucucugcc

SEQ ID NO: 3558931 - RNA, 19 nt, Human
accuguuucugcagccacu

SEQ ID NO: 3558932 - RNA, 18 nt, Human
accuguuuucgcaccuac

SEQ ID NO: 3558933 - RNA, 18 nt, Human
accuguuuuuaagcuguu

SEQ ID NO: 3558934 - RNA, 20 nt, Human
accuguuuuuaagcuguuuc

SEQ ID NO: 3558935 - RNA, 18 nt, Human
accuguuuuuuuucuuuu

SEQ ID NO: 3558936 - RNA, 18 nt, Human
accuguuuuuuuuucauu

SEQ ID NO: 3558937 - RNA, 15 nt, Human
accuuaaaauuugaa

SEQ ID NO: 3558938 - RNA, 20 nt, Human
accuuaaaauuugaaacauu

SEQ ID NO: 3558939 - RNA, 16 nt, Human
accuuaaacaccccuc

SEQ ID NO: 3558940 - RNA, 22 nt, Human
accuuaaacaccccucaguugu

SEQ ID NO: 3558941 - RNA, 12 nt, Human
accuuaaauuaa

SEQ ID NO: 3558942 - RNA, 22 nt, Human
accuuaaauuaaacaauuuauu

SEQ ID NO: 3558943 - RNA, 22 nt, Human
accuuaagaccuacuguucuaa

SEQ ID NO: 3558944 - RNA, 22 nt, Human
agaagucacauuccugaacagg

SEQ ID NO: 3558945 - RNA, 18 nt, Human
agaagucacucaauuguu

SEQ ID NO: 3558946 - RNA, 22 nt, Human
agaagucaucuugcuaccagua

SEQ ID NO: 3558947 - RNA, 17 nt, Human
agaagucaugaagccca

SEQ ID NO: 3558948 - RNA, 20 nt, Human
agaagucaugaagcccaagu

SEQ ID NO: 3558949 - RNA, 22 nt, Human
agaagucucagcuaagcucacg

SEQ ID NO: 3558950 - RNA, 19 nt, Human
agaagucuuagauguauau

SEQ ID NO: 3558951 - RNA, 16 nt, Human
agaagucuucaugaaa

SEQ ID NO: 3558952 - RNA, 18 nt, Human
agaagucuucuauuuauu

SEQ ID NO: 3558953 - RNA, 16 nt, Human
agaagucuuucaagaa

SEQ ID NO: 3558954 - RNA, 15 nt, Human
agaagugaagaaugc

SEQ ID NO: 3558955 - RNA, 19 nt, Human
agaagugaaugcugggacu

SEQ ID NO: 3558956 - RNA, 14 nt, Human
agaagugacaggga

SEQ ID NO: 3558957 - RNA, 18 nt, Human
agaagugacagggaagcu

SEQ ID NO: 3558958 - RNA, 22 nt, Human
agaagugacagggaagcuacag

SEQ ID NO: 3558959 - RNA, 17 nt, Human
agaagugacauugcauc

SEQ ID NO: 3558960 - RNA, 18 nt, Human
agaagugaccaaggagga

SEQ ID NO: 3558961 - RNA, 17 nt, Human
agaagugaguguuucua

SEQ ID NO: 3558962 - RNA, 15 nt, Human
agaagugcuccccuc

SEQ ID NO: 3558963 - RNA, 23 nt, Human
agaagugggccaggacaggcccg

SEQ ID NO: 3558964 - RNA, 20 nt, Human
agaaguggggacagagcaga

SEQ ID NO: 3558965 - RNA, 23 nt, Human
agaagugugauugggaauaaaua

SEQ ID NO: 3558966 - RNA, 22 nt, Human
agaaguguggggauuuucacug

SEQ ID NO: 3558967 - RNA, 16 nt, Human
agaaguguuucaugca

SEQ ID NO: 3558968 - RNA, 15 nt, Human
agaaguuacugaaug

SEQ ID NO: 3558969 - RNA, 16 nt, Human
agaaguuaguuuguau

SEQ ID NO: 3558970 - RNA, 19 nt, Human
agaaguucaauauaagcuu

SEQ ID NO: 3558971 - RNA, 21 nt, Human
agaaguucuuugauucuguaa

SEQ ID NO: 3558972 - RNA, 19 nt, Human
agaaguugaaugggcacag

SEQ ID NO: 3558973 - RNA, 14 nt, Human
agaauggagaggaa

SEQ ID NO: 3558974 - RNA, 23 nt, Human
agaauggauaaaauaaugcugca

SEQ ID NO: 3558975 - RNA, 19 nt, Human
agaauggaucacaagaugg

SEQ ID NO: 3558976 - RNA, 14 nt, Human
agaauggcauuugc

SEQ ID NO: 3558977 - RNA, 21 nt, Human
agaauggcauuugcaauaaaa

SEQ ID NO: 3558978 - RNA, 21 nt, Human
agaauggcgccaccagcucug

SEQ ID NO: 3558979 - RNA, 15 nt, Human
agaauggggugcaug

SEQ ID NO: 3558980 - RNA, 20 nt, Human
agaauggugugaacccggga

SEQ ID NO: 3558981 - RNA, 15 nt, Human
agaauguaaagcaac

SEQ ID NO: 3558982 - RNA, 17 nt, Human
agaauguaaaugucuca

SEQ ID NO: 3558983 - RNA, 19 nt, Human
agaauguaagguauaucau

SEQ ID NO: 3558984 - RNA, 23 nt, Human
agaauguaagguauaucauucua

SEQ ID NO: 3558985 - RNA, 21 nt, Human
agaauguacguccagccugcc

SEQ ID NO: 3558986 - RNA, 14 nt, Human
agaauguagccauu

SEQ ID NO: 3558987 - RNA, 13 nt, Human
agaauguauugua

SEQ ID NO: 3558988 - RNA, 14 nt, Human
agaauguauuguac

SEQ ID NO: 3558989 - RNA, 23 nt, Human
agaauguauuguaccuuuuaaca

SEQ ID NO: 3558990 - RNA, 16 nt, Human
agaauguauuuuauau

SEQ ID NO: 3558991 - RNA, 14 nt, Human
agaaugucagaaaa

SEQ ID NO: 3558992 - RNA, 18 nt, Human
agaaugucagauuccuuu

SEQ ID NO: 3558993 - RNA, 19 nt, Human
agaaugucagauuccuuuc

SEQ ID NO: 3558994 - RNA, 21 nt, Human
agaaugucagauuccuuuccc

SEQ ID NO: 3558995 - RNA, 20 nt, Human
agaaugucauuuugguacuu

SEQ ID NO: 3558996 - RNA, 21 nt, Human
agaaugugugucaauuuauaa

SEQ ID NO: 3558997 - RNA, 14 nt, Human
agaauguuaagacu

SEQ ID NO: 3558998 - RNA, 13 nt, Human
agaauguuccaga

SEQ ID NO: 3558999 - RNA, 19 nt, Human
agaauguuccagacauucu

SEQ ID NO: 3559000 - RNA, 20 nt, Human
agaauguugguuuacuuuca

SEQ ID NO: 3559001 - RNA, 21 nt, Human
agaauguugguuuacuuucaa

SEQ ID NO: 3559002 - RNA, 15 nt, Human
agaauguuguauuca

SEQ ID NO: 3559003 - RNA, 19 nt, Human
agaauguuuuacugugaaa

SEQ ID NO: 3559004 - RNA, 12 nt, Human
agaauguuuuca

SEQ ID NO: 3559005 - RNA, 23 nt, Human
agaauuaacacaugauccugcaa

SEQ ID NO: 3559006 - RNA, 21 nt, Human
agaauuaagcccuaagguccu

SEQ ID NO: 3559007 - RNA, 19 nt, Human
agaauuaccauuuguuaau

SEQ ID NO: 3559008 - RNA, 14 nt, Human
agaauuacuguaac

SEQ ID NO: 3559009 - RNA, 20 nt, Human
agaauuacuguaacugauua

SEQ ID NO: 3559010 - RNA, 14 nt, Human
agaauuagcugcuu

SEQ ID NO: 3559011 - RNA, 16 nt, Human
agaauuagcugcuucu

SEQ ID NO: 3559012 - RNA, 15 nt, Human
agaauuagcuuuuuc

SEQ ID NO: 3559013 - RNA, 19 nt, Human
agaauuagugccagaauuu

SEQ ID NO: 3559014 - RNA, 21 nt, Human
agaauuagugccagaauuuua

SEQ ID NO: 3559015 - RNA, 19 nt, Human
agaauuaguggcacuugcu

SEQ ID NO: 3559016 - RNA, 22 nt, Human
agaauuauauagguugugcaaa

SEQ ID NO: 3559017 - RNA, 19 nt, Human
agaauuauuuuuaaaaaga

SEQ ID NO: 3559018 - RNA, 12 nt, Human
agaauucaaauu

SEQ ID NO: 3559019 - RNA, 18 nt, Human
agaauucagaagaccccu

SEQ ID NO: 3559020 - RNA, 13 nt, Human
agaauucagacau

SEQ ID NO: 3559021 - RNA, 14 nt, Human
agaauucagcugcc

SEQ ID NO: 3559022 - RNA, 15 nt, Human
agaauucagcugccc

SEQ ID NO: 3559023 - RNA, 13 nt, Human
agaauucauucau

SEQ ID NO: 3559024 - RNA, 21 nt, Human
agaauucauucauacuuaaaa

SEQ ID NO: 3559025 - RNA, 16 nt, Human
agaauuccaaagcaaa

SEQ ID NO: 3559026 - RNA, 20 nt, Human
agaauuccaggguauggcca

SEQ ID NO: 3559027 - RNA, 20 nt, Human
agaauucccucucucugacu

SEQ ID NO: 3559028 - RNA, 23 nt, Human
agaauucuagugcugcugaagau

SEQ ID NO: 3559029 - RNA, 20 nt, Human
agaauucucagaaucucaaa

SEQ ID NO: 3559030 - RNA, 20 nt, Human
agaauucugcuaccucacug

SEQ ID NO: 3559031 - RNA, 18 nt, Human
agaauucuguauuggaua

SEQ ID NO: 3559032 - RNA, 20 nt, Human
agaauucuuacauguuuucu

SEQ ID NO: 3559033 - RNA, 23 nt, Human
agaauucuuacauguuuucuuug

SEQ ID NO: 3559034 - RNA, 17 nt, Human
agaauucuucaggugga

SEQ ID NO: 3559035 - RNA, 19 nt, Human
agaauugaaaaguuuuugu

SEQ ID NO: 3559036 - RNA, 14 nt, Human
agaauugaaacacu

SEQ ID NO: 3559037 - RNA, 17 nt, Human
agaauugaaacacuuuu

SEQ ID NO: 3559038 - RNA, 16 nt, Human
agaauugaacccagga

SEQ ID NO: 3559039 - RNA, 13 nt, Human
agaauugaagguu

SEQ ID NO: 3559040 - RNA, 15 nt, Human
agaauugaagguuuu

SEQ ID NO: 3559041 - RNA, 15 nt, Human
agaauugacauugaa

SEQ ID NO: 3559042 - RNA, 18 nt, Human
agaauugaguaauggugu

SEQ ID NO: 3559043 - RNA, 23 nt, Human
agaauugauugggcacaucauuu

SEQ ID NO: 3559044 - RNA, 18 nt, Human
agaauuggaaaagacuaa

SEQ ID NO: 3559045 - RNA, 22 nt, Human
agaauuggcugaacucaugaga

SEQ ID NO: 3559046 - RNA, 22 nt, Human
agaauugugguuuauauauuua

SEQ ID NO: 3559047 - RNA, 17 nt, Human
agaauuguugagauacu

SEQ ID NO: 3559048 - RNA, 12 nt, Human
agaauuuaaaga

SEQ ID NO: 3559049 - RNA, 13 nt, Human
agaauuuaaagaa

SEQ ID NO: 3559050 - RNA, 14 nt, Human
agaauuuaguauua

SEQ ID NO: 3559051 - RNA, 16 nt, Human
agaauuuaguauuauc

SEQ ID NO: 3559052 - RNA, 14 nt, Human
agaauuuaguguau

SEQ ID NO: 3559053 - RNA, 13 nt, Human
agaauuuauucaa

SEQ ID NO: 3559054 - RNA, 16 nt, Human
agaauuucaauuuguu

SEQ ID NO: 3559055 - RNA, 17 nt, Human
agaauuucccaaagcag

SEQ ID NO: 3559056 - RNA, 17 nt, Human
agaauuucuaaaaagau

SEQ ID NO: 3559057 - RNA, 21 nt, Human
agaauuucuaccauuucagag

SEQ ID NO: 3559058 - RNA, 13 nt, Human
agaauuucuagga

SEQ ID NO: 3559059 - RNA, 13 nt, Human
agaauuucuuggu

SEQ ID NO: 3559060 - RNA, 22 nt, Human
agaauuucuugguaagaagccg

SEQ ID NO: 3559061 - RNA, 13 nt, Human
agaauuugcauac

SEQ ID NO: 3559062 - RNA, 15 nt, Human
agaauuuggaaaucc

SEQ ID NO: 3559063 - RNA, 17 nt, Human
agaauuuuaaaaaugaa

SEQ ID NO: 3559064 - RNA, 15 nt, Human
agaauuuuaaauuau

SEQ ID NO: 3559065 - RNA, 22 nt, Human
agaauuuuaagugcuuuguaau

SEQ ID NO: 3559066 - RNA, 13 nt, Human
agaauuuuaggaa

SEQ ID NO: 3559067 - RNA, 18 nt, Human
agaauuuuauacuuuccc

SEQ ID NO: 3559068 - RNA, 21 nt, Human
agaauuuuauacuuucccuac

SEQ ID NO: 3559069 - RNA, 23 nt, Human
agaauuuuccugagacaaauuuu

SEQ ID NO: 3559070 - RNA, 12 nt, Human
agaauuuuggaa

SEQ ID NO: 3559071 - RNA, 15 nt, Human
agaauuuuuuugucu

SEQ ID NO: 3559072 - RNA, 17 nt, Human
agacaaaaacagccuca

SEQ ID NO: 3559073 - RNA, 22 nt, Human
agacaaaaacagccucacagaa

SEQ ID NO: 3559074 - RNA, 14 nt, Human
agacaaaaagacaa

SEQ ID NO: 3559075 - RNA, 15 nt, Human
agacaaaaagacaaa

SEQ ID NO: 3559076 - RNA, 14 nt, Human
agacaaaaauacuc

SEQ ID NO: 3559077 - RNA, 22 nt, Human
agacaaaaauacucuaauucua

SEQ ID NO: 3559078 - RNA, 23 nt, Human
agacaaaaauacucuaauucuaa

SEQ ID NO: 3559079 - RNA, 21 nt, Human
agacaaaaauuaucuauuugu

SEQ ID NO: 3559080 - RNA, 22 nt, Human
agacaaaauggauacauaaaga

SEQ ID NO: 3559081 - RNA, 19 nt, Human
agacaaacaccucccagga

SEQ ID NO: 3559082 - RNA, 17 nt, Human
agacaaaccagaagcaa

SEQ ID NO: 3559083 - RNA, 18 nt, Human
agacaaacuguaaaaaau

SEQ ID NO: 3559084 - RNA, 20 nt, Human
agacaaauacucauguguau

SEQ ID NO: 3559085 - RNA, 22 nt, Human
agacaaauauuccuuugcauau

SEQ ID NO: 3559086 - RNA, 16 nt, Human
agacaaauauuuggag

SEQ ID NO: 3559087 - RNA, 16 nt, Human
agacaaaucaaagcag

SEQ ID NO: 3559088 - RNA, 19 nt, Human
agacaaauucuguuucuug

SEQ ID NO: 3559089 - RNA, 23 nt, Human
agacaacagguaaaacagggcca

SEQ ID NO: 3559090 - RNA, 21 nt, Human
agacaacccugcaaaggacug

SEQ ID NO: 3559091 - RNA, 16 nt, Human
agacaacgugcucuuu

SEQ ID NO: 3559092 - RNA, 19 nt, Human
agacaacgugcucuuuguu

SEQ ID NO: 3559093 - RNA, 20 nt, Human
agacaacgugcucuuuguuu

SEQ ID NO: 3559094 - RNA, 21 nt, Human
agacaagacuucaguauguug

SEQ ID NO: 3559095 - RNA, 18 nt, Human
agacaagcuguugaccag

SEQ ID NO: 3559096 - RNA, 22 nt, Human
agacaagcuguugaccaggcac

SEQ ID NO: 3559097 - RNA, 18 nt, Human
agacaaguaauuucagug

SEQ ID NO: 3559098 - RNA, 22 nt, Human
agacaagugacuguaucugugu

SEQ ID NO: 3559099 - RNA, 15 nt, Human
agacaaguuccaugg

SEQ ID NO: 3559100 - RNA, 17 nt, Human
agacaauaaacccucag

SEQ ID NO: 3559101 - RNA, 17 nt, Human
agacaauacguuugaua

SEQ ID NO: 3559102 - RNA, 21 nt, Human
accuuaaguaagcaacagcau

SEQ ID NO: 3559103 - RNA, 15 nt, Human
accuuaauuuauuau

SEQ ID NO: 3559104 - RNA, 20 nt, Human
accuuacauuugaaaucuau

SEQ ID NO: 3559105 - RNA, 15 nt, Human
accuuaccaacuuuc

SEQ ID NO: 3559106 - RNA, 19 nt, Human
accuuaccaacuuucugua

SEQ ID NO: 3559107 - RNA, 18 nt, Human
accuuacgaucaggcaca

SEQ ID NO: 3559108 - RNA, 19 nt, Human
accuuacgaucaggcacag

SEQ ID NO: 3559109 - RNA, 21 nt, Human
accuuacuguggaggaaggau

SEQ ID NO: 3559110 - RNA, 21 nt, Human
accuuagaagguauuaagauu

SEQ ID NO: 3559111 - RNA, 14 nt, Human
accuuagaauacag

SEQ ID NO: 3559112 - RNA, 19 nt, Human
accuuagacagucccugcc

SEQ ID NO: 3559113 - RNA, 19 nt, Human
accuuagaccaccaagccu

SEQ ID NO: 3559114 - RNA, 21 nt, Human
accuuagauuuaguaguguaa

SEQ ID NO: 3559115 - RNA, 20 nt, Human
accuuagcucccucccgcac

SEQ ID NO: 3559116 - RNA, 12 nt, Human
acuaaggggccc

SEQ ID NO: 3559117 - RNA, 18 nt, Human
acuaaguagcccauaagg

SEQ ID NO: 3559118 - RNA, 20 nt, Human
acuaagucucuuuuuuacaa

SEQ ID NO: 3559119 - RNA, 22 nt, Human
acuaagucucuuuuuuacaaag

SEQ ID NO: 3559120 - RNA, 13 nt, Human
acuaaguucacau

SEQ ID NO: 3559121 - RNA, 15 nt, Human
acuaaguuuuuaugg

SEQ ID NO: 3559122 - RNA, 12 nt, Human
acuaauaaaaua

SEQ ID NO: 3559123 - RNA, 17 nt, Human
acuaauaaaauauuuuc

SEQ ID NO: 3559124 - RNA, 18 nt, Human
acuaauaaaauauuuucu

SEQ ID NO: 3559125 - RNA, 20 nt, Human
acuaauaaaauauuuucugu

SEQ ID NO: 3559126 - RNA, 15 nt, Human
acuaauaaauacaua

SEQ ID NO: 3559127 - RNA, 18 nt, Human
acuaauauaaaaugagua

SEQ ID NO: 3559128 - RNA, 17 nt, Human
acuaauauauuuaaaaa

SEQ ID NO: 3559129 - RNA, 19 nt, Human
acuaauauauuuaaaaaua

SEQ ID NO: 3559130 - RNA, 15 nt, Human
acuaauaugggcauu

SEQ ID NO: 3559131 - RNA, 14 nt, Human
acuaauauuucugu

SEQ ID NO: 3559132 - RNA, 15 nt, Human
acuaauauuucugua

SEQ ID NO: 3559133 - RNA, 19 nt, Human
acuaaugccuuacucuucu

SEQ ID NO: 3559134 - RNA, 13 nt, Human
acuaauggcauga

SEQ ID NO: 3559135 - RNA, 21 nt, Human
acuaauggcaugagaaauaca

SEQ ID NO: 3559136 - RNA, 16 nt, Human
acuaauguaaaaugau

SEQ ID NO: 3559137 - RNA, 15 nt, Human
acuaauuaacauaua

SEQ ID NO: 3559138 - RNA, 18 nt, Human
acuaauuaacauauaaua

SEQ ID NO: 3559139 - RNA, 20 nt, Human
acuaauuaggguacauuuau

SEQ ID NO: 3559140 - RNA, 23 nt, Human
acuaauuaggguacauuuauaau

SEQ ID NO: 3559141 - RNA, 17 nt, Human
acuaauuauacuacuuu

SEQ ID NO: 3559142 - RNA, 14 nt, Human
acuaauuguauaac

SEQ ID NO: 3559143 - RNA, 15 nt, Human
acuaauuuuaaaaug

SEQ ID NO: 3559144 - RNA, 23 nt, Human
acuaauuuuacacauuagauuuu

SEQ ID NO: 3559145 - RNA, 21 nt, Human
acuaauuuuacauguuuauaa

SEQ ID NO: 3559146 - RNA, 21 nt, Human
acuaauuuuaguauucauucu

SEQ ID NO: 3559147 - RNA, 18 nt, Human
acuaauuuuuguauuauu

SEQ ID NO: 3559148 - RNA, 21 nt, Human
acuacaaaaaaguuguuaacu

SEQ ID NO: 3559149 - RNA, 14 nt, Human
acuacaaaauuuga

SEQ ID NO: 3559150 - RNA, 21 nt, Human
acuacaaacaaaauuucuauu

SEQ ID NO: 3559151 - RNA, 22 nt, Human
acuacaaacaaaauuucuauua

SEQ ID NO: 3559152 - RNA, 11 nt, Human
agacuguggcu

SEQ ID NO: 3559153 - RNA, 19 nt, Human
agacuguggcuagugacaa

SEQ ID NO: 3559154 - RNA, 20 nt, Human
agacuguggcugcuagcacu

SEQ ID NO: 3559155 - RNA, 22 nt, Human
agacugugugugcccucugggc

SEQ ID NO: 3559156 - RNA, 21 nt, Human
agacuguguuugguccuguag

SEQ ID NO: 3559157 - RNA, 23 nt, Human
agacuguugggguggguauaaaa

SEQ ID NO: 3559158 - RNA, 23 nt, Human
agacuguuuuucagggagguggc

SEQ ID NO: 3559159 - RNA, 20 nt, Human
agacuuaaugagacuuuaaa

SEQ ID NO: 3559160 - RNA, 15 nt, Human
agacuuacuauuaca

SEQ ID NO: 3559161 - RNA, 16 nt, Human
agacuuacucuaagau

SEQ ID NO: 3559162 - RNA, 18 nt, Human
agacuuacucuaagaucu

SEQ ID NO: 3559163 - RNA, 18 nt, Human
agacuuaguauauuuucu

SEQ ID NO: 3559164 - RNA, 22 nt, Human
agacuuaguauauuuucuuuuc

SEQ ID NO: 3559165 - RNA, 19 nt, Human
agacuucaagcauggcuau

SEQ ID NO: 3559166 - RNA, 22 nt, Human
agacuucagggagucagcuguu

SEQ ID NO: 3559167 - RNA, 19 nt, Human
agacuucaguauguuguca

SEQ ID NO: 3559168 - RNA, 17 nt, Human
agacuucaucccucugg

SEQ ID NO: 3559169 - RNA, 17 nt, Human
agacuuccaaagaaugu

SEQ ID NO: 3559170 - RNA, 22 nt, Human
agacuucucuacccaucuuaaa

SEQ ID NO: 3559171 - RNA, 12 nt, Human
agacuucugcuu

SEQ ID NO: 3559172 - RNA, 15 nt, Human
agacuucuguuuuca

SEQ ID NO: 3559173 - RNA, 18 nt, Human
agacuucuguuuucaauc

SEQ ID NO: 3559174 - RNA, 12 nt, Human
agacuugaaaag

SEQ ID NO: 3559175 - RNA, 15 nt, Human
agacuugaaaagaga

SEQ ID NO: 3559176 - RNA, 20 nt, Human
agacuugaaaagagacaggc

SEQ ID NO: 3559177 - RNA, 15 nt, Human
agacuugacagugga

SEQ ID NO: 3559178 - RNA, 16 nt, Human
agacuugccagagccg

SEQ ID NO: 3559179 - RNA, 11 nt, Human
agacuugccuu

SEQ ID NO: 3559180 - RNA, 13 nt, Human
agacuugccuucc

SEQ ID NO: 3559181 - RNA, 22 nt, Human
agacuugccuuccuaagccugu

SEQ ID NO: 3559182 - RNA, 18 nt, Human
agacuuggaaaugggaga

SEQ ID NO: 3559183 - RNA, 19 nt, Human
agacuugguguccuuuccc

SEQ ID NO: 3559184 - RNA, 21 nt, Human
agacuugguugguaggguggg

SEQ ID NO: 3559185 - RNA, 18 nt, Human
agacuuguauauucuauu

SEQ ID NO: 3559186 - RNA, 22 nt, Human
agacuugucaagccugugcaaa

SEQ ID NO: 3559187 - RNA, 12 nt, Human
agacuuuaacau

SEQ ID NO: 3559188 - RNA, 16 nt, Human
agacuuuagaaauaaa

SEQ ID NO: 3559189 - RNA, 18 nt, Human
agacuuuagaaauaaaug

SEQ ID NO: 3559190 - RNA, 17 nt, Human
agacuuuagcuuucuga

SEQ ID NO: 3559191 - RNA, 12 nt, Human
agacuuucuguu

SEQ ID NO: 3559192 - RNA, 14 nt, Human
agacuuucuuuaaa

SEQ ID NO: 3559193 - RNA, 11 nt, Human
agacuuugaug

SEQ ID NO: 3559194 - RNA, 13 nt, Human
agacuuugauguc

SEQ ID NO: 3559195 - RNA, 14 nt, Human
agacuuugauguca

SEQ ID NO: 3559196 - RNA, 18 nt, Human
agacuuugaugucagcag

SEQ ID NO: 3559197 - RNA, 17 nt, Human
agacuuugguuauuuua

SEQ ID NO: 3559198 - RNA, 12 nt, Human
agacuuuuauga

SEQ ID NO: 3559199 - RNA, 15 nt, Human
agacuuuuaugauac

SEQ ID NO: 3559200 - RNA, 21 nt, Human
agacuuuuccaauaugugauu

SEQ ID NO: 3559201 - RNA, 13 nt, Human
agacuuuuguaca

SEQ ID NO: 3559202 - RNA, 15 nt, Human
agacuuuuuucuagu

SEQ ID NO: 3559203 - RNA, 21 nt, Human
agagaaaaaaaguuugccaga

SEQ ID NO: 3559204 - RNA, 21 nt, Human
agagaaaaagaaaugcaaaaa

SEQ ID NO: 3559205 - RNA, 12 nt, Human
agagaaaaagag

SEQ ID NO: 3559206 - RNA, 20 nt, Human
agagaaaaagcagaggccaa

SEQ ID NO: 3559207 - RNA, 16 nt, Human
agagaaaacaugcaga

SEQ ID NO: 3559208 - RNA, 19 nt, Human
agagaaaacuuauuugagu

SEQ ID NO: 3559209 - RNA, 12 nt, Human
agagaaaagaaa

SEQ ID NO: 3559210 - RNA, 13 nt, Human
agagaaaagaaaa

SEQ ID NO: 3559211 - RNA, 15 nt, Human
agagaaaagaaaaaa

SEQ ID NO: 3559212 - RNA, 14 nt, Human
agagaaaauaaaaa

SEQ ID NO: 3559213 - RNA, 15 nt, Human
agagaaaauaaaaag

SEQ ID NO: 3559214 - RNA, 19 nt, Human
agagaaaauaaaaaguuaa

SEQ ID NO: 3559215 - RNA, 12 nt, Human
agagaaaauaua

SEQ ID NO: 3559216 - RNA, 20 nt, Human
agagaaaaugcgguuauaaa

SEQ ID NO: 3559217 - RNA, 16 nt, Human
agagaaaauguaaaua

SEQ ID NO: 3559218 - RNA, 14 nt, Human
agagaaacaaacuu

SEQ ID NO: 3559219 - RNA, 15 nt, Human
agagaaacaaacuuu

SEQ ID NO: 3559220 - RNA, 13 nt, Human
agagaaacaguug

SEQ ID NO: 3559221 - RNA, 16 nt, Human
agagaaacaguuggua

SEQ ID NO: 3559222 - RNA, 13 nt, Human
agagaaaccagcu

SEQ ID NO: 3559223 - RNA, 17 nt, Human
agagaaaccagcuuccu

SEQ ID NO: 3559224 - RNA, 20 nt, Human
agagaaaccagcuuccuuca

SEQ ID NO: 3559225 - RNA, 20 nt, Human
agagaaaccguccucuuuuu

SEQ ID NO: 3559226 - RNA, 21 nt, Human
agagaaacuuuauacauuagu

SEQ ID NO: 3559227 - RNA, 13 nt, Human
agagaaagaaauu

SEQ ID NO: 3559228 - RNA, 16 nt, Human
agagaaagaagagaca

SEQ ID NO: 3559229 - RNA, 14 nt, Human
agagaaagagagag

SEQ ID NO: 3559230 - RNA, 16 nt, Human
agagaaagccaggcag

SEQ ID NO: 3559231 - RNA, 19 nt, Human
agagaaagccaggcaggua

SEQ ID NO: 3559232 - RNA, 11 nt, Human
agagaaaucuc

SEQ ID NO: 3559233 - RNA, 12 nt, Human
agagaaauucug

SEQ ID NO: 3559234 - RNA, 13 nt, Human
agagaaauucugu

SEQ ID NO: 3559235 - RNA, 18 nt, Human
agagaaauucuguuaaaa

SEQ ID NO: 3559236 - RNA, 13 nt, Human
agagaacaggacu

SEQ ID NO: 3559237 - RNA, 14 nt, Human
agagaacaggacua

SEQ ID NO: 3559238 - RNA, 15 nt, Human
agagaacccagccca

SEQ ID NO: 3559239 - RNA, 20 nt, Human
agagaaccgagcaaagauca

SEQ ID NO: 3559240 - RNA, 20 nt, Human
agagaaccuggaguuccuga

SEQ ID NO: 3559241 - RNA, 22 nt, Human
agagaacuaacacuauuuuaug

SEQ ID NO: 3559242 - RNA, 13 nt, Human
agagaacuagugg

SEQ ID NO: 3559243 - RNA, 15 nt, Human
agagaacugaaaaga

SEQ ID NO: 3559244 - RNA, 17 nt, Human
agagaacugaaaagaga

SEQ ID NO: 3559245 - RNA, 17 nt, Human
agagaacuuccagaucc

SEQ ID NO: 3559246 - RNA, 10 nt, Human
agagaagaag

SEQ ID NO: 3559247 - RNA, 12 nt, Human
agagaagaauga

SEQ ID NO: 3559248 - RNA, 13 nt, Human
agagaagagcccc

SEQ ID NO: 3559249 - RNA, 16 nt, Human
agagaagagccccacu

SEQ ID NO: 3559250 - RNA, 18 nt, Human
agagaagagccccacucu

SEQ ID NO: 3559251 - RNA, 21 nt, Human
agagaagauaauuguugaaau

SEQ ID NO: 3559252 - RNA, 16 nt, Human
agagaagcaaguggug

SEQ ID NO: 3559253 - RNA, 11 nt, Human
agagaagccag

SEQ ID NO: 3559254 - RNA, 13 nt, Human
agagaagccugug

SEQ ID NO: 3559255 - RNA, 13 nt, Human
agagaagccuuca

SEQ ID NO: 3559256 - RNA, 14 nt, Human
agagaagccuuggu

SEQ ID NO: 3559257 - RNA, 14 nt, Human
agagaagcugcuga

SEQ ID NO: 3559258 - RNA, 16 nt, Human
agagaaggaaugucuu

SEQ ID NO: 3559259 - RNA, 12 nt, Human
agagaaggagcc

SEQ ID NO: 3559260 - RNA, 13 nt, Human
agagaaggcagga

SEQ ID NO: 3559261 - RNA, 16 nt, Human
agagaaguagaaauca

SEQ ID NO: 3559262 - RNA, 16 nt, Human
agagaaguauuauaaa

SEQ ID NO: 3559263 - RNA, 16 nt, Human
agagccugccuggagc

SEQ ID NO: 3559264 - RNA, 12 nt, Human
agagccugcugc

SEQ ID NO: 3559265 - RNA, 14 nt, Human
agagccuggagaag

SEQ ID NO: 3559266 - RNA, 16 nt, Human
agagccuguaaacuuu

SEQ ID NO: 3559267 - RNA, 13 nt, Human
agagccuuaaaac

SEQ ID NO: 3559268 - RNA, 16 nt, Human
agagccuuccacccag

SEQ ID NO: 3559269 - RNA, 17 nt, Human
agagccuuccaggggug

SEQ ID NO: 3559270 - RNA, 15 nt, Human
agagccuucucagaa

SEQ ID NO: 3559271 - RNA, 16 nt, Human
agagccuucucagaag

SEQ ID NO: 3559272 - RNA, 22 nt, Human
agagccuucugaugucucuaaa

SEQ ID NO: 3559273 - RNA, 22 nt, Human
agagccuugguguccaccuggc

SEQ ID NO: 3559274 - RNA, 21 nt, Human
agagccuuuggaugaccagaa

SEQ ID NO: 3559275 - RNA, 23 nt, Human
agagcgaggcugagccuacagau

SEQ ID NO: 3559276 - RNA, 14 nt, Human
agagcgcacaggga

SEQ ID NO: 3559277 - RNA, 21 nt, Human
agagcgccgugaguucucagg

SEQ ID NO: 3559278 - RNA, 14 nt, Human
agagcgccugcccc

SEQ ID NO: 3559279 - RNA, 20 nt, Human
agagcgccugccccucccag

SEQ ID NO: 3559280 - RNA, 18 nt, Human
agagcgugagcugagcag

SEQ ID NO: 3559281 - RNA, 15 nt, Human
agagcguugaaguug

SEQ ID NO: 3559282 - RNA, 19 nt, Human
agagcuaaacuccuuccug

SEQ ID NO: 3559283 - RNA, 18 nt, Human
agagcuaagggugggugc

SEQ ID NO: 3559284 - RNA, 17 nt, Human
agagcuacguauuuaau

SEQ ID NO: 3559285 - RNA, 16 nt, Human
agagcuagaaccugga

SEQ ID NO: 3559286 - RNA, 22 nt, Human
agagcuagaaccuggagaacua

SEQ ID NO: 3559287 - RNA, 14 nt, Human
agagcuagagaaau

SEQ ID NO: 3559288 - RNA, 20 nt, Human
agagcuagcagcagggaggg

SEQ ID NO: 3559289 - RNA, 14 nt, Human
agagcuagcgcugc

SEQ ID NO: 3559290 - RNA, 17 nt, Human
agagcuaucaggagaaa

SEQ ID NO: 3559291 - RNA, 19 nt, Human
agagcuauggacagcauug

SEQ ID NO: 3559292 - RNA, 12 nt, Human
agagcucaggau

SEQ ID NO: 3559293 - RNA, 21 nt, Human
agagcuccccuacggaccagg

SEQ ID NO: 3559294 - RNA, 16 nt, Human
agagcucuccagcucc

SEQ ID NO: 3559295 - RNA, 13 nt, Human
agagcucucucua

SEQ ID NO: 3559296 - RNA, 23 nt, Human
agagcugaagguuguggccuuug

SEQ ID NO: 3559297 - RNA, 14 nt, Human
agagcugauccaga

SEQ ID NO: 3559298 - RNA, 18 nt, Human
agagcugauggagaagga

SEQ ID NO: 3559299 - RNA, 19 nt, Human
agagcugauggagaaggaa

SEQ ID NO: 3559300 - RNA, 14 nt, Human
agagcugccaccug

SEQ ID NO: 3559301 - RNA, 12 nt, Human
agagcugccagu

SEQ ID NO: 3559302 - RNA, 15 nt, Human
agagcugcccucucc

SEQ ID NO: 3559303 - RNA, 16 nt, Human
agagcugcccucuccu

SEQ ID NO: 3559304 - RNA, 19 nt, Human
agagcugcccucuccuggg

SEQ ID NO: 3559305 - RNA, 20 nt, Human
agagcugcccucuccugggc

SEQ ID NO: 3559306 - RNA, 18 nt, Human
agagcugccuaagaggca

SEQ ID NO: 3559307 - RNA, 14 nt, Human
agagcugccucucg

SEQ ID NO: 3559308 - RNA, 14 nt, Human
agagcugcgggcug

SEQ ID NO: 3559309 - RNA, 15 nt, Human
agagcuggcaaaggu

SEQ ID NO: 3559310 - RNA, 18 nt, Human
agagcuggcaaagguggc

SEQ ID NO: 3559311 - RNA, 22 nt, Human
agagcugggaggcauggcccug

SEQ ID NO: 3559312 - RNA, 23 nt, Human
agagcugggaggcauggcccugg

SEQ ID NO: 3559313 - RNA, 18 nt, Human
agagcuggggcugaggga

SEQ ID NO: 3559314 - RNA, 21 nt, Human
agagacccucugccaccagag

SEQ ID NO: 3559315 - RNA, 13 nt, Human
agagaccgaggag

SEQ ID NO: 3559316 - RNA, 22 nt, Human
agagaccguccucaccccuguc

SEQ ID NO: 3559317 - RNA, 20 nt, Human
agagaccgucgggggcugag

SEQ ID NO: 3559318 - RNA, 15 nt, Human
agagaccuaccucag

SEQ ID NO: 3559319 - RNA, 17 nt, Human
agagaccuaccucaggu

SEQ ID NO: 3559320 - RNA, 20 nt, Human
agagaccuaccucagguugc

SEQ ID NO: 3559321 - RNA, 16 nt, Human
agagaccucaucagga

SEQ ID NO: 3559322 - RNA, 16 nt, Human
agagaccugaagugug

SEQ ID NO: 3559323 - RNA, 14 nt, Human
agagacucagccug

SEQ ID NO: 3559324 - RNA, 16 nt, Human
agagacucagccugca

SEQ ID NO: 3559325 - RNA, 18 nt, Human
agagacucagccugcagu

SEQ ID NO: 3559326 - RNA, 18 nt, Human
agagacucccaugaagcc

SEQ ID NO: 3559327 - RNA, 19 nt, Human
agagacucccaugaagccu

SEQ ID NO: 3559328 - RNA, 13 nt, Human
agagacuccugca

SEQ ID NO: 3559329 - RNA, 22 nt, Human
agagacuccugcaggcagccag

SEQ ID NO: 3559330 - RNA, 23 nt, Human
agagacuccugcaggcagccagg

SEQ ID NO: 3559331 - RNA, 21 nt, Human
agagacuccuugagagaccag

SEQ ID NO: 3559332 - RNA, 22 nt, Human
agagacucuggccuccacaguu

SEQ ID NO: 3559333 - RNA, 22 nt, Human
agagacugaauagauaugaaag

SEQ ID NO: 3559334 - RNA, 22 nt, Human
agagacugcguucugcaagcau

SEQ ID NO: 3559335 - RNA, 13 nt, Human
agagacuggagca

SEQ ID NO: 3559336 - RNA, 21 nt, Human
agagacuggagcaucugacuc

SEQ ID NO: 3559337 - RNA, 23 nt, Human
agagacugggaagauaggcucug

SEQ ID NO: 3559338 - RNA, 15 nt, Human
agagacuguagauug

SEQ ID NO: 3559339 - RNA, 15 nt, Human
agagacuugggaaug

SEQ ID NO: 3559340 - RNA, 17 nt, Human
agagacuuuagggggug

SEQ ID NO: 3559341 - RNA, 19 nt, Human
agagagaaaaaaaaaauag

SEQ ID NO: 3559342 - RNA, 15 nt, Human
agagagaaaauaaaa

SEQ ID NO: 3559343 - RNA, 22 nt, Human
agagagaaaauaaaaaguuaaa

SEQ ID NO: 3559344 - RNA, 21 nt, Human
agagagaaagaaguaggcaug

SEQ ID NO: 3559345 - RNA, 14 nt, Human
agagagaaagagag

SEQ ID NO: 3559346 - RNA, 12 nt, Human
agagagaaaucu

SEQ ID NO: 3559347 - RNA, 19 nt, Human
agagagaaauucuguuaaa

SEQ ID NO: 3559348 - RNA, 16 nt, Human
agagagaagagcccca

SEQ ID NO: 3559349 - RNA, 14 nt, Human
agagagacaagaag

SEQ ID NO: 3559350 - RNA, 10 nt, Human
agagagagaa

SEQ ID NO: 3559351 - RNA, 11 nt, Human
agagagagaga

SEQ ID NO: 3559352 - RNA, 14 nt, Human
agagagagagaaaa

SEQ ID NO: 3559353 - RNA, 15 nt, Human
agagagagagagagg

SEQ ID NO: 3559354 - RNA, 13 nt, Human
agagagagagagg

SEQ ID NO: 3559355 - RNA, 14 nt, Human
agagagagaggaca

SEQ ID NO: 3559356 - RNA, 14 nt, Human
agagagagagggcc

SEQ ID NO: 3559357 - RNA, 14 nt, Human
agagagaggcagaa

SEQ ID NO: 3559358 - RNA, 21 nt, Human
agagagaucaaauggaaagga

SEQ ID NO: 3559359 - RNA, 15 nt, Human
agagagcagugcuuu

SEQ ID NO: 3559360 - RNA, 15 nt, Human
agagagccugcagga

SEQ ID NO: 3559361 - RNA, 18 nt, Human
agagagccugcaggaucu

SEQ ID NO: 3559362 - RNA, 19 nt, Human
agagagcugagugagcuga

SEQ ID NO: 3559363 - RNA, 20 nt, Human
agagaggaaauucuccacug

SEQ ID NO: 3559364 - RNA, 14 nt, Human
agagaggagaaaca

SEQ ID NO: 3559365 - RNA, 17 nt, Human
agagaggagaggagaga

SEQ ID NO: 3559366 - RNA, 20 nt, Human
agagaggagucagagagaau

SEQ ID NO: 3559367 - RNA, 18 nt, Human
agagaggaguucaaugau

SEQ ID NO: 3559368 - RNA, 22 nt, Human
agagaggccauucuuucccaac

SEQ ID NO: 3559369 - RNA, 16 nt, Human
agagaggccuuguccc

SEQ ID NO: 3559370 - RNA, 18 nt, Human
agagaggcuaaaauguuu

SEQ ID NO: 3559371 - RNA, 17 nt, Human
agagagggaauucucuu

SEQ ID NO: 3559372 - RNA, 16 nt, Human
agagagggagaagaag

SEQ ID NO: 3559373 - RNA, 19 nt, Human
agagagggagaagaaguca

SEQ ID NO: 3559374 - RNA, 15 nt, Human
agagagggcaggcau

SEQ ID NO: 3559375 - RNA, 14 nt, Human
agagagggggccac

SEQ ID NO: 3559376 - RNA, 19 nt, Human
agagagggggccaccuccc

SEQ ID NO: 3559377 - RNA, 22 nt, Human
agagaggguggugaccucugcc

SEQ ID NO: 3559378 - RNA, 23 nt, Human
agagaggguggugaccucugccu

SEQ ID NO: 3559379 - RNA, 23 nt, Human
agagaggucaagcccaggaggac

SEQ ID NO: 3559380 - RNA, 20 nt, Human
agagagucccacugccucag

SEQ ID NO: 3559381 - RNA, 21 nt, Human
agagagucccacugccucagg

SEQ ID NO: 3559382 - RNA, 15 nt, Human
agagaguccucugga

SEQ ID NO: 3559383 - RNA, 16 nt, Human
agagaguccucuggau

SEQ ID NO: 3559384 - RNA, 14 nt, Human
agagaguggcuccu

SEQ ID NO: 3559385 - RNA, 14 nt, Human
agagaguggcuggg

SEQ ID NO: 3559386 - RNA, 16 nt, Human
agagaguggcuggggc

SEQ ID NO: 3559387 - RNA, 17 nt, Human
agagaguggcuggggca

SEQ ID NO: 3559388 - RNA, 16 nt, Human
agagaguguugaaacg

SEQ ID NO: 3559389 - RNA, 14 nt, Human
agagaguuaaucaa

SEQ ID NO: 3559390 - RNA, 19 nt, Human
agagauaccaagaugccau

SEQ ID NO: 3559391 - RNA, 16 nt, Human
agagauagaaccugga

SEQ ID NO: 3559392 - RNA, 17 nt, Human
agagauagccuguggcc

SEQ ID NO: 3559393 - RNA, 13 nt, Human
agagauauauaua

SEQ ID NO: 3559394 - RNA, 15 nt, Human
agagauauaucugaa

SEQ ID NO: 3559395 - RNA, 23 nt, Human
agagauauaucugaaaacuggaa

SEQ ID NO: 3559396 - RNA, 18 nt, Human
agagauauuuugggcaug

SEQ ID NO: 3559397 - RNA, 15 nt, Human
agagaucaaagauga

SEQ ID NO: 3559398 - RNA, 22 nt, Human
agagaucaaccccuucgcuccu

SEQ ID NO: 3559399 - RNA, 13 nt, Human
agagaucauggaa

SEQ ID NO: 3559400 - RNA, 15 nt, Human
agagauccaaagacu

SEQ ID NO: 3559401 - RNA, 21 nt, Human
agagaucccaaguagaaucuc

SEQ ID NO: 3559402 - RNA, 18 nt, Human
agagaugacugaguccuc

SEQ ID NO: 3559403 - RNA, 13 nt, Human
agagaugcagaaa

SEQ ID NO: 3559404 - RNA, 16 nt, Human
agagaugccuccaccg

SEQ ID NO: 3559405 - RNA, 21 nt, Human
agagaugcuguaacuuaaaau

SEQ ID NO: 3559406 - RNA, 22 nt, Human
agagauggacaguucacacccu

SEQ ID NO: 3559407 - RNA, 18 nt, Human
agagauggaggaggaggc

SEQ ID NO: 3559408 - RNA, 23 nt, Human
agaggccagccccacccaggagg

SEQ ID NO: 3559409 - RNA, 15 nt, Human
agaggccagccuggc

SEQ ID NO: 3559410 - RNA, 23 nt, Human
agaggccaggcaggagcccuucu

SEQ ID NO: 3559411 - RNA, 14 nt, Human
agaggccauggcag

SEQ ID NO: 3559412 - RNA, 20 nt, Human
agaggccauggcagaauaau

SEQ ID NO: 3559413 - RNA, 15 nt, Human
agaggcccaggcugc

SEQ ID NO: 3559414 - RNA, 16 nt, Human
agaggcccaggcugcc

SEQ ID NO: 3559415 - RNA, 12 nt, Human
agaggccccagc

SEQ ID NO: 3559416 - RNA, 15 nt, Human
agaggccccagccuc

SEQ ID NO: 3559417 - RNA, 23 nt, Human
agaggccccagccucccugaagc

SEQ ID NO: 3559418 - RNA, 14 nt, Human
agaggcccccagcc

SEQ ID NO: 3559419 - RNA, 16 nt, Human
agaggcccccagccca

SEQ ID NO: 3559420 - RNA, 21 nt, Human
agaggcccccagcccagggcu

SEQ ID NO: 3559421 - RNA, 14 nt, Human
agaggcccucaagu

SEQ ID NO: 3559422 - RNA, 14 nt, Human
agaggcccucgcug

SEQ ID NO: 3559423 - RNA, 19 nt, Human
agaggcccucgcugccagc

SEQ ID NO: 3559424 - RNA, 18 nt, Human
agaggcccucuggagugg

SEQ ID NO: 3559425 - RNA, 22 nt, Human
agaggcccucuggaguggccac

SEQ ID NO: 3559426 - RNA, 23 nt, Human
agaggcccucuggaguggccacu

SEQ ID NO: 3559427 - RNA, 24 nt, Human
agaggcccucuggaguggccacua

SEQ ID NO: 3559428 - RNA, 12 nt, Human
agaggcccugga

SEQ ID NO: 3559429 - RNA, 21 nt, Human
agaggcccuggaucagcgugg

SEQ ID NO: 3559430 - RNA, 22 nt, Human
agaggcccuggaucagcguggc

SEQ ID NO: 3559431 - RNA, 23 nt, Human
agaggcccuggaucagcguggcc

SEQ ID NO: 3559432 - RNA, 23 nt, Human
agaggccugaaauccugguuccu

SEQ ID NO: 3559433 - RNA, 13 nt, Human
agaggccugcccg

SEQ ID NO: 3559434 - RNA, 21 nt, Human
agaggccugccuccagggcug

SEQ ID NO: 3559435 - RNA, 18 nt, Human
agaggccugggcugggaa

SEQ ID NO: 3559436 - RNA, 18 nt, Human
agaggccuguuuggccuc

SEQ ID NO: 3559437 - RNA, 15 nt, Human
agaggcgggccagcc

SEQ ID NO: 3559438 - RNA, 19 nt, Human
agaggcuaaauuacucagg

SEQ ID NO: 3559439 - RNA, 21 nt, Human
agaggcuaaauuacucaggaa

SEQ ID NO: 3559440 - RNA, 16 nt, Human
agaggcuagcuucugc

SEQ ID NO: 3559441 - RNA, 19 nt, Human
agaggcuauuauuuucacu

SEQ ID NO: 3559442 - RNA, 19 nt, Human
agaggcugaaagaggccaa

SEQ ID NO: 3559443 - RNA, 12 nt, Human
agaggcugagac

SEQ ID NO: 3559444 - RNA, 17 nt, Human
agaggcugaggccugga

SEQ ID NO: 3559445 - RNA, 16 nt, Human
agaggcugaggcuggc

SEQ ID NO: 3559446 - RNA, 19 nt, Human
agaggcugaggcuggcaca

SEQ ID NO: 3559447 - RNA, 12 nt, Human
agaggcugcagc

SEQ ID NO: 3559448 - RNA, 16 nt, Human
agaggcugcagccagg

SEQ ID NO: 3559449 - RNA, 22 nt, Human
agaggcugccucucccaucacu

SEQ ID NO: 3559450 - RNA, 19 nt, Human
agaggcuggaggcagggcc

SEQ ID NO: 3559451 - RNA, 16 nt, Human
agaggcuggugcugug

SEQ ID NO: 3559452 - RNA, 21 nt, Human
agaggcuggugcuguggccag

SEQ ID NO: 3559453 - RNA, 22 nt, Human
agaggcuggugcuguggccagg

SEQ ID NO: 3559454 - RNA, 18 nt, Human
agaggcugguuuuggcau

SEQ ID NO: 3559455 - RNA, 23 nt, Human
agaggcuucuccgccagccuccu

SEQ ID NO: 3559456 - RNA, 13 nt, Human
agagggaaaaugu

SEQ ID NO: 3559457 - RNA, 20 nt, Human
agagggaaacgugcccucug

SEQ ID NO: 3559458 - RNA, 15 nt, Human
agagggaagaaaaga

SEQ ID NO: 3559459 - RNA, 23 nt, Human
agagggaagaaaagagcuuucuu

SEQ ID NO: 3559460 - RNA, 12 nt, Human
agagggaaugug

SEQ ID NO: 3559461 - RNA, 16 nt, Human
agagggaaugugaaau

SEQ ID NO: 3559462 - RNA, 16 nt, Human
agagggaccucuccca

SEQ ID NO: 3559463 - RNA, 15 nt, Human
agagggacgccuggg

SEQ ID NO: 3559464 - RNA, 15 nt, Human
agagggagaagaagu

SEQ ID NO: 3559465 - RNA, 17 nt, Human
agagggaggcaagcccu

SEQ ID NO: 3559466 - RNA, 16 nt, Human
agagggagggagggcu

SEQ ID NO: 3559467 - RNA, 20 nt, Human
agagggagggagggcuccag

SEQ ID NO: 3559468 - RNA, 22 nt, Human
agagggagggagggcuccagac

SEQ ID NO: 3559469 - RNA, 16 nt, Human
agagggaggggccuag

SEQ ID NO: 3559470 - RNA, 15 nt, Human
agagggagguaagga

SEQ ID NO: 3559471 - RNA, 22 nt, Human
agagggaggucacuggaaaggg

SEQ ID NO: 3559472 - RNA, 20 nt, Human
agagggagugacagaggcag

SEQ ID NO: 3559473 - RNA, 22 nt, Human
agagcaggacuccaggcccaag

SEQ ID NO: 3559474 - RNA, 12 nt, Human
agagcaggcaca

SEQ ID NO: 3559475 - RNA, 20 nt, Human
agagcaggcacauggaggag

SEQ ID NO: 3559476 - RNA, 13 nt, Human
agagcaggccagg

SEQ ID NO: 3559477 - RNA, 19 nt, Human
agagcaggcguucagcuca

SEQ ID NO: 3559478 - RNA, 13 nt, Human
agagcaggcuggc

SEQ ID NO: 3559479 - RNA, 22 nt, Human
agagcaggcuggcagcucucca

SEQ ID NO: 3559480 - RNA, 23 nt, Human
agagcaggcuggcagcucuccag

SEQ ID NO: 3559481 - RNA, 22 nt, Human
agagcagggguccuugguguga

SEQ ID NO: 3559482 - RNA, 18 nt, Human
agagcaguccauuucuac

SEQ ID NO: 3559483 - RNA, 12 nt, Human
agagcagugcuu

SEQ ID NO: 3559484 - RNA, 16 nt, Human
agagcagugggccugg

SEQ ID NO: 3559485 - RNA, 17 nt, Human
agagcagugguaagaau

SEQ ID NO: 3559486 - RNA, 15 nt, Human
agagcaucaggccua

SEQ ID NO: 3559487 - RNA, 15 nt, Human
agagcaucaugccuc

SEQ ID NO: 3559488 - RNA, 18 nt, Human
agagcaucaugccucuga

SEQ ID NO: 3559489 - RNA, 21 nt, Human
agagcaucaugccucugaggc

SEQ ID NO: 3559490 - RNA, 23 nt, Human
agagcaucaugccucugaggcca

SEQ ID NO: 3559491 - RNA, 12 nt, Human
agagcaugaaau

SEQ ID NO: 3559492 - RNA, 17 nt, Human
agagcauuacgugagcc

SEQ ID NO: 3559493 - RNA, 21 nt, Human
agagcauuacgugagccaggu

SEQ ID NO: 3559494 - RNA, 17 nt, Human
agagcauugcauggaca

SEQ ID NO: 3559495 - RNA, 20 nt, Human
agagcauuuccaacaccaca

SEQ ID NO: 3559496 - RNA, 23 nt, Human
agagccaauggaguagaccccug

SEQ ID NO: 3559497 - RNA, 17 nt, Human
agagccacaggucuuua

SEQ ID NO: 3559498 - RNA, 18 nt, Human
agagccagagaagugaca

SEQ ID NO: 3559499 - RNA, 14 nt, Human
agagccagcccucc

SEQ ID NO: 3559500 - RNA, 17 nt, Human
agagccagcccucccug

SEQ ID NO: 3559501 - RNA, 20 nt, Human
agagccagcccucccugucc

SEQ ID NO: 3559502 - RNA, 13 nt, Human
agagccagcuccc

SEQ ID NO: 3559503 - RNA, 13 nt, Human
agagccagcuugg

SEQ ID NO: 3559504 - RNA, 19 nt, Human
agagccaggagaagcucag

SEQ ID NO: 3559505 - RNA, 16 nt, Human
agagccauacauaaaa

SEQ ID NO: 3559506 - RNA, 20 nt, Human
agagccauauaaguuugaag

SEQ ID NO: 3559507 - RNA, 16 nt, Human
agagccaugcugggaa

SEQ ID NO: 3559508 - RNA, 18 nt, Human
agagccauguagaagcug

SEQ ID NO: 3559509 - RNA, 20 nt, Human
agagccauguagaagcugca

SEQ ID NO: 3559510 - RNA, 19 nt, Human
agagccaugucuucucccu

SEQ ID NO: 3559511 - RNA, 16 nt, Human
agagccauuuugugaa

SEQ ID NO: 3559512 - RNA, 19 nt, Human
agagcccaccuuggcucaa

SEQ ID NO: 3559513 - RNA, 16 nt, Human
agagcccagagguaac

SEQ ID NO: 3559514 - RNA, 15 nt, Human
agagcccagaguccc

SEQ ID NO: 3559515 - RNA, 17 nt, Human
agagcccaggagcuccc

SEQ ID NO: 3559516 - RNA, 13 nt, Human
agagcccaggcuc

SEQ ID NO: 3559517 - RNA, 15 nt, Human
agagccccacagccc

SEQ ID NO: 3559518 - RNA, 14 nt, Human
agagccccagcuga

SEQ ID NO: 3559519 - RNA, 15 nt, Human
agagccccagcugac

SEQ ID NO: 3559520 - RNA, 12 nt, Human
agagcccccagg

SEQ ID NO: 3559521 - RNA, 13 nt, Human
agagcccccagga

SEQ ID NO: 3559522 - RNA, 19 nt, Human
agagccccuccuccagccc

SEQ ID NO: 3559523 - RNA, 23 nt, Human
agagccccuccuccagccccugu

SEQ ID NO: 3559524 - RNA, 16 nt, Human
agagcccugcucccuc

SEQ ID NO: 3559525 - RNA, 18 nt, Human
agagcccugcucccuccg

SEQ ID NO: 3559526 - RNA, 12 nt, Human
agagcccuggga

SEQ ID NO: 3559527 - RNA, 15 nt, Human
agagcccuucauuug

SEQ ID NO: 3559528 - RNA, 19 nt, Human
agagccggcccgccucucc

SEQ ID NO: 3559529 - RNA, 21 nt, Human
agagccggcccgccucuccuc

SEQ ID NO: 3559530 - RNA, 18 nt, Human
agagccggguguccccaa

SEQ ID NO: 3559531 - RNA, 17 nt, Human
agagccucaaaugagaa

SEQ ID NO: 3559532 - RNA, 15 nt, Human
agagccugagaguga

SEQ ID NO: 3559533 - RNA, 17 nt, Human
agagccugcaggugcug

SEQ ID NO: 3559534 - RNA, 13 nt, Human
agagccugcccca

SEQ ID NO: 3559535 - RNA, 15 nt, Human
agagccugccuggag

SEQ ID NO: 3559536 - RNA, 17 nt, Human
agagccugccuggagcg

SEQ ID NO: 3559537 - RNA, 17 nt, Human
agagccugcugcauggg

SEQ ID NO: 3559538 - RNA, 12 nt, Human
agagccugcugg

SEQ ID NO: 3559539 - RNA, 13 nt, Human
agagccugcugga

SEQ ID NO: 3559540 - RNA, 16 nt, Human
agagccugcuggaucu

SEQ ID NO: 3559541 - RNA, 16 nt, Human
agagccuggagaagcu

SEQ ID NO: 3559542 - RNA, 10 nt, Human
agagccuggg

SEQ ID NO: 3559543 - RNA, 13 nt, Human
agagccuggggcu

SEQ ID NO: 3559544 - RNA, 16 nt, Human
agagccuggggcucua

SEQ ID NO: 3559545 - RNA, 18 nt, Human
agagccuggugcugcugc

SEQ ID NO: 3559546 - RNA, 15 nt, Human
agagccuuaaaacau

SEQ ID NO: 3559547 - RNA, 16 nt, Human
agagccuucagccuua

SEQ ID NO: 3559548 - RNA, 17 nt, Human
agagccuuccacccagg

SEQ ID NO: 3559549 - RNA, 20 nt, Human
agagccuuccacccaggggc

SEQ ID NO: 3559550 - RNA, 19 nt, Human
agagccuucucagaagcac

SEQ ID NO: 3559551 - RNA, 21 nt, Human
agagccuugguguccaccugg

SEQ ID NO: 3559552 - RNA, 23 nt, Human
agagccuugguucaucaguguua

SEQ ID NO: 3559553 - RNA, 22 nt, Human
agaucauaguuuuauuuauauu

SEQ ID NO: 3559554 - RNA, 21 nt, Human
agaucauccagaaguuccuca

SEQ ID NO: 3559555 - RNA, 21 nt, Human
agaucauugugaaauuauuca

SEQ ID NO: 3559556 - RNA, 17 nt, Human
agaucauuugaguucag

SEQ ID NO: 3559557 - RNA, 14 nt, Human
agauccacacacag

SEQ ID NO: 3559558 - RNA, 16 nt, Human
agauccacacacagag

SEQ ID NO: 3559559 - RNA, 13 nt, Human
agauccagccugg

SEQ ID NO: 3559560 - RNA, 17 nt, Human
agauccaggagcuccag

SEQ ID NO: 3559561 - RNA, 22 nt, Human
agauccagggacagaggcccca

SEQ ID NO: 3559562 - RNA, 15 nt, Human
agauccauuaauuua

SEQ ID NO: 3559563 - RNA, 18 nt, Human
agauccauuaauuuaaau

SEQ ID NO: 3559564 - RNA, 19 nt, Human
agauccauuuccauugcuu

SEQ ID NO: 3559565 - RNA, 22 nt, Human
agaucccagaaggaccuccuga

SEQ ID NO: 3559566 - RNA, 13 nt, Human
agaucccagcuca

SEQ ID NO: 3559567 - RNA, 19 nt, Human
agaucccccagaaaagaaa

SEQ ID NO: 3559568 - RNA, 14 nt, Human
agaucccccagacu

SEQ ID NO: 3559569 - RNA, 16 nt, Human
agauccuaagaugugu

SEQ ID NO: 3559570 - RNA, 14 nt, Human
agauccuaaggguc

SEQ ID NO: 3559571 - RNA, 12 nt, Human
agauccuccuca

SEQ ID NO: 3559572 - RNA, 15 nt, Human
agauccuccucauuc

SEQ ID NO: 3559573 - RNA, 14 nt, Human
agauccucucuggg

SEQ ID NO: 3559574 - RNA, 17 nt, Human
agauccucucuggggcu

SEQ ID NO: 3559575 - RNA, 20 nt, Human
agauccugaucuuaagaggc

SEQ ID NO: 3559576 - RNA, 22 nt, Human
agauccugaucuuaagaggcug

SEQ ID NO: 3559577 - RNA, 13 nt, Human
agauccuggaaau

SEQ ID NO: 3559578 - RNA, 14 nt, Human
agauccuuguuuca

SEQ ID NO: 3559579 - RNA, 18 nt, Human
agaucgagaccauccugg

SEQ ID NO: 3559580 - RNA, 14 nt, Human
agaucggggccaga

SEQ ID NO: 3559581 - RNA, 17 nt, Human
agaucggggccagaggc

SEQ ID NO: 3559582 - RNA, 14 nt, Human
agaucgguuaacaa

SEQ ID NO: 3559583 - RNA, 14 nt, Human
agaucgucaggacc

SEQ ID NO: 3559584 - RNA, 22 nt, Human
agaucgugccguuacucuccaa

SEQ ID NO: 3559585 - RNA, 14 nt, Human
agaucguguauuga

SEQ ID NO: 3559586 - RNA, 23 nt, Human
agaucguguauugagauuucuua

SEQ ID NO: 3559587 - RNA, 22 nt, Human
agaucuaaaaauaacuguaauu

SEQ ID NO: 3559588 - RNA, 18 nt, Human
agaucuaaauaaaaugcu

SEQ ID NO: 3559589 - RNA, 22 nt, Human
agaucuaaggaugucacagggc

SEQ ID NO: 3559590 - RNA, 16 nt, Human
agaucuauaaagcgau

SEQ ID NO: 3559591 - RNA, 16 nt, Human
agaucucacucugccc

SEQ ID NO: 3559592 - RNA, 21 nt, Human
agaucucccacaugccagggg

SEQ ID NO: 3559593 - RNA, 18 nt, Human
agaucucuaacuucacca

SEQ ID NO: 3559594 - RNA, 18 nt, Human
agaucucugcuuuggaaa

SEQ ID NO: 3559595 - RNA, 13 nt, Human
agaucugccuaag

SEQ ID NO: 3559596 - RNA, 12 nt, Human
agaucugguuuu

SEQ ID NO: 3559597 - RNA, 17 nt, Human
agaucugguuuugcuau

SEQ ID NO: 3559598 - RNA, 18 nt, Human
agaucuguaauuuuuauu

SEQ ID NO: 3559599 - RNA, 15 nt, Human
agaucuguccucagc

SEQ ID NO: 3559600 - RNA, 14 nt, Human
agaucugugcccca

SEQ ID NO: 3559601 - RNA, 19 nt, Human
agaucugugccccaugccu

SEQ ID NO: 3559602 - RNA, 12 nt, Human
agaucuuaauau

SEQ ID NO: 3559603 - RNA, 14 nt, Human
agaucuuagauucu

SEQ ID NO: 3559604 - RNA, 13 nt, Human
agaucuuagguau

SEQ ID NO: 3559605 - RNA, 18 nt, Human
agaucuugcagaaguucu

SEQ ID NO: 3559606 - RNA, 12 nt, Human
agaucuuucagg

SEQ ID NO: 3559607 - RNA, 17 nt, Human
agaugaaaaagcaugua

SEQ ID NO: 3559608 - RNA, 21 nt, Human
agaugaaaaagcauguacagu

SEQ ID NO: 3559609 - RNA, 23 nt, Human
agaugaaagaggagguuuggggu

SEQ ID NO: 3559610 - RNA, 17 nt, Human
agaugaaauuccauuug

SEQ ID NO: 3559611 - RNA, 18 nt, Human
agaugaaauuccauuugu

SEQ ID NO: 3559612 - RNA, 18 nt, Human
agaugaacagacugaccu

SEQ ID NO: 3559613 - RNA, 19 nt, Human
agaugaagcaaacacauua

SEQ ID NO: 3559614 - RNA, 17 nt, Human
agaugaaggucuguuuu

SEQ ID NO: 3559615 - RNA, 22 nt, Human
agaugaaguuuguaguuguuuu

SEQ ID NO: 3559616 - RNA, 22 nt, Human
agaugaauacaaacaauggaaa

SEQ ID NO: 3559617 - RNA, 19 nt, Human
agaugaaugaagcaaaugu

SEQ ID NO: 3559618 - RNA, 16 nt, Human
agaugaaugccgugga

SEQ ID NO: 3559619 - RNA, 15 nt, Human
agaugaaugucaguu

SEQ ID NO: 3559620 - RNA, 21 nt, Human
agaugaauuauccuauuucag

SEQ ID NO: 3559621 - RNA, 18 nt, Human
agaugacaagaaaggcug

SEQ ID NO: 3559622 - RNA, 18 nt, Human
agaugacauugacuauuu

SEQ ID NO: 3559623 - RNA, 20 nt, Human
agaugaccauaaccacugaa

SEQ ID NO: 3559624 - RNA, 20 nt, Human
agaugaccccugcccagauc

SEQ ID NO: 3559625 - RNA, 15 nt, Human
agaugacugaguccu

SEQ ID NO: 3559626 - RNA, 13 nt, Human
agaugagaacaaa

SEQ ID NO: 3559627 - RNA, 19 nt, Human
agaugagaacaaagcuguu

SEQ ID NO: 3559628 - RNA, 17 nt, Human
agaugagaacagauaaa

SEQ ID NO: 3559629 - RNA, 13 nt, Human
agaugagaauuag

SEQ ID NO: 3559630 - RNA, 23 nt, Human
agaugagaggggagagcugaaca

SEQ ID NO: 3559631 - RNA, 19 nt, Human
agaugagauuggcauggcu

SEQ ID NO: 3559632 - RNA, 16 nt, Human
agaugagcuuucuuuu

SEQ ID NO: 3559633 - RNA, 13 nt, Human
agaugagcuuuuc

SEQ ID NO: 3559634 - RNA, 16 nt, Human
agaugagcuuuucuag

SEQ ID NO: 3559635 - RNA, 21 nt, Human
agaugaggccagaccauggac

SEQ ID NO: 3559636 - RNA, 18 nt, Human
agaugaggucaguugugu

SEQ ID NO: 3559637 - RNA, 20 nt, Human
agaugaguuaucuaagaaua

SEQ ID NO: 3559638 - RNA, 19 nt, Human
agaugauggaugccaauau

SEQ ID NO: 3559639 - RNA, 17 nt, Human
agaugcaaagaggcaag

SEQ ID NO: 3559640 - RNA, 18 nt, Human
agaugcaaugugcuacug

SEQ ID NO: 3559641 - RNA, 19 nt, Human
agaugcaaugugcuacuga

SEQ ID NO: 3559642 - RNA, 23 nt, Human
agaugcaccaccaagccaaggga

SEQ ID NO: 3559643 - RNA, 14 nt, Human
agaugcaccagccc

SEQ ID NO: 3559644 - RNA, 23 nt, Human
agaugcacuuaaguuagccucca

SEQ ID NO: 3559645 - RNA, 19 nt, Human
agaugcacuuugcuuuaau

SEQ ID NO: 3559646 - RNA, 17 nt, Human
agaugcagagagccauu

SEQ ID NO: 3559647 - RNA, 18 nt, Human
agaugcagagagccauuu

SEQ ID NO: 3559648 - RNA, 19 nt, Human
agaugcagagagccauuuu

SEQ ID NO: 3559649 - RNA, 13 nt, Human
agaugcagcucuu

SEQ ID NO: 3559650 - RNA, 16 nt, Human
agaugcaguucugaag

SEQ ID NO: 3559651 - RNA, 17 nt, Human
agaugcauguugaccau

SEQ ID NO: 3559652 - RNA, 16 nt, Human
agaugcauuguaguuu

SEQ ID NO: 3559653 - RNA, 14 nt, Human
agaugcauuuggaa

SEQ ID NO: 3559654 - RNA, 18 nt, Human
agaugcauuuggguccag

SEQ ID NO: 3559655 - RNA, 21 nt, Human
agaugccacuaccccuugauu

SEQ ID NO: 3559656 - RNA, 21 nt, Human
agaugccagagcaaagggcca

SEQ ID NO: 3559657 - RNA, 18 nt, Human
agaugccauucauagaga

SEQ ID NO: 3559658 - RNA, 15 nt, Human
agaugcccaaauccu

SEQ ID NO: 3559659 - RNA, 17 nt, Human
agaugccccagagcugu

SEQ ID NO: 3559660 - RNA, 22 nt, Human
agaugccuccaccccccagaac

SEQ ID NO: 3559661 - RNA, 15 nt, Human
agaugccuccaccgc

SEQ ID NO: 3559662 - RNA, 21 nt, Human
agaugccuccaccgcugccua

SEQ ID NO: 3559663 - RNA, 18 nt, Human
agaugcgcagccccaucu

SEQ ID NO: 3559664 - RNA, 20 nt, Human
agaugcgucccaagauguug

SEQ ID NO: 3559665 - RNA, 20 nt, Human
agaugcuaaaaucccuggau

SEQ ID NO: 3559666 - RNA, 19 nt, Human
agaugcuagaacucccuuu

SEQ ID NO: 3559667 - RNA, 10 nt, Human
agaugcucaa

SEQ ID NO: 3559668 - RNA, 13 nt, Human
agaugcuccaaga

SEQ ID NO: 3559669 - RNA, 19 nt, Human
agaugcuccaagauucuag

SEQ ID NO: 3559670 - RNA, 20 nt, Human
agaugcuccuugggcccuuu

SEQ ID NO: 3559671 - RNA, 13 nt, Human
agaugcucuuuua

SEQ ID NO: 3559672 - RNA, 21 nt, Human
agaugcugaaacaggagagaa

SEQ ID NO: 3559673 - RNA, 15 nt, Human
agaugcugauguuca

SEQ ID NO: 3559674 - RNA, 17 nt, Human
agaugcugauguucagu

SEQ ID NO: 3559675 - RNA, 15 nt, Human
agaugccauucauag

SEQ ID NO: 3559676 - RNA, 21 nt, Human
agaugcccagagggcccaggc

SEQ ID NO: 3559677 - RNA, 18 nt, Human
agaugcccgagggagggg

SEQ ID NO: 3559678 - RNA, 19 nt, Human
agaugcccgagggagggga

SEQ ID NO: 3559679 - RNA, 14 nt, Human
agaugcccugcuag

SEQ ID NO: 3559680 - RNA, 12 nt, Human
agaugccuccac

SEQ ID NO: 3559681 - RNA, 14 nt, Human
agaugccuccaccg

SEQ ID NO: 3559682 - RNA, 19 nt, Human
agaugccucccugacccug

SEQ ID NO: 3559683 - RNA, 22 nt, Human
agaugccucccugacccugcag

SEQ ID NO: 3559684 - RNA, 23 nt, Human
agaugccucccugacccugcaga

SEQ ID NO: 3559685 - RNA, 13 nt, Human
agaugccuccuuc

SEQ ID NO: 3559686 - RNA, 16 nt, Human
agaugccuccuuccuc

SEQ ID NO: 3559687 - RNA, 22 nt, Human
agaugcgcauucuaaccuggag

SEQ ID NO: 3559688 - RNA, 15 nt, Human
agaugcgucccaaga

SEQ ID NO: 3559689 - RNA, 16 nt, Human
agaugcuacuaagaaa

SEQ ID NO: 3559690 - RNA, 14 nt, Human
agaugcuagaacuc

SEQ ID NO: 3559691 - RNA, 15 nt, Human
agaugcuagaacucc

SEQ ID NO: 3559692 - RNA, 21 nt, Human
agaugcuagaacucccuuuca

SEQ ID NO: 3559693 - RNA, 23 nt, Human
agaugcuagaacucccuuucaac

SEQ ID NO: 3559694 - RNA, 20 nt, Human
agaugcuagcgcguugccug

SEQ ID NO: 3559695 - RNA, 20 nt, Human
agaugcucaaaguuguuuuu

SEQ ID NO: 3559696 - RNA, 20 nt, Human
agaugcucagguacagagaa

SEQ ID NO: 3559697 - RNA, 15 nt, Human
acucuguucauuccu

SEQ ID NO: 3559698 - RNA, 16 nt, Human
acucuguucauuccuc

SEQ ID NO: 3559699 - RNA, 17 nt, Human
acucuguuccuucacau

SEQ ID NO: 3559700 - RNA, 18 nt, Human
acucuguuccuucacauc

SEQ ID NO: 3559701 - RNA, 20 nt, Human
acucuguuccuucacauccu

SEQ ID NO: 3559702 - RNA, 20 nt, Human
acucuguugcaagugcaaua

SEQ ID NO: 3559703 - RNA, 11 nt, Human
acucuuaaaac

SEQ ID NO: 3559704 - RNA, 13 nt, Human
acucuuaaagcaa

SEQ ID NO: 3559705 - RNA, 20 nt, Human
acucuuaaaugaucugccuc

SEQ ID NO: 3559706 - RNA, 14 nt, Human
acucuuaagaagac

SEQ ID NO: 3559707 - RNA, 20 nt, Human
acucuuaagaagacugcauu

SEQ ID NO: 3559708 - RNA, 13 nt, Human
acucuuaagccau

SEQ ID NO: 3559709 - RNA, 22 nt, Human
acucuuaagccaucuugguaaa

SEQ ID NO: 3559710 - RNA, 16 nt, Human
acucuuaaguuucuca

SEQ ID NO: 3559711 - RNA, 22 nt, Human
acucuuaaguuucucagcuccc

SEQ ID NO: 3559712 - RNA, 14 nt, Human
acucuuaaucaaau

SEQ ID NO: 3559713 - RNA, 19 nt, Human
acucuuaggaagagaaacc

SEQ ID NO: 3559714 - RNA, 20 nt, Human
acucuuaggaagagaaacca

SEQ ID NO: 3559715 - RNA, 21 nt, Human
acucuuaggcacuuugggggu

SEQ ID NO: 3559716 - RNA, 15 nt, Human
acucuuaguuacuca

SEQ ID NO: 3559717 - RNA, 12 nt, Human
acucuucacugu

SEQ ID NO: 3559718 - RNA, 20 nt, Human
acucuucaguuaagccuuug

SEQ ID NO: 3559719 - RNA, 17 nt, Human
acucuuccagaauccca

SEQ ID NO: 3559720 - RNA, 20 nt, Human
acucuuccgaaaaauccucu

SEQ ID NO: 3559721 - RNA, 22 nt, Human
acucuuccgaaaaauccucuuc

SEQ ID NO: 3559722 - RNA, 17 nt, Human
acucuuccuccaaggac

SEQ ID NO: 3559723 - RNA, 20 nt, Human
acucuucgaagccuugccua

SEQ ID NO: 3559724 - RNA, 23 nt, Human
acucuucucaucuugacagagcc

SEQ ID NO: 3559725 - RNA, 17 nt, Human
acucuucucucugcucu

SEQ ID NO: 3559726 - RNA, 15 nt, Human
acucuucuugaaauu

SEQ ID NO: 3559727 - RNA, 16 nt, Human
acucuucuugaaauuu

SEQ ID NO: 3559728 - RNA, 19 nt, Human
acucuucuugaaauuuuaa

SEQ ID NO: 3559729 - RNA, 12 nt, Human
acucuugacagc

SEQ ID NO: 3559730 - RNA, 15 nt, Human
acucuugacucuugc

SEQ ID NO: 3559731 - RNA, 21 nt, Human
acucuugaguuguuuuuguau

SEQ ID NO: 3559732 - RNA, 22 nt, Human
acucuugcacagucacugcucu

SEQ ID NO: 3559733 - RNA, 18 nt, Human
acucuugccuguuuccca

SEQ ID NO: 3559734 - RNA, 13 nt, Human
acucuugcucuuu

SEQ ID NO: 3559735 - RNA, 16 nt, Human
acucuuggagccugca

SEQ ID NO: 3559736 - RNA, 12 nt, Human
acucuuguaaga

SEQ ID NO: 3559737 - RNA, 16 nt, Human
acucuuguaagauuuu

SEQ ID NO: 3559738 - RNA, 19 nt, Human
acucuuguaagauuuugaa

SEQ ID NO: 3559739 - RNA, 20 nt, Human
acucuuguaagauuuugaaa

SEQ ID NO: 3559740 - RNA, 16 nt, Human
acucuuguugaguucu

SEQ ID NO: 3559741 - RNA, 15 nt, Human
acucuuguuuccuua

SEQ ID NO: 3559742 - RNA, 18 nt, Human
acucuuuaugaucuggcc

SEQ ID NO: 3559743 - RNA, 16 nt, Human
acucuuuauugucugu

SEQ ID NO: 3559744 - RNA, 20 nt, Human
acucuuuauugucuguaaau

SEQ ID NO: 3559745 - RNA, 13 nt, Human
acucuuucaaaac

SEQ ID NO: 3559746 - RNA, 17 nt, Human
acucuuucuaaugcuga

SEQ ID NO: 3559747 - RNA, 15 nt, Human
acucuuucugagugc

SEQ ID NO: 3559748 - RNA, 20 nt, Human
acucuuucugagugccuucu

SEQ ID NO: 3559749 - RNA, 19 nt, Human
acucuuucuuucaauaaaa

SEQ ID NO: 3559750 - RNA, 17 nt, Human
acucuuugaaugacaaa

SEQ ID NO: 3559751 - RNA, 16 nt, Human
acucuuugagauagaa

SEQ ID NO: 3559752 - RNA, 19 nt, Human
acucuuugagauagaagaa

SEQ ID NO: 3559753 - RNA, 18 nt, Human
acucuuuuccuucccuuu

SEQ ID NO: 3559754 - RNA, 21 nt, Human
acucuuuugcuuuauuccaga

SEQ ID NO: 3559755 - RNA, 17 nt, Human
acucuuuuugggcuccu

SEQ ID NO: 3559756 - RNA, 18 nt, Human
acucuuuuugggcuccuu

SEQ ID NO: 3559757 - RNA, 16 nt, Human
acugaaaaaauauaug

SEQ ID NO: 3559758 - RNA, 14 nt, Human
acugaaaacauaaa

SEQ ID NO: 3559759 - RNA, 18 nt, Human
acugaaaacauaaaaagu

SEQ ID NO: 3559760 - RNA, 19 nt, Human
acugaaaacauaaaaaguu

SEQ ID NO: 3559761 - RNA, 14 nt, Human
acugaaaacaucug

SEQ ID NO: 3559762 - RNA, 19 nt, Human
acugaaaagacucaguguu

SEQ ID NO: 3559763 - RNA, 14 nt, Human
acugaaaagagagc

SEQ ID NO: 3559764 - RNA, 20 nt, Human
acugaaaagagagcagagaa

SEQ ID NO: 3559765 - RNA, 20 nt, Human
acugaaaagguucuucaucc

SEQ ID NO: 3559766 - RNA, 19 nt, Human
acugaaaauaccaucaggc

SEQ ID NO: 3559767 - RNA, 15 nt, Human
acugaaaaugugcua

SEQ ID NO: 3559768 - RNA, 19 nt, Human
acugaaaaugugcuauacu

SEQ ID NO: 3559769 - RNA, 14 nt, Human
acugaaacagauuu

SEQ ID NO: 3559770 - RNA, 19 nt, Human
acugaaaccuuuaagaaaa

SEQ ID NO: 3559771 - RNA, 21 nt, Human
acugaaagacaccauuuaucu

SEQ ID NO: 3559772 - RNA, 17 nt, Human
acugaaaggcuuuucaa

SEQ ID NO: 3559773 - RNA, 13 nt, Human
acugaaagguuac

SEQ ID NO: 3559774 - RNA, 17 nt, Human
acugaaagugguuugaa

SEQ ID NO: 3559775 - RNA, 16 nt, Human
acugaaaguuuuguaa

SEQ ID NO: 3559776 - RNA, 17 nt, Human
acugaaaguuuuguaaa

SEQ ID NO: 3559777 - RNA, 18 nt, Human
acugaaaguuuuguaaaa

SEQ ID NO: 3559778 - RNA, 23 nt, Human
acugaaaguuuuguaaaagaaau

SEQ ID NO: 3559779 - RNA, 17 nt, Human
acugaaaucugucaaga

SEQ ID NO: 3559780 - RNA, 12 nt, Human
acugaacaaaaa

SEQ ID NO: 3559781 - RNA, 19 nt, Human
acugaacaucugaguccug

SEQ ID NO: 3559782 - RNA, 23 nt, Human
acugaacaucugaguccuggaug

SEQ ID NO: 3559783 - RNA, 24 nt, Human
acugaacaucugaguccuggauga

SEQ ID NO: 3559784 - RNA, 22 nt, Human
acugaaccugggaaagagauuu

SEQ ID NO: 3559785 - RNA, 20 nt, Human
acugaacgauccuucaaagu

SEQ ID NO: 3559786 - RNA, 18 nt, Human
acugaacucacuuuccuc

SEQ ID NO: 3559787 - RNA, 21 nt, Human
acugaacuucaggauaauaaa

SEQ ID NO: 3559788 - RNA, 19 nt, Human
acugaacuuugaagacccg

SEQ ID NO: 3559789 - RNA, 16 nt, Human
acugaacuuugcugag

SEQ ID NO: 3559790 - RNA, 19 nt, Human
acugaacuuugcugagccu

SEQ ID NO: 3559791 - RNA, 12 nt, Human
acugaagaagca

SEQ ID NO: 3559792 - RNA, 14 nt, Human
acugaagaggagga

SEQ ID NO: 3559793 - RNA, 14 nt, Human
acugaagauagaag

SEQ ID NO: 3559794 - RNA, 16 nt, Human
acugaagauguugaga

SEQ ID NO: 3559795 - RNA, 21 nt, Human
acugaagcagccucuccccag

SEQ ID NO: 3559796 - RNA, 18 nt, Human
acugaagccagaaauaaa

SEQ ID NO: 3559797 - RNA, 15 nt, Human
acugaagccugcagg

SEQ ID NO: 3559798 - RNA, 11 nt, Human
acugaaggaga

SEQ ID NO: 3559799 - RNA, 21 nt, Human
acugaaggccacuugaguugg

SEQ ID NO: 3559800 - RNA, 20 nt, Human
acugaaggccuggcccacag

SEQ ID NO: 3559801 - RNA, 19 nt, Human
acugaaguagugugcaguu

SEQ ID NO: 3559802 - RNA, 14 nt, Human
acugaauaccacuc

SEQ ID NO: 3559803 - RNA, 15 nt, Human
acugaauauuuauau

SEQ ID NO: 3559804 - RNA, 16 nt, Human
acugaaugaaaccccc

SEQ ID NO: 3559805 - RNA, 19 nt, Human
acugaaugaaacccccaca

SEQ ID NO: 3559806 - RNA, 23 nt, Human
acugaaugaaacccccacacaca

SEQ ID NO: 3559807 - RNA, 17 nt, Human
acugaaugaacaaccuc

SEQ ID NO: 3559808 - RNA, 21 nt, Human
acugaaugaagcaguauuuug

SEQ ID NO: 3559809 - RNA, 22 nt, Human
acugaaugcuucugacuucaua

SEQ ID NO: 3559810 - RNA, 17 nt, Human
acugaauggacuuugca

SEQ ID NO: 3559811 - RNA, 19 nt, Human
acugaauguuuauuccuug

SEQ ID NO: 3559812 - RNA, 13 nt, Human
acugaauuuggag

SEQ ID NO: 3559813 - RNA, 19 nt, Human
acugaauuuuuauguguga

SEQ ID NO: 3559814 - RNA, 13 nt, Human
acugacaaaucaa

SEQ ID NO: 3559815 - RNA, 17 nt, Human
acugacaagcuccauuu

SEQ ID NO: 3559816 - RNA, 13 nt, Human
acugacacacacg

SEQ ID NO: 3559817 - RNA, 12 nt, Human
acugacagcaug

SEQ ID NO: 3559818 - RNA, 13 nt, Human
acugacagcaugu

SEQ ID NO: 3559819 - RNA, 20 nt, Human
acugacaggcagccuggaca

SEQ ID NO: 3559820 - RNA, 23 nt, Human
acugacaugauuagcagaagaaa

SEQ ID NO: 3559821 - RNA, 17 nt, Human
acugacaugcccucccu

SEQ ID NO: 3559822 - RNA, 12 nt, Human
acugacaugugg

SEQ ID NO: 3559823 - RNA, 17 nt, Human
acugacauuguuggcca

SEQ ID NO: 3559824 - RNA, 23 nt, Human
acugacauuguuggccaaagcca

SEQ ID NO: 3559825 - RNA, 20 nt, Human
acugaccaauauuguacagu

SEQ ID NO: 3559826 - RNA, 22 nt, Human
acugaccaauauuguacaguuu

SEQ ID NO: 3559827 - RNA, 12 nt, Human
acugaccagaac

SEQ ID NO: 3559828 - RNA, 20 nt, Human
acugaccagccuccaugcug

SEQ ID NO: 3559829 - RNA, 22 nt, Human
acugaccauccacucuacccuc

SEQ ID NO: 3559830 - RNA, 13 nt, Human
acugacccugggg

SEQ ID NO: 3559831 - RNA, 21 nt, Human
acugaccugguccacagggca

SEQ ID NO: 3559832 - RNA, 22 nt, Human
acugaccugguccacagggcac

SEQ ID NO: 3559833 - RNA, 13 nt, Human
agauuauaacuug

SEQ ID NO: 3559834 - RNA, 13 nt, Human
agauuauaauaaa

SEQ ID NO: 3559835 - RNA, 23 nt, Human
agauuauagauucuaaagauucu

SEQ ID NO: 3559836 - RNA, 16 nt, Human
agauuauaucaaagua

SEQ ID NO: 3559837 - RNA, 15 nt, Human
agauuaucguuuucu

SEQ ID NO: 3559838 - RNA, 16 nt, Human
agauuauucacugauu

SEQ ID NO: 3559839 - RNA, 14 nt, Human
agauuauugaaaua

SEQ ID NO: 3559840 - RNA, 16 nt, Human
agauuauugaaauauu

SEQ ID NO: 3559841 - RNA, 14 nt, Human
agauuuuauuuuac

SEQ ID NO: 3559842 - RNA, 15 nt, Human
agauuuuauuuuacu

SEQ ID NO: 3559843 - RNA, 20 nt, Human
agauuuuguguuuauucuug

SEQ ID NO: 3559844 - RNA, 17 nt, Human
agauuuuguuuugcuuu

SEQ ID NO: 3559845 - RNA, 23 nt, Human
agauuuuguuuugcuuuuucuga

SEQ ID NO: 3559846 - RNA, 19 nt, Human
agauuuuuaaaaaauauuu

SEQ ID NO: 3559847 - RNA, 16 nt, Human
agauuuuuaacgaaug

SEQ ID NO: 3559848 - RNA, 22 nt, Human
agauuuuucucaaaguuuugaa

SEQ ID NO: 3559849 - RNA, 13 nt, Human
agauuuuuuaaua

SEQ ID NO: 3559850 - RNA, 16 nt, Human
agauuuuuuauugcua

SEQ ID NO: 3559851 - RNA, 23 nt, Human
agauuuuuuuguuguuuguuuag

SEQ ID NO: 3559852 - RNA, 14 nt, Human
agcaaaaaagaaaa

SEQ ID NO: 3559853 - RNA, 16 nt, Human
agcaaaaaauaaugac

SEQ ID NO: 3559854 - RNA, 19 nt, Human
agcaaaaacgaaagcuggg

SEQ ID NO: 3559855 - RNA, 15 nt, Human
agcaaaaagcaaaau

SEQ ID NO: 3559856 - RNA, 12 nt, Human
agcaaaaagugg

SEQ ID NO: 3559857 - RNA, 17 nt, Human
agcaaaaauauuuuaug

SEQ ID NO: 3559858 - RNA, 18 nt, Human
agcaaaaauauuuuauga

SEQ ID NO: 3559859 - RNA, 19 nt, Human
agcaaaaauauuuuaugau

SEQ ID NO: 3559860 - RNA, 23 nt, Human
agcaaaaauauuuuaugauccag

SEQ ID NO: 3559861 - RNA, 16 nt, Human
agcaaaaaugcuaaua

SEQ ID NO: 3559862 - RNA, 21 nt, Human
agcaaaaccaaauauuccaga

SEQ ID NO: 3559863 - RNA, 19 nt, Human
agcaaaaccauugcuucac

SEQ ID NO: 3559864 - RNA, 16 nt, Human
agcaaaacuuuuaaac

SEQ ID NO: 3559865 - RNA, 16 nt, Human
agcaaaagaaguaaca

SEQ ID NO: 3559866 - RNA, 15 nt, Human
agcaaaauaaaaacu

SEQ ID NO: 3559867 - RNA, 17 nt, Human
agcaaaauaaaaacuau

SEQ ID NO: 3559868 - RNA, 15 nt, Human
agcaaaauaaaacau

SEQ ID NO: 3559869 - RNA, 21 nt, Human
agcaaaauaauuuuaaacaaa

SEQ ID NO: 3559870 - RNA, 14 nt, Human
agcaaaaucauuuu

SEQ ID NO: 3559871 - RNA, 23 nt, Human
agcaaaaugugaaugggaaaaga

SEQ ID NO: 3559872 - RNA, 19 nt, Human
agcaaaauugauguguuua

SEQ ID NO: 3559873 - RNA, 14 nt, Human
agcaaaccaagaga

SEQ ID NO: 3559874 - RNA, 17 nt, Human
agcaaaccaagagauug

SEQ ID NO: 3559875 - RNA, 22 nt, Human
agcaaaccaagagauugcuaau

SEQ ID NO: 3559876 - RNA, 23 nt, Human
agcaaaccauuuuuaaaguagaa

SEQ ID NO: 3559877 - RNA, 21 nt, Human
agcaaacccugucaaacauua

SEQ ID NO: 3559878 - RNA, 14 nt, Human
agcaaacucugcug

SEQ ID NO: 3559879 - RNA, 17 nt, Human
agcaaacucuuuuccca

SEQ ID NO: 3559880 - RNA, 20 nt, Human
agcaaacugcaugcccagag

SEQ ID NO: 3559881 - RNA, 20 nt, Human
agcaaagauaucucaucucu

SEQ ID NO: 3559882 - RNA, 17 nt, Human
agcaaagaucaaaauaa

SEQ ID NO: 3559883 - RNA, 12 nt, Human
agcaaagcacag

SEQ ID NO: 3559884 - RNA, 22 nt, Human
agcaaagcaccagcuucuccag

SEQ ID NO: 3559885 - RNA, 22 nt, Human
agcaaagccccaugcuggagcc

SEQ ID NO: 3559886 - RNA, 23 nt, Human
agcaaagccccaugcuggagccu

SEQ ID NO: 3559887 - RNA, 22 nt, Human
agcaaagccuguucauggcaga

SEQ ID NO: 3559888 - RNA, 21 nt, Human
agcaaagcugaugacaacuuc

SEQ ID NO: 3559889 - RNA, 24 nt, Human
agcaaaguaguacuucuucuguaa

SEQ ID NO: 3559890 - RNA, 14 nt, Human
agcaaagucuaaag

SEQ ID NO: 3559891 - RNA, 20 nt, Human
agcaaagucuaaaguuuaca

SEQ ID NO: 3559892 - RNA, 19 nt, Human
agcaaauaaacuaggaaau

SEQ ID NO: 3559893 - RNA, 12 nt, Human
agcaaauacuua

SEQ ID NO: 3559894 - RNA, 21 nt, Human
agcaaauacuuagcaaaaagu

SEQ ID NO: 3559895 - RNA, 16 nt, Human
agcaaaucagaaacuu

SEQ ID NO: 3559896 - RNA, 20 nt, Human
agcaaauggccucaugucaa

SEQ ID NO: 3559897 - RNA, 17 nt, Human
agcaaaugucuuccugg

SEQ ID NO: 3559898 - RNA, 17 nt, Human
agcaaauguuaugcaua

SEQ ID NO: 3559899 - RNA, 16 nt, Human
agcaaauguuucugca

SEQ ID NO: 3559900 - RNA, 17 nt, Human
agcaaauguuucugcag

SEQ ID NO: 3559901 - RNA, 14 nt, Human
agcaaauuuauaau

SEQ ID NO: 3559902 - RNA, 15 nt, Human
agcaaauuuauaauu

SEQ ID NO: 3559903 - RNA, 18 nt, Human
agcaaauuuauaauuuua

SEQ ID NO: 3559904 - RNA, 21 nt, Human
agcaaauuuauaauuuuaaga

SEQ ID NO: 3559905 - RNA, 18 nt, Human
agcaaauuucaaaagaca

SEQ ID NO: 3559906 - RNA, 13 nt, Human
agcaacaauaaau

SEQ ID NO: 3559907 - RNA, 15 nt, Human
agcaacaauuuauga

SEQ ID NO: 3559908 - RNA, 21 nt, Human
agcaacaauuuaugaauugaa

SEQ ID NO: 3559909 - RNA, 15 nt, Human
agcaacaauuuucag

SEQ ID NO: 3559910 - RNA, 16 nt, Human
agcaacaauuuucaga

SEQ ID NO: 3559911 - RNA, 21 nt, Human
agcaacacaauguuauucguu

SEQ ID NO: 3559912 - RNA, 13 nt, Human
agcaacacagccu

SEQ ID NO: 3559913 - RNA, 20 nt, Human
agcaacagagugagacccug

SEQ ID NO: 3559914 - RNA, 22 nt, Human
agcaacagagugagacccuguc

SEQ ID NO: 3559915 - RNA, 16 nt, Human
agcaacaucagcuuga

SEQ ID NO: 3559916 - RNA, 20 nt, Human
agcaacaugcuucaugaaaa

SEQ ID NO: 3559917 - RNA, 18 nt, Human
agcaaccagagcacugua

SEQ ID NO: 3559918 - RNA, 15 nt, Human
agcaaccaguuggcu

SEQ ID NO: 3559919 - RNA, 18 nt, Human
agcaaccccuggacccca

SEQ ID NO: 3559920 - RNA, 20 nt, Human
agcaaccccuggaccccagc

SEQ ID NO: 3559921 - RNA, 24 nt, Human
agcaaccccuggaccccagccuca

SEQ ID NO: 3559922 - RNA, 22 nt, Human
agcaacccuccuaucaccuccc

SEQ ID NO: 3559923 - RNA, 20 nt, Human
agcaaccgccucaaaaugug

SEQ ID NO: 3559924 - RNA, 15 nt, Human
agcaaccguggcccu

SEQ ID NO: 3559925 - RNA, 19 nt, Human
agcaaccguggcccuuccu

SEQ ID NO: 3559926 - RNA, 15 nt, Human
agcaaccugggucca

SEQ ID NO: 3559927 - RNA, 19 nt, Human
agcaaccuuucaccuuugu

SEQ ID NO: 3559928 - RNA, 19 nt, Human
agcaacgcuauuccagcug

SEQ ID NO: 3559929 - RNA, 23 nt, Human
agcaacgcuuguagaacucacuc

SEQ ID NO: 3559930 - RNA, 21 nt, Human
agcaacuaaaaugugucuugc

SEQ ID NO: 3559931 - RNA, 21 nt, Human
agcaacuacagucuaaagcug

SEQ ID NO: 3559932 - RNA, 16 nt, Human
agcaacuaggccuuca

SEQ ID NO: 3559933 - RNA, 22 nt, Human
agcaacugucuauuucugcuga

SEQ ID NO: 3559934 - RNA, 18 nt, Human
agcaacuguuaugaaaua

SEQ ID NO: 3559935 - RNA, 20 nt, Human
agcaacuguuaugaaauaaa

SEQ ID NO: 3559936 - RNA, 21 nt, Human
agcaacuguuaugaaauaaag

SEQ ID NO: 3559937 - RNA, 22 nt, Human
agcaacuugaacuucaccugca

SEQ ID NO: 3559938 - RNA, 20 nt, Human
agcaacuugucuuuuucugg

SEQ ID NO: 3559939 - RNA, 20 nt, Human
agcaagaaaaaaaaaugcca

SEQ ID NO: 3559940 - RNA, 21 nt, Human
agcaagaagauccuaaaacaa

SEQ ID NO: 3559941 - RNA, 19 nt, Human
agcaagaaggcaaaaauag

SEQ ID NO: 3559942 - RNA, 13 nt, Human
agcaagacgcugu

SEQ ID NO: 3559943 - RNA, 16 nt, Human
agcaagacgcugugcu

SEQ ID NO: 3559944 - RNA, 20 nt, Human
agcaagacgcugugcugccc

SEQ ID NO: 3559945 - RNA, 21 nt, Human
agcaagacuucucuuugccuc

SEQ ID NO: 3559946 - RNA, 18 nt, Human
agcaagagagcagcaagg

SEQ ID NO: 3559947 - RNA, 16 nt, Human
agcaagagauauuuug

SEQ ID NO: 3559948 - RNA, 22 nt, Human
agcaagaggcaagcugaaauuu

SEQ ID NO: 3559949 - RNA, 21 nt, Human
agcaagauccugucuuuaagg

SEQ ID NO: 3559950 - RNA, 15 nt, Human
agcaagauguacuau

SEQ ID NO: 3559951 - RNA, 14 nt, Human
agcaagauuucaga

SEQ ID NO: 3559952 - RNA, 15 nt, Human
agcaagcauucagaa

SEQ ID NO: 3559953 - RNA, 16 nt, Human
agcaaggaaaacuuau

SEQ ID NO: 3559954 - RNA, 14 nt, Human
agcaaggagauuua

SEQ ID NO: 3559955 - RNA, 21 nt, Human
agcaaggccaccucuuccugg

SEQ ID NO: 3559956 - RNA, 22 nt, Human
agcaaggccaccucuuccuggc

SEQ ID NO: 3559957 - RNA, 18 nt, Human
agcaaggcccgagcagcu

SEQ ID NO: 3559958 - RNA, 12 nt, Human
agcaaggcccug

SEQ ID NO: 3559959 - RNA, 16 nt, Human
agcaaggcccugcugc

SEQ ID NO: 3559960 - RNA, 16 nt, Human
agcaaggggcucugcc

SEQ ID NO: 3559961 - RNA, 19 nt, Human
agcaagguggaguggaugc

SEQ ID NO: 3559962 - RNA, 21 nt, Human
agcaagugugaauacugcuug

SEQ ID NO: 3559963 - RNA, 16 nt, Human
agcaaguuacagugau

SEQ ID NO: 3559964 - RNA, 18 nt, Human
agcaaguucgucuguugu

SEQ ID NO: 3559965 - RNA, 20 nt, Human
agcaaguucuagagaagagg

SEQ ID NO: 3559966 - RNA, 15 nt, Human
agcaauaaaauuuuu

SEQ ID NO: 3559967 - RNA, 14 nt, Human
agcaauaaagaaga

SEQ ID NO: 3559968 - RNA, 23 nt, Human
agcaauaauggucccauccaggc

SEQ ID NO: 3559969 - RNA, 12 nt, Human
agcaauaauuuc

SEQ ID NO: 3559970 - RNA, 14 nt, Human
agcaauagaaacaa

SEQ ID NO: 3559971 - RNA, 15 nt, Human
agcaauaucaguuau

SEQ ID NO: 3559972 - RNA, 21 nt, Human
agcaauaucaguuauuuuuug

SEQ ID NO: 3559973 - RNA, 13 nt, Human
agcaauaucugcu

SEQ ID NO: 3559974 - RNA, 12 nt, Human
agcaauaugcau

SEQ ID NO: 3559975 - RNA, 13 nt, Human
agcaauauuguau

SEQ ID NO: 3559976 - RNA, 16 nt, Human
agcaauauuuaaggag

SEQ ID NO: 3559977 - RNA, 17 nt, Human
agcaauauuuaaggaga

SEQ ID NO: 3559978 - RNA, 16 nt, Human
agcaauauuuauggau

SEQ ID NO: 3559979 - RNA, 21 nt, Human
agcaaucagauuuuccugugg

SEQ ID NO: 3559980 - RNA, 14 nt, Human
agcaauccuccuga

SEQ ID NO: 3559981 - RNA, 12 nt, Human
agcaaucuuuga

SEQ ID NO: 3559982 - RNA, 18 nt, Human
agcaaugacaucucaggg

SEQ ID NO: 3559983 - RNA, 19 nt, Human
agcaaugacaucucagggg

SEQ ID NO: 3559984 - RNA, 13 nt, Human
acuggcugugggc

SEQ ID NO: 3559985 - RNA, 15 nt, Human
acuggcuucagcaag

SEQ ID NO: 3559986 - RNA, 15 nt, Human
acuggcuuuggcuuc

SEQ ID NO: 3559987 - RNA, 18 nt, Human
acuggcuuuggcuucuug

SEQ ID NO: 3559988 - RNA, 16 nt, Human
acuggcuuugucccac

SEQ ID NO: 3559989 - RNA, 22 nt, Human
acuggcuuugucccacagcuug

SEQ ID NO: 3559990 - RNA, 18 nt, Human
acuggcuuuuauuaaugc

SEQ ID NO: 3559991 - RNA, 21 nt, Human
acuggcuuuuauuaaugcacu

SEQ ID NO: 3559992 - RNA, 23 nt, Human
acuggcuuuuauuaaugcacuuu

SEQ ID NO: 3559993 - RNA, 16 nt, Human
acugggaaccccuuuc

SEQ ID NO: 3559994 - RNA, 20 nt, Human
acugggaaccccuuucccac

SEQ ID NO: 3559995 - RNA, 12 nt, Human
acugggaaggcu

SEQ ID NO: 3559996 - RNA, 17 nt, Human
acugggaaggcuacuuc

SEQ ID NO: 3559997 - RNA, 21 nt, Human
acugggaccuuuagugguggc

SEQ ID NO: 3559998 - RNA, 23 nt, Human
acugggagaggugccagcaacug

SEQ ID NO: 3559999 - RNA, 17 nt, Human
acugggagcccccagcc

SEQ ID NO: 3560000 - RNA, 13 nt, Human
acugggcaaugau

SEQ ID NO: 3560001 - RNA, 15 nt, Human
acugggcaugagggg

SEQ ID NO: 3560002 - RNA, 17 nt, Human
acugggcccugagucug

SEQ ID NO: 3560003 - RNA, 22 nt, Human
acugggcucccgggccccacag

SEQ ID NO: 3560004 - RNA, 13 nt, Human
acugggcugaggg

SEQ ID NO: 3560005 - RNA, 19 nt, Human
acuggggaaaacuccaccu

SEQ ID NO: 3560006 - RNA, 15 nt, Human
acuggggaaacuggc

SEQ ID NO: 3560007 - RNA, 18 nt, Human
acuggggaaacuggccau

SEQ ID NO: 3560008 - RNA, 17 nt, Human
acuggggacuuggccuc

SEQ ID NO: 3560009 - RNA, 18 nt, Human
acuggggacuuggccucu

SEQ ID NO: 3560010 - RNA, 16 nt, Human
acuggggaugugggag

SEQ ID NO: 3560011 - RNA, 12 nt, Human
acuggggccucc

SEQ ID NO: 3560012 - RNA, 13 nt, Human
acuggggcucaga

SEQ ID NO: 3560013 - RNA, 16 nt, Human
acuggggcucagagcc

SEQ ID NO: 3560014 - RNA, 16 nt, Human
acuggggcuggcacaa

SEQ ID NO: 3560015 - RNA, 19 nt, Human
acuggggcuggggaaggaa

SEQ ID NO: 3560016 - RNA, 13 nt, Human
acugggggagggg

SEQ ID NO: 3560017 - RNA, 19 nt, Human
acuggggguugcgggggga

SEQ ID NO: 3560018 - RNA, 15 nt, Human
acuggggugccgccu

SEQ ID NO: 3560019 - RNA, 20 nt, Human
acuggguaaugaaacaaaga

SEQ ID NO: 3560020 - RNA, 15 nt, Human
acuggguacuugugg

SEQ ID NO: 3560021 - RNA, 18 nt, Human
acuggguacuuguggaca

SEQ ID NO: 3560022 - RNA, 22 nt, Human
acugggugguggccuggucccu

SEQ ID NO: 3560023 - RNA, 17 nt, Human
acuggguguaaacacau

SEQ ID NO: 3560024 - RNA, 22 nt, Human
acugggugucauuucauuccau

SEQ ID NO: 3560025 - RNA, 16 nt, Human
acuggguuuggacccc

SEQ ID NO: 3560026 - RNA, 20 nt, Human
acuggguuuggaccccagcu

SEQ ID NO: 3560027 - RNA, 17 nt, Human
acugguaagauuguuau

SEQ ID NO: 3560028 - RNA, 20 nt, Human
acugguacuuagaguuucug

SEQ ID NO: 3560029 - RNA, 22 nt, Human
acuggucacggauuugugucug

SEQ ID NO: 3560030 - RNA, 22 nt, Human
acugguccaaaagauugcugaa

SEQ ID NO: 3560031 - RNA, 18 nt, Human
acuggugacugauucuuc

SEQ ID NO: 3560032 - RNA, 16 nt, Human
acuggugagcagacug

SEQ ID NO: 3560033 - RNA, 23 nt, Human
acuggugcaaguugaggacuucu

SEQ ID NO: 3560034 - RNA, 13 nt, Human
acuggugcacuuu

SEQ ID NO: 3560035 - RNA, 22 nt, Human
acuggugcacuuuguaaauucc

SEQ ID NO: 3560036 - RNA, 21 nt, Human
acugguggcccgacagccugg

SEQ ID NO: 3560037 - RNA, 22 nt, Human
acugguggcccgacagccuggc

SEQ ID NO: 3560038 - RNA, 20 nt, Human
acuggugggaucugugccca

SEQ ID NO: 3560039 - RNA, 13 nt, Human
agcaucacagaau

SEQ ID NO: 3560040 - RNA, 13 nt, Human
agcaucaccugcc

SEQ ID NO: 3560041 - RNA, 12 nt, Human
agcaucacuccc

SEQ ID NO: 3560042 - RNA, 16 nt, Human
agcaucaggccuagag

SEQ ID NO: 3560043 - RNA, 21 nt, Human
agcaucaggccuagaggccug

SEQ ID NO: 3560044 - RNA, 20 nt, Human
agcaucaguacuuguuucua

SEQ ID NO: 3560045 - RNA, 19 nt, Human
agcaucaugccucugaggc

SEQ ID NO: 3560046 - RNA, 22 nt, Human
agcaucaugccucugaggccag

SEQ ID NO: 3560047 - RNA, 22 nt, Human
agcaucauuauuuauguauugu

SEQ ID NO: 3560048 - RNA, 16 nt, Human
agcaucauuuugcauu

SEQ ID NO: 3560049 - RNA, 16 nt, Human
agcauccaccuccuuc

SEQ ID NO: 3560050 - RNA, 20 nt, Human
agcaucccugaggagccagg

SEQ ID NO: 3560051 - RNA, 17 nt, Human
agcauccuaagaaauau

SEQ ID NO: 3560052 - RNA, 22 nt, Human
agcauccuaagaaauaugugag

SEQ ID NO: 3560053 - RNA, 22 nt, Human
agcauccugccuuagagccagg

SEQ ID NO: 3560054 - RNA, 15 nt, Human
agcauccuggaauau

SEQ ID NO: 3560055 - RNA, 19 nt, Human
agcauccuuuucugcagag

SEQ ID NO: 3560056 - RNA, 19 nt, Human
agcaucgcacucuggcagc

SEQ ID NO: 3560057 - RNA, 19 nt, Human
agcaucgcuuaggagaagu

SEQ ID NO: 3560058 - RNA, 21 nt, Human
agcaucggccuagggccccca

SEQ ID NO: 3560059 - RNA, 14 nt, Human
agcaucuaaacuuu

SEQ ID NO: 3560060 - RNA, 16 nt, Human
agcaucuaaacuuuaa

SEQ ID NO: 3560061 - RNA, 23 nt, Human
agcaucuaaguuauaagacucuc

SEQ ID NO: 3560062 - RNA, 14 nt, Human
agcaucucaugagu

SEQ ID NO: 3560063 - RNA, 17 nt, Human
agcaucuccaagcagcu

SEQ ID NO: 3560064 - RNA, 20 nt, Human
agcaucucccucacugaaac

SEQ ID NO: 3560065 - RNA, 12 nt, Human
agcaucuguaca

SEQ ID NO: 3560066 - RNA, 12 nt, Human
agcaucuucugg

SEQ ID NO: 3560067 - RNA, 14 nt, Human
agcaugaaaaagca

SEQ ID NO: 3560068 - RNA, 17 nt, Human
agcaugaaauaaaauau

SEQ ID NO: 3560069 - RNA, 16 nt, Human
agcaugaaaugugaau

SEQ ID NO: 3560070 - RNA, 22 nt, Human
agcaugaaaugugaauuuuuau

SEQ ID NO: 3560071 - RNA, 20 nt, Human
agcaugaagucuuaaggaca

SEQ ID NO: 3560072 - RNA, 16 nt, Human
agcaugaauuuguaau

SEQ ID NO: 3560073 - RNA, 18 nt, Human
agcaugacaagccccagg

SEQ ID NO: 3560074 - RNA, 22 nt, Human
agcaugacaagccccaggcagg

SEQ ID NO: 3560075 - RNA, 15 nt, Human
agcaugacagccugc

SEQ ID NO: 3560076 - RNA, 16 nt, Human
agcaugacauaacagu

SEQ ID NO: 3560077 - RNA, 17 nt, Human
agcaugaucugaaaaau

SEQ ID NO: 3560078 - RNA, 13 nt, Human
agcaugcacaaag

SEQ ID NO: 3560079 - RNA, 14 nt, Human
agcaugcacaaauu

SEQ ID NO: 3560080 - RNA, 15 nt, Human
agcaugcaccacggg

SEQ ID NO: 3560081 - RNA, 19 nt, Human
agcaugccaacaagaaugc

SEQ ID NO: 3560082 - RNA, 20 nt, Human
agcaugccuggauggggcug

SEQ ID NO: 3560083 - RNA, 23 nt, Human
agcaugccuggauggggcugcac

SEQ ID NO: 3560084 - RNA, 17 nt, Human
agcaugcuugugaaaau

SEQ ID NO: 3560085 - RNA, 23 nt, Human
agcaugcuugugaaaauguguuc

SEQ ID NO: 3560086 - RNA, 17 nt, Human
agcauggaacacuucga

SEQ ID NO: 3560087 - RNA, 17 nt, Human
agcauggacauuuagaa

SEQ ID NO: 3560088 - RNA, 18 nt, Human
agcauggacauuuagaag

SEQ ID NO: 3560089 - RNA, 17 nt, Human
agcauggcugugaggau

SEQ ID NO: 3560090 - RNA, 17 nt, Human
agcauggugcaugccgc

SEQ ID NO: 3560091 - RNA, 14 nt, Human
agcauguacagugu

SEQ ID NO: 3560092 - RNA, 21 nt, Human
agcauguacggauuuucaguu

SEQ ID NO: 3560093 - RNA, 14 nt, Human
agcauguauugugu

SEQ ID NO: 3560094 - RNA, 16 nt, Human
agcaugucacuaaagc

SEQ ID NO: 3560095 - RNA, 19 nt, Human
agcaugucuauucagcuuc

SEQ ID NO: 3560096 - RNA, 17 nt, Human
agcaugucuuauuuaaa

SEQ ID NO: 3560097 - RNA, 16 nt, Human
agcaugugcccuccug

SEQ ID NO: 3560098 - RNA, 16 nt, Human
agcaugugucaugcau

SEQ ID NO: 3560099 - RNA, 16 nt, Human
agcauguugagccagg

SEQ ID NO: 3560100 - RNA, 15 nt, Human
agcauguuguagaua

SEQ ID NO: 3560101 - RNA, 24 nt, Human
agcauguuuagacuuuaacauaag

SEQ ID NO: 3560102 - RNA, 16 nt, Human
agcauguuugcugaac

SEQ ID NO: 3560103 - RNA, 16 nt, Human
agcauguuuuguauac

SEQ ID NO: 3560104 - RNA, 19 nt, Human
agcauguuuuguauacaaa

SEQ ID NO: 3560105 - RNA, 14 nt, Human
agcauuaacuaauc

SEQ ID NO: 3560106 - RNA, 18 nt, Human
agcauuaacuaaucuauu

SEQ ID NO: 3560107 - RNA, 18 nt, Human
agcauuaacuucucugga

SEQ ID NO: 3560108 - RNA, 17 nt, Human
agcauuaagaacacuuu

SEQ ID NO: 3560109 - RNA, 19 nt, Human
agcauuaccucuuuggaaa

SEQ ID NO: 3560110 - RNA, 18 nt, Human
agcauuacgugagccagg

SEQ ID NO: 3560111 - RNA, 20 nt, Human
agcauuacgugagccaggua

SEQ ID NO: 3560112 - RNA, 16 nt, Human
agcauuacucuuguaa

SEQ ID NO: 3560113 - RNA, 19 nt, Human
agcauuacucuuguaagau

SEQ ID NO: 3560114 - RNA, 16 nt, Human
agcauuaugcaauuag

SEQ ID NO: 3560115 - RNA, 14 nt, Human
agcauucagaagaa

SEQ ID NO: 3560116 - RNA, 13 nt, Human
agcauuccaacaa

SEQ ID NO: 3560117 - RNA, 14 nt, Human
agcauuccaacaaa

SEQ ID NO: 3560118 - RNA, 15 nt, Human
agcauuccaacaaag

SEQ ID NO: 3560119 - RNA, 16 nt, Human
agcauuccuucuuuga

SEQ ID NO: 3560120 - RNA, 19 nt, Human
agcauuccuucuuugauaa

SEQ ID NO: 3560121 - RNA, 22 nt, Human
agcauuccuucuuugauaaugu

SEQ ID NO: 3560122 - RNA, 19 nt, Human
agcauucucaggcaccagu

SEQ ID NO: 3560123 - RNA, 14 nt, Human
agcauucucauugg

SEQ ID NO: 3560124 - RNA, 22 nt, Human
agcauucucauuggaaauuuag

SEQ ID NO: 3560125 - RNA, 12 nt, Human
agcauucucucc

SEQ ID NO: 3560126 - RNA, 22 nt, Human
agcauucuugucacaauaaaug

SEQ ID NO: 3560127 - RNA, 16 nt, Human
agcauugaaauuauag

SEQ ID NO: 3560128 - RNA, 14 nt, Human
acuguaugaucaaa

SEQ ID NO: 3560129 - RNA, 24 nt, Human
acuguaugaucaaauguuuaauca

SEQ ID NO: 3560130 - RNA, 11 nt, Human
acuguauggaa

SEQ ID NO: 3560131 - RNA, 21 nt, Human
acuguauuaagagugaaaauu

SEQ ID NO: 3560132 - RNA, 12 nt, Human
acuguauugaug

SEQ ID NO: 3560133 - RNA, 13 nt, Human
acuguauuuguau

SEQ ID NO: 3560134 - RNA, 14 nt, Human
acuguauuuguauc

SEQ ID NO: 3560135 - RNA, 15 nt, Human
acuguauuugugacu

SEQ ID NO: 3560136 - RNA, 16 nt, Human
acuguauuugugacua

SEQ ID NO: 3560137 - RNA, 23 nt, Human
acuguauuugugacuaauuguau

SEQ ID NO: 3560138 - RNA, 14 nt, Human
acugucaauaaaca

SEQ ID NO: 3560139 - RNA, 15 nt, Human
acugucaauaaacag

SEQ ID NO: 3560140 - RNA, 17 nt, Human
acugucaauaaacagcu

SEQ ID NO: 3560141 - RNA, 21 nt, Human
acugucaauaaacagcuucau

SEQ ID NO: 3560142 - RNA, 14 nt, Human
acugucacucauug

SEQ ID NO: 3560143 - RNA, 15 nt, Human
acugucacuguuucu

SEQ ID NO: 3560144 - RNA, 20 nt, Human
acugucacuguuucucugcu

SEQ ID NO: 3560145 - RNA, 18 nt, Human
acugucacuuugcucugg

SEQ ID NO: 3560146 - RNA, 12 nt, Human
acugucaggaag

SEQ ID NO: 3560147 - RNA, 22 nt, Human
acugucaggaagaaaucacaga

SEQ ID NO: 3560148 - RNA, 20 nt, Human
acugucaggcugaaaacaau

SEQ ID NO: 3560149 - RNA, 21 nt, Human
acugucauccucaaagaaagu

SEQ ID NO: 3560150 - RNA, 22 nt, Human
acugucauccucaaagaaagug

SEQ ID NO: 3560151 - RNA, 14 nt, Human
acuguccagagagc

SEQ ID NO: 3560152 - RNA, 15 nt, Human
acuguccagagagca

SEQ ID NO: 3560153 - RNA, 14 nt, Human
acugucccucaaau

SEQ ID NO: 3560154 - RNA, 12 nt, Human
acugucccuccu

SEQ ID NO: 3560155 - RNA, 17 nt, Human
acugucccuccuggugu

SEQ ID NO: 3560156 - RNA, 16 nt, Human
acugucccuugccuca

SEQ ID NO: 3560157 - RNA, 15 nt, Human
acuguccuauuauau

SEQ ID NO: 3560158 - RNA, 16 nt, Human
acuguccuauuauauu

SEQ ID NO: 3560159 - RNA, 18 nt, Human
acuguccuauuauauuca

SEQ ID NO: 3560160 - RNA, 16 nt, Human
acuguccuccaagcca

SEQ ID NO: 3560161 - RNA, 18 nt, Human
acuguccucuuucagaaa

SEQ ID NO: 3560162 - RNA, 12 nt, Human
acuguccugcuc

SEQ ID NO: 3560163 - RNA, 19 nt, Human
acuguccugcuccacagug

SEQ ID NO: 3560164 - RNA, 17 nt, Human
acuguccugggccugca

SEQ ID NO: 3560165 - RNA, 19 nt, Human
acuguccugggccugcaga

SEQ ID NO: 3560166 - RNA, 17 nt, Human
acuguccuguccugcuc

SEQ ID NO: 3560167 - RNA, 21 nt, Human
acugucuaagauuaauagcau

SEQ ID NO: 3560168 - RNA, 17 nt, Human
acugucuagcacuuccu

SEQ ID NO: 3560169 - RNA, 18 nt, Human
acugucuagcacuuccuu

SEQ ID NO: 3560170 - RNA, 21 nt, Human
acugucuagcacuuccuugcc

SEQ ID NO: 3560171 - RNA, 24 nt, Human
acugucuagcacuuccuugccagu

SEQ ID NO: 3560172 - RNA, 17 nt, Human
acugucuauuucugcug

SEQ ID NO: 3560173 - RNA, 19 nt, Human
acugucucaagagggcacu

SEQ ID NO: 3560174 - RNA, 23 nt, Human
acugucucaagagggcacuggug

SEQ ID NO: 3560175 - RNA, 21 nt, Human
acugucucgaugcaaugaaca

SEQ ID NO: 3560176 - RNA, 18 nt, Human
acugucucucaugaaccu

SEQ ID NO: 3560177 - RNA, 20 nt, Human
acugucucucuucucagagu

SEQ ID NO: 3560178 - RNA, 18 nt, Human
acugucugauuggcuugu

SEQ ID NO: 3560179 - RNA, 17 nt, Human
acugucugguuuuaaca

SEQ ID NO: 3560180 - RNA, 17 nt, Human
acugucuuaauuaagua

SEQ ID NO: 3560181 - RNA, 19 nt, Human
acugucuuaauuaaguaaa

SEQ ID NO: 3560182 - RNA, 20 nt, Human
acugucuuccucaaaauaaa

SEQ ID NO: 3560183 - RNA, 17 nt, Human
acugucuucucccugca

SEQ ID NO: 3560184 - RNA, 17 nt, Human
acugucuuuaaaagaga

SEQ ID NO: 3560185 - RNA, 12 nt, Human
acugucuuuccu

SEQ ID NO: 3560186 - RNA, 21 nt, Human
acugucuuuggaaaaauguuu

SEQ ID NO: 3560187 - RNA, 23 nt, Human
acugucuuuggaaaaauguuugu

SEQ ID NO: 3560188 - RNA, 16 nt, Human
acugucuuuuuucuaa

SEQ ID NO: 3560189 - RNA, 15 nt, Human
acugugaagagcugg

SEQ ID NO: 3560190 - RNA, 15 nt, Human
acugugaaggacccu

SEQ ID NO: 3560191 - RNA, 23 nt, Human
acugugacucuuuuuagggccag

SEQ ID NO: 3560192 - RNA, 11 nt, Human
acugugacuga

SEQ ID NO: 3560193 - RNA, 23 nt, Human
acugugaucaggcuauguaugga

SEQ ID NO: 3560194 - RNA, 13 nt, Human
acugugaugccac

SEQ ID NO: 3560195 - RNA, 20 nt, Human
acugugaugccacacagagu

SEQ ID NO: 3560196 - RNA, 18 nt, Human
acugugaugcccugcccu

SEQ ID NO: 3560197 - RNA, 20 nt, Human
acugugcacaucugugucuu

SEQ ID NO: 3560198 - RNA, 18 nt, Human
acugugcaccaagcagga

SEQ ID NO: 3560199 - RNA, 19 nt, Human
agccaaauuuaaaacuguu

SEQ ID NO: 3560200 - RNA, 19 nt, Human
agccaacacccaucuguuu

SEQ ID NO: 3560201 - RNA, 18 nt, Human
agccaacacgcaccugcc

SEQ ID NO: 3560202 - RNA, 14 nt, Human
agccaacagcuaca

SEQ ID NO: 3560203 - RNA, 20 nt, Human
agccaacagcuacaacagcc

SEQ ID NO: 3560204 - RNA, 17 nt, Human
agccaacagguggcagg

SEQ ID NO: 3560205 - RNA, 16 nt, Human
agccaacauguggcuc

SEQ ID NO: 3560206 - RNA, 20 nt, Human
agccaacauguggcuccucc

SEQ ID NO: 3560207 - RNA, 19 nt, Human
agccaaccuuacuuacagc

SEQ ID NO: 3560208 - RNA, 21 nt, Human
agccaacgacaaagccaaacu

SEQ ID NO: 3560209 - RNA, 17 nt, Human
agccaacuauggccugu

SEQ ID NO: 3560210 - RNA, 21 nt, Human
agccaacugcugcuuuuugag

SEQ ID NO: 3560211 - RNA, 19 nt, Human
agccaacuuggcuuucccg

SEQ ID NO: 3560212 - RNA, 18 nt, Human
agccaacuuguaaauaca

SEQ ID NO: 3560213 - RNA, 19 nt, Human
agccaacuuguaaauacac

SEQ ID NO: 3560214 - RNA, 19 nt, Human
agccaagaucgcgccacug

SEQ ID NO: 3560215 - RNA, 20 nt, Human
agccaagauuuuccucuugu

SEQ ID NO: 3560216 - RNA, 13 nt, Human
agccaagcacagu

SEQ ID NO: 3560217 - RNA, 21 nt, Human
agccaagcuuguuaucagcuu

SEQ ID NO: 3560218 - RNA, 19 nt, Human
agccaagcuuuaaauuaug

SEQ ID NO: 3560219 - RNA, 22 nt, Human
agccaagcuuuaaauuauguga

SEQ ID NO: 3560220 - RNA, 20 nt, Human
agccaaggccaaaggaagca

SEQ ID NO: 3560221 - RNA, 23 nt, Human
agccaaggcccugaguuggcagu

SEQ ID NO: 3560222 - RNA, 20 nt, Human
agccaaggccgaagcucugg

SEQ ID NO: 3560223 - RNA, 16 nt, Human
agccaaggcucuguuu

SEQ ID NO: 3560224 - RNA, 14 nt, Human
agccaagggaaagg

SEQ ID NO: 3560225 - RNA, 19 nt, Human
agccaagggaaccuguguc

SEQ ID NO: 3560226 - RNA, 11 nt, Human
agccaagggau

SEQ ID NO: 3560227 - RNA, 14 nt, Human
agccaagggaugga

SEQ ID NO: 3560228 - RNA, 23 nt, Human
agccaaggugggcugagcccugg

SEQ ID NO: 3560229 - RNA, 13 nt, Human
agccaaguccaga

SEQ ID NO: 3560230 - RNA, 18 nt, Human
agccaaguccagauuuac

SEQ ID NO: 3560231 - RNA, 23 nt, Human
agccaagugugguagagugugcc

SEQ ID NO: 3560232 - RNA, 22 nt, Human
agccaaguuuuauaauccuuaa

SEQ ID NO: 3560233 - RNA, 18 nt, Human
agccaauaacacacagcu

SEQ ID NO: 3560234 - RNA, 14 nt, Human
agccaauauuuuuc

SEQ ID NO: 3560235 - RNA, 20 nt, Human
agccaauuuaaagaaaacug

SEQ ID NO: 3560236 - RNA, 19 nt, Human
agccacaaaauaaauguug

SEQ ID NO: 3560237 - RNA, 17 nt, Human
agccacaaccacauaca

SEQ ID NO: 3560238 - RNA, 16 nt, Human
agccacaagucuucca

SEQ ID NO: 3560239 - RNA, 18 nt, Human
agccacaagucuuccaga

SEQ ID NO: 3560240 - RNA, 17 nt, Human
agccacacaaacguuua

SEQ ID NO: 3560241 - RNA, 10 nt, Human
agccacacac

SEQ ID NO: 3560242 - RNA, 12 nt, Human
agccacacacac

SEQ ID NO: 3560243 - RNA, 17 nt, Human
agccacacacacagaaa

SEQ ID NO: 3560244 - RNA, 21 nt, Human
agccacacacacagaaaauau

SEQ ID NO: 3560245 - RNA, 22 nt, Human
agccacacacacagaaaauaua

SEQ ID NO: 3560246 - RNA, 23 nt, Human
agccacacacacagaaaauauac

SEQ ID NO: 3560247 - RNA, 21 nt, Human
agccacacucugggcuccaga

SEQ ID NO: 3560248 - RNA, 20 nt, Human
agccacacuucucaggacac

SEQ ID NO: 3560249 - RNA, 12 nt, Human
agccacagaagc

SEQ ID NO: 3560250 - RNA, 19 nt, Human
agccacagaagccaggagc

SEQ ID NO: 3560251 - RNA, 20 nt, Human
agccacagaagccaggagca

SEQ ID NO: 3560252 - RNA, 12 nt, Human
agccacagccca

SEQ ID NO: 3560253 - RNA, 17 nt, Human
agccacagcccaggccu

SEQ ID NO: 3560254 - RNA, 21 nt, Human
agccacaggccugagauuuca

SEQ ID NO: 3560255 - RNA, 20 nt, Human
agccacaguuccccuaugug

SEQ ID NO: 3560256 - RNA, 23 nt, Human
agccacaucccuuugaaacaaga

SEQ ID NO: 3560257 - RNA, 18 nt, Human
agccacauuccugaugcu

SEQ ID NO: 3560258 - RNA, 21 nt, Human
agccacauuuggaauacuuuu

SEQ ID NO: 3560259 - RNA, 16 nt, Human
agccaccaucuuugca

SEQ ID NO: 3560260 - RNA, 17 nt, Human
agccaccaucuuugcag

SEQ ID NO: 3560261 - RNA, 23 nt, Human
agccaccaugcccagcucagagg

SEQ ID NO: 3560262 - RNA, 18 nt, Human
agccaccccagaaauggu

SEQ ID NO: 3560263 - RNA, 19 nt, Human
agccaccccaugcuggccu

SEQ ID NO: 3560264 - RNA, 14 nt, Human
agccaccccgggcu

SEQ ID NO: 3560265 - RNA, 19 nt, Human
agccaccccgggcucucug

SEQ ID NO: 3560266 - RNA, 20 nt, Human
agccaccccgggcucucugc

SEQ ID NO: 3560267 - RNA, 23 nt, Human
agccaccccgggcucucugcugu

SEQ ID NO: 3560268 - RNA, 12 nt, Human
agccacccugag

SEQ ID NO: 3560269 - RNA, 16 nt, Human
agccaccucugucauu

SEQ ID NO: 3560270 - RNA, 13 nt, Human
agccaccuguccc

SEQ ID NO: 3560271 - RNA, 14 nt, Human
agccaccuguccca

SEQ ID NO: 3560272 - RNA, 15 nt, Human
agccacggccaggcc

SEQ ID NO: 3560273 - RNA, 16 nt, Human
agccacggccaggcca

SEQ ID NO: 3560274 - RNA, 18 nt, Human
agccacgggugccagaag

SEQ ID NO: 3560275 - RNA, 18 nt, Human
agccacguuccuuacugc

SEQ ID NO: 3560276 - RNA, 22 nt, Human
agccacguuccuuacugcagaa

SEQ ID NO: 3560277 - RNA, 23 nt, Human
agccacguuccuuacugcagaau

SEQ ID NO: 3560278 - RNA, 13 nt, Human
agccacuaacuag

SEQ ID NO: 3560279 - RNA, 19 nt, Human
agccacuaagaaccccucu

SEQ ID NO: 3560280 - RNA, 17 nt, Human
agccacuccccagccag

SEQ ID NO: 3560281 - RNA, 23 nt, Human
agccacuccccagccagccuggc

SEQ ID NO: 3560282 - RNA, 17 nt, Human
agccacuccccggcaug

SEQ ID NO: 3560283 - RNA, 15 nt, Human
agccacuccucugac

SEQ ID NO: 3560284 - RNA, 21 nt, Human
agccacuccucugacucaggg

SEQ ID NO: 3560285 - RNA, 20 nt, Human
agccacucucuucccuuucc

SEQ ID NO: 3560286 - RNA, 17 nt, Human
agccacucugucccuuc

SEQ ID NO: 3560287 - RNA, 13 nt, Human
agccacucuguuc

SEQ ID NO: 3560288 - RNA, 15 nt, Human
agccacucuguuccu

SEQ ID NO: 3560289 - RNA, 13 nt, Human
agccacugaagua

SEQ ID NO: 3560290 - RNA, 13 nt, Human
agccacugcaccg

SEQ ID NO: 3560291 - RNA, 16 nt, Human
agccacugcaccgggc

SEQ ID NO: 3560292 - RNA, 14 nt, Human
agccacugccucuc

SEQ ID NO: 3560293 - RNA, 17 nt, Human
agccacugccucucccu

SEQ ID NO: 3560294 - RNA, 14 nt, Human
agccacugugcuga

SEQ ID NO: 3560295 - RNA, 22 nt, Human
agccacuuaccuucaauaaagu

SEQ ID NO: 3560296 - RNA, 22 nt, Human
agccacuugccugugcuacaau

SEQ ID NO: 3560297 - RNA, 22 nt, Human
agccagaacguggcucugcugg

SEQ ID NO: 3560298 - RNA, 18 nt, Human
agccagaacucugugucc

SEQ ID NO: 3560299 - RNA, 18 nt, Human
agccagaaucagcacaga

SEQ ID NO: 3560300 - RNA, 14 nt, Human
agccagacacucug

SEQ ID NO: 3560301 - RNA, 22 nt, Human
agccagacacucugcucugccc

SEQ ID NO: 3560302 - RNA, 12 nt, Human
agccagacagac

SEQ ID NO: 3560303 - RNA, 18 nt, Human
agccagaccuauuccucc

SEQ ID NO: 3560304 - RNA, 20 nt, Human
agccagaccuauuccuccug

SEQ ID NO: 3560305 - RNA, 16 nt, Human
agccagacucuggucu

SEQ ID NO: 3560306 - RNA, 14 nt, Human
agccagagaaguga

SEQ ID NO: 3560307 - RNA, 15 nt, Human
agccagagaagugac

SEQ ID NO: 3560308 - RNA, 19 nt, Human
agccagagaagugacaggg

SEQ ID NO: 3560309 - RNA, 11 nt, Human
agccagaggag

SEQ ID NO: 3560310 - RNA, 15 nt, Human
agccagaggcugggu

SEQ ID NO: 3560311 - RNA, 15 nt, Human
agccagaguuccugc

SEQ ID NO: 3560312 - RNA, 12 nt, Human
agccagauccuc

SEQ ID NO: 3560313 - RNA, 14 nt, Human
agccagauccucuu

SEQ ID NO: 3560314 - RNA, 18 nt, Human
agccagauuugucuuuuu

SEQ ID NO: 3560315 - RNA, 15 nt, Human
agccagauuuuccug

SEQ ID NO: 3560316 - RNA, 22 nt, Human
agccagauuuuuuaaaauuuau

SEQ ID NO: 3560317 - RNA, 22 nt, Human
agccagcaaugauguccagaag

SEQ ID NO: 3560318 - RNA, 20 nt, Human
agccagcaccggaccagccu

SEQ ID NO: 3560319 - RNA, 21 nt, Human
agccagcaccggaccagccug

SEQ ID NO: 3560320 - RNA, 22 nt, Human
agccagcaccggaccagccugg

SEQ ID NO: 3560321 - RNA, 23 nt, Human
agccagcaccggaccagccuggc

SEQ ID NO: 3560322 - RNA, 23 nt, Human
agccagcaccuggcaucgcacca

SEQ ID NO: 3560323 - RNA, 21 nt, Human
agccagcacuuguccagcuga

SEQ ID NO: 3560324 - RNA, 22 nt, Human
agccagcacuuguccagcugag

SEQ ID NO: 3560325 - RNA, 22 nt, Human
agccagcagacauugucagcaa

SEQ ID NO: 3560326 - RNA, 16 nt, Human
agccagcaggcucuca

SEQ ID NO: 3560327 - RNA, 21 nt, Human
agccagcaggcucucaggcca

SEQ ID NO: 3560328 - RNA, 17 nt, Human
agccagcaguucagagc

SEQ ID NO: 3560329 - RNA, 17 nt, Human
agccagcaucugggccu

SEQ ID NO: 3560330 - RNA, 20 nt, Human
agccagccaagcuuuaaauu

SEQ ID NO: 3560331 - RNA, 12 nt, Human
agccagccacuc

SEQ ID NO: 3560332 - RNA, 13 nt, Human
agccagccacucu

SEQ ID NO: 3560333 - RNA, 16 nt, Human
agccagccacucuacc

SEQ ID NO: 3560334 - RNA, 18 nt, Human
agccagcccagcccagcu

SEQ ID NO: 3560335 - RNA, 15 nt, Human
agccagcccucccug

SEQ ID NO: 3560336 - RNA, 23 nt, Human
agccagcccucccuguccuccuc

SEQ ID NO: 3560337 - RNA, 18 nt, Human
agccagcccugccuggag

SEQ ID NO: 3560338 - RNA, 19 nt, Human
agccagcccugccuggagg

SEQ ID NO: 3560339 - RNA, 24 nt, Human
agccagcccugccuggaggaccug

SEQ ID NO: 3560340 - RNA, 18 nt, Human
agccagccuucuuccauc

SEQ ID NO: 3560341 - RNA, 21 nt, Human
agccagccuucuuccauccca

SEQ ID NO: 3560342 - RNA, 23 nt, Human
agccagccuucuuccaucccagg

SEQ ID NO: 3560343 - RNA, 23 nt, Human
agccagcgccucccuccacccca

SEQ ID NO: 3560344 - RNA, 17 nt, Human
agccagcguccuccucu

SEQ ID NO: 3560345 - RNA, 23 nt, Human
agccagcucacagugcugugugc

SEQ ID NO: 3560346 - RNA, 14 nt, Human
agccagcucccucu

SEQ ID NO: 3560347 - RNA, 13 nt, Human
agcauaaagcuca

SEQ ID NO: 3560348 - RNA, 13 nt, Human
agcauaaaugcaa

SEQ ID NO: 3560349 - RNA, 13 nt, Human
agcauaacauaug

SEQ ID NO: 3560350 - RNA, 17 nt, Human
agcauaaguauacaguu

SEQ ID NO: 3560351 - RNA, 14 nt, Human
agcauacauuuaua

SEQ ID NO: 3560352 - RNA, 17 nt, Human
agcauacguacacauuu

SEQ ID NO: 3560353 - RNA, 15 nt, Human
agcauacuucuagga

SEQ ID NO: 3560354 - RNA, 15 nt, Human
agcauagauaauauu

SEQ ID NO: 3560355 - RNA, 19 nt, Human
agcauagauaauauuguuu

SEQ ID NO: 3560356 - RNA, 18 nt, Human
agcauagcuuauuauuga

SEQ ID NO: 3560357 - RNA, 20 nt, Human
agcauagcuuauuauugaag

SEQ ID NO: 3560358 - RNA, 23 nt, Human
agcauaggugauccauguaacug

SEQ ID NO: 3560359 - RNA, 23 nt, Human
agcauauaaaauggcaacaaacu

SEQ ID NO: 3560360 - RNA, 22 nt, Human
agcauauauuuuuauauuuacu

SEQ ID NO: 3560361 - RNA, 16 nt, Human
agcauaugacaaaugu

SEQ ID NO: 3560362 - RNA, 12 nt, Human
agcauaugagga

SEQ ID NO: 3560363 - RNA, 20 nt, Human
agcauaugaguuucauagcu

SEQ ID NO: 3560364 - RNA, 18 nt, Human
agcauauguguuggcuug

SEQ ID NO: 3560365 - RNA, 17 nt, Human
agcauauucaggaagcu

SEQ ID NO: 3560366 - RNA, 21 nt, Human
agcauauucaggaagcucagg

SEQ ID NO: 3560367 - RNA, 22 nt, Human
agcauauucaggaagcucaggg

SEQ ID NO: 3560368 - RNA, 21 nt, Human
agcauauucuuuucugcaaaa

SEQ ID NO: 3560369 - RNA, 20 nt, Human
agcauauuuguauaguugcu

SEQ ID NO: 3560370 - RNA, 21 nt, Human
agcauauuuguauaguugcuu

SEQ ID NO: 3560371 - RNA, 13 nt, Human
agcaucaaacucu

SEQ ID NO: 3560372 - RNA, 14 nt, Human
agcaucacagaaug

SEQ ID NO: 3560373 - RNA, 17 nt, Human
agcaucacaguuuuggu

SEQ ID NO: 3560374 - RNA, 18 nt, Human
agcaucaccuagaaacuu

SEQ ID NO: 3560375 - RNA, 13 nt, Human
agcaucaccucag

SEQ ID NO: 3560376 - RNA, 16 nt, Human
agcaucaccucaggcc

SEQ ID NO: 3560377 - RNA, 20 nt, Human
agcaucacuccccaaggaag

SEQ ID NO: 3560378 - RNA, 16 nt, Human
agcaucacuuaaaaca

SEQ ID NO: 3560379 - RNA, 12 nt, Human
agcaucaggcca

SEQ ID NO: 3560380 - RNA, 13 nt, Human
agcaucaggccag

SEQ ID NO: 3560381 - RNA, 14 nt, Human
agcaucaggccagg

SEQ ID NO: 3560382 - RNA, 19 nt, Human
agcaucaggccaggcccuc

SEQ ID NO: 3560383 - RNA, 22 nt, Human
agcaucaggccaggcccucugc

SEQ ID NO: 3560384 - RNA, 22 nt, Human
agcaucaggguuaagaagacuu

SEQ ID NO: 3560385 - RNA, 20 nt, Human
agcaucaucugggaacuugu

SEQ ID NO: 3560386 - RNA, 23 nt, Human
agcaucaugccucugaggccagc

SEQ ID NO: 3560387 - RNA, 18 nt, Human
agcaucauuauuuaugua

SEQ ID NO: 3560388 - RNA, 19 nt, Human
agcaucauuauuuauguau

SEQ ID NO: 3560389 - RNA, 21 nt, Human
agcaucauuauuuauguauug

SEQ ID NO: 3560390 - RNA, 18 nt, Human
agcaucauuuugcauuca

SEQ ID NO: 3560391 - RNA, 16 nt, Human
agcauccaaguggcau

SEQ ID NO: 3560392 - RNA, 15 nt, Human
agcauccaccuccuu

SEQ ID NO: 3560393 - RNA, 18 nt, Human
agcauccaccuccuucuc

SEQ ID NO: 3560394 - RNA, 20 nt, Human
agcaucccccaaaguucaca

SEQ ID NO: 3560395 - RNA, 20 nt, Human
agcauccccuugaacucuuc

SEQ ID NO: 3560396 - RNA, 20 nt, Human
agcaucccggaggaaaucug

SEQ ID NO: 3560397 - RNA, 23 nt, Human
agcaucccuugaccaggccuggg

SEQ ID NO: 3560398 - RNA, 19 nt, Human
agcauccuaagaaauaugu

SEQ ID NO: 3560399 - RNA, 21 nt, Human
agcauccuaagaaauauguga

SEQ ID NO: 3560400 - RNA, 16 nt, Human
agcauccugagccccg

SEQ ID NO: 3560401 - RNA, 17 nt, Human
agcauccugagccccgc

SEQ ID NO: 3560402 - RNA, 23 nt, Human
agcauccugagccccgcccucuu

SEQ ID NO: 3560403 - RNA, 21 nt, Human
agcauccugccuuagagccag

SEQ ID NO: 3560404 - RNA, 23 nt, Human
agcauccugccuuagagccaggc

SEQ ID NO: 3560405 - RNA, 14 nt, Human
agcauccuggaaua

SEQ ID NO: 3560406 - RNA, 14 nt, Human
agcauccuggcacc

SEQ ID NO: 3560407 - RNA, 22 nt, Human
agcauccuggcacccggccccu

SEQ ID NO: 3560408 - RNA, 14 nt, Human
agcaucggccuagg

SEQ ID NO: 3560409 - RNA, 15 nt, Human
agcaucggccuaggg

SEQ ID NO: 3560410 - RNA, 22 nt, Human
agcaucuaaacuuuaauaugua

SEQ ID NO: 3560411 - RNA, 22 nt, Human
agcaucuaaguuauaagacucu

SEQ ID NO: 3560412 - RNA, 16 nt, Human
agcaucuaugugagac

SEQ ID NO: 3560413 - RNA, 15 nt, Human
agcaucucagcucau

SEQ ID NO: 3560414 - RNA, 23 nt, Human
acuucccagcuaggaagagcagg

SEQ ID NO: 3560415 - RNA, 17 nt, Human
acuucccagugaauucu

SEQ ID NO: 3560416 - RNA, 21 nt, Human
acuuccccaauaucuugcuug

SEQ ID NO: 3560417 - RNA, 22 nt, Human
acuuccccaauaucuugcuuga

SEQ ID NO: 3560418 - RNA, 16 nt, Human
acuucccccaaauuua

SEQ ID NO: 3560419 - RNA, 21 nt, Human
acuuccccuccuaccccuccc

SEQ ID NO: 3560420 - RNA, 15 nt, Human
acuucccgggccagg

SEQ ID NO: 3560421 - RNA, 18 nt, Human
acuucccgggccagggcu

SEQ ID NO: 3560422 - RNA, 14 nt, Human
acuucccugcugcc

SEQ ID NO: 3560423 - RNA, 10 nt, Human
acuucccugg

SEQ ID NO: 3560424 - RNA, 22 nt, Human
acuucccuggguuagacugcca

SEQ ID NO: 3560425 - RNA, 17 nt, Human
acuuccuccuccccacu

SEQ ID NO: 3560426 - RNA, 18 nt, Human
acuuccuccuccccacuu

SEQ ID NO: 3560427 - RNA, 21 nt, Human
acuuccugauugguuucucuu

SEQ ID NO: 3560428 - RNA, 12 nt, Human
acuuccugccua

SEQ ID NO: 3560429 - RNA, 21 nt, Human
acuuccugccuggucuccugc

SEQ ID NO: 3560430 - RNA, 22 nt, Human
acuuccugccuggucuccugcc

SEQ ID NO: 3560431 - RNA, 16 nt, Human
acuuccugcuuccuca

SEQ ID NO: 3560432 - RNA, 17 nt, Human
acuuccugcuuccucag

SEQ ID NO: 3560433 - RNA, 12 nt, Human
acuuccuguacu

SEQ ID NO: 3560434 - RNA, 18 nt, Human
acuuccuguccagcucca

SEQ ID NO: 3560435 - RNA, 21 nt, Human
acuuccuguuugggccccucu

SEQ ID NO: 3560436 - RNA, 16 nt, Human
acuucgacacuguucu

SEQ ID NO: 3560437 - RNA, 14 nt, Human
acuucgacugugac

SEQ ID NO: 3560438 - RNA, 22 nt, Human
acuucgcaccggagugucugga

SEQ ID NO: 3560439 - RNA, 16 nt, Human
acuucgcaucaaaaga

SEQ ID NO: 3560440 - RNA, 20 nt, Human
acuucgcaucaaaagacaau

SEQ ID NO: 3560441 - RNA, 23 nt, Human
acuucgccaagguuguagcaugg

SEQ ID NO: 3560442 - RNA, 17 nt, Human
acuucgggaggucgagg

SEQ ID NO: 3560443 - RNA, 14 nt, Human
acuucgggcuggcc

SEQ ID NO: 3560444 - RNA, 16 nt, Human
acuucgggcuguguaa

SEQ ID NO: 3560445 - RNA, 17 nt, Human
acuucgggcuguguaaa

SEQ ID NO: 3560446 - RNA, 20 nt, Human
acuucgucuucuaauuucaa

SEQ ID NO: 3560447 - RNA, 18 nt, Human
acuucguuuaaugaaugc

SEQ ID NO: 3560448 - RNA, 20 nt, Human
acuucguuuugguuaaguug

SEQ ID NO: 3560449 - RNA, 22 nt, Human
acuucuaaaacuguacuuugau

SEQ ID NO: 3560450 - RNA, 21 nt, Human
acuucuaaguaaaaccacagc

SEQ ID NO: 3560451 - RNA, 23 nt, Human
acuucuaaguaaaaccacagcag

SEQ ID NO: 3560452 - RNA, 11 nt, Human
acuucuaauau

SEQ ID NO: 3560453 - RNA, 15 nt, Human
acuucuaauauauuu

SEQ ID NO: 3560454 - RNA, 16 nt, Human
acuucuaccugcccuc

SEQ ID NO: 3560455 - RNA, 17 nt, Human
acuucuaccugcccuca

SEQ ID NO: 3560456 - RNA, 23 nt, Human
acuucuacuucugcccuugccaa

SEQ ID NO: 3560457 - RNA, 22 nt, Human
acuucucaaaccuguuuaaaua

SEQ ID NO: 3560458 - RNA, 17 nt, Human
acuucucacuaauuugu

SEQ ID NO: 3560459 - RNA, 20 nt, Human
acuucucaggacacaggccu

SEQ ID NO: 3560460 - RNA, 15 nt, Human
acuucucaucacaca

SEQ ID NO: 3560461 - RNA, 17 nt, Human
acuucucaucacacaca

SEQ ID NO: 3560462 - RNA, 19 nt, Human
acuucucaucacacacaug

SEQ ID NO: 3560463 - RNA, 16 nt, Human
acuucuccacccugcu

SEQ ID NO: 3560464 - RNA, 13 nt, Human
acuucuccagccu

SEQ ID NO: 3560465 - RNA, 10 nt, Human
acuucuccca

SEQ ID NO: 3560466 - RNA, 23 nt, Human
acuucucuauaaaaaauauguau

SEQ ID NO: 3560467 - RNA, 22 nt, Human
acuucucucuaaggagaauggc

SEQ ID NO: 3560468 - RNA, 17 nt, Human
acuucucugaagggagg

SEQ ID NO: 3560469 - RNA, 20 nt, Human
acuucucuggaaagggggga

SEQ ID NO: 3560470 - RNA, 21 nt, Human
acuucucuuaaacuugugaau

SEQ ID NO: 3560471 - RNA, 14 nt, Human
acuucucuugcuuu

SEQ ID NO: 3560472 - RNA, 21 nt, Human
acuucucuuugccucaaauaa

SEQ ID NO: 3560473 - RNA, 12 nt, Human
acuucugagauc

SEQ ID NO: 3560474 - RNA, 20 nt, Human
acuucugagaucuguugauu

SEQ ID NO: 3560475 - RNA, 20 nt, Human
acuucugccauauucuguug

SEQ ID NO: 3560476 - RNA, 13 nt, Human
acuucugccucuu

SEQ ID NO: 3560477 - RNA, 16 nt, Human
acuucugccuggagac

SEQ ID NO: 3560478 - RNA, 12 nt, Human
acuucugccugu

SEQ ID NO: 3560479 - RNA, 16 nt, Human
acuucugcuuuccaca

SEQ ID NO: 3560480 - RNA, 22 nt, Human
acuucuggcucccucuucuuuc

SEQ ID NO: 3560481 - RNA, 17 nt, Human
acuucugggcuucaucu

SEQ ID NO: 3560482 - RNA, 19 nt, Human
acuucugggcuucaucugg

SEQ ID NO: 3560483 - RNA, 22 nt, Human
acuucugggcuucaucuggcaa

SEQ ID NO: 3560484 - RNA, 16 nt, Human
acuucuggguggggca

SEQ ID NO: 3560485 - RNA, 17 nt, Human
acuucuggguggggcag

SEQ ID NO: 3560486 - RNA, 21 nt, Human
acuucugucuucacaacagau

SEQ ID NO: 3560487 - RNA, 14 nt, Human
acuucuguuuucaa

SEQ ID NO: 3560488 - RNA, 15 nt, Human
acuucuguuuucaau

SEQ ID NO: 3560489 - RNA, 17 nt, Human
acuucuguuuucaaucu

SEQ ID NO: 3560490 - RNA, 22 nt, Human
acuucuguuuucaaucucguau

SEQ ID NO: 3560491 - RNA, 16 nt, Human
acuucuuaaaaguugu

SEQ ID NO: 3560492 - RNA, 12 nt, Human
acuucuuaaaua

SEQ ID NO: 3560493 - RNA, 14 nt, Human
acuucuuaaauauc

SEQ ID NO: 3560494 - RNA, 17 nt, Human
acuucuuaaauaucuuu

SEQ ID NO: 3560495 - RNA, 18 nt, Human
acuucuuaaauaucuuuu

SEQ ID NO: 3560496 - RNA, 22 nt, Human
acuucuuaaauaucuuuuaugu

SEQ ID NO: 3560497 - RNA, 13 nt, Human
acuucuucagagc

SEQ ID NO: 3560498 - RNA, 16 nt, Human
acuucuucagagcuga

SEQ ID NO: 3560499 - RNA, 20 nt, Human
acuucuucagagcugacaca

SEQ ID NO: 3560500 - RNA, 13 nt, Human
acuucuucucuua

SEQ ID NO: 3560501 - RNA, 21 nt, Human
acuucuucuguaauauuuaca

SEQ ID NO: 3560502 - RNA, 16 nt, Human
acuucuugaaggugcu

SEQ ID NO: 3560503 - RNA, 16 nt, Human
acuucuugcccugggg

SEQ ID NO: 3560504 - RNA, 18 nt, Human
acuucuugcccuggggau

SEQ ID NO: 3560505 - RNA, 19 nt, Human
acuucuugcuucuuucuag

SEQ ID NO: 3560506 - RNA, 19 nt, Human
acuucuugucagacauaaa
